United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 180

SEQ ID NO: 7508697 - DNA, 22 bp, Homo sapiens
tagatatgtatacttgtttgag

SEQ ID NO: 7508698 - DNA, 22 bp, Homo sapiens
tagatcaggctgcttagataga

SEQ ID NO: 7508699 - DNA, 22 bp, Homo sapiens
tagatcaggctgcttagataga

SEQ ID NO: 7508700 - DNA, 22 bp, Homo sapiens
tagatcagagttcaggaagttt

SEQ ID NO: 7508701 - DNA, 22 bp, Homo sapiens
tagatcagagttcaggaagttt

SEQ ID NO: 7508702 - DNA, 22 bp, Homo sapiens
tagatcagtgcataaaggaatg

SEQ ID NO: 7508703 - DNA, 22 bp, Homo sapiens
tagatcatatttgtggagaaaa

SEQ ID NO: 7508704 - DNA, 22 bp, Homo sapiens
tagatcatggagtaaaatggaa

SEQ ID NO: 7508705 - DNA, 22 bp, Homo sapiens
tagatcatgggtactgcatatg

SEQ ID NO: 7508706 - DNA, 22 bp, Homo sapiens
tagatcatgggtactgcatatg

SEQ ID NO: 7508707 - DNA, 21 bp, Homo sapiens
tagatcatggtattctttggc

SEQ ID NO: 7508708 - DNA, 22 bp, Homo sapiens
tagatcatttgaattgaggtag

SEQ ID NO: 7508709 - DNA, 22 bp, Homo sapiens
tagatccagctgttatgttatg

SEQ ID NO: 7508710 - DNA, 22 bp, Homo sapiens
tagatcctgagccctatctact

SEQ ID NO: 7508711 - DNA, 23 bp, Homo sapiens
tagactgcaggctccttgagggc

SEQ ID NO: 7508712 - DNA, 22 bp, Homo sapiens
tagactcttggggaaatctgca

SEQ ID NO: 7508713 - DNA, 22 bp, Homo sapiens
tagactctgcatttacctccca

SEQ ID NO: 7508714 - DNA, 22 bp, Homo sapiens
tagactctgcatttacctccca

SEQ ID NO: 7508715 - DNA, 19 bp, Homo sapiens
tagactctaatgttaagct

SEQ ID NO: 7508716 - DNA, 22 bp, Homo sapiens
tagactatagctcacagtgctt

SEQ ID NO: 7508717 - DNA, 22 bp, Homo sapiens
tagactagaggatcagcaaggg

SEQ ID NO: 7508718 - DNA, 22 bp, Homo sapiens
tagactagaggatcagcaaggg

SEQ ID NO: 7508719 - DNA, 22 bp, Homo sapiens
tagactagaggatcagcaaggg

SEQ ID NO: 7508720 - DNA, 22 bp, Homo sapiens
tagactggtgaattagggggaa

SEQ ID NO: 7508721 - DNA, 22 bp, Homo sapiens
tagactggtgaattagggggaa

SEQ ID NO: 7508722 - DNA, 22 bp, Homo sapiens
tagactggtgaattagggggaa

SEQ ID NO: 7508723 - DNA, 22 bp, Homo sapiens
tagactggtgaattagggggaa

SEQ ID NO: 7508724 - DNA, 22 bp, Homo sapiens
tagactggtgaattagggggaa

SEQ ID NO: 7508725 - DNA, 22 bp, Homo sapiens
tagactggtgaattagggggaa

SEQ ID NO: 7508726 - DNA, 22 bp, Homo sapiens
tagactggtgaattagggggaa

SEQ ID NO: 7508727 - DNA, 22 bp, Homo sapiens
tagactggtgaattagggggaa

SEQ ID NO: 7508728 - DNA, 22 bp, Homo sapiens
tagactagaggatcagcaaggg

SEQ ID NO: 7508729 - DNA, 22 bp, Homo sapiens
tagacgcaactataacacttca

SEQ ID NO: 7508730 - DNA, 22 bp, Homo sapiens
tagactaaaagtatcagagggc

SEQ ID NO: 7508731 - DNA, 22 bp, Homo sapiens
tagacgtggccgtgttcccaat

SEQ ID NO: 7508732 - DNA, 22 bp, Homo sapiens
tagacctgcagacctgggcccc

SEQ ID NO: 7508733 - DNA, 22 bp, Homo sapiens
tagacgagaggtaaatgaaagg

SEQ ID NO: 7508734 - DNA, 23 bp, Homo sapiens
tagacctctgctctaaccattag

SEQ ID NO: 7508735 - DNA, 22 bp, Homo sapiens
tagaccattttacaatagtgtg

SEQ ID NO: 7508736 - DNA, 22 bp, Homo sapiens
tagacctgaaatatggacctgg

SEQ ID NO: 7508737 - DNA, 22 bp, Homo sapiens
tagacctgcagacctgggcccc

SEQ ID NO: 7508738 - DNA, 22 bp, Homo sapiens
tagaccaggcccacacacgggg

SEQ ID NO: 7508739 - DNA, 22 bp, Homo sapiens
tagaccaggttgaccaggtagg

SEQ ID NO: 7508740 - DNA, 22 bp, Homo sapiens
tagaccattttacaatagtgtg

SEQ ID NO: 7508741 - DNA, 22 bp, Homo sapiens
tagacaggaaacattaggatgg

SEQ ID NO: 7508742 - DNA, 22 bp, Homo sapiens
tagacagatttcttgttagaca

SEQ ID NO: 7508743 - DNA, 21 bp, Homo sapiens
tagaagcacataggttcaaag

SEQ ID NO: 7508744 - DNA, 22 bp, Homo sapiens
tagacagatttcttgttagaca

SEQ ID NO: 7508745 - DNA, 22 bp, Homo sapiens
tagaccagaacttgtcacctgg

SEQ ID NO: 7508746 - DNA, 22 bp, Homo sapiens
tagaccagaattgtcagcacct

SEQ ID NO: 7508747 - DNA, 21 bp, Homo sapiens
tagaccagctgtgctcctcgg

SEQ ID NO: 7508748 - DNA, 22 bp, Homo sapiens
tagacaggaaacattaggatgg

SEQ ID NO: 7508749 - DNA, 22 bp, Homo sapiens
tagacaggagtcaggctagaat

SEQ ID NO: 7508750 - DNA, 22 bp, Homo sapiens
tagaagataagacaagtgctgc

SEQ ID NO: 7508751 - DNA, 22 bp, Homo sapiens
tagaagataagacaagtgctgc

SEQ ID NO: 7508752 - DNA, 22 bp, Homo sapiens
tagaagataagacaagtgctgc

SEQ ID NO: 7508753 - DNA, 22 bp, Homo sapiens
tagaagatgggattcaagtccc

SEQ ID NO: 7508754 - DNA, 22 bp, Homo sapiens
tagaagatgggattcaagtccc

SEQ ID NO: 7508755 - DNA, 22 bp, Homo sapiens
tagaagatgccttaaagttgaa

SEQ ID NO: 7508756 - DNA, 22 bp, Homo sapiens
tagaagatcttaaaagctgact

SEQ ID NO: 7508757 - DNA, 22 bp, Homo sapiens
tagaagatgccttaaagttgaa

SEQ ID NO: 7508758 - DNA, 22 bp, Homo sapiens
tagaagattccagaggcaaagc

SEQ ID NO: 7508759 - DNA, 22 bp, Homo sapiens
tagaagattccagaggcaaagc

SEQ ID NO: 7508760 - DNA, 22 bp, Homo sapiens
tagaagattcatttcctctgaa

SEQ ID NO: 7508761 - DNA, 22 bp, Homo sapiens
tagaagattcatttcctctgaa

SEQ ID NO: 7508762 - DNA, 22 bp, Homo sapiens
tagaagattctaaagtggagag

SEQ ID NO: 7508763 - DNA, 22 bp, Homo sapiens
tagaagattccagaggcaaagc

SEQ ID NO: 7508764 - DNA, 22 bp, Homo sapiens
tagaagattctaaagtggagag

SEQ ID NO: 7508765 - DNA, 22 bp, Homo sapiens
tagaagattctgccaagagcgc

SEQ ID NO: 7508766 - DNA, 22 bp, Homo sapiens
tagaagcacagcctgatggaca

SEQ ID NO: 7508767 - DNA, 22 bp, Homo sapiens
tagaagcacagcctgatggaca

SEQ ID NO: 7508768 - DNA, 22 bp, Homo sapiens
tagaagattctgccaagagcgc

SEQ ID NO: 7508769 - DNA, 22 bp, Homo sapiens
tagaagcacaggttaaaggcat

SEQ ID NO: 7508770 - DNA, 22 bp, Homo sapiens
tagaagcacaggttaaaggcat

SEQ ID NO: 7508771 - DNA, 22 bp, Homo sapiens
tagaagcacagcctgatggaca

SEQ ID NO: 7508772 - DNA, 21 bp, Homo sapiens
tagaagcacataggttcaaag

SEQ ID NO: 7508773 - DNA, 22 bp, Homo sapiens
tagaagcacagcctgatggaca

SEQ ID NO: 7508774 - DNA, 21 bp, Homo sapiens
tagaagcacataggttcaaag

SEQ ID NO: 7508775 - DNA, 21 bp, Homo sapiens
tagaagcacataggttcaaag

SEQ ID NO: 7508776 - DNA, 22 bp, Homo sapiens
tagaagataagacaagtgctgc

SEQ ID NO: 7508777 - DNA, 22 bp, Homo sapiens
tagaagagacatagcctgtggt

SEQ ID NO: 7508778 - DNA, 22 bp, Homo sapiens
tagaagacaggaaatacaaacc

SEQ ID NO: 7508779 - DNA, 22 bp, Homo sapiens
tagaagaacatgtcaaactata

SEQ ID NO: 7508780 - DNA, 22 bp, Homo sapiens
tagaagaacatgtcaaactata

SEQ ID NO: 7508781 - DNA, 22 bp, Homo sapiens
tagaagaacatgtcaaactata

SEQ ID NO: 7508782 - DNA, 22 bp, Homo sapiens
tagaagaacatgtcaaactata

SEQ ID NO: 7508783 - DNA, 22 bp, Homo sapiens
tagaagaacatgtcaaactata

SEQ ID NO: 7508784 - DNA, 22 bp, Homo sapiens
tagaagaaagtgaagctgggga

SEQ ID NO: 7508785 - DNA, 22 bp, Homo sapiens
tagaagaacatgtcaaactata

SEQ ID NO: 7508786 - DNA, 22 bp, Homo sapiens
tagaagaacatgtcaaactata

SEQ ID NO: 7508787 - DNA, 22 bp, Homo sapiens
tagaagaaaagcacttagagat

SEQ ID NO: 7508788 - DNA, 22 bp, Homo sapiens
tagaagaaagtgaagctgggga

SEQ ID NO: 7508789 - DNA, 22 bp, Homo sapiens
tagaagaaagtgaagctgggga

SEQ ID NO: 7508790 - DNA, 22 bp, Homo sapiens
tagaagaaagtgaagctgggga

SEQ ID NO: 7508791 - DNA, 22 bp, Homo sapiens
tagaagaaaagcacttagagat

SEQ ID NO: 7508792 - DNA, 22 bp, Homo sapiens
tagaactttgccttagggcaaa

SEQ ID NO: 7508793 - DNA, 20 bp, Homo sapiens
tagaacttttcagtatggat

SEQ ID NO: 7508794 - DNA, 22 bp, Homo sapiens
tagaaatggggaagtagttagg

SEQ ID NO: 7508795 - DNA, 22 bp, Homo sapiens
tagaaatggggaagtagttagg

SEQ ID NO: 7508796 - DNA, 22 bp, Homo sapiens
tagaaatggggaagtagttagg

SEQ ID NO: 7508797 - DNA, 22 bp, Homo sapiens
tagaaatggggaagtagttagg

SEQ ID NO: 7508798 - DNA, 22 bp, Homo sapiens
tagaaatggggaagtagttagg

SEQ ID NO: 7508799 - DNA, 22 bp, Homo sapiens
tagaaatggggaagtagttagg

SEQ ID NO: 7508800 - DNA, 22 bp, Homo sapiens
tacttacattagcaaacaaggt

SEQ ID NO: 7508801 - DNA, 22 bp, Homo sapiens
tacttacattagcaaacaaggt

SEQ ID NO: 7508802 - DNA, 22 bp, Homo sapiens
tagaaatggagaacagattaat

SEQ ID NO: 7508803 - DNA, 22 bp, Homo sapiens
tacttacatgaattcaagagca

SEQ ID NO: 7508804 - DNA, 22 bp, Homo sapiens
tacttacattagcaaacaaggt

SEQ ID NO: 7508805 - DNA, 22 bp, Homo sapiens
tagaaatgggttacatttagag

SEQ ID NO: 7508806 - DNA, 22 bp, Homo sapiens
tagaaatgggttacatttagag

SEQ ID NO: 7508807 - DNA, 22 bp, Homo sapiens
tagaaatgggttacatttagag

SEQ ID NO: 7508808 - DNA, 22 bp, Homo sapiens
tagaaatgggttacatttagag

SEQ ID NO: 7508809 - DNA, 22 bp, Homo sapiens
tagaaatgggttacatttagag

SEQ ID NO: 7508810 - DNA, 22 bp, Homo sapiens
tagaaatgtaggcttcctgaca

SEQ ID NO: 7508811 - DNA, 22 bp, Homo sapiens
tagaaatgtaggcttcctgaca

SEQ ID NO: 7508812 - DNA, 22 bp, Homo sapiens
tagaaatgggttacatttagag

SEQ ID NO: 7508813 - DNA, 22 bp, Homo sapiens
tagaacatgtgaaaatatagcc

SEQ ID NO: 7508814 - DNA, 22 bp, Homo sapiens
tagaacatgtgaaaatatagcc

SEQ ID NO: 7508815 - DNA, 22 bp, Homo sapiens
tagaacatgggatagagttttt

SEQ ID NO: 7508816 - DNA, 22 bp, Homo sapiens
tagaacatttgtagcagctgag

SEQ ID NO: 7508817 - DNA, 22 bp, Homo sapiens
tagaacatgctcatgtataaat

SEQ ID NO: 7508818 - DNA, 22 bp, Homo sapiens
tagaacatgctcatgtataaat

SEQ ID NO: 7508819 - DNA, 22 bp, Homo sapiens
tagaacatgctcatgtataaat

SEQ ID NO: 7508820 - DNA, 22 bp, Homo sapiens
tagaacatcaggttgaatttgg

SEQ ID NO: 7508821 - DNA, 23 bp, Homo sapiens
tagaacatcggtgtcttggagca

SEQ ID NO: 7508822 - DNA, 23 bp, Homo sapiens
tagaacatcggtgtcttggagca

SEQ ID NO: 7508823 - DNA, 23 bp, Homo sapiens
tagaacatcggtgtcttggagca

SEQ ID NO: 7508824 - DNA, 22 bp, Homo sapiens
tagaacttaaatatgttttccc

SEQ ID NO: 7508825 - DNA, 22 bp, Homo sapiens
tagaacttagcactagacttgt

SEQ ID NO: 7508826 - DNA, 22 bp, Homo sapiens
tagaacttagcactagacttgt

SEQ ID NO: 7508827 - DNA, 22 bp, Homo sapiens
tagaactggcggctagaccact

SEQ ID NO: 7508828 - DNA, 22 bp, Homo sapiens
tagaactggaattttgtggttt

SEQ ID NO: 7508829 - DNA, 22 bp, Homo sapiens
tagaactgtccaagtctgagct

SEQ ID NO: 7508830 - DNA, 22 bp, Homo sapiens
tagaactggaattttgtggttt

SEQ ID NO: 7508831 - DNA, 22 bp, Homo sapiens
tagaacttatttggcattattt

SEQ ID NO: 7508832 - DNA, 22 bp, Homo sapiens
tagaacttccaattcagggctg

SEQ ID NO: 7508833 - DNA, 22 bp, Homo sapiens
tagaacttcttacagctaagtt

SEQ ID NO: 7508834 - DNA, 22 bp, Homo sapiens
tagaacttattagaaaggctca

SEQ ID NO: 7508835 - DNA, 22 bp, Homo sapiens
tagaacttgatagacagtacaa

SEQ ID NO: 7508836 - DNA, 22 bp, Homo sapiens
tagaacttgagatcaggtcttc

SEQ ID NO: 7508837 - DNA, 22 bp, Homo sapiens
tagaactgctctcatacttgct

SEQ ID NO: 7508838 - DNA, 22 bp, Homo sapiens
tagaactgctctcatacttgct

SEQ ID NO: 7508839 - DNA, 19 bp, Homo sapiens
tagaactgaggacttgcat

SEQ ID NO: 7508840 - DNA, 22 bp, Homo sapiens
tagaactgacgttagggaagaa

SEQ ID NO: 7508841 - DNA, 21 bp, Homo sapiens
tagaactgacgatttcagagt

SEQ ID NO: 7508842 - DNA, 22 bp, Homo sapiens
tagaactagaacaaggatttga

SEQ ID NO: 7508843 - DNA, 22 bp, Homo sapiens
tagaaccagtccacagaatttg

SEQ ID NO: 7508844 - DNA, 19 bp, Homo sapiens
tagaacctggatttcagga

SEQ ID NO: 7508845 - DNA, 22 bp, Homo sapiens
tagcaaagcgaaagagatttat

SEQ ID NO: 7508846 - DNA, 22 bp, Homo sapiens
tagcaaagcgaaagagatttat

SEQ ID NO: 7508847 - DNA, 22 bp, Homo sapiens
tagcaaagctccgtagttattt

SEQ ID NO: 7508848 - DNA, 22 bp, Homo sapiens
tagcaaagcgaaagagatttat

SEQ ID NO: 7508849 - DNA, 22 bp, Homo sapiens
tagcaaagctccgtagttattt

SEQ ID NO: 7508850 - DNA, 22 bp, Homo sapiens
tagcaaagctccgtagttattt

SEQ ID NO: 7508851 - DNA, 21 bp, Homo sapiens
tagcaaagccagatgtatatt

SEQ ID NO: 7508852 - DNA, 22 bp, Homo sapiens
tagcaaagcccacgtgccaagc

SEQ ID NO: 7508853 - DNA, 22 bp, Homo sapiens
tagcaaagcccttcaggccctg

SEQ ID NO: 7508854 - DNA, 22 bp, Homo sapiens
tagcaaagcccttgctgtgtaa

SEQ ID NO: 7508855 - DNA, 18 bp, Homo sapiens
tagcaaagatgtggattg

SEQ ID NO: 7508856 - DNA, 21 bp, Homo sapiens
tagcaaagccagatgtatatt

SEQ ID NO: 7508857 - DNA, 21 bp, Homo sapiens
tagcaaagccagatgtatatt

SEQ ID NO: 7508858 - DNA, 22 bp, Homo sapiens
tagcaaagaggagacctaggca

SEQ ID NO: 7508859 - DNA, 18 bp, Homo sapiens
tagcaaagatgtggattg

SEQ ID NO: 7508860 - DNA, 22 bp, Homo sapiens
tagcaaagagaaaaattatgct

SEQ ID NO: 7508861 - DNA, 22 bp, Homo sapiens
tagcaaagagaaaaattatgct

SEQ ID NO: 7508862 - DNA, 22 bp, Homo sapiens
tagcaaagaccaaagctagttg

SEQ ID NO: 7508863 - DNA, 22 bp, Homo sapiens
tagcaaaatgtggatgtagttg

SEQ ID NO: 7508864 - DNA, 22 bp, Homo sapiens
tagcaaactaatacaggctcaa

SEQ ID NO: 7508865 - DNA, 22 bp, Homo sapiens
tagcaaaatgtggatgtagttg

SEQ ID NO: 7508866 - DNA, 22 bp, Homo sapiens
tagcaaactcatacatgtgggt

SEQ ID NO: 7508867 - DNA, 22 bp, Homo sapiens
tagcaaactcatacatgtgggt

SEQ ID NO: 7508868 - DNA, 22 bp, Homo sapiens
tagcaaactaccacaaactggg

SEQ ID NO: 7508869 - DNA, 22 bp, Homo sapiens
tagcaaactaccacaaactggg

SEQ ID NO: 7508870 - DNA, 22 bp, Homo sapiens
tagcaaagaagatattattgca

SEQ ID NO: 7508871 - DNA, 22 bp, Homo sapiens
tagcaaagaacctgatacccca

SEQ ID NO: 7508872 - DNA, 22 bp, Homo sapiens
tagcaaagaagatattattgca

SEQ ID NO: 7508873 - DNA, 22 bp, Homo sapiens
tagcaaactcatacatgtgggt

SEQ ID NO: 7508874 - DNA, 22 bp, Homo sapiens
tagcaaagaacctgatacccca

SEQ ID NO: 7508875 - DNA, 22 bp, Homo sapiens
tagcaaaagctcaacaggaagg

SEQ ID NO: 7508876 - DNA, 22 bp, Homo sapiens
tagcaaaagctcaacaggaagg

SEQ ID NO: 7508877 - DNA, 22 bp, Homo sapiens
tagcaaaagctcaacaggaagg

SEQ ID NO: 7508878 - DNA, 22 bp, Homo sapiens
tagcaaaatgtggatgtagttg

SEQ ID NO: 7508879 - DNA, 22 bp, Homo sapiens
tagcaaaatgtggatgtagttg

SEQ ID NO: 7508880 - DNA, 22 bp, Homo sapiens
tagcaaaatgtggatgtagttg

SEQ ID NO: 7508881 - DNA, 22 bp, Homo sapiens
tagcaaaagctcaacaggaagg

SEQ ID NO: 7508882 - DNA, 22 bp, Homo sapiens
tagcaaaagctcaacaggaagg

SEQ ID NO: 7508883 - DNA, 22 bp, Homo sapiens
tagcaaaatgtggatgtagttg

SEQ ID NO: 7508884 - DNA, 22 bp, Homo sapiens
tagcaaaatgtggatgtagttg

SEQ ID NO: 7508885 - DNA, 22 bp, Homo sapiens
tagcaaaatgtggatgtagttg

SEQ ID NO: 7508886 - DNA, 22 bp, Homo sapiens
tagcaaaatgtggatgtagttg

SEQ ID NO: 7508887 - DNA, 22 bp, Homo sapiens
tagcaaaagctcaacaggaagg

SEQ ID NO: 7508888 - DNA, 22 bp, Homo sapiens
tagcaaaagctcaacaggaagg

SEQ ID NO: 7508889 - DNA, 22 bp, Homo sapiens
tagcaaaagctcaacaggaagg

SEQ ID NO: 7508890 - DNA, 22 bp, Homo sapiens
tagcaaaagctcaacaggaagg

SEQ ID NO: 7508891 - DNA, 22 bp, Homo sapiens
tagcaaaagctcaacaggaagg

SEQ ID NO: 7508892 - DNA, 22 bp, Homo sapiens
tagcaaaagccacgattacttt

SEQ ID NO: 7508893 - DNA, 22 bp, Homo sapiens
tagatgaccttgtgttaggcaa

SEQ ID NO: 7508894 - DNA, 22 bp, Homo sapiens
tagatgaccttgtgttaggcaa

SEQ ID NO: 7508895 - DNA, 22 bp, Homo sapiens
tagatgaccttgtgttaggcaa

SEQ ID NO: 7508896 - DNA, 22 bp, Homo sapiens
tagatgaccttgtgttaggcaa

SEQ ID NO: 7508897 - DNA, 22 bp, Homo sapiens
tagatgaatgacttatatgtca

SEQ ID NO: 7508898 - DNA, 22 bp, Homo sapiens
tagatgaattagcaattatctt

SEQ ID NO: 7508899 - DNA, 22 bp, Homo sapiens
tagatgaaatttgtgtgtatgc

SEQ ID NO: 7508900 - DNA, 22 bp, Homo sapiens
tagatgaacagaaagccactgt

SEQ ID NO: 7508901 - DNA, 22 bp, Homo sapiens
tagatgaacagaaagccactgt

SEQ ID NO: 7508902 - DNA, 22 bp, Homo sapiens
tagatgaactgcctctcagcaa

SEQ ID NO: 7508903 - DNA, 22 bp, Homo sapiens
tagatgaagcaacatgtgtaat

SEQ ID NO: 7508904 - DNA, 22 bp, Homo sapiens
tagatgaagcaacatgtgtaat

SEQ ID NO: 7508905 - DNA, 22 bp, Homo sapiens
tagatgaagagggtaggtagat

SEQ ID NO: 7508906 - DNA, 22 bp, Homo sapiens
tagatgaaggctgagcacctgt

SEQ ID NO: 7508907 - DNA, 22 bp, Homo sapiens
tagatgaaggctgagcacctgt

SEQ ID NO: 7508908 - DNA, 22 bp, Homo sapiens
tagatgaaggggttcagcatgg

SEQ ID NO: 7508909 - DNA, 22 bp, Homo sapiens
tagatgaaggggttcagcatgg

SEQ ID NO: 7508910 - DNA, 22 bp, Homo sapiens
tagatgaatgtgaaaggctctt

SEQ ID NO: 7508911 - DNA, 22 bp, Homo sapiens
tagatctgatacaattcatctg

SEQ ID NO: 7508912 - DNA, 22 bp, Homo sapiens
tagatctgatacaattcatctg

SEQ ID NO: 7508913 - DNA, 20 bp, Homo sapiens
tagatcctggggatttattg

SEQ ID NO: 7508914 - DNA, 22 bp, Homo sapiens
tagatctgatacaattcatctg

SEQ ID NO: 7508915 - DNA, 22 bp, Homo sapiens
tagatctgatacaattcatctg

SEQ ID NO: 7508916 - DNA, 22 bp, Homo sapiens
tagatctgatacaattcatctg

SEQ ID NO: 7508917 - DNA, 21 bp, Homo sapiens
tagatgaaatcagagtatttc

SEQ ID NO: 7508918 - DNA, 22 bp, Homo sapiens
tagatgaaatgtgtgttattat

SEQ ID NO: 7508919 - DNA, 22 bp, Homo sapiens
tagatgaaatttgtgtgtatgc

SEQ ID NO: 7508920 - DNA, 22 bp, Homo sapiens
tagatgaaaggtctagcacagt

SEQ ID NO: 7508921 - DNA, 22 bp, Homo sapiens
tagatgaaaggtctagcacagt

SEQ ID NO: 7508922 - DNA, 22 bp, Homo sapiens
tagatgaaagagggcctgtgag

SEQ ID NO: 7508923 - DNA, 23 bp, Homo sapiens
tagatcttcatctaattctgtag

SEQ ID NO: 7508924 - DNA, 22 bp, Homo sapiens
tagatcttgttacagatttcct

SEQ ID NO: 7508925 - DNA, 22 bp, Homo sapiens
tagatcttgttacagatttcct

SEQ ID NO: 7508926 - DNA, 22 bp, Homo sapiens
tagcaaatgggcttgttttcca

SEQ ID NO: 7508927 - DNA, 22 bp, Homo sapiens
tagcaaatgggcttgttttcca

SEQ ID NO: 7508928 - DNA, 22 bp, Homo sapiens
tagcaaatgggcttgttttcca

SEQ ID NO: 7508929 - DNA, 22 bp, Homo sapiens
tagcaaatgggcttgttttcca

SEQ ID NO: 7508930 - DNA, 22 bp, Homo sapiens
tagcaaatgtaaaatgcctaca

SEQ ID NO: 7508931 - DNA, 21 bp, Homo sapiens
tagcaaatggagagtaagaga

SEQ ID NO: 7508932 - DNA, 22 bp, Homo sapiens
tagcaaatgtaaaatgcctaca

SEQ ID NO: 7508933 - DNA, 22 bp, Homo sapiens
tagcaaatgtaaaatgcctaca

SEQ ID NO: 7508934 - DNA, 22 bp, Homo sapiens
tagcaaatgtgttatgctatgc

SEQ ID NO: 7508935 - DNA, 22 bp, Homo sapiens
tagcaaatgtctgaaggaatag

SEQ ID NO: 7508936 - DNA, 22 bp, Homo sapiens
tagcaaatgtctgaaggaatag

SEQ ID NO: 7508937 - DNA, 22 bp, Homo sapiens
tagcaaatgtctgaaggaatag

SEQ ID NO: 7508938 - DNA, 22 bp, Homo sapiens
tagcaaatgcctggttaattag

SEQ ID NO: 7508939 - DNA, 22 bp, Homo sapiens
tagcaaatgcctggttaattag

SEQ ID NO: 7508940 - DNA, 22 bp, Homo sapiens
tagcaaatgcctggttaattag

SEQ ID NO: 7508941 - DNA, 21 bp, Homo sapiens
tagcaaatggagagtaagaga

SEQ ID NO: 7508942 - DNA, 21 bp, Homo sapiens
tagcaaatggagagtaagaga

SEQ ID NO: 7508943 - DNA, 21 bp, Homo sapiens
tagcaaatggagagtaagaga

SEQ ID NO: 7508944 - DNA, 22 bp, Homo sapiens
tagcaaatacatgatgtaattt

SEQ ID NO: 7508945 - DNA, 22 bp, Homo sapiens
tagcaaatacatgatgtaattt

SEQ ID NO: 7508946 - DNA, 22 bp, Homo sapiens
tagcaaatacatgatgtaattt

SEQ ID NO: 7508947 - DNA, 22 bp, Homo sapiens
tagcaaatacatgatgtaattt

SEQ ID NO: 7508948 - DNA, 22 bp, Homo sapiens
tagcaaataaaacagtattgaa

SEQ ID NO: 7508949 - DNA, 22 bp, Homo sapiens
tagcaaataaaacagtattgaa

SEQ ID NO: 7508950 - DNA, 22 bp, Homo sapiens
tagcaaataaaacagtattgaa

SEQ ID NO: 7508951 - DNA, 22 bp, Homo sapiens
tagcaaataaaacagtattgaa

SEQ ID NO: 7508952 - DNA, 23 bp, Homo sapiens
tagcaaagttgtttgggaaattt

SEQ ID NO: 7508953 - DNA, 23 bp, Homo sapiens
tagcaaagttgtttgggaaattt

SEQ ID NO: 7508954 - DNA, 23 bp, Homo sapiens
tagcaaagttgtttgggaaattt

SEQ ID NO: 7508955 - DNA, 22 bp, Homo sapiens
tagcaaagttttgtggtgatta

SEQ ID NO: 7508956 - DNA, 22 bp, Homo sapiens
tagcaaaggatgactatgtacc

SEQ ID NO: 7508957 - DNA, 22 bp, Homo sapiens
tagcaaaggatgactatgtacc

SEQ ID NO: 7508958 - DNA, 22 bp, Homo sapiens
tagcaaaggccttggacacgct

SEQ ID NO: 7508959 - DNA, 22 bp, Homo sapiens
tagcaaaggccttggacacgct

SEQ ID NO: 7508960 - DNA, 22 bp, Homo sapiens
tagcaaaggccttggacacgct

SEQ ID NO: 7508961 - DNA, 22 bp, Homo sapiens
tagcaaagggaaagaagggcct

SEQ ID NO: 7508962 - DNA, 22 bp, Homo sapiens
tagcaagaagggagatggggtt

SEQ ID NO: 7508963 - DNA, 22 bp, Homo sapiens
tagcagctcctaaacagtggtg

SEQ ID NO: 7508964 - DNA, 22 bp, Homo sapiens
tagcaagaagggagatggggtt

SEQ ID NO: 7508965 - DNA, 22 bp, Homo sapiens
tagcagctctttactaaccagt

SEQ ID NO: 7508966 - DNA, 22 bp, Homo sapiens
tagcagctctgattctgggccc

SEQ ID NO: 7508967 - DNA, 22 bp, Homo sapiens
tagcagctctttactaaccagt

SEQ ID NO: 7508968 - DNA, 22 bp, Homo sapiens
tagcagctcctaaacagtggtg

SEQ ID NO: 7508969 - DNA, 22 bp, Homo sapiens
tagcagctctgattctgggccc

SEQ ID NO: 7508970 - DNA, 22 bp, Homo sapiens
tagcagctctgattctgggccc

SEQ ID NO: 7508971 - DNA, 22 bp, Homo sapiens
tagcaacatggttatcacatta

SEQ ID NO: 7508972 - DNA, 22 bp, Homo sapiens
tagcaacagaaaataggagtgc

SEQ ID NO: 7508973 - DNA, 22 bp, Homo sapiens
tagcaactgcctttactatatt

SEQ ID NO: 7508974 - DNA, 22 bp, Homo sapiens
tagcaactgcctttactatatt

SEQ ID NO: 7508975 - DNA, 22 bp, Homo sapiens
tagcaactgctctattctagga

SEQ ID NO: 7508976 - DNA, 22 bp, Homo sapiens
tagcaactgctctattctagga

SEQ ID NO: 7508977 - DNA, 22 bp, Homo sapiens
tagcaagaaaacacaagaatta

SEQ ID NO: 7508978 - DNA, 22 bp, Homo sapiens
tagcaagaaaacacaagaatta

SEQ ID NO: 7508979 - DNA, 22 bp, Homo sapiens
tagcaagaagctgtcacaggtg

SEQ ID NO: 7508980 - DNA, 22 bp, Homo sapiens
tagcaagaagctgtcacaggtg

SEQ ID NO: 7508981 - DNA, 22 bp, Homo sapiens
tagcaaatgtgttatgctatgc

SEQ ID NO: 7508982 - DNA, 22 bp, Homo sapiens
tagcaaatgtgttatgctatgc

SEQ ID NO: 7508983 - DNA, 22 bp, Homo sapiens
tagcaaatgtgttatgctatgc

SEQ ID NO: 7508984 - DNA, 22 bp, Homo sapiens
tagcaaatgtgttatgctatgc

SEQ ID NO: 7508985 - DNA, 22 bp, Homo sapiens
tagcaacaagtgactatctata

SEQ ID NO: 7508986 - DNA, 21 bp, Homo sapiens
tagcaaattgctattaaggca

SEQ ID NO: 7508987 - DNA, 21 bp, Homo sapiens
tagcaaattgctattaaggca

SEQ ID NO: 7508988 - DNA, 22 bp, Homo sapiens
tagcaacaatggaagtaacttc

SEQ ID NO: 7508989 - DNA, 22 bp, Homo sapiens
tagcaacaatggaagtaacttc

SEQ ID NO: 7508990 - DNA, 22 bp, Homo sapiens
tagcaacaccatctggtgagaa

SEQ ID NO: 7508991 - DNA, 22 bp, Homo sapiens
tagcaacagcaatagtggtatt

SEQ ID NO: 7508992 - DNA, 22 bp, Homo sapiens
tagcaacatggttatcacatta

SEQ ID NO: 7508993 - DNA, 22 bp, Homo sapiens
tagcaacatggttatcacatta

SEQ ID NO: 7508994 - DNA, 22 bp, Homo sapiens
tagcaacataagaaacattttg

SEQ ID NO: 7508995 - DNA, 22 bp, Homo sapiens
tagctgacgctaaataaatgtt

SEQ ID NO: 7508996 - DNA, 19 bp, Homo sapiens
tagctgatagctactttat

SEQ ID NO: 7508997 - DNA, 19 bp, Homo sapiens
tagctgatagctactttat

SEQ ID NO: 7508998 - DNA, 22 bp, Homo sapiens
tagctgatgtttctgggagaat

SEQ ID NO: 7508999 - DNA, 22 bp, Homo sapiens
tagctgatgaataattattctt

SEQ ID NO: 7509000 - DNA, 22 bp, Homo sapiens
tagctgccaaaagggtgggcta

SEQ ID NO: 7509001 - DNA, 20 bp, Homo sapiens
tagctgcacagccctaggag

SEQ ID NO: 7509002 - DNA, 20 bp, Homo sapiens
tagctgcacagccctaggag

SEQ ID NO: 7509003 - DNA, 22 bp, Homo sapiens
tagctgcacaggaagtaagatt

SEQ ID NO: 7509004 - DNA, 22 bp, Homo sapiens
tagctgcacaggaagtaagatt

SEQ ID NO: 7509005 - DNA, 22 bp, Homo sapiens
tagctgacgctaaataaatgtt

SEQ ID NO: 7509006 - DNA, 22 bp, Homo sapiens
tagcagggttttgaagagggtt

SEQ ID NO: 7509007 - DNA, 22 bp, Homo sapiens
tagcagggtctcaggagtcagg

SEQ ID NO: 7509008 - DNA, 22 bp, Homo sapiens
tagcagggtctcaggagtcagg

SEQ ID NO: 7509009 - DNA, 22 bp, Homo sapiens
tagcagggtaaatgtagatgga

SEQ ID NO: 7509010 - DNA, 22 bp, Homo sapiens
tagcaggggtagatagagtgtg

SEQ ID NO: 7509011 - DNA, 22 bp, Homo sapiens
tagcaggggtagatagagtgtg

SEQ ID NO: 7509012 - DNA, 22 bp, Homo sapiens
tagcagggtccaatgtgaggca

SEQ ID NO: 7509013 - DNA, 22 bp, Homo sapiens
tagcagggtccaatgtgaggca

SEQ ID NO: 7509014 - DNA, 22 bp, Homo sapiens
tagcagggtctcaggagtcagg

SEQ ID NO: 7509015 - DNA, 22 bp, Homo sapiens
tagcagggtccaatgtgaggca

SEQ ID NO: 7509016 - DNA, 22 bp, Homo sapiens
tagcagggtccaatgtgaggca

SEQ ID NO: 7509017 - DNA, 17 bp, Homo sapiens
tagctgccccgaatgct

SEQ ID NO: 7509018 - DNA, 22 bp, Homo sapiens
tagctgcccatctttcctttag

SEQ ID NO: 7509019 - DNA, 22 bp, Homo sapiens
tagctgccattgctccaggaag

SEQ ID NO: 7509020 - DNA, 22 bp, Homo sapiens
tagctgccagaccattcttact

SEQ ID NO: 7509021 - DNA, 22 bp, Homo sapiens
tagctgcctatgtgataagaga

SEQ ID NO: 7509022 - DNA, 22 bp, Homo sapiens
tagctgcctagacagctatagc

SEQ ID NO: 7509023 - DNA, 19 bp, Homo sapiens
tagctgcctgttacctcca

SEQ ID NO: 7509024 - DNA, 22 bp, Homo sapiens
tagctgcctttgggctcctgct

SEQ ID NO: 7509025 - DNA, 22 bp, Homo sapiens
tagctgcctttgggctcctgct

SEQ ID NO: 7509026 - DNA, 22 bp, Homo sapiens
tagctgcctttgggctcctgct

SEQ ID NO: 7509027 - DNA, 22 bp, Homo sapiens
tagctgcctttgggctcctgct

SEQ ID NO: 7509028 - DNA, 22 bp, Homo sapiens
tagctgcttagaaatcactgag

SEQ ID NO: 7509029 - DNA, 22 bp, Homo sapiens
tagctgcttagaaatcactgag

SEQ ID NO: 7509030 - DNA, 22 bp, Homo sapiens
tagctgctgcagcacagggagg

SEQ ID NO: 7509031 - DNA, 22 bp, Homo sapiens
tagctgcctttgggctcctgct

SEQ ID NO: 7509032 - DNA, 22 bp, Homo sapiens
tagctgcttcagtctaggtctc

SEQ ID NO: 7509033 - DNA, 22 bp, Homo sapiens
tagctgcttctcacatgggcaa

SEQ ID NO: 7509034 - DNA, 22 bp, Homo sapiens
tagctgcttctcacatgggcaa

SEQ ID NO: 7509035 - DNA, 22 bp, Homo sapiens
tagctgcttgaccaggcagtgg

SEQ ID NO: 7509036 - DNA, 22 bp, Homo sapiens
tagctggcaaaacattatttct

SEQ ID NO: 7509037 - DNA, 22 bp, Homo sapiens
tagctgggaattatctggttgc

SEQ ID NO: 7509038 - DNA, 22 bp, Homo sapiens
tagctgggaattatctggttgc

SEQ ID NO: 7509039 - DNA, 22 bp, Homo sapiens
tagctgggaattatctggttgc

SEQ ID NO: 7509040 - DNA, 17 bp, Homo sapiens
tagctggcactggggtt

SEQ ID NO: 7509041 - DNA, 22 bp, Homo sapiens
tagctggcatggccctgtggga

SEQ ID NO: 7509042 - DNA, 22 bp, Homo sapiens
tagctggcatggccctgtggga

SEQ ID NO: 7509043 - DNA, 22 bp, Homo sapiens
tagctggccctgggactcccgg

SEQ ID NO: 7509044 - DNA, 22 bp, Homo sapiens
tagctggcttatataaaagggc

SEQ ID NO: 7509045 - DNA, 21 bp, Homo sapiens
tagcaggatttggtttatttt

SEQ ID NO: 7509046 - DNA, 21 bp, Homo sapiens
tagcaggatttggtttatttt

SEQ ID NO: 7509047 - DNA, 22 bp, Homo sapiens
tagcaggcatccaataaatact

SEQ ID NO: 7509048 - DNA, 22 bp, Homo sapiens
tagcaggcatggagatgactgt

SEQ ID NO: 7509049 - DNA, 22 bp, Homo sapiens
tagcaggcatccaataaatact

SEQ ID NO: 7509050 - DNA, 22 bp, Homo sapiens
tagcaggcttgtgaatggagcc

SEQ ID NO: 7509051 - DNA, 23 bp, Homo sapiens
tagcaggctttcttttctctcac

SEQ ID NO: 7509052 - DNA, 22 bp, Homo sapiens
tagcaggcttgtgaatggagcc

SEQ ID NO: 7509053 - DNA, 22 bp, Homo sapiens
tagcaggctcgcaataaaatgt

SEQ ID NO: 7509054 - DNA, 22 bp, Homo sapiens
tagcaggcatggagatgactgt

SEQ ID NO: 7509055 - DNA, 22 bp, Homo sapiens
tagcaggcatggagatgactgt

SEQ ID NO: 7509056 - DNA, 21 bp, Homo sapiens
tagcaggagcgaattttgatg

SEQ ID NO: 7509057 - DNA, 21 bp, Homo sapiens
tagcaggagcgaattttgatg

SEQ ID NO: 7509058 - DNA, 21 bp, Homo sapiens
tagcaggagcgaattttgatg

SEQ ID NO: 7509059 - DNA, 22 bp, Homo sapiens
tagcaggagcagcctgcctaga

SEQ ID NO: 7509060 - DNA, 21 bp, Homo sapiens
tagcaggaggcccctgcttgc

SEQ ID NO: 7509061 - DNA, 22 bp, Homo sapiens
tagcaggaggcagttcctcgct

SEQ ID NO: 7509062 - DNA, 22 bp, Homo sapiens
tagcaggaggcagttcctcgct

SEQ ID NO: 7509063 - DNA, 22 bp, Homo sapiens
tagcaggagtgtgttctatttt

SEQ ID NO: 7509064 - DNA, 22 bp, Homo sapiens
tagcaggagtgtgttctatttt

SEQ ID NO: 7509065 - DNA, 21 bp, Homo sapiens
tagcaggaggcccctgcttgc

SEQ ID NO: 7509066 - DNA, 22 bp, Homo sapiens
tagcaggagtgatgttgtgtga

SEQ ID NO: 7509067 - DNA, 22 bp, Homo sapiens
tagcaggagtgtgttctatttt

SEQ ID NO: 7509068 - DNA, 22 bp, Homo sapiens
tagcaggatcacagggagagcc

SEQ ID NO: 7509069 - DNA, 22 bp, Homo sapiens
tagcaggatcacagggagagcc

SEQ ID NO: 7509070 - DNA, 22 bp, Homo sapiens
tagcaggatttgaagaagatct

SEQ ID NO: 7509071 - DNA, 22 bp, Homo sapiens
tagcaggatttgaagaagatct

SEQ ID NO: 7509072 - DNA, 22 bp, Homo sapiens
tagcagggagggccagtgtcaa

SEQ ID NO: 7509073 - DNA, 22 bp, Homo sapiens
tagcagggagggccagtgtcaa

SEQ ID NO: 7509074 - DNA, 22 bp, Homo sapiens
tagcagggaaggtgtgctgagc

SEQ ID NO: 7509075 - DNA, 22 bp, Homo sapiens
tagcagggaagatgatcagaat

SEQ ID NO: 7509076 - DNA, 22 bp, Homo sapiens
tagcagggaagatgatcagaat

SEQ ID NO: 7509077 - DNA, 22 bp, Homo sapiens
tagcagggatacaaggtcgcct

SEQ ID NO: 7509078 - DNA, 22 bp, Homo sapiens
tagcagggatacaaggtcgcct

SEQ ID NO: 7509079 - DNA, 22 bp, Homo sapiens
tagcagggatacaaggtcgcct

SEQ ID NO: 7509080 - DNA, 22 bp, Homo sapiens
tagcagggatacaaggtcgcct

SEQ ID NO: 7509081 - DNA, 22 bp, Homo sapiens
tagcagggagggccagtgtcaa

SEQ ID NO: 7509082 - DNA, 22 bp, Homo sapiens
tagcagggccaggctgggaacc

SEQ ID NO: 7509083 - DNA, 22 bp, Homo sapiens
tagcagggccaggctgggaacc

SEQ ID NO: 7509084 - DNA, 22 bp, Homo sapiens
tagcaggaataaaaatgtaccc

SEQ ID NO: 7509085 - DNA, 22 bp, Homo sapiens
tagcaggaaggttcagggccct

SEQ ID NO: 7509086 - DNA, 22 bp, Homo sapiens
tagcaggaataaaaatgtaccc

SEQ ID NO: 7509087 - DNA, 22 bp, Homo sapiens
tagcaggaataaaaatgtaccc

SEQ ID NO: 7509088 - DNA, 22 bp, Homo sapiens
tagcaggaagaaagctactcag

SEQ ID NO: 7509089 - DNA, 22 bp, Homo sapiens
tagcaggaaggttcagggccct

SEQ ID NO: 7509090 - DNA, 22 bp, Homo sapiens
tagcaggaagaaagctactcag

SEQ ID NO: 7509091 - DNA, 22 bp, Homo sapiens
tagcaggaagaaagctactcag

SEQ ID NO: 7509092 - DNA, 22 bp, Homo sapiens
tagcagcttccagagagggcag

SEQ ID NO: 7509093 - DNA, 22 bp, Homo sapiens
tagcagcttaagtaattagaat

SEQ ID NO: 7509094 - DNA, 22 bp, Homo sapiens
tagcagcttccagagagggcag

SEQ ID NO: 7509095 - DNA, 22 bp, Homo sapiens
tagcagcttccagagagggcag

SEQ ID NO: 7509096 - DNA, 22 bp, Homo sapiens
tagcagcttccagagagggcag

SEQ ID NO: 7509097 - DNA, 22 bp, Homo sapiens
tagcaggaaacctgtgttgagg

SEQ ID NO: 7509098 - DNA, 22 bp, Homo sapiens
tagcaggaaacctgtgttgagg

SEQ ID NO: 7509099 - DNA, 22 bp, Homo sapiens
tagcaggaatatgaggttaata

SEQ ID NO: 7509100 - DNA, 22 bp, Homo sapiens
tagcaggaatatgaggttaata

SEQ ID NO: 7509101 - DNA, 22 bp, Homo sapiens
tagcaggaatgaagttctgagg

SEQ ID NO: 7509102 - DNA, 22 bp, Homo sapiens
tagcaggaatgaagttctgagg

SEQ ID NO: 7509103 - DNA, 22 bp, Homo sapiens
tagcaggaattggctgcagctg

SEQ ID NO: 7509104 - DNA, 22 bp, Homo sapiens
tagcaggaattggctgcagctg

SEQ ID NO: 7509105 - DNA, 22 bp, Homo sapiens
tagcaggaattggctgcagctg

SEQ ID NO: 7509106 - DNA, 22 bp, Homo sapiens
tagcaggaattggctgcagctg

SEQ ID NO: 7509107 - DNA, 22 bp, Homo sapiens
tagcaggacatgtgcagagaag

SEQ ID NO: 7509108 - DNA, 22 bp, Homo sapiens
tagcaggaccatgacaagaaaa

SEQ ID NO: 7509109 - DNA, 22 bp, Homo sapiens
tagcaggaccatgacaagaaaa

SEQ ID NO: 7509110 - DNA, 22 bp, Homo sapiens
tagcaggacatgtgcagagaag

SEQ ID NO: 7509111 - DNA, 22 bp, Homo sapiens
tagcaggaccctgagcatccca

SEQ ID NO: 7509112 - DNA, 22 bp, Homo sapiens
tagcaggagagaagttttaagt

SEQ ID NO: 7509113 - DNA, 22 bp, Homo sapiens
tagcagctgtcagtttcacata

SEQ ID NO: 7509114 - DNA, 22 bp, Homo sapiens
tagcagctgtcagtttcacata

SEQ ID NO: 7509115 - DNA, 22 bp, Homo sapiens
tagcagctgtcagtttcacata

SEQ ID NO: 7509116 - DNA, 22 bp, Homo sapiens
tagcagctgtgagtaaaagcca

SEQ ID NO: 7509117 - DNA, 22 bp, Homo sapiens
tagcagctgtcagtttcacata

SEQ ID NO: 7509118 - DNA, 22 bp, Homo sapiens
tagcagctgtggaggggctgtg

SEQ ID NO: 7509119 - DNA, 22 bp, Homo sapiens
tagcagcttaagtaattagaat

SEQ ID NO: 7509120 - DNA, 22 bp, Homo sapiens
tagcagctgtggaggggctgtg

SEQ ID NO: 7509121 - DNA, 22 bp, Homo sapiens
tagcagctgtgagtaaaagcca

SEQ ID NO: 7509122 - DNA, 22 bp, Homo sapiens
tagcagctgtggaggggctgtg

SEQ ID NO: 7509123 - DNA, 22 bp, Homo sapiens
tagcagctgcatcattttacag

SEQ ID NO: 7509124 - DNA, 19 bp, Homo sapiens
tagcagctgccaaaggaga

SEQ ID NO: 7509125 - DNA, 19 bp, Homo sapiens
tagcagctgccaaaggaga

SEQ ID NO: 7509126 - DNA, 22 bp, Homo sapiens
tagcagctggggctattcatca

SEQ ID NO: 7509127 - DNA, 22 bp, Homo sapiens
tagcagctggggctattcatca

SEQ ID NO: 7509128 - DNA, 22 bp, Homo sapiens
tagcagctctttactaaccagt

SEQ ID NO: 7509129 - DNA, 22 bp, Homo sapiens
tagcagctgcatcattttacag

SEQ ID NO: 7509130 - DNA, 22 bp, Homo sapiens
tagcagctgcatcattttacag

SEQ ID NO: 7509131 - DNA, 19 bp, Homo sapiens
tagcagctgccaaaggaga

SEQ ID NO: 7509132 - DNA, 22 bp, Homo sapiens
tcagaattagagctcttcttga

SEQ ID NO: 7509133 - DNA, 22 bp, Homo sapiens
tcagaattaagctcttggtcag

SEQ ID NO: 7509134 - DNA, 22 bp, Homo sapiens
tcagaattacacagggccttga

SEQ ID NO: 7509135 - DNA, 22 bp, Homo sapiens
tcagaatgggccttcctgtccc

SEQ ID NO: 7509136 - DNA, 22 bp, Homo sapiens
tcagaatgtgcagaggaacagt

SEQ ID NO: 7509137 - DNA, 22 bp, Homo sapiens
tcagaatgtgcagaggaacagt

SEQ ID NO: 7509138 - DNA, 22 bp, Homo sapiens
tcagaatgtggagagctgccct

SEQ ID NO: 7509139 - DNA, 22 bp, Homo sapiens
tcagaatgttcctgctgtcagt

SEQ ID NO: 7509140 - DNA, 22 bp, Homo sapiens
tcagaattctacaatagatcag

SEQ ID NO: 7509141 - DNA, 22 bp, Homo sapiens
tcagaattctagctcttccctt

SEQ ID NO: 7509142 - DNA, 23 bp, Homo sapiens
tcagaattccagtttctttgaag

SEQ ID NO: 7509143 - DNA, 23 bp, Homo sapiens
tcagaattccagtttctttgaag

SEQ ID NO: 7509144 - DNA, 22 bp, Homo sapiens
tcagaatttttgttacccttga

SEQ ID NO: 7509145 - DNA, 22 bp, Homo sapiens
tcagacaactctggaggctggc

SEQ ID NO: 7509146 - DNA, 22 bp, Homo sapiens
tcagaattttaaaccaaggaaa

SEQ ID NO: 7509147 - DNA, 19 bp, Homo sapiens
tcagaattctgtctcttga

SEQ ID NO: 7509148 - DNA, 22 bp, Homo sapiens
tcagaattgattttcaaaacag

SEQ ID NO: 7509149 - DNA, 22 bp, Homo sapiens
tcagaattggaacgtgaagatt

SEQ ID NO: 7509150 - DNA, 22 bp, Homo sapiens
tcagaattggacaatagaagca

SEQ ID NO: 7509151 - DNA, 22 bp, Homo sapiens
tcagaattggacaatagaagca

SEQ ID NO: 7509152 - DNA, 22 bp, Homo sapiens
tcagacaagtaaaataatgtaa

SEQ ID NO: 7509153 - DNA, 22 bp, Homo sapiens
tcagacaagtaaaataatgtaa

SEQ ID NO: 7509154 - DNA, 22 bp, Homo sapiens
tcagacaagtaaaataatgtaa

SEQ ID NO: 7509155 - DNA, 22 bp, Homo sapiens
tcagacaagtaaaataatgtaa

SEQ ID NO: 7509156 - DNA, 18 bp, Homo sapiens
tcagacaagttagacagg

SEQ ID NO: 7509157 - DNA, 18 bp, Homo sapiens
tcagacaagttagacagg

SEQ ID NO: 7509158 - DNA, 18 bp, Homo sapiens
tcagacaagttagacagg

SEQ ID NO: 7509159 - DNA, 22 bp, Homo sapiens
tcagacaagttgatgtacctgg

SEQ ID NO: 7509160 - DNA, 22 bp, Homo sapiens
tcagacaagttgatgtacctgg

SEQ ID NO: 7509161 - DNA, 18 bp, Homo sapiens
tcagacaagttagacagg

SEQ ID NO: 7509162 - DNA, 22 bp, Homo sapiens
tcagacacagatgagacaagga

SEQ ID NO: 7509163 - DNA, 22 bp, Homo sapiens
tcagacacagatgagacaagga

SEQ ID NO: 7509164 - DNA, 22 bp, Homo sapiens
tcagacacagatgagacaagga

SEQ ID NO: 7509165 - DNA, 22 bp, Homo sapiens
tcagacagaaggactatttgaa

SEQ ID NO: 7509166 - DNA, 22 bp, Homo sapiens
tcagacagaaggactatttgaa

SEQ ID NO: 7509167 - DNA, 22 bp, Homo sapiens
tcagacagaaagatgagtatgg

SEQ ID NO: 7509168 - DNA, 22 bp, Homo sapiens
tcagacagagaagtacaatgag

SEQ ID NO: 7509169 - DNA, 22 bp, Homo sapiens
tcagagtgttttactaaacaag

SEQ ID NO: 7509170 - DNA, 22 bp, Homo sapiens
tcagagtgtggtgagatgtgca

SEQ ID NO: 7509171 - DNA, 22 bp, Homo sapiens
tcagagtgtggtgagatgtgca

SEQ ID NO: 7509172 - DNA, 21 bp, Homo sapiens
tcagagtgtgttacagcaagc

SEQ ID NO: 7509173 - DNA, 21 bp, Homo sapiens
tcagagtgtgttacagcaagc

SEQ ID NO: 7509174 - DNA, 22 bp, Homo sapiens
tcagagtgtgagacatattgga

SEQ ID NO: 7509175 - DNA, 22 bp, Homo sapiens
tcagagtgtgagacatattgga

SEQ ID NO: 7509176 - DNA, 22 bp, Homo sapiens
tcagagtgtgacttggtcatga

SEQ ID NO: 7509177 - DNA, 22 bp, Homo sapiens
tcagagtgtgacttggtcatga

SEQ ID NO: 7509178 - DNA, 22 bp, Homo sapiens
tcagagtgggagaatgtgccaa

SEQ ID NO: 7509179 - DNA, 22 bp, Homo sapiens
tcagagtggtggttttgccttc

SEQ ID NO: 7509180 - DNA, 22 bp, Homo sapiens
tcagagtgcagggagtagcagc

SEQ ID NO: 7509181 - DNA, 22 bp, Homo sapiens
tcagacagaggagctcgtgcag

SEQ ID NO: 7509182 - DNA, 22 bp, Homo sapiens
tcagacagaggagctcgtgcag

SEQ ID NO: 7509183 - DNA, 22 bp, Homo sapiens
tcagatttcttcttgcaacggc

SEQ ID NO: 7509184 - DNA, 22 bp, Homo sapiens
tcagatttctgaaagccctctc

SEQ ID NO: 7509185 - DNA, 22 bp, Homo sapiens
tcagatttctgaaagccctctc

SEQ ID NO: 7509186 - DNA, 22 bp, Homo sapiens
tcagatttctagcgtttggcca

SEQ ID NO: 7509187 - DNA, 22 bp, Homo sapiens
tcagatttccttgcagtttgga

SEQ ID NO: 7509188 - DNA, 22 bp, Homo sapiens
tcagatttctagcgtttggcca

SEQ ID NO: 7509189 - DNA, 22 bp, Homo sapiens
tcagatttctagcgtttggcca

SEQ ID NO: 7509190 - DNA, 22 bp, Homo sapiens
tcagatttctagcgtttggcca

SEQ ID NO: 7509191 - DNA, 22 bp, Homo sapiens
tcagatttccttgcagtttgga

SEQ ID NO: 7509192 - DNA, 22 bp, Homo sapiens
tcagatttccttgcagtttgga

SEQ ID NO: 7509193 - DNA, 22 bp, Homo sapiens
tcagatttcctgttgaagaagt

SEQ ID NO: 7509194 - DNA, 22 bp, Homo sapiens
tcagatttcctgttgaagaagt

SEQ ID NO: 7509195 - DNA, 22 bp, Homo sapiens
tcagatttccttgcagtttgga

SEQ ID NO: 7509196 - DNA, 22 bp, Homo sapiens
tcagatttcctgttgaagaagt

SEQ ID NO: 7509197 - DNA, 22 bp, Homo sapiens
tcagatttagggtgattacctt

SEQ ID NO: 7509198 - DNA, 22 bp, Homo sapiens
tcagatttatgaatatactatg

SEQ ID NO: 7509199 - DNA, 22 bp, Homo sapiens
tcagatttagggtgattacctt

SEQ ID NO: 7509200 - DNA, 22 bp, Homo sapiens
tcagatttagggtgattacctt

SEQ ID NO: 7509201 - DNA, 22 bp, Homo sapiens
tcagatttatgaatatactatg

SEQ ID NO: 7509202 - DNA, 22 bp, Homo sapiens
tcagatttatgaatatactatg

SEQ ID NO: 7509203 - DNA, 22 bp, Homo sapiens
tcagatttatgaatatactatg

SEQ ID NO: 7509204 - DNA, 22 bp, Homo sapiens
tcagatttcctgttgaagaagt

SEQ ID NO: 7509205 - DNA, 22 bp, Homo sapiens
tcagatttcagctaaagggatg

SEQ ID NO: 7509206 - DNA, 22 bp, Homo sapiens
tcagatttcagctaaagggatg

SEQ ID NO: 7509207 - DNA, 22 bp, Homo sapiens
tcagatttcagctaaagggatg

SEQ ID NO: 7509208 - DNA, 22 bp, Homo sapiens
tcagatttatgtggctaggctc

SEQ ID NO: 7509209 - DNA, 22 bp, Homo sapiens
tcagatttatgtggctaggctc

SEQ ID NO: 7509210 - DNA, 22 bp, Homo sapiens
tcagattttccacagactggaa

SEQ ID NO: 7509211 - DNA, 22 bp, Homo sapiens
tcagattttccacagactggaa

SEQ ID NO: 7509212 - DNA, 22 bp, Homo sapiens
tcagattttattttcctgttac

SEQ ID NO: 7509213 - DNA, 22 bp, Homo sapiens
tcagattttccacagactggaa

SEQ ID NO: 7509214 - DNA, 22 bp, Homo sapiens
tcagattttccagcctttctct

SEQ ID NO: 7509215 - DNA, 22 bp, Homo sapiens
tcagattttccagcctttctct

SEQ ID NO: 7509216 - DNA, 22 bp, Homo sapiens
tcagattttccagcctttctct

SEQ ID NO: 7509217 - DNA, 20 bp, Homo sapiens
tcagatttttctaactttga

SEQ ID NO: 7509218 - DNA, 20 bp, Homo sapiens
tcagattttgggtcactgat

SEQ ID NO: 7509219 - DNA, 20 bp, Homo sapiens
tcagattttgggtcactgat

SEQ ID NO: 7509220 - DNA, 22 bp, Homo sapiens
tcagattttgcacgaggttttg

SEQ ID NO: 7509221 - DNA, 20 bp, Homo sapiens
tcagattttgggtcactgat

SEQ ID NO: 7509222 - DNA, 22 bp, Homo sapiens
tcagattttgcacgaggttttg

SEQ ID NO: 7509223 - DNA, 22 bp, Homo sapiens
tcagattttccagcctttctct

SEQ ID NO: 7509224 - DNA, 22 bp, Homo sapiens
tcagattttgcacgaggttttg

SEQ ID NO: 7509225 - DNA, 22 bp, Homo sapiens
tcagattttgcacgaggttttg

SEQ ID NO: 7509226 - DNA, 22 bp, Homo sapiens
tcagatttgaatattcctttcg

SEQ ID NO: 7509227 - DNA, 22 bp, Homo sapiens
tcagatttcttcttgcaacggc

SEQ ID NO: 7509228 - DNA, 22 bp, Homo sapiens
tcagatttgaatattcctttcg

SEQ ID NO: 7509229 - DNA, 22 bp, Homo sapiens
tcagatttgaatattcctttcg

SEQ ID NO: 7509230 - DNA, 22 bp, Homo sapiens
tcagatttgatgtggttttcta

SEQ ID NO: 7509231 - DNA, 22 bp, Homo sapiens
tcagatttgatgtggttttcta

SEQ ID NO: 7509232 - DNA, 22 bp, Homo sapiens
tcagatttggacacaggaactt

SEQ ID NO: 7509233 - DNA, 22 bp, Homo sapiens
tcagatttggacacaggaactt

SEQ ID NO: 7509234 - DNA, 22 bp, Homo sapiens
tcagatttgtcctactaggcac

SEQ ID NO: 7509235 - DNA, 22 bp, Homo sapiens
tcagatttggacacaggaactt

SEQ ID NO: 7509236 - DNA, 22 bp, Homo sapiens
tcagatttggacacaggaactt

SEQ ID NO: 7509237 - DNA, 22 bp, Homo sapiens
tcagattttattttcctgttac

SEQ ID NO: 7509238 - DNA, 22 bp, Homo sapiens
tcagatttgtcctactaggcac

SEQ ID NO: 7509239 - DNA, 22 bp, Homo sapiens
tcagattttattttcctgttac

SEQ ID NO: 7509240 - DNA, 22 bp, Homo sapiens
tcagatgtctccaagggctggg

SEQ ID NO: 7509241 - DNA, 22 bp, Homo sapiens
tcagatgtctctcagcagggtt

SEQ ID NO: 7509242 - DNA, 22 bp, Homo sapiens
tcagagtgtgacttggtcatga

SEQ ID NO: 7509243 - DNA, 22 bp, Homo sapiens
tcagatgttgaaaaggaaaagt

SEQ ID NO: 7509244 - DNA, 22 bp, Homo sapiens
tcagatggtcattcactagggt

SEQ ID NO: 7509245 - DNA, 22 bp, Homo sapiens
tcagatggtcattcactagggt

SEQ ID NO: 7509246 - DNA, 22 bp, Homo sapiens
tcagatggtcattcactagggt

SEQ ID NO: 7509247 - DNA, 18 bp, Homo sapiens
tcagatttaactgtatcc

SEQ ID NO: 7509248 - DNA, 22 bp, Homo sapiens
tcagattctggatagatcttca

SEQ ID NO: 7509249 - DNA, 22 bp, Homo sapiens
tcagattctggatagatcttca

SEQ ID NO: 7509250 - DNA, 20 bp, Homo sapiens
tcagattaaatgttctgtct

SEQ ID NO: 7509251 - DNA, 20 bp, Homo sapiens
tcagattaaatgttctgtct

SEQ ID NO: 7509252 - DNA, 22 bp, Homo sapiens
tcagatttactgcagagcagat

SEQ ID NO: 7509253 - DNA, 22 bp, Homo sapiens
tcagatttactgcagagcagat

SEQ ID NO: 7509254 - DNA, 22 bp, Homo sapiens
tcagatttactgcagagcagat

SEQ ID NO: 7509255 - DNA, 22 bp, Homo sapiens
tcagatttactgcagagcagat

SEQ ID NO: 7509256 - DNA, 18 bp, Homo sapiens
tcagatttaactgtatcc

SEQ ID NO: 7509257 - DNA, 18 bp, Homo sapiens
tcagatttaactgtatcc

SEQ ID NO: 7509258 - DNA, 18 bp, Homo sapiens
tcagatttaactgtatcc

SEQ ID NO: 7509259 - DNA, 22 bp, Homo sapiens
tcagatgcttagagattagact

SEQ ID NO: 7509260 - DNA, 22 bp, Homo sapiens
tcagatgcttagtgactacaca

SEQ ID NO: 7509261 - DNA, 22 bp, Homo sapiens
tcagagttcctcatagatccag

SEQ ID NO: 7509262 - DNA, 22 bp, Homo sapiens
tcagagttctctgtccagatga

SEQ ID NO: 7509263 - DNA, 20 bp, Homo sapiens
tcagatgggagtgagccatc

SEQ ID NO: 7509264 - DNA, 22 bp, Homo sapiens
tcagatggcataggttggaatt

SEQ ID NO: 7509265 - DNA, 22 bp, Homo sapiens
tcagatggatttatactatttc

SEQ ID NO: 7509266 - DNA, 22 bp, Homo sapiens
tcagatggaaaggttactgtcc

SEQ ID NO: 7509267 - DNA, 22 bp, Homo sapiens
tcagatggaatgatgccactgc

SEQ ID NO: 7509268 - DNA, 22 bp, Homo sapiens
tcagatggaggcaatgttacct

SEQ ID NO: 7509269 - DNA, 22 bp, Homo sapiens
tcagatggattcattacatgac

SEQ ID NO: 7509270 - DNA, 22 bp, Homo sapiens
tcagcagtgtagtttatcattc

SEQ ID NO: 7509271 - DNA, 22 bp, Homo sapiens
tcagcagtgtcagttcccagag

SEQ ID NO: 7509272 - DNA, 22 bp, Homo sapiens
tcagcagtgggtcctgagggtg

SEQ ID NO: 7509273 - DNA, 22 bp, Homo sapiens
tcagcaggggccgttgggtgga

SEQ ID NO: 7509274 - DNA, 22 bp, Homo sapiens
tcagcagtgtagtttatcattc

SEQ ID NO: 7509275 - DNA, 22 bp, Homo sapiens
tcagcagtgtagtttatcattc

SEQ ID NO: 7509276 - DNA, 22 bp, Homo sapiens
tcagcaggggccgttgggtgga

SEQ ID NO: 7509277 - DNA, 22 bp, Homo sapiens
tcagcaggggccgttgggtgga

SEQ ID NO: 7509278 - DNA, 22 bp, Homo sapiens
tcagcaggggccgttgggtgga

SEQ ID NO: 7509279 - DNA, 17 bp, Homo sapiens
tcagcaggggccaagct

SEQ ID NO: 7509280 - DNA, 17 bp, Homo sapiens
tcagcaggggccaagct

SEQ ID NO: 7509281 - DNA, 17 bp, Homo sapiens
tcagcaggggccaagct

SEQ ID NO: 7509282 - DNA, 22 bp, Homo sapiens
tcagcagggctgtggtgtggct

SEQ ID NO: 7509283 - DNA, 17 bp, Homo sapiens
tcagcaggggccaagct

SEQ ID NO: 7509284 - DNA, 17 bp, Homo sapiens
tcagcaggggccaagct

SEQ ID NO: 7509285 - DNA, 17 bp, Homo sapiens
tcagcaggggccaagct

SEQ ID NO: 7509286 - DNA, 17 bp, Homo sapiens
tcagcaggggccaagct

SEQ ID NO: 7509287 - DNA, 17 bp, Homo sapiens
tcagcaggggccaagct

SEQ ID NO: 7509288 - DNA, 22 bp, Homo sapiens
tcagcagggctgggagctgtga

SEQ ID NO: 7509289 - DNA, 22 bp, Homo sapiens
tcagcagggctgtggtgtggct

SEQ ID NO: 7509290 - DNA, 22 bp, Homo sapiens
tcagcagggctgtggtgtggct

SEQ ID NO: 7509291 - DNA, 22 bp, Homo sapiens
tcagcagggctgtggtgtggct

SEQ ID NO: 7509292 - DNA, 22 bp, Homo sapiens
tcagcagggctgtggtgtggct

SEQ ID NO: 7509293 - DNA, 22 bp, Homo sapiens
tcagcagggctgggagctgtga

SEQ ID NO: 7509294 - DNA, 22 bp, Homo sapiens
tcagcagggctgggagctgtga

SEQ ID NO: 7509295 - DNA, 22 bp, Homo sapiens
tcagcagggctgggagctgtga

SEQ ID NO: 7509296 - DNA, 22 bp, Homo sapiens
tcagcagggaggctctgtgccc

SEQ ID NO: 7509297 - DNA, 22 bp, Homo sapiens
tcagcagggctgggagctgtga

SEQ ID NO: 7509298 - DNA, 22 bp, Homo sapiens
tcagcagggcctccttgtgcag

SEQ ID NO: 7509299 - DNA, 22 bp, Homo sapiens
tcagcagggcctccttgtgcag

SEQ ID NO: 7509300 - DNA, 22 bp, Homo sapiens
tcagcagggcatactgagccta

SEQ ID NO: 7509301 - DNA, 22 bp, Homo sapiens
tcagcagggccatgctctctct

SEQ ID NO: 7509302 - DNA, 22 bp, Homo sapiens
tcagcagggcatactgagccta

SEQ ID NO: 7509303 - DNA, 22 bp, Homo sapiens
tcagcagggcatactgagccta

SEQ ID NO: 7509304 - DNA, 22 bp, Homo sapiens
tcagcagggcatactgagccta

SEQ ID NO: 7509305 - DNA, 22 bp, Homo sapiens
tcagcagggcatactgagccta

SEQ ID NO: 7509306 - DNA, 22 bp, Homo sapiens
tcagcagggcatactgagccta

SEQ ID NO: 7509307 - DNA, 22 bp, Homo sapiens
tcagcagggcatactgagccta

SEQ ID NO: 7509308 - DNA, 22 bp, Homo sapiens
tcagcagggccatgctctctct

SEQ ID NO: 7509309 - DNA, 22 bp, Homo sapiens
tcagcagggccatgctctctct

SEQ ID NO: 7509310 - DNA, 22 bp, Homo sapiens
tcagcagggccatgctctctct

SEQ ID NO: 7509311 - DNA, 22 bp, Homo sapiens
tcagcagggccatgctctctct

SEQ ID NO: 7509312 - DNA, 22 bp, Homo sapiens
tcagcagggcctccttgtgcag

SEQ ID NO: 7509313 - DNA, 22 bp, Homo sapiens
tcagcagggcctccttgtgcag

SEQ ID NO: 7509314 - DNA, 22 bp, Homo sapiens
tcagcagggcctccttgtgcag

SEQ ID NO: 7509315 - DNA, 22 bp, Homo sapiens
tcagcagggaggctctgtgccc

SEQ ID NO: 7509316 - DNA, 22 bp, Homo sapiens
tcagcagggaggctctgtgccc

SEQ ID NO: 7509317 - DNA, 22 bp, Homo sapiens
tcagcagggcatactgagccta

SEQ ID NO: 7509318 - DNA, 22 bp, Homo sapiens
tcagcagggaggctctgtgccc

SEQ ID NO: 7509319 - DNA, 22 bp, Homo sapiens
tcagcagggaggctctgtgccc

SEQ ID NO: 7509320 - DNA, 22 bp, Homo sapiens
tcagcagggagaggagaatgca

SEQ ID NO: 7509321 - DNA, 22 bp, Homo sapiens
tcagcagggagaggagaatgca

SEQ ID NO: 7509322 - DNA, 22 bp, Homo sapiens
tcagcaggctgtcagcaggggc

SEQ ID NO: 7509323 - DNA, 22 bp, Homo sapiens
tcagcagggagaggagaatgca

SEQ ID NO: 7509324 - DNA, 22 bp, Homo sapiens
tcagcagggagaggagaatgca

SEQ ID NO: 7509325 - DNA, 22 bp, Homo sapiens
tcagcagggagaggagaatgca

SEQ ID NO: 7509326 - DNA, 22 bp, Homo sapiens
tcagcaggctctggttgaccat

SEQ ID NO: 7509327 - DNA, 22 bp, Homo sapiens
tcagcagggagaggagaatgca

SEQ ID NO: 7509328 - DNA, 22 bp, Homo sapiens
tcagcaagaagtcatttgtagc

SEQ ID NO: 7509329 - DNA, 22 bp, Homo sapiens
tcagcaagaagtcatttgtagc

SEQ ID NO: 7509330 - DNA, 22 bp, Homo sapiens
tcagcaactctcattccgcttt

SEQ ID NO: 7509331 - DNA, 22 bp, Homo sapiens
tcagcaagaagctgtgggcttc

SEQ ID NO: 7509332 - DNA, 22 bp, Homo sapiens
tcagcaagaagctgtgggcttc

SEQ ID NO: 7509333 - DNA, 22 bp, Homo sapiens
tcagcaggcaggaggcatgcca

SEQ ID NO: 7509334 - DNA, 22 bp, Homo sapiens
tcagcaggcaggaggcatgcca

SEQ ID NO: 7509335 - DNA, 22 bp, Homo sapiens
tcagcaggcagaaatctgcaga

SEQ ID NO: 7509336 - DNA, 22 bp, Homo sapiens
tcagcaggcagaaatctgcaga

SEQ ID NO: 7509337 - DNA, 22 bp, Homo sapiens
tcagcaaatacttattgagcgc

SEQ ID NO: 7509338 - DNA, 22 bp, Homo sapiens
tcagcaaccaggggcacagtcc

SEQ ID NO: 7509339 - DNA, 22 bp, Homo sapiens
tcagcaaccaggggcacagtcc

SEQ ID NO: 7509340 - DNA, 22 bp, Homo sapiens
tcagcaaatacttattgagcgc

SEQ ID NO: 7509341 - DNA, 22 bp, Homo sapiens
tcagcaaatacttattgagcgc

SEQ ID NO: 7509342 - DNA, 22 bp, Homo sapiens
tcagcaaaggcaattcattatt

SEQ ID NO: 7509343 - DNA, 22 bp, Homo sapiens
tcagcaaaggcaattcattatt

SEQ ID NO: 7509344 - DNA, 22 bp, Homo sapiens
tcagcaaaggcaattcattatt

SEQ ID NO: 7509345 - DNA, 22 bp, Homo sapiens
tcagcaactatttatcaaattc

SEQ ID NO: 7509346 - DNA, 22 bp, Homo sapiens
tcagcaactatttatcaaattc

SEQ ID NO: 7509347 - DNA, 22 bp, Homo sapiens
tcagcaaccaggggcacagtcc

SEQ ID NO: 7509348 - DNA, 22 bp, Homo sapiens
tcagcaagaagctgtgggcttc

SEQ ID NO: 7509349 - DNA, 17 bp, Homo sapiens
tcagcaaagacaaagga

SEQ ID NO: 7509350 - DNA, 17 bp, Homo sapiens
tcagcaaagacaaagga

SEQ ID NO: 7509351 - DNA, 17 bp, Homo sapiens
tcagcaaagacaaagga

SEQ ID NO: 7509352 - DNA, 22 bp, Homo sapiens
tcagcaaacattgattggactt

SEQ ID NO: 7509353 - DNA, 17 bp, Homo sapiens
tcagcaaagacaaagga

SEQ ID NO: 7509354 - DNA, 17 bp, Homo sapiens
tcagcaaagacaaagga

SEQ ID NO: 7509355 - DNA, 22 bp, Homo sapiens
tcagcaaaggaccagcacaggc

SEQ ID NO: 7509356 - DNA, 22 bp, Homo sapiens
tcagcaaaggaccagcacaggc

SEQ ID NO: 7509357 - DNA, 22 bp, Homo sapiens
tcagcaaaggaccagcacaggc

SEQ ID NO: 7509358 - DNA, 22 bp, Homo sapiens
tcagcaaaggaccagcacaggc

SEQ ID NO: 7509359 - DNA, 22 bp, Homo sapiens
tcagcaaaggaccagcacaggc

SEQ ID NO: 7509360 - DNA, 21 bp, Homo sapiens
tcagcaaaataagcaaatgga

SEQ ID NO: 7509361 - DNA, 21 bp, Homo sapiens
tcagcaaaataagcaaatgga

SEQ ID NO: 7509362 - DNA, 21 bp, Homo sapiens
tcagcaaaataagcaaatgga

SEQ ID NO: 7509363 - DNA, 22 bp, Homo sapiens
tcagcaaaatgtggctagtgct

SEQ ID NO: 7509364 - DNA, 22 bp, Homo sapiens
tcagcaaaatgtggctagtgct

SEQ ID NO: 7509365 - DNA, 22 bp, Homo sapiens
tcagcaaacattgattggactt

SEQ ID NO: 7509366 - DNA, 22 bp, Homo sapiens
tcagcaaacattgattggactt

SEQ ID NO: 7509367 - DNA, 22 bp, Homo sapiens
tcagcaaacattgattggactt

SEQ ID NO: 7509368 - DNA, 21 bp, Homo sapiens
tcagcaaaataagcaaatgga

SEQ ID NO: 7509369 - DNA, 20 bp, Homo sapiens
tcagatttttctaactttga

SEQ ID NO: 7509370 - DNA, 22 bp, Homo sapiens
tcagatttttgagatgtctgtt

SEQ ID NO: 7509371 - DNA, 20 bp, Homo sapiens
tcagatttttctaactttga

SEQ ID NO: 7509372 - DNA, 22 bp, Homo sapiens
tcagatttttgagatgtctgtt

SEQ ID NO: 7509373 - DNA, 22 bp, Homo sapiens
tcagatttttgagatgtctgtt

SEQ ID NO: 7509374 - DNA, 22 bp, Homo sapiens
tcagatttttgagatgtctgtt

SEQ ID NO: 7509375 - DNA, 22 bp, Homo sapiens
tcagatttttgagatgtctgtt

SEQ ID NO: 7509376 - DNA, 22 bp, Homo sapiens
tcagcaggctgtcagcaggggc

SEQ ID NO: 7509377 - DNA, 22 bp, Homo sapiens
tcagcaggctgtcagcaggggc

SEQ ID NO: 7509378 - DNA, 22 bp, Homo sapiens
tcagcaggctgtcagcaggggc

SEQ ID NO: 7509379 - DNA, 22 bp, Homo sapiens
tcagcaggctgtcagcaggggc

SEQ ID NO: 7509380 - DNA, 22 bp, Homo sapiens
tcagcaggctgtcagcaggggc

SEQ ID NO: 7509381 - DNA, 22 bp, Homo sapiens
tcagcaggctgtcagcaggggc

SEQ ID NO: 7509382 - DNA, 22 bp, Homo sapiens
tcagcaggctgtcagcaggggc

SEQ ID NO: 7509383 - DNA, 22 bp, Homo sapiens
tcagcaggctgtcagcaggggc

SEQ ID NO: 7509384 - DNA, 22 bp, Homo sapiens
tcagcaggctgtcagcaggggc

SEQ ID NO: 7509385 - DNA, 22 bp, Homo sapiens
tcagcaggctctggttgaccat

SEQ ID NO: 7509386 - DNA, 22 bp, Homo sapiens
tcagcaggctctggttgaccat

SEQ ID NO: 7509387 - DNA, 22 bp, Homo sapiens
tcagcaggcggttccttgtggg

SEQ ID NO: 7509388 - DNA, 22 bp, Homo sapiens
tcagcaggcggttccttgtggg

SEQ ID NO: 7509389 - DNA, 22 bp, Homo sapiens
tcagcaggcccatcctccaggc

SEQ ID NO: 7509390 - DNA, 22 bp, Homo sapiens
tcagcaggcggttccttgtggg

SEQ ID NO: 7509391 - DNA, 22 bp, Homo sapiens
tcagcaggcggttccttgtggg

SEQ ID NO: 7509392 - DNA, 22 bp, Homo sapiens
tcagcaggcccatcctccaggc

SEQ ID NO: 7509393 - DNA, 22 bp, Homo sapiens
tcagcaggcccatcctccaggc

SEQ ID NO: 7509394 - DNA, 22 bp, Homo sapiens
tcagcaggcagtgggtcacaat

SEQ ID NO: 7509395 - DNA, 22 bp, Homo sapiens
tcagcaggcagtgggtcacaat

SEQ ID NO: 7509396 - DNA, 22 bp, Homo sapiens
tcagcaggcagtgggtcacaat

SEQ ID NO: 7509397 - DNA, 22 bp, Homo sapiens
tcagcaggcaggaggcatgcca

SEQ ID NO: 7509398 - DNA, 22 bp, Homo sapiens
tcagcaggcaggaggcatgcca

SEQ ID NO: 7509399 - DNA, 22 bp, Homo sapiens
tcagcaggcaggaggcatgcca

SEQ ID NO: 7509400 - DNA, 23 bp, Homo sapiens
tcagctgcttcctcctgcctgcc

SEQ ID NO: 7509401 - DNA, 23 bp, Homo sapiens
tcagctgcttcctcctgcctgcc

SEQ ID NO: 7509402 - DNA, 23 bp, Homo sapiens
tcagctgcttcctcctgcctgcc

SEQ ID NO: 7509403 - DNA, 23 bp, Homo sapiens
tcagctgcttcctcctgcctgcc

SEQ ID NO: 7509404 - DNA, 22 bp, Homo sapiens
tcagctggaagatggtgcagaa

SEQ ID NO: 7509405 - DNA, 22 bp, Homo sapiens
tcagctggaagatggtgcagaa

SEQ ID NO: 7509406 - DNA, 22 bp, Homo sapiens
tcagctggaagatggtgcagaa

SEQ ID NO: 7509407 - DNA, 22 bp, Homo sapiens
tcagctggaagatggtgcagaa

SEQ ID NO: 7509408 - DNA, 19 bp, Homo sapiens
tcagctggcaggcctcctc

SEQ ID NO: 7509409 - DNA, 19 bp, Homo sapiens
tcagctggcaggcctcctc

SEQ ID NO: 7509410 - DNA, 22 bp, Homo sapiens
tcagctggagatccttgttgtg

SEQ ID NO: 7509411 - DNA, 22 bp, Homo sapiens
tcagctggcagttcagaggctg

SEQ ID NO: 7509412 - DNA, 22 bp, Homo sapiens
tcagctggcaggttctgggaag

SEQ ID NO: 7509413 - DNA, 22 bp, Homo sapiens
tcagctggcaggttctgggaag

SEQ ID NO: 7509414 - DNA, 22 bp, Homo sapiens
tcagctggcaggttctgggaag

SEQ ID NO: 7509415 - DNA, 22 bp, Homo sapiens
tcagctggcagttcagaggctg

SEQ ID NO: 7509416 - DNA, 22 bp, Homo sapiens
tcagctgggaagttctcgcttg

SEQ ID NO: 7509417 - DNA, 22 bp, Homo sapiens
tcagctgggaagttctcgcttg

SEQ ID NO: 7509418 - DNA, 22 bp, Homo sapiens
tcagctggcatcggctcaccca

SEQ ID NO: 7509419 - DNA, 22 bp, Homo sapiens
tcagctggggccccctctgtcc

SEQ ID NO: 7509420 - DNA, 22 bp, Homo sapiens
tcagctggggccccctctgtcc

SEQ ID NO: 7509421 - DNA, 18 bp, Homo sapiens
tcagctggggctgcagcc

SEQ ID NO: 7509422 - DNA, 18 bp, Homo sapiens
tcagctggggctgcagcc

SEQ ID NO: 7509423 - DNA, 18 bp, Homo sapiens
tcagctggggctgcagcc

SEQ ID NO: 7509424 - DNA, 22 bp, Homo sapiens
tcaggaattttgttctgtatcc

SEQ ID NO: 7509425 - DNA, 22 bp, Homo sapiens
tcaggacaacaagacttgttta

SEQ ID NO: 7509426 - DNA, 22 bp, Homo sapiens
tcaggacaacaagacttgttta

SEQ ID NO: 7509427 - DNA, 22 bp, Homo sapiens
tcaggacaacaagacttgttta

SEQ ID NO: 7509428 - DNA, 22 bp, Homo sapiens
tcaggaagtataatcagattca

SEQ ID NO: 7509429 - DNA, 22 bp, Homo sapiens
tcaggaagtataatcagattca

SEQ ID NO: 7509430 - DNA, 22 bp, Homo sapiens
tcaggaagggtggtccacaggg

SEQ ID NO: 7509431 - DNA, 22 bp, Homo sapiens
tcaggaagggtggtccacaggg

SEQ ID NO: 7509432 - DNA, 22 bp, Homo sapiens
tcaggaagggtggtccacaggg

SEQ ID NO: 7509433 - DNA, 22 bp, Homo sapiens
tcaggaagtataatcagattca

SEQ ID NO: 7509434 - DNA, 22 bp, Homo sapiens
tcaggaagtataatcagattca

SEQ ID NO: 7509435 - DNA, 21 bp, Homo sapiens
tcagctgtagagattacattc

SEQ ID NO: 7509436 - DNA, 22 bp, Homo sapiens
tcaggaagggctcagtctgtgc

SEQ ID NO: 7509437 - DNA, 22 bp, Homo sapiens
tcaggaagggtggtccacaggg

SEQ ID NO: 7509438 - DNA, 22 bp, Homo sapiens
tcaggaagggtggtccacaggg

SEQ ID NO: 7509439 - DNA, 22 bp, Homo sapiens
tcaggaagggtggtccacaggg

SEQ ID NO: 7509440 - DNA, 22 bp, Homo sapiens
tcaggaagggtggtccacaggg

SEQ ID NO: 7509441 - DNA, 22 bp, Homo sapiens
tcaggaagggtggtccacaggg

SEQ ID NO: 7509442 - DNA, 22 bp, Homo sapiens
tcagctggtgaatggactcatc

SEQ ID NO: 7509443 - DNA, 22 bp, Homo sapiens
tcagctggtgaatggactcatc

SEQ ID NO: 7509444 - DNA, 18 bp, Homo sapiens
tcagctgggtttctgggt

SEQ ID NO: 7509445 - DNA, 22 bp, Homo sapiens
tcagctggtgaatggactcatc

SEQ ID NO: 7509446 - DNA, 22 bp, Homo sapiens
tcagctggtgagtggatagaca

SEQ ID NO: 7509447 - DNA, 18 bp, Homo sapiens
tcagctggggctgcagcc

SEQ ID NO: 7509448 - DNA, 22 bp, Homo sapiens
tcagctgggtgagtgttctgca

SEQ ID NO: 7509449 - DNA, 18 bp, Homo sapiens
tcagctgggtttctgggt

SEQ ID NO: 7509450 - DNA, 22 bp, Homo sapiens
tcagctggtgagtggatagaca

SEQ ID NO: 7509451 - DNA, 22 bp, Homo sapiens
tcagctggtgagtggatagaca

SEQ ID NO: 7509452 - DNA, 22 bp, Homo sapiens
tcagctggtgccactcagtcaa

SEQ ID NO: 7509453 - DNA, 22 bp, Homo sapiens
tcagctggtgccactcagtcaa

SEQ ID NO: 7509454 - DNA, 22 bp, Homo sapiens
tcagctggtgtttcttctcctt

SEQ ID NO: 7509455 - DNA, 22 bp, Homo sapiens
tcagctgtactgtgccatagct

SEQ ID NO: 7509456 - DNA, 22 bp, Homo sapiens
tcagctgtactgtgccatagct

SEQ ID NO: 7509457 - DNA, 22 bp, Homo sapiens
tcagctgtactgtgccatagct

SEQ ID NO: 7509458 - DNA, 21 bp, Homo sapiens
tcagctgtagagattacattc

SEQ ID NO: 7509459 - DNA, 18 bp, Homo sapiens
tcaggagacacagacgca

SEQ ID NO: 7509460 - DNA, 22 bp, Homo sapiens
tcaggagacaaagggtgcggag

SEQ ID NO: 7509461 - DNA, 22 bp, Homo sapiens
tcaggagacaaagggtgcggag

SEQ ID NO: 7509462 - DNA, 22 bp, Homo sapiens
tcaggagaatcagggctgtcct

SEQ ID NO: 7509463 - DNA, 22 bp, Homo sapiens
tcaggagaatcagggctgtcct

SEQ ID NO: 7509464 - DNA, 22 bp, Homo sapiens
tcaggagaatcagggctgtcct

SEQ ID NO: 7509465 - DNA, 22 bp, Homo sapiens
tcaggagacattcttaaagtag

SEQ ID NO: 7509466 - DNA, 22 bp, Homo sapiens
tcaggagacattcttaaagtag

SEQ ID NO: 7509467 - DNA, 18 bp, Homo sapiens
tcaggagacacagacgca

SEQ ID NO: 7509468 - DNA, 18 bp, Homo sapiens
tcaggagacacagacgca

SEQ ID NO: 7509469 - DNA, 18 bp, Homo sapiens
tcaggagacacagacgca

SEQ ID NO: 7509470 - DNA, 22 bp, Homo sapiens
tcaggagactggcagtgcccac

SEQ ID NO: 7509471 - DNA, 22 bp, Homo sapiens
tcaggagactggcagtgcccac

SEQ ID NO: 7509472 - DNA, 22 bp, Homo sapiens
tcaggagactggcagtgcccac

SEQ ID NO: 7509473 - DNA, 19 bp, Homo sapiens
tcaggactgacttgaagtc

SEQ ID NO: 7509474 - DNA, 22 bp, Homo sapiens
tcaggactagacatgaggaagg

SEQ ID NO: 7509475 - DNA, 22 bp, Homo sapiens
tcaggacatttgtcagcaggag

SEQ ID NO: 7509476 - DNA, 22 bp, Homo sapiens
tcaggacatttgtcagcaggag

SEQ ID NO: 7509477 - DNA, 22 bp, Homo sapiens
tcaggagaaaatatcaggaagt

SEQ ID NO: 7509478 - DNA, 22 bp, Homo sapiens
tcaggagaaagccaattagagt

SEQ ID NO: 7509479 - DNA, 22 bp, Homo sapiens
tcaggagaaagccaattagagt

SEQ ID NO: 7509480 - DNA, 22 bp, Homo sapiens
tcaggagaaagccaattagagt

SEQ ID NO: 7509481 - DNA, 22 bp, Homo sapiens
tcaggagaaaatatcaggaagt

SEQ ID NO: 7509482 - DNA, 22 bp, Homo sapiens
tcaggagaaaatatcaggaagt

SEQ ID NO: 7509483 - DNA, 22 bp, Homo sapiens
tcaggagaaaatatcaggaagt

SEQ ID NO: 7509484 - DNA, 22 bp, Homo sapiens
tcaggagaaaatatcaggaagt

SEQ ID NO: 7509485 - DNA, 22 bp, Homo sapiens
tcaggagaacttccttctaccc

SEQ ID NO: 7509486 - DNA, 22 bp, Homo sapiens
tcaggagaacttccttctaccc

SEQ ID NO: 7509487 - DNA, 22 bp, Homo sapiens
tcaggagaacttccttctaccc

SEQ ID NO: 7509488 - DNA, 22 bp, Homo sapiens
tcaggagaacttccttctaccc

SEQ ID NO: 7509489 - DNA, 22 bp, Homo sapiens
tcaggacatttgtcagcaggag

SEQ ID NO: 7509490 - DNA, 22 bp, Homo sapiens
tcaggagaaggcaatgtggaaa

SEQ ID NO: 7509491 - DNA, 22 bp, Homo sapiens
tcaggagaaggcaatgtggaaa

SEQ ID NO: 7509492 - DNA, 22 bp, Homo sapiens
tcaggagaacttccttctaccc

SEQ ID NO: 7509493 - DNA, 22 bp, Homo sapiens
tcaggagaaggcaatgtggaaa

SEQ ID NO: 7509494 - DNA, 22 bp, Homo sapiens
tcaggagaaggcaatgtggaaa

SEQ ID NO: 7509495 - DNA, 22 bp, Homo sapiens
tcaggacagaaggctgccaggg

SEQ ID NO: 7509496 - DNA, 22 bp, Homo sapiens
tcaggacagaaggctgccaggg

SEQ ID NO: 7509497 - DNA, 22 bp, Homo sapiens
tcaggacagactagactagcgt

SEQ ID NO: 7509498 - DNA, 22 bp, Homo sapiens
tcaggacagactagactagcgt

SEQ ID NO: 7509499 - DNA, 22 bp, Homo sapiens
tcaggacagactagactagcgt

SEQ ID NO: 7509500 - DNA, 22 bp, Homo sapiens
tcaggacagactagactagcgt

SEQ ID NO: 7509501 - DNA, 22 bp, Homo sapiens
tcaggacagaaggctgccaggg

SEQ ID NO: 7509502 - DNA, 22 bp, Homo sapiens
tcaggacacttggcacaaggtc

SEQ ID NO: 7509503 - DNA, 22 bp, Homo sapiens
tcaggacacttggcacaaggtc

SEQ ID NO: 7509504 - DNA, 22 bp, Homo sapiens
tcaggacacttggcacaaggtc

SEQ ID NO: 7509505 - DNA, 22 bp, Homo sapiens
tcaggacacttggcacaaggtc

SEQ ID NO: 7509506 - DNA, 22 bp, Homo sapiens
tcaggacacttggcacaaggtc

SEQ ID NO: 7509507 - DNA, 22 bp, Homo sapiens
tcaggacaacctgttttcagac

SEQ ID NO: 7509508 - DNA, 22 bp, Homo sapiens
tcaggacaacctgttttcagac

SEQ ID NO: 7509509 - DNA, 22 bp, Homo sapiens
tcaggacaacctgttttcagac

SEQ ID NO: 7509510 - DNA, 22 bp, Homo sapiens
tcaggacaatagtgatttttac

SEQ ID NO: 7509511 - DNA, 22 bp, Homo sapiens
tcaggacaacatgttgctaatc

SEQ ID NO: 7509512 - DNA, 22 bp, Homo sapiens
tcaggacaacaagacttgttta

SEQ ID NO: 7509513 - DNA, 22 bp, Homo sapiens
tcaggacaacatgttgctaatc

SEQ ID NO: 7509514 - DNA, 22 bp, Homo sapiens
tcaggacaccctgtgcttcctt

SEQ ID NO: 7509515 - DNA, 22 bp, Homo sapiens
tcaggacaacatgttgctaatc

SEQ ID NO: 7509516 - DNA, 22 bp, Homo sapiens
tcaggacaacctgttttcagac

SEQ ID NO: 7509517 - DNA, 22 bp, Homo sapiens
tcaggacaccctgtgcttcctt

SEQ ID NO: 7509518 - DNA, 22 bp, Homo sapiens
tcaggacaatagtgatttttac

SEQ ID NO: 7509519 - DNA, 22 bp, Homo sapiens
tcaggacaatagtgatttttac

SEQ ID NO: 7509520 - DNA, 22 bp, Homo sapiens
tcaggacaccctgtgcttcctt

SEQ ID NO: 7509521 - DNA, 22 bp, Homo sapiens
tcaggacaccctgtgcttcctt

SEQ ID NO: 7509522 - DNA, 22 bp, Homo sapiens
tcaggacagccagggtgcagac

SEQ ID NO: 7509523 - DNA, 22 bp, Homo sapiens
tcaggacagccagggtgcagac

SEQ ID NO: 7509524 - DNA, 22 bp, Homo sapiens
tcaggacagccagggtgcagac

SEQ ID NO: 7509525 - DNA, 22 bp, Homo sapiens
tcaggacagccagggtgcagac

SEQ ID NO: 7509526 - DNA, 22 bp, Homo sapiens
tcaggacagccagggtgcagac

SEQ ID NO: 7509527 - DNA, 22 bp, Homo sapiens
tcaggacagagatcagaacttc

SEQ ID NO: 7509528 - DNA, 22 bp, Homo sapiens
tcaggacagactagactagcgt

SEQ ID NO: 7509529 - DNA, 22 bp, Homo sapiens
tcaggacagagatcagaacttc

SEQ ID NO: 7509530 - DNA, 22 bp, Homo sapiens
tcaggacagagatcagaacttc

SEQ ID NO: 7509531 - DNA, 22 bp, Homo sapiens
tcaggacagagatcagaacttc

SEQ ID NO: 7509532 - DNA, 22 bp, Homo sapiens
tcaggacagagatcagaacttc

SEQ ID NO: 7509533 - DNA, 22 bp, Homo sapiens
tcaggacagagatcagaacttc

SEQ ID NO: 7509534 - DNA, 22 bp, Homo sapiens
tcaggacagggatcacatcatc

SEQ ID NO: 7509535 - DNA, 22 bp, Homo sapiens
tcaggacagccagggtgcagac

SEQ ID NO: 7509536 - DNA, 22 bp, Homo sapiens
tcaggacagggatcacatcatc

SEQ ID NO: 7509537 - DNA, 22 bp, Homo sapiens
tcaggacagccagggtgcagac

SEQ ID NO: 7509538 - DNA, 22 bp, Homo sapiens
tcaggacaggttcgggtgggta

SEQ ID NO: 7509539 - DNA, 22 bp, Homo sapiens
tcaggacaggttcgggtgggta

SEQ ID NO: 7509540 - DNA, 22 bp, Homo sapiens
tcaggacaggttcgggtgggta

SEQ ID NO: 7509541 - DNA, 22 bp, Homo sapiens
tcaggacagggatcacatcatc

SEQ ID NO: 7509542 - DNA, 22 bp, Homo sapiens
tcaggacagttccctgcaaatt

SEQ ID NO: 7509543 - DNA, 22 bp, Homo sapiens
tcaggacagttccctgcaaatt

SEQ ID NO: 7509544 - DNA, 22 bp, Homo sapiens
tcaggacaggttcgggtgggta

SEQ ID NO: 7509545 - DNA, 22 bp, Homo sapiens
tcaggacagttccctgcaaatt

SEQ ID NO: 7509546 - DNA, 22 bp, Homo sapiens
tcaggacagttccctgcaaatt

SEQ ID NO: 7509547 - DNA, 22 bp, Homo sapiens
tcaggacagttccctgcaaatt

SEQ ID NO: 7509548 - DNA, 22 bp, Homo sapiens
tcaggacatttgtcagcaggag

SEQ ID NO: 7509549 - DNA, 22 bp, Homo sapiens
tcaggacatttgtcagcaggag

SEQ ID NO: 7509550 - DNA, 22 bp, Homo sapiens
tcaggacatttgtcagcaggag

SEQ ID NO: 7509551 - DNA, 22 bp, Homo sapiens
tcaggacatttgtcagcaggag

SEQ ID NO: 7509552 - DNA, 22 bp, Homo sapiens
tcagccagaggcttcttggttt

SEQ ID NO: 7509553 - DNA, 22 bp, Homo sapiens
tcagccagaggcttcttggttt

SEQ ID NO: 7509554 - DNA, 22 bp, Homo sapiens
tcagccagaggcttcttggttt

SEQ ID NO: 7509555 - DNA, 22 bp, Homo sapiens
tcagccagaggcttcttggttt

SEQ ID NO: 7509556 - DNA, 22 bp, Homo sapiens
tcagccagaaagtgattttcag

SEQ ID NO: 7509557 - DNA, 22 bp, Homo sapiens
tcagccagaaagtgattttcag

SEQ ID NO: 7509558 - DNA, 22 bp, Homo sapiens
tcagccagaaagtgattttcag

SEQ ID NO: 7509559 - DNA, 22 bp, Homo sapiens
tcagccacttccctctggtcag

SEQ ID NO: 7509560 - DNA, 22 bp, Homo sapiens
tcagccagaaagtgattttcag

SEQ ID NO: 7509561 - DNA, 22 bp, Homo sapiens
tcagccacttccctctggtcag

SEQ ID NO: 7509562 - DNA, 22 bp, Homo sapiens
tcagccactacccaccttaaca

SEQ ID NO: 7509563 - DNA, 22 bp, Homo sapiens
tcagccactacccaccttaaca

SEQ ID NO: 7509564 - DNA, 19 bp, Homo sapiens
tcagccaccagaagagata

SEQ ID NO: 7509565 - DNA, 22 bp, Homo sapiens
tcagccaagaagggaactggtc

SEQ ID NO: 7509566 - DNA, 22 bp, Homo sapiens
tcagccaagcgtaggatattgg

SEQ ID NO: 7509567 - DNA, 22 bp, Homo sapiens
tcagccaagctgtgagagagta

SEQ ID NO: 7509568 - DNA, 22 bp, Homo sapiens
tcagcattgtggcagagaatgg

SEQ ID NO: 7509569 - DNA, 22 bp, Homo sapiens
tcagcattgtggcagagaatgg

SEQ ID NO: 7509570 - DNA, 22 bp, Homo sapiens
tcagcattgtggcagagaatgg

SEQ ID NO: 7509571 - DNA, 22 bp, Homo sapiens
tcagcatttcagaagtggcata

SEQ ID NO: 7509572 - DNA, 22 bp, Homo sapiens
tcagcatttcagaagtggcata

SEQ ID NO: 7509573 - DNA, 22 bp, Homo sapiens
tcagccagccagctacaggctt

SEQ ID NO: 7509574 - DNA, 22 bp, Homo sapiens
tcagccagccagctacaggctt

SEQ ID NO: 7509575 - DNA, 22 bp, Homo sapiens
tcagccagccagctacaggctt

SEQ ID NO: 7509576 - DNA, 22 bp, Homo sapiens
tcagccagccagctacaggctt

SEQ ID NO: 7509577 - DNA, 22 bp, Homo sapiens
tcagccagcatcagctaagtgc

SEQ ID NO: 7509578 - DNA, 22 bp, Homo sapiens
tcagccagcatcagctaagtgc

SEQ ID NO: 7509579 - DNA, 22 bp, Homo sapiens
tcagccagcatcagctaagtgc

SEQ ID NO: 7509580 - DNA, 22 bp, Homo sapiens
tcagccagcatcagctaagtgc

SEQ ID NO: 7509581 - DNA, 22 bp, Homo sapiens
tcagccagcatcagctaagtgc

SEQ ID NO: 7509582 - DNA, 22 bp, Homo sapiens
tcagccagcattacccctgact

SEQ ID NO: 7509583 - DNA, 22 bp, Homo sapiens
tcagccagaggtggatgagtca

SEQ ID NO: 7509584 - DNA, 22 bp, Homo sapiens
tcagccagaggtggatgagtca

SEQ ID NO: 7509585 - DNA, 22 bp, Homo sapiens
tcagccagagggggcaaaggaa

SEQ ID NO: 7509586 - DNA, 22 bp, Homo sapiens
tcagccagagggggcaaaggaa

SEQ ID NO: 7509587 - DNA, 22 bp, Homo sapiens
tcagcagttcaaccccgtcaga

SEQ ID NO: 7509588 - DNA, 22 bp, Homo sapiens
tcagcagttcaaccccgtcaga

SEQ ID NO: 7509589 - DNA, 22 bp, Homo sapiens
tcagcagttgccccctcccagc

SEQ ID NO: 7509590 - DNA, 22 bp, Homo sapiens
tcagcagttgccccctcccagc

SEQ ID NO: 7509591 - DNA, 22 bp, Homo sapiens
tcagcagttattcccctacaga

SEQ ID NO: 7509592 - DNA, 22 bp, Homo sapiens
tcagcagttattcccctacaga

SEQ ID NO: 7509593 - DNA, 22 bp, Homo sapiens
tcagcagtgtgcttggaatgga

SEQ ID NO: 7509594 - DNA, 22 bp, Homo sapiens
tcagcagttattcccctacaga

SEQ ID NO: 7509595 - DNA, 22 bp, Homo sapiens
tcagcagtgtgcccagaggctg

SEQ ID NO: 7509596 - DNA, 22 bp, Homo sapiens
tcagcagtgtgcttggaatgga

SEQ ID NO: 7509597 - DNA, 22 bp, Homo sapiens
tcagcagtgtgcccagaggctg

SEQ ID NO: 7509598 - DNA, 22 bp, Homo sapiens
tcagcagtgtcagttcccagag

SEQ ID NO: 7509599 - DNA, 22 bp, Homo sapiens
tcagcagtgtgcccagaggctg

SEQ ID NO: 7509600 - DNA, 22 bp, Homo sapiens
tcagcagtgtagtttatcattc

SEQ ID NO: 7509601 - DNA, 22 bp, Homo sapiens
tcagcagtgtcagttcccagag

SEQ ID NO: 7509602 - DNA, 22 bp, Homo sapiens
tcagcagttgccccctcccagc

SEQ ID NO: 7509603 - DNA, 22 bp, Homo sapiens
tcagcagttttatatgcagctt

SEQ ID NO: 7509604 - DNA, 19 bp, Homo sapiens
tcagcatcaatttggtcct

SEQ ID NO: 7509605 - DNA, 23 bp, Homo sapiens
tcagcatcacctgggaacttact

SEQ ID NO: 7509606 - DNA, 22 bp, Homo sapiens
tcagcatcacgtggtccgagaa

SEQ ID NO: 7509607 - DNA, 22 bp, Homo sapiens
tcagcatcacgtggtccgagaa

SEQ ID NO: 7509608 - DNA, 19 bp, Homo sapiens
tcagcatcaatttggtcct

SEQ ID NO: 7509609 - DNA, 19 bp, Homo sapiens
tcagcatcaatttggtcct

SEQ ID NO: 7509610 - DNA, 20 bp, Homo sapiens
tcagcatgctcctcagacat

SEQ ID NO: 7509611 - DNA, 20 bp, Homo sapiens
tcagcatgctcctcagacat

SEQ ID NO: 7509612 - DNA, 22 bp, Homo sapiens
tcagcatcttcagcatggggaa

SEQ ID NO: 7509613 - DNA, 22 bp, Homo sapiens
tcagcatctcaaccttctctac

SEQ ID NO: 7509614 - DNA, 22 bp, Homo sapiens
tcagcatctcaaccttctctac

SEQ ID NO: 7509615 - DNA, 22 bp, Homo sapiens
tcagcatcttcagcatggggaa

SEQ ID NO: 7509616 - DNA, 22 bp, Homo sapiens
tcagcatctacagctttgctat

SEQ ID NO: 7509617 - DNA, 22 bp, Homo sapiens
tcagcatcagtattgtttagga

SEQ ID NO: 7509618 - DNA, 21 bp, Homo sapiens
tcagcatcctgagctgtcctc

SEQ ID NO: 7509619 - DNA, 21 bp, Homo sapiens
tcagcatcctgagctgtcctc

SEQ ID NO: 7509620 - DNA, 22 bp, Homo sapiens
tcagcatcaggttgtctgaatt

SEQ ID NO: 7509621 - DNA, 22 bp, Homo sapiens
tcagcatcagtattgtttagga

SEQ ID NO: 7509622 - DNA, 22 bp, Homo sapiens
tcagcattcctgaagacaagca

SEQ ID NO: 7509623 - DNA, 22 bp, Homo sapiens
tcagcattcctgaagacaagca

SEQ ID NO: 7509624 - DNA, 22 bp, Homo sapiens
tcagcattctttacaaggatga

SEQ ID NO: 7509625 - DNA, 22 bp, Homo sapiens
tcagcattctttacaaggatga

SEQ ID NO: 7509626 - DNA, 20 bp, Homo sapiens
tcagcatgctcctcagacat

SEQ ID NO: 7509627 - DNA, 22 bp, Homo sapiens
tcagcatgtacttctcctccat

SEQ ID NO: 7509628 - DNA, 20 bp, Homo sapiens
tcagcatgctcctcagacat

SEQ ID NO: 7509629 - DNA, 22 bp, Homo sapiens
tcagcatgtacttctcctccat

SEQ ID NO: 7509630 - DNA, 20 bp, Homo sapiens
tcagcatgttctcctccggt

SEQ ID NO: 7509631 - DNA, 22 bp, Homo sapiens
tcagctgctcaaatttatgtca

SEQ ID NO: 7509632 - DNA, 22 bp, Homo sapiens
tcagctgctctgttgagctgaa

SEQ ID NO: 7509633 - DNA, 22 bp, Homo sapiens
tcagctgctctgttgagctgaa

SEQ ID NO: 7509634 - DNA, 22 bp, Homo sapiens
tcagctgcgacaggggcctgag

SEQ ID NO: 7509635 - DNA, 22 bp, Homo sapiens
tcagctgcgacaggggcctgag

SEQ ID NO: 7509636 - DNA, 22 bp, Homo sapiens
tcagctgcgacaggggcctgag

SEQ ID NO: 7509637 - DNA, 22 bp, Homo sapiens
tcagctgctcaaatttatgtca

SEQ ID NO: 7509638 - DNA, 22 bp, Homo sapiens
tcagctgcttcatgttctgaat

SEQ ID NO: 7509639 - DNA, 22 bp, Homo sapiens
tcagctgcttcatgttctgaat

SEQ ID NO: 7509640 - DNA, 22 bp, Homo sapiens
tcagctgcttcatgttctgaat

SEQ ID NO: 7509641 - DNA, 22 bp, Homo sapiens
tcagctgctgtggtatgtacat

SEQ ID NO: 7509642 - DNA, 23 bp, Homo sapiens
tcagctgcttcctcctgcctgcc

SEQ ID NO: 7509643 - DNA, 23 bp, Homo sapiens
tcagctgcttcctcctgcctgcc

SEQ ID NO: 7509644 - DNA, 23 bp, Homo sapiens
tcagctgcttcctcctgcctgcc

SEQ ID NO: 7509645 - DNA, 23 bp, Homo sapiens
tcagctgcttcctcctgcctgcc

SEQ ID NO: 7509646 - DNA, 22 bp, Homo sapiens
tcagctgctctgttgagctgaa

SEQ ID NO: 7509647 - DNA, 22 bp, Homo sapiens
tcagctgctctgttgagctgaa

SEQ ID NO: 7509648 - DNA, 22 bp, Homo sapiens
tcagctgctgtggtatgtacat

SEQ ID NO: 7509649 - DNA, 22 bp, Homo sapiens
tcagctgctgtggtatgtacat

SEQ ID NO: 7509650 - DNA, 22 bp, Homo sapiens
tcagctgcctctccctggaaga

SEQ ID NO: 7509651 - DNA, 22 bp, Homo sapiens
tcagctgcctctccctggaaga

SEQ ID NO: 7509652 - DNA, 22 bp, Homo sapiens
tcagctgcctctccctggaaga

SEQ ID NO: 7509653 - DNA, 22 bp, Homo sapiens
tcagctgcctctccctggaaga

SEQ ID NO: 7509654 - DNA, 22 bp, Homo sapiens
tcagctgcctttcccatgctag

SEQ ID NO: 7509655 - DNA, 22 bp, Homo sapiens
tcagctgccccgggcactgccc

SEQ ID NO: 7509656 - DNA, 22 bp, Homo sapiens
tcagctgcctttcccatgctag

SEQ ID NO: 7509657 - DNA, 22 bp, Homo sapiens
tcagctgcgacaggggcctgag

SEQ ID NO: 7509658 - DNA, 22 bp, Homo sapiens
tcagctgcctttcccatgctag

SEQ ID NO: 7509659 - DNA, 22 bp, Homo sapiens
tcagctgcctttcccatgctag

SEQ ID NO: 7509660 - DNA, 22 bp, Homo sapiens
tcagctgccccgggcactgccc

SEQ ID NO: 7509661 - DNA, 22 bp, Homo sapiens
tcagctgccccgggcactgccc

SEQ ID NO: 7509662 - DNA, 22 bp, Homo sapiens
tcagctgccccgggcactgccc

SEQ ID NO: 7509663 - DNA, 22 bp, Homo sapiens
tcagctgccccgggcactgccc

SEQ ID NO: 7509664 - DNA, 22 bp, Homo sapiens
tcagctgccccgggcactgccc

SEQ ID NO: 7509665 - DNA, 22 bp, Homo sapiens
tcagctgccccgggcactgccc

SEQ ID NO: 7509666 - DNA, 22 bp, Homo sapiens
tcagctgccccatgtgttcact

SEQ ID NO: 7509667 - DNA, 22 bp, Homo sapiens
tcagctgccccatgtgttcact

SEQ ID NO: 7509668 - DNA, 22 bp, Homo sapiens
tcagctgccccatgtgttcact

SEQ ID NO: 7509669 - DNA, 19 bp, Homo sapiens
tcagctctggggtcagtgg

SEQ ID NO: 7509670 - DNA, 22 bp, Homo sapiens
tcagccaggccaccttcagctt

SEQ ID NO: 7509671 - DNA, 22 bp, Homo sapiens
tcagccaggccaccttcagctt

SEQ ID NO: 7509672 - DNA, 22 bp, Homo sapiens
tcagccaggcacaatggcagct

SEQ ID NO: 7509673 - DNA, 22 bp, Homo sapiens
tcagccaggcagccccctggtc

SEQ ID NO: 7509674 - DNA, 22 bp, Homo sapiens
tcagccaggcagccccctggtc

SEQ ID NO: 7509675 - DNA, 22 bp, Homo sapiens
tcagctctgcctgtggaggcac

SEQ ID NO: 7509676 - DNA, 19 bp, Homo sapiens
tcagctctggggtcagtgg

SEQ ID NO: 7509677 - DNA, 22 bp, Homo sapiens
tcagctctgcctgtggaggcac

SEQ ID NO: 7509678 - DNA, 22 bp, Homo sapiens
tcagctctgcactccactgtgg

SEQ ID NO: 7509679 - DNA, 22 bp, Homo sapiens
tcagccaggccaggcattcaca

SEQ ID NO: 7509680 - DNA, 22 bp, Homo sapiens
tcagctctgcctgtggaggcac

SEQ ID NO: 7509681 - DNA, 22 bp, Homo sapiens
tcagctctgcactccactgtgg

SEQ ID NO: 7509682 - DNA, 20 bp, Homo sapiens
tcagccagctaacatgggga

SEQ ID NO: 7509683 - DNA, 20 bp, Homo sapiens
tcagccagctaacatgggga

SEQ ID NO: 7509684 - DNA, 22 bp, Homo sapiens
tcagccagccagctacaggctt

SEQ ID NO: 7509685 - DNA, 22 bp, Homo sapiens
tcagccagctcttggactctga

SEQ ID NO: 7509686 - DNA, 20 bp, Homo sapiens
tcagccagctaacatgggga

SEQ ID NO: 7509687 - DNA, 22 bp, Homo sapiens
tcagccaggcacaatggcagct

SEQ ID NO: 7509688 - DNA, 22 bp, Homo sapiens
tcagccaggcacaatggcagct

SEQ ID NO: 7509689 - DNA, 22 bp, Homo sapiens
tcagccaggcacaatggcagct

SEQ ID NO: 7509690 - DNA, 22 bp, Homo sapiens
tcagccaggcacaatggcagct

SEQ ID NO: 7509691 - DNA, 22 bp, Homo sapiens
tcagccagctgtgtgcttctgc

SEQ ID NO: 7509692 - DNA, 22 bp, Homo sapiens
tcagccagctgtgtgcttctgc

SEQ ID NO: 7509693 - DNA, 22 bp, Homo sapiens
tcagccagctgtgtgcttctgc

SEQ ID NO: 7509694 - DNA, 22 bp, Homo sapiens
tcaacactaaagaataatcttt

SEQ ID NO: 7509695 - DNA, 22 bp, Homo sapiens
tcaacactaaagaataatcttt

SEQ ID NO: 7509696 - DNA, 22 bp, Homo sapiens
tcaacactatccaggcaatctt

SEQ ID NO: 7509697 - DNA, 22 bp, Homo sapiens
tcaacacaacagagaaatgctg

SEQ ID NO: 7509698 - DNA, 22 bp, Homo sapiens
tcaacaattgcatgttgatgtt

SEQ ID NO: 7509699 - DNA, 22 bp, Homo sapiens
tcaacacaacagagaaatgctg

SEQ ID NO: 7509700 - DNA, 22 bp, Homo sapiens
tcaacaccacaatttcttaact

SEQ ID NO: 7509701 - DNA, 22 bp, Homo sapiens
tcaacaattttgagatgagaca

SEQ ID NO: 7509702 - DNA, 22 bp, Homo sapiens
tcaacaataggatatagcaggt

SEQ ID NO: 7509703 - DNA, 22 bp, Homo sapiens
tcaacaataggatatagcaggt

SEQ ID NO: 7509704 - DNA, 22 bp, Homo sapiens
tcaacaatcccatggttcagtt

SEQ ID NO: 7509705 - DNA, 22 bp, Homo sapiens
tcaacaataggatatagcaggt

SEQ ID NO: 7509706 - DNA, 22 bp, Homo sapiens
tcaacaatcccatggttcagtt

SEQ ID NO: 7509707 - DNA, 22 bp, Homo sapiens
tcaacaatgggtctgtaatgga

SEQ ID NO: 7509708 - DNA, 22 bp, Homo sapiens
tcaacaatgggtctgtaatgga

SEQ ID NO: 7509709 - DNA, 22 bp, Homo sapiens
tcaacaatgggtctgtaatgga

SEQ ID NO: 7509710 - DNA, 22 bp, Homo sapiens
tcaacaatgggtctgtaatgga

SEQ ID NO: 7509711 - DNA, 22 bp, Homo sapiens
tcaacaatgggtctgtaatgga

SEQ ID NO: 7509712 - DNA, 22 bp, Homo sapiens
tcaacaatgggtctgtaatgga

SEQ ID NO: 7509713 - DNA, 22 bp, Homo sapiens
tcaacaattgcatgttgatgtt

SEQ ID NO: 7509714 - DNA, 22 bp, Homo sapiens
tcaaatgaggctgatgaatgtg

SEQ ID NO: 7509715 - DNA, 22 bp, Homo sapiens
tcaaatgaggctgatgaatgtg

SEQ ID NO: 7509716 - DNA, 22 bp, Homo sapiens
tcaaatgaggctgatgaatgtg

SEQ ID NO: 7509717 - DNA, 22 bp, Homo sapiens
tcaaatgagtgactcacacagg

SEQ ID NO: 7509718 - DNA, 22 bp, Homo sapiens
tcaaatgaggctgatgaatgtg

SEQ ID NO: 7509719 - DNA, 22 bp, Homo sapiens
tcaaatgaggctgatgaatgtg

SEQ ID NO: 7509720 - DNA, 22 bp, Homo sapiens
tcaaatgagtgactcacacagg

SEQ ID NO: 7509721 - DNA, 22 bp, Homo sapiens
tcaaatgagtgactcacacagg

SEQ ID NO: 7509722 - DNA, 22 bp, Homo sapiens
tcaaatgcacctctcatttgtt

SEQ ID NO: 7509723 - DNA, 22 bp, Homo sapiens
tcaaatgcacctctcatttgtt

SEQ ID NO: 7509724 - DNA, 22 bp, Homo sapiens
tcaaatgagtgactcacacagg

SEQ ID NO: 7509725 - DNA, 22 bp, Homo sapiens
tcaaatgagtgactcacacagg

SEQ ID NO: 7509726 - DNA, 22 bp, Homo sapiens
tcaaatgagtgactcacacagg

SEQ ID NO: 7509727 - DNA, 22 bp, Homo sapiens
tcaaatgcacctctcatttgtt

SEQ ID NO: 7509728 - DNA, 22 bp, Homo sapiens
tcaaatgcacctctcatttgtt

SEQ ID NO: 7509729 - DNA, 22 bp, Homo sapiens
tcaaatgcaggtctggtcttgg

SEQ ID NO: 7509730 - DNA, 22 bp, Homo sapiens
tcaaatgcacgtagagaaaata

SEQ ID NO: 7509731 - DNA, 22 bp, Homo sapiens
tcaaatgcaggtctggtcttgg

SEQ ID NO: 7509732 - DNA, 22 bp, Homo sapiens
tcaaatgcaggtctggtcttgg

SEQ ID NO: 7509733 - DNA, 22 bp, Homo sapiens
tcaacaataggatatagcaggt

SEQ ID NO: 7509734 - DNA, 19 bp, Homo sapiens
tcaaatgccaatgtcacag

SEQ ID NO: 7509735 - DNA, 22 bp, Homo sapiens
tcaacaagagcccatgcttttt

SEQ ID NO: 7509736 - DNA, 22 bp, Homo sapiens
tcaacaagagcccatgcttttt

SEQ ID NO: 7509737 - DNA, 22 bp, Homo sapiens
tcaacatttatgaagctgtggc

SEQ ID NO: 7509738 - DNA, 22 bp, Homo sapiens
tcaaccacagtcccatgtctcc

SEQ ID NO: 7509739 - DNA, 22 bp, Homo sapiens
tcaacattcatatatagccaca

SEQ ID NO: 7509740 - DNA, 22 bp, Homo sapiens
tcaacatatcatatctatcggt

SEQ ID NO: 7509741 - DNA, 22 bp, Homo sapiens
tcaaccacagtcccatgtctcc

SEQ ID NO: 7509742 - DNA, 22 bp, Homo sapiens
tcaacattggaggcaacattca

SEQ ID NO: 7509743 - DNA, 22 bp, Homo sapiens
tcaacattggaggcaacattca

SEQ ID NO: 7509744 - DNA, 22 bp, Homo sapiens
tcaacatataggcaacctgtaa

SEQ ID NO: 7509745 - DNA, 22 bp, Homo sapiens
tcaacatataggcaacctgtaa

SEQ ID NO: 7509746 - DNA, 22 bp, Homo sapiens
tcaacagctagaaatatagaga

SEQ ID NO: 7509747 - DNA, 22 bp, Homo sapiens
tcaacagttgcactggagaggt

SEQ ID NO: 7509748 - DNA, 22 bp, Homo sapiens
tcaacagttctgtccaattaat

SEQ ID NO: 7509749 - DNA, 22 bp, Homo sapiens
tcaacatacatacatggtcagg

SEQ ID NO: 7509750 - DNA, 22 bp, Homo sapiens
tcaacatacatacatggtcagg

SEQ ID NO: 7509751 - DNA, 22 bp, Homo sapiens
tcaacagttgcactggagaggt

SEQ ID NO: 7509752 - DNA, 22 bp, Homo sapiens
tcaacagttgcactggagaggt

SEQ ID NO: 7509753 - DNA, 22 bp, Homo sapiens
tcaacactggctacagttatgc

SEQ ID NO: 7509754 - DNA, 22 bp, Homo sapiens
tcaacactggctacagttatgc

SEQ ID NO: 7509755 - DNA, 22 bp, Homo sapiens
tcaacactggctacagttatgc

SEQ ID NO: 7509756 - DNA, 22 bp, Homo sapiens
tcaacactctttggcacagtta

SEQ ID NO: 7509757 - DNA, 22 bp, Homo sapiens
tcaacactatccaggcaatctt

SEQ ID NO: 7509758 - DNA, 22 bp, Homo sapiens
tcaacacttttgtctttgtccc

SEQ ID NO: 7509759 - DNA, 22 bp, Homo sapiens
tcaacacttttgtctttgtccc

SEQ ID NO: 7509760 - DNA, 22 bp, Homo sapiens
tcaacacttttgtctttgtccc

SEQ ID NO: 7509761 - DNA, 22 bp, Homo sapiens
tcaacacttgctggtttcctct

SEQ ID NO: 7509762 - DNA, 22 bp, Homo sapiens
tcaacacttgctggtttcctct

SEQ ID NO: 7509763 - DNA, 22 bp, Homo sapiens
tcaacagaagtgatagctatta

SEQ ID NO: 7509764 - DNA, 22 bp, Homo sapiens
tcaacagaagtgatagctatta

SEQ ID NO: 7509765 - DNA, 22 bp, Homo sapiens
tcaacagacatttttaagcact

SEQ ID NO: 7509766 - DNA, 22 bp, Homo sapiens
tcaacagaagtgatagctatta

SEQ ID NO: 7509767 - DNA, 22 bp, Homo sapiens
tcaacagacatttttaagcact

SEQ ID NO: 7509768 - DNA, 22 bp, Homo sapiens
tcaacagacatttttaagcact

SEQ ID NO: 7509769 - DNA, 22 bp, Homo sapiens
tcaacagattgtattaaggtta

SEQ ID NO: 7509770 - DNA, 22 bp, Homo sapiens
tcaacagccagaaatattagcc

SEQ ID NO: 7509771 - DNA, 22 bp, Homo sapiens
tcaacagacatttttaagcact

SEQ ID NO: 7509772 - DNA, 22 bp, Homo sapiens
tcaacagacatttttaagcact

SEQ ID NO: 7509773 - DNA, 22 bp, Homo sapiens
tcaactttgaaaccatagtgaa

SEQ ID NO: 7509774 - DNA, 22 bp, Homo sapiens
tcaactttagtgtagctattta

SEQ ID NO: 7509775 - DNA, 22 bp, Homo sapiens
tcaactttagtgtagctattta

SEQ ID NO: 7509776 - DNA, 22 bp, Homo sapiens
tcaacttggctttttaaagtcc

SEQ ID NO: 7509777 - DNA, 22 bp, Homo sapiens
tcaagaaactgtgctacagagt

SEQ ID NO: 7509778 - DNA, 22 bp, Homo sapiens
tcaagaaactgtagcaatgggt

SEQ ID NO: 7509779 - DNA, 22 bp, Homo sapiens
tcaagaaaatgcctgctggtgt

SEQ ID NO: 7509780 - DNA, 22 bp, Homo sapiens
tcaagaaactgtgctacagagt

SEQ ID NO: 7509781 - DNA, 22 bp, Homo sapiens
tcaagaaactgtgctacagagt

SEQ ID NO: 7509782 - DNA, 22 bp, Homo sapiens
tcaagaaactgtgctacagagt

SEQ ID NO: 7509783 - DNA, 22 bp, Homo sapiens
tcaagaaactgtgctacagagt

SEQ ID NO: 7509784 - DNA, 22 bp, Homo sapiens
tcaagaaactgtgctacagagt

SEQ ID NO: 7509785 - DNA, 22 bp, Homo sapiens
tcaagaaactgtgctacagagt

SEQ ID NO: 7509786 - DNA, 22 bp, Homo sapiens
tcaagaaactgtgctacagagt

SEQ ID NO: 7509787 - DNA, 22 bp, Homo sapiens
tcaagaaagggcttcaccagga

SEQ ID NO: 7509788 - DNA, 22 bp, Homo sapiens
tcaagaaagggcttcaccagga

SEQ ID NO: 7509789 - DNA, 22 bp, Homo sapiens
tcaaccttgtgagaactgagtc

SEQ ID NO: 7509790 - DNA, 22 bp, Homo sapiens
tcaacctatgagagagtctgtt

SEQ ID NO: 7509791 - DNA, 22 bp, Homo sapiens
tcaacctctggagaaatcagga

SEQ ID NO: 7509792 - DNA, 22 bp, Homo sapiens
tcaacgtttgttaaatgagtat

SEQ ID NO: 7509793 - DNA, 22 bp, Homo sapiens
tcaacccttcctccatatttcc

SEQ ID NO: 7509794 - DNA, 21 bp, Homo sapiens
tcaacccttgcgtcaccaagc

SEQ ID NO: 7509795 - DNA, 22 bp, Homo sapiens
tcaacttggagcacatttggct

SEQ ID NO: 7509796 - DNA, 22 bp, Homo sapiens
tcaactgatttagtctgtgcca

SEQ ID NO: 7509797 - DNA, 22 bp, Homo sapiens
tcaactgcaagtttgcttagtt

SEQ ID NO: 7509798 - DNA, 22 bp, Homo sapiens
tcaactcatgttattctgtgaa

SEQ ID NO: 7509799 - DNA, 22 bp, Homo sapiens
tcaactcacaagaatgagcaag

SEQ ID NO: 7509800 - DNA, 22 bp, Homo sapiens
tcaactcacaagaatgagcaag

SEQ ID NO: 7509801 - DNA, 22 bp, Homo sapiens
tcaactcacaagaatgagcaag

SEQ ID NO: 7509802 - DNA, 22 bp, Homo sapiens
tcaactaaggcacaatctctaa

SEQ ID NO: 7509803 - DNA, 22 bp, Homo sapiens
tcacagtgacttacagagattg

SEQ ID NO: 7509804 - DNA, 22 bp, Homo sapiens
tcacagtgacttacagagattg

SEQ ID NO: 7509805 - DNA, 22 bp, Homo sapiens
tcacagtgagaaatttgttggc

SEQ ID NO: 7509806 - DNA, 22 bp, Homo sapiens
tcacagtgagaaatttgttggc

SEQ ID NO: 7509807 - DNA, 22 bp, Homo sapiens
tcacagtgagaaatttgttggc

SEQ ID NO: 7509808 - DNA, 22 bp, Homo sapiens
tcacagtgacagccaatgtttt

SEQ ID NO: 7509809 - DNA, 22 bp, Homo sapiens
tcacagtgacagccaatgtttt

SEQ ID NO: 7509810 - DNA, 22 bp, Homo sapiens
tcacagtgacttacagagattg

SEQ ID NO: 7509811 - DNA, 22 bp, Homo sapiens
tcacagtgacttacagagattg

SEQ ID NO: 7509812 - DNA, 22 bp, Homo sapiens
tcacagtgacttacagagattg

SEQ ID NO: 7509813 - DNA, 22 bp, Homo sapiens
tcacagtgacttacagagattg

SEQ ID NO: 7509814 - DNA, 22 bp, Homo sapiens
tcacagtgacttacagagattg

SEQ ID NO: 7509815 - DNA, 22 bp, Homo sapiens
tcacagtcggtgacttcttgct

SEQ ID NO: 7509816 - DNA, 22 bp, Homo sapiens
tcacagtcggtgacttcttgct

SEQ ID NO: 7509817 - DNA, 22 bp, Homo sapiens
tcacagtgacagccaatgtttt

SEQ ID NO: 7509818 - DNA, 22 bp, Homo sapiens
tcacagtgacagccaatgtttt

SEQ ID NO: 7509819 - DNA, 22 bp, Homo sapiens
tcacagtcggtgacttcttgct

SEQ ID NO: 7509820 - DNA, 22 bp, Homo sapiens
tcacagtgacagccaatgtttt

SEQ ID NO: 7509821 - DNA, 22 bp, Homo sapiens
tcacagtgacagccaatgtttt

SEQ ID NO: 7509822 - DNA, 22 bp, Homo sapiens
tcacagtattcatgaacatgga

SEQ ID NO: 7509823 - DNA, 23 bp, Homo sapiens
tcacagtatctctggagccatag

SEQ ID NO: 7509824 - DNA, 23 bp, Homo sapiens
tcacagtatctctggagccatag

SEQ ID NO: 7509825 - DNA, 22 bp, Homo sapiens
tcacagtattgggggtggagga

SEQ ID NO: 7509826 - DNA, 22 bp, Homo sapiens
tcacagtatctagaaatgaggg

SEQ ID NO: 7509827 - DNA, 22 bp, Homo sapiens
tcacagtatctagaaatgaggg

SEQ ID NO: 7509828 - DNA, 22 bp, Homo sapiens
tcacagtatctagaaatgaggg

SEQ ID NO: 7509829 - DNA, 22 bp, Homo sapiens
tcacagtatcaggtggagtgga

SEQ ID NO: 7509830 - DNA, 22 bp, Homo sapiens
tcacagtatcaggtggagtgga

SEQ ID NO: 7509831 - DNA, 22 bp, Homo sapiens
tcacagtatcacacaaggatta

SEQ ID NO: 7509832 - DNA, 22 bp, Homo sapiens
tcacagtatcacacaaggatta

SEQ ID NO: 7509833 - DNA, 22 bp, Homo sapiens
tcacagtatcacacaaggatta

SEQ ID NO: 7509834 - DNA, 22 bp, Homo sapiens
tcaagaaggagactccactgtg

SEQ ID NO: 7509835 - DNA, 22 bp, Homo sapiens
tcacagtatcacacaaggatta

SEQ ID NO: 7509836 - DNA, 22 bp, Homo sapiens
tcacagtatcacacaaggatta

SEQ ID NO: 7509837 - DNA, 22 bp, Homo sapiens
tcaagaaggagactccactgtg

SEQ ID NO: 7509838 - DNA, 22 bp, Homo sapiens
tcaagaacttaggagcaagcca

SEQ ID NO: 7509839 - DNA, 22 bp, Homo sapiens
tcaagaactgtgaagagtctga

SEQ ID NO: 7509840 - DNA, 22 bp, Homo sapiens
tcaagaagataatgtctagggt

SEQ ID NO: 7509841 - DNA, 22 bp, Homo sapiens
tcaagaagataatgtctagggt

SEQ ID NO: 7509842 - DNA, 22 bp, Homo sapiens
tcaagaaggagactccactgtg

SEQ ID NO: 7509843 - DNA, 22 bp, Homo sapiens
tcaagaactgtgaagagtctga

SEQ ID NO: 7509844 - DNA, 22 bp, Homo sapiens
tcaagaactgtgaagagtctga

SEQ ID NO: 7509845 - DNA, 22 bp, Homo sapiens
tcaagaactggaaattgatatg

SEQ ID NO: 7509846 - DNA, 22 bp, Homo sapiens
tcaagaactggaaattgatatg

SEQ ID NO: 7509847 - DNA, 22 bp, Homo sapiens
tcaagaactggaaattgatatg

SEQ ID NO: 7509848 - DNA, 22 bp, Homo sapiens
tcaagaaagggcttcaccagga

SEQ ID NO: 7509849 - DNA, 22 bp, Homo sapiens
tcaagaaatgtgcttggatata

SEQ ID NO: 7509850 - DNA, 22 bp, Homo sapiens
tcaagaaatgtgcttggatata

SEQ ID NO: 7509851 - DNA, 22 bp, Homo sapiens
tcacatttatttcaaagttact

SEQ ID NO: 7509852 - DNA, 22 bp, Homo sapiens
tcacatttatttcaaagttact

SEQ ID NO: 7509853 - DNA, 22 bp, Homo sapiens
tcacatttatttcaaagttact

SEQ ID NO: 7509854 - DNA, 22 bp, Homo sapiens
tcacatttatttcaaagttact

SEQ ID NO: 7509855 - DNA, 22 bp, Homo sapiens
tcacatttatttcaaagttact

SEQ ID NO: 7509856 - DNA, 23 bp, Homo sapiens
tcacatttaacccctcagacctc

SEQ ID NO: 7509857 - DNA, 22 bp, Homo sapiens
tcacatttatttcaaagttact

SEQ ID NO: 7509858 - DNA, 22 bp, Homo sapiens
tcacatttcaagtgctcaaaag

SEQ ID NO: 7509859 - DNA, 22 bp, Homo sapiens
tcacatttcaagtgctcaaaag

SEQ ID NO: 7509860 - DNA, 22 bp, Homo sapiens
tcacatttcaagtgctcaaaag

SEQ ID NO: 7509861 - DNA, 22 bp, Homo sapiens
tcacatttcaagtgctcaaaag

SEQ ID NO: 7509862 - DNA, 22 bp, Homo sapiens
tcacatttctcagcactgatga

SEQ ID NO: 7509863 - DNA, 22 bp, Homo sapiens
tcacatttctcagcactgatga

SEQ ID NO: 7509864 - DNA, 22 bp, Homo sapiens
tcacatttctcagcactgatga

SEQ ID NO: 7509865 - DNA, 22 bp, Homo sapiens
tcacatttcgcatcagtccgat

SEQ ID NO: 7509866 - DNA, 22 bp, Homo sapiens
tcacatttctcagcactgatga

SEQ ID NO: 7509867 - DNA, 22 bp, Homo sapiens
tcacatttcacatgggaggagg

SEQ ID NO: 7509868 - DNA, 22 bp, Homo sapiens
tcacatttcacatgggaggagg

SEQ ID NO: 7509869 - DNA, 21 bp, Homo sapiens
tcacatttctcatgggtaaat

SEQ ID NO: 7509870 - DNA, 21 bp, Homo sapiens
tcacatttctcatgggtaaat

SEQ ID NO: 7509871 - DNA, 21 bp, Homo sapiens
tcacatttctcatgggtaaat

SEQ ID NO: 7509872 - DNA, 21 bp, Homo sapiens
tcacatttctcatgggtaaat

SEQ ID NO: 7509873 - DNA, 21 bp, Homo sapiens
tcacatttctcatgggtaaat

SEQ ID NO: 7509874 - DNA, 22 bp, Homo sapiens
tcacatttctcagcactgatga

SEQ ID NO: 7509875 - DNA, 22 bp, Homo sapiens
tcacatttctgattataccaaa

SEQ ID NO: 7509876 - DNA, 22 bp, Homo sapiens
tcacatttctgattataccaaa

SEQ ID NO: 7509877 - DNA, 22 bp, Homo sapiens
tcacatttctgattataccaaa

SEQ ID NO: 7509878 - DNA, 22 bp, Homo sapiens
tcacatttgataatgcccattg

SEQ ID NO: 7509879 - DNA, 22 bp, Homo sapiens
tcacatttctttatgtagtctt

SEQ ID NO: 7509880 - DNA, 22 bp, Homo sapiens
tcacatttctgattataccaaa

SEQ ID NO: 7509881 - DNA, 22 bp, Homo sapiens
tcacatttctttatgtagtctt

SEQ ID NO: 7509882 - DNA, 22 bp, Homo sapiens
tcacatttctttatgtagtctt

SEQ ID NO: 7509883 - DNA, 22 bp, Homo sapiens
tcacatttctttatgtagtctt

SEQ ID NO: 7509884 - DNA, 22 bp, Homo sapiens
tcacatttctgattataccaaa

SEQ ID NO: 7509885 - DNA, 21 bp, Homo sapiens
tcacatgcttattcctggaat

SEQ ID NO: 7509886 - DNA, 21 bp, Homo sapiens
tcacatgcttattcctggaat

SEQ ID NO: 7509887 - DNA, 21 bp, Homo sapiens
tcacatgcttattcctggaat

SEQ ID NO: 7509888 - DNA, 22 bp, Homo sapiens
tcacatgcttgaggaaagaaaa

SEQ ID NO: 7509889 - DNA, 22 bp, Homo sapiens
tcacatgctgtgtgtggagatc

SEQ ID NO: 7509890 - DNA, 22 bp, Homo sapiens
tcacatgctgtgtgtggagatc

SEQ ID NO: 7509891 - DNA, 22 bp, Homo sapiens
tcacatgctgtgggatctgtat

SEQ ID NO: 7509892 - DNA, 22 bp, Homo sapiens
tcacatgctgtgggatctgtat

SEQ ID NO: 7509893 - DNA, 22 bp, Homo sapiens
tcacatgctcacctaagccaca

SEQ ID NO: 7509894 - DNA, 22 bp, Homo sapiens
tcacatgctcacctaagccaca

SEQ ID NO: 7509895 - DNA, 22 bp, Homo sapiens
tcacatgctactgagccagacc

SEQ ID NO: 7509896 - DNA, 22 bp, Homo sapiens
tcacatgctactgagccagacc

SEQ ID NO: 7509897 - DNA, 22 bp, Homo sapiens
tcacatgctactgagccagacc

SEQ ID NO: 7509898 - DNA, 22 bp, Homo sapiens
tcacatgctactgagccagacc

SEQ ID NO: 7509899 - DNA, 22 bp, Homo sapiens
tcacatgctactgagccagacc

SEQ ID NO: 7509900 - DNA, 22 bp, Homo sapiens
tcacattgtaggtcatttgcaa

SEQ ID NO: 7509901 - DNA, 22 bp, Homo sapiens
tcacattgtaggatagcagaga

SEQ ID NO: 7509902 - DNA, 22 bp, Homo sapiens
tcacattgctcccatagtggat

SEQ ID NO: 7509903 - DNA, 22 bp, Homo sapiens
tcacattggaccttcctgacaa

SEQ ID NO: 7509904 - DNA, 22 bp, Homo sapiens
tcacattgccgtctgtgcactt

SEQ ID NO: 7509905 - DNA, 22 bp, Homo sapiens
tcacattgccgtctgtgcactt

SEQ ID NO: 7509906 - DNA, 22 bp, Homo sapiens
tcacattgttatgtaaatgttt

SEQ ID NO: 7509907 - DNA, 22 bp, Homo sapiens
tcacattgttcttagtttacct

SEQ ID NO: 7509908 - DNA, 22 bp, Homo sapiens
tcacatttaaacaggaggatta

SEQ ID NO: 7509909 - DNA, 22 bp, Homo sapiens
tcacatttaaacaggaggatta

SEQ ID NO: 7509910 - DNA, 22 bp, Homo sapiens
tcacatttatactccatttgca

SEQ ID NO: 7509911 - DNA, 22 bp, Homo sapiens
tcacatttatactccatttgca

SEQ ID NO: 7509912 - DNA, 23 bp, Homo sapiens
tcacatttaacccctcagacctc

SEQ ID NO: 7509913 - DNA, 22 bp, Homo sapiens
tcacatttatttcaaagttact

SEQ ID NO: 7509914 - DNA, 22 bp, Homo sapiens
tcacagtgcaggatcagttaat

SEQ ID NO: 7509915 - DNA, 22 bp, Homo sapiens
tcacagtgcaggatcagttaat

SEQ ID NO: 7509916 - DNA, 19 bp, Homo sapiens
tcacagtgcagaaccctcc

SEQ ID NO: 7509917 - DNA, 19 bp, Homo sapiens
tcacagtgcagaaccctcc

SEQ ID NO: 7509918 - DNA, 19 bp, Homo sapiens
tcacagtgcagaaccctcc

SEQ ID NO: 7509919 - DNA, 22 bp, Homo sapiens
tcacagtgcaggatcagttaat

SEQ ID NO: 7509920 - DNA, 22 bp, Homo sapiens
tcacagtgcaggatcagttaat

SEQ ID NO: 7509921 - DNA, 22 bp, Homo sapiens
tcacagtgcacccctcacaggg

SEQ ID NO: 7509922 - DNA, 19 bp, Homo sapiens
tcacagtgcagaaccctcc

SEQ ID NO: 7509923 - DNA, 19 bp, Homo sapiens
tcacagtgcagaaccctcc

SEQ ID NO: 7509924 - DNA, 22 bp, Homo sapiens
tcacagtgcacccctcacaggg

SEQ ID NO: 7509925 - DNA, 22 bp, Homo sapiens
tcacagtgcacccctcacaggg

SEQ ID NO: 7509926 - DNA, 22 bp, Homo sapiens
tcacagtgcacccctcacaggg

SEQ ID NO: 7509927 - DNA, 22 bp, Homo sapiens
tcacagtgcacccctcacaggg

SEQ ID NO: 7509928 - DNA, 22 bp, Homo sapiens
tcacagtgcacccctcacaggg

SEQ ID NO: 7509929 - DNA, 22 bp, Homo sapiens
tcacagtgcaccagtgtgaagc

SEQ ID NO: 7509930 - DNA, 22 bp, Homo sapiens
tcacagtgcacccctcacaggg

SEQ ID NO: 7509931 - DNA, 22 bp, Homo sapiens
tcacagtggagccaccaaggta

SEQ ID NO: 7509932 - DNA, 22 bp, Homo sapiens
tcacagtgggacttttatcgct

SEQ ID NO: 7509933 - DNA, 22 bp, Homo sapiens
tcacagtggagccaccaaggta

SEQ ID NO: 7509934 - DNA, 22 bp, Homo sapiens
tcacagtgggacttttatcgct

SEQ ID NO: 7509935 - DNA, 22 bp, Homo sapiens
tcacagtgggacttttatcgct

SEQ ID NO: 7509936 - DNA, 18 bp, Homo sapiens
tcacagtgctcttgccta

SEQ ID NO: 7509937 - DNA, 18 bp, Homo sapiens
tcacagtgctcttgccta

SEQ ID NO: 7509938 - DNA, 22 bp, Homo sapiens
tcacagtggagccaccaaggta

SEQ ID NO: 7509939 - DNA, 22 bp, Homo sapiens
tcacagtgctctgggtggcaga

SEQ ID NO: 7509940 - DNA, 22 bp, Homo sapiens
tcacagtgctctgggtggcaga

SEQ ID NO: 7509941 - DNA, 22 bp, Homo sapiens
tcacagtgctctgggtggcaga

SEQ ID NO: 7509942 - DNA, 22 bp, Homo sapiens
tcacagtgctctgggtggcaga

SEQ ID NO: 7509943 - DNA, 18 bp, Homo sapiens
tcacagtgctcttgccta

SEQ ID NO: 7509944 - DNA, 18 bp, Homo sapiens
tcacagtgctcttgccta

SEQ ID NO: 7509945 - DNA, 18 bp, Homo sapiens
tcacagtgctcttgccta

SEQ ID NO: 7509946 - DNA, 22 bp, Homo sapiens
tcacagtgcacagcaggcgtgg

SEQ ID NO: 7509947 - DNA, 22 bp, Homo sapiens
tcacagtgcacagcaggcgtgg

SEQ ID NO: 7509948 - DNA, 22 bp, Homo sapiens
tcacagtgatgacgtgggagca

SEQ ID NO: 7509949 - DNA, 22 bp, Homo sapiens
tcacagtgcacagcaggcgtgg

SEQ ID NO: 7509950 - DNA, 22 bp, Homo sapiens
tcacagtgcaccagtgtgaagc

SEQ ID NO: 7509951 - DNA, 22 bp, Homo sapiens
tcacagtgcaccagtgtgaagc

SEQ ID NO: 7509952 - DNA, 22 bp, Homo sapiens
tcacagtgcaccagtgtgaagc

SEQ ID NO: 7509953 - DNA, 22 bp, Homo sapiens
tcacagtgcaccagtgtgaagc

SEQ ID NO: 7509954 - DNA, 22 bp, Homo sapiens
tcacagtgatgacgtgggagca

SEQ ID NO: 7509955 - DNA, 22 bp, Homo sapiens
tcacagtgatgacgtgggagca

SEQ ID NO: 7509956 - DNA, 22 bp, Homo sapiens
tcacagtgatgacgtgggagca

SEQ ID NO: 7509957 - DNA, 22 bp, Homo sapiens
tcacagtgatgacgtgggagca

SEQ ID NO: 7509958 - DNA, 22 bp, Homo sapiens
tcacagtgataactaagtcctg

SEQ ID NO: 7509959 - DNA, 22 bp, Homo sapiens
tcacagtgataactaagtcctg

SEQ ID NO: 7509960 - DNA, 22 bp, Homo sapiens
tcacagtgataactaagtcctg

SEQ ID NO: 7509961 - DNA, 22 bp, Homo sapiens
tcacagtgatgacgtgggagca

SEQ ID NO: 7509962 - DNA, 22 bp, Homo sapiens
tcacagtgatgacgtgggagca

SEQ ID NO: 7509963 - DNA, 22 bp, Homo sapiens
tcacagtgaggcagttcttgta

SEQ ID NO: 7509964 - DNA, 22 bp, Homo sapiens
tcacagtgaggcagttcttgta

SEQ ID NO: 7509965 - DNA, 22 bp, Homo sapiens
tcacagtgataactaagtcctg

SEQ ID NO: 7509966 - DNA, 22 bp, Homo sapiens
tcacagtgataactaagtcctg

SEQ ID NO: 7509967 - DNA, 22 bp, Homo sapiens
tcacagtgaggagttacagttt

SEQ ID NO: 7509968 - DNA, 22 bp, Homo sapiens
tcacagtgaggagttacagttt

SEQ ID NO: 7509969 - DNA, 22 bp, Homo sapiens
tcacagtgaggagttacagttt

SEQ ID NO: 7509970 - DNA, 22 bp, Homo sapiens
tcacagtgaggagttacagttt

SEQ ID NO: 7509971 - DNA, 22 bp, Homo sapiens
tcacagtgaggagttacagttt

SEQ ID NO: 7509972 - DNA, 22 bp, Homo sapiens
tcacagtgagccatgtcagaga

SEQ ID NO: 7509973 - DNA, 22 bp, Homo sapiens
tcacagtgaggagttacagttt

SEQ ID NO: 7509974 - DNA, 22 bp, Homo sapiens
tcacagtgaggagttacagttt

SEQ ID NO: 7509975 - DNA, 22 bp, Homo sapiens
tcacagtgagccatgtcagaga

SEQ ID NO: 7509976 - DNA, 22 bp, Homo sapiens
tcacagtgagccatgtcagaga

SEQ ID NO: 7509977 - DNA, 22 bp, Homo sapiens
tcacagtttcttttctgataaa

SEQ ID NO: 7509978 - DNA, 22 bp, Homo sapiens
tcacagttttaagtgtgatcca

SEQ ID NO: 7509979 - DNA, 22 bp, Homo sapiens
tcacagttttaagtgtgatcca

SEQ ID NO: 7509980 - DNA, 22 bp, Homo sapiens
tcacagttttaagtgtgatcca

SEQ ID NO: 7509981 - DNA, 22 bp, Homo sapiens
tcacagtttcttttctgataaa

SEQ ID NO: 7509982 - DNA, 22 bp, Homo sapiens
tcacagtttccataggtcagca

SEQ ID NO: 7509983 - DNA, 22 bp, Homo sapiens
tcacagtttccataggtcagca

SEQ ID NO: 7509984 - DNA, 22 bp, Homo sapiens
tcacagtgtgaaggtcagtcac

SEQ ID NO: 7509985 - DNA, 22 bp, Homo sapiens
tcacagtgtgaaggtcagtcac

SEQ ID NO: 7509986 - DNA, 22 bp, Homo sapiens
tcacagtgtgaaggtcagtcac

SEQ ID NO: 7509987 - DNA, 22 bp, Homo sapiens
tcacagtgtcgtccttgggtgt

SEQ ID NO: 7509988 - DNA, 22 bp, Homo sapiens
tcacagtgtcacaatgcctgga

SEQ ID NO: 7509989 - DNA, 22 bp, Homo sapiens
tcacagtgtcacaatgcctgga

SEQ ID NO: 7509990 - DNA, 22 bp, Homo sapiens
tcacagtgggacttttatcgct

SEQ ID NO: 7509991 - DNA, 22 bp, Homo sapiens
tcacagtgtcacaatgcctgga

SEQ ID NO: 7509992 - DNA, 22 bp, Homo sapiens
tcacagtgtcacaatgcctgga

SEQ ID NO: 7509993 - DNA, 22 bp, Homo sapiens
tcacagtgtcacaatgcctgga

SEQ ID NO: 7509994 - DNA, 22 bp, Homo sapiens
tcacagtgtcgtccttgggtgt

SEQ ID NO: 7509995 - DNA, 22 bp, Homo sapiens
tcacagtgtcgtccttgggtgt

SEQ ID NO: 7509996 - DNA, 22 bp, Homo sapiens
tcacagtgtcacaatgcctgga

SEQ ID NO: 7509997 - DNA, 22 bp, Homo sapiens
tcacagttttagctgttaaata

SEQ ID NO: 7509998 - DNA, 22 bp, Homo sapiens
tcacagttttagaaaatagata

SEQ ID NO: 7509999 - DNA, 22 bp, Homo sapiens
tcacataaattatacaatttca

SEQ ID NO: 7510000 - DNA, 22 bp, Homo sapiens
tcacagttttagctgttaaata

SEQ ID NO: 7510001 - DNA, 22 bp, Homo sapiens
tcacagttttagctgttaaata

SEQ ID NO: 7510002 - DNA, 22 bp, Homo sapiens
tcacataaattatacaatttca

SEQ ID NO: 7510003 - DNA, 22 bp, Homo sapiens
tcacataaattatacaatttca

SEQ ID NO: 7510004 - DNA, 22 bp, Homo sapiens
tcacataaatttaccagatgat

SEQ ID NO: 7510005 - DNA, 23 bp, Homo sapiens
tcacataatccttcatccacagg

SEQ ID NO: 7510006 - DNA, 22 bp, Homo sapiens
tcacatacactaggatattttt

SEQ ID NO: 7510007 - DNA, 22 bp, Homo sapiens
tcacatacactaggatattttt

SEQ ID NO: 7510008 - DNA, 22 bp, Homo sapiens
tcacatactgaaagtccagtga

SEQ ID NO: 7510009 - DNA, 23 bp, Homo sapiens
tcacataatccttcatccacagg

SEQ ID NO: 7510010 - DNA, 23 bp, Homo sapiens
tcacataatccttcatccacagg

SEQ ID NO: 7510011 - DNA, 23 bp, Homo sapiens
tcacataatccttcatccacagg

SEQ ID NO: 7510012 - DNA, 23 bp, Homo sapiens
tcacataatccttcatccacagg

SEQ ID NO: 7510013 - DNA, 22 bp, Homo sapiens
tcactgcaacctccacctcccg

SEQ ID NO: 7510014 - DNA, 22 bp, Homo sapiens
tcactgcaacctccacctcccg

SEQ ID NO: 7510015 - DNA, 22 bp, Homo sapiens
tcactgcaacctccacctcccg

SEQ ID NO: 7510016 - DNA, 22 bp, Homo sapiens
tcactgcaacctccacctcccg

SEQ ID NO: 7510017 - DNA, 22 bp, Homo sapiens
tcactgcaacctccacctcccg

SEQ ID NO: 7510018 - DNA, 22 bp, Homo sapiens
tcactgcaacctccacctcccg

SEQ ID NO: 7510019 - DNA, 22 bp, Homo sapiens
tcactgcaacctccacctcccg

SEQ ID NO: 7510020 - DNA, 22 bp, Homo sapiens
tcactgcaacctccacctcccg

SEQ ID NO: 7510021 - DNA, 22 bp, Homo sapiens
tcactgcaacctccacctcccg

SEQ ID NO: 7510022 - DNA, 22 bp, Homo sapiens
tcactgcaacctccacctcccg

SEQ ID NO: 7510023 - DNA, 22 bp, Homo sapiens
tcactgcaacctccacctcccg

SEQ ID NO: 7510024 - DNA, 22 bp, Homo sapiens
tcactgcaacctccacctcccg

SEQ ID NO: 7510025 - DNA, 22 bp, Homo sapiens
tcactgcaacctccacctcccg

SEQ ID NO: 7510026 - DNA, 22 bp, Homo sapiens
tcactgcaacctccacctcccg

SEQ ID NO: 7510027 - DNA, 22 bp, Homo sapiens
tcactgcaacctccacctcccg

SEQ ID NO: 7510028 - DNA, 22 bp, Homo sapiens
tcactgcaacctccacctcccg

SEQ ID NO: 7510029 - DNA, 22 bp, Homo sapiens
tcacattttatctattttaagt

SEQ ID NO: 7510030 - DNA, 22 bp, Homo sapiens
tcacattttatatctctggttt

SEQ ID NO: 7510031 - DNA, 22 bp, Homo sapiens
tcacattttatctattttaagt

SEQ ID NO: 7510032 - DNA, 22 bp, Homo sapiens
tcacattttatctattttaagt

SEQ ID NO: 7510033 - DNA, 22 bp, Homo sapiens
tcacattttatctattttaagt

SEQ ID NO: 7510034 - DNA, 22 bp, Homo sapiens
tcacattttatctattttaagt

SEQ ID NO: 7510035 - DNA, 22 bp, Homo sapiens
tcacattttatctattttaagt

SEQ ID NO: 7510036 - DNA, 22 bp, Homo sapiens
tcacattttatctattttaagt

SEQ ID NO: 7510037 - DNA, 22 bp, Homo sapiens
tcactgatttgcccttatcctg

SEQ ID NO: 7510038 - DNA, 22 bp, Homo sapiens
tcactgatttgcccttatcctg

SEQ ID NO: 7510039 - DNA, 22 bp, Homo sapiens
tcactgatttgcccttatcctg

SEQ ID NO: 7510040 - DNA, 22 bp, Homo sapiens
tcactgcaacctccacctcccg

SEQ ID NO: 7510041 - DNA, 22 bp, Homo sapiens
tcactgattatgaaaatgaagg

SEQ ID NO: 7510042 - DNA, 22 bp, Homo sapiens
tcacattttatctattttaagt

SEQ ID NO: 7510043 - DNA, 22 bp, Homo sapiens
tcacattttatctattttaagt

SEQ ID NO: 7510044 - DNA, 22 bp, Homo sapiens
tcactgattatgaaaatgaagg

SEQ ID NO: 7510045 - DNA, 22 bp, Homo sapiens
tcactgattatgaaaatgaagg

SEQ ID NO: 7510046 - DNA, 22 bp, Homo sapiens
tcactgattatgaaaatgaagg

SEQ ID NO: 7510047 - DNA, 22 bp, Homo sapiens
tcacatttgttcctctgcactt

SEQ ID NO: 7510048 - DNA, 22 bp, Homo sapiens
tcacatttgttcctctgcactt

SEQ ID NO: 7510049 - DNA, 22 bp, Homo sapiens
tcacatttgttcctctgcactt

SEQ ID NO: 7510050 - DNA, 22 bp, Homo sapiens
tcacatttgttcctctgcactt

SEQ ID NO: 7510051 - DNA, 22 bp, Homo sapiens
tcacatttgtgttttattagag

SEQ ID NO: 7510052 - DNA, 22 bp, Homo sapiens
tcacatttgttcctctgcactt

SEQ ID NO: 7510053 - DNA, 22 bp, Homo sapiens
tcacatttgttcctctgcactt

SEQ ID NO: 7510054 - DNA, 22 bp, Homo sapiens
tcacatttgttcctctgcactt

SEQ ID NO: 7510055 - DNA, 22 bp, Homo sapiens
tcacattttagtaccatgattt

SEQ ID NO: 7510056 - DNA, 22 bp, Homo sapiens
tcacattttagtaccatgattt

SEQ ID NO: 7510057 - DNA, 22 bp, Homo sapiens
tcacattttagtaccatgattt

SEQ ID NO: 7510058 - DNA, 22 bp, Homo sapiens
tcacattttatatctctggttt

SEQ ID NO: 7510059 - DNA, 22 bp, Homo sapiens
tcacattttatatctctggttt

SEQ ID NO: 7510060 - DNA, 22 bp, Homo sapiens
tcacattttatatctctggttt

SEQ ID NO: 7510061 - DNA, 22 bp, Homo sapiens
tcacattttagtaccatgattt

SEQ ID NO: 7510062 - DNA, 22 bp, Homo sapiens
tcacatttgttcttgaatctaa

SEQ ID NO: 7510063 - DNA, 22 bp, Homo sapiens
tcacatttgttcttgaatctaa

SEQ ID NO: 7510064 - DNA, 22 bp, Homo sapiens
tcacatttgcaattgcattgtt

SEQ ID NO: 7510065 - DNA, 22 bp, Homo sapiens
tcacatttgcaattgcattgtt

SEQ ID NO: 7510066 - DNA, 22 bp, Homo sapiens
tcacatttgcaattgcattgtt

SEQ ID NO: 7510067 - DNA, 22 bp, Homo sapiens
tcacatttgctatcccactcct

SEQ ID NO: 7510068 - DNA, 22 bp, Homo sapiens
tcacatttgcaattgcattgtt

SEQ ID NO: 7510069 - DNA, 22 bp, Homo sapiens
tcacatttgataatgcccattg

SEQ ID NO: 7510070 - DNA, 22 bp, Homo sapiens
tcacatttgcaattgcattgtt

SEQ ID NO: 7510071 - DNA, 22 bp, Homo sapiens
tcacatttgcaattgcattgtt

SEQ ID NO: 7510072 - DNA, 22 bp, Homo sapiens
tcacatttgtgttttattagag

SEQ ID NO: 7510073 - DNA, 22 bp, Homo sapiens
tcacatttgtgttttattagag

SEQ ID NO: 7510074 - DNA, 22 bp, Homo sapiens
tcacatttgtgttttattagag

SEQ ID NO: 7510075 - DNA, 22 bp, Homo sapiens
tcacatttgctatcccactcct

SEQ ID NO: 7510076 - DNA, 22 bp, Homo sapiens
tcacatttggagaaagcctgcc

SEQ ID NO: 7510077 - DNA, 22 bp, Homo sapiens
tcacatttggagaaagcctgcc

SEQ ID NO: 7510078 - DNA, 22 bp, Homo sapiens
tcacatttggagaaagcctgcc

SEQ ID NO: 7510079 - DNA, 22 bp, Homo sapiens
tcactgcaacctccacctcctg

SEQ ID NO: 7510080 - DNA, 22 bp, Homo sapiens
tcactgcaacctccacctcccg

SEQ ID NO: 7510081 - DNA, 22 bp, Homo sapiens
tcactgcaacctccacctcccg

SEQ ID NO: 7510082 - DNA, 22 bp, Homo sapiens
tcactgcaacctccacctcccg

SEQ ID NO: 7510083 - DNA, 22 bp, Homo sapiens
tcactgcaacctccacctcccg

SEQ ID NO: 7510084 - DNA, 22 bp, Homo sapiens
tcactgcaacctccacctcccg

SEQ ID NO: 7510085 - DNA, 22 bp, Homo sapiens
tcactgcaacctccacctcctg

SEQ ID NO: 7510086 - DNA, 22 bp, Homo sapiens
tcactgcaacctccacctcctg

SEQ ID NO: 7510087 - DNA, 22 bp, Homo sapiens
tcactgcaacctccacctcctg

SEQ ID NO: 7510088 - DNA, 22 bp, Homo sapiens
tcactgcaacctccacctcctg

SEQ ID NO: 7510089 - DNA, 22 bp, Homo sapiens
tcactgcaacctccacctcctg

SEQ ID NO: 7510090 - DNA, 22 bp, Homo sapiens
tcactgcaacctccacctcctg

SEQ ID NO: 7510091 - DNA, 22 bp, Homo sapiens
tcactgcaacctccacctcctg

SEQ ID NO: 7510092 - DNA, 22 bp, Homo sapiens
tcactgcaacctccacctcctg

SEQ ID NO: 7510093 - DNA, 22 bp, Homo sapiens
tcactgcaacctccacctcctg

SEQ ID NO: 7510094 - DNA, 22 bp, Homo sapiens
tcactgcaacctccacctcctg

SEQ ID NO: 7510095 - DNA, 22 bp, Homo sapiens
tcactgcaacctccacctcctg

SEQ ID NO: 7510096 - DNA, 22 bp, Homo sapiens
tcactgcgcttcagcctgggtg

SEQ ID NO: 7510097 - DNA, 22 bp, Homo sapiens
tcactgcgcttcagcctgggtg

SEQ ID NO: 7510098 - DNA, 22 bp, Homo sapiens
tcactgcgcttcagcctgggtg

SEQ ID NO: 7510099 - DNA, 22 bp, Homo sapiens
tcactgcatcctccgcctcctg

SEQ ID NO: 7510100 - DNA, 22 bp, Homo sapiens
tcactgcgcttcagcctgggtg

SEQ ID NO: 7510101 - DNA, 22 bp, Homo sapiens
tcactgcgcttcagcctgggtg

SEQ ID NO: 7510102 - DNA, 22 bp, Homo sapiens
tcactgctacacaagtttctgc

SEQ ID NO: 7510103 - DNA, 22 bp, Homo sapiens
tcactgctacacaagtttctgc

SEQ ID NO: 7510104 - DNA, 22 bp, Homo sapiens
tcactgcaacctccacctcctg

SEQ ID NO: 7510105 - DNA, 22 bp, Homo sapiens
tcactgcatcccatctccagcc

SEQ ID NO: 7510106 - DNA, 22 bp, Homo sapiens
tcactgcaacctccacctcctg

SEQ ID NO: 7510107 - DNA, 22 bp, Homo sapiens
tcactgcaacctccacctcctg

SEQ ID NO: 7510108 - DNA, 22 bp, Homo sapiens
tcactgcaacctccacctcctg

SEQ ID NO: 7510109 - DNA, 22 bp, Homo sapiens
tcactgcaacctccacctcctg

SEQ ID NO: 7510110 - DNA, 22 bp, Homo sapiens
tcagaaaatgaaatggactctc

SEQ ID NO: 7510111 - DNA, 22 bp, Homo sapiens
tcagaaaatgaaatggactctc

SEQ ID NO: 7510112 - DNA, 22 bp, Homo sapiens
tcagaaaatgaaatggactctc

SEQ ID NO: 7510113 - DNA, 22 bp, Homo sapiens
tcagaaaatgaaatggactctc

SEQ ID NO: 7510114 - DNA, 22 bp, Homo sapiens
tcagaaaataactgttagtttg

SEQ ID NO: 7510115 - DNA, 22 bp, Homo sapiens
tcagaaaataactgttagtttg

SEQ ID NO: 7510116 - DNA, 22 bp, Homo sapiens
tcactgcttcttggagaatgtc

SEQ ID NO: 7510117 - DNA, 22 bp, Homo sapiens
tcactgcttcttggagaatgtc

SEQ ID NO: 7510118 - DNA, 22 bp, Homo sapiens
tcactgcttcttggagaatgtc

SEQ ID NO: 7510119 - DNA, 22 bp, Homo sapiens
tcactgcttaactcaagatctc

SEQ ID NO: 7510120 - DNA, 22 bp, Homo sapiens
tcactgcttaactcaagatctc

SEQ ID NO: 7510121 - DNA, 22 bp, Homo sapiens
tcactgcttaactcaagatctc

SEQ ID NO: 7510122 - DNA, 22 bp, Homo sapiens
tcactgctgctgccatgatgga

SEQ ID NO: 7510123 - DNA, 22 bp, Homo sapiens
tcactgctgctgccatgatgga

SEQ ID NO: 7510124 - DNA, 22 bp, Homo sapiens
tcactgctctgaaagtacaggg

SEQ ID NO: 7510125 - DNA, 22 bp, Homo sapiens
tcactgctgctgccatgatgga

SEQ ID NO: 7510126 - DNA, 22 bp, Homo sapiens
tcactgctctgaaagtacaggg

SEQ ID NO: 7510127 - DNA, 22 bp, Homo sapiens
tcactgctctgaaagtacaggg

SEQ ID NO: 7510128 - DNA, 22 bp, Homo sapiens
tcactgctctctaagcatcgcc

SEQ ID NO: 7510129 - DNA, 22 bp, Homo sapiens
tcactgctctctaagcatcgcc

SEQ ID NO: 7510130 - DNA, 22 bp, Homo sapiens
tcactgctctgaaagtacaggg

SEQ ID NO: 7510131 - DNA, 22 bp, Homo sapiens
tcactgctctccaatgtggagt

SEQ ID NO: 7510132 - DNA, 22 bp, Homo sapiens
tcactgctcgataacatgatta

SEQ ID NO: 7510133 - DNA, 22 bp, Homo sapiens
tcactgctctccaatgtggagt

SEQ ID NO: 7510134 - DNA, 22 bp, Homo sapiens
tcactgctctccaatgtggagt

SEQ ID NO: 7510135 - DNA, 22 bp, Homo sapiens
tcactgctcgataacatgatta

SEQ ID NO: 7510136 - DNA, 22 bp, Homo sapiens
tcactgctcgataacatgatta

SEQ ID NO: 7510137 - DNA, 22 bp, Homo sapiens
tcactgctcagtctgtactaca

SEQ ID NO: 7510138 - DNA, 22 bp, Homo sapiens
tcactgctatattggatactga

SEQ ID NO: 7510139 - DNA, 23 bp, Homo sapiens
tcactgctactcagcctgagatt

SEQ ID NO: 7510140 - DNA, 22 bp, Homo sapiens
tcactgctatattggatactga

SEQ ID NO: 7510141 - DNA, 22 bp, Homo sapiens
tcactgctcagtctgtactaca

SEQ ID NO: 7510142 - DNA, 22 bp, Homo sapiens
tcactgctatattggatactga

SEQ ID NO: 7510143 - DNA, 23 bp, Homo sapiens
tcactgctactcagcctgagatt

SEQ ID NO: 7510144 - DNA, 23 bp, Homo sapiens
tcactgctactcagcctgagatt

SEQ ID NO: 7510145 - DNA, 23 bp, Homo sapiens
tcactgctactcagcctgagatt

SEQ ID NO: 7510146 - DNA, 23 bp, Homo sapiens
tcactgctactcagcctgagatt

SEQ ID NO: 7510147 - DNA, 23 bp, Homo sapiens
tcactgctactcagcctgagatt

SEQ ID NO: 7510148 - DNA, 23 bp, Homo sapiens
tcactgctactcagcctgagatt

SEQ ID NO: 7510149 - DNA, 23 bp, Homo sapiens
tcagaagtttggttgtaacatgg

SEQ ID NO: 7510150 - DNA, 23 bp, Homo sapiens
tcagaagtttggttgtaacatgg

SEQ ID NO: 7510151 - DNA, 22 bp, Homo sapiens
tcagaataaacatgggcatggg

SEQ ID NO: 7510152 - DNA, 22 bp, Homo sapiens
tcagaataagttatgaaatgaa

SEQ ID NO: 7510153 - DNA, 22 bp, Homo sapiens
tcagaataagttatgaaatgaa

SEQ ID NO: 7510154 - DNA, 20 bp, Homo sapiens
tcagaagtttcctggagcat

SEQ ID NO: 7510155 - DNA, 20 bp, Homo sapiens
tcagaagtttcctggagcat

SEQ ID NO: 7510156 - DNA, 20 bp, Homo sapiens
tcagaagtttcctggagcat

SEQ ID NO: 7510157 - DNA, 22 bp, Homo sapiens
tcagaagttgataaagtagttg

SEQ ID NO: 7510158 - DNA, 22 bp, Homo sapiens
tcagaagttgagatattcaggg

SEQ ID NO: 7510159 - DNA, 22 bp, Homo sapiens
tcagaagtttcaatcccagctg

SEQ ID NO: 7510160 - DNA, 22 bp, Homo sapiens
tcagaagtttcaatcccagctg

SEQ ID NO: 7510161 - DNA, 22 bp, Homo sapiens
tcagaatatgctaatgacattt

SEQ ID NO: 7510162 - DNA, 22 bp, Homo sapiens
tcagaatatattcatgttgtca

SEQ ID NO: 7510163 - DNA, 22 bp, Homo sapiens
tcagaatatattcatgttgtca

SEQ ID NO: 7510164 - DNA, 22 bp, Homo sapiens
tcagaatatattcatgttgtca

SEQ ID NO: 7510165 - DNA, 23 bp, Homo sapiens
tcagaataataacctagtaactg

SEQ ID NO: 7510166 - DNA, 23 bp, Homo sapiens
tcagaataataacctagtaactg

SEQ ID NO: 7510167 - DNA, 22 bp, Homo sapiens
tcagaataagttatgaaatgaa

SEQ ID NO: 7510168 - DNA, 22 bp, Homo sapiens
tcagaataagttatgaaatgaa

SEQ ID NO: 7510169 - DNA, 22 bp, Homo sapiens
tcagaatgaaatttctttcaga

SEQ ID NO: 7510170 - DNA, 23 bp, Homo sapiens
tcagaatgcactgaatttaccct

SEQ ID NO: 7510171 - DNA, 19 bp, Homo sapiens
tcagaatgactactcatgt

SEQ ID NO: 7510172 - DNA, 23 bp, Homo sapiens
tcagaatgcactgaatttaccct

SEQ ID NO: 7510173 - DNA, 22 bp, Homo sapiens
tcagaatggacccagactatag

SEQ ID NO: 7510174 - DNA, 22 bp, Homo sapiens
tcagaatggacccagactatag

SEQ ID NO: 7510175 - DNA, 22 bp, Homo sapiens
tcagaatggcccataaatagtc

SEQ ID NO: 7510176 - DNA, 22 bp, Homo sapiens
tcagaatggcccataaatagtc

SEQ ID NO: 7510177 - DNA, 22 bp, Homo sapiens
tcagaatggcccataaatagtc

SEQ ID NO: 7510178 - DNA, 22 bp, Homo sapiens
tcagaatctttctagagtctag

SEQ ID NO: 7510179 - DNA, 21 bp, Homo sapiens
tcagaatgaaaaggcaatctg

SEQ ID NO: 7510180 - DNA, 22 bp, Homo sapiens
tcagaatgaaatttctttcaga

SEQ ID NO: 7510181 - DNA, 21 bp, Homo sapiens
tcagaatgaaaaggcaatctg

SEQ ID NO: 7510182 - DNA, 22 bp, Homo sapiens
tcagaatgaaatttctttcaga

SEQ ID NO: 7510183 - DNA, 22 bp, Homo sapiens
tcagaatatgctaatgacattt

SEQ ID NO: 7510184 - DNA, 22 bp, Homo sapiens
tcagaatatgctaatgacattt

SEQ ID NO: 7510185 - DNA, 22 bp, Homo sapiens
tcagaatatgctaatgacattt

SEQ ID NO: 7510186 - DNA, 22 bp, Homo sapiens
tcagaatatgctaatgacattt

SEQ ID NO: 7510187 - DNA, 22 bp, Homo sapiens
tcagaatatgctaatgacattt

SEQ ID NO: 7510188 - DNA, 22 bp, Homo sapiens
tcagaatctaaataggctccag

SEQ ID NO: 7510189 - DNA, 22 bp, Homo sapiens
tcagaatctaaataggctccag

SEQ ID NO: 7510190 - DNA, 22 bp, Homo sapiens
tcagaatctctggaggcttggc

SEQ ID NO: 7510191 - DNA, 22 bp, Homo sapiens
tcagaatctgaaaagcgcttgg

SEQ ID NO: 7510192 - DNA, 22 bp, Homo sapiens
tcagaatctgaaaagcgcttgg

SEQ ID NO: 7510193 - DNA, 22 bp, Homo sapiens
tcagaatctctggaggcttggc

SEQ ID NO: 7510194 - DNA, 22 bp, Homo sapiens
tcagaatctgaaaagcgcttgg

SEQ ID NO: 7510195 - DNA, 22 bp, Homo sapiens
tcagaatctgcatttaacaaaa

SEQ ID NO: 7510196 - DNA, 21 bp, Homo sapiens
tcagaatctgtgagctatctc

SEQ ID NO: 7510197 - DNA, 21 bp, Homo sapiens
tcagaatctgtgagctatctc

SEQ ID NO: 7510198 - DNA, 22 bp, Homo sapiens
tcagaagttaatatataaattt

SEQ ID NO: 7510199 - DNA, 22 bp, Homo sapiens
tcagaagttaatacgaggagaa

SEQ ID NO: 7510200 - DNA, 22 bp, Homo sapiens
tcagaagccttgattatctaga

SEQ ID NO: 7510201 - DNA, 22 bp, Homo sapiens
tcagaagttaatatataaattt

SEQ ID NO: 7510202 - DNA, 22 bp, Homo sapiens
tcagaagttgaaggctcttttt

SEQ ID NO: 7510203 - DNA, 22 bp, Homo sapiens
tcagaagttgagatattcaggg

SEQ ID NO: 7510204 - DNA, 22 bp, Homo sapiens
tcagaagccggaagtgctcctc

SEQ ID NO: 7510205 - DNA, 22 bp, Homo sapiens
tcagaagccttgattatctaga

SEQ ID NO: 7510206 - DNA, 22 bp, Homo sapiens
tcagaagccttgattatctaga

SEQ ID NO: 7510207 - DNA, 22 bp, Homo sapiens
tcagaagttaatacgaggagaa

SEQ ID NO: 7510208 - DNA, 22 bp, Homo sapiens
tcagaagctaaatttgatattt

SEQ ID NO: 7510209 - DNA, 22 bp, Homo sapiens
tcagaagctaaatttgatattt

SEQ ID NO: 7510210 - DNA, 22 bp, Homo sapiens
tcagaagccggaagtgctcctc

SEQ ID NO: 7510211 - DNA, 22 bp, Homo sapiens
tcagaagccggaagtgctcctc

SEQ ID NO: 7510212 - DNA, 22 bp, Homo sapiens
tcagaagccgggcaggttttgg

SEQ ID NO: 7510213 - DNA, 22 bp, Homo sapiens
tcagaagccgggcaggttttgg

SEQ ID NO: 7510214 - DNA, 20 bp, Homo sapiens
tcagaacagtagaggagcta

SEQ ID NO: 7510215 - DNA, 22 bp, Homo sapiens
tcagaagccggaagtgctcctc

SEQ ID NO: 7510216 - DNA, 22 bp, Homo sapiens
tcagaagccaccttttgttggg

SEQ ID NO: 7510217 - DNA, 22 bp, Homo sapiens
tcagaacaggactggctgccat

SEQ ID NO: 7510218 - DNA, 22 bp, Homo sapiens
tcagaacagctctcagatatcc

SEQ ID NO: 7510219 - DNA, 22 bp, Homo sapiens
tcagaacaggttgtactatgtc

SEQ ID NO: 7510220 - DNA, 22 bp, Homo sapiens
tcagaacaggactggctgccat

SEQ ID NO: 7510221 - DNA, 22 bp, Homo sapiens
tcagaacaggttgtactatgtc

SEQ ID NO: 7510222 - DNA, 22 bp, Homo sapiens
tcagaacaggttgtactatgtc

SEQ ID NO: 7510223 - DNA, 22 bp, Homo sapiens
tcagaacaggttgtactatgtc

SEQ ID NO: 7510224 - DNA, 22 bp, Homo sapiens
tcagaacaggttgtactatgtc

SEQ ID NO: 7510225 - DNA, 22 bp, Homo sapiens
tcagaacaggttgtactatgtc

SEQ ID NO: 7510226 - DNA, 22 bp, Homo sapiens
tcagaacagcacagggtgattt

SEQ ID NO: 7510227 - DNA, 22 bp, Homo sapiens
tcagaacagcgagaatattcac

SEQ ID NO: 7510228 - DNA, 22 bp, Homo sapiens
tcagaacagcagggtgtggctg

SEQ ID NO: 7510229 - DNA, 22 bp, Homo sapiens
tcagaacagctctcagatatcc

SEQ ID NO: 7510230 - DNA, 22 bp, Homo sapiens
tcagaacagctctcagatatcc

SEQ ID NO: 7510231 - DNA, 22 bp, Homo sapiens
tcagaacagctctcagatatcc

SEQ ID NO: 7510232 - DNA, 22 bp, Homo sapiens
tcagaaagcttagtgtcttgca

SEQ ID NO: 7510233 - DNA, 22 bp, Homo sapiens
tcagaaagctgattcttgatac

SEQ ID NO: 7510234 - DNA, 22 bp, Homo sapiens
tcagaaagcttagtgtcttgca

SEQ ID NO: 7510235 - DNA, 22 bp, Homo sapiens
tcagaaagcttttacttaaaca

SEQ ID NO: 7510236 - DNA, 22 bp, Homo sapiens
tcagaaagcttttacttaaaca

SEQ ID NO: 7510237 - DNA, 22 bp, Homo sapiens
tcagaaagacgaaacagatggg

SEQ ID NO: 7510238 - DNA, 22 bp, Homo sapiens
tcagaaagacgaaacagatggg

SEQ ID NO: 7510239 - DNA, 22 bp, Homo sapiens
tcagaaagacgaaacagatggg

SEQ ID NO: 7510240 - DNA, 22 bp, Homo sapiens
tcagaaagacgaaacagatggg

SEQ ID NO: 7510241 - DNA, 22 bp, Homo sapiens
tcagaaagacgaaacagatggg

SEQ ID NO: 7510242 - DNA, 22 bp, Homo sapiens
tcagaaagctatatggtgtgtc

SEQ ID NO: 7510243 - DNA, 22 bp, Homo sapiens
tcagaaagctatatggtgtgtc

SEQ ID NO: 7510244 - DNA, 22 bp, Homo sapiens
tcagaaagctatatggtgtgtc

SEQ ID NO: 7510245 - DNA, 22 bp, Homo sapiens
tcagaaagctatatggtgtgtc

SEQ ID NO: 7510246 - DNA, 22 bp, Homo sapiens
tcagaaagctatatggtgtgtc

SEQ ID NO: 7510247 - DNA, 22 bp, Homo sapiens
tcagaaagaacacaggcagtag

SEQ ID NO: 7510248 - DNA, 22 bp, Homo sapiens
tcagaaagaacacaggcagtag

SEQ ID NO: 7510249 - DNA, 22 bp, Homo sapiens
tcagaaagacgaaacagatggg

SEQ ID NO: 7510250 - DNA, 22 bp, Homo sapiens
tcagaaagacgaaacagatggg

SEQ ID NO: 7510251 - DNA, 22 bp, Homo sapiens
tcagaaagaacacaggcagtag

SEQ ID NO: 7510252 - DNA, 22 bp, Homo sapiens
tcagaaaccccaacaatggaga

SEQ ID NO: 7510253 - DNA, 22 bp, Homo sapiens
tcagaaaccccaacaatggaga

SEQ ID NO: 7510254 - DNA, 22 bp, Homo sapiens
tcagaaactaaatgtggatttg

SEQ ID NO: 7510255 - DNA, 22 bp, Homo sapiens
tcagaaactaaatgtggatttg

SEQ ID NO: 7510256 - DNA, 22 bp, Homo sapiens
tcagaaagaacacaggcagtag

SEQ ID NO: 7510257 - DNA, 22 bp, Homo sapiens
tcagaaagaacacaggcagtag

SEQ ID NO: 7510258 - DNA, 22 bp, Homo sapiens
tcagaaacactcttcttctgtc

SEQ ID NO: 7510259 - DNA, 22 bp, Homo sapiens
tcagaaaatgaaatggactctc

SEQ ID NO: 7510260 - DNA, 22 bp, Homo sapiens
tcagaaaatgaaatggactctc

SEQ ID NO: 7510261 - DNA, 22 bp, Homo sapiens
tcagaaaatgaaatggactctc

SEQ ID NO: 7510262 - DNA, 22 bp, Homo sapiens
tcagaaacagaaactaagaacc

SEQ ID NO: 7510263 - DNA, 22 bp, Homo sapiens
tcagaaaccagctctctcaatt

SEQ ID NO: 7510264 - DNA, 22 bp, Homo sapiens
tcagaaaccccaacaatggaga

SEQ ID NO: 7510265 - DNA, 22 bp, Homo sapiens
tcagaaaggttgagtcatgtgc

SEQ ID NO: 7510266 - DNA, 22 bp, Homo sapiens
tcagaaaggttgagtcatgtgc

SEQ ID NO: 7510267 - DNA, 22 bp, Homo sapiens
tcagaaaggttctatgttttac

SEQ ID NO: 7510268 - DNA, 22 bp, Homo sapiens
tcagaaaggttctatgttttac

SEQ ID NO: 7510269 - DNA, 22 bp, Homo sapiens
tcagaacaattcctttataaca

SEQ ID NO: 7510270 - DNA, 22 bp, Homo sapiens
tcagaaaggttgagtcatgtgc

SEQ ID NO: 7510271 - DNA, 22 bp, Homo sapiens
tcagaacaattcctttataaca

SEQ ID NO: 7510272 - DNA, 22 bp, Homo sapiens
tcagaacaattcctttataaca

SEQ ID NO: 7510273 - DNA, 22 bp, Homo sapiens
tcagaaaggttctatgttttac

SEQ ID NO: 7510274 - DNA, 22 bp, Homo sapiens
tcagaaaggttctatgttttac

SEQ ID NO: 7510275 - DNA, 22 bp, Homo sapiens
tcagaaaggccacatggtgcag

SEQ ID NO: 7510276 - DNA, 22 bp, Homo sapiens
tcagaaaggttctatgttttac

SEQ ID NO: 7510277 - DNA, 22 bp, Homo sapiens
tcagaaagcttttacttaaaca

SEQ ID NO: 7510278 - DNA, 22 bp, Homo sapiens
tcagaaagcttttacttaaaca

SEQ ID NO: 7510279 - DNA, 22 bp, Homo sapiens
tcagaaagcttttacttaaaca

SEQ ID NO: 7510280 - DNA, 22 bp, Homo sapiens
tcagaaagcttttacttaaaca

SEQ ID NO: 7510281 - DNA, 22 bp, Homo sapiens
tcagaaaggagttagaggtctc

SEQ ID NO: 7510282 - DNA, 22 bp, Homo sapiens
tcagaaaggagttagaggtctc

SEQ ID NO: 7510283 - DNA, 22 bp, Homo sapiens
tcagaaaggagttagaggtctc

SEQ ID NO: 7510284 - DNA, 22 bp, Homo sapiens
tcagaaaggagttagaggtctc

SEQ ID NO: 7510285 - DNA, 22 bp, Homo sapiens
tcagaaaggccacatggtgcag

SEQ ID NO: 7510286 - DNA, 22 bp, Homo sapiens
tcagaaaggagttagaggtctc

SEQ ID NO: 7510287 - DNA, 22 bp, Homo sapiens
tcagaaaggccacatggtgcag

SEQ ID NO: 7510288 - DNA, 22 bp, Homo sapiens
tcagaaaggccacatggtgcag

SEQ ID NO: 7510289 - DNA, 22 bp, Homo sapiens
tcagaaaggccacatggtgcag

SEQ ID NO: 7510290 - DNA, 22 bp, Homo sapiens
tcagaacagaagaaggaacacg

SEQ ID NO: 7510291 - DNA, 22 bp, Homo sapiens
tcagaacagaagctggctataa

SEQ ID NO: 7510292 - DNA, 22 bp, Homo sapiens
tcagaacagaagaaggaacacg

SEQ ID NO: 7510293 - DNA, 22 bp, Homo sapiens
tcagaacagaagaaggaacacg

SEQ ID NO: 7510294 - DNA, 22 bp, Homo sapiens
tcagaacagaagaaggaacacg

SEQ ID NO: 7510295 - DNA, 22 bp, Homo sapiens
tcagaacagcacagggtgattt

SEQ ID NO: 7510296 - DNA, 22 bp, Homo sapiens
tcagaacagaagctggctataa

SEQ ID NO: 7510297 - DNA, 22 bp, Homo sapiens
tcagaacagaagctggctataa

SEQ ID NO: 7510298 - DNA, 22 bp, Homo sapiens
tcagaacagaagaaggaacacg

SEQ ID NO: 7510299 - DNA, 22 bp, Homo sapiens
tcagaacactttctctactgac

SEQ ID NO: 7510300 - DNA, 22 bp, Homo sapiens
tcagaacagaagaaggaacacg

SEQ ID NO: 7510301 - DNA, 22 bp, Homo sapiens
tcagaacactttctctactgac

SEQ ID NO: 7510302 - DNA, 22 bp, Homo sapiens
tcagaacactttctctactgac

SEQ ID NO: 7510303 - DNA, 22 bp, Homo sapiens
tcagaacactttctctactgac

SEQ ID NO: 7510304 - DNA, 22 bp, Homo sapiens
tcagaacactttctctactgac

SEQ ID NO: 7510305 - DNA, 22 bp, Homo sapiens
tcagaacaattgggaaccatta

SEQ ID NO: 7510306 - DNA, 22 bp, Homo sapiens
tcagaacaattgggaaccatta

SEQ ID NO: 7510307 - DNA, 22 bp, Homo sapiens
tcagaacaattgggaaccatta

SEQ ID NO: 7510308 - DNA, 22 bp, Homo sapiens
tcagaacaattcctttataaca

SEQ ID NO: 7510309 - DNA, 22 bp, Homo sapiens
tcatgcaggtttccagccagat

SEQ ID NO: 7510310 - DNA, 22 bp, Homo sapiens
tcatgcagtgaatctttcttgc

SEQ ID NO: 7510311 - DNA, 22 bp, Homo sapiens
tcatgcagtgaatctttcttgc

SEQ ID NO: 7510312 - DNA, 19 bp, Homo sapiens
tcatgcagtggggggtgtg

SEQ ID NO: 7510313 - DNA, 19 bp, Homo sapiens
tcatgcagtggggggtgtg

SEQ ID NO: 7510314 - DNA, 22 bp, Homo sapiens
tcatgcagtgaatctttcttgc

SEQ ID NO: 7510315 - DNA, 19 bp, Homo sapiens
tcatgcagtggggggtgtg

SEQ ID NO: 7510316 - DNA, 22 bp, Homo sapiens
tcatgcagttactgttatgcaa

SEQ ID NO: 7510317 - DNA, 22 bp, Homo sapiens
tcatgcagttactgttatgcaa

SEQ ID NO: 7510318 - DNA, 22 bp, Homo sapiens
tcatgcagtttcttatctgcca

SEQ ID NO: 7510319 - DNA, 22 bp, Homo sapiens
tcatgcagtttcttatctgcca

SEQ ID NO: 7510320 - DNA, 22 bp, Homo sapiens
tcatgcagttttgccacctaag

SEQ ID NO: 7510321 - DNA, 22 bp, Homo sapiens
tcatgcagtttcttatctgcca

SEQ ID NO: 7510322 - DNA, 22 bp, Homo sapiens
tcatgcagtttgaagttcaggg

SEQ ID NO: 7510323 - DNA, 22 bp, Homo sapiens
tcatgcatctgggctggctggt

SEQ ID NO: 7510324 - DNA, 22 bp, Homo sapiens
tcatgcatctgggctggctggt

SEQ ID NO: 7510325 - DNA, 22 bp, Homo sapiens
tcatgcatcaatttctctttag

SEQ ID NO: 7510326 - DNA, 22 bp, Homo sapiens
tcatgcatcaatttctctttag

SEQ ID NO: 7510327 - DNA, 22 bp, Homo sapiens
tcatgcatctgggctggctggt

SEQ ID NO: 7510328 - DNA, 22 bp, Homo sapiens
tcatgcataaccttgactttgt

SEQ ID NO: 7510329 - DNA, 22 bp, Homo sapiens
tcatgcagtttgaagttcaggg

SEQ ID NO: 7510330 - DNA, 22 bp, Homo sapiens
tcatgcagttttgccacctaag

SEQ ID NO: 7510331 - DNA, 22 bp, Homo sapiens
tcatgcataatggtgacaacct

SEQ ID NO: 7510332 - DNA, 22 bp, Homo sapiens
tcatgcataaccttgactttgt

SEQ ID NO: 7510333 - DNA, 22 bp, Homo sapiens
tcatgcataatggtgacaacct

SEQ ID NO: 7510334 - DNA, 22 bp, Homo sapiens
tcatgcagcttttccattcagc

SEQ ID NO: 7510335 - DNA, 22 bp, Homo sapiens
tcatgcagcttttccattcagc

SEQ ID NO: 7510336 - DNA, 22 bp, Homo sapiens
tcatgcaggaccaccccagcat

SEQ ID NO: 7510337 - DNA, 22 bp, Homo sapiens
tcatgcaggaccaccccagcat

SEQ ID NO: 7510338 - DNA, 22 bp, Homo sapiens
tcatgcaggacttacaagagat

SEQ ID NO: 7510339 - DNA, 22 bp, Homo sapiens
tcatgcaggacttacaagagat

SEQ ID NO: 7510340 - DNA, 22 bp, Homo sapiens
tcatgcaggacttacaagagat

SEQ ID NO: 7510341 - DNA, 22 bp, Homo sapiens
tcatgcagcaatatgcattagg

SEQ ID NO: 7510342 - DNA, 23 bp, Homo sapiens
tcatgcagcctggaacctcccag

SEQ ID NO: 7510343 - DNA, 23 bp, Homo sapiens
tcatgcagcctggaacctcccag

SEQ ID NO: 7510344 - DNA, 23 bp, Homo sapiens
tcatgcagcctggaacctcccag

SEQ ID NO: 7510345 - DNA, 22 bp, Homo sapiens
tcatgcagcttttccattcagc

SEQ ID NO: 7510346 - DNA, 22 bp, Homo sapiens
tcatgcagatttggaggtattt

SEQ ID NO: 7510347 - DNA, 22 bp, Homo sapiens
tcatgcagatttggaggtattt

SEQ ID NO: 7510348 - DNA, 22 bp, Homo sapiens
tcatgcagcaatatgcattagg

SEQ ID NO: 7510349 - DNA, 22 bp, Homo sapiens
tcatgcagcaatatgcattagg

SEQ ID NO: 7510350 - DNA, 22 bp, Homo sapiens
tcatgcaggtttccagccagat

SEQ ID NO: 7510351 - DNA, 22 bp, Homo sapiens
tcatgcaggtttccagccagat

SEQ ID NO: 7510352 - DNA, 22 bp, Homo sapiens
tcatgcaggtttccagccagat

SEQ ID NO: 7510353 - DNA, 20 bp, Homo sapiens
tcatgcaggtgttctaggtt

SEQ ID NO: 7510354 - DNA, 22 bp, Homo sapiens
tcatgcaggcagcctttagtaa

SEQ ID NO: 7510355 - DNA, 22 bp, Homo sapiens
tcatgcaggcagcctttagtaa

SEQ ID NO: 7510356 - DNA, 20 bp, Homo sapiens
tcatgcaggtgttctaggtt

SEQ ID NO: 7510357 - DNA, 20 bp, Homo sapiens
tcatgcaggtgttctaggtt

SEQ ID NO: 7510358 - DNA, 21 bp, Homo sapiens
tcatgcaggcagagtttggta

SEQ ID NO: 7510359 - DNA, 22 bp, Homo sapiens
tcatgcaggacttacgagagat

SEQ ID NO: 7510360 - DNA, 21 bp, Homo sapiens
tcatgcaggcagagtttggta

SEQ ID NO: 7510361 - DNA, 22 bp, Homo sapiens
tcatgcaggacttacaagagat

SEQ ID NO: 7510362 - DNA, 22 bp, Homo sapiens
tcatgcaggacttacgagagat

SEQ ID NO: 7510363 - DNA, 22 bp, Homo sapiens
tcatgcaggacttacaagagat

SEQ ID NO: 7510364 - DNA, 22 bp, Homo sapiens
tcatgcaggacttacgagagat

SEQ ID NO: 7510365 - DNA, 22 bp, Homo sapiens
tcatgcaggacttacgagagat

SEQ ID NO: 7510366 - DNA, 22 bp, Homo sapiens
tcattgttcctatttggcaaga

SEQ ID NO: 7510367 - DNA, 22 bp, Homo sapiens
tcattgttatgttttgctgtct

SEQ ID NO: 7510368 - DNA, 20 bp, Homo sapiens
tcattgtgttgccaattccc

SEQ ID NO: 7510369 - DNA, 22 bp, Homo sapiens
tcattgttaactcccagattca

SEQ ID NO: 7510370 - DNA, 22 bp, Homo sapiens
tcattgttaattgtatgatctg

SEQ ID NO: 7510371 - DNA, 22 bp, Homo sapiens
tcattgttaattcctgccggcc

SEQ ID NO: 7510372 - DNA, 22 bp, Homo sapiens
tcattgttactgtttagttgcc

SEQ ID NO: 7510373 - DNA, 22 bp, Homo sapiens
tcattgtcgctctgcggtgttc

SEQ ID NO: 7510374 - DNA, 22 bp, Homo sapiens
tcattgtctctcttttcatata

SEQ ID NO: 7510375 - DNA, 22 bp, Homo sapiens
tcattgtattcagaactgaaga

SEQ ID NO: 7510376 - DNA, 22 bp, Homo sapiens
tcattgtcagctcttgacttct

SEQ ID NO: 7510377 - DNA, 22 bp, Homo sapiens
tcattgtattcagaactgaaga

SEQ ID NO: 7510378 - DNA, 20 bp, Homo sapiens
tcattgtgttgccaattccc

SEQ ID NO: 7510379 - DNA, 19 bp, Homo sapiens
tcattgtgctgagcaaggt

SEQ ID NO: 7510380 - DNA, 23 bp, Homo sapiens
tcattgtgactgtgccacataac

SEQ ID NO: 7510381 - DNA, 22 bp, Homo sapiens
tcattgtcttgatatgattgtc

SEQ ID NO: 7510382 - DNA, 23 bp, Homo sapiens
tcattgtgactgtgccacataac

SEQ ID NO: 7510383 - DNA, 22 bp, Homo sapiens
tcattgccatggcatttgcaga

SEQ ID NO: 7510384 - DNA, 16 bp, Homo sapiens
tcattgctcatgggtc

SEQ ID NO: 7510385 - DNA, 22 bp, Homo sapiens
tcattgctctaggttccttgga

SEQ ID NO: 7510386 - DNA, 22 bp, Homo sapiens
tcattggttgtcacacagggag

SEQ ID NO: 7510387 - DNA, 21 bp, Homo sapiens
tcattggtcattaagctctgt

SEQ ID NO: 7510388 - DNA, 22 bp, Homo sapiens
tcattggtaattatttttgaca

SEQ ID NO: 7510389 - DNA, 22 bp, Homo sapiens
tcattgctctaggttccttgga

SEQ ID NO: 7510390 - DNA, 22 bp, Homo sapiens
tcattgcttcaggacctaccat

SEQ ID NO: 7510391 - DNA, 23 bp, Homo sapiens
tcattgtacatgttccagtggat

SEQ ID NO: 7510392 - DNA, 22 bp, Homo sapiens
tcattgtagggcatttagagag

SEQ ID NO: 7510393 - DNA, 22 bp, Homo sapiens
tcattgtacaattgcatgtgcg

SEQ ID NO: 7510394 - DNA, 22 bp, Homo sapiens
tcattgtacaattgcatgtgcg

SEQ ID NO: 7510395 - DNA, 22 bp, Homo sapiens
tcattgtaattatctgtggtat

SEQ ID NO: 7510396 - DNA, 22 bp, Homo sapiens
tcattgtagggcatttagagag

SEQ ID NO: 7510397 - DNA, 22 bp, Homo sapiens
tcattgtagggcatttagagag

SEQ ID NO: 7510398 - DNA, 22 bp, Homo sapiens
tcattgtatactttatttatga

SEQ ID NO: 7510399 - DNA, 22 bp, Homo sapiens
tcattgtatactttatttatga

SEQ ID NO: 7510400 - DNA, 22 bp, Homo sapiens
tcattgtatactttatttatga

SEQ ID NO: 7510401 - DNA, 22 bp, Homo sapiens
tcattgtatactttatttatga

SEQ ID NO: 7510402 - DNA, 22 bp, Homo sapiens
tcattgtatactttatttatga

SEQ ID NO: 7510403 - DNA, 22 bp, Homo sapiens
tcattgtattaaaatattggtt

SEQ ID NO: 7510404 - DNA, 22 bp, Homo sapiens
tcattgtattaaaatattggtt

SEQ ID NO: 7510405 - DNA, 22 bp, Homo sapiens
tcattgtattaaaatattggtt

SEQ ID NO: 7510406 - DNA, 22 bp, Homo sapiens
tcattgtattcagaactgaaga

SEQ ID NO: 7510407 - DNA, 22 bp, Homo sapiens
tcattgtattcagaactgaaga

SEQ ID NO: 7510408 - DNA, 22 bp, Homo sapiens
tcattgtattcagaactgaaga

SEQ ID NO: 7510409 - DNA, 22 bp, Homo sapiens
tcatttacatagaaacaatata

SEQ ID NO: 7510410 - DNA, 22 bp, Homo sapiens
tcatttacatagaaacaatata

SEQ ID NO: 7510411 - DNA, 22 bp, Homo sapiens
tcatttacatagaaacaatata

SEQ ID NO: 7510412 - DNA, 22 bp, Homo sapiens
tcatttacatgtctttctctga

SEQ ID NO: 7510413 - DNA, 22 bp, Homo sapiens
tcatttacatgtctttctctga

SEQ ID NO: 7510414 - DNA, 22 bp, Homo sapiens
tcatttacatgtctttctctga

SEQ ID NO: 7510415 - DNA, 22 bp, Homo sapiens
tcatttacatgtctttctctga

SEQ ID NO: 7510416 - DNA, 22 bp, Homo sapiens
tcatttacgcgcctccttcctt

SEQ ID NO: 7510417 - DNA, 22 bp, Homo sapiens
tcatttacgcgcctccttcctt

SEQ ID NO: 7510418 - DNA, 19 bp, Homo sapiens
tcatttacggttttgatga

SEQ ID NO: 7510419 - DNA, 19 bp, Homo sapiens
tcatttacggttttgatga

SEQ ID NO: 7510420 - DNA, 19 bp, Homo sapiens
tcatttacggttttgatga

SEQ ID NO: 7510421 - DNA, 19 bp, Homo sapiens
tcatttacggttttgatga

SEQ ID NO: 7510422 - DNA, 22 bp, Homo sapiens
tcatttacttctatgacaacat

SEQ ID NO: 7510423 - DNA, 22 bp, Homo sapiens
tcatttacttctatgacaacat

SEQ ID NO: 7510424 - DNA, 22 bp, Homo sapiens
tcatttacttctatgacaacat

SEQ ID NO: 7510425 - DNA, 19 bp, Homo sapiens
tcatttactttctgggtga

SEQ ID NO: 7510426 - DNA, 22 bp, Homo sapiens
tcatttacttggttttaatctt

SEQ ID NO: 7510427 - DNA, 22 bp, Homo sapiens
tcatttacttggttttaatctt

SEQ ID NO: 7510428 - DNA, 22 bp, Homo sapiens
tcatttacttggttttaatctt

SEQ ID NO: 7510429 - DNA, 22 bp, Homo sapiens
tcatttactgtaggcaaaaatt

SEQ ID NO: 7510430 - DNA, 22 bp, Homo sapiens
tcatttactgtaggagtgaacc

SEQ ID NO: 7510431 - DNA, 22 bp, Homo sapiens
tcatttactgtaggcaaaaatt

SEQ ID NO: 7510432 - DNA, 22 bp, Homo sapiens
tcatttactgtaggcaaaaatt

SEQ ID NO: 7510433 - DNA, 22 bp, Homo sapiens
tcatttactgtaggagtgaacc

SEQ ID NO: 7510434 - DNA, 22 bp, Homo sapiens
tcatttactggatccataagca

SEQ ID NO: 7510435 - DNA, 22 bp, Homo sapiens
tcatttactggatccataagca

SEQ ID NO: 7510436 - DNA, 22 bp, Homo sapiens
tcatttatattgtattctgtag

SEQ ID NO: 7510437 - DNA, 22 bp, Homo sapiens
tcatttatattgtattctgtag

SEQ ID NO: 7510438 - DNA, 22 bp, Homo sapiens
tcatttatattgtattctgtag

SEQ ID NO: 7510439 - DNA, 22 bp, Homo sapiens
tcatttatattgtattctgtag

SEQ ID NO: 7510440 - DNA, 22 bp, Homo sapiens
tcatttatattgtattctgtag

SEQ ID NO: 7510441 - DNA, 22 bp, Homo sapiens
tcatttatagctaaccttgaat

SEQ ID NO: 7510442 - DNA, 22 bp, Homo sapiens
tcatttatagctaaccttgaat

SEQ ID NO: 7510443 - DNA, 22 bp, Homo sapiens
tcatttatagctaaccttgaat

SEQ ID NO: 7510444 - DNA, 22 bp, Homo sapiens
tcatttatagaagtgggcagta

SEQ ID NO: 7510445 - DNA, 22 bp, Homo sapiens
tcatttataaggatgcaattaa

SEQ ID NO: 7510446 - DNA, 22 bp, Homo sapiens
tcatttataaggatgcaattaa

SEQ ID NO: 7510447 - DNA, 22 bp, Homo sapiens
tcatttataaggatgcaattaa

SEQ ID NO: 7510448 - DNA, 22 bp, Homo sapiens
tcatttataaggatgcaattaa

SEQ ID NO: 7510449 - DNA, 22 bp, Homo sapiens
tcatttataaggatgcaattaa

SEQ ID NO: 7510450 - DNA, 22 bp, Homo sapiens
tcatttacagactgtgtgggtg

SEQ ID NO: 7510451 - DNA, 22 bp, Homo sapiens
tcatttacagactgtgtgggtg

SEQ ID NO: 7510452 - DNA, 22 bp, Homo sapiens
tcatttacacttcacaaatgga

SEQ ID NO: 7510453 - DNA, 22 bp, Homo sapiens
tcatttacacttcacaaatgga

SEQ ID NO: 7510454 - DNA, 22 bp, Homo sapiens
tcatttacaggtgaagcaacta

SEQ ID NO: 7510455 - DNA, 22 bp, Homo sapiens
tcatttacaggtgaagcaacta

SEQ ID NO: 7510456 - DNA, 22 bp, Homo sapiens
tcatttacaggtgaagcaacta

SEQ ID NO: 7510457 - DNA, 22 bp, Homo sapiens
tcatttacatagaaacaatata

SEQ ID NO: 7510458 - DNA, 22 bp, Homo sapiens
tcatttacatagaaacaatata

SEQ ID NO: 7510459 - DNA, 22 bp, Homo sapiens
tcatttacatagaaacaatata

SEQ ID NO: 7510460 - DNA, 22 bp, Homo sapiens
tcatttacatagaaacaatata

SEQ ID NO: 7510461 - DNA, 22 bp, Homo sapiens
tcatttacatagaaacaatata

SEQ ID NO: 7510462 - DNA, 22 bp, Homo sapiens
tcatttacatagaaacaatata

SEQ ID NO: 7510463 - DNA, 22 bp, Homo sapiens
tcatttaattggttttgctcgt

SEQ ID NO: 7510464 - DNA, 22 bp, Homo sapiens
tcatttaattggttttgctcgt

SEQ ID NO: 7510465 - DNA, 22 bp, Homo sapiens
tcatttaatagcttttgtcttt

SEQ ID NO: 7510466 - DNA, 22 bp, Homo sapiens
tcatttaattggttttgctcgt

SEQ ID NO: 7510467 - DNA, 22 bp, Homo sapiens
tcatttacacttcacaaatgga

SEQ ID NO: 7510468 - DNA, 22 bp, Homo sapiens
tcatttacacttcacaaatgga

SEQ ID NO: 7510469 - DNA, 22 bp, Homo sapiens
tcatttaataatttttgagtag

SEQ ID NO: 7510470 - DNA, 22 bp, Homo sapiens
tcatttaataatttttgagtag

SEQ ID NO: 7510471 - DNA, 22 bp, Homo sapiens
tcatttaataatttttgagtag

SEQ ID NO: 7510472 - DNA, 22 bp, Homo sapiens
tcatttaatagcttttgtcttt

SEQ ID NO: 7510473 - DNA, 22 bp, Homo sapiens
tcatttaatagcttttgtcttt

SEQ ID NO: 7510474 - DNA, 22 bp, Homo sapiens
tcatttaatagcttttgtcttt

SEQ ID NO: 7510475 - DNA, 22 bp, Homo sapiens
tcatttaaaatgtaccaggatt

SEQ ID NO: 7510476 - DNA, 22 bp, Homo sapiens
tcatttaaaatgtaccaggatt

SEQ ID NO: 7510477 - DNA, 22 bp, Homo sapiens
tcatttaaaatgtaccaggatt

SEQ ID NO: 7510478 - DNA, 22 bp, Homo sapiens
tcattgttttgattccttcatg

SEQ ID NO: 7510479 - DNA, 22 bp, Homo sapiens
tcatttaaaatgtaccaggatt

SEQ ID NO: 7510480 - DNA, 22 bp, Homo sapiens
tcattgtttctgcttttcatga

SEQ ID NO: 7510481 - DNA, 22 bp, Homo sapiens
tcatttaataatttttgagtag

SEQ ID NO: 7510482 - DNA, 22 bp, Homo sapiens
tcatttaaaatgtaccaggatt

SEQ ID NO: 7510483 - DNA, 22 bp, Homo sapiens
tcatttaaaatgtaccaggatt

SEQ ID NO: 7510484 - DNA, 22 bp, Homo sapiens
tcatttaaaatgtaccaggatt

SEQ ID NO: 7510485 - DNA, 22 bp, Homo sapiens
tcatttaataatttttgagtag

SEQ ID NO: 7510486 - DNA, 22 bp, Homo sapiens
tcattgtttctgcttttcatga

SEQ ID NO: 7510487 - DNA, 22 bp, Homo sapiens
tcattgtttctgcttttcatga

SEQ ID NO: 7510488 - DNA, 22 bp, Homo sapiens
tcattgtttctgcttttcatga

SEQ ID NO: 7510489 - DNA, 22 bp, Homo sapiens
tcattgttgcgttaatgtcttc

SEQ ID NO: 7510490 - DNA, 22 bp, Homo sapiens
tcattgttgacataccaagagc

SEQ ID NO: 7510491 - DNA, 21 bp, Homo sapiens
tcattgttgcatggtaggggg

SEQ ID NO: 7510492 - DNA, 22 bp, Homo sapiens
tcattgttcctatttggcaaga

SEQ ID NO: 7510493 - DNA, 22 bp, Homo sapiens
tcattgttgcgttaatgtcttc

SEQ ID NO: 7510494 - DNA, 22 bp, Homo sapiens
tcatttctgttgtgcatcactg

SEQ ID NO: 7510495 - DNA, 22 bp, Homo sapiens
tcatttctgttgtgcatcactg

SEQ ID NO: 7510496 - DNA, 22 bp, Homo sapiens
tcatttctgttgtgcatcactg

SEQ ID NO: 7510497 - DNA, 22 bp, Homo sapiens
tcatttctgagccttccatgat

SEQ ID NO: 7510498 - DNA, 22 bp, Homo sapiens
tcatttctgagccttccatgat

SEQ ID NO: 7510499 - DNA, 22 bp, Homo sapiens
tcatttctgttgtgcatcactg

SEQ ID NO: 7510500 - DNA, 22 bp, Homo sapiens
tcatttctgagccttccatgat

SEQ ID NO: 7510501 - DNA, 22 bp, Homo sapiens
tcatttctctgagtctgataat

SEQ ID NO: 7510502 - DNA, 22 bp, Homo sapiens
tcatttctgagccttccatgat

SEQ ID NO: 7510503 - DNA, 22 bp, Homo sapiens
tcatttctgagccttccatgat

SEQ ID NO: 7510504 - DNA, 22 bp, Homo sapiens
tcatttctgagccttccatgat

SEQ ID NO: 7510505 - DNA, 22 bp, Homo sapiens
tcatttctctgagtctgataat

SEQ ID NO: 7510506 - DNA, 22 bp, Homo sapiens
tcatttctctgagtctgataat

SEQ ID NO: 7510507 - DNA, 22 bp, Homo sapiens
tcatttctctgagtctgataat

SEQ ID NO: 7510508 - DNA, 22 bp, Homo sapiens
tcatttggagccttcctgtttt

SEQ ID NO: 7510509 - DNA, 23 bp, Homo sapiens
tcatttggacaaggcacagcaga

SEQ ID NO: 7510510 - DNA, 22 bp, Homo sapiens
tcatttggagccttcctgtttt

SEQ ID NO: 7510511 - DNA, 22 bp, Homo sapiens
tcatttggagccttcctgtttt

SEQ ID NO: 7510512 - DNA, 22 bp, Homo sapiens
tcatttggaagcctgagagtgt

SEQ ID NO: 7510513 - DNA, 22 bp, Homo sapiens
tcatttggaagcctgagagtgt

SEQ ID NO: 7510514 - DNA, 23 bp, Homo sapiens
tcatttggacaaggcacagcaga

SEQ ID NO: 7510515 - DNA, 23 bp, Homo sapiens
tcatttggacaaggcacagcaga

SEQ ID NO: 7510516 - DNA, 22 bp, Homo sapiens
tcatttggccttctttgcattg

SEQ ID NO: 7510517 - DNA, 17 bp, Homo sapiens
tcatttgggcctcacaa

SEQ ID NO: 7510518 - DNA, 22 bp, Homo sapiens
tcatttgggtcagttttccata

SEQ ID NO: 7510519 - DNA, 22 bp, Homo sapiens
tcatttggtcctcccaacaagc

SEQ ID NO: 7510520 - DNA, 22 bp, Homo sapiens
tcatttggtattaattttcaga

SEQ ID NO: 7510521 - DNA, 22 bp, Homo sapiens
tcatttcttaactagagtgaac

SEQ ID NO: 7510522 - DNA, 22 bp, Homo sapiens
tcatttcttaactagagtgaac

SEQ ID NO: 7510523 - DNA, 22 bp, Homo sapiens
tcatttctgttgtgcatcactg

SEQ ID NO: 7510524 - DNA, 22 bp, Homo sapiens
tcatttcttaactagagtgaac

SEQ ID NO: 7510525 - DNA, 22 bp, Homo sapiens
tcatttcttaactagagtgaac

SEQ ID NO: 7510526 - DNA, 22 bp, Homo sapiens
tcatttcttaactagagtgaac

SEQ ID NO: 7510527 - DNA, 20 bp, Homo sapiens
tcatttcttggggttccaag

SEQ ID NO: 7510528 - DNA, 22 bp, Homo sapiens
tcatttctctgagtctgataat

SEQ ID NO: 7510529 - DNA, 22 bp, Homo sapiens
tcatttctctgagtctgataat

SEQ ID NO: 7510530 - DNA, 22 bp, Homo sapiens
tcatttctctgagtctgataat

SEQ ID NO: 7510531 - DNA, 22 bp, Homo sapiens
tcatttctctgagtctgataat

SEQ ID NO: 7510532 - DNA, 22 bp, Homo sapiens
tcatttctctgagtctgataat

SEQ ID NO: 7510533 - DNA, 21 bp, Homo sapiens
tcatttctctatgtatttcac

SEQ ID NO: 7510534 - DNA, 21 bp, Homo sapiens
tcatttctctatgtatttcac

SEQ ID NO: 7510535 - DNA, 21 bp, Homo sapiens
tcatttctctatgtatttcac

SEQ ID NO: 7510536 - DNA, 21 bp, Homo sapiens
tcatttctctatgtatttcac

SEQ ID NO: 7510537 - DNA, 22 bp, Homo sapiens
tcatttctcctaagtgaaatat

SEQ ID NO: 7510538 - DNA, 21 bp, Homo sapiens
tcatttctctatgtatttcac

SEQ ID NO: 7510539 - DNA, 21 bp, Homo sapiens
tcatttctctatgtatttcac

SEQ ID NO: 7510540 - DNA, 22 bp, Homo sapiens
tcatttctcctaagtgaaatat

SEQ ID NO: 7510541 - DNA, 22 bp, Homo sapiens
tcatttctcctaagtgaaatat

SEQ ID NO: 7510542 - DNA, 22 bp, Homo sapiens
tcatttctcctaagtgaaatat

SEQ ID NO: 7510543 - DNA, 22 bp, Homo sapiens
tcatttctcctaagtgaaatat

SEQ ID NO: 7510544 - DNA, 22 bp, Homo sapiens
tcatttctcctaagtgaaatat

SEQ ID NO: 7510545 - DNA, 22 bp, Homo sapiens
tcatttctcctaagtgaaatat

SEQ ID NO: 7510546 - DNA, 22 bp, Homo sapiens
tcatttctcctaagtgaaatat

SEQ ID NO: 7510547 - DNA, 22 bp, Homo sapiens
tcatttctattgctactgtctg

SEQ ID NO: 7510548 - DNA, 22 bp, Homo sapiens
tcatttctattgctactgtctg

SEQ ID NO: 7510549 - DNA, 22 bp, Homo sapiens
tcatttctcccggccaaaaact

SEQ ID NO: 7510550 - DNA, 22 bp, Homo sapiens
tcatttctcccggccaaaaact

SEQ ID NO: 7510551 - DNA, 22 bp, Homo sapiens
tcatttctcccggccaaaaact

SEQ ID NO: 7510552 - DNA, 22 bp, Homo sapiens
tcatttctccgacctgctgtcc

SEQ ID NO: 7510553 - DNA, 22 bp, Homo sapiens
tcatttctccgacctgctgtcc

SEQ ID NO: 7510554 - DNA, 22 bp, Homo sapiens
tcatttctccgacctgctgtcc

SEQ ID NO: 7510555 - DNA, 22 bp, Homo sapiens
tcatttctccgacctgctgtcc

SEQ ID NO: 7510556 - DNA, 22 bp, Homo sapiens
tcatttctccgacctgctgtcc

SEQ ID NO: 7510557 - DNA, 22 bp, Homo sapiens
tcatttctccgacctgctgtcc

SEQ ID NO: 7510558 - DNA, 22 bp, Homo sapiens
tcatttatattgtattctgtag

SEQ ID NO: 7510559 - DNA, 22 bp, Homo sapiens
tcatttatattgtattctgtag

SEQ ID NO: 7510560 - DNA, 22 bp, Homo sapiens
tcatttatattgtattctgtag

SEQ ID NO: 7510561 - DNA, 22 bp, Homo sapiens
tcatttatattgtattctgtag

SEQ ID NO: 7510562 - DNA, 22 bp, Homo sapiens
tcatttatcatttgtgctgtag

SEQ ID NO: 7510563 - DNA, 22 bp, Homo sapiens
tcatttatcatttgtgctgtag

SEQ ID NO: 7510564 - DNA, 23 bp, Homo sapiens
tcatttcacagtgagcttcctag

SEQ ID NO: 7510565 - DNA, 22 bp, Homo sapiens
tcatttatcatttgtgctgtag

SEQ ID NO: 7510566 - DNA, 22 bp, Homo sapiens
tcatttatcatttgtgctgtag

SEQ ID NO: 7510567 - DNA, 22 bp, Homo sapiens
tcatttcaatgatactactaag

SEQ ID NO: 7510568 - DNA, 22 bp, Homo sapiens
tcatttcaatgatactactaag

SEQ ID NO: 7510569 - DNA, 21 bp, Homo sapiens
tcatttcagggccttggcttc

SEQ ID NO: 7510570 - DNA, 21 bp, Homo sapiens
tcatttcagggccttggcttc

SEQ ID NO: 7510571 - DNA, 22 bp, Homo sapiens
tcatttcagccatttttaaatg

SEQ ID NO: 7510572 - DNA, 22 bp, Homo sapiens
tcatttcagccatttttaaatg

SEQ ID NO: 7510573 - DNA, 22 bp, Homo sapiens
tcatttcagccatttttaaatg

SEQ ID NO: 7510574 - DNA, 22 bp, Homo sapiens
tcatttcagatgcatttagaat

SEQ ID NO: 7510575 - DNA, 22 bp, Homo sapiens
tcatttcagatgcatttagaat

SEQ ID NO: 7510576 - DNA, 22 bp, Homo sapiens
tcatttcagatgcatttagaat

SEQ ID NO: 7510577 - DNA, 22 bp, Homo sapiens
tcatttcagatgcatttagaat

SEQ ID NO: 7510578 - DNA, 22 bp, Homo sapiens
tcatttcacttctctagggaga

SEQ ID NO: 7510579 - DNA, 17 bp, Homo sapiens
tcatttctaggcactcc

SEQ ID NO: 7510580 - DNA, 22 bp, Homo sapiens
tcatttcctcaaattcaaggtt

SEQ ID NO: 7510581 - DNA, 22 bp, Homo sapiens
tcatttcctcaaattcaaggtt

SEQ ID NO: 7510582 - DNA, 17 bp, Homo sapiens
tcatttctaggcactcc

SEQ ID NO: 7510583 - DNA, 17 bp, Homo sapiens
tcatttctaggcactcc

SEQ ID NO: 7510584 - DNA, 22 bp, Homo sapiens
tcatttctatctatgcagcttc

SEQ ID NO: 7510585 - DNA, 22 bp, Homo sapiens
tcatttctatctatgcagcttc

SEQ ID NO: 7510586 - DNA, 22 bp, Homo sapiens
tcatttcatgtctcaggcactg

SEQ ID NO: 7510587 - DNA, 23 bp, Homo sapiens
tcatttcatccagccttgagagt

SEQ ID NO: 7510588 - DNA, 23 bp, Homo sapiens
tcatttcatccagccttgagagt

SEQ ID NO: 7510589 - DNA, 22 bp, Homo sapiens
tcatttccctcctacaaagagg

SEQ ID NO: 7510590 - DNA, 22 bp, Homo sapiens
tcatttcatgtctcaggcactg

SEQ ID NO: 7510591 - DNA, 22 bp, Homo sapiens
tcatttccctcctacaaagagg

SEQ ID NO: 7510592 - DNA, 22 bp, Homo sapiens
tcatttccctcctacaaagagg

SEQ ID NO: 7510593 - DNA, 17 bp, Homo sapiens
tcatttcagtaaatcca

SEQ ID NO: 7510594 - DNA, 17 bp, Homo sapiens
tcatttcagtaaatcca

SEQ ID NO: 7510595 - DNA, 22 bp, Homo sapiens
tcatttcagtcctctgtgtgag

SEQ ID NO: 7510596 - DNA, 22 bp, Homo sapiens
tcatttcagtcctctgtgtgag

SEQ ID NO: 7510597 - DNA, 22 bp, Homo sapiens
tcatttcagttcagaggccttt

SEQ ID NO: 7510598 - DNA, 22 bp, Homo sapiens
tcatttcagtggcacagaagat

SEQ ID NO: 7510599 - DNA, 22 bp, Homo sapiens
tcatttcagtggcacagaagat

SEQ ID NO: 7510600 - DNA, 23 bp, Homo sapiens
tcatttcatccagccttgagagt

SEQ ID NO: 7510601 - DNA, 23 bp, Homo sapiens
tcatttcatccagccttgagagt

SEQ ID NO: 7510602 - DNA, 23 bp, Homo sapiens
tcatttcatccagccttgagagt

SEQ ID NO: 7510603 - DNA, 22 bp, Homo sapiens
tccaatatttctcacatatgga

SEQ ID NO: 7510604 - DNA, 22 bp, Homo sapiens
tccaatatttctcatatatgga

SEQ ID NO: 7510605 - DNA, 22 bp, Homo sapiens
tccaatatttctcacatatgga

SEQ ID NO: 7510606 - DNA, 22 bp, Homo sapiens
tccaatatttctcacatatgga

SEQ ID NO: 7510607 - DNA, 22 bp, Homo sapiens
tccaataaccacaatcagatag

SEQ ID NO: 7510608 - DNA, 22 bp, Homo sapiens
tccaatatttctcatatatgga

SEQ ID NO: 7510609 - DNA, 22 bp, Homo sapiens
tccaatcatgagtctatactag

SEQ ID NO: 7510610 - DNA, 22 bp, Homo sapiens
tccaatcagggaaagccaggtc

SEQ ID NO: 7510611 - DNA, 22 bp, Homo sapiens
tccaataaccacaatcagatag

SEQ ID NO: 7510612 - DNA, 22 bp, Homo sapiens
tccaataacatctaaaaactta

SEQ ID NO: 7510613 - DNA, 22 bp, Homo sapiens
tccaataaaactcttgaattaa

SEQ ID NO: 7510614 - DNA, 22 bp, Homo sapiens
tccaataaaactcttgaattaa

SEQ ID NO: 7510615 - DNA, 22 bp, Homo sapiens
tccaataacatctaaaaactta

SEQ ID NO: 7510616 - DNA, 20 bp, Homo sapiens
tccaagttataaagtgccaa

SEQ ID NO: 7510617 - DNA, 20 bp, Homo sapiens
tccaagttataaagtgccaa

SEQ ID NO: 7510618 - DNA, 20 bp, Homo sapiens
tccaagttataaagtgccaa

SEQ ID NO: 7510619 - DNA, 22 bp, Homo sapiens
tccaagttctaggaactgctgc

SEQ ID NO: 7510620 - DNA, 22 bp, Homo sapiens
tccaagttgatgtttcttaaat

SEQ ID NO: 7510621 - DNA, 22 bp, Homo sapiens
tccaagttgatgtttcttaaat

SEQ ID NO: 7510622 - DNA, 22 bp, Homo sapiens
tccaagtttcttctgcacaaca

SEQ ID NO: 7510623 - DNA, 22 bp, Homo sapiens
tccaatctagtatgataaatga

SEQ ID NO: 7510624 - DNA, 22 bp, Homo sapiens
tccaatggggcctctctgtcag

SEQ ID NO: 7510625 - DNA, 22 bp, Homo sapiens
tccaatgtgactatcagggagc

SEQ ID NO: 7510626 - DNA, 22 bp, Homo sapiens
tccaatgtgtttgtggcatgga

SEQ ID NO: 7510627 - DNA, 22 bp, Homo sapiens
tccaatgttattatctagaggc

SEQ ID NO: 7510628 - DNA, 20 bp, Homo sapiens
tccaatttaagaatttagag

SEQ ID NO: 7510629 - DNA, 20 bp, Homo sapiens
tccaattaaaaattgtatgc

SEQ ID NO: 7510630 - DNA, 23 bp, Homo sapiens
tccaattcaattgggtcaggaag

SEQ ID NO: 7510631 - DNA, 19 bp, Homo sapiens
tccaatttgtatgttttca

SEQ ID NO: 7510632 - DNA, 22 bp, Homo sapiens
tccaatttgaaatggtatatgt

SEQ ID NO: 7510633 - DNA, 22 bp, Homo sapiens
tccaatttgaaatggtatatgt

SEQ ID NO: 7510634 - DNA, 19 bp, Homo sapiens
tccaatttctattcatgtt

SEQ ID NO: 7510635 - DNA, 19 bp, Homo sapiens
tccaatttctattcatgtt

SEQ ID NO: 7510636 - DNA, 22 bp, Homo sapiens
tccaatttgtttgatgatggaa

SEQ ID NO: 7510637 - DNA, 22 bp, Homo sapiens
tccaatttgtttgatgatggaa

SEQ ID NO: 7510638 - DNA, 22 bp, Homo sapiens
tccaattttacgtctgtataaa

SEQ ID NO: 7510639 - DNA, 22 bp, Homo sapiens
tccaagtataaattagatactg

SEQ ID NO: 7510640 - DNA, 22 bp, Homo sapiens
tccaagtataaattagatactg

SEQ ID NO: 7510641 - DNA, 22 bp, Homo sapiens
tccaagtataaattagatactg

SEQ ID NO: 7510642 - DNA, 21 bp, Homo sapiens
tccaagtctggggcatgtgtg

SEQ ID NO: 7510643 - DNA, 22 bp, Homo sapiens
tccaagtcttccttcccaaacc

SEQ ID NO: 7510644 - DNA, 22 bp, Homo sapiens
tccaagtcttccttcccaaacc

SEQ ID NO: 7510645 - DNA, 23 bp, Homo sapiens
tccaaggttgttgtggaaggggc

SEQ ID NO: 7510646 - DNA, 22 bp, Homo sapiens
tccaagggttcatgtgcattca

SEQ ID NO: 7510647 - DNA, 22 bp, Homo sapiens
tccaagggttcatgtgcattca

SEQ ID NO: 7510648 - DNA, 22 bp, Homo sapiens
tccaaggggaaaggcgccggcg

SEQ ID NO: 7510649 - DNA, 22 bp, Homo sapiens
tccaagggcagcagccatagcc

SEQ ID NO: 7510650 - DNA, 22 bp, Homo sapiens
tccaagggcatgctgaaataag

SEQ ID NO: 7510651 - DNA, 23 bp, Homo sapiens
tccaagggctacaaacacagacc

SEQ ID NO: 7510652 - DNA, 23 bp, Homo sapiens
tccaagggctacaaacacagacc

SEQ ID NO: 7510653 - DNA, 22 bp, Homo sapiens
tccaagggcatgctgaaataag

SEQ ID NO: 7510654 - DNA, 22 bp, Homo sapiens
tccaagggctcatggacacttt

SEQ ID NO: 7510655 - DNA, 22 bp, Homo sapiens
tccaagggctcatggacacttt

SEQ ID NO: 7510656 - DNA, 22 bp, Homo sapiens
tccaagggctttggcgtgaagt

SEQ ID NO: 7510657 - DNA, 22 bp, Homo sapiens
tccaagggctttggcgtgaagt

SEQ ID NO: 7510658 - DNA, 22 bp, Homo sapiens
tccaagggcagcagccatagcc

SEQ ID NO: 7510659 - DNA, 22 bp, Homo sapiens
tccaagggcagcagccatagcc

SEQ ID NO: 7510660 - DNA, 22 bp, Homo sapiens
tccaagggcagccatagaactt

SEQ ID NO: 7510661 - DNA, 22 bp, Homo sapiens
tccaagggcagccatagaactt

SEQ ID NO: 7510662 - DNA, 20 bp, Homo sapiens
tccaagggcagcagaatcag

SEQ ID NO: 7510663 - DNA, 20 bp, Homo sapiens
tccaagggcagcagaatcag

SEQ ID NO: 7510664 - DNA, 22 bp, Homo sapiens
tccaagggaatttaaagttgct

SEQ ID NO: 7510665 - DNA, 22 bp, Homo sapiens
tccaagggcaacaatggaacac

SEQ ID NO: 7510666 - DNA, 22 bp, Homo sapiens
tccaagggcaacaatggaacac

SEQ ID NO: 7510667 - DNA, 22 bp, Homo sapiens
tccaagggaatgtgggcaatgc

SEQ ID NO: 7510668 - DNA, 22 bp, Homo sapiens
tccaagggaatgtgggcaatgc

SEQ ID NO: 7510669 - DNA, 22 bp, Homo sapiens
tccaagggaatgtgggcaatgc

SEQ ID NO: 7510670 - DNA, 22 bp, Homo sapiens
tccaaggctccggccctggcgt

SEQ ID NO: 7510671 - DNA, 22 bp, Homo sapiens
tccaaggctccggccctggcgt

SEQ ID NO: 7510672 - DNA, 22 bp, Homo sapiens
tccaaggctccggccctggcgt

SEQ ID NO: 7510673 - DNA, 22 bp, Homo sapiens
tccaagggaaactgcacttcta

SEQ ID NO: 7510674 - DNA, 22 bp, Homo sapiens
tccaagggaaactgcacttcta

SEQ ID NO: 7510675 - DNA, 22 bp, Homo sapiens
tccaaggcctggcagcacaaag

SEQ ID NO: 7510676 - DNA, 22 bp, Homo sapiens
tccaaggctccggccctggcgt

SEQ ID NO: 7510677 - DNA, 22 bp, Homo sapiens
tccaaggcctggcagcacaaag

SEQ ID NO: 7510678 - DNA, 22 bp, Homo sapiens
tccaaggccgcaggctgggcct

SEQ ID NO: 7510679 - DNA, 22 bp, Homo sapiens
tccaaggccgcaggctgggcct

SEQ ID NO: 7510680 - DNA, 22 bp, Homo sapiens
tccaaggccgcaggctgggcct

SEQ ID NO: 7510681 - DNA, 22 bp, Homo sapiens
tccaaggccgcaggctgggcct

SEQ ID NO: 7510682 - DNA, 22 bp, Homo sapiens
tccaaggccgcaggctgggcct

SEQ ID NO: 7510683 - DNA, 22 bp, Homo sapiens
tccaaatttaccttacagatat

SEQ ID NO: 7510684 - DNA, 22 bp, Homo sapiens
tccaaatttaccttacagatat

SEQ ID NO: 7510685 - DNA, 22 bp, Homo sapiens
tccaaattctatgttctttcca

SEQ ID NO: 7510686 - DNA, 22 bp, Homo sapiens
tccaaattgacagtagtgatta

SEQ ID NO: 7510687 - DNA, 22 bp, Homo sapiens
tccaaattctatgttctttcca

SEQ ID NO: 7510688 - DNA, 22 bp, Homo sapiens
tccaacatgcagtcaggcctag

SEQ ID NO: 7510689 - DNA, 21 bp, Homo sapiens
tccaacatgcctgatggtgcc

SEQ ID NO: 7510690 - DNA, 22 bp, Homo sapiens
tccaacatttatcaaggttgtt

SEQ ID NO: 7510691 - DNA, 22 bp, Homo sapiens
tccaagaagctcagcaaacatc

SEQ ID NO: 7510692 - DNA, 22 bp, Homo sapiens
tccaagaagctcagcaaacatc

SEQ ID NO: 7510693 - DNA, 22 bp, Homo sapiens
tccaagaagctcagcaaacatc

SEQ ID NO: 7510694 - DNA, 22 bp, Homo sapiens
tccaagaagagcctttctcctc

SEQ ID NO: 7510695 - DNA, 22 bp, Homo sapiens
tccaagaagagcctttctcctc

SEQ ID NO: 7510696 - DNA, 22 bp, Homo sapiens
tccaagaacccaagcgaatgcc

SEQ ID NO: 7510697 - DNA, 22 bp, Homo sapiens
tccaacttctgcaatcagtttg

SEQ ID NO: 7510698 - DNA, 22 bp, Homo sapiens
tccaactttctcctccggcttg

SEQ ID NO: 7510699 - DNA, 22 bp, Homo sapiens
tccaactttctcctccggcttg

SEQ ID NO: 7510700 - DNA, 22 bp, Homo sapiens
tccaactttctcctccggcttg

SEQ ID NO: 7510701 - DNA, 22 bp, Homo sapiens
tccaactttctcctccggcttg

SEQ ID NO: 7510702 - DNA, 22 bp, Homo sapiens
tccaaatattatgattatagga

SEQ ID NO: 7510703 - DNA, 22 bp, Homo sapiens
tccaaatattcatctacttctg

SEQ ID NO: 7510704 - DNA, 22 bp, Homo sapiens
tccaaatattatgattatagga

SEQ ID NO: 7510705 - DNA, 22 bp, Homo sapiens
tccaaatattatgattatagga

SEQ ID NO: 7510706 - DNA, 22 bp, Homo sapiens
tccaaatatattcacgtcctag

SEQ ID NO: 7510707 - DNA, 22 bp, Homo sapiens
tccaaatatattcacgtcctag

SEQ ID NO: 7510708 - DNA, 22 bp, Homo sapiens
tccaaatatcttggtggttagg

SEQ ID NO: 7510709 - DNA, 22 bp, Homo sapiens
tccaaatattatgattatagga

SEQ ID NO: 7510710 - DNA, 22 bp, Homo sapiens
tccaaatattcggtctttctga

SEQ ID NO: 7510711 - DNA, 21 bp, Homo sapiens
tccaaatcccattctgtagtc

SEQ ID NO: 7510712 - DNA, 22 bp, Homo sapiens
tccaaattctagggccttggtt

SEQ ID NO: 7510713 - DNA, 22 bp, Homo sapiens
tccaaattctagggccttggtt

SEQ ID NO: 7510714 - DNA, 22 bp, Homo sapiens
tccaaatattcggtctttctga

SEQ ID NO: 7510715 - DNA, 22 bp, Homo sapiens
tccaaatattcatctacttctg

SEQ ID NO: 7510716 - DNA, 22 bp, Homo sapiens
tccaaatattcatctacttctg

SEQ ID NO: 7510717 - DNA, 22 bp, Homo sapiens
tccaaatattcatctacttctg

SEQ ID NO: 7510718 - DNA, 22 bp, Homo sapiens
tccaaggagtcttaagttacat

SEQ ID NO: 7510719 - DNA, 22 bp, Homo sapiens
tccaaggagtcttaagttacat

SEQ ID NO: 7510720 - DNA, 22 bp, Homo sapiens
tccaaggagtcttaagttacat

SEQ ID NO: 7510721 - DNA, 22 bp, Homo sapiens
tccaaggcatagacacagtgcc

SEQ ID NO: 7510722 - DNA, 22 bp, Homo sapiens
tccaaggcatagacacagtgcc

SEQ ID NO: 7510723 - DNA, 22 bp, Homo sapiens
tccaaggcatagacacagtgcc

SEQ ID NO: 7510724 - DNA, 19 bp, Homo sapiens
tccaaggcatggcccagtg

SEQ ID NO: 7510725 - DNA, 19 bp, Homo sapiens
tccaaggcatggcccagtg

SEQ ID NO: 7510726 - DNA, 22 bp, Homo sapiens
tccaaggcatggtgggagagag

SEQ ID NO: 7510727 - DNA, 22 bp, Homo sapiens
tccaaggccgcaggctgggcct

SEQ ID NO: 7510728 - DNA, 19 bp, Homo sapiens
tccaaggcatggcccagtg

SEQ ID NO: 7510729 - DNA, 19 bp, Homo sapiens
tccaaggcatggcccagtg

SEQ ID NO: 7510730 - DNA, 22 bp, Homo sapiens
tccaaggcatagacacagtgcc

SEQ ID NO: 7510731 - DNA, 22 bp, Homo sapiens
tccaaggaggctttgacgtcca

SEQ ID NO: 7510732 - DNA, 22 bp, Homo sapiens
tccaaggagcagatccagagga

SEQ ID NO: 7510733 - DNA, 22 bp, Homo sapiens
tccaaggaggctttgacgtcca

SEQ ID NO: 7510734 - DNA, 22 bp, Homo sapiens
tccaaggagcagtcttcaacct

SEQ ID NO: 7510735 - DNA, 22 bp, Homo sapiens
tccaaggagcagtcttcaacct

SEQ ID NO: 7510736 - DNA, 22 bp, Homo sapiens
tccaaggaggagctggagattg

SEQ ID NO: 7510737 - DNA, 22 bp, Homo sapiens
tccaaggaggagctggagattg

SEQ ID NO: 7510738 - DNA, 22 bp, Homo sapiens
tccaaggaggagctggagattg

SEQ ID NO: 7510739 - DNA, 22 bp, Homo sapiens
tccaaggagcagatccagagga

SEQ ID NO: 7510740 - DNA, 22 bp, Homo sapiens
tccaaggactcttgtcagctgt

SEQ ID NO: 7510741 - DNA, 22 bp, Homo sapiens
tccaaggactcttgtcagctgt

SEQ ID NO: 7510742 - DNA, 22 bp, Homo sapiens
tccaaggagcagatccagagga

SEQ ID NO: 7510743 - DNA, 22 bp, Homo sapiens
tccaaggagcagatccagagga

SEQ ID NO: 7510744 - DNA, 22 bp, Homo sapiens
tccaaggagcagatccagagga

SEQ ID NO: 7510745 - DNA, 22 bp, Homo sapiens
tccaagaagcttacaatctaat

SEQ ID NO: 7510746 - DNA, 22 bp, Homo sapiens
tccaagaagcttacaatctaat

SEQ ID NO: 7510747 - DNA, 22 bp, Homo sapiens
tccaagaagcttacaatctaat

SEQ ID NO: 7510748 - DNA, 22 bp, Homo sapiens
tccaagaagcttacaatctaat

SEQ ID NO: 7510749 - DNA, 22 bp, Homo sapiens
tccaagaagctcagcaaacatc

SEQ ID NO: 7510750 - DNA, 22 bp, Homo sapiens
tccaagctctctatgccatgat

SEQ ID NO: 7510751 - DNA, 22 bp, Homo sapiens
tccaagctactgaaggtttggg

SEQ ID NO: 7510752 - DNA, 22 bp, Homo sapiens
tccaagcttgctttagccacag

SEQ ID NO: 7510753 - DNA, 22 bp, Homo sapiens
tccaagctgtatgttcctagag

SEQ ID NO: 7510754 - DNA, 22 bp, Homo sapiens
tccaagctttccatgccctcac

SEQ ID NO: 7510755 - DNA, 22 bp, Homo sapiens
tccaagcttgctttagccacag

SEQ ID NO: 7510756 - DNA, 22 bp, Homo sapiens
tccaaggaagtcatttaaactg

SEQ ID NO: 7510757 - DNA, 22 bp, Homo sapiens
tccaaggaagtttgcactattg

SEQ ID NO: 7510758 - DNA, 22 bp, Homo sapiens
tccaaggaagtttgcactattg

SEQ ID NO: 7510759 - DNA, 22 bp, Homo sapiens
tccaaggacattgttctagttg

SEQ ID NO: 7510760 - DNA, 22 bp, Homo sapiens
tccaaggacattgttctagttg

SEQ ID NO: 7510761 - DNA, 22 bp, Homo sapiens
tccaaggactaaattctagatt

SEQ ID NO: 7510762 - DNA, 22 bp, Homo sapiens
tccaaggactaaattctagatt

SEQ ID NO: 7510763 - DNA, 22 bp, Homo sapiens
tccaaggactcttgtcagctgt

SEQ ID NO: 7510764 - DNA, 22 bp, Homo sapiens
tccaaggacgctggacccctgc

SEQ ID NO: 7510765 - DNA, 22 bp, Homo sapiens
tcatttgttcatctgctcttct

SEQ ID NO: 7510766 - DNA, 19 bp, Homo sapiens
tcatttgttagtagaagtt

SEQ ID NO: 7510767 - DNA, 22 bp, Homo sapiens
tcatttgttcatctgctcttct

SEQ ID NO: 7510768 - DNA, 22 bp, Homo sapiens
tcatttttagcgcgcaaaagtt

SEQ ID NO: 7510769 - DNA, 22 bp, Homo sapiens
tcatttttagcgcgcaaaagtt

SEQ ID NO: 7510770 - DNA, 21 bp, Homo sapiens
tcatttttattgctaccttgc

SEQ ID NO: 7510771 - DNA, 21 bp, Homo sapiens
tcatttttattgctaccttgc

SEQ ID NO: 7510772 - DNA, 22 bp, Homo sapiens
tcatttttcacacagggtcacc

SEQ ID NO: 7510773 - DNA, 22 bp, Homo sapiens
tcatttttcacacagggtcacc

SEQ ID NO: 7510774 - DNA, 22 bp, Homo sapiens
tcatttttcacacagggtcacc

SEQ ID NO: 7510775 - DNA, 21 bp, Homo sapiens
tcatttttattgctaccttgc

SEQ ID NO: 7510776 - DNA, 21 bp, Homo sapiens
tcatttttattgctaccttgc

SEQ ID NO: 7510777 - DNA, 21 bp, Homo sapiens
tcatttttattgctaccttgc

SEQ ID NO: 7510778 - DNA, 22 bp, Homo sapiens
tcatttttagcgcgcaaaagtt

SEQ ID NO: 7510779 - DNA, 21 bp, Homo sapiens
tcatttttattgctaccttgc

SEQ ID NO: 7510780 - DNA, 21 bp, Homo sapiens
tcatttttattgctaccttgc

SEQ ID NO: 7510781 - DNA, 21 bp, Homo sapiens
tcatttttattgctaccttgc

SEQ ID NO: 7510782 - DNA, 21 bp, Homo sapiens
tcatttttattgctaccttgc

SEQ ID NO: 7510783 - DNA, 22 bp, Homo sapiens
tcatttgtgtgagtgatttgac

SEQ ID NO: 7510784 - DNA, 22 bp, Homo sapiens
tcatttgtgtgagtgatttgac

SEQ ID NO: 7510785 - DNA, 22 bp, Homo sapiens
tcatttgtggaagtgattgtgg

SEQ ID NO: 7510786 - DNA, 22 bp, Homo sapiens
tcatttgtggaagtgattgtgg

SEQ ID NO: 7510787 - DNA, 22 bp, Homo sapiens
tcatttgtggaagtgattgtgg

SEQ ID NO: 7510788 - DNA, 22 bp, Homo sapiens
tcatttgtggaagtgattgtgg

SEQ ID NO: 7510789 - DNA, 21 bp, Homo sapiens
tcatttgtgatctgatttcca

SEQ ID NO: 7510790 - DNA, 22 bp, Homo sapiens
tcatttgtgcaatgtagatgaa

SEQ ID NO: 7510791 - DNA, 21 bp, Homo sapiens
tcatttgtgatctgatttcca

SEQ ID NO: 7510792 - DNA, 21 bp, Homo sapiens
tcatttgtgatctgatttcca

SEQ ID NO: 7510793 - DNA, 22 bp, Homo sapiens
tcatttgtctggcacagggaat

SEQ ID NO: 7510794 - DNA, 22 bp, Homo sapiens
tcatttgtacttgtgtgcttgt

SEQ ID NO: 7510795 - DNA, 22 bp, Homo sapiens
tcatttgtacttgtgtgcttgt

SEQ ID NO: 7510796 - DNA, 22 bp, Homo sapiens
tcatttgtaccattttttaaga

SEQ ID NO: 7510797 - DNA, 22 bp, Homo sapiens
tcatttgtaccattttttaaga

SEQ ID NO: 7510798 - DNA, 22 bp, Homo sapiens
tcatttttctcttacacgtaga

SEQ ID NO: 7510799 - DNA, 22 bp, Homo sapiens
tcatttttctcttacacgtaga

SEQ ID NO: 7510800 - DNA, 22 bp, Homo sapiens
tcatttttctcttacacgtaga

SEQ ID NO: 7510801 - DNA, 22 bp, Homo sapiens
tcatttttctcttacacgtaga

SEQ ID NO: 7510802 - DNA, 22 bp, Homo sapiens
tcatttttctcttacacgtaga

SEQ ID NO: 7510803 - DNA, 22 bp, Homo sapiens
tcatttttctcttacacgtaga

SEQ ID NO: 7510804 - DNA, 22 bp, Homo sapiens
tcatttttcacacagggtcacc

SEQ ID NO: 7510805 - DNA, 22 bp, Homo sapiens
tcatttttctcttacacgtaga

SEQ ID NO: 7510806 - DNA, 22 bp, Homo sapiens
tcatttttctcttacacgtaga

SEQ ID NO: 7510807 - DNA, 22 bp, Homo sapiens
tcatttttctcttacacgtaga

SEQ ID NO: 7510808 - DNA, 22 bp, Homo sapiens
tcatttttgaccatgggtagga

SEQ ID NO: 7510809 - DNA, 22 bp, Homo sapiens
tcatttttgaccatgggtagga

SEQ ID NO: 7510810 - DNA, 22 bp, Homo sapiens
tcatttttgtctccggtttgtg

SEQ ID NO: 7510811 - DNA, 22 bp, Homo sapiens
tcatttttgtctccggtttgtg

SEQ ID NO: 7510812 - DNA, 22 bp, Homo sapiens
tcatttttgaccatgggtagga

SEQ ID NO: 7510813 - DNA, 22 bp, Homo sapiens
tcatttttgaccatgggtagga

SEQ ID NO: 7510814 - DNA, 22 bp, Homo sapiens
tcatttttgtctccggtttgtg

SEQ ID NO: 7510815 - DNA, 22 bp, Homo sapiens
tcatttttgtctccggtttgtg

SEQ ID NO: 7510816 - DNA, 22 bp, Homo sapiens
tcattttttgcatacctgtgtc

SEQ ID NO: 7510817 - DNA, 22 bp, Homo sapiens
tcattttttgcatacctgtgtc

SEQ ID NO: 7510818 - DNA, 22 bp, Homo sapiens
tcattttttgcatacctgtgtc

SEQ ID NO: 7510819 - DNA, 22 bp, Homo sapiens
tcattttttgcatacctgtgtc

SEQ ID NO: 7510820 - DNA, 22 bp, Homo sapiens
tcattttttgcatacctgtgtc

SEQ ID NO: 7510821 - DNA, 22 bp, Homo sapiens
tcatttttttccggtaggaata

SEQ ID NO: 7510822 - DNA, 22 bp, Homo sapiens
tcatttttttccggtaggaata

SEQ ID NO: 7510823 - DNA, 22 bp, Homo sapiens
tcatttttttccggtaggaata

SEQ ID NO: 7510824 - DNA, 22 bp, Homo sapiens
tcattttttgcatacctgtgtc

SEQ ID NO: 7510825 - DNA, 22 bp, Homo sapiens
tcattttttgcatacctgtgtc

SEQ ID NO: 7510826 - DNA, 22 bp, Homo sapiens
tcattttttgcatacctgtgtc

SEQ ID NO: 7510827 - DNA, 22 bp, Homo sapiens
tcattttttgcatacctgtgtc

SEQ ID NO: 7510828 - DNA, 22 bp, Homo sapiens
tcatttttttccggtaggaata

SEQ ID NO: 7510829 - DNA, 22 bp, Homo sapiens
tcatttttttccggtaggaata

SEQ ID NO: 7510830 - DNA, 22 bp, Homo sapiens
tcatttttttccggtaggaata

SEQ ID NO: 7510831 - DNA, 22 bp, Homo sapiens
tcatttttttccggtaggaata

SEQ ID NO: 7510832 - DNA, 21 bp, Homo sapiens
tccaaaaaggagcgtccttct

SEQ ID NO: 7510833 - DNA, 18 bp, Homo sapiens
tccaaaatcatgtatttt

SEQ ID NO: 7510834 - DNA, 18 bp, Homo sapiens
tccaaaatcatgtatttt

SEQ ID NO: 7510835 - DNA, 22 bp, Homo sapiens
tccaaaaaacgtttgaatagtt

SEQ ID NO: 7510836 - DNA, 22 bp, Homo sapiens
tcatttttttccggtaggaata

SEQ ID NO: 7510837 - DNA, 22 bp, Homo sapiens
tccaaaaaacgtttgaatagtt

SEQ ID NO: 7510838 - DNA, 22 bp, Homo sapiens
tccaaaaaacgtttgaatagtt

SEQ ID NO: 7510839 - DNA, 22 bp, Homo sapiens
tccaaaaaacgtttgaatagtt

SEQ ID NO: 7510840 - DNA, 22 bp, Homo sapiens
tccaaaaaacgtttgaatagtt

SEQ ID NO: 7510841 - DNA, 22 bp, Homo sapiens
tccaaaaaacgtttgaatagtt

SEQ ID NO: 7510842 - DNA, 21 bp, Homo sapiens
tccaaaaaggagcgtccttct

SEQ ID NO: 7510843 - DNA, 21 bp, Homo sapiens
tccaaaaaggagcgtccttct

SEQ ID NO: 7510844 - DNA, 19 bp, Homo sapiens
tccaaaggacccacctcca

SEQ ID NO: 7510845 - DNA, 22 bp, Homo sapiens
tccaaaggcaaaactgtggtgt

SEQ ID NO: 7510846 - DNA, 22 bp, Homo sapiens
tccaaaggaggctgccaagttc

SEQ ID NO: 7510847 - DNA, 22 bp, Homo sapiens
tccaaaggaagaggctgtcagt

SEQ ID NO: 7510848 - DNA, 22 bp, Homo sapiens
tccaaatacatttactgtattt

SEQ ID NO: 7510849 - DNA, 22 bp, Homo sapiens
tccaaatacatttactgtattt

SEQ ID NO: 7510850 - DNA, 22 bp, Homo sapiens
tccaaagtaatttcacttctgt

SEQ ID NO: 7510851 - DNA, 22 bp, Homo sapiens
tccaaagtaatttcacttctgt

SEQ ID NO: 7510852 - DNA, 22 bp, Homo sapiens
tccaaaggggcagtgtccagcc

SEQ ID NO: 7510853 - DNA, 22 bp, Homo sapiens
tccaaatagttctggaagactg

SEQ ID NO: 7510854 - DNA, 22 bp, Homo sapiens
tccaaatagttctggaagactg

SEQ ID NO: 7510855 - DNA, 22 bp, Homo sapiens
tccaaatatacagaatctcctc

SEQ ID NO: 7510856 - DNA, 22 bp, Homo sapiens
tccaaatatacagaatctcctc

SEQ ID NO: 7510857 - DNA, 22 bp, Homo sapiens
tccaaatatagatgagttgtaa

SEQ ID NO: 7510858 - DNA, 22 bp, Homo sapiens
tccaaatatagatgagttgtaa

SEQ ID NO: 7510859 - DNA, 22 bp, Homo sapiens
tccaaatatagatgagttgtaa

SEQ ID NO: 7510860 - DNA, 22 bp, Homo sapiens
tccaaatataggatgtgatata

SEQ ID NO: 7510861 - DNA, 22 bp, Homo sapiens
tccaaatatacagaatctcctc

SEQ ID NO: 7510862 - DNA, 22 bp, Homo sapiens
tccaaatataggatgtgatata

SEQ ID NO: 7510863 - DNA, 22 bp, Homo sapiens
tccaaataccagatgggctaat

SEQ ID NO: 7510864 - DNA, 22 bp, Homo sapiens
tccaaatacatttactgtattt

SEQ ID NO: 7510865 - DNA, 22 bp, Homo sapiens
tccaaatacatttactgtattt

SEQ ID NO: 7510866 - DNA, 22 bp, Homo sapiens
tccaaatacatttactgtattt

SEQ ID NO: 7510867 - DNA, 22 bp, Homo sapiens
tccaaatacatttactgtattt

SEQ ID NO: 7510868 - DNA, 22 bp, Homo sapiens
tccaaatagctggatgatggtg

SEQ ID NO: 7510869 - DNA, 23 bp, Homo sapiens
tccaaatacctgtcaccttgtct

SEQ ID NO: 7510870 - DNA, 23 bp, Homo sapiens
tccaaatacctgtcaccttgtct

SEQ ID NO: 7510871 - DNA, 22 bp, Homo sapiens
tccaaagaacattgctgagacc

SEQ ID NO: 7510872 - DNA, 22 bp, Homo sapiens
tccaaagaacattgctgagacc

SEQ ID NO: 7510873 - DNA, 22 bp, Homo sapiens
tccaaacgggagccaaatgagc

SEQ ID NO: 7510874 - DNA, 23 bp, Homo sapiens
tccaaactcaagacattaataag

SEQ ID NO: 7510875 - DNA, 23 bp, Homo sapiens
tccaaactcaagacattaataag

SEQ ID NO: 7510876 - DNA, 22 bp, Homo sapiens
tccaaagaacctggctactgtc

SEQ ID NO: 7510877 - DNA, 22 bp, Homo sapiens
tccaaagaacctggctactgtc

SEQ ID NO: 7510878 - DNA, 23 bp, Homo sapiens
tccaaactcaagacattaataag

SEQ ID NO: 7510879 - DNA, 22 bp, Homo sapiens
tccaaagaacctggctactgtc

SEQ ID NO: 7510880 - DNA, 21 bp, Homo sapiens
tccaaacctgtctctggctct

SEQ ID NO: 7510881 - DNA, 22 bp, Homo sapiens
tccaaacaccctccatgctgca

SEQ ID NO: 7510882 - DNA, 22 bp, Homo sapiens
tccaaacaccctccatgctgca

SEQ ID NO: 7510883 - DNA, 22 bp, Homo sapiens
tccaaacaccctccatgctgca

SEQ ID NO: 7510884 - DNA, 22 bp, Homo sapiens
tccaaacaccctccatgctgca

SEQ ID NO: 7510885 - DNA, 22 bp, Homo sapiens
tccaaacaccctccatgctgca

SEQ ID NO: 7510886 - DNA, 18 bp, Homo sapiens
tccaaaatcatgtatttt

SEQ ID NO: 7510887 - DNA, 18 bp, Homo sapiens
tccaaaatcatgtatttt

SEQ ID NO: 7510888 - DNA, 18 bp, Homo sapiens
tccaaaatcatgtatttt

SEQ ID NO: 7510889 - DNA, 18 bp, Homo sapiens
tccaaaatcatgtatttt

SEQ ID NO: 7510890 - DNA, 22 bp, Homo sapiens
tccaaagacttgctgtatgtaa

SEQ ID NO: 7510891 - DNA, 20 bp, Homo sapiens
tccaaagaagttcacattta

SEQ ID NO: 7510892 - DNA, 22 bp, Homo sapiens
tccaaagaggttaagaacgaga

SEQ ID NO: 7510893 - DNA, 22 bp, Homo sapiens
tccaaagagcttaggagagaaa

SEQ ID NO: 7510894 - DNA, 22 bp, Homo sapiens
tccaaagagcttaggagagaaa

SEQ ID NO: 7510895 - DNA, 22 bp, Homo sapiens
tccaaagaggattcagggacct

SEQ ID NO: 7510896 - DNA, 22 bp, Homo sapiens
tccaaagaggattcagggacct

SEQ ID NO: 7510897 - DNA, 22 bp, Homo sapiens
tccaaagcatctgagtgtgcat

SEQ ID NO: 7510898 - DNA, 22 bp, Homo sapiens
tccaaagcatttggctcccacc

SEQ ID NO: 7510899 - DNA, 22 bp, Homo sapiens
tccaaagcatctgagtgtgcat

SEQ ID NO: 7510900 - DNA, 18 bp, Homo sapiens
tccaaagccagagaagtt

SEQ ID NO: 7510901 - DNA, 18 bp, Homo sapiens
tccaaagccagagaagtt

SEQ ID NO: 7510902 - DNA, 22 bp, Homo sapiens
tccaaagccccatgcactttct

SEQ ID NO: 7510903 - DNA, 22 bp, Homo sapiens
tccaaagccgactgacatctga

SEQ ID NO: 7510904 - DNA, 22 bp, Homo sapiens
tccaaagccgactgacatctga

SEQ ID NO: 7510905 - DNA, 22 bp, Homo sapiens
tcatgaaaatagatcagaaatt

SEQ ID NO: 7510906 - DNA, 22 bp, Homo sapiens
tcatgaaaatagatcagaaatt

SEQ ID NO: 7510907 - DNA, 19 bp, Homo sapiens
tcatgcactttgatgtaac

SEQ ID NO: 7510908 - DNA, 23 bp, Homo sapiens
tcatgcagagaaggactgcttac

SEQ ID NO: 7510909 - DNA, 23 bp, Homo sapiens
tcatgcagagaaggactgcttac

SEQ ID NO: 7510910 - DNA, 23 bp, Homo sapiens
tcatgcagagaaggactgcttac

SEQ ID NO: 7510911 - DNA, 22 bp, Homo sapiens
tcatgcagagccagtcaggata

SEQ ID NO: 7510912 - DNA, 22 bp, Homo sapiens
tcatgaaaatagatcagaaatt

SEQ ID NO: 7510913 - DNA, 22 bp, Homo sapiens
tcatgaaaatagatcagaaatt

SEQ ID NO: 7510914 - DNA, 22 bp, Homo sapiens
tcatgaaaatagatcagaaatt

SEQ ID NO: 7510915 - DNA, 22 bp, Homo sapiens
tcatgaaaatagatcagaaatt

SEQ ID NO: 7510916 - DNA, 22 bp, Homo sapiens
tcatgaaaatagatcagaaatt

SEQ ID NO: 7510917 - DNA, 22 bp, Homo sapiens
tcatgcagataagaataagtaa

SEQ ID NO: 7510918 - DNA, 22 bp, Homo sapiens
tcatgcagagtagaaagggcaa

SEQ ID NO: 7510919 - DNA, 22 bp, Homo sapiens
tcatgcagagtagaaagggcaa

SEQ ID NO: 7510920 - DNA, 22 bp, Homo sapiens
tcatgcagagtagaaagggcaa

SEQ ID NO: 7510921 - DNA, 22 bp, Homo sapiens
tcatgcagataagaataagtaa

SEQ ID NO: 7510922 - DNA, 22 bp, Homo sapiens
tcatgcagataagaataagtaa

SEQ ID NO: 7510923 - DNA, 22 bp, Homo sapiens
tcatgcagatttggaggtattt

SEQ ID NO: 7510924 - DNA, 22 bp, Homo sapiens
tcatgcagaggaaggctagttt

SEQ ID NO: 7510925 - DNA, 22 bp, Homo sapiens
tcatgcagagccagtcaggata

SEQ ID NO: 7510926 - DNA, 22 bp, Homo sapiens
tcatgcagaggaaggctagttt

SEQ ID NO: 7510927 - DNA, 22 bp, Homo sapiens
tcatgcagagtagaaagggcaa

SEQ ID NO: 7510928 - DNA, 22 bp, Homo sapiens
tcatgcagagtagaaagggcaa

SEQ ID NO: 7510929 - DNA, 22 bp, Homo sapiens
tcatctttaccccttgcttcaa

SEQ ID NO: 7510930 - DNA, 22 bp, Homo sapiens
tcatctttaccccttgcttcaa

SEQ ID NO: 7510931 - DNA, 22 bp, Homo sapiens
tcatctttcctcaaaagatcca

SEQ ID NO: 7510932 - DNA, 22 bp, Homo sapiens
tcatctttcctcaaaagatcca

SEQ ID NO: 7510933 - DNA, 22 bp, Homo sapiens
tcatctttcctcaaaagatcca

SEQ ID NO: 7510934 - DNA, 22 bp, Homo sapiens
tcatctttaccccttgcttcaa

SEQ ID NO: 7510935 - DNA, 22 bp, Homo sapiens
tcatctttaccccttgcttcaa

SEQ ID NO: 7510936 - DNA, 22 bp, Homo sapiens
tcatctttcctcaaaagatcca

SEQ ID NO: 7510937 - DNA, 22 bp, Homo sapiens
tcatctttcctcaaaagatcca

SEQ ID NO: 7510938 - DNA, 22 bp, Homo sapiens
tcatctttcctcaaaagatcca

SEQ ID NO: 7510939 - DNA, 22 bp, Homo sapiens
tcatctttcctcaaaagatcca

SEQ ID NO: 7510940 - DNA, 22 bp, Homo sapiens
tcatctttgtatccctaacaca

SEQ ID NO: 7510941 - DNA, 22 bp, Homo sapiens
tcatgaaaaattttccatgtca

SEQ ID NO: 7510942 - DNA, 22 bp, Homo sapiens
tcatctttgtatccctaacaca

SEQ ID NO: 7510943 - DNA, 22 bp, Homo sapiens
tcatgaaaaattttccatgtca

SEQ ID NO: 7510944 - DNA, 22 bp, Homo sapiens
tcatgaaaatagatcagaaatt

SEQ ID NO: 7510945 - DNA, 22 bp, Homo sapiens
tcatgaaaaattttccatgtca

SEQ ID NO: 7510946 - DNA, 22 bp, Homo sapiens
tcatctgtctgagagacttctg

SEQ ID NO: 7510947 - DNA, 22 bp, Homo sapiens
tcatctgtcccaggcttttttc

SEQ ID NO: 7510948 - DNA, 22 bp, Homo sapiens
tcatctgtcaaattgcaataag

SEQ ID NO: 7510949 - DNA, 23 bp, Homo sapiens
tcatctgtaagtatctgtggagt

SEQ ID NO: 7510950 - DNA, 22 bp, Homo sapiens
tcatctgtcaaattgcaataag

SEQ ID NO: 7510951 - DNA, 22 bp, Homo sapiens
tcatctgtcatccacaaagctg

SEQ ID NO: 7510952 - DNA, 22 bp, Homo sapiens
tcatctgggagcttgttagaaa

SEQ ID NO: 7510953 - DNA, 20 bp, Homo sapiens
tcatctgattaacctcgaag

SEQ ID NO: 7510954 - DNA, 22 bp, Homo sapiens
tcatctgaggtttgaggcagtt

SEQ ID NO: 7510955 - DNA, 21 bp, Homo sapiens
tcatctggtctggggcctgct

SEQ ID NO: 7510956 - DNA, 23 bp, Homo sapiens
tcatctgtaacagcctatgaaat

SEQ ID NO: 7510957 - DNA, 23 bp, Homo sapiens
tcatctgtaacagcctatgaaat

SEQ ID NO: 7510958 - DNA, 22 bp, Homo sapiens
tcatctgaggcaccagagcata

SEQ ID NO: 7510959 - DNA, 22 bp, Homo sapiens
tcatctgaccccatctattctc

SEQ ID NO: 7510960 - DNA, 22 bp, Homo sapiens
tcatctgaccccatctattctc

SEQ ID NO: 7510961 - DNA, 22 bp, Homo sapiens
tcatctgaccccatctattctc

SEQ ID NO: 7510962 - DNA, 22 bp, Homo sapiens
tcatctgtgaataatgaactgg

SEQ ID NO: 7510963 - DNA, 22 bp, Homo sapiens
tcatctgtgagtaaaggcacat

SEQ ID NO: 7510964 - DNA, 22 bp, Homo sapiens
tcatctgttatgggagtttttg

SEQ ID NO: 7510965 - DNA, 22 bp, Homo sapiens
tcatctgtgagtaaaggcacat

SEQ ID NO: 7510966 - DNA, 22 bp, Homo sapiens
tcatctgtggctgcttttgtgc

SEQ ID NO: 7510967 - DNA, 22 bp, Homo sapiens
tcatctgttatttatgcctgag

SEQ ID NO: 7510968 - DNA, 22 bp, Homo sapiens
tcatctgttcatacacatgcgt

SEQ ID NO: 7510969 - DNA, 22 bp, Homo sapiens
tcatctgttcatacacatgcgt

SEQ ID NO: 7510970 - DNA, 22 bp, Homo sapiens
tcatctgttgattttaagtctt

SEQ ID NO: 7510971 - DNA, 21 bp, Homo sapiens
tcatcttacagtcctttcttt

SEQ ID NO: 7510972 - DNA, 21 bp, Homo sapiens
tcatcttacagtcctttcttt

SEQ ID NO: 7510973 - DNA, 22 bp, Homo sapiens
tcatcttcctcatttctccagg

SEQ ID NO: 7510974 - DNA, 22 bp, Homo sapiens
tcatcttgcagtgtgtgttctg

SEQ ID NO: 7510975 - DNA, 22 bp, Homo sapiens
tcatcttgcagtgtgtgttctg

SEQ ID NO: 7510976 - DNA, 22 bp, Homo sapiens
tcatcttctattaatagggaga

SEQ ID NO: 7510977 - DNA, 22 bp, Homo sapiens
tcatagaatgagttaatgaact

SEQ ID NO: 7510978 - DNA, 22 bp, Homo sapiens
tcatagaaggaactgggagata

SEQ ID NO: 7510979 - DNA, 22 bp, Homo sapiens
tcatagaaggaactgggagata

SEQ ID NO: 7510980 - DNA, 18 bp, Homo sapiens
tcatagaagtgaatcaga

SEQ ID NO: 7510981 - DNA, 18 bp, Homo sapiens
tcatagaagtgaatcaga

SEQ ID NO: 7510982 - DNA, 22 bp, Homo sapiens
tcatctgaccactttatctctc

SEQ ID NO: 7510983 - DNA, 22 bp, Homo sapiens
tcatctgaccactttatctctc

SEQ ID NO: 7510984 - DNA, 22 bp, Homo sapiens
tcatctgaagattgctgttcaa

SEQ ID NO: 7510985 - DNA, 22 bp, Homo sapiens
tcatctgaacatgcagcctgtg

SEQ ID NO: 7510986 - DNA, 22 bp, Homo sapiens
tcatagatgtgctgtgcacaaa

SEQ ID NO: 7510987 - DNA, 22 bp, Homo sapiens
tcatctcttttgtattggggtt

SEQ ID NO: 7510988 - DNA, 22 bp, Homo sapiens
tcatagaatgagttaatgaact

SEQ ID NO: 7510989 - DNA, 22 bp, Homo sapiens
tcatctgaaattgtatatgtag

SEQ ID NO: 7510990 - DNA, 22 bp, Homo sapiens
tcatagaaatggaaagtatatt

SEQ ID NO: 7510991 - DNA, 22 bp, Homo sapiens
tcatagaaatggaaagtatatt

SEQ ID NO: 7510992 - DNA, 22 bp, Homo sapiens
tcatagaaatggaaagtatatt

SEQ ID NO: 7510993 - DNA, 22 bp, Homo sapiens
tcatagaaatggaaagtatatt

SEQ ID NO: 7510994 - DNA, 22 bp, Homo sapiens
tcatagaaatggaaagtatatt

SEQ ID NO: 7510995 - DNA, 22 bp, Homo sapiens
tcatagaaatggaaagtatatt

SEQ ID NO: 7510996 - DNA, 22 bp, Homo sapiens
tcatagaagcaccagaagatat

SEQ ID NO: 7510997 - DNA, 22 bp, Homo sapiens
tcatagaaatgtggccagaaac

SEQ ID NO: 7510998 - DNA, 22 bp, Homo sapiens
tcatagaaatgtggccagaaac

SEQ ID NO: 7510999 - DNA, 22 bp, Homo sapiens
tcatagaagcaccagaagatat

SEQ ID NO: 7511000 - DNA, 22 bp, Homo sapiens
tcatactagtttaatgatcttc

SEQ ID NO: 7511001 - DNA, 22 bp, Homo sapiens
tcatacattcagcagatatttg

SEQ ID NO: 7511002 - DNA, 22 bp, Homo sapiens
tcatacattcagcagatatttg

SEQ ID NO: 7511003 - DNA, 22 bp, Homo sapiens
tcatacattcagcagatatttg

SEQ ID NO: 7511004 - DNA, 22 bp, Homo sapiens
tcatacatctgtcctggagctc

SEQ ID NO: 7511005 - DNA, 22 bp, Homo sapiens
tcatacatctgtcctggagctc

SEQ ID NO: 7511006 - DNA, 22 bp, Homo sapiens
tcataaattgggttggctgggt

SEQ ID NO: 7511007 - DNA, 22 bp, Homo sapiens
tcataaattgattatgtgcttt

SEQ ID NO: 7511008 - DNA, 22 bp, Homo sapiens
tcataaattgattatgtgcttt

SEQ ID NO: 7511009 - DNA, 22 bp, Homo sapiens
tcataaattgattatgtgcttt

SEQ ID NO: 7511010 - DNA, 22 bp, Homo sapiens
tcataaattgattatgtgcttt

SEQ ID NO: 7511011 - DNA, 22 bp, Homo sapiens
tcatacatcttgtatatctatc

SEQ ID NO: 7511012 - DNA, 22 bp, Homo sapiens
tcatacatcttgtatatctatc

SEQ ID NO: 7511013 - DNA, 22 bp, Homo sapiens
tcatacatcttgtatatctatc

SEQ ID NO: 7511014 - DNA, 22 bp, Homo sapiens
tcatacatcttgtatatctatc

SEQ ID NO: 7511015 - DNA, 22 bp, Homo sapiens
tcatacatcttgtatatctatc

SEQ ID NO: 7511016 - DNA, 22 bp, Homo sapiens
tcatacatcttgtatatctatc

SEQ ID NO: 7511017 - DNA, 22 bp, Homo sapiens
tcatacatgttgtgttcaaatg

SEQ ID NO: 7511018 - DNA, 22 bp, Homo sapiens
tcatacatgttgtgttcaaatg

SEQ ID NO: 7511019 - DNA, 22 bp, Homo sapiens
tcatacatcttgtatatctatc

SEQ ID NO: 7511020 - DNA, 22 bp, Homo sapiens
tcataaattatctatttggcta

SEQ ID NO: 7511021 - DNA, 22 bp, Homo sapiens
tcataaattctggtgctgtgag

SEQ ID NO: 7511022 - DNA, 22 bp, Homo sapiens
tcataaattctggtgctgtgag

SEQ ID NO: 7511023 - DNA, 22 bp, Homo sapiens
tcataaattgattatgtgcttt

SEQ ID NO: 7511024 - DNA, 22 bp, Homo sapiens
tcataaattgattatgtgcttt

SEQ ID NO: 7511025 - DNA, 22 bp, Homo sapiens
tcataaattgattatgtgcttt

SEQ ID NO: 7511026 - DNA, 22 bp, Homo sapiens
tcataaatgcagtgtcataaat

SEQ ID NO: 7511027 - DNA, 22 bp, Homo sapiens
tcataaatgcagtgtcataaat

SEQ ID NO: 7511028 - DNA, 22 bp, Homo sapiens
tcataaatgcagtgtcataaat

SEQ ID NO: 7511029 - DNA, 22 bp, Homo sapiens
tcataaatgcagtgtcataaat

SEQ ID NO: 7511030 - DNA, 22 bp, Homo sapiens
tcataaattagctgtctttgaa

SEQ ID NO: 7511031 - DNA, 22 bp, Homo sapiens
tcataaattagctgtctttgaa

SEQ ID NO: 7511032 - DNA, 22 bp, Homo sapiens
tcataaattatctatttggcta

SEQ ID NO: 7511033 - DNA, 22 bp, Homo sapiens
tcataaattatctatttggcta

SEQ ID NO: 7511034 - DNA, 22 bp, Homo sapiens
tcagtgttgaattttttgcaaa

SEQ ID NO: 7511035 - DNA, 22 bp, Homo sapiens
tcagtgttggcattcagaaatg

SEQ ID NO: 7511036 - DNA, 22 bp, Homo sapiens
tcagtgttggcattcagaaatg

SEQ ID NO: 7511037 - DNA, 22 bp, Homo sapiens
tcagtgttgaattttttgcaaa

SEQ ID NO: 7511038 - DNA, 22 bp, Homo sapiens
tcagtgttcttatttaattagg

SEQ ID NO: 7511039 - DNA, 22 bp, Homo sapiens
tcagtgttcttatttaattagg

SEQ ID NO: 7511040 - DNA, 22 bp, Homo sapiens
tcagtctcctttcctctagaca

SEQ ID NO: 7511041 - DNA, 22 bp, Homo sapiens
tcagtctcatcaactctattcc

SEQ ID NO: 7511042 - DNA, 22 bp, Homo sapiens
tcagtctcctttcctctagaca

SEQ ID NO: 7511043 - DNA, 22 bp, Homo sapiens
tcagtctcctttcctctagaca

SEQ ID NO: 7511044 - DNA, 22 bp, Homo sapiens
tcagtgtttattcaatgttatt

SEQ ID NO: 7511045 - DNA, 22 bp, Homo sapiens
tcagtgtttaccgtatgttgtt

SEQ ID NO: 7511046 - DNA, 22 bp, Homo sapiens
tcagtgtttaccgtatgttgtt

SEQ ID NO: 7511047 - DNA, 22 bp, Homo sapiens
tcagtgtttcagtttggaaatg

SEQ ID NO: 7511048 - DNA, 22 bp, Homo sapiens
tcagtgttgtgcacatacaaaa

SEQ ID NO: 7511049 - DNA, 22 bp, Homo sapiens
tcagtgtttacatgcatccttg

SEQ ID NO: 7511050 - DNA, 22 bp, Homo sapiens
tcagtgttggtcaagaatcagt

SEQ ID NO: 7511051 - DNA, 22 bp, Homo sapiens
tcagtgttggtcaagaatcagt

SEQ ID NO: 7511052 - DNA, 22 bp, Homo sapiens
tcagtgttgtgcacatacaaaa

SEQ ID NO: 7511053 - DNA, 22 bp, Homo sapiens
tcagtgttggcattcagaaatg

SEQ ID NO: 7511054 - DNA, 22 bp, Homo sapiens
tcagtgttggtcaagaatcagt

SEQ ID NO: 7511055 - DNA, 22 bp, Homo sapiens
tcagtgttggcattcagaaatg

SEQ ID NO: 7511056 - DNA, 22 bp, Homo sapiens
tcagtgttggctacatctgcct

SEQ ID NO: 7511057 - DNA, 22 bp, Homo sapiens
tcagtccttatctggtgttcag

SEQ ID NO: 7511058 - DNA, 22 bp, Homo sapiens
tcagtccttatctggtgttcag

SEQ ID NO: 7511059 - DNA, 22 bp, Homo sapiens
tcagtccttatctggtgttcag

SEQ ID NO: 7511060 - DNA, 22 bp, Homo sapiens
tcagtccttggcatttaggagc

SEQ ID NO: 7511061 - DNA, 19 bp, Homo sapiens
tcagtctaggaatgagcta

SEQ ID NO: 7511062 - DNA, 22 bp, Homo sapiens
tcagtctatccagctcagatcc

SEQ ID NO: 7511063 - DNA, 22 bp, Homo sapiens
tcagtctcagcacctagtcaca

SEQ ID NO: 7511064 - DNA, 22 bp, Homo sapiens
tcagtctcagcacctagtcaca

SEQ ID NO: 7511065 - DNA, 23 bp, Homo sapiens
tcagtcctgtaggggctccaggt

SEQ ID NO: 7511066 - DNA, 22 bp, Homo sapiens
tcagtcctgggccggcatcctc

SEQ ID NO: 7511067 - DNA, 23 bp, Homo sapiens
tcagtcctgtaggggctccaggt

SEQ ID NO: 7511068 - DNA, 23 bp, Homo sapiens
tcagtcctgtaggggctccaggt

SEQ ID NO: 7511069 - DNA, 23 bp, Homo sapiens
tcagtcctgtaggggctccaggt

SEQ ID NO: 7511070 - DNA, 22 bp, Homo sapiens
tcagtcctgggccggcatcctc

SEQ ID NO: 7511071 - DNA, 22 bp, Homo sapiens
tcagtcctgggccggcatcctc

SEQ ID NO: 7511072 - DNA, 22 bp, Homo sapiens
tcagtcctgatgacaggcccaa

SEQ ID NO: 7511073 - DNA, 22 bp, Homo sapiens
tcagtcctgatgacaggcccaa

SEQ ID NO: 7511074 - DNA, 22 bp, Homo sapiens
tcagtcctctctgggtttctta

SEQ ID NO: 7511075 - DNA, 19 bp, Homo sapiens
tcagtatataattacacca

SEQ ID NO: 7511076 - DNA, 22 bp, Homo sapiens
tcagtatccacaaatgctcaaa

SEQ ID NO: 7511077 - DNA, 22 bp, Homo sapiens
tcagtattcctggaaatacaag

SEQ ID NO: 7511078 - DNA, 22 bp, Homo sapiens
tcagtattcctggaaatacaag

SEQ ID NO: 7511079 - DNA, 22 bp, Homo sapiens
tcagtcctacacgctcagggac

SEQ ID NO: 7511080 - DNA, 22 bp, Homo sapiens
tcagtcctacacgctcagggac

SEQ ID NO: 7511081 - DNA, 22 bp, Homo sapiens
tcagtcccttctccaggtcagc

SEQ ID NO: 7511082 - DNA, 22 bp, Homo sapiens
tcagtcctacacgctcagggac

SEQ ID NO: 7511083 - DNA, 22 bp, Homo sapiens
tcagtcctccacacaggcaccc

SEQ ID NO: 7511084 - DNA, 22 bp, Homo sapiens
tcagtcctccacacaggcaccc

SEQ ID NO: 7511085 - DNA, 22 bp, Homo sapiens
tcagtcctcacttggttctaag

SEQ ID NO: 7511086 - DNA, 22 bp, Homo sapiens
tcagtcctccacacaggcaccc

SEQ ID NO: 7511087 - DNA, 22 bp, Homo sapiens
tcagtcctccacacaggcaccc

SEQ ID NO: 7511088 - DNA, 18 bp, Homo sapiens
tcagtcctccatagagct

SEQ ID NO: 7511089 - DNA, 22 bp, Homo sapiens
tcagtcctccacacaggcaccc

SEQ ID NO: 7511090 - DNA, 22 bp, Homo sapiens
tcagtcctcctctcatagagag

SEQ ID NO: 7511091 - DNA, 22 bp, Homo sapiens
tcagtgtttttaaagcaatata

SEQ ID NO: 7511092 - DNA, 22 bp, Homo sapiens
tcagttaacaactatttattga

SEQ ID NO: 7511093 - DNA, 22 bp, Homo sapiens
tcagttaacaactatttattga

SEQ ID NO: 7511094 - DNA, 22 bp, Homo sapiens
tcagttaatatgggtaaagcat

SEQ ID NO: 7511095 - DNA, 22 bp, Homo sapiens
tcagttaatggattctgtcaga

SEQ ID NO: 7511096 - DNA, 22 bp, Homo sapiens
tcagttaatatgggtaaagcat

SEQ ID NO: 7511097 - DNA, 22 bp, Homo sapiens
tcagttaagactgcactggact

SEQ ID NO: 7511098 - DNA, 23 bp, Homo sapiens
tcagttaactgtgttacctgtgc

SEQ ID NO: 7511099 - DNA, 22 bp, Homo sapiens
tcagttaagcactataccctaa

SEQ ID NO: 7511100 - DNA, 22 bp, Homo sapiens
tcagtgtttgaacccagggtta

SEQ ID NO: 7511101 - DNA, 22 bp, Homo sapiens
tcagtgtttgaacccagggtta

SEQ ID NO: 7511102 - DNA, 22 bp, Homo sapiens
tcagtgtttcctgtggtacagc

SEQ ID NO: 7511103 - DNA, 22 bp, Homo sapiens
tcagtgtttcctgtggtacagc

SEQ ID NO: 7511104 - DNA, 22 bp, Homo sapiens
tcagtgttttaactgtctttta

SEQ ID NO: 7511105 - DNA, 22 bp, Homo sapiens
tcagtgttttaactgtctttta

SEQ ID NO: 7511106 - DNA, 22 bp, Homo sapiens
tcagtgttttaactgtctttta

SEQ ID NO: 7511107 - DNA, 22 bp, Homo sapiens
tcagtgttttaactgtctttta

SEQ ID NO: 7511108 - DNA, 22 bp, Homo sapiens
tcagtgttttccagggtctact

SEQ ID NO: 7511109 - DNA, 22 bp, Homo sapiens
tcagtgtttggtttcagaattg

SEQ ID NO: 7511110 - DNA, 22 bp, Homo sapiens
tcagtgtttgtggcaaatgtta

SEQ ID NO: 7511111 - DNA, 22 bp, Homo sapiens
tcagtgtttgtggcaaatgtta

SEQ ID NO: 7511112 - DNA, 22 bp, Homo sapiens
tcagttaatggtaagggtgaaa

SEQ ID NO: 7511113 - DNA, 22 bp, Homo sapiens
tcataaagcttgcctgcagtgt

SEQ ID NO: 7511114 - DNA, 22 bp, Homo sapiens
tcataaagcttgcctgcagtgt

SEQ ID NO: 7511115 - DNA, 22 bp, Homo sapiens
tcagttaatggattctgtcaga

SEQ ID NO: 7511116 - DNA, 22 bp, Homo sapiens
tcataaagttacccaaatttta

SEQ ID NO: 7511117 - DNA, 22 bp, Homo sapiens
tcataaagttacccaaatttta

SEQ ID NO: 7511118 - DNA, 22 bp, Homo sapiens
tcataaagtgaaggatgatggg

SEQ ID NO: 7511119 - DNA, 22 bp, Homo sapiens
tcataaagtgaaggatgatggg

SEQ ID NO: 7511120 - DNA, 22 bp, Homo sapiens
tcataaagttatcaccaaatcc

SEQ ID NO: 7511121 - DNA, 22 bp, Homo sapiens
tcataaagttatcaccaaatcc

SEQ ID NO: 7511122 - DNA, 22 bp, Homo sapiens
tcataaagttatcaccaaatcc

SEQ ID NO: 7511123 - DNA, 22 bp, Homo sapiens
tcataaagttatcaccaaatcc

SEQ ID NO: 7511124 - DNA, 22 bp, Homo sapiens
tcataaagttgttttaatggga

SEQ ID NO: 7511125 - DNA, 22 bp, Homo sapiens
tcataaagttgttttaatggga

SEQ ID NO: 7511126 - DNA, 22 bp, Homo sapiens
tcataaagttctaagaattgta

SEQ ID NO: 7511127 - DNA, 22 bp, Homo sapiens
tcataaagttctaagaattgta

SEQ ID NO: 7511128 - DNA, 22 bp, Homo sapiens
tcataaatcatactccatttgc

SEQ ID NO: 7511129 - DNA, 22 bp, Homo sapiens
tcataaatcatactccatttgc

SEQ ID NO: 7511130 - DNA, 22 bp, Homo sapiens
tcataaatatttgtgggggctt

SEQ ID NO: 7511131 - DNA, 22 bp, Homo sapiens
tcataaatcatactccatttgc

SEQ ID NO: 7511132 - DNA, 23 bp, Homo sapiens
tcataaatattagcacagtagga

SEQ ID NO: 7511133 - DNA, 23 bp, Homo sapiens
tcataaatattagcacagtagga

SEQ ID NO: 7511134 - DNA, 23 bp, Homo sapiens
tcataaatattagcacagtagga

SEQ ID NO: 7511135 - DNA, 23 bp, Homo sapiens
tcataaatattagcacagtagga

SEQ ID NO: 7511136 - DNA, 22 bp, Homo sapiens
tcataaatagttgtgcctgaat

SEQ ID NO: 7511137 - DNA, 22 bp, Homo sapiens
tcataaatagttgtgcctgaat

SEQ ID NO: 7511138 - DNA, 23 bp, Homo sapiens
tcataaatattagcacagtagga

SEQ ID NO: 7511139 - DNA, 23 bp, Homo sapiens
tcataaatattagcacagtagga

SEQ ID NO: 7511140 - DNA, 22 bp, Homo sapiens
tcaggctgtatatcttgcactc

SEQ ID NO: 7511141 - DNA, 22 bp, Homo sapiens
tcaggctgttagccacctcctc

SEQ ID NO: 7511142 - DNA, 22 bp, Homo sapiens
tcaggctgttcctgtccaaaat

SEQ ID NO: 7511143 - DNA, 22 bp, Homo sapiens
tcaggctgttcctgtccaaaat

SEQ ID NO: 7511144 - DNA, 22 bp, Homo sapiens
tcaggctgttcctgtccaaaat

SEQ ID NO: 7511145 - DNA, 22 bp, Homo sapiens
tcaggcttataggtagtggtta

SEQ ID NO: 7511146 - DNA, 22 bp, Homo sapiens
tcaggcttattacgttattgtc

SEQ ID NO: 7511147 - DNA, 22 bp, Homo sapiens
tcaggcttcactcctgtccaag

SEQ ID NO: 7511148 - DNA, 22 bp, Homo sapiens
tcaggctgtatatcttgcactc

SEQ ID NO: 7511149 - DNA, 22 bp, Homo sapiens
tcaggctgtatatcttgcactc

SEQ ID NO: 7511150 - DNA, 22 bp, Homo sapiens
tcaggctgttagccacctcctc

SEQ ID NO: 7511151 - DNA, 22 bp, Homo sapiens
tcaggctgttagccacctcctc

SEQ ID NO: 7511152 - DNA, 22 bp, Homo sapiens
tcaggctgtatatcttgcactc

SEQ ID NO: 7511153 - DNA, 22 bp, Homo sapiens
tcaggctgtagggcccctggag

SEQ ID NO: 7511154 - DNA, 22 bp, Homo sapiens
tcaggctgtatatcttgcactc

SEQ ID NO: 7511155 - DNA, 22 bp, Homo sapiens
tcaggctgtagggcccctggag

SEQ ID NO: 7511156 - DNA, 22 bp, Homo sapiens
tcaggcttgtctctagagcaat

SEQ ID NO: 7511157 - DNA, 22 bp, Homo sapiens
tcaggcttgtctctagagcaat

SEQ ID NO: 7511158 - DNA, 22 bp, Homo sapiens
tcaggcttggtgctccagtgcc

SEQ ID NO: 7511159 - DNA, 22 bp, Homo sapiens
tcaggcttggtgctccagtgcc

SEQ ID NO: 7511160 - DNA, 22 bp, Homo sapiens
tcaggcttgggaggcccagggc

SEQ ID NO: 7511161 - DNA, 22 bp, Homo sapiens
tcaggcttgggaggcccagggc

SEQ ID NO: 7511162 - DNA, 18 bp, Homo sapiens
tcaggctttgagagaatc

SEQ ID NO: 7511163 - DNA, 22 bp, Homo sapiens
tcaggcttgggaggcccagggc

SEQ ID NO: 7511164 - DNA, 22 bp, Homo sapiens
tcaggctttccgaagcgcgcgg

SEQ ID NO: 7511165 - DNA, 22 bp, Homo sapiens
tcaggctttccgaagcgcgcgg

SEQ ID NO: 7511166 - DNA, 22 bp, Homo sapiens
tcaggcttccaggctctgctga

SEQ ID NO: 7511167 - DNA, 22 bp, Homo sapiens
tcaggcttcttctgagcaggga

SEQ ID NO: 7511168 - DNA, 22 bp, Homo sapiens
tcaggcttcttctgagcaggga

SEQ ID NO: 7511169 - DNA, 22 bp, Homo sapiens
tcaggcttccaacaatgatgtt

SEQ ID NO: 7511170 - DNA, 22 bp, Homo sapiens
tcaggcttgcgatggaagtcac

SEQ ID NO: 7511171 - DNA, 22 bp, Homo sapiens
tcaggcttgaggtctgtatgtg

SEQ ID NO: 7511172 - DNA, 22 bp, Homo sapiens
tcaggcttgcgatggaagtcac

SEQ ID NO: 7511173 - DNA, 22 bp, Homo sapiens
tcaggcttgcgatggaagtcac

SEQ ID NO: 7511174 - DNA, 22 bp, Homo sapiens
tcaggcttcttctgagcaggga

SEQ ID NO: 7511175 - DNA, 22 bp, Homo sapiens
tcaggcttgaggtctgtatgtg

SEQ ID NO: 7511176 - DNA, 22 bp, Homo sapiens
tcaggcttgaggtctgtatgtg

SEQ ID NO: 7511177 - DNA, 22 bp, Homo sapiens
tcagggcaggcgagcagctgct

SEQ ID NO: 7511178 - DNA, 22 bp, Homo sapiens
tcagggcaggcgagcagctgct

SEQ ID NO: 7511179 - DNA, 22 bp, Homo sapiens
tcagggcaggcgagcagctgct

SEQ ID NO: 7511180 - DNA, 22 bp, Homo sapiens
tcagggcaggttaacttgggtg

SEQ ID NO: 7511181 - DNA, 21 bp, Homo sapiens
tcagggcagtgggaggttcct

SEQ ID NO: 7511182 - DNA, 19 bp, Homo sapiens
tcagggcagtccggtcccc

SEQ ID NO: 7511183 - DNA, 19 bp, Homo sapiens
tcagggcagtccggtcccc

SEQ ID NO: 7511184 - DNA, 22 bp, Homo sapiens
tcagggcaggttaacttgggtg

SEQ ID NO: 7511185 - DNA, 22 bp, Homo sapiens
tcagggcaggcgagcagctgct

SEQ ID NO: 7511186 - DNA, 22 bp, Homo sapiens
tcagggcaggacagtgtaggcc

SEQ ID NO: 7511187 - DNA, 22 bp, Homo sapiens
tcagggcaggacagtgtaggcc

SEQ ID NO: 7511188 - DNA, 21 bp, Homo sapiens
tcagggcagctgctcttcaga

SEQ ID NO: 7511189 - DNA, 22 bp, Homo sapiens
tcagggcaggacagtgtaggcc

SEQ ID NO: 7511190 - DNA, 18 bp, Homo sapiens
tcaggctttgagagaatc

SEQ ID NO: 7511191 - DNA, 22 bp, Homo sapiens
tcagggcaggacagtgtaggcc

SEQ ID NO: 7511192 - DNA, 21 bp, Homo sapiens
tcagggcagctgctcttcaga

SEQ ID NO: 7511193 - DNA, 22 bp, Homo sapiens
tcaggcttttcttccctcagtg

SEQ ID NO: 7511194 - DNA, 22 bp, Homo sapiens
tcaggctttttctcaacctctt

SEQ ID NO: 7511195 - DNA, 22 bp, Homo sapiens
tcaggctttttctcaacctctt

SEQ ID NO: 7511196 - DNA, 22 bp, Homo sapiens
tcaggcttttcctgcctcctac

SEQ ID NO: 7511197 - DNA, 22 bp, Homo sapiens
tcaggctttgggtcaggctctg

SEQ ID NO: 7511198 - DNA, 22 bp, Homo sapiens
tcaggctttgctctgttgattt

SEQ ID NO: 7511199 - DNA, 22 bp, Homo sapiens
tcaggagacttatgtcacagtg

SEQ ID NO: 7511200 - DNA, 22 bp, Homo sapiens
tcaggagacttatgtcacagtg

SEQ ID NO: 7511201 - DNA, 22 bp, Homo sapiens
tcaggagacttatgtcacagtg

SEQ ID NO: 7511202 - DNA, 22 bp, Homo sapiens
tcaggagacttatgtcacagtg

SEQ ID NO: 7511203 - DNA, 22 bp, Homo sapiens
tcaggagacttatgtcacagtg

SEQ ID NO: 7511204 - DNA, 22 bp, Homo sapiens
tcaggagagaaagaatacaatt

SEQ ID NO: 7511205 - DNA, 22 bp, Homo sapiens
tcaggagagaaagaatacaatt

SEQ ID NO: 7511206 - DNA, 22 bp, Homo sapiens
tcaggagacttatgtcacagtg

SEQ ID NO: 7511207 - DNA, 22 bp, Homo sapiens
tcaggagagaaagaatacaatt

SEQ ID NO: 7511208 - DNA, 22 bp, Homo sapiens
tcaggagagaaagaatacaatt

SEQ ID NO: 7511209 - DNA, 21 bp, Homo sapiens
tcaggagagcccatctacaaa

SEQ ID NO: 7511210 - DNA, 22 bp, Homo sapiens
tcaggagagagttgggtaggct

SEQ ID NO: 7511211 - DNA, 22 bp, Homo sapiens
tcaggagagagttgggtaggct

SEQ ID NO: 7511212 - DNA, 22 bp, Homo sapiens
tcaggagagagttgggtaggct

SEQ ID NO: 7511213 - DNA, 22 bp, Homo sapiens
tcaggagagagttgggtaggct

SEQ ID NO: 7511214 - DNA, 22 bp, Homo sapiens
tcaggagagagaaattggggct

SEQ ID NO: 7511215 - DNA, 22 bp, Homo sapiens
tcaggagagagaaattggggct

SEQ ID NO: 7511216 - DNA, 22 bp, Homo sapiens
tcaggagagagaaattggggct

SEQ ID NO: 7511217 - DNA, 22 bp, Homo sapiens
tcaggagagaaagaatacaatt

SEQ ID NO: 7511218 - DNA, 22 bp, Homo sapiens
tcaggagagagaaattggggct

SEQ ID NO: 7511219 - DNA, 22 bp, Homo sapiens
tcaggagagagaaattggggct

SEQ ID NO: 7511220 - DNA, 17 bp, Homo sapiens
tcaggctgggtgcagtg

SEQ ID NO: 7511221 - DNA, 17 bp, Homo sapiens
tcaggctgggtgcagtg

SEQ ID NO: 7511222 - DNA, 17 bp, Homo sapiens
tcaggctgggtgcagtg

SEQ ID NO: 7511223 - DNA, 17 bp, Homo sapiens
tcaggctgggtgcagtg

SEQ ID NO: 7511224 - DNA, 17 bp, Homo sapiens
tcaggctgggtgcagtg

SEQ ID NO: 7511225 - DNA, 21 bp, Homo sapiens
tcaggagagcccatctacaaa

SEQ ID NO: 7511226 - DNA, 21 bp, Homo sapiens
tcaggagagcccatctacaaa

SEQ ID NO: 7511227 - DNA, 21 bp, Homo sapiens
tcaggagagcccatctacaaa

SEQ ID NO: 7511228 - DNA, 21 bp, Homo sapiens
tcaggagagcccatctacaaa

SEQ ID NO: 7511229 - DNA, 21 bp, Homo sapiens
tcaggagagcccatctacaaa

SEQ ID NO: 7511230 - DNA, 17 bp, Homo sapiens
tcaggctgggtgcagtg

SEQ ID NO: 7511231 - DNA, 17 bp, Homo sapiens
tcaggctgggtgcagtg

SEQ ID NO: 7511232 - DNA, 17 bp, Homo sapiens
tcaggctgggtgcagtg

SEQ ID NO: 7511233 - DNA, 17 bp, Homo sapiens
tcaggctgggtgcagtg

SEQ ID NO: 7511234 - DNA, 17 bp, Homo sapiens
tcaggctgggtgcagtg

SEQ ID NO: 7511235 - DNA, 17 bp, Homo sapiens
tcaggctgggtgcagtg

SEQ ID NO: 7511236 - DNA, 22 bp, Homo sapiens
tcaggctggtccccacagtgga

SEQ ID NO: 7511237 - DNA, 17 bp, Homo sapiens
tcaggctgggtgcagtg

SEQ ID NO: 7511238 - DNA, 22 bp, Homo sapiens
tcaggctggtccccacagtgga

SEQ ID NO: 7511239 - DNA, 22 bp, Homo sapiens
tcaggctggtccccacagtgga

SEQ ID NO: 7511240 - DNA, 22 bp, Homo sapiens
tcaggctggtccccacagtgga

SEQ ID NO: 7511241 - DNA, 22 bp, Homo sapiens
tcaggctggtccccacagtgga

SEQ ID NO: 7511242 - DNA, 22 bp, Homo sapiens
tcaggctggtccccacagtgga

SEQ ID NO: 7511243 - DNA, 22 bp, Homo sapiens
tcaggctggtccccacagtgga

SEQ ID NO: 7511244 - DNA, 22 bp, Homo sapiens
tcaggctggtccccacagtgga

SEQ ID NO: 7511245 - DNA, 20 bp, Homo sapiens
tcaggctggtgggctttccc

SEQ ID NO: 7511246 - DNA, 22 bp, Homo sapiens
tcaggctggtccccacagtgga

SEQ ID NO: 7511247 - DNA, 22 bp, Homo sapiens
tcaggctggtccccacagtgga

SEQ ID NO: 7511248 - DNA, 20 bp, Homo sapiens
tcaggctggtgggctttccc

SEQ ID NO: 7511249 - DNA, 20 bp, Homo sapiens
tcaggctggtgggctttccc

SEQ ID NO: 7511250 - DNA, 22 bp, Homo sapiens
tcaggctggtggtcagatggct

SEQ ID NO: 7511251 - DNA, 20 bp, Homo sapiens
tcaggctggtgggctttccc

SEQ ID NO: 7511252 - DNA, 22 bp, Homo sapiens
tcaggctggtggtcagatggct

SEQ ID NO: 7511253 - DNA, 22 bp, Homo sapiens
tcaggctggtggtcagatggct

SEQ ID NO: 7511254 - DNA, 22 bp, Homo sapiens
tcaggctggtggtcagatggct

SEQ ID NO: 7511255 - DNA, 22 bp, Homo sapiens
tcaggctgtaaatggtgtgggt

SEQ ID NO: 7511256 - DNA, 22 bp, Homo sapiens
tcaggctggtggtcagatggct

SEQ ID NO: 7511257 - DNA, 22 bp, Homo sapiens
tcaggctgtaaatggtgtgggt

SEQ ID NO: 7511258 - DNA, 22 bp, Homo sapiens
tcaggctggtggtcagatggct

SEQ ID NO: 7511259 - DNA, 22 bp, Homo sapiens
tcaggctggtggtcagatggct

SEQ ID NO: 7511260 - DNA, 22 bp, Homo sapiens
tcaggctggtggtcagatggct

SEQ ID NO: 7511261 - DNA, 22 bp, Homo sapiens
tcaggctggtggtcagatggct

SEQ ID NO: 7511262 - DNA, 22 bp, Homo sapiens
tcaggctggtggtcagatggct

SEQ ID NO: 7511263 - DNA, 22 bp, Homo sapiens
tcaggctggtggtcagatggct

SEQ ID NO: 7511264 - DNA, 22 bp, Homo sapiens
tcaggctggtggtcagatggct

SEQ ID NO: 7511265 - DNA, 22 bp, Homo sapiens
tcaggctggtggtcagatggct

SEQ ID NO: 7511266 - DNA, 22 bp, Homo sapiens
tcaggctgtagggcccctggag

SEQ ID NO: 7511267 - DNA, 22 bp, Homo sapiens
tcaggctgtagggcccctggag

SEQ ID NO: 7511268 - DNA, 22 bp, Homo sapiens
tcaggctgtaaatggtgtgggt

SEQ ID NO: 7511269 - DNA, 22 bp, Homo sapiens
tcaggctgtaaatggtgtgggt

SEQ ID NO: 7511270 - DNA, 22 bp, Homo sapiens
tcaggctgtaaatggtgtgggt

SEQ ID NO: 7511271 - DNA, 22 bp, Homo sapiens
tcaggctgtaaatggtgtgggt

SEQ ID NO: 7511272 - DNA, 22 bp, Homo sapiens
tcaggctgtaaatggtgtgggt

SEQ ID NO: 7511273 - DNA, 22 bp, Homo sapiens
tcagtataattgctggcactga

SEQ ID NO: 7511274 - DNA, 22 bp, Homo sapiens
tcagtatagctaaaagtttgtc

SEQ ID NO: 7511275 - DNA, 22 bp, Homo sapiens
tcagtatagctaaaagtttgtc

SEQ ID NO: 7511276 - DNA, 22 bp, Homo sapiens
tcagtagttttgatctgagcag

SEQ ID NO: 7511277 - DNA, 22 bp, Homo sapiens
tcagtagttttaagtctgttaa

SEQ ID NO: 7511278 - DNA, 22 bp, Homo sapiens
tcagtagttttgatctgagcag

SEQ ID NO: 7511279 - DNA, 22 bp, Homo sapiens
tcagtatccacaaatgctcaaa

SEQ ID NO: 7511280 - DNA, 22 bp, Homo sapiens
tcagtatcaggctggaattaag

SEQ ID NO: 7511281 - DNA, 19 bp, Homo sapiens
tcagtatataattacacca

SEQ ID NO: 7511282 - DNA, 23 bp, Homo sapiens
tcagtagtcattgggaaagtgtg

SEQ ID NO: 7511283 - DNA, 22 bp, Homo sapiens
tcagtagtcttgggccgacttg

SEQ ID NO: 7511284 - DNA, 23 bp, Homo sapiens
tcagtagtgcaactttaaggcag

SEQ ID NO: 7511285 - DNA, 23 bp, Homo sapiens
tcagtagtgcattgaataagtgc

SEQ ID NO: 7511286 - DNA, 23 bp, Homo sapiens
tcagtagtgcattgaataagtgc

SEQ ID NO: 7511287 - DNA, 23 bp, Homo sapiens
tcagtagtgcattgaataagtgc

SEQ ID NO: 7511288 - DNA, 23 bp, Homo sapiens
tcagtagtgcaactttaaggcag

SEQ ID NO: 7511289 - DNA, 22 bp, Homo sapiens
tcagtagtggctgtagccaaat

SEQ ID NO: 7511290 - DNA, 22 bp, Homo sapiens
tcagtagtggctgtagccaaat

SEQ ID NO: 7511291 - DNA, 22 bp, Homo sapiens
tcagtagtggcttagaagaagg

SEQ ID NO: 7511292 - DNA, 22 bp, Homo sapiens
tcagtagtgtgccagtgggcat

SEQ ID NO: 7511293 - DNA, 22 bp, Homo sapiens
tcagtagtgtgccagtgggcat

SEQ ID NO: 7511294 - DNA, 22 bp, Homo sapiens
tcagtagtttctgctttgtgtt

SEQ ID NO: 7511295 - DNA, 22 bp, Homo sapiens
tcagtagtttctgctttgtgtt

SEQ ID NO: 7511296 - DNA, 22 bp, Homo sapiens
tcagtagtgttagcaatgttaa

SEQ ID NO: 7511297 - DNA, 21 bp, Homo sapiens
tcagtagttcggttttctcac

SEQ ID NO: 7511298 - DNA, 22 bp, Homo sapiens
tcagtagtgtgccagtgggcat

SEQ ID NO: 7511299 - DNA, 22 bp, Homo sapiens
tcagtagttcagcaaatatttt

SEQ ID NO: 7511300 - DNA, 22 bp, Homo sapiens
tcagtagttcagcaaatatttt

SEQ ID NO: 7511301 - DNA, 22 bp, Homo sapiens
tcagtagttcagcaaatatttt

SEQ ID NO: 7511302 - DNA, 22 bp, Homo sapiens
tcagtacagcttagtcttctca

SEQ ID NO: 7511303 - DNA, 23 bp, Homo sapiens
tcagtaccacagctgcatgacct

SEQ ID NO: 7511304 - DNA, 22 bp, Homo sapiens
tcagtacacttcagtatttgtg

SEQ ID NO: 7511305 - DNA, 22 bp, Homo sapiens
tcagtacacttcagtatttgtg

SEQ ID NO: 7511306 - DNA, 22 bp, Homo sapiens
tcagtacaaaggtgctctcaag

SEQ ID NO: 7511307 - DNA, 22 bp, Homo sapiens
tcagtacaaaggtgctctcaag

SEQ ID NO: 7511308 - DNA, 22 bp, Homo sapiens
tcagtaattacctatgactcga

SEQ ID NO: 7511309 - DNA, 22 bp, Homo sapiens
tcagtaatattctttaaaatac

SEQ ID NO: 7511310 - DNA, 22 bp, Homo sapiens
tcagtaatattctttaaaatac

SEQ ID NO: 7511311 - DNA, 22 bp, Homo sapiens
tcagtaatattctttaaaatac

SEQ ID NO: 7511312 - DNA, 23 bp, Homo sapiens
tcagtactctgctgggtatagag

SEQ ID NO: 7511313 - DNA, 22 bp, Homo sapiens
tcagtagtctaggatttcacct

SEQ ID NO: 7511314 - DNA, 22 bp, Homo sapiens
tcagtagtctaggatttcacct

SEQ ID NO: 7511315 - DNA, 23 bp, Homo sapiens
tcagtagtcattgggaaagtgtg

SEQ ID NO: 7511316 - DNA, 23 bp, Homo sapiens
tcagtagtcattgggaaagtgtg

SEQ ID NO: 7511317 - DNA, 22 bp, Homo sapiens
tcagtagtaaatggatttggaa

SEQ ID NO: 7511318 - DNA, 22 bp, Homo sapiens
tcagtagtatggctttgttgat

SEQ ID NO: 7511319 - DNA, 22 bp, Homo sapiens
tcagtagcccttgagttcatgt

SEQ ID NO: 7511320 - DNA, 22 bp, Homo sapiens
tcagtagcagaaagcaatgagt

SEQ ID NO: 7511321 - DNA, 22 bp, Homo sapiens
tcagtaaataactcagatgctc

SEQ ID NO: 7511322 - DNA, 22 bp, Homo sapiens
tcagtaaagttctttcttgctg

SEQ ID NO: 7511323 - DNA, 22 bp, Homo sapiens
tcagtaaagttctttcttgctg

SEQ ID NO: 7511324 - DNA, 22 bp, Homo sapiens
tcagtaaagtctctagagggta

SEQ ID NO: 7511325 - DNA, 22 bp, Homo sapiens
tcagtaaatctctaattggcat

SEQ ID NO: 7511326 - DNA, 22 bp, Homo sapiens
tcagtaaataactcagatgctc

SEQ ID NO: 7511327 - DNA, 22 bp, Homo sapiens
tcagtaaataactcagatgctc

SEQ ID NO: 7511328 - DNA, 22 bp, Homo sapiens
tcagtaaatctctaattggcat

SEQ ID NO: 7511329 - DNA, 22 bp, Homo sapiens
tcagtaaatgaatgaatatatg

SEQ ID NO: 7511330 - DNA, 21 bp, Homo sapiens
tcagtaaacctaaagattgta

SEQ ID NO: 7511331 - DNA, 21 bp, Homo sapiens
tcagtaaacctaaagattgta

SEQ ID NO: 7511332 - DNA, 22 bp, Homo sapiens
tcagtaaaggctaggttatgct

SEQ ID NO: 7511333 - DNA, 22 bp, Homo sapiens
tcagtaaaggctaggttatgct

SEQ ID NO: 7511334 - DNA, 22 bp, Homo sapiens
tcagtaaaggggaggtgatggg

SEQ ID NO: 7511335 - DNA, 22 bp, Homo sapiens
tcagtaaaggggaggtgatggg

SEQ ID NO: 7511336 - DNA, 22 bp, Homo sapiens
tcagtaaacaggtttaagtcct

SEQ ID NO: 7511337 - DNA, 22 bp, Homo sapiens
tcagtaaaattacagatctaca

SEQ ID NO: 7511338 - DNA, 22 bp, Homo sapiens
tcagtaaaattacagatctaca

SEQ ID NO: 7511339 - DNA, 23 bp, Homo sapiens
tcagtaaatggtaaagtctcttc

SEQ ID NO: 7511340 - DNA, 22 bp, Homo sapiens
tcagtaaatggttgctgttatt

SEQ ID NO: 7511341 - DNA, 22 bp, Homo sapiens
tcagtaaccctgctgttcagag

SEQ ID NO: 7511342 - DNA, 19 bp, Homo sapiens
tcagtaacttttaagagga

SEQ ID NO: 7511343 - DNA, 22 bp, Homo sapiens
tcagtaacttcatgaccaagca

SEQ ID NO: 7511344 - DNA, 22 bp, Homo sapiens
tcagtaacttacttattcacct

SEQ ID NO: 7511345 - DNA, 22 bp, Homo sapiens
tcagtaaatgcctttctgtgaa

SEQ ID NO: 7511346 - DNA, 22 bp, Homo sapiens
tcagtaaatgcttgcaggccga

SEQ ID NO: 7511347 - DNA, 22 bp, Homo sapiens
tcagtaaatgagcaaaaatttc

SEQ ID NO: 7511348 - DNA, 22 bp, Homo sapiens
tcagtaaatgagcaaaaatttc

SEQ ID NO: 7511349 - DNA, 22 bp, Homo sapiens
tcagtaaatgaatgaatatatg

SEQ ID NO: 7511350 - DNA, 22 bp, Homo sapiens
tcagtaaatgaatgaatatatg

SEQ ID NO: 7511351 - DNA, 22 bp, Homo sapiens
tcagtaaatgaatgaatatatg

SEQ ID NO: 7511352 - DNA, 22 bp, Homo sapiens
tcagggctcagcatctggcatt

SEQ ID NO: 7511353 - DNA, 22 bp, Homo sapiens
tcagggctcagcatctggcatt

SEQ ID NO: 7511354 - DNA, 22 bp, Homo sapiens
tcagggctcagcatctggcatt

SEQ ID NO: 7511355 - DNA, 22 bp, Homo sapiens
tcagggctcagcatctggcatt

SEQ ID NO: 7511356 - DNA, 22 bp, Homo sapiens
tcagggctcagcatctggcatt

SEQ ID NO: 7511357 - DNA, 22 bp, Homo sapiens
tcagggctcaccagcctctgcc

SEQ ID NO: 7511358 - DNA, 22 bp, Homo sapiens
tcagggctcaccagcctctgcc

SEQ ID NO: 7511359 - DNA, 23 bp, Homo sapiens
tcagggctcacacgttttctggc

SEQ ID NO: 7511360 - DNA, 22 bp, Homo sapiens
tcagggctgactgctactctcc

SEQ ID NO: 7511361 - DNA, 22 bp, Homo sapiens
tcagggctgactgctactctcc

SEQ ID NO: 7511362 - DNA, 22 bp, Homo sapiens
tcagggctgactgctactctcc

SEQ ID NO: 7511363 - DNA, 22 bp, Homo sapiens
tcagggctgactgctactctcc

SEQ ID NO: 7511364 - DNA, 22 bp, Homo sapiens
tcagggctccggaagtggcctc

SEQ ID NO: 7511365 - DNA, 22 bp, Homo sapiens
tcagggctccggaagtggcctc

SEQ ID NO: 7511366 - DNA, 22 bp, Homo sapiens
tcagggctcagtgggataggtc

SEQ ID NO: 7511367 - DNA, 22 bp, Homo sapiens
tcagggctgcatacaggagata

SEQ ID NO: 7511368 - DNA, 22 bp, Homo sapiens
tcagggctgcatacaggagata

SEQ ID NO: 7511369 - DNA, 22 bp, Homo sapiens
tcagggctgcatacaggagata

SEQ ID NO: 7511370 - DNA, 22 bp, Homo sapiens
tcagggctgcatacaggagata

SEQ ID NO: 7511371 - DNA, 22 bp, Homo sapiens
tcagggctgcatacaggagata

SEQ ID NO: 7511372 - DNA, 22 bp, Homo sapiens
tcagggctgcagaagaggcagg

SEQ ID NO: 7511373 - DNA, 22 bp, Homo sapiens
tcagggctgcagaagaggcagg

SEQ ID NO: 7511374 - DNA, 22 bp, Homo sapiens
tcagggctgcagaagaggcagg

SEQ ID NO: 7511375 - DNA, 22 bp, Homo sapiens
tcagggctgcagaagaggcagg

SEQ ID NO: 7511376 - DNA, 22 bp, Homo sapiens
tcagggctgcagaagaggcagg

SEQ ID NO: 7511377 - DNA, 22 bp, Homo sapiens
tcagggctgcatacaggagata

SEQ ID NO: 7511378 - DNA, 22 bp, Homo sapiens
tcagtaaaacctgcttttagtg

SEQ ID NO: 7511379 - DNA, 22 bp, Homo sapiens
tcagggctgccgggcagaccgt

SEQ ID NO: 7511380 - DNA, 22 bp, Homo sapiens
tcagtaaaataaaacatgggac

SEQ ID NO: 7511381 - DNA, 22 bp, Homo sapiens
tcagtaaaagggtgctttactc

SEQ ID NO: 7511382 - DNA, 22 bp, Homo sapiens
tcagggccggggctgtggcgag

SEQ ID NO: 7511383 - DNA, 22 bp, Homo sapiens
tcagggccggggctgtggcgag

SEQ ID NO: 7511384 - DNA, 22 bp, Homo sapiens
tcagggcctgagcttttaatta

SEQ ID NO: 7511385 - DNA, 22 bp, Homo sapiens
tcagggcctgagcttttaatta

SEQ ID NO: 7511386 - DNA, 22 bp, Homo sapiens
tcagggcctttgcagttgtttt

SEQ ID NO: 7511387 - DNA, 22 bp, Homo sapiens
tcagggccgccggggatctcgc

SEQ ID NO: 7511388 - DNA, 19 bp, Homo sapiens
tcagggccgcagagggtac

SEQ ID NO: 7511389 - DNA, 22 bp, Homo sapiens
tcagggccgccggggatctcgc

SEQ ID NO: 7511390 - DNA, 22 bp, Homo sapiens
tcagggccgccggggatctcgc

SEQ ID NO: 7511391 - DNA, 19 bp, Homo sapiens
tcagggccgcagagggtac

SEQ ID NO: 7511392 - DNA, 22 bp, Homo sapiens
tcagggccctggcaggaaacag

SEQ ID NO: 7511393 - DNA, 22 bp, Homo sapiens
tcagggccctggcaggaaacag

SEQ ID NO: 7511394 - DNA, 22 bp, Homo sapiens
tcagggccctggacaaccctcc

SEQ ID NO: 7511395 - DNA, 22 bp, Homo sapiens
tcagggcatctcttaagtggtg

SEQ ID NO: 7511396 - DNA, 22 bp, Homo sapiens
tcagggcatccattgcctgttg

SEQ ID NO: 7511397 - DNA, 22 bp, Homo sapiens
tcagggcatccattgcctgttg

SEQ ID NO: 7511398 - DNA, 22 bp, Homo sapiens
tcagggcatcatcatgaatata

SEQ ID NO: 7511399 - DNA, 22 bp, Homo sapiens
tcagggcatcatcatgaatata

SEQ ID NO: 7511400 - DNA, 22 bp, Homo sapiens
tcagggcatcatcatgaatata

SEQ ID NO: 7511401 - DNA, 22 bp, Homo sapiens
tcagggcatactcttcaaggtc

SEQ ID NO: 7511402 - DNA, 21 bp, Homo sapiens
tcagggcagtgggaggttcct

SEQ ID NO: 7511403 - DNA, 21 bp, Homo sapiens
tcagggcagtgggaggttcct

SEQ ID NO: 7511404 - DNA, 22 bp, Homo sapiens
tcagggcatactcttcaaggtc

SEQ ID NO: 7511405 - DNA, 22 bp, Homo sapiens
tcagggcatactcttcaaggtc

SEQ ID NO: 7511406 - DNA, 22 bp, Homo sapiens
tcctgagatgagacagtgctgc

SEQ ID NO: 7511407 - DNA, 22 bp, Homo sapiens
tcctgagatgagacagtgctgc

SEQ ID NO: 7511408 - DNA, 22 bp, Homo sapiens
tcctgagatgagacagtgctgc

SEQ ID NO: 7511409 - DNA, 22 bp, Homo sapiens
tcctgagatgagacagtgctgc

SEQ ID NO: 7511410 - DNA, 22 bp, Homo sapiens
tcctgagatccttttagggatc

SEQ ID NO: 7511411 - DNA, 22 bp, Homo sapiens
tcctgagatccttttagggatc

SEQ ID NO: 7511412 - DNA, 22 bp, Homo sapiens
tcctgagatccttttagggatc

SEQ ID NO: 7511413 - DNA, 22 bp, Homo sapiens
tcctgagatgctgatttcgggg

SEQ ID NO: 7511414 - DNA, 23 bp, Homo sapiens
tcctgagatgagacagtgctgcc

SEQ ID NO: 7511415 - DNA, 23 bp, Homo sapiens
tcctgagatgagacagtgctgcc

SEQ ID NO: 7511416 - DNA, 23 bp, Homo sapiens
tcctgagatgagacagtgctgcc

SEQ ID NO: 7511417 - DNA, 23 bp, Homo sapiens
tcctgagatgagacagtgctgcc

SEQ ID NO: 7511418 - DNA, 22 bp, Homo sapiens
tcctgagatgagacagtgctgc

SEQ ID NO: 7511419 - DNA, 22 bp, Homo sapiens
tcctgagatgagacagtgctgc

SEQ ID NO: 7511420 - DNA, 22 bp, Homo sapiens
tcctgagaggtttataacgcag

SEQ ID NO: 7511421 - DNA, 22 bp, Homo sapiens
tcctgagaggtttataacgcag

SEQ ID NO: 7511422 - DNA, 22 bp, Homo sapiens
tcctgagagtcaagaatgcagg

SEQ ID NO: 7511423 - DNA, 22 bp, Homo sapiens
tcctgagagtcaagaatgcagg

SEQ ID NO: 7511424 - DNA, 22 bp, Homo sapiens
tcctgagagtcaagaatgcagg

SEQ ID NO: 7511425 - DNA, 20 bp, Homo sapiens
tcctgagaggctcttggaga

SEQ ID NO: 7511426 - DNA, 20 bp, Homo sapiens
tcctgagaggctcttggaga

SEQ ID NO: 7511427 - DNA, 22 bp, Homo sapiens
tcctgagaggtgtgaggtgcag

SEQ ID NO: 7511428 - DNA, 22 bp, Homo sapiens
tcctgagaggtgtgaggtgcag

SEQ ID NO: 7511429 - DNA, 22 bp, Homo sapiens
tcctgagaggtgtgaggtgcag

SEQ ID NO: 7511430 - DNA, 22 bp, Homo sapiens
tcctgagataaatctcatgtga

SEQ ID NO: 7511431 - DNA, 22 bp, Homo sapiens
tcctgagataaatctcatgtga

SEQ ID NO: 7511432 - DNA, 22 bp, Homo sapiens
tcctgagataaatctcatgtga

SEQ ID NO: 7511433 - DNA, 22 bp, Homo sapiens
tcctgagataggagttgaaggc

SEQ ID NO: 7511434 - DNA, 22 bp, Homo sapiens
tcctgagataggagttgaaggc

SEQ ID NO: 7511435 - DNA, 20 bp, Homo sapiens
tcctgagcctccaccatgtc

SEQ ID NO: 7511436 - DNA, 22 bp, Homo sapiens
tcctgagccctgtaggaccctg

SEQ ID NO: 7511437 - DNA, 22 bp, Homo sapiens
tcctgagccctggggtcagtgt

SEQ ID NO: 7511438 - DNA, 22 bp, Homo sapiens
tcctgagccctggggtcagtgt

SEQ ID NO: 7511439 - DNA, 22 bp, Homo sapiens
tcctgagccctggggtcagtgt

SEQ ID NO: 7511440 - DNA, 22 bp, Homo sapiens
tcctgagccctgtaggaccctg

SEQ ID NO: 7511441 - DNA, 22 bp, Homo sapiens
tcctgagctacagtagtatgat

SEQ ID NO: 7511442 - DNA, 22 bp, Homo sapiens
tcctgagcctgacaatcaccat

SEQ ID NO: 7511443 - DNA, 20 bp, Homo sapiens
tcctgagcctccaccatgtc

SEQ ID NO: 7511444 - DNA, 22 bp, Homo sapiens
tcctgagccctggggtcagtgt

SEQ ID NO: 7511445 - DNA, 22 bp, Homo sapiens
tcctgagccctggggtcagtgt

SEQ ID NO: 7511446 - DNA, 22 bp, Homo sapiens
tcctgagccctactctagacga

SEQ ID NO: 7511447 - DNA, 22 bp, Homo sapiens
tcctgagccctactctagacga

SEQ ID NO: 7511448 - DNA, 22 bp, Homo sapiens
tcctgagccccagggaggttgg

SEQ ID NO: 7511449 - DNA, 22 bp, Homo sapiens
tcctgagccccagggaggttgg

SEQ ID NO: 7511450 - DNA, 22 bp, Homo sapiens
tcctgagcacctatgccatggc

SEQ ID NO: 7511451 - DNA, 22 bp, Homo sapiens
tcctgagcacctatgccatggc

SEQ ID NO: 7511452 - DNA, 22 bp, Homo sapiens
tcctgagattctgcatttctaa

SEQ ID NO: 7511453 - DNA, 20 bp, Homo sapiens
tcctgagatttaaggggttc

SEQ ID NO: 7511454 - DNA, 22 bp, Homo sapiens
tcctgagatgtggagctccatg

SEQ ID NO: 7511455 - DNA, 22 bp, Homo sapiens
tcctgagatgtggagctccatg

SEQ ID NO: 7511456 - DNA, 22 bp, Homo sapiens
tcctgagcacctatgccatggc

SEQ ID NO: 7511457 - DNA, 22 bp, Homo sapiens
tcctgagcacctatgccatggc

SEQ ID NO: 7511458 - DNA, 22 bp, Homo sapiens
tcctgagcacagagacaaggaa

SEQ ID NO: 7511459 - DNA, 22 bp, Homo sapiens
tcctgagcacagagacaaggaa

SEQ ID NO: 7511460 - DNA, 22 bp, Homo sapiens
tcctgagcaacacagctaagtg

SEQ ID NO: 7511461 - DNA, 20 bp, Homo sapiens
tcctgagatttaaggggttc

SEQ ID NO: 7511462 - DNA, 20 bp, Homo sapiens
tcctgagatttaaggggttc

SEQ ID NO: 7511463 - DNA, 22 bp, Homo sapiens
tcctgaggactaacaggaagga

SEQ ID NO: 7511464 - DNA, 22 bp, Homo sapiens
tcctgaggactaacaggaagga

SEQ ID NO: 7511465 - DNA, 22 bp, Homo sapiens
tcctgaggactaacaggaagga

SEQ ID NO: 7511466 - DNA, 22 bp, Homo sapiens
tcctgaggaccctgtcaggggc

SEQ ID NO: 7511467 - DNA, 22 bp, Homo sapiens
tcctgaggactaacaggaagga

SEQ ID NO: 7511468 - DNA, 22 bp, Homo sapiens
tcctgaggactaacaggaagga

SEQ ID NO: 7511469 - DNA, 22 bp, Homo sapiens
tcctgaggagaagagtgctagg

SEQ ID NO: 7511470 - DNA, 22 bp, Homo sapiens
tcctgaggactaacaggaagga

SEQ ID NO: 7511471 - DNA, 22 bp, Homo sapiens
tcctgaggaccctgtcaggggc

SEQ ID NO: 7511472 - DNA, 22 bp, Homo sapiens
tcctgaggaatgtgaagagaac

SEQ ID NO: 7511473 - DNA, 22 bp, Homo sapiens
tcctgaggaatgtgaagagaac

SEQ ID NO: 7511474 - DNA, 22 bp, Homo sapiens
tcctgaggaatgtgaagagaac

SEQ ID NO: 7511475 - DNA, 23 bp, Homo sapiens
tcctgaggaatggcatctcacat

SEQ ID NO: 7511476 - DNA, 23 bp, Homo sapiens
tcctgaggaatggcatctcacat

SEQ ID NO: 7511477 - DNA, 23 bp, Homo sapiens
tcctgaggaatggcatctcacat

SEQ ID NO: 7511478 - DNA, 23 bp, Homo sapiens
tcctgaggaatggcatctcacat

SEQ ID NO: 7511479 - DNA, 22 bp, Homo sapiens
tcctgagctttacagtaaggac

SEQ ID NO: 7511480 - DNA, 22 bp, Homo sapiens
tcctgagcttcagtttcttcat

SEQ ID NO: 7511481 - DNA, 23 bp, Homo sapiens
tcctgaggaatggcatctcacat

SEQ ID NO: 7511482 - DNA, 22 bp, Homo sapiens
tcctgaggaaagttcatgaatg

SEQ ID NO: 7511483 - DNA, 22 bp, Homo sapiens
tcctgaggaaagttcatgaatg

SEQ ID NO: 7511484 - DNA, 22 bp, Homo sapiens
tcctgaggaaagttcatgaatg

SEQ ID NO: 7511485 - DNA, 22 bp, Homo sapiens
tcctgaggaaagttcatgaatg

SEQ ID NO: 7511486 - DNA, 22 bp, Homo sapiens
tcctgagctgacacttggggag

SEQ ID NO: 7511487 - DNA, 22 bp, Homo sapiens
tcctgagctcccatgaacaggc

SEQ ID NO: 7511488 - DNA, 22 bp, Homo sapiens
tcctgagctcccatgaacaggc

SEQ ID NO: 7511489 - DNA, 22 bp, Homo sapiens
tcctgagctcccatgaacaggc

SEQ ID NO: 7511490 - DNA, 22 bp, Homo sapiens
tcctgagctgacacttggggag

SEQ ID NO: 7511491 - DNA, 22 bp, Homo sapiens
tcctgagctgccgcatcagcag

SEQ ID NO: 7511492 - DNA, 22 bp, Homo sapiens
tcctgagctgccgcatcagcag

SEQ ID NO: 7511493 - DNA, 22 bp, Homo sapiens
tcctgagctgccgcatcagcag

SEQ ID NO: 7511494 - DNA, 22 bp, Homo sapiens
tcctgaggcacaatcctagaat

SEQ ID NO: 7511495 - DNA, 22 bp, Homo sapiens
tcctgaggcacaatcctagaat

SEQ ID NO: 7511496 - DNA, 22 bp, Homo sapiens
tcctgaggcacaatcctagaat

SEQ ID NO: 7511497 - DNA, 22 bp, Homo sapiens
tcctgaggcacaatcctagaat

SEQ ID NO: 7511498 - DNA, 22 bp, Homo sapiens
tcctgaggatggttgaagtgca

SEQ ID NO: 7511499 - DNA, 22 bp, Homo sapiens
tcctgaggatggttgaagtgca

SEQ ID NO: 7511500 - DNA, 22 bp, Homo sapiens
tcctgaggatggttgaagtgca

SEQ ID NO: 7511501 - DNA, 22 bp, Homo sapiens
tcctgaggagaagagtgctagg

SEQ ID NO: 7511502 - DNA, 22 bp, Homo sapiens
tcctgaggagaagagtgctagg

SEQ ID NO: 7511503 - DNA, 22 bp, Homo sapiens
tcctgaggagaagagtgctagg

SEQ ID NO: 7511504 - DNA, 22 bp, Homo sapiens
tcctgaggcctctgtgatgtga

SEQ ID NO: 7511505 - DNA, 22 bp, Homo sapiens
tcctgaggcctctgtgatgtga

SEQ ID NO: 7511506 - DNA, 22 bp, Homo sapiens
tcctgaggctaaagtgcagtgg

SEQ ID NO: 7511507 - DNA, 22 bp, Homo sapiens
tcctgaggctaaagtgcagtgg

SEQ ID NO: 7511508 - DNA, 22 bp, Homo sapiens
tcctgaggctaaagtgcagtgg

SEQ ID NO: 7511509 - DNA, 22 bp, Homo sapiens
tcctgaggcctctgtgatgtga

SEQ ID NO: 7511510 - DNA, 22 bp, Homo sapiens
tcctgaggcctctgtgatgtga

SEQ ID NO: 7511511 - DNA, 22 bp, Homo sapiens
tcctgaggccctgttagggtct

SEQ ID NO: 7511512 - DNA, 22 bp, Homo sapiens
tcctgagtgagagctgggaggt

SEQ ID NO: 7511513 - DNA, 22 bp, Homo sapiens
tcctgaggttttaaaactattc

SEQ ID NO: 7511514 - DNA, 22 bp, Homo sapiens
tcctgaggttttaaaactattc

SEQ ID NO: 7511515 - DNA, 22 bp, Homo sapiens
tcctgaggctaaagtgcagtgg

SEQ ID NO: 7511516 - DNA, 22 bp, Homo sapiens
tcctgaggctaaagtgcagtgg

SEQ ID NO: 7511517 - DNA, 22 bp, Homo sapiens
tcctgaggctaaagtgcagtgg

SEQ ID NO: 7511518 - DNA, 22 bp, Homo sapiens
tcctgaggctaaagtgcagtgg

SEQ ID NO: 7511519 - DNA, 22 bp, Homo sapiens
tcctgaggctcactttgaatgt

SEQ ID NO: 7511520 - DNA, 22 bp, Homo sapiens
tcctgaggctcactttgaatgt

SEQ ID NO: 7511521 - DNA, 22 bp, Homo sapiens
tcctgaggctcactttgaatgt

SEQ ID NO: 7511522 - DNA, 22 bp, Homo sapiens
tcctgatggcctctggctccag

SEQ ID NO: 7511523 - DNA, 22 bp, Homo sapiens
tcctgatggaggggtcatcttt

SEQ ID NO: 7511524 - DNA, 22 bp, Homo sapiens
tcctgatggaggggtcatcttt

SEQ ID NO: 7511525 - DNA, 22 bp, Homo sapiens
tcctgatggaggggtcatcttt

SEQ ID NO: 7511526 - DNA, 22 bp, Homo sapiens
tcctgagtgtttggccaggcca

SEQ ID NO: 7511527 - DNA, 22 bp, Homo sapiens
tcctgatgatattgctctttct

SEQ ID NO: 7511528 - DNA, 21 bp, Homo sapiens
tcctgagtgtgcccaggctct

SEQ ID NO: 7511529 - DNA, 20 bp, Homo sapiens
tcctgagtgcagttggcttg

SEQ ID NO: 7511530 - DNA, 22 bp, Homo sapiens
tcctgagtgagagctgggaggt

SEQ ID NO: 7511531 - DNA, 22 bp, Homo sapiens
tcctgagtgagagctgggaggt

SEQ ID NO: 7511532 - DNA, 20 bp, Homo sapiens
tcctgagtgcagttggcttg

SEQ ID NO: 7511533 - DNA, 21 bp, Homo sapiens
tcctgagtgtgcccaggctct

SEQ ID NO: 7511534 - DNA, 22 bp, Homo sapiens
tcctctttctcaacattagtta

SEQ ID NO: 7511535 - DNA, 22 bp, Homo sapiens
tcctctttaaatgcttttatct

SEQ ID NO: 7511536 - DNA, 22 bp, Homo sapiens
tcctcttgggaatacctttcta

SEQ ID NO: 7511537 - DNA, 22 bp, Homo sapiens
tcctcttctgtggattccctga

SEQ ID NO: 7511538 - DNA, 22 bp, Homo sapiens
tcctcttctgtggattccctga

SEQ ID NO: 7511539 - DNA, 22 bp, Homo sapiens
tcctcttctgtggattccctga

SEQ ID NO: 7511540 - DNA, 22 bp, Homo sapiens
tcctcttctgcctatatctgcc

SEQ ID NO: 7511541 - DNA, 22 bp, Homo sapiens
tcctcttctgcctatatctgcc

SEQ ID NO: 7511542 - DNA, 22 bp, Homo sapiens
tcctcttctgtggattccctga

SEQ ID NO: 7511543 - DNA, 22 bp, Homo sapiens
tcctcttctgtggattccctga

SEQ ID NO: 7511544 - DNA, 22 bp, Homo sapiens
tcctcttctgcctatatctgcc

SEQ ID NO: 7511545 - DNA, 22 bp, Homo sapiens
tcctcttctgcctatatctgcc

SEQ ID NO: 7511546 - DNA, 22 bp, Homo sapiens
tcctcttctgcccatcagaggc

SEQ ID NO: 7511547 - DNA, 22 bp, Homo sapiens
tcctcttcagagggacctcggg

SEQ ID NO: 7511548 - DNA, 22 bp, Homo sapiens
tcctcttcagagggacctcggg

SEQ ID NO: 7511549 - DNA, 22 bp, Homo sapiens
tcctcttccttctgtccaaatg

SEQ ID NO: 7511550 - DNA, 22 bp, Homo sapiens
tcctcttcagagggacctcggg

SEQ ID NO: 7511551 - DNA, 22 bp, Homo sapiens
tcctcttcaaaatagctctgaa

SEQ ID NO: 7511552 - DNA, 22 bp, Homo sapiens
tcctcttcaaaatagctctgaa

SEQ ID NO: 7511553 - DNA, 22 bp, Homo sapiens
tcctcttcaaaatagctctgaa

SEQ ID NO: 7511554 - DNA, 22 bp, Homo sapiens
tcctctgtggaccgggctttgg

SEQ ID NO: 7511555 - DNA, 22 bp, Homo sapiens
tcctcttcaaaatagctctgaa

SEQ ID NO: 7511556 - DNA, 22 bp, Homo sapiens
tcctcttcaaaaggatttcctt

SEQ ID NO: 7511557 - DNA, 22 bp, Homo sapiens
tcctctgtggaccgggctttgg

SEQ ID NO: 7511558 - DNA, 22 bp, Homo sapiens
tcctcttcaaaaggatttcctt

SEQ ID NO: 7511559 - DNA, 22 bp, Homo sapiens
tcctcttcaaaaggatttcctt

SEQ ID NO: 7511560 - DNA, 22 bp, Homo sapiens
tcctctggggcgtggtcctgga

SEQ ID NO: 7511561 - DNA, 22 bp, Homo sapiens
tcctctggggcgtggtcctgga

SEQ ID NO: 7511562 - DNA, 22 bp, Homo sapiens
tcctctggggcgtggtcctgga

SEQ ID NO: 7511563 - DNA, 22 bp, Homo sapiens
tcctctggggcgtggtcctgga

SEQ ID NO: 7511564 - DNA, 22 bp, Homo sapiens
tcctctggggcgtggtcctgga

SEQ ID NO: 7511565 - DNA, 22 bp, Homo sapiens
tcctctgggctccctgcaacag

SEQ ID NO: 7511566 - DNA, 22 bp, Homo sapiens
tcctcaggtgactaggtatctt

SEQ ID NO: 7511567 - DNA, 22 bp, Homo sapiens
tcctcaggtgactaggtatctt

SEQ ID NO: 7511568 - DNA, 22 bp, Homo sapiens
tcctcaggtgactaggtatctt

SEQ ID NO: 7511569 - DNA, 22 bp, Homo sapiens
tcctcaggtgactaggtatctt

SEQ ID NO: 7511570 - DNA, 22 bp, Homo sapiens
tcctcaggtcaaagcaggagaa

SEQ ID NO: 7511571 - DNA, 22 bp, Homo sapiens
tcctctgggctccctgcaacag

SEQ ID NO: 7511572 - DNA, 22 bp, Homo sapiens
tcctctgggctccctgcaacag

SEQ ID NO: 7511573 - DNA, 22 bp, Homo sapiens
tcctctgggctccctgcaacag

SEQ ID NO: 7511574 - DNA, 22 bp, Homo sapiens
tcctcagtaaggatcgtcagct

SEQ ID NO: 7511575 - DNA, 22 bp, Homo sapiens
tcctctggggtcagggcactac

SEQ ID NO: 7511576 - DNA, 22 bp, Homo sapiens
tcctctggggtcagggcactac

SEQ ID NO: 7511577 - DNA, 19 bp, Homo sapiens
tcctctggtaccacccttg

SEQ ID NO: 7511578 - DNA, 19 bp, Homo sapiens
tcctctggtaccacccttg

SEQ ID NO: 7511579 - DNA, 19 bp, Homo sapiens
tcctctggtaccacccttg

SEQ ID NO: 7511580 - DNA, 22 bp, Homo sapiens
tcctctggtcctgcagcagatc

SEQ ID NO: 7511581 - DNA, 22 bp, Homo sapiens
tcctctggtacttaaagtgctt

SEQ ID NO: 7511582 - DNA, 22 bp, Homo sapiens
tcctctggtacttaaagtgctt

SEQ ID NO: 7511583 - DNA, 22 bp, Homo sapiens
tcctctggtcctgcagcagatc

SEQ ID NO: 7511584 - DNA, 22 bp, Homo sapiens
tcctctggtcctgcagcagatc

SEQ ID NO: 7511585 - DNA, 22 bp, Homo sapiens
tcctctggtcctgcagcagatc

SEQ ID NO: 7511586 - DNA, 22 bp, Homo sapiens
tcctctggtcttcggtgtggac

SEQ ID NO: 7511587 - DNA, 22 bp, Homo sapiens
tcctctggttatacttgcaccc

SEQ ID NO: 7511588 - DNA, 22 bp, Homo sapiens
tcctctggttatacttgcaccc

SEQ ID NO: 7511589 - DNA, 22 bp, Homo sapiens
tcctctggttatacttgcaccc

SEQ ID NO: 7511590 - DNA, 19 bp, Homo sapiens
tcctgaaaacttctggaat

SEQ ID NO: 7511591 - DNA, 19 bp, Homo sapiens
tcctgaaaacttctggaat

SEQ ID NO: 7511592 - DNA, 22 bp, Homo sapiens
tcctgaaaaattacatgttcag

SEQ ID NO: 7511593 - DNA, 22 bp, Homo sapiens
tcctgaaaaattacatgttcag

SEQ ID NO: 7511594 - DNA, 22 bp, Homo sapiens
tcctgaaaataatttcacaaga

SEQ ID NO: 7511595 - DNA, 22 bp, Homo sapiens
tcctgaaaaattacatgttcag

SEQ ID NO: 7511596 - DNA, 22 bp, Homo sapiens
tcctgaaaataatttcacaaga

SEQ ID NO: 7511597 - DNA, 19 bp, Homo sapiens
tcctgaaaacttctggaat

SEQ ID NO: 7511598 - DNA, 19 bp, Homo sapiens
tcctgaaaacttctggaat

SEQ ID NO: 7511599 - DNA, 22 bp, Homo sapiens
tcctgaaattctggttgtcact

SEQ ID NO: 7511600 - DNA, 22 bp, Homo sapiens
tcctgaaatttgttttaattct

SEQ ID NO: 7511601 - DNA, 22 bp, Homo sapiens
tcctgaaatttgttttaattct

SEQ ID NO: 7511602 - DNA, 22 bp, Homo sapiens
tcctgaaatgtgcacatgacat

SEQ ID NO: 7511603 - DNA, 22 bp, Homo sapiens
tcctgaaattctggttgtcact

SEQ ID NO: 7511604 - DNA, 22 bp, Homo sapiens
tcctgaaaataatttcacaaga

SEQ ID NO: 7511605 - DNA, 22 bp, Homo sapiens
tcctgaaatgtgcacatgacat

SEQ ID NO: 7511606 - DNA, 22 bp, Homo sapiens
tcctgaaaataatttcacaaga

SEQ ID NO: 7511607 - DNA, 22 bp, Homo sapiens
tcctgaaatgtgcacatgacat

SEQ ID NO: 7511608 - DNA, 22 bp, Homo sapiens
tcctgaaatgtgcacatgacat

SEQ ID NO: 7511609 - DNA, 22 bp, Homo sapiens
tcctgaaatgtgcacatgacat

SEQ ID NO: 7511610 - DNA, 22 bp, Homo sapiens
tcctgaagatgaaaagagaggt

SEQ ID NO: 7511611 - DNA, 22 bp, Homo sapiens
tcctgaagaggctacactgctt

SEQ ID NO: 7511612 - DNA, 22 bp, Homo sapiens
tcctgaagaggttgtctttata

SEQ ID NO: 7511613 - DNA, 22 bp, Homo sapiens
tcctgaagcagttagcatgagc

SEQ ID NO: 7511614 - DNA, 22 bp, Homo sapiens
tcctgaagcagttagcatgagc

SEQ ID NO: 7511615 - DNA, 22 bp, Homo sapiens
tcctgaagcagttagcatgagc

SEQ ID NO: 7511616 - DNA, 22 bp, Homo sapiens
tcctgaagcagttagcatgagc

SEQ ID NO: 7511617 - DNA, 19 bp, Homo sapiens
tcctgaagatttcctcagc

SEQ ID NO: 7511618 - DNA, 22 bp, Homo sapiens
tcctgaacattatgcaagcttc

SEQ ID NO: 7511619 - DNA, 22 bp, Homo sapiens
tcctgaacagtgtagcagagag

SEQ ID NO: 7511620 - DNA, 22 bp, Homo sapiens
tcctgaacattatgcaagcttc

SEQ ID NO: 7511621 - DNA, 22 bp, Homo sapiens
tcctgaagaacgaagtcatgta

SEQ ID NO: 7511622 - DNA, 22 bp, Homo sapiens
tcctgaagaacgaagtcatgta

SEQ ID NO: 7511623 - DNA, 22 bp, Homo sapiens
tcctgaagaaggcagatatttg

SEQ ID NO: 7511624 - DNA, 22 bp, Homo sapiens
tcctgaagaaggcagatatttg

SEQ ID NO: 7511625 - DNA, 22 bp, Homo sapiens
tcctgaagagccctgctctgtg

SEQ ID NO: 7511626 - DNA, 22 bp, Homo sapiens
tcctgaagagccctgctctgtg

SEQ ID NO: 7511627 - DNA, 22 bp, Homo sapiens
tcctgaaggcctgagttccacc

SEQ ID NO: 7511628 - DNA, 22 bp, Homo sapiens
tcctgagaatagagttgcatgt

SEQ ID NO: 7511629 - DNA, 22 bp, Homo sapiens
tcctgaaggcctgagttccacc

SEQ ID NO: 7511630 - DNA, 22 bp, Homo sapiens
tcctgagaaggcacagcttgca

SEQ ID NO: 7511631 - DNA, 22 bp, Homo sapiens
tcctgaaggcctgagttccacc

SEQ ID NO: 7511632 - DNA, 22 bp, Homo sapiens
tcctgagaatagagttgcatgt

SEQ ID NO: 7511633 - DNA, 22 bp, Homo sapiens
tcctgagaatagagttgcatgt

SEQ ID NO: 7511634 - DNA, 22 bp, Homo sapiens
tcctgagacatctctgctggtc

SEQ ID NO: 7511635 - DNA, 22 bp, Homo sapiens
tcctgaagcctgagtgatgact

SEQ ID NO: 7511636 - DNA, 22 bp, Homo sapiens
tcctgaagcctgagtgatgact

SEQ ID NO: 7511637 - DNA, 22 bp, Homo sapiens
tcctgaagctctcttaaggaaa

SEQ ID NO: 7511638 - DNA, 22 bp, Homo sapiens
tcctgaaggagcagttgctggg

SEQ ID NO: 7511639 - DNA, 22 bp, Homo sapiens
tcctgaaggagcagttgctggg

SEQ ID NO: 7511640 - DNA, 22 bp, Homo sapiens
tcctgaaggcagatggggatca

SEQ ID NO: 7511641 - DNA, 22 bp, Homo sapiens
tcctgaaggcagatggggatca

SEQ ID NO: 7511642 - DNA, 22 bp, Homo sapiens
tcctgaaggcagatggggatca

SEQ ID NO: 7511643 - DNA, 20 bp, Homo sapiens
tcctgagacctgggaaggtt

SEQ ID NO: 7511644 - DNA, 22 bp, Homo sapiens
tcctgagagcagagtccaggtg

SEQ ID NO: 7511645 - DNA, 22 bp, Homo sapiens
tcctgagacatctctgctggtc

SEQ ID NO: 7511646 - DNA, 22 bp, Homo sapiens
tcctgagacatctctgctggtc

SEQ ID NO: 7511647 - DNA, 22 bp, Homo sapiens
tcctgagacatctctgctggtc

SEQ ID NO: 7511648 - DNA, 20 bp, Homo sapiens
tcctgagacctgggaaggtt

SEQ ID NO: 7511649 - DNA, 20 bp, Homo sapiens
tcctgagacctgggaaggtt

SEQ ID NO: 7511650 - DNA, 22 bp, Homo sapiens
tcctgagagcagctgctttgga

SEQ ID NO: 7511651 - DNA, 22 bp, Homo sapiens
tcctgagagcagctgctttgga

SEQ ID NO: 7511652 - DNA, 22 bp, Homo sapiens
tcctgagagcagctgctttgga

SEQ ID NO: 7511653 - DNA, 22 bp, Homo sapiens
tcctgagagcagctgctttgga

SEQ ID NO: 7511654 - DNA, 20 bp, Homo sapiens
tcctgagaggctcttggaga

SEQ ID NO: 7511655 - DNA, 22 bp, Homo sapiens
tcctgagagccttggcttcaga

SEQ ID NO: 7511656 - DNA, 22 bp, Homo sapiens
tcctgagagccttggcttcaga

SEQ ID NO: 7511657 - DNA, 22 bp, Homo sapiens
tcctgcctcttttcttattcca

SEQ ID NO: 7511658 - DNA, 22 bp, Homo sapiens
tcctgcctcttttcttattcca

SEQ ID NO: 7511659 - DNA, 22 bp, Homo sapiens
tcctgcctcttttcttattcca

SEQ ID NO: 7511660 - DNA, 22 bp, Homo sapiens
tcctgcctcttttcttattcca

SEQ ID NO: 7511661 - DNA, 22 bp, Homo sapiens
tcctgcctcttttcttattcca

SEQ ID NO: 7511662 - DNA, 22 bp, Homo sapiens
tcctgcctcttgccttcttcac

SEQ ID NO: 7511663 - DNA, 22 bp, Homo sapiens
tcctgcctcttgccttcttcac

SEQ ID NO: 7511664 - DNA, 22 bp, Homo sapiens
tcctgcctcttgccttcttcac

SEQ ID NO: 7511665 - DNA, 22 bp, Homo sapiens
tcctgcctctccatgctaacta

SEQ ID NO: 7511666 - DNA, 22 bp, Homo sapiens
tcctgcctcttgccttcttcac

SEQ ID NO: 7511667 - DNA, 22 bp, Homo sapiens
tcctgcctcttgccttcttcac

SEQ ID NO: 7511668 - DNA, 22 bp, Homo sapiens
tcctgcctcttgccttcttcac

SEQ ID NO: 7511669 - DNA, 22 bp, Homo sapiens
tcctgcctctccatgctaacta

SEQ ID NO: 7511670 - DNA, 22 bp, Homo sapiens
tcctgcctctccatgctaacta

SEQ ID NO: 7511671 - DNA, 22 bp, Homo sapiens
tcctgcctctccatgctaacta

SEQ ID NO: 7511672 - DNA, 22 bp, Homo sapiens
tcctgcctgcaatcccagcact

SEQ ID NO: 7511673 - DNA, 22 bp, Homo sapiens
tcctgcctgcaatcccagcact

SEQ ID NO: 7511674 - DNA, 22 bp, Homo sapiens
tcctgcctgcaatcccagcact

SEQ ID NO: 7511675 - DNA, 22 bp, Homo sapiens
tcctgcctgcaatcccagcact

SEQ ID NO: 7511676 - DNA, 22 bp, Homo sapiens
tcctgcctgcaatcccagcact

SEQ ID NO: 7511677 - DNA, 22 bp, Homo sapiens
tcctgcctgcaatcccagcact

SEQ ID NO: 7511678 - DNA, 22 bp, Homo sapiens
tcctgcctgcaatcccagcact

SEQ ID NO: 7511679 - DNA, 22 bp, Homo sapiens
tcctgcctgagcgtggaggagg

SEQ ID NO: 7511680 - DNA, 22 bp, Homo sapiens
tcctgcctgagcgtggaggagg

SEQ ID NO: 7511681 - DNA, 22 bp, Homo sapiens
tcctgcctgagcgtggaggagg

SEQ ID NO: 7511682 - DNA, 22 bp, Homo sapiens
tcctgcctcttttcttattcca

SEQ ID NO: 7511683 - DNA, 22 bp, Homo sapiens
tcctgcctgcaatcccagcact

SEQ ID NO: 7511684 - DNA, 22 bp, Homo sapiens
tcctgcctgagcgtggaggagg

SEQ ID NO: 7511685 - DNA, 22 bp, Homo sapiens
tcctgcctgagcgtggaggagg

SEQ ID NO: 7511686 - DNA, 22 bp, Homo sapiens
tcctgcctgagcgtggaggagg

SEQ ID NO: 7511687 - DNA, 22 bp, Homo sapiens
tcctgcctctccatgctaacta

SEQ ID NO: 7511688 - DNA, 22 bp, Homo sapiens
tcctgcctctccatgctaacta

SEQ ID NO: 7511689 - DNA, 22 bp, Homo sapiens
tcctgcctcaggctctggagta

SEQ ID NO: 7511690 - DNA, 22 bp, Homo sapiens
tcctgcctcaggctctggagta

SEQ ID NO: 7511691 - DNA, 22 bp, Homo sapiens
tcctgcctcaggctctggagta

SEQ ID NO: 7511692 - DNA, 22 bp, Homo sapiens
tcctgcctcaggctctggagta

SEQ ID NO: 7511693 - DNA, 22 bp, Homo sapiens
tcctgcctcaggctctggagta

SEQ ID NO: 7511694 - DNA, 22 bp, Homo sapiens
tcctgcctcacagttgaagttt

SEQ ID NO: 7511695 - DNA, 22 bp, Homo sapiens
tcctgcctcacagttgaagttt

SEQ ID NO: 7511696 - DNA, 22 bp, Homo sapiens
tcctgcctagcaggtgacctat

SEQ ID NO: 7511697 - DNA, 22 bp, Homo sapiens
tcctgcctcacagttgaagttt

SEQ ID NO: 7511698 - DNA, 22 bp, Homo sapiens
tcctgcctcaggctctggagta

SEQ ID NO: 7511699 - DNA, 22 bp, Homo sapiens
tcctgcctcacagttgaagttt

SEQ ID NO: 7511700 - DNA, 22 bp, Homo sapiens
tcctgcctcaggctctggagta

SEQ ID NO: 7511701 - DNA, 22 bp, Homo sapiens
tcctgcctcaggctctggagta

SEQ ID NO: 7511702 - DNA, 22 bp, Homo sapiens
tcctgcctaccttgcggaggtg

SEQ ID NO: 7511703 - DNA, 22 bp, Homo sapiens
tcctgcctaccttgcggaggtg

SEQ ID NO: 7511704 - DNA, 22 bp, Homo sapiens
tcctgcctaccttgcggaggtg

SEQ ID NO: 7511705 - DNA, 22 bp, Homo sapiens
tcctgccgtcctccggggcctc

SEQ ID NO: 7511706 - DNA, 22 bp, Homo sapiens
tcctgcctaccttgcggaggtg

SEQ ID NO: 7511707 - DNA, 22 bp, Homo sapiens
tcctgcctagcaggtgacctat

SEQ ID NO: 7511708 - DNA, 22 bp, Homo sapiens
tcctgcctagcaggtgacctat

SEQ ID NO: 7511709 - DNA, 22 bp, Homo sapiens
tcctgcctagcaggtgacctat

SEQ ID NO: 7511710 - DNA, 22 bp, Homo sapiens
tcctgcctagcaggtgacctat

SEQ ID NO: 7511711 - DNA, 22 bp, Homo sapiens
tcctgcctagcaggtgacctat

SEQ ID NO: 7511712 - DNA, 22 bp, Homo sapiens
tcctgcctagcaggtgacctat

SEQ ID NO: 7511713 - DNA, 22 bp, Homo sapiens
tcctgcctagcaggtgacctat

SEQ ID NO: 7511714 - DNA, 22 bp, Homo sapiens
tcctgcctagcaggtgacctat

SEQ ID NO: 7511715 - DNA, 22 bp, Homo sapiens
tcctgcctagcaggtgacctat

SEQ ID NO: 7511716 - DNA, 22 bp, Homo sapiens
tcctgcctcacagttgaagttt

SEQ ID NO: 7511717 - DNA, 22 bp, Homo sapiens
tcctgcctgcaatcccagcact

SEQ ID NO: 7511718 - DNA, 22 bp, Homo sapiens
tcctgcagacctcagtcaggtc

SEQ ID NO: 7511719 - DNA, 22 bp, Homo sapiens
tcctgcagacctcagtcaggtc

SEQ ID NO: 7511720 - DNA, 22 bp, Homo sapiens
tcctgcagacctcagtcaggtc

SEQ ID NO: 7511721 - DNA, 22 bp, Homo sapiens
tcctgcagacctcagtcaggtc

SEQ ID NO: 7511722 - DNA, 22 bp, Homo sapiens
tcctgcagacctcagtcaggtc

SEQ ID NO: 7511723 - DNA, 22 bp, Homo sapiens
tcctgcagacctcagtcaggtc

SEQ ID NO: 7511724 - DNA, 19 bp, Homo sapiens
tcctgcagaccagacctgt

SEQ ID NO: 7511725 - DNA, 22 bp, Homo sapiens
tcctgcagacctcagtcaggtc

SEQ ID NO: 7511726 - DNA, 19 bp, Homo sapiens
tcctgcagaccagacctgt

SEQ ID NO: 7511727 - DNA, 19 bp, Homo sapiens
tcctgcagaccagacctgt

SEQ ID NO: 7511728 - DNA, 22 bp, Homo sapiens
tcctgcagagacagaggcctca

SEQ ID NO: 7511729 - DNA, 22 bp, Homo sapiens
tcctgcagagacagaggcctca

SEQ ID NO: 7511730 - DNA, 22 bp, Homo sapiens
tcctgcagacctcagtcaggtc

SEQ ID NO: 7511731 - DNA, 22 bp, Homo sapiens
tcctgcagagacagaggcctca

SEQ ID NO: 7511732 - DNA, 22 bp, Homo sapiens
tcctgcagagacagaggcctca

SEQ ID NO: 7511733 - DNA, 22 bp, Homo sapiens
tcctgcagagacagaggcctca

SEQ ID NO: 7511734 - DNA, 22 bp, Homo sapiens
tcctgcagacctcagtcaggtc

SEQ ID NO: 7511735 - DNA, 22 bp, Homo sapiens
tcctgcacagcctaagtagaaa

SEQ ID NO: 7511736 - DNA, 21 bp, Homo sapiens
tcctgcaccctccctgtggct

SEQ ID NO: 7511737 - DNA, 22 bp, Homo sapiens
tcctgcacagttggtgcttgaa

SEQ ID NO: 7511738 - DNA, 22 bp, Homo sapiens
tcctgcacattagtatttttta

SEQ ID NO: 7511739 - DNA, 21 bp, Homo sapiens
tcctgatgtgtaaaaggcagg

SEQ ID NO: 7511740 - DNA, 22 bp, Homo sapiens
tcctgattaggtttccatagct

SEQ ID NO: 7511741 - DNA, 22 bp, Homo sapiens
tcctgatggttctctggttctt

SEQ ID NO: 7511742 - DNA, 22 bp, Homo sapiens
tcctgatgtgcacttgcacctc

SEQ ID NO: 7511743 - DNA, 22 bp, Homo sapiens
tcctgcacaccttgagcttgga

SEQ ID NO: 7511744 - DNA, 22 bp, Homo sapiens
tcctgcacaccttgagcttgga

SEQ ID NO: 7511745 - DNA, 20 bp, Homo sapiens
tcctgcaaaaggacaagttt

SEQ ID NO: 7511746 - DNA, 22 bp, Homo sapiens
tcctgcacaccttgagcttgga

SEQ ID NO: 7511747 - DNA, 21 bp, Homo sapiens
tcctgcagaatgccttcctac

SEQ ID NO: 7511748 - DNA, 21 bp, Homo sapiens
tcctgcagaatgccttcctac

SEQ ID NO: 7511749 - DNA, 21 bp, Homo sapiens
tcctgcagaatgccttcctac

SEQ ID NO: 7511750 - DNA, 22 bp, Homo sapiens
tcctgcagacatttacaccttt

SEQ ID NO: 7511751 - DNA, 22 bp, Homo sapiens
tcctgcagacatttacaccttt

SEQ ID NO: 7511752 - DNA, 21 bp, Homo sapiens
tcctgcagaatgccttcctac

SEQ ID NO: 7511753 - DNA, 19 bp, Homo sapiens
tcctgcagaccagacctgt

SEQ ID NO: 7511754 - DNA, 22 bp, Homo sapiens
tcctgcagacatttacaccttt

SEQ ID NO: 7511755 - DNA, 19 bp, Homo sapiens
tcctgcagaccagacctgt

SEQ ID NO: 7511756 - DNA, 19 bp, Homo sapiens
tcctgcagaccagacctgt

SEQ ID NO: 7511757 - DNA, 19 bp, Homo sapiens
tcctgcagaccagacctgt

SEQ ID NO: 7511758 - DNA, 22 bp, Homo sapiens
tcctgcagatcaaagcctttga

SEQ ID NO: 7511759 - DNA, 23 bp, Homo sapiens
tcctgcagataagctggttgaca

SEQ ID NO: 7511760 - DNA, 22 bp, Homo sapiens
tcctgcagatcaaagcctttga

SEQ ID NO: 7511761 - DNA, 22 bp, Homo sapiens
tcctgcagatcaaagcctttga

SEQ ID NO: 7511762 - DNA, 22 bp, Homo sapiens
tcctgcagatcaaagcctttga

SEQ ID NO: 7511763 - DNA, 22 bp, Homo sapiens
tcctgcagagtcccactgattt

SEQ ID NO: 7511764 - DNA, 22 bp, Homo sapiens
tcctgcagagtcccactgattt

SEQ ID NO: 7511765 - DNA, 22 bp, Homo sapiens
tcctgcagagtcccactgattt

SEQ ID NO: 7511766 - DNA, 23 bp, Homo sapiens
tcctgcagataagctggttgaca

SEQ ID NO: 7511767 - DNA, 22 bp, Homo sapiens
tcctgcagagtcccactgattt

SEQ ID NO: 7511768 - DNA, 22 bp, Homo sapiens
tcctgcagagtcccactgattt

SEQ ID NO: 7511769 - DNA, 22 bp, Homo sapiens
tcctgcagagccgccctcaggt

SEQ ID NO: 7511770 - DNA, 22 bp, Homo sapiens
tcctgcagagccgccctcaggt

SEQ ID NO: 7511771 - DNA, 22 bp, Homo sapiens
tcctgcagagccgccctcaggt

SEQ ID NO: 7511772 - DNA, 22 bp, Homo sapiens
tcctgcagagccgccctcaggt

SEQ ID NO: 7511773 - DNA, 22 bp, Homo sapiens
tcctgcagagccgccctcaggt

SEQ ID NO: 7511774 - DNA, 22 bp, Homo sapiens
tcctgcagagacagaggcctca

SEQ ID NO: 7511775 - DNA, 22 bp, Homo sapiens
tcctgcagagacagaggcctca

SEQ ID NO: 7511776 - DNA, 22 bp, Homo sapiens
tcctgcagagccgccctcaggt

SEQ ID NO: 7511777 - DNA, 22 bp, Homo sapiens
tcctgcagccaagggtcatcga

SEQ ID NO: 7511778 - DNA, 22 bp, Homo sapiens
tcctgcagccaagggtcatcga

SEQ ID NO: 7511779 - DNA, 22 bp, Homo sapiens
tcctgcagcatccgtcgtctgt

SEQ ID NO: 7511780 - DNA, 22 bp, Homo sapiens
tcctgcagccactgcaggcaga

SEQ ID NO: 7511781 - DNA, 22 bp, Homo sapiens
tcctgcagccactgcaggcaga

SEQ ID NO: 7511782 - DNA, 22 bp, Homo sapiens
tcctgcagccaagggtcatcga

SEQ ID NO: 7511783 - DNA, 22 bp, Homo sapiens
tcctgcagccaagggtcatcga

SEQ ID NO: 7511784 - DNA, 22 bp, Homo sapiens
tcctgcagccaagggtcatcga

SEQ ID NO: 7511785 - DNA, 22 bp, Homo sapiens
tcctgcagccaagggtcatcga

SEQ ID NO: 7511786 - DNA, 22 bp, Homo sapiens
tcctgcagccactgcaggcaga

SEQ ID NO: 7511787 - DNA, 22 bp, Homo sapiens
tcctgcagccactgcaggcaga

SEQ ID NO: 7511788 - DNA, 22 bp, Homo sapiens
tcctgcagccactgcaggcaga

SEQ ID NO: 7511789 - DNA, 22 bp, Homo sapiens
tcctgcagccattagaggtcaa

SEQ ID NO: 7511790 - DNA, 22 bp, Homo sapiens
tcctgcagccattagaggtcaa

SEQ ID NO: 7511791 - DNA, 22 bp, Homo sapiens
tcctgcagccattagaggtcaa

SEQ ID NO: 7511792 - DNA, 22 bp, Homo sapiens
tcctgcagccttgggctggagc

SEQ ID NO: 7511793 - DNA, 22 bp, Homo sapiens
tcctgcagccttgggctggagc

SEQ ID NO: 7511794 - DNA, 22 bp, Homo sapiens
tcctgcagccttgggctggagc

SEQ ID NO: 7511795 - DNA, 22 bp, Homo sapiens
tcctgcagccattagaggtcaa

SEQ ID NO: 7511796 - DNA, 22 bp, Homo sapiens
tcctgcagccactgcaggcaga

SEQ ID NO: 7511797 - DNA, 22 bp, Homo sapiens
tcctgcagccactgcaggcaga

SEQ ID NO: 7511798 - DNA, 22 bp, Homo sapiens
tcctgcagccactgcaggcaga

SEQ ID NO: 7511799 - DNA, 22 bp, Homo sapiens
tcctgcaggtggatgattctct

SEQ ID NO: 7511800 - DNA, 22 bp, Homo sapiens
tcctgcaggtggatgattctct

SEQ ID NO: 7511801 - DNA, 19 bp, Homo sapiens
tcctgcaggtggcttgcag

SEQ ID NO: 7511802 - DNA, 19 bp, Homo sapiens
tcctgcaggtggcttgcag

SEQ ID NO: 7511803 - DNA, 20 bp, Homo sapiens
tcctgcagtcgctagcgccc

SEQ ID NO: 7511804 - DNA, 20 bp, Homo sapiens
tcctgcagtcgctagcgccc

SEQ ID NO: 7511805 - DNA, 19 bp, Homo sapiens
tcctgcaggtggcttgcag

SEQ ID NO: 7511806 - DNA, 19 bp, Homo sapiens
tcctgcaggtggcttgcag

SEQ ID NO: 7511807 - DNA, 22 bp, Homo sapiens
tcctgcaggggctgaggaacca

SEQ ID NO: 7511808 - DNA, 22 bp, Homo sapiens
tcctgcaggggctgaggaacca

SEQ ID NO: 7511809 - DNA, 22 bp, Homo sapiens
tcctgcaggggctgaggaacca

SEQ ID NO: 7511810 - DNA, 21 bp, Homo sapiens
tcctgcagggcagcagagtgg

SEQ ID NO: 7511811 - DNA, 22 bp, Homo sapiens
tcctgcaggcttgagtcctcag

SEQ ID NO: 7511812 - DNA, 22 bp, Homo sapiens
tcctgcaggcttgagtcctcag

SEQ ID NO: 7511813 - DNA, 21 bp, Homo sapiens
tcctgcagggcagcagagtgg

SEQ ID NO: 7511814 - DNA, 21 bp, Homo sapiens
tcctgcagggcagcagagtgg

SEQ ID NO: 7511815 - DNA, 21 bp, Homo sapiens
tcctgcagggcagcagagtgg

SEQ ID NO: 7511816 - DNA, 21 bp, Homo sapiens
tcctgcagggcagcagagtgg

SEQ ID NO: 7511817 - DNA, 21 bp, Homo sapiens
tcctgcagggcagcagagtgg

SEQ ID NO: 7511818 - DNA, 22 bp, Homo sapiens
tcctgcaggggctgaggaacca

SEQ ID NO: 7511819 - DNA, 21 bp, Homo sapiens
tcctgcagggcagcagagtgg

SEQ ID NO: 7511820 - DNA, 22 bp, Homo sapiens
tcctgcagtctgcactctgcct

SEQ ID NO: 7511821 - DNA, 22 bp, Homo sapiens
tcctgcagtctgcactctgcct

SEQ ID NO: 7511822 - DNA, 22 bp, Homo sapiens
tcctgcagtctgcactctgcct

SEQ ID NO: 7511823 - DNA, 20 bp, Homo sapiens
tcctgcagtcgctagcgccc

SEQ ID NO: 7511824 - DNA, 22 bp, Homo sapiens
tcctgcagtctgcactctgcct

SEQ ID NO: 7511825 - DNA, 22 bp, Homo sapiens
tcctgcagtctgcactctgcct

SEQ ID NO: 7511826 - DNA, 22 bp, Homo sapiens
tcctgcccagagctctccactc

SEQ ID NO: 7511827 - DNA, 20 bp, Homo sapiens
tcctgcagtcgctagcgccc

SEQ ID NO: 7511828 - DNA, 20 bp, Homo sapiens
tcctgcagtcgctagcgccc

SEQ ID NO: 7511829 - DNA, 20 bp, Homo sapiens
tcctgcagtcgctagcgccc

SEQ ID NO: 7511830 - DNA, 22 bp, Homo sapiens
tcctgcagtctgcactctgcct

SEQ ID NO: 7511831 - DNA, 22 bp, Homo sapiens
tcctgccctgaaaagtcagtct

SEQ ID NO: 7511832 - DNA, 22 bp, Homo sapiens
tcctgccctgaaaagtcagtct

SEQ ID NO: 7511833 - DNA, 22 bp, Homo sapiens
tcctgccgtcctccggggcctc

SEQ ID NO: 7511834 - DNA, 22 bp, Homo sapiens
tcctgccctgaaaagtcagtct

SEQ ID NO: 7511835 - DNA, 22 bp, Homo sapiens
tcctgccctgaaaagtcagtct

SEQ ID NO: 7511836 - DNA, 22 bp, Homo sapiens
tcctgccctcgggggtgttcca

SEQ ID NO: 7511837 - DNA, 22 bp, Homo sapiens
tcctgccctcgggggtgttcca

SEQ ID NO: 7511838 - DNA, 22 bp, Homo sapiens
tcctgccctaagatgttatatt

SEQ ID NO: 7511839 - DNA, 22 bp, Homo sapiens
tcctgccctcgggggtgttcca

SEQ ID NO: 7511840 - DNA, 22 bp, Homo sapiens
tcctgccctcgggggtgttcca

SEQ ID NO: 7511841 - DNA, 22 bp, Homo sapiens
tcctgccctaagatgttatatt

SEQ ID NO: 7511842 - DNA, 22 bp, Homo sapiens
tcctgccccactgtttgaaaga

SEQ ID NO: 7511843 - DNA, 22 bp, Homo sapiens
tcctgcccagagctctccactc

SEQ ID NO: 7511844 - DNA, 22 bp, Homo sapiens
tcctgcaggcctgttcccagta

SEQ ID NO: 7511845 - DNA, 22 bp, Homo sapiens
tcctgcaggcctgttcccagta

SEQ ID NO: 7511846 - DNA, 22 bp, Homo sapiens
tcctgcaggccagaggggtgag

SEQ ID NO: 7511847 - DNA, 22 bp, Homo sapiens
tcctgcaggcctgttcccagta

SEQ ID NO: 7511848 - DNA, 22 bp, Homo sapiens
tcctgcaggccagaggggtgag

SEQ ID NO: 7511849 - DNA, 22 bp, Homo sapiens
tcctgcaggccagaggggtgag

SEQ ID NO: 7511850 - DNA, 22 bp, Homo sapiens
tcctgcaggcttgagtcctcag

SEQ ID NO: 7511851 - DNA, 22 bp, Homo sapiens
tcctgcaggcttgagtcctcag

SEQ ID NO: 7511852 - DNA, 22 bp, Homo sapiens
tcctgcaggcttgagtcctcag

SEQ ID NO: 7511853 - DNA, 22 bp, Homo sapiens
tcctgcaggcctgttcccagta

SEQ ID NO: 7511854 - DNA, 22 bp, Homo sapiens
tcctgcaggccagaggggtgag

SEQ ID NO: 7511855 - DNA, 22 bp, Homo sapiens
tcctgcaggccagaggggtgag

SEQ ID NO: 7511856 - DNA, 22 bp, Homo sapiens
tcctgcaggccagaggggtgag

SEQ ID NO: 7511857 - DNA, 22 bp, Homo sapiens
tcctgcaggccagaggggtgag

SEQ ID NO: 7511858 - DNA, 21 bp, Homo sapiens
tcctgcaggaggcctgagagg

SEQ ID NO: 7511859 - DNA, 21 bp, Homo sapiens
tcctgcaggaggcctgagagg

SEQ ID NO: 7511860 - DNA, 21 bp, Homo sapiens
tcctgcaggaggcctgagagg

SEQ ID NO: 7511861 - DNA, 18 bp, Homo sapiens
tcctgcagcttctatgta

SEQ ID NO: 7511862 - DNA, 18 bp, Homo sapiens
tcctgcagcttctatgta

SEQ ID NO: 7511863 - DNA, 22 bp, Homo sapiens
tcctgcagctgcagacctgggg

SEQ ID NO: 7511864 - DNA, 21 bp, Homo sapiens
tcctgcaggaggcctgagagg

SEQ ID NO: 7511865 - DNA, 18 bp, Homo sapiens
tcctgcagcttctatgta

SEQ ID NO: 7511866 - DNA, 22 bp, Homo sapiens
tcctgcagctgaagctcatgtg

SEQ ID NO: 7511867 - DNA, 22 bp, Homo sapiens
tcctgcagctgaagctcatgtg

SEQ ID NO: 7511868 - DNA, 22 bp, Homo sapiens
tcctgcagctgaagctcatgtg

SEQ ID NO: 7511869 - DNA, 22 bp, Homo sapiens
tcctgcagctgaagctcatgtg

SEQ ID NO: 7511870 - DNA, 22 bp, Homo sapiens
tcctgcagctctgagaagcatc

SEQ ID NO: 7511871 - DNA, 22 bp, Homo sapiens
tcctgcagctctgagaagcatc

SEQ ID NO: 7511872 - DNA, 22 bp, Homo sapiens
tcctgcagctctgagaagcatc

SEQ ID NO: 7511873 - DNA, 22 bp, Homo sapiens
tcctgcagctctgagaagcatc

SEQ ID NO: 7511874 - DNA, 22 bp, Homo sapiens
tcctgcagccttgggctggagc

SEQ ID NO: 7511875 - DNA, 22 bp, Homo sapiens
tcctgcagccttgggctggagc

SEQ ID NO: 7511876 - DNA, 22 bp, Homo sapiens
tcctgcagctgataaatacagt

SEQ ID NO: 7511877 - DNA, 22 bp, Homo sapiens
tcctgcagctgcagacctgggg

SEQ ID NO: 7511878 - DNA, 22 bp, Homo sapiens
tcctgcagctgcagacctgggg

SEQ ID NO: 7511879 - DNA, 22 bp, Homo sapiens
tcctgcagctgaagctcatgtg

SEQ ID NO: 7511880 - DNA, 22 bp, Homo sapiens
tcctgcagctgaagctcatgtg

SEQ ID NO: 7511881 - DNA, 22 bp, Homo sapiens
tccattatacttctgattcaaa

SEQ ID NO: 7511882 - DNA, 22 bp, Homo sapiens
tccattcagaaatctggctaca

SEQ ID NO: 7511883 - DNA, 22 bp, Homo sapiens
tccattcaattctaaagccctt

SEQ ID NO: 7511884 - DNA, 22 bp, Homo sapiens
tccattatacttctgattcaaa

SEQ ID NO: 7511885 - DNA, 22 bp, Homo sapiens
tccattcattcaggtatttagt

SEQ ID NO: 7511886 - DNA, 22 bp, Homo sapiens
tccattcattcaggtatttagt

SEQ ID NO: 7511887 - DNA, 22 bp, Homo sapiens
tccattcaggccagtgcaaagt

SEQ ID NO: 7511888 - DNA, 22 bp, Homo sapiens
tccattcaccattcagggaaca

SEQ ID NO: 7511889 - DNA, 20 bp, Homo sapiens
tccattcagcattgtggaaa

SEQ ID NO: 7511890 - DNA, 20 bp, Homo sapiens
tccattcagcattgtggaaa

SEQ ID NO: 7511891 - DNA, 17 bp, Homo sapiens
tccattcctaaggccct

SEQ ID NO: 7511892 - DNA, 22 bp, Homo sapiens
tccattctatgcttacatttat

SEQ ID NO: 7511893 - DNA, 22 bp, Homo sapiens
tccattcttttgctgtcttcct

SEQ ID NO: 7511894 - DNA, 22 bp, Homo sapiens
tccattctatgcttacatttat

SEQ ID NO: 7511895 - DNA, 22 bp, Homo sapiens
tccattctacaaggtagcaggg

SEQ ID NO: 7511896 - DNA, 22 bp, Homo sapiens
tccattcattcattgatgaaca

SEQ ID NO: 7511897 - DNA, 22 bp, Homo sapiens
tccattcttttgctgtcttcct

SEQ ID NO: 7511898 - DNA, 22 bp, Homo sapiens
tccattcttttgctgtcttcct

SEQ ID NO: 7511899 - DNA, 22 bp, Homo sapiens
tccattctttttacctctcaga

SEQ ID NO: 7511900 - DNA, 22 bp, Homo sapiens
tccattctttttacctctcaga

SEQ ID NO: 7511901 - DNA, 22 bp, Homo sapiens
tccattgacacaacaggaggaa

SEQ ID NO: 7511902 - DNA, 22 bp, Homo sapiens
tccattggtctctgtgcccagg

SEQ ID NO: 7511903 - DNA, 22 bp, Homo sapiens
tccattgctcaatatagagttt

SEQ ID NO: 7511904 - DNA, 22 bp, Homo sapiens
tccattgtgattatatacaaaa

SEQ ID NO: 7511905 - DNA, 22 bp, Homo sapiens
tccattgtctttggtcctagcc

SEQ ID NO: 7511906 - DNA, 22 bp, Homo sapiens
tccattgtgattatatacaaaa

SEQ ID NO: 7511907 - DNA, 22 bp, Homo sapiens
tccatttagctggcaaacaatg

SEQ ID NO: 7511908 - DNA, 22 bp, Homo sapiens
tccatttagctggcaaacaatg

SEQ ID NO: 7511909 - DNA, 22 bp, Homo sapiens
tccatttactattctcatatcg

SEQ ID NO: 7511910 - DNA, 21 bp, Homo sapiens
tccattgttttcccagggttt

SEQ ID NO: 7511911 - DNA, 22 bp, Homo sapiens
tccatttactattctcatatcg

SEQ ID NO: 7511912 - DNA, 22 bp, Homo sapiens
tccatttactattctcatatcg

SEQ ID NO: 7511913 - DNA, 22 bp, Homo sapiens
tcccaaaggtccgagcgggaat

SEQ ID NO: 7511914 - DNA, 22 bp, Homo sapiens
tcccaaagctactcttctgact

SEQ ID NO: 7511915 - DNA, 22 bp, Homo sapiens
tcccaaagctactcttctgact

SEQ ID NO: 7511916 - DNA, 22 bp, Homo sapiens
tcccaaagctactcttctgact

SEQ ID NO: 7511917 - DNA, 22 bp, Homo sapiens
tccattatacttctgattcaaa

SEQ ID NO: 7511918 - DNA, 22 bp, Homo sapiens
tccattatacttctgattcaaa

SEQ ID NO: 7511919 - DNA, 22 bp, Homo sapiens
tccattatacttctgattcaaa

SEQ ID NO: 7511920 - DNA, 22 bp, Homo sapiens
tccattatacttctgattcaaa

SEQ ID NO: 7511921 - DNA, 22 bp, Homo sapiens
tccattatacttctgattcaaa

SEQ ID NO: 7511922 - DNA, 22 bp, Homo sapiens
tccattatacttctgattcaaa

SEQ ID NO: 7511923 - DNA, 22 bp, Homo sapiens
tccattatacttctgattcaaa

SEQ ID NO: 7511924 - DNA, 22 bp, Homo sapiens
tccattaatgattatttctgtg

SEQ ID NO: 7511925 - DNA, 22 bp, Homo sapiens
tccattaatgattatttctgtg

SEQ ID NO: 7511926 - DNA, 22 bp, Homo sapiens
tccattatacttctgattcaaa

SEQ ID NO: 7511927 - DNA, 19 bp, Homo sapiens
tccattaagctcagagctc

SEQ ID NO: 7511928 - DNA, 22 bp, Homo sapiens
tccattaacacctgtacgtggc

SEQ ID NO: 7511929 - DNA, 19 bp, Homo sapiens
tccatgtgtttcagacctg

SEQ ID NO: 7511930 - DNA, 19 bp, Homo sapiens
tccatgtgtttcagacctg

SEQ ID NO: 7511931 - DNA, 22 bp, Homo sapiens
tccatgtggcaataggagacag

SEQ ID NO: 7511932 - DNA, 22 bp, Homo sapiens
tccatgttttctctgacaccta

SEQ ID NO: 7511933 - DNA, 22 bp, Homo sapiens
tccattaaacctggatggagtt

SEQ ID NO: 7511934 - DNA, 22 bp, Homo sapiens
tccatgttaggtaaaggcactg

SEQ ID NO: 7511935 - DNA, 22 bp, Homo sapiens
tccatggagatggatgactgta

SEQ ID NO: 7511936 - DNA, 22 bp, Homo sapiens
tccatggagatggatgactgta

SEQ ID NO: 7511937 - DNA, 22 bp, Homo sapiens
tccatggagatggatgactgta

SEQ ID NO: 7511938 - DNA, 22 bp, Homo sapiens
tccatggggcccaggatgagag

SEQ ID NO: 7511939 - DNA, 22 bp, Homo sapiens
tccatggggcccaggatgagag

SEQ ID NO: 7511940 - DNA, 22 bp, Homo sapiens
tccatgggaagattttgagtgg

SEQ ID NO: 7511941 - DNA, 22 bp, Homo sapiens
tccatggtttcagtctggctgg

SEQ ID NO: 7511942 - DNA, 22 bp, Homo sapiens
tccatggtaggtttcttaaaga

SEQ ID NO: 7511943 - DNA, 22 bp, Homo sapiens
tccatgtgaccttgagctgctt

SEQ ID NO: 7511944 - DNA, 22 bp, Homo sapiens
tccatgtgaccttgagctgctt

SEQ ID NO: 7511945 - DNA, 22 bp, Homo sapiens
tccatgtgacggtggcagtttt

SEQ ID NO: 7511946 - DNA, 22 bp, Homo sapiens
tccatgtgccaaggggcagagg

SEQ ID NO: 7511947 - DNA, 22 bp, Homo sapiens
tccatgtgcttcctcaggggaa

SEQ ID NO: 7511948 - DNA, 22 bp, Homo sapiens
tcccagagccaagctatggatg

SEQ ID NO: 7511949 - DNA, 22 bp, Homo sapiens
tcccagagcagtactccaggag

SEQ ID NO: 7511950 - DNA, 22 bp, Homo sapiens
tcccagagcagtactccaggag

SEQ ID NO: 7511951 - DNA, 22 bp, Homo sapiens
tcccagagcagtactccaggag

SEQ ID NO: 7511952 - DNA, 22 bp, Homo sapiens
tcccagagcagtactccaggag

SEQ ID NO: 7511953 - DNA, 22 bp, Homo sapiens
tcccagagccaagctatggatg

SEQ ID NO: 7511954 - DNA, 22 bp, Homo sapiens
tcccagagccaagctatggatg

SEQ ID NO: 7511955 - DNA, 22 bp, Homo sapiens
tcccagagccaagctatggatg

SEQ ID NO: 7511956 - DNA, 22 bp, Homo sapiens
tcccagagccaagctatggatg

SEQ ID NO: 7511957 - DNA, 22 bp, Homo sapiens
tcccagagccaagctatggatg

SEQ ID NO: 7511958 - DNA, 22 bp, Homo sapiens
tcccagagccaagctatggatg

SEQ ID NO: 7511959 - DNA, 22 bp, Homo sapiens
tcccagagcagatgtgctaaag

SEQ ID NO: 7511960 - DNA, 22 bp, Homo sapiens
tcccagagcagatgtgctaaag

SEQ ID NO: 7511961 - DNA, 22 bp, Homo sapiens
tcccagagcagatgtgctaaag

SEQ ID NO: 7511962 - DNA, 22 bp, Homo sapiens
tcccagagcagatgtgctaaag

SEQ ID NO: 7511963 - DNA, 22 bp, Homo sapiens
tcccagagcagatgtgctaaag

SEQ ID NO: 7511964 - DNA, 22 bp, Homo sapiens
tcccagagcagtactccaggag

SEQ ID NO: 7511965 - DNA, 22 bp, Homo sapiens
tcccagagcagtactccaggag

SEQ ID NO: 7511966 - DNA, 22 bp, Homo sapiens
tcccagagcagtactccaggag

SEQ ID NO: 7511967 - DNA, 22 bp, Homo sapiens
tcccagagcagatgtgctaaag

SEQ ID NO: 7511968 - DNA, 22 bp, Homo sapiens
tcccagagcagtactccaggag

SEQ ID NO: 7511969 - DNA, 22 bp, Homo sapiens
tcccagagacatcatttctccg

SEQ ID NO: 7511970 - DNA, 22 bp, Homo sapiens
tcccagagacatcatttctccg

SEQ ID NO: 7511971 - DNA, 22 bp, Homo sapiens
tcccagagacatcatttctccg

SEQ ID NO: 7511972 - DNA, 22 bp, Homo sapiens
tcccagagacagagcctcctcc

SEQ ID NO: 7511973 - DNA, 22 bp, Homo sapiens
tcccagagacatcatttctccg

SEQ ID NO: 7511974 - DNA, 22 bp, Homo sapiens
tcccagagacatcatttctccg

SEQ ID NO: 7511975 - DNA, 22 bp, Homo sapiens
tcccagagacagagcctcctcc

SEQ ID NO: 7511976 - DNA, 22 bp, Homo sapiens
tcccagagacagagcctcctcc

SEQ ID NO: 7511977 - DNA, 22 bp, Homo sapiens
tcccagagacagagcctcctcc

SEQ ID NO: 7511978 - DNA, 22 bp, Homo sapiens
tcccagagacagagcctcctcc

SEQ ID NO: 7511979 - DNA, 22 bp, Homo sapiens
tcccagagacagagcctcctcc

SEQ ID NO: 7511980 - DNA, 22 bp, Homo sapiens
tcccagagatttcctctccttc

SEQ ID NO: 7511981 - DNA, 22 bp, Homo sapiens
tcccagagatttcctctccttc

SEQ ID NO: 7511982 - DNA, 22 bp, Homo sapiens
tcccagagatttcctctccttc

SEQ ID NO: 7511983 - DNA, 22 bp, Homo sapiens
tcccagagatttcctctccttc

SEQ ID NO: 7511984 - DNA, 22 bp, Homo sapiens
tcccagagacatcatttctccg

SEQ ID NO: 7511985 - DNA, 22 bp, Homo sapiens
tcccagagatttcctctccttc

SEQ ID NO: 7511986 - DNA, 22 bp, Homo sapiens
tcccagagatttcctctccttc

SEQ ID NO: 7511987 - DNA, 22 bp, Homo sapiens
tcccagagatttcctctccttc

SEQ ID NO: 7511988 - DNA, 22 bp, Homo sapiens
tcccagagatttcctctccttc

SEQ ID NO: 7511989 - DNA, 22 bp, Homo sapiens
tcccagagatttcctctccttc

SEQ ID NO: 7511990 - DNA, 22 bp, Homo sapiens
tcccagagcagatgtgctaaag

SEQ ID NO: 7511991 - DNA, 22 bp, Homo sapiens
tcccaagatgacacagtggacg

SEQ ID NO: 7511992 - DNA, 22 bp, Homo sapiens
tcccaagatacgctgtaagaag

SEQ ID NO: 7511993 - DNA, 22 bp, Homo sapiens
tcccaagatgacacagtggacg

SEQ ID NO: 7511994 - DNA, 22 bp, Homo sapiens
tcccaagagctctgggataagg

SEQ ID NO: 7511995 - DNA, 22 bp, Homo sapiens
tcccaagattattgagggaggg

SEQ ID NO: 7511996 - DNA, 22 bp, Homo sapiens
tcccaagagctctgggataagg

SEQ ID NO: 7511997 - DNA, 22 bp, Homo sapiens
tcccaagattaggttggaaagg

SEQ ID NO: 7511998 - DNA, 22 bp, Homo sapiens
tcccaagattaggttggaaagg

SEQ ID NO: 7511999 - DNA, 22 bp, Homo sapiens
tcccaagatgacacagtggacg

SEQ ID NO: 7512000 - DNA, 22 bp, Homo sapiens
tcccaagagcaagaacttgctg

SEQ ID NO: 7512001 - DNA, 22 bp, Homo sapiens
tcccaagatgacacagtggacg

SEQ ID NO: 7512002 - DNA, 22 bp, Homo sapiens
tcccaagatgacacagtggacg

SEQ ID NO: 7512003 - DNA, 22 bp, Homo sapiens
tcccagagaagagctggatgga

SEQ ID NO: 7512004 - DNA, 22 bp, Homo sapiens
tcccagagacagagcctcctcc

SEQ ID NO: 7512005 - DNA, 22 bp, Homo sapiens
tcccagagacagagcctcctcc

SEQ ID NO: 7512006 - DNA, 22 bp, Homo sapiens
tcccagagaagagctggatgga

SEQ ID NO: 7512007 - DNA, 22 bp, Homo sapiens
tcccagagaagagctggatgga

SEQ ID NO: 7512008 - DNA, 22 bp, Homo sapiens
tcccagagaagagctggatgga

SEQ ID NO: 7512009 - DNA, 22 bp, Homo sapiens
tcccagagaagagctggatgga

SEQ ID NO: 7512010 - DNA, 22 bp, Homo sapiens
tcccagagaaagtcaaggtctt

SEQ ID NO: 7512011 - DNA, 19 bp, Homo sapiens
tcccaagatttctgtatca

SEQ ID NO: 7512012 - DNA, 22 bp, Homo sapiens
tcccaagattattgagggaggg

SEQ ID NO: 7512013 - DNA, 22 bp, Homo sapiens
tcccaagattattgagggaggg

SEQ ID NO: 7512014 - DNA, 19 bp, Homo sapiens
tcccaagatttctgtatca

SEQ ID NO: 7512015 - DNA, 22 bp, Homo sapiens
tcccaagagctactcaatggaa

SEQ ID NO: 7512016 - DNA, 22 bp, Homo sapiens
tcccaagagacagaatggtatc

SEQ ID NO: 7512017 - DNA, 22 bp, Homo sapiens
tcccaagagctactcaatggaa

SEQ ID NO: 7512018 - DNA, 22 bp, Homo sapiens
tcccaagacgatgtgcttggcc

SEQ ID NO: 7512019 - DNA, 22 bp, Homo sapiens
tcccaagacgatgtgcttggcc

SEQ ID NO: 7512020 - DNA, 22 bp, Homo sapiens
tcccaagactcaatttccttac

SEQ ID NO: 7512021 - DNA, 22 bp, Homo sapiens
tcccaaatataatgcaagagac

SEQ ID NO: 7512022 - DNA, 22 bp, Homo sapiens
tcccaagacctggcatccaagt

SEQ ID NO: 7512023 - DNA, 22 bp, Homo sapiens
tcccaaagtattagcatttcaa

SEQ ID NO: 7512024 - DNA, 22 bp, Homo sapiens
tcccaaagtcaagctgtgtctt

SEQ ID NO: 7512025 - DNA, 22 bp, Homo sapiens
tcccaaagtcaagctgtgtctt

SEQ ID NO: 7512026 - DNA, 22 bp, Homo sapiens
tcccaaagtcaagctgtgtctt

SEQ ID NO: 7512027 - DNA, 22 bp, Homo sapiens
tcccaaagtattagcatttcaa

SEQ ID NO: 7512028 - DNA, 22 bp, Homo sapiens
tcccaaagtattagcatttcaa

SEQ ID NO: 7512029 - DNA, 22 bp, Homo sapiens
tcccaaagtattagcatttcaa

SEQ ID NO: 7512030 - DNA, 22 bp, Homo sapiens
tcccagcctggaccctgccagt

SEQ ID NO: 7512031 - DNA, 22 bp, Homo sapiens
tcccagcctgacagtgcatcaa

SEQ ID NO: 7512032 - DNA, 22 bp, Homo sapiens
tcccagcctggaccctgccagt

SEQ ID NO: 7512033 - DNA, 22 bp, Homo sapiens
tcccagcctggaccctgccagt

SEQ ID NO: 7512034 - DNA, 22 bp, Homo sapiens
tcccagcctgacagtgcatcaa

SEQ ID NO: 7512035 - DNA, 22 bp, Homo sapiens
tcccagcctgacagtgcatcaa

SEQ ID NO: 7512036 - DNA, 22 bp, Homo sapiens
tcccagcctggaccctgccagt

SEQ ID NO: 7512037 - DNA, 22 bp, Homo sapiens
tcccagcctggaccctgccagt

SEQ ID NO: 7512038 - DNA, 22 bp, Homo sapiens
tcccagcctgacagtgcatcaa

SEQ ID NO: 7512039 - DNA, 22 bp, Homo sapiens
tcccagcctgacagtgcatcaa

SEQ ID NO: 7512040 - DNA, 22 bp, Homo sapiens
tcccagccttatctcccctggc

SEQ ID NO: 7512041 - DNA, 22 bp, Homo sapiens
tcccagccttatctcccctggc

SEQ ID NO: 7512042 - DNA, 22 bp, Homo sapiens
tcccagccttatctcccctggc

SEQ ID NO: 7512043 - DNA, 22 bp, Homo sapiens
tcccagccttatctcccctggc

SEQ ID NO: 7512044 - DNA, 22 bp, Homo sapiens
tcccagccttatctcccctggc

SEQ ID NO: 7512045 - DNA, 22 bp, Homo sapiens
tcccagccttatctcccctggc

SEQ ID NO: 7512046 - DNA, 22 bp, Homo sapiens
tcccagccttatctcccctggc

SEQ ID NO: 7512047 - DNA, 22 bp, Homo sapiens
tcccagccttatctcccctggc

SEQ ID NO: 7512048 - DNA, 22 bp, Homo sapiens
tcccagccttccagtctggttt

SEQ ID NO: 7512049 - DNA, 22 bp, Homo sapiens
tcccagccttccagtctggttt

SEQ ID NO: 7512050 - DNA, 22 bp, Homo sapiens
tcccagccttccagtctggttt

SEQ ID NO: 7512051 - DNA, 22 bp, Homo sapiens
tcccagccttatctcccctggc

SEQ ID NO: 7512052 - DNA, 22 bp, Homo sapiens
tcccagccttccttgtggtgaa

SEQ ID NO: 7512053 - DNA, 22 bp, Homo sapiens
tcccagccttccagtctggttt

SEQ ID NO: 7512054 - DNA, 22 bp, Homo sapiens
tcccagccttccagtctggttt

SEQ ID NO: 7512055 - DNA, 22 bp, Homo sapiens
tcccagccttccagtctggttt

SEQ ID NO: 7512056 - DNA, 22 bp, Homo sapiens
tcccaggcgcctggtggggagc

SEQ ID NO: 7512057 - DNA, 22 bp, Homo sapiens
tcccaggcgcctggtggggagc

SEQ ID NO: 7512058 - DNA, 22 bp, Homo sapiens
tcccaggcgcctggtggggagc

SEQ ID NO: 7512059 - DNA, 22 bp, Homo sapiens
tcccaggcgcctggtggggagc

SEQ ID NO: 7512060 - DNA, 22 bp, Homo sapiens
tcccaggcgcctggtggggagc

SEQ ID NO: 7512061 - DNA, 22 bp, Homo sapiens
tcccaggccataaaactcagag

SEQ ID NO: 7512062 - DNA, 22 bp, Homo sapiens
tcccaggctaccagtgaggtca

SEQ ID NO: 7512063 - DNA, 22 bp, Homo sapiens
tcccaggctaccagtgaggtca

SEQ ID NO: 7512064 - DNA, 22 bp, Homo sapiens
tcccaggctaccagtgaggtca

SEQ ID NO: 7512065 - DNA, 22 bp, Homo sapiens
tcccaggcgcctggtggggagc

SEQ ID NO: 7512066 - DNA, 22 bp, Homo sapiens
tcccaggcgcctggtggggagc

SEQ ID NO: 7512067 - DNA, 22 bp, Homo sapiens
tcccaggccataaaactcagag

SEQ ID NO: 7512068 - DNA, 22 bp, Homo sapiens
tcccaggccataaaactcagag

SEQ ID NO: 7512069 - DNA, 22 bp, Homo sapiens
tcccaggccataaaactcagag

SEQ ID NO: 7512070 - DNA, 16 bp, Homo sapiens
tcccaggccaggtgga

SEQ ID NO: 7512071 - DNA, 16 bp, Homo sapiens
tcccaggccaggtgga

SEQ ID NO: 7512072 - DNA, 16 bp, Homo sapiens
tcccaggccaggtgga

SEQ ID NO: 7512073 - DNA, 22 bp, Homo sapiens
tcccagcctttctttctccagc

SEQ ID NO: 7512074 - DNA, 22 bp, Homo sapiens
tcccagcctttctttctccagc

SEQ ID NO: 7512075 - DNA, 22 bp, Homo sapiens
tcccagcctttctttctccagc

SEQ ID NO: 7512076 - DNA, 22 bp, Homo sapiens
tcccaggcaggtgacaggggga

SEQ ID NO: 7512077 - DNA, 22 bp, Homo sapiens
tcccaggcaggtgacaggggga

SEQ ID NO: 7512078 - DNA, 22 bp, Homo sapiens
tcccaggcaggtgacaggggga

SEQ ID NO: 7512079 - DNA, 22 bp, Homo sapiens
tcccaggcaggtgacaggggga

SEQ ID NO: 7512080 - DNA, 22 bp, Homo sapiens
tcccaggccacacttggggaac

SEQ ID NO: 7512081 - DNA, 22 bp, Homo sapiens
tcccaggccacacttggggaac

SEQ ID NO: 7512082 - DNA, 22 bp, Homo sapiens
tcccagccttccttgtggtgaa

SEQ ID NO: 7512083 - DNA, 22 bp, Homo sapiens
tcccagccttccttgtggtgaa

SEQ ID NO: 7512084 - DNA, 22 bp, Homo sapiens
tcccagccttccttgtggtgaa

SEQ ID NO: 7512085 - DNA, 22 bp, Homo sapiens
tcccagccttccttgtggtgaa

SEQ ID NO: 7512086 - DNA, 22 bp, Homo sapiens
tcccagccttccttgtggtgaa

SEQ ID NO: 7512087 - DNA, 22 bp, Homo sapiens
tcccagccttccttgtggtgaa

SEQ ID NO: 7512088 - DNA, 22 bp, Homo sapiens
tcccagcctttctttctccagc

SEQ ID NO: 7512089 - DNA, 22 bp, Homo sapiens
tcccagcctttctttctccagc

SEQ ID NO: 7512090 - DNA, 22 bp, Homo sapiens
tcccagcctttctttctccagc

SEQ ID NO: 7512091 - DNA, 22 bp, Homo sapiens
tcccagagtattagcaattgct

SEQ ID NO: 7512092 - DNA, 22 bp, Homo sapiens
tcccagagtattagcaattgct

SEQ ID NO: 7512093 - DNA, 22 bp, Homo sapiens
tcccagagtattagcaattgct

SEQ ID NO: 7512094 - DNA, 22 bp, Homo sapiens
tcccagcataacaaactgcccg

SEQ ID NO: 7512095 - DNA, 22 bp, Homo sapiens
tcccagagtattagcaattgct

SEQ ID NO: 7512096 - DNA, 22 bp, Homo sapiens
tcccagaggttgagtcacttat

SEQ ID NO: 7512097 - DNA, 22 bp, Homo sapiens
tcccagagtattagcaattgct

SEQ ID NO: 7512098 - DNA, 22 bp, Homo sapiens
tcccagagtattagcaattgct

SEQ ID NO: 7512099 - DNA, 22 bp, Homo sapiens
tcccagaggttgagtcacttat

SEQ ID NO: 7512100 - DNA, 22 bp, Homo sapiens
tcccagaggttgagtcacttat

SEQ ID NO: 7512101 - DNA, 22 bp, Homo sapiens
tcccagaggtctctgctggttc

SEQ ID NO: 7512102 - DNA, 22 bp, Homo sapiens
tcccagaggtctctgctggttc

SEQ ID NO: 7512103 - DNA, 22 bp, Homo sapiens
tcccagaggtctctgctggttc

SEQ ID NO: 7512104 - DNA, 22 bp, Homo sapiens
tcccagaggtctctgctggttc

SEQ ID NO: 7512105 - DNA, 22 bp, Homo sapiens
tcccagaggtctctgctggttc

SEQ ID NO: 7512106 - DNA, 22 bp, Homo sapiens
tcccagaggttgagtcacttat

SEQ ID NO: 7512107 - DNA, 22 bp, Homo sapiens
tcccagaggttgagtcacttat

SEQ ID NO: 7512108 - DNA, 22 bp, Homo sapiens
tcccagaggttgagtcacttat

SEQ ID NO: 7512109 - DNA, 22 bp, Homo sapiens
tcccagaggttgagtcacttat

SEQ ID NO: 7512110 - DNA, 22 bp, Homo sapiens
tcccagaggactgttggtgcta

SEQ ID NO: 7512111 - DNA, 22 bp, Homo sapiens
tcccagaggcagttggtaactt

SEQ ID NO: 7512112 - DNA, 22 bp, Homo sapiens
tcccagaggcagttggtaactt

SEQ ID NO: 7512113 - DNA, 22 bp, Homo sapiens
tcccagaggcagttggtaactt

SEQ ID NO: 7512114 - DNA, 22 bp, Homo sapiens
tcccagaggcagttggtaactt

SEQ ID NO: 7512115 - DNA, 22 bp, Homo sapiens
tcccagagccaagctatggatg

SEQ ID NO: 7512116 - DNA, 22 bp, Homo sapiens
tcccagagccaagctatggatg

SEQ ID NO: 7512117 - DNA, 22 bp, Homo sapiens
tcccagagccaagctatggatg

SEQ ID NO: 7512118 - DNA, 22 bp, Homo sapiens
tcccagagccaagctatggatg

SEQ ID NO: 7512119 - DNA, 22 bp, Homo sapiens
tcccagagccaagctatggatg

SEQ ID NO: 7512120 - DNA, 22 bp, Homo sapiens
tcccagaggctccagtctctat

SEQ ID NO: 7512121 - DNA, 22 bp, Homo sapiens
tcccagaggctccagtctctat

SEQ ID NO: 7512122 - DNA, 22 bp, Homo sapiens
tcccagaggctccagtctctat

SEQ ID NO: 7512123 - DNA, 22 bp, Homo sapiens
tcccagaggctccagtctctat

SEQ ID NO: 7512124 - DNA, 22 bp, Homo sapiens
tcccagaggctccagtctctat

SEQ ID NO: 7512125 - DNA, 22 bp, Homo sapiens
tcccagaggctccagtctctat

SEQ ID NO: 7512126 - DNA, 22 bp, Homo sapiens
tcccagaggctccagtctctat

SEQ ID NO: 7512127 - DNA, 22 bp, Homo sapiens
tcccagaggctccagtctctat

SEQ ID NO: 7512128 - DNA, 22 bp, Homo sapiens
tcccagcctcctgacagttttg

SEQ ID NO: 7512129 - DNA, 22 bp, Homo sapiens
tcccagcctcctgacagttttg

SEQ ID NO: 7512130 - DNA, 22 bp, Homo sapiens
tcccagcctcctgacagttttg

SEQ ID NO: 7512131 - DNA, 22 bp, Homo sapiens
tcccagcctcctgacagttttg

SEQ ID NO: 7512132 - DNA, 22 bp, Homo sapiens
tcccagcctcctgacagttttg

SEQ ID NO: 7512133 - DNA, 22 bp, Homo sapiens
tcccagccggtgcctgggtccc

SEQ ID NO: 7512134 - DNA, 22 bp, Homo sapiens
tcccagccggtgcctgggtccc

SEQ ID NO: 7512135 - DNA, 23 bp, Homo sapiens
tcccagcctcttctcttgcatac

SEQ ID NO: 7512136 - DNA, 23 bp, Homo sapiens
tcccagcctcttctcttgcatac

SEQ ID NO: 7512137 - DNA, 23 bp, Homo sapiens
tcccagcctcttctcttgcatac

SEQ ID NO: 7512138 - DNA, 23 bp, Homo sapiens
tcccagcctcttctcttgcatac

SEQ ID NO: 7512139 - DNA, 22 bp, Homo sapiens
tcccagcctcctgacagttttg

SEQ ID NO: 7512140 - DNA, 22 bp, Homo sapiens
tcccagcctcctgacagttttg

SEQ ID NO: 7512141 - DNA, 22 bp, Homo sapiens
tcccagcctgacagtgcatcaa

SEQ ID NO: 7512142 - DNA, 23 bp, Homo sapiens
tcccagcctcttctcttgcatac

SEQ ID NO: 7512143 - DNA, 22 bp, Homo sapiens
tcccagccggtgcctgggtccc

SEQ ID NO: 7512144 - DNA, 22 bp, Homo sapiens
tcccagccggtgcctgggtccc

SEQ ID NO: 7512145 - DNA, 22 bp, Homo sapiens
tcccagccggtgcctgggtccc

SEQ ID NO: 7512146 - DNA, 22 bp, Homo sapiens
tcccagccggtgcctgggtccc

SEQ ID NO: 7512147 - DNA, 22 bp, Homo sapiens
tcccagcattaatgcctgtcag

SEQ ID NO: 7512148 - DNA, 22 bp, Homo sapiens
tcccagccggtgcctgggtccc

SEQ ID NO: 7512149 - DNA, 22 bp, Homo sapiens
tcccagcccaggtatgatgata

SEQ ID NO: 7512150 - DNA, 22 bp, Homo sapiens
tcccagccacaggtgtagccct

SEQ ID NO: 7512151 - DNA, 22 bp, Homo sapiens
tcccagccacaggtgtagccct

SEQ ID NO: 7512152 - DNA, 22 bp, Homo sapiens
tcccagccacaggtgtagccct

SEQ ID NO: 7512153 - DNA, 22 bp, Homo sapiens
tcccagcattaatgcctgtcag

SEQ ID NO: 7512154 - DNA, 22 bp, Homo sapiens
tcccagcattaatgcctgtcag

SEQ ID NO: 7512155 - DNA, 22 bp, Homo sapiens
tcccagcattaatgcctgtcag

SEQ ID NO: 7512156 - DNA, 22 bp, Homo sapiens
tcccagcattaatgcctgtcag

SEQ ID NO: 7512157 - DNA, 22 bp, Homo sapiens
tcccagcataacaaactgcccg

SEQ ID NO: 7512158 - DNA, 22 bp, Homo sapiens
tccagggaagagcagaggctac

SEQ ID NO: 7512159 - DNA, 22 bp, Homo sapiens
tccagggaagagcagaggctac

SEQ ID NO: 7512160 - DNA, 21 bp, Homo sapiens
tccagggaacttctcaggaat

SEQ ID NO: 7512161 - DNA, 21 bp, Homo sapiens
tccagggaacttctcaggaat

SEQ ID NO: 7512162 - DNA, 21 bp, Homo sapiens
tccagggaacttctcaggaat

SEQ ID NO: 7512163 - DNA, 21 bp, Homo sapiens
tccagggaacttctcaggaat

SEQ ID NO: 7512164 - DNA, 21 bp, Homo sapiens
tccagggaacttctcaggaat

SEQ ID NO: 7512165 - DNA, 22 bp, Homo sapiens
tccaggctttttcatgctgtct

SEQ ID NO: 7512166 - DNA, 21 bp, Homo sapiens
tccagggaacttctcaggaat

SEQ ID NO: 7512167 - DNA, 22 bp, Homo sapiens
tccaggctgggctgaagggtgc

SEQ ID NO: 7512168 - DNA, 22 bp, Homo sapiens
tccaggctgggctgaagggtgc

SEQ ID NO: 7512169 - DNA, 22 bp, Homo sapiens
tccaggctgggctgaagggtgc

SEQ ID NO: 7512170 - DNA, 23 bp, Homo sapiens
tccaggctgggacttcaactggc

SEQ ID NO: 7512171 - DNA, 23 bp, Homo sapiens
tccaggctgggacttcaactggc

SEQ ID NO: 7512172 - DNA, 23 bp, Homo sapiens
tccaggctgggacttcaactggc

SEQ ID NO: 7512173 - DNA, 23 bp, Homo sapiens
tccaggctgggacttcaactggc

SEQ ID NO: 7512174 - DNA, 22 bp, Homo sapiens
tccagggaaggtgtgaggctgg

SEQ ID NO: 7512175 - DNA, 22 bp, Homo sapiens
tccagggaaggtgtgaggctgg

SEQ ID NO: 7512176 - DNA, 22 bp, Homo sapiens
tccagggaagagcagaggctac

SEQ ID NO: 7512177 - DNA, 22 bp, Homo sapiens
tccagggaagagcagaggctac

SEQ ID NO: 7512178 - DNA, 22 bp, Homo sapiens
tccagggaagagcagaggctac

SEQ ID NO: 7512179 - DNA, 22 bp, Homo sapiens
tccagggaagagcagaggctac

SEQ ID NO: 7512180 - DNA, 22 bp, Homo sapiens
tccagggaagagcagaggctac

SEQ ID NO: 7512181 - DNA, 22 bp, Homo sapiens
tccagggaagagcagaggctac

SEQ ID NO: 7512182 - DNA, 22 bp, Homo sapiens
tccagggaagagcagaggctac

SEQ ID NO: 7512183 - DNA, 22 bp, Homo sapiens
tccagggaagagcagaggctac

SEQ ID NO: 7512184 - DNA, 22 bp, Homo sapiens
tccagggaaggtgtgaggctgg

SEQ ID NO: 7512185 - DNA, 21 bp, Homo sapiens
tccagggaatttcaactttta

SEQ ID NO: 7512186 - DNA, 21 bp, Homo sapiens
tccagggaatttcaactttta

SEQ ID NO: 7512187 - DNA, 21 bp, Homo sapiens
tccagggaatttcaactttta

SEQ ID NO: 7512188 - DNA, 21 bp, Homo sapiens
tccagggaatttcaactttta

SEQ ID NO: 7512189 - DNA, 22 bp, Homo sapiens
tccagggaaggtgtgaggctgg

SEQ ID NO: 7512190 - DNA, 22 bp, Homo sapiens
tccagggaaggtgtgaggctgg

SEQ ID NO: 7512191 - DNA, 22 bp, Homo sapiens
tccagggaaggtgtgaggctgg

SEQ ID NO: 7512192 - DNA, 22 bp, Homo sapiens
tccagggaaggtgtgaggctgg

SEQ ID NO: 7512193 - DNA, 22 bp, Homo sapiens
tccagggacacagagtccttct

SEQ ID NO: 7512194 - DNA, 22 bp, Homo sapiens
tccagggacacagagtccttct

SEQ ID NO: 7512195 - DNA, 22 bp, Homo sapiens
tccagggacacagagtccttct

SEQ ID NO: 7512196 - DNA, 22 bp, Homo sapiens
tccagggacacagagtccttct

SEQ ID NO: 7512197 - DNA, 22 bp, Homo sapiens
tccagggacacagagtccttct

SEQ ID NO: 7512198 - DNA, 22 bp, Homo sapiens
tccagggacacagagtccttct

SEQ ID NO: 7512199 - DNA, 22 bp, Homo sapiens
tccagggacagcgctggagcta

SEQ ID NO: 7512200 - DNA, 22 bp, Homo sapiens
tccagggacagcgctggagcta

SEQ ID NO: 7512201 - DNA, 22 bp, Homo sapiens
tccagggctccccaacatccag

SEQ ID NO: 7512202 - DNA, 22 bp, Homo sapiens
tccagggctgacttgggagagg

SEQ ID NO: 7512203 - DNA, 22 bp, Homo sapiens
tccagggctgacttgggagagg

SEQ ID NO: 7512204 - DNA, 22 bp, Homo sapiens
tccagggctgacttgggagagg

SEQ ID NO: 7512205 - DNA, 22 bp, Homo sapiens
tccagggctgacttgggagagg

SEQ ID NO: 7512206 - DNA, 22 bp, Homo sapiens
tccagggctgacttgggagagg

SEQ ID NO: 7512207 - DNA, 22 bp, Homo sapiens
tccagggctgacttgggagagg

SEQ ID NO: 7512208 - DNA, 23 bp, Homo sapiens
tccagggctggccagacctcggt

SEQ ID NO: 7512209 - DNA, 23 bp, Homo sapiens
tccagggctggccagacctcggt

SEQ ID NO: 7512210 - DNA, 22 bp, Homo sapiens
tccagggctgggttggctcagc

SEQ ID NO: 7512211 - DNA, 22 bp, Homo sapiens
tccagggctgggttggctcagc

SEQ ID NO: 7512212 - DNA, 22 bp, Homo sapiens
tccagggctgggttggctcagc

SEQ ID NO: 7512213 - DNA, 22 bp, Homo sapiens
tccagggctgggttggctcagc

SEQ ID NO: 7512214 - DNA, 18 bp, Homo sapiens
tccagggcttcctcctct

SEQ ID NO: 7512215 - DNA, 18 bp, Homo sapiens
tccagggcttcctcctct

SEQ ID NO: 7512216 - DNA, 22 bp, Homo sapiens
tccagggctgttactttacata

SEQ ID NO: 7512217 - DNA, 18 bp, Homo sapiens
tccagggcttcctcctct

SEQ ID NO: 7512218 - DNA, 18 bp, Homo sapiens
tccagggcttcctcctct

SEQ ID NO: 7512219 - DNA, 22 bp, Homo sapiens
tccagggctgttactttacata

SEQ ID NO: 7512220 - DNA, 22 bp, Homo sapiens
tccagggctgggttggctcagc

SEQ ID NO: 7512221 - DNA, 22 bp, Homo sapiens
tccagggctgggttggctcagc

SEQ ID NO: 7512222 - DNA, 22 bp, Homo sapiens
tccagggctgttactttacata

SEQ ID NO: 7512223 - DNA, 22 bp, Homo sapiens
tccaggtcttcctattccaggt

SEQ ID NO: 7512224 - DNA, 22 bp, Homo sapiens
tccaggtgagtgcaggtgcaga

SEQ ID NO: 7512225 - DNA, 22 bp, Homo sapiens
tccaggtgagtgcaggtgcaga

SEQ ID NO: 7512226 - DNA, 22 bp, Homo sapiens
tccaggtgagtgcaggtgcaga

SEQ ID NO: 7512227 - DNA, 22 bp, Homo sapiens
tccaggtgacagagacaggata

SEQ ID NO: 7512228 - DNA, 22 bp, Homo sapiens
tccaggtgagtgcaggtgcaga

SEQ ID NO: 7512229 - DNA, 22 bp, Homo sapiens
tccaggtgacagagacaggata

SEQ ID NO: 7512230 - DNA, 19 bp, Homo sapiens
tccaggtggagagacaccc

SEQ ID NO: 7512231 - DNA, 22 bp, Homo sapiens
tccaggtgtatttactgaagta

SEQ ID NO: 7512232 - DNA, 19 bp, Homo sapiens
tccaggtggagagacaccc

SEQ ID NO: 7512233 - DNA, 22 bp, Homo sapiens
tccaggtgccggggactgaggc

SEQ ID NO: 7512234 - DNA, 22 bp, Homo sapiens
tccaggtgccggggactgaggc

SEQ ID NO: 7512235 - DNA, 22 bp, Homo sapiens
tccaggtgggctgcacccaggc

SEQ ID NO: 7512236 - DNA, 22 bp, Homo sapiens
tccaggtgccggggactgaggc

SEQ ID NO: 7512237 - DNA, 22 bp, Homo sapiens
tccaggtgccggggactgaggc

SEQ ID NO: 7512238 - DNA, 22 bp, Homo sapiens
tccaggtgagtgcaggtgcaga

SEQ ID NO: 7512239 - DNA, 22 bp, Homo sapiens
tccaggtgccggggactgaggc

SEQ ID NO: 7512240 - DNA, 19 bp, Homo sapiens
tccaggtggagagacaccc

SEQ ID NO: 7512241 - DNA, 22 bp, Homo sapiens
tccatgctcttgtctagcctcc

SEQ ID NO: 7512242 - DNA, 19 bp, Homo sapiens
tccatgcccaggcaccaag

SEQ ID NO: 7512243 - DNA, 22 bp, Homo sapiens
tccagtcacttcattttacaga

SEQ ID NO: 7512244 - DNA, 22 bp, Homo sapiens
tccagtcacttcattttacaga

SEQ ID NO: 7512245 - DNA, 22 bp, Homo sapiens
tccagtcacttcattttacaga

SEQ ID NO: 7512246 - DNA, 19 bp, Homo sapiens
tccatgcccaggcaccaag

SEQ ID NO: 7512247 - DNA, 20 bp, Homo sapiens
tccagtatgttatttggtgt

SEQ ID NO: 7512248 - DNA, 22 bp, Homo sapiens
tccagtcaacttaatctcttta

SEQ ID NO: 7512249 - DNA, 22 bp, Homo sapiens
tccagtcaacttaatctcttta

SEQ ID NO: 7512250 - DNA, 21 bp, Homo sapiens
tccagtcaacttggcttggct

SEQ ID NO: 7512251 - DNA, 22 bp, Homo sapiens
tccagtcaagcttgagaatttc

SEQ ID NO: 7512252 - DNA, 22 bp, Homo sapiens
tccagtcaagcttgagaatttc

SEQ ID NO: 7512253 - DNA, 22 bp, Homo sapiens
tccaggtttcgctacaggagag

SEQ ID NO: 7512254 - DNA, 22 bp, Homo sapiens
tccaggtgtgctctgtgccctg

SEQ ID NO: 7512255 - DNA, 22 bp, Homo sapiens
tccaggttcaagcgattgtcct

SEQ ID NO: 7512256 - DNA, 22 bp, Homo sapiens
tccaggtgggctgcacccaggc

SEQ ID NO: 7512257 - DNA, 22 bp, Homo sapiens
tccaggtgtatttactgaagta

SEQ ID NO: 7512258 - DNA, 22 bp, Homo sapiens
tccaggtgtgctctgtgccctg

SEQ ID NO: 7512259 - DNA, 22 bp, Homo sapiens
tccagtatcaaagtcctagtcc

SEQ ID NO: 7512260 - DNA, 22 bp, Homo sapiens
tccagtatgactgatgtccttc

SEQ ID NO: 7512261 - DNA, 22 bp, Homo sapiens
tccagtacaggtctctcatttc

SEQ ID NO: 7512262 - DNA, 22 bp, Homo sapiens
tccagtacaggtctctcatttc

SEQ ID NO: 7512263 - DNA, 22 bp, Homo sapiens
tccagtactgaagctccttcaa

SEQ ID NO: 7512264 - DNA, 21 bp, Homo sapiens
tccagggctttgattctctca

SEQ ID NO: 7512265 - DNA, 21 bp, Homo sapiens
tccagggctttgattctctca

SEQ ID NO: 7512266 - DNA, 21 bp, Homo sapiens
tccagggctttgattctctca

SEQ ID NO: 7512267 - DNA, 21 bp, Homo sapiens
tccagggctttgattctctca

SEQ ID NO: 7512268 - DNA, 22 bp, Homo sapiens
tccaggtcctactggcccatag

SEQ ID NO: 7512269 - DNA, 22 bp, Homo sapiens
tccaggtctggcctgctaggca

SEQ ID NO: 7512270 - DNA, 22 bp, Homo sapiens
tccaggtctggttggacaggtt

SEQ ID NO: 7512271 - DNA, 19 bp, Homo sapiens
tccagggctttatggcttt

SEQ ID NO: 7512272 - DNA, 22 bp, Homo sapiens
tccagggcttggctgggacggt

SEQ ID NO: 7512273 - DNA, 19 bp, Homo sapiens
tccagggctttatggcttt

SEQ ID NO: 7512274 - DNA, 21 bp, Homo sapiens
tccagggctttgattctctca

SEQ ID NO: 7512275 - DNA, 19 bp, Homo sapiens
tccagggctttatggcttt

SEQ ID NO: 7512276 - DNA, 19 bp, Homo sapiens
tccagggctttatggcttt

SEQ ID NO: 7512277 - DNA, 19 bp, Homo sapiens
tccagggctttatggcttt

SEQ ID NO: 7512278 - DNA, 22 bp, Homo sapiens
tccagggcttggctgggacggt

SEQ ID NO: 7512279 - DNA, 22 bp, Homo sapiens
tccagggcttggctgggacggt

SEQ ID NO: 7512280 - DNA, 22 bp, Homo sapiens
tccagggcttggctgggacggt

SEQ ID NO: 7512281 - DNA, 22 bp, Homo sapiens
tccagggcttggctgggacggt

SEQ ID NO: 7512282 - DNA, 22 bp, Homo sapiens
tccagggcttgacagggtgcct

SEQ ID NO: 7512283 - DNA, 22 bp, Homo sapiens
tccagggcttgacagggtgcct

SEQ ID NO: 7512284 - DNA, 22 bp, Homo sapiens
tccagggcttgacagggtgcct

SEQ ID NO: 7512285 - DNA, 22 bp, Homo sapiens
tccagggcttgacagggtgcct

SEQ ID NO: 7512286 - DNA, 22 bp, Homo sapiens
tccagggcttgacagggtgcct

SEQ ID NO: 7512287 - DNA, 22 bp, Homo sapiens
tccagggcttgacagggtgcct

SEQ ID NO: 7512288 - DNA, 22 bp, Homo sapiens
tccagggcttgacagggtgcct

SEQ ID NO: 7512289 - DNA, 22 bp, Homo sapiens
tccagggcttgacagggtgcct

SEQ ID NO: 7512290 - DNA, 18 bp, Homo sapiens
tccagggcttcctcctct

SEQ ID NO: 7512291 - DNA, 18 bp, Homo sapiens
tccagggcttcctcctct

SEQ ID NO: 7512292 - DNA, 22 bp, Homo sapiens
tccaggctagagtgcagtggcc

SEQ ID NO: 7512293 - DNA, 22 bp, Homo sapiens
tccaggctagagtgcagtggcc

SEQ ID NO: 7512294 - DNA, 22 bp, Homo sapiens
tccaggctagagtgcagtggcc

SEQ ID NO: 7512295 - DNA, 22 bp, Homo sapiens
tccaggctagaagtcacaggcc

SEQ ID NO: 7512296 - DNA, 22 bp, Homo sapiens
tccaggctagagtgcagtggcc

SEQ ID NO: 7512297 - DNA, 22 bp, Homo sapiens
tccaggctagagtgcagtggcc

SEQ ID NO: 7512298 - DNA, 22 bp, Homo sapiens
tccaggctagagtgcagtggcc

SEQ ID NO: 7512299 - DNA, 22 bp, Homo sapiens
tccaggctacttggattcctgg

SEQ ID NO: 7512300 - DNA, 22 bp, Homo sapiens
tccaggctagaagtcacaggcc

SEQ ID NO: 7512301 - DNA, 22 bp, Homo sapiens
tccaggctagaagtcacaggcc

SEQ ID NO: 7512302 - DNA, 22 bp, Homo sapiens
tccaggctagaagtcacaggcc

SEQ ID NO: 7512303 - DNA, 22 bp, Homo sapiens
tccaggctacttggattcctgg

SEQ ID NO: 7512304 - DNA, 22 bp, Homo sapiens
tccaggctagaagtcacaggcc

SEQ ID NO: 7512305 - DNA, 22 bp, Homo sapiens
tccaggctagaagtcacaggcc

SEQ ID NO: 7512306 - DNA, 22 bp, Homo sapiens
tccaggctagaagtcacaggcc

SEQ ID NO: 7512307 - DNA, 22 bp, Homo sapiens
tccaggctagaagtcacaggcc

SEQ ID NO: 7512308 - DNA, 22 bp, Homo sapiens
tccaggctagaagtcacaggcc

SEQ ID NO: 7512309 - DNA, 22 bp, Homo sapiens
tccaggctaggtttacaggaca

SEQ ID NO: 7512310 - DNA, 21 bp, Homo sapiens
tccaggctggaaggggcgttg

SEQ ID NO: 7512311 - DNA, 22 bp, Homo sapiens
tccaggctggacatgaggcggg

SEQ ID NO: 7512312 - DNA, 21 bp, Homo sapiens
tccaggctggaaggggcgttg

SEQ ID NO: 7512313 - DNA, 21 bp, Homo sapiens
tccaggctggaaggggcgttg

SEQ ID NO: 7512314 - DNA, 22 bp, Homo sapiens
tccaggctggacatgaggcggg

SEQ ID NO: 7512315 - DNA, 22 bp, Homo sapiens
tccaggctggacatgaggcggg

SEQ ID NO: 7512316 - DNA, 22 bp, Homo sapiens
tccaggctagcctggtagagaa

SEQ ID NO: 7512317 - DNA, 22 bp, Homo sapiens
tccaggctagagtgcagtggcc

SEQ ID NO: 7512318 - DNA, 22 bp, Homo sapiens
tccaggctaggtttacaggaca

SEQ ID NO: 7512319 - DNA, 22 bp, Homo sapiens
tccaggctagcctggtagagaa

SEQ ID NO: 7512320 - DNA, 22 bp, Homo sapiens
tccaggctaggtttacaggaca

SEQ ID NO: 7512321 - DNA, 22 bp, Homo sapiens
tccaggctaggtttacaggaca

SEQ ID NO: 7512322 - DNA, 22 bp, Homo sapiens
tccaggctagcctggtagagaa

SEQ ID NO: 7512323 - DNA, 22 bp, Homo sapiens
tccaggctagcctggtagagaa

SEQ ID NO: 7512324 - DNA, 22 bp, Homo sapiens
tccaggctagcctggtagagaa

SEQ ID NO: 7512325 - DNA, 22 bp, Homo sapiens
tccaggctagcctggtagagaa

SEQ ID NO: 7512326 - DNA, 22 bp, Homo sapiens
tccaggctggagtgcagtggca

SEQ ID NO: 7512327 - DNA, 22 bp, Homo sapiens
tccaggctggagtgcagtggca

SEQ ID NO: 7512328 - DNA, 22 bp, Homo sapiens
tccaggctggagtgcagtggca

SEQ ID NO: 7512329 - DNA, 22 bp, Homo sapiens
tccaggctggagtgcagtggca

SEQ ID NO: 7512330 - DNA, 22 bp, Homo sapiens
tccaggctggagtgcagtggca

SEQ ID NO: 7512331 - DNA, 22 bp, Homo sapiens
tccaggctggacatgaggcggg

SEQ ID NO: 7512332 - DNA, 22 bp, Homo sapiens
tccaggctggacatgaggcggg

SEQ ID NO: 7512333 - DNA, 22 bp, Homo sapiens
tccaggctggagtgcagtggcg

SEQ ID NO: 7512334 - DNA, 22 bp, Homo sapiens
tccaggctggagtgcagtggcg

SEQ ID NO: 7512335 - DNA, 22 bp, Homo sapiens
tccaggctggagtgcagtggca

SEQ ID NO: 7512336 - DNA, 22 bp, Homo sapiens
tccaggctggagtgcagtggca

SEQ ID NO: 7512337 - DNA, 22 bp, Homo sapiens
tccaggctggagtgcagtggcg

SEQ ID NO: 7512338 - DNA, 22 bp, Homo sapiens
tccaggctggagtgcagtggcg

SEQ ID NO: 7512339 - DNA, 22 bp, Homo sapiens
tccaggctggagtgcagtggcg

SEQ ID NO: 7512340 - DNA, 22 bp, Homo sapiens
tccaggctggagtgcagtggcg

SEQ ID NO: 7512341 - DNA, 22 bp, Homo sapiens
tccaggctggcctcgcgtgaca

SEQ ID NO: 7512342 - DNA, 22 bp, Homo sapiens
tccaggctggctcttcaaaatt

SEQ ID NO: 7512343 - DNA, 22 bp, Homo sapiens
tccaggctggctcttcaaaatt

SEQ ID NO: 7512344 - DNA, 22 bp, Homo sapiens
tccaggctggcctcgcgtgaca

SEQ ID NO: 7512345 - DNA, 22 bp, Homo sapiens
tccaggctggcctcgcgtgaca

SEQ ID NO: 7512346 - DNA, 22 bp, Homo sapiens
tccaggctggctcttcaaaatt

SEQ ID NO: 7512347 - DNA, 22 bp, Homo sapiens
tccaggctggctcttcaaaatt

SEQ ID NO: 7512348 - DNA, 22 bp, Homo sapiens
tccaggctggctcttcaaaatt

SEQ ID NO: 7512349 - DNA, 22 bp, Homo sapiens
tccaggctggagtgcagtggcg

SEQ ID NO: 7512350 - DNA, 18 bp, Homo sapiens
tccaggctggattgatga

SEQ ID NO: 7512351 - DNA, 18 bp, Homo sapiens
tccaggctggattgatga

SEQ ID NO: 7512352 - DNA, 18 bp, Homo sapiens
tccaggctggattgatga

SEQ ID NO: 7512353 - DNA, 22 bp, Homo sapiens
tccaggctggcctcgcgtgaca

SEQ ID NO: 7512354 - DNA, 22 bp, Homo sapiens
tccaggctggcctcgcgtgaca

SEQ ID NO: 7512355 - DNA, 18 bp, Homo sapiens
tccaggctggattgatga

SEQ ID NO: 7512356 - DNA, 22 bp, Homo sapiens
tccaggccttgacaggtcagtt

SEQ ID NO: 7512357 - DNA, 22 bp, Homo sapiens
tccaggccttgacaggtcagtt

SEQ ID NO: 7512358 - DNA, 22 bp, Homo sapiens
tccaggccttgacaggtcagtt

SEQ ID NO: 7512359 - DNA, 22 bp, Homo sapiens
tccaggccttgacaggtcagtt

SEQ ID NO: 7512360 - DNA, 22 bp, Homo sapiens
tccaggccttgacaggtcagtt

SEQ ID NO: 7512361 - DNA, 20 bp, Homo sapiens
tccaggccttgttctcagat

SEQ ID NO: 7512362 - DNA, 22 bp, Homo sapiens
tccaggccttgacaggtcagtt

SEQ ID NO: 7512363 - DNA, 20 bp, Homo sapiens
tccaggccttgttctcagat

SEQ ID NO: 7512364 - DNA, 20 bp, Homo sapiens
tccaggccttgttctcagat

SEQ ID NO: 7512365 - DNA, 22 bp, Homo sapiens
tccaggcctgcctggtgtttgc

SEQ ID NO: 7512366 - DNA, 22 bp, Homo sapiens
tccaggcctggctccattcagt

SEQ ID NO: 7512367 - DNA, 22 bp, Homo sapiens
tccaggcctggctccattcagt

SEQ ID NO: 7512368 - DNA, 22 bp, Homo sapiens
tccaggcctggctccattcagt

SEQ ID NO: 7512369 - DNA, 22 bp, Homo sapiens
tccaggcctggctccattcagt

SEQ ID NO: 7512370 - DNA, 22 bp, Homo sapiens
tccaggccttgacaggtcagtt

SEQ ID NO: 7512371 - DNA, 22 bp, Homo sapiens
tccaggcctggctccattcagt

SEQ ID NO: 7512372 - DNA, 22 bp, Homo sapiens
tccaggcctggctccattcagt

SEQ ID NO: 7512373 - DNA, 22 bp, Homo sapiens
tccaggctaattttgcattgtt

SEQ ID NO: 7512374 - DNA, 22 bp, Homo sapiens
tccaggctacttggattcctgg

SEQ ID NO: 7512375 - DNA, 22 bp, Homo sapiens
tccaggctaattttgcattgtt

SEQ ID NO: 7512376 - DNA, 22 bp, Homo sapiens
tccaggcctttgcacatgttgt

SEQ ID NO: 7512377 - DNA, 22 bp, Homo sapiens
tccaggctaattttgcattgtt

SEQ ID NO: 7512378 - DNA, 22 bp, Homo sapiens
tccaggctaattttgcattgtt

SEQ ID NO: 7512379 - DNA, 22 bp, Homo sapiens
tccaggcctttgcacatgttgt

SEQ ID NO: 7512380 - DNA, 20 bp, Homo sapiens
tccaggccttgttctcagat

SEQ ID NO: 7512381 - DNA, 20 bp, Homo sapiens
tccaggccttgttctcagat

SEQ ID NO: 7512382 - DNA, 22 bp, Homo sapiens
tccaggctaattttgcattgtt

SEQ ID NO: 7512383 - DNA, 22 bp, Homo sapiens
tccaggcctttgcacatgttgt

SEQ ID NO: 7512384 - DNA, 22 bp, Homo sapiens
tccaggcctttgcacatgttgt

SEQ ID NO: 7512385 - DNA, 22 bp, Homo sapiens
tccaggcctgactataaatgta

SEQ ID NO: 7512386 - DNA, 18 bp, Homo sapiens
tccaggcctgaagtgtcc

SEQ ID NO: 7512387 - DNA, 18 bp, Homo sapiens
tccaggcctgaagtgtcc

SEQ ID NO: 7512388 - DNA, 18 bp, Homo sapiens
tccaggcctgaagtgtcc

SEQ ID NO: 7512389 - DNA, 18 bp, Homo sapiens
tccaggcctgaagtgtcc

SEQ ID NO: 7512390 - DNA, 18 bp, Homo sapiens
tccaggcctgaagtgtcc

SEQ ID NO: 7512391 - DNA, 22 bp, Homo sapiens
tccaggcctgcctggtgtttgc

SEQ ID NO: 7512392 - DNA, 22 bp, Homo sapiens
tccaggcctgcctggtgtttgc

SEQ ID NO: 7512393 - DNA, 22 bp, Homo sapiens
tccaggcctgcaatgacaaagc

SEQ ID NO: 7512394 - DNA, 22 bp, Homo sapiens
tccaggcctgactataaatgta

SEQ ID NO: 7512395 - DNA, 22 bp, Homo sapiens
tccaggcctgcaatgacaaagc

SEQ ID NO: 7512396 - DNA, 22 bp, Homo sapiens
tccaggcctgcaatgacaaagc

SEQ ID NO: 7512397 - DNA, 22 bp, Homo sapiens
tccaggcctgactataaatgta

SEQ ID NO: 7512398 - DNA, 21 bp, Homo sapiens
tccacaagttagaaggaaatt

SEQ ID NO: 7512399 - DNA, 21 bp, Homo sapiens
tccacaagttagaaggaaatt

SEQ ID NO: 7512400 - DNA, 21 bp, Homo sapiens
tccacaatagggaaattcacc

SEQ ID NO: 7512401 - DNA, 22 bp, Homo sapiens
tccacaaggcagctcctccagg

SEQ ID NO: 7512402 - DNA, 22 bp, Homo sapiens
tccacaaggcagctcctccagg

SEQ ID NO: 7512403 - DNA, 21 bp, Homo sapiens
tccaatttttaagactatggc

SEQ ID NO: 7512404 - DNA, 22 bp, Homo sapiens
tccaattttacgtctgtataaa

SEQ ID NO: 7512405 - DNA, 21 bp, Homo sapiens
tccaatttttaagactatggc

SEQ ID NO: 7512406 - DNA, 22 bp, Homo sapiens
tccacaagatgataaagagagg

SEQ ID NO: 7512407 - DNA, 22 bp, Homo sapiens
tccacaaggcagctcctccagg

SEQ ID NO: 7512408 - DNA, 22 bp, Homo sapiens
tccaggcctctagcccctatct

SEQ ID NO: 7512409 - DNA, 22 bp, Homo sapiens
tccaggcctctagcccctatct

SEQ ID NO: 7512410 - DNA, 22 bp, Homo sapiens
tccaggcctctagcccctatct

SEQ ID NO: 7512411 - DNA, 22 bp, Homo sapiens
tccaggcctctagcccctatct

SEQ ID NO: 7512412 - DNA, 22 bp, Homo sapiens
tccaggcctctagccctctctt

SEQ ID NO: 7512413 - DNA, 22 bp, Homo sapiens
tccaggcctctagccctctctt

SEQ ID NO: 7512414 - DNA, 22 bp, Homo sapiens
tccaggcctctagccctctctt

SEQ ID NO: 7512415 - DNA, 22 bp, Homo sapiens
tccaggcctctagccctctctt

SEQ ID NO: 7512416 - DNA, 22 bp, Homo sapiens
tccaggcctctagccctctctt

SEQ ID NO: 7512417 - DNA, 22 bp, Homo sapiens
tcctcaaagttgtataaatatt

SEQ ID NO: 7512418 - DNA, 22 bp, Homo sapiens
tcctcaaagttgtataaatatt

SEQ ID NO: 7512419 - DNA, 22 bp, Homo sapiens
tcctatgtattgccagagccag

SEQ ID NO: 7512420 - DNA, 22 bp, Homo sapiens
tcctatgttttcccctagagaa

SEQ ID NO: 7512421 - DNA, 22 bp, Homo sapiens
tcctcaaattagcagatcatag

SEQ ID NO: 7512422 - DNA, 22 bp, Homo sapiens
tcctcaaatatttacttactga

SEQ ID NO: 7512423 - DNA, 22 bp, Homo sapiens
tcctcacaagcaagcacaggta

SEQ ID NO: 7512424 - DNA, 22 bp, Homo sapiens
tcctcacaagcaagcacaggta

SEQ ID NO: 7512425 - DNA, 22 bp, Homo sapiens
tcctcaaaggatacccaggctt

SEQ ID NO: 7512426 - DNA, 22 bp, Homo sapiens
tcctcaaaggatacccaggctt

SEQ ID NO: 7512427 - DNA, 22 bp, Homo sapiens
tcctatgttttcccctagagaa

SEQ ID NO: 7512428 - DNA, 18 bp, Homo sapiens
tcctagtgaaatgcctgt

SEQ ID NO: 7512429 - DNA, 22 bp, Homo sapiens
tcctagtgcaaattggagcatg

SEQ ID NO: 7512430 - DNA, 22 bp, Homo sapiens
tcctagtgcaaattggagcatg

SEQ ID NO: 7512431 - DNA, 22 bp, Homo sapiens
tcctagttctctgccagtcgct

SEQ ID NO: 7512432 - DNA, 22 bp, Homo sapiens
tcctcacaagcaagcacaggta

SEQ ID NO: 7512433 - DNA, 22 bp, Homo sapiens
tcctcacaagcatcctgtctca

SEQ ID NO: 7512434 - DNA, 22 bp, Homo sapiens
tcctcacagagtggcaggcaat

SEQ ID NO: 7512435 - DNA, 22 bp, Homo sapiens
tcctcacactatagatgaggat

SEQ ID NO: 7512436 - DNA, 22 bp, Homo sapiens
tcctcacagcatgaccaggcag

SEQ ID NO: 7512437 - DNA, 22 bp, Homo sapiens
tcctcacagctggttcattcag

SEQ ID NO: 7512438 - DNA, 22 bp, Homo sapiens
tcctcacagctggttcattcag

SEQ ID NO: 7512439 - DNA, 22 bp, Homo sapiens
tcctcacagagtggcaggcaat

SEQ ID NO: 7512440 - DNA, 22 bp, Homo sapiens
tcctcacagatgggtgcatagc

SEQ ID NO: 7512441 - DNA, 22 bp, Homo sapiens
tcctcagaatcacctggcagct

SEQ ID NO: 7512442 - DNA, 22 bp, Homo sapiens
tcctcagaatcacctggcagct

SEQ ID NO: 7512443 - DNA, 22 bp, Homo sapiens
tcctcagaagaacccctagatt

SEQ ID NO: 7512444 - DNA, 20 bp, Homo sapiens
tcctcagaagacatttgggg

SEQ ID NO: 7512445 - DNA, 22 bp, Homo sapiens
tcctcagaaacccctgtgaggt

SEQ ID NO: 7512446 - DNA, 22 bp, Homo sapiens
tcctcagaaacccctgtgaggt

SEQ ID NO: 7512447 - DNA, 22 bp, Homo sapiens
tcctcagaagaacccctagatt

SEQ ID NO: 7512448 - DNA, 22 bp, Homo sapiens
tcctcagaatcacctggcagct

SEQ ID NO: 7512449 - DNA, 22 bp, Homo sapiens
tcctcagaatcacctggcagct

SEQ ID NO: 7512450 - DNA, 22 bp, Homo sapiens
tcctcagaatcacctggcagct

SEQ ID NO: 7512451 - DNA, 22 bp, Homo sapiens
tcctcagaatcacctggcagct

SEQ ID NO: 7512452 - DNA, 22 bp, Homo sapiens
tcctcagaatggatggcagggg

SEQ ID NO: 7512453 - DNA, 22 bp, Homo sapiens
tcctcagaatggatggcagggg

SEQ ID NO: 7512454 - DNA, 22 bp, Homo sapiens
tcctcagaatggatggcagggg

SEQ ID NO: 7512455 - DNA, 22 bp, Homo sapiens
tcctcagaatcacctggcagct

SEQ ID NO: 7512456 - DNA, 22 bp, Homo sapiens
tcctcagaatccaaactgcagt

SEQ ID NO: 7512457 - DNA, 22 bp, Homo sapiens
tcctcactttgtagccatcctt

SEQ ID NO: 7512458 - DNA, 22 bp, Homo sapiens
tcctcactttgtagccatcctt

SEQ ID NO: 7512459 - DNA, 22 bp, Homo sapiens
tcctcagaaacccctgtgaggt

SEQ ID NO: 7512460 - DNA, 22 bp, Homo sapiens
tcctcactgcagtgctccgagc

SEQ ID NO: 7512461 - DNA, 22 bp, Homo sapiens
tcctcactgcagtgctccgagc

SEQ ID NO: 7512462 - DNA, 22 bp, Homo sapiens
tcctcacatggtgagccacaca

SEQ ID NO: 7512463 - DNA, 22 bp, Homo sapiens
tcctcacagggcaggaaggagg

SEQ ID NO: 7512464 - DNA, 22 bp, Homo sapiens
tcctcacagggcaggaaggagg

SEQ ID NO: 7512465 - DNA, 22 bp, Homo sapiens
tcctcacagctggttcattcag

SEQ ID NO: 7512466 - DNA, 22 bp, Homo sapiens
tcctcacagtcaacactttgag

SEQ ID NO: 7512467 - DNA, 22 bp, Homo sapiens
tcctcacatggtgagccacaca

SEQ ID NO: 7512468 - DNA, 22 bp, Homo sapiens
tcctcacatggtgagccacaca

SEQ ID NO: 7512469 - DNA, 19 bp, Homo sapiens
tcctcaggggctcacagac

SEQ ID NO: 7512470 - DNA, 19 bp, Homo sapiens
tcctcaggggctcacagac

SEQ ID NO: 7512471 - DNA, 19 bp, Homo sapiens
tcctcaggggctcacagac

SEQ ID NO: 7512472 - DNA, 19 bp, Homo sapiens
tcctcaggggctcacagac

SEQ ID NO: 7512473 - DNA, 19 bp, Homo sapiens
tcctcaggggctcacagac

SEQ ID NO: 7512474 - DNA, 22 bp, Homo sapiens
tcctcagggcggcctccgtctt

SEQ ID NO: 7512475 - DNA, 22 bp, Homo sapiens
tcctcagggcggcctccgtctt

SEQ ID NO: 7512476 - DNA, 21 bp, Homo sapiens
tcctcagggccccagagcact

SEQ ID NO: 7512477 - DNA, 19 bp, Homo sapiens
tcctcaggggctcacagac

SEQ ID NO: 7512478 - DNA, 22 bp, Homo sapiens
tcctcagggcggcctccgtctt

SEQ ID NO: 7512479 - DNA, 21 bp, Homo sapiens
tcctcagggccccagagcact

SEQ ID NO: 7512480 - DNA, 21 bp, Homo sapiens
tcctcagggccccagagcact

SEQ ID NO: 7512481 - DNA, 21 bp, Homo sapiens
tcctcagggccccagagcact

SEQ ID NO: 7512482 - DNA, 22 bp, Homo sapiens
tcctcagcattagcacagacat

SEQ ID NO: 7512483 - DNA, 22 bp, Homo sapiens
tcctcagcattagcacagacat

SEQ ID NO: 7512484 - DNA, 21 bp, Homo sapiens
tcctcagggccccagagcact

SEQ ID NO: 7512485 - DNA, 21 bp, Homo sapiens
tcctcagggccccagagcact

SEQ ID NO: 7512486 - DNA, 21 bp, Homo sapiens
tcctcagggccccagagcact

SEQ ID NO: 7512487 - DNA, 22 bp, Homo sapiens
tcctcaggtcaaagcaggagaa

SEQ ID NO: 7512488 - DNA, 22 bp, Homo sapiens
tcctcaggtcaaagcaggagaa

SEQ ID NO: 7512489 - DNA, 22 bp, Homo sapiens
tcctcaggtcaaagcaggagaa

SEQ ID NO: 7512490 - DNA, 22 bp, Homo sapiens
tcctcaggtcaaagcaggagaa

SEQ ID NO: 7512491 - DNA, 22 bp, Homo sapiens
tcctcaggggtttcaggtgtac

SEQ ID NO: 7512492 - DNA, 22 bp, Homo sapiens
tcctcaggggtttcaggtgtac

SEQ ID NO: 7512493 - DNA, 22 bp, Homo sapiens
tcctcaggtcaaagcaggagaa

SEQ ID NO: 7512494 - DNA, 22 bp, Homo sapiens
tcctcaggtcaaagcaggagaa

SEQ ID NO: 7512495 - DNA, 22 bp, Homo sapiens
tcctcaggtcaaagcaggagaa

SEQ ID NO: 7512496 - DNA, 22 bp, Homo sapiens
tcctcaggtcaaagcaggagaa

SEQ ID NO: 7512497 - DNA, 22 bp, Homo sapiens
tcctcaggggtttcaggtgtac

SEQ ID NO: 7512498 - DNA, 22 bp, Homo sapiens
tcctcaggggtttcaggtgtac

SEQ ID NO: 7512499 - DNA, 22 bp, Homo sapiens
tcctcaggggtttcaggtgtac

SEQ ID NO: 7512500 - DNA, 22 bp, Homo sapiens
tcctcaggggtttcaggtgtac

SEQ ID NO: 7512501 - DNA, 22 bp, Homo sapiens
tcctcaggggtttcaggtgtac

SEQ ID NO: 7512502 - DNA, 22 bp, Homo sapiens
tcctcagggggccaacccagcc

SEQ ID NO: 7512503 - DNA, 22 bp, Homo sapiens
tcctcagggggccaacccagcc

SEQ ID NO: 7512504 - DNA, 22 bp, Homo sapiens
tcctcagggggccaacccagcc

SEQ ID NO: 7512505 - DNA, 22 bp, Homo sapiens
tcctcagggggccaacccagcc

SEQ ID NO: 7512506 - DNA, 19 bp, Homo sapiens
tcctcaggggctcacagac

SEQ ID NO: 7512507 - DNA, 22 bp, Homo sapiens
tcctcagagatgggcatctaag

SEQ ID NO: 7512508 - DNA, 22 bp, Homo sapiens
tcctcagacttccctttgtgta

SEQ ID NO: 7512509 - DNA, 22 bp, Homo sapiens
tcctcagacaccctgctggctt

SEQ ID NO: 7512510 - DNA, 22 bp, Homo sapiens
tcctcagacaccctgctggctt

SEQ ID NO: 7512511 - DNA, 22 bp, Homo sapiens
tcctcagatataaatgagggtg

SEQ ID NO: 7512512 - DNA, 22 bp, Homo sapiens
tcctcagatacctggcagatca

SEQ ID NO: 7512513 - DNA, 22 bp, Homo sapiens
tcctcagagcagccctccgcat

SEQ ID NO: 7512514 - DNA, 22 bp, Homo sapiens
tcctcagagcatagcgctgtct

SEQ ID NO: 7512515 - DNA, 22 bp, Homo sapiens
tcctcagagcatagcgctgtct

SEQ ID NO: 7512516 - DNA, 22 bp, Homo sapiens
tcctcagatacctggcagatca

SEQ ID NO: 7512517 - DNA, 22 bp, Homo sapiens
tcctcagcatggaatctggact

SEQ ID NO: 7512518 - DNA, 22 bp, Homo sapiens
tcctcagcatggaatctggact

SEQ ID NO: 7512519 - DNA, 22 bp, Homo sapiens
tcctcagcatggaatctggact

SEQ ID NO: 7512520 - DNA, 23 bp, Homo sapiens
tcctcagcatgttttgtcatgta

SEQ ID NO: 7512521 - DNA, 23 bp, Homo sapiens
tcctcagcatgttttgtcatgta

SEQ ID NO: 7512522 - DNA, 23 bp, Homo sapiens
tcctcagcatgttttgtcatgta

SEQ ID NO: 7512523 - DNA, 22 bp, Homo sapiens
tcctcagcattagcacagacat

SEQ ID NO: 7512524 - DNA, 23 bp, Homo sapiens
tcctcagcatgttttgtcatgta

SEQ ID NO: 7512525 - DNA, 22 bp, Homo sapiens
tcctcagcattagcacagacat

SEQ ID NO: 7512526 - DNA, 23 bp, Homo sapiens
tcctcagcatgttttgtcatgta

SEQ ID NO: 7512527 - DNA, 23 bp, Homo sapiens
tcctcagcatgttttgtcatgta

SEQ ID NO: 7512528 - DNA, 22 bp, Homo sapiens
tcctcagcaaacacttcactct

SEQ ID NO: 7512529 - DNA, 22 bp, Homo sapiens
tcctcagcaggtctgtgtacca

SEQ ID NO: 7512530 - DNA, 22 bp, Homo sapiens
tcctcagcaggtctgtgtacca

SEQ ID NO: 7512531 - DNA, 22 bp, Homo sapiens
tcctcagcaaacacttcactct

SEQ ID NO: 7512532 - DNA, 22 bp, Homo sapiens
tcctagcttgtcagttctctaa

SEQ ID NO: 7512533 - DNA, 22 bp, Homo sapiens
tcctaggaatactgcctgaaat

SEQ ID NO: 7512534 - DNA, 22 bp, Homo sapiens
tcctaggaagtggaggcacctg

SEQ ID NO: 7512535 - DNA, 22 bp, Homo sapiens
tcctaggatctggggtgttttt

SEQ ID NO: 7512536 - DNA, 22 bp, Homo sapiens
tcctaggcagttggtgctccat

SEQ ID NO: 7512537 - DNA, 22 bp, Homo sapiens
tcctagaggatggtaggaagct

SEQ ID NO: 7512538 - DNA, 19 bp, Homo sapiens
tcctagcacctggcacata

SEQ ID NO: 7512539 - DNA, 22 bp, Homo sapiens
tcctagagcctccagagggaga

SEQ ID NO: 7512540 - DNA, 22 bp, Homo sapiens
tcctagaggatggtaggaagct

SEQ ID NO: 7512541 - DNA, 20 bp, Homo sapiens
tcctagcttctctctgtaca

SEQ ID NO: 7512542 - DNA, 22 bp, Homo sapiens
tcctagctggcctctcaccagc

SEQ ID NO: 7512543 - DNA, 22 bp, Homo sapiens
tcctaggcctggcctggtggat

SEQ ID NO: 7512544 - DNA, 22 bp, Homo sapiens
tcctaggctccagaactgtgaa

SEQ ID NO: 7512545 - DNA, 22 bp, Homo sapiens
tcctaggcccagcctgagctgt

SEQ ID NO: 7512546 - DNA, 22 bp, Homo sapiens
tcctaggcccagcctgagctgt

SEQ ID NO: 7512547 - DNA, 22 bp, Homo sapiens
tcctagggattcaacactgaac

SEQ ID NO: 7512548 - DNA, 22 bp, Homo sapiens
tcctagggtaatcagcatacat

SEQ ID NO: 7512549 - DNA, 22 bp, Homo sapiens
tcctagggttggagacagtgac

SEQ ID NO: 7512550 - DNA, 22 bp, Homo sapiens
tcctagagagtaatacagtttt

SEQ ID NO: 7512551 - DNA, 22 bp, Homo sapiens
tcctagagagtaatacagtttt

SEQ ID NO: 7512552 - DNA, 22 bp, Homo sapiens
tcctagagagtaatacagtttt

SEQ ID NO: 7512553 - DNA, 22 bp, Homo sapiens
tcctagagcctccagagggaga

SEQ ID NO: 7512554 - DNA, 22 bp, Homo sapiens
tcctagagcctccagagggaga

SEQ ID NO: 7512555 - DNA, 22 bp, Homo sapiens
tcctagagatgcaatttgattt

SEQ ID NO: 7512556 - DNA, 22 bp, Homo sapiens
tcctagagatgcaatttgattt

SEQ ID NO: 7512557 - DNA, 19 bp, Homo sapiens
tcctagaatgagggtgttg

SEQ ID NO: 7512558 - DNA, 19 bp, Homo sapiens
tcctagaatgagggtgttg

SEQ ID NO: 7512559 - DNA, 22 bp, Homo sapiens
tcctagaatctttgtaagattg

SEQ ID NO: 7512560 - DNA, 22 bp, Homo sapiens
tcctagaatgcacctctgctgt

SEQ ID NO: 7512561 - DNA, 22 bp, Homo sapiens
tcctagaatgcacctctgctgt

SEQ ID NO: 7512562 - DNA, 22 bp, Homo sapiens
tcctagaataatctttgactgc

SEQ ID NO: 7512563 - DNA, 22 bp, Homo sapiens
tcctagaataatctttgactgc

SEQ ID NO: 7512564 - DNA, 22 bp, Homo sapiens
tcctagaaggatcattctagtg

SEQ ID NO: 7512565 - DNA, 22 bp, Homo sapiens
tcctagaatatttgtggaggtt

SEQ ID NO: 7512566 - DNA, 22 bp, Homo sapiens
tcctagaatagtgtgtctggag

SEQ ID NO: 7512567 - DNA, 22 bp, Homo sapiens
tcctagaatagtgtgtctggag

SEQ ID NO: 7512568 - DNA, 22 bp, Homo sapiens
tccctgggcaagtttactcttc

SEQ ID NO: 7512569 - DNA, 18 bp, Homo sapiens
tccctgggatataattac

SEQ ID NO: 7512570 - DNA, 18 bp, Homo sapiens
tccctgggatataattac

SEQ ID NO: 7512571 - DNA, 22 bp, Homo sapiens
tccgtgagattaagcagaattc

SEQ ID NO: 7512572 - DNA, 22 bp, Homo sapiens
tccgtgcccctggcactaggtc

SEQ ID NO: 7512573 - DNA, 22 bp, Homo sapiens
tccggtgctgaaggcccaggtg

SEQ ID NO: 7512574 - DNA, 22 bp, Homo sapiens
tccctgggcaagtttactcttc

SEQ ID NO: 7512575 - DNA, 22 bp, Homo sapiens
tccctgggcaagtttactcttc

SEQ ID NO: 7512576 - DNA, 22 bp, Homo sapiens
tccggtccgggtactcctctct

SEQ ID NO: 7512577 - DNA, 22 bp, Homo sapiens
tcctaaaggctgcttttatatt

SEQ ID NO: 7512578 - DNA, 22 bp, Homo sapiens
tcctaaaggctgcttttatatt

SEQ ID NO: 7512579 - DNA, 22 bp, Homo sapiens
tccgtgttccaagacagggtgg

SEQ ID NO: 7512580 - DNA, 22 bp, Homo sapiens
tccgtggggcctgtggcttccg

SEQ ID NO: 7512581 - DNA, 22 bp, Homo sapiens
tccgtggagattttgtgcaggg

SEQ ID NO: 7512582 - DNA, 22 bp, Homo sapiens
tccgtggagattttgtgcaggg

SEQ ID NO: 7512583 - DNA, 22 bp, Homo sapiens
tccgtggggcctgtggcttccg

SEQ ID NO: 7512584 - DNA, 22 bp, Homo sapiens
tccgttttcacactgctataaa

SEQ ID NO: 7512585 - DNA, 22 bp, Homo sapiens
tccctgggagatgatgatgagg

SEQ ID NO: 7512586 - DNA, 22 bp, Homo sapiens
tccctgggagatgatgatgagg

SEQ ID NO: 7512587 - DNA, 16 bp, Homo sapiens
tccctgggagtggtgg

SEQ ID NO: 7512588 - DNA, 22 bp, Homo sapiens
tccctgggagatgatgatgagg

SEQ ID NO: 7512589 - DNA, 15 bp, Homo sapiens
tccctgggagatggt

SEQ ID NO: 7512590 - DNA, 22 bp, Homo sapiens
tccctgggacggccttttggag

SEQ ID NO: 7512591 - DNA, 22 bp, Homo sapiens
tccctgggactcagacatggaa

SEQ ID NO: 7512592 - DNA, 22 bp, Homo sapiens
tccctgggactcagacatggaa

SEQ ID NO: 7512593 - DNA, 22 bp, Homo sapiens
tccctgggacggccttttggag

SEQ ID NO: 7512594 - DNA, 22 bp, Homo sapiens
tccctgggacggccttttggag

SEQ ID NO: 7512595 - DNA, 22 bp, Homo sapiens
tccctgggaccggcagctcaca

SEQ ID NO: 7512596 - DNA, 22 bp, Homo sapiens
tccctgggaccggcagctcaca

SEQ ID NO: 7512597 - DNA, 22 bp, Homo sapiens
tccctgggaccggcagctcaca

SEQ ID NO: 7512598 - DNA, 22 bp, Homo sapiens
tccctgggaccggcagctcaca

SEQ ID NO: 7512599 - DNA, 22 bp, Homo sapiens
tccctgggaccggcagctcaca

SEQ ID NO: 7512600 - DNA, 22 bp, Homo sapiens
tccctgggaccggcagctcaca

SEQ ID NO: 7512601 - DNA, 22 bp, Homo sapiens
tccctgggaacaaaggatgaga

SEQ ID NO: 7512602 - DNA, 22 bp, Homo sapiens
tccctgggaattaatatttgga

SEQ ID NO: 7512603 - DNA, 22 bp, Homo sapiens
tccctgggaacaaaggatgaga

SEQ ID NO: 7512604 - DNA, 22 bp, Homo sapiens
tccctgggaacaaaggatgaga

SEQ ID NO: 7512605 - DNA, 22 bp, Homo sapiens
tccctgggaacaaaggatgaga

SEQ ID NO: 7512606 - DNA, 22 bp, Homo sapiens
tccctgggaacaaaggatgaga

SEQ ID NO: 7512607 - DNA, 22 bp, Homo sapiens
tccctggctgtgttcaggtgcg

SEQ ID NO: 7512608 - DNA, 22 bp, Homo sapiens
tccctggctgtgttcaggtgcg

SEQ ID NO: 7512609 - DNA, 22 bp, Homo sapiens
tccctgggaaatgtcagtttca

SEQ ID NO: 7512610 - DNA, 22 bp, Homo sapiens
tccctgggaaatgtcagtttca

SEQ ID NO: 7512611 - DNA, 22 bp, Homo sapiens
tccctggctgtgttcaggtgcg

SEQ ID NO: 7512612 - DNA, 22 bp, Homo sapiens
tccctggctggtgtagagggat

SEQ ID NO: 7512613 - DNA, 22 bp, Homo sapiens
tccctggctgtgttcaggtgcg

SEQ ID NO: 7512614 - DNA, 22 bp, Homo sapiens
tccctggctgtgttcaggtgcg

SEQ ID NO: 7512615 - DNA, 22 bp, Homo sapiens
tccctggctgtgttcaggtgcg

SEQ ID NO: 7512616 - DNA, 22 bp, Homo sapiens
tccctggctggtgtagagggat

SEQ ID NO: 7512617 - DNA, 22 bp, Homo sapiens
tccctggctggtgtagagggat

SEQ ID NO: 7512618 - DNA, 22 bp, Homo sapiens
tccctggctggtgtagagggat

SEQ ID NO: 7512619 - DNA, 22 bp, Homo sapiens
tccctggctggtgtagagggat

SEQ ID NO: 7512620 - DNA, 22 bp, Homo sapiens
tccctggctgggggctgccttg

SEQ ID NO: 7512621 - DNA, 22 bp, Homo sapiens
tccctggctgggggctgccttg

SEQ ID NO: 7512622 - DNA, 22 bp, Homo sapiens
tccctggctgggggctgccttg

SEQ ID NO: 7512623 - DNA, 22 bp, Homo sapiens
tccctggctgggggctgccttg

SEQ ID NO: 7512624 - DNA, 22 bp, Homo sapiens
tccctggctgggggctgccttg

SEQ ID NO: 7512625 - DNA, 22 bp, Homo sapiens
tccctggctgggggctgccttg

SEQ ID NO: 7512626 - DNA, 19 bp, Homo sapiens
tccctggcgcctctcgggc

SEQ ID NO: 7512627 - DNA, 19 bp, Homo sapiens
tccctggcgcctctcgggc

SEQ ID NO: 7512628 - DNA, 19 bp, Homo sapiens
tccctggcgcctctcgggc

SEQ ID NO: 7512629 - DNA, 19 bp, Homo sapiens
tccctggcgcctctcgggc

SEQ ID NO: 7512630 - DNA, 19 bp, Homo sapiens
tccctggcgcctctcgggc

SEQ ID NO: 7512631 - DNA, 22 bp, Homo sapiens
tccctggcctggaaggatatca

SEQ ID NO: 7512632 - DNA, 23 bp, Homo sapiens
tccctggccgcaatggccgcctt

SEQ ID NO: 7512633 - DNA, 22 bp, Homo sapiens
tccctggccattcctctaggcc

SEQ ID NO: 7512634 - DNA, 22 bp, Homo sapiens
tccctggccattcctctaggcc

SEQ ID NO: 7512635 - DNA, 22 bp, Homo sapiens
tccctggcagctgtcctttcag

SEQ ID NO: 7512636 - DNA, 22 bp, Homo sapiens
tccctggcagctgtcctttcag

SEQ ID NO: 7512637 - DNA, 22 bp, Homo sapiens
tccctggcctggaaggatatca

SEQ ID NO: 7512638 - DNA, 22 bp, Homo sapiens
tccctggcctggaaggatatca

SEQ ID NO: 7512639 - DNA, 22 bp, Homo sapiens
tccctggcctggaaggatatca

SEQ ID NO: 7512640 - DNA, 23 bp, Homo sapiens
tccctggccgcaatggccgcctt

SEQ ID NO: 7512641 - DNA, 23 bp, Homo sapiens
tccctggccgcaatggccgcctt

SEQ ID NO: 7512642 - DNA, 23 bp, Homo sapiens
tccctggccgcaatggccgcctt

SEQ ID NO: 7512643 - DNA, 22 bp, Homo sapiens
tccctggccattcctctaggcc

SEQ ID NO: 7512644 - DNA, 22 bp, Homo sapiens
tccctggccattcctctaggcc

SEQ ID NO: 7512645 - DNA, 22 bp, Homo sapiens
tccctggccattcctctaggcc

SEQ ID NO: 7512646 - DNA, 22 bp, Homo sapiens
tccctggaggtgtttgctcagg

SEQ ID NO: 7512647 - DNA, 20 bp, Homo sapiens
tccctggaggtggtggcatc

SEQ ID NO: 7512648 - DNA, 22 bp, Homo sapiens
tccctggcacaagaaggctgtc

SEQ ID NO: 7512649 - DNA, 22 bp, Homo sapiens
tccctggcacaagaaggctgtc

SEQ ID NO: 7512650 - DNA, 22 bp, Homo sapiens
tccctggaggtgtttgctcagg

SEQ ID NO: 7512651 - DNA, 23 bp, Homo sapiens
tccctggaggcaggtccagggcc

SEQ ID NO: 7512652 - DNA, 20 bp, Homo sapiens
tccctggaggtggtggcatc

SEQ ID NO: 7512653 - DNA, 20 bp, Homo sapiens
tccctggaggtggtggcatc

SEQ ID NO: 7512654 - DNA, 20 bp, Homo sapiens
tccctggaggtggtggcatc

SEQ ID NO: 7512655 - DNA, 20 bp, Homo sapiens
tccctggaggtggtggcatc

SEQ ID NO: 7512656 - DNA, 22 bp, Homo sapiens
tccctggcagctgtcctttcag

SEQ ID NO: 7512657 - DNA, 22 bp, Homo sapiens
tccctggcagctaagggtggtc

SEQ ID NO: 7512658 - DNA, 22 bp, Homo sapiens
tccctggcactgctgtgattag

SEQ ID NO: 7512659 - DNA, 22 bp, Homo sapiens
tccctggcagctaagggtggtc

SEQ ID NO: 7512660 - DNA, 22 bp, Homo sapiens
tccctggcagctaagggtggtc

SEQ ID NO: 7512661 - DNA, 22 bp, Homo sapiens
tccctggcagctaagggtggtc

SEQ ID NO: 7512662 - DNA, 22 bp, Homo sapiens
tccctggcagctaagggtggtc

SEQ ID NO: 7512663 - DNA, 22 bp, Homo sapiens
tccctggcactgctgtgattag

SEQ ID NO: 7512664 - DNA, 22 bp, Homo sapiens
tccctggcactgctgtgattag

SEQ ID NO: 7512665 - DNA, 22 bp, Homo sapiens
tccctggcacaagaaggctgtc

SEQ ID NO: 7512666 - DNA, 22 bp, Homo sapiens
tccctggcacaagaaggctgtc

SEQ ID NO: 7512667 - DNA, 22 bp, Homo sapiens
tccctggcacaagaaggctgtc

SEQ ID NO: 7512668 - DNA, 22 bp, Homo sapiens
tccctgcctcctggcagtgcca

SEQ ID NO: 7512669 - DNA, 22 bp, Homo sapiens
tccctggacagccttgcctggg

SEQ ID NO: 7512670 - DNA, 22 bp, Homo sapiens
tccctggagataacttctggga

SEQ ID NO: 7512671 - DNA, 22 bp, Homo sapiens
tccctggacaacagacttcact

SEQ ID NO: 7512672 - DNA, 22 bp, Homo sapiens
tccctggacagccttgcctggg

SEQ ID NO: 7512673 - DNA, 22 bp, Homo sapiens
tccctggagataacttctggga

SEQ ID NO: 7512674 - DNA, 23 bp, Homo sapiens
tccctggaggcaggtccagggcc

SEQ ID NO: 7512675 - DNA, 22 bp, Homo sapiens
tccctggacaacagacttcact

SEQ ID NO: 7512676 - DNA, 22 bp, Homo sapiens
tccctggacaacagacttcact

SEQ ID NO: 7512677 - DNA, 22 bp, Homo sapiens
tccctggaacagagagacaacg

SEQ ID NO: 7512678 - DNA, 22 bp, Homo sapiens
tccctggacaacagacttcact

SEQ ID NO: 7512679 - DNA, 22 bp, Homo sapiens
tccctggaacagagagacaacg

SEQ ID NO: 7512680 - DNA, 22 bp, Homo sapiens
tccctgcctctcagacttcctt

SEQ ID NO: 7512681 - DNA, 22 bp, Homo sapiens
tccctgcctctcagacttcctt

SEQ ID NO: 7512682 - DNA, 22 bp, Homo sapiens
tcccagggacccagcctgatac

SEQ ID NO: 7512683 - DNA, 22 bp, Homo sapiens
tcccagggacccagcctgatac

SEQ ID NO: 7512684 - DNA, 22 bp, Homo sapiens
tcccagggacccagcctgatac

SEQ ID NO: 7512685 - DNA, 22 bp, Homo sapiens
tcccagggacccagcctgatac

SEQ ID NO: 7512686 - DNA, 22 bp, Homo sapiens
tcccagggacaccaagctgttt

SEQ ID NO: 7512687 - DNA, 22 bp, Homo sapiens
tcccagggactctctgccttcc

SEQ ID NO: 7512688 - DNA, 22 bp, Homo sapiens
tcccagggactctctgccttcc

SEQ ID NO: 7512689 - DNA, 22 bp, Homo sapiens
tcccagggactctctgccttcc

SEQ ID NO: 7512690 - DNA, 22 bp, Homo sapiens
tcccagggactggatgatgcag

SEQ ID NO: 7512691 - DNA, 22 bp, Homo sapiens
tcccagggactggatgatgcag

SEQ ID NO: 7512692 - DNA, 22 bp, Homo sapiens
tcccctggcacctagtcctact

SEQ ID NO: 7512693 - DNA, 22 bp, Homo sapiens
tcccctggtgccacgatctgct

SEQ ID NO: 7512694 - DNA, 22 bp, Homo sapiens
tcccctggtgccacgatctgct

SEQ ID NO: 7512695 - DNA, 18 bp, Homo sapiens
tccccttccaggaagtca

SEQ ID NO: 7512696 - DNA, 18 bp, Homo sapiens
tccccttccaggaagtca

SEQ ID NO: 7512697 - DNA, 18 bp, Homo sapiens
tccccttccaggaagtca

SEQ ID NO: 7512698 - DNA, 22 bp, Homo sapiens
tcccagggactggatgatgcag

SEQ ID NO: 7512699 - DNA, 22 bp, Homo sapiens
tcccagggactggatgatgcag

SEQ ID NO: 7512700 - DNA, 22 bp, Homo sapiens
tccccttggcttggtcaagagg

SEQ ID NO: 7512701 - DNA, 22 bp, Homo sapiens
tccccttggcttggtcaagagg

SEQ ID NO: 7512702 - DNA, 22 bp, Homo sapiens
tcccctttgtaagatggaaacg

SEQ ID NO: 7512703 - DNA, 22 bp, Homo sapiens
tcccgataggcagggctctggc

SEQ ID NO: 7512704 - DNA, 19 bp, Homo sapiens
tcccgcccactgagcgtgc

SEQ ID NO: 7512705 - DNA, 22 bp, Homo sapiens
tcccgcccttgtacttgccgag

SEQ ID NO: 7512706 - DNA, 22 bp, Homo sapiens
tcccgcttcttccgaatcgcga

SEQ ID NO: 7512707 - DNA, 22 bp, Homo sapiens
tcccgcttcttccgaatcgcga

SEQ ID NO: 7512708 - DNA, 21 bp, Homo sapiens
tccctcagaaggtagccaagc

SEQ ID NO: 7512709 - DNA, 22 bp, Homo sapiens
tcccgcttcttccgaatcgcga

SEQ ID NO: 7512710 - DNA, 21 bp, Homo sapiens
tccctcagaagctcttggtca

SEQ ID NO: 7512711 - DNA, 22 bp, Homo sapiens
tccctcagacagatgtgttcct

SEQ ID NO: 7512712 - DNA, 18 bp, Homo sapiens
tccctcagaattatagaa

SEQ ID NO: 7512713 - DNA, 18 bp, Homo sapiens
tccctcagaattatagaa

SEQ ID NO: 7512714 - DNA, 21 bp, Homo sapiens
tccctcagaaggtagccaagc

SEQ ID NO: 7512715 - DNA, 21 bp, Homo sapiens
tccctcagaaggtagccaagc

SEQ ID NO: 7512716 - DNA, 22 bp, Homo sapiens
tccctcagattggcaattagat

SEQ ID NO: 7512717 - DNA, 22 bp, Homo sapiens
tccctcagattggcaattagat

SEQ ID NO: 7512718 - DNA, 22 bp, Homo sapiens
tccctcagatgagctcctagca

SEQ ID NO: 7512719 - DNA, 22 bp, Homo sapiens
tccctcagatgagctcctagca

SEQ ID NO: 7512720 - DNA, 20 bp, Homo sapiens
tccctcagcacttctacctc

SEQ ID NO: 7512721 - DNA, 20 bp, Homo sapiens
tccctcagcacttctacctc

SEQ ID NO: 7512722 - DNA, 22 bp, Homo sapiens
tccctcagattggcaattagat

SEQ ID NO: 7512723 - DNA, 22 bp, Homo sapiens
tccctcagattggcaattagat

SEQ ID NO: 7512724 - DNA, 22 bp, Homo sapiens
tccctcagcaggaactggcctg

SEQ ID NO: 7512725 - DNA, 20 bp, Homo sapiens
tccctcagcacttctacctc

SEQ ID NO: 7512726 - DNA, 22 bp, Homo sapiens
tccctcagcaggaactggcctg

SEQ ID NO: 7512727 - DNA, 22 bp, Homo sapiens
tccctcagcaggaactggcctg

SEQ ID NO: 7512728 - DNA, 22 bp, Homo sapiens
tccctcagcaggaactggcctg

SEQ ID NO: 7512729 - DNA, 22 bp, Homo sapiens
tccctcagcaggaactggcctg

SEQ ID NO: 7512730 - DNA, 22 bp, Homo sapiens
tccctcagcaggaactggcctg

SEQ ID NO: 7512731 - DNA, 22 bp, Homo sapiens
tccctcagcaggaatgtggcag

SEQ ID NO: 7512732 - DNA, 22 bp, Homo sapiens
tccctcagcaggaatgtggcag

SEQ ID NO: 7512733 - DNA, 22 bp, Homo sapiens
tccctcagcaggaatgtggcag

SEQ ID NO: 7512734 - DNA, 21 bp, Homo sapiens
tccctcagacagggtgcctat

SEQ ID NO: 7512735 - DNA, 21 bp, Homo sapiens
tccctcagacagggtgcctat

SEQ ID NO: 7512736 - DNA, 21 bp, Homo sapiens
tccctcagacagggtgcctat

SEQ ID NO: 7512737 - DNA, 21 bp, Homo sapiens
tccctcagacagggtgcctat

SEQ ID NO: 7512738 - DNA, 21 bp, Homo sapiens
tccctcagacagggtgcctat

SEQ ID NO: 7512739 - DNA, 22 bp, Homo sapiens
tccctcagagaccgtggtgcag

SEQ ID NO: 7512740 - DNA, 22 bp, Homo sapiens
tccctcagagaccgtggtgcag

SEQ ID NO: 7512741 - DNA, 22 bp, Homo sapiens
tccctcagagggcaagcgcaga

SEQ ID NO: 7512742 - DNA, 22 bp, Homo sapiens
tccctcagagggcaagcgcaga

SEQ ID NO: 7512743 - DNA, 22 bp, Homo sapiens
tccctcagagggcaagcgcaga

SEQ ID NO: 7512744 - DNA, 22 bp, Homo sapiens
tccctcagatgagctcctagca

SEQ ID NO: 7512745 - DNA, 22 bp, Homo sapiens
tccctcagatgagctcctagca

SEQ ID NO: 7512746 - DNA, 22 bp, Homo sapiens
tccctcagatgagctcctagca

SEQ ID NO: 7512747 - DNA, 22 bp, Homo sapiens
tccctcagatgagctcctagca

SEQ ID NO: 7512748 - DNA, 22 bp, Homo sapiens
tccctcagatgagctcctagca

SEQ ID NO: 7512749 - DNA, 22 bp, Homo sapiens
tccctcagatgagctcctagca

SEQ ID NO: 7512750 - DNA, 22 bp, Homo sapiens
tccctcagatgagctcctagca

SEQ ID NO: 7512751 - DNA, 22 bp, Homo sapiens
tccctcagatgagctcctagca

SEQ ID NO: 7512752 - DNA, 20 bp, Homo sapiens
tcccaggctccaccctagac

SEQ ID NO: 7512753 - DNA, 20 bp, Homo sapiens
tcccaggctccaccctagac

SEQ ID NO: 7512754 - DNA, 20 bp, Homo sapiens
tcccaggctccaccctagac

SEQ ID NO: 7512755 - DNA, 20 bp, Homo sapiens
tcccaggctccaccctagac

SEQ ID NO: 7512756 - DNA, 20 bp, Homo sapiens
tcccaggctccaccctagac

SEQ ID NO: 7512757 - DNA, 20 bp, Homo sapiens
tcccaggctccaccctagac

SEQ ID NO: 7512758 - DNA, 22 bp, Homo sapiens
tcccaggctaggcctctgcgtt

SEQ ID NO: 7512759 - DNA, 22 bp, Homo sapiens
tcccaggctaggcctctgcgtt

SEQ ID NO: 7512760 - DNA, 22 bp, Homo sapiens
tcccaggctaggcctctgcgtt

SEQ ID NO: 7512761 - DNA, 22 bp, Homo sapiens
tcccaggctaggcctctgcgtt

SEQ ID NO: 7512762 - DNA, 22 bp, Homo sapiens
tcccaggctaggcctctgcgtt

SEQ ID NO: 7512763 - DNA, 22 bp, Homo sapiens
tcccaggctaggcctctgcgtt

SEQ ID NO: 7512764 - DNA, 22 bp, Homo sapiens
tcccaggctaggcctctgcgtt

SEQ ID NO: 7512765 - DNA, 22 bp, Homo sapiens
tcccaggctaggcctctgcgtt

SEQ ID NO: 7512766 - DNA, 22 bp, Homo sapiens
tcccaggctaggcctctgcgtt

SEQ ID NO: 7512767 - DNA, 22 bp, Homo sapiens
tcccaggctaccagtgaggtca

SEQ ID NO: 7512768 - DNA, 22 bp, Homo sapiens
tcccaggctaccagtgaggtca

SEQ ID NO: 7512769 - DNA, 22 bp, Homo sapiens
tcccaggctaccagtgaggtca

SEQ ID NO: 7512770 - DNA, 22 bp, Homo sapiens
tcccaggctggcaggcagcagt

SEQ ID NO: 7512771 - DNA, 22 bp, Homo sapiens
tcccaggctggcaggcagcagt

SEQ ID NO: 7512772 - DNA, 22 bp, Homo sapiens
tcccaggctggcaggcagcagt

SEQ ID NO: 7512773 - DNA, 22 bp, Homo sapiens
tcccaggctggcaggcagcagt

SEQ ID NO: 7512774 - DNA, 22 bp, Homo sapiens
tcccaggctggcaggcagcagt

SEQ ID NO: 7512775 - DNA, 20 bp, Homo sapiens
tcccaggctgggctccagct

SEQ ID NO: 7512776 - DNA, 20 bp, Homo sapiens
tcccaggctgggctccagct

SEQ ID NO: 7512777 - DNA, 20 bp, Homo sapiens
tcccaggctgggctccagct

SEQ ID NO: 7512778 - DNA, 22 bp, Homo sapiens
tcccaggctggcaggcagcagt

SEQ ID NO: 7512779 - DNA, 22 bp, Homo sapiens
tcccaggctggcaggcagcagt

SEQ ID NO: 7512780 - DNA, 22 bp, Homo sapiens
tcccaggctcttcaaggaagac

SEQ ID NO: 7512781 - DNA, 22 bp, Homo sapiens
tcccaggctcttcaaggaagac

SEQ ID NO: 7512782 - DNA, 22 bp, Homo sapiens
tcccaggctcttcaaggaagac

SEQ ID NO: 7512783 - DNA, 20 bp, Homo sapiens
tcccaggctccaccctagac

SEQ ID NO: 7512784 - DNA, 20 bp, Homo sapiens
tcccaggctccaccctagac

SEQ ID NO: 7512785 - DNA, 20 bp, Homo sapiens
tcccaggctccaccctagac

SEQ ID NO: 7512786 - DNA, 20 bp, Homo sapiens
tcccaggctccaccctagac

SEQ ID NO: 7512787 - DNA, 22 bp, Homo sapiens
tcccagggacaccaagctgttt

SEQ ID NO: 7512788 - DNA, 23 bp, Homo sapiens
tcccagggaaggtgagcgaggct

SEQ ID NO: 7512789 - DNA, 22 bp, Homo sapiens
tcccagggacaccaagctgttt

SEQ ID NO: 7512790 - DNA, 22 bp, Homo sapiens
tcccagggacaccaagctgttt

SEQ ID NO: 7512791 - DNA, 22 bp, Homo sapiens
tcccagggacaccaagctgttt

SEQ ID NO: 7512792 - DNA, 23 bp, Homo sapiens
tcccagggaaggtgagcgaggct

SEQ ID NO: 7512793 - DNA, 23 bp, Homo sapiens
tcccagggaaggtgagcgaggct

SEQ ID NO: 7512794 - DNA, 23 bp, Homo sapiens
tcccagggaaggtgagcgaggct

SEQ ID NO: 7512795 - DNA, 23 bp, Homo sapiens
tcccagggaaggtgagcgaggct

SEQ ID NO: 7512796 - DNA, 23 bp, Homo sapiens
tcccagggaaggtgagcgaggct

SEQ ID NO: 7512797 - DNA, 23 bp, Homo sapiens
tcccagggaaggtgagcgaggct

SEQ ID NO: 7512798 - DNA, 23 bp, Homo sapiens
tcccagggaaggtgagcgaggct

SEQ ID NO: 7512799 - DNA, 22 bp, Homo sapiens
tcccaggctgggggcctgaagt

SEQ ID NO: 7512800 - DNA, 22 bp, Homo sapiens
tcccaggctgggggcctgaagt

SEQ ID NO: 7512801 - DNA, 22 bp, Homo sapiens
tcccaggctgggggcctgaagt

SEQ ID NO: 7512802 - DNA, 22 bp, Homo sapiens
tcccaggctgggggcctgaagt

SEQ ID NO: 7512803 - DNA, 22 bp, Homo sapiens
tcccaggctgggggcctgaagt

SEQ ID NO: 7512804 - DNA, 20 bp, Homo sapiens
tcccaggctgggctccagct

SEQ ID NO: 7512805 - DNA, 20 bp, Homo sapiens
tcccaggctgggctccagct

SEQ ID NO: 7512806 - DNA, 20 bp, Homo sapiens
tcccaggctgggctccagct

SEQ ID NO: 7512807 - DNA, 20 bp, Homo sapiens
tcccaggctgggctccagct

SEQ ID NO: 7512808 - DNA, 20 bp, Homo sapiens
tcccaggctgggctccagct

SEQ ID NO: 7512809 - DNA, 22 bp, Homo sapiens
tcccaggctggggccaggtgac

SEQ ID NO: 7512810 - DNA, 22 bp, Homo sapiens
tcccaggctggggccaggtgac

SEQ ID NO: 7512811 - DNA, 22 bp, Homo sapiens
tcccaggctggggccaggtgac

SEQ ID NO: 7512812 - DNA, 22 bp, Homo sapiens
tcccaggctggggccaggtgac

SEQ ID NO: 7512813 - DNA, 22 bp, Homo sapiens
tcccaggctggggccaggtgac

SEQ ID NO: 7512814 - DNA, 22 bp, Homo sapiens
tcccaggctggggccaggtgac

SEQ ID NO: 7512815 - DNA, 22 bp, Homo sapiens
tcccaggctggggccaggtgac

SEQ ID NO: 7512816 - DNA, 20 bp, Homo sapiens
tccctcagtttccagccctg

SEQ ID NO: 7512817 - DNA, 20 bp, Homo sapiens
tccctcagtttccagccctg

SEQ ID NO: 7512818 - DNA, 19 bp, Homo sapiens
tccctcagtctgccaggcc

SEQ ID NO: 7512819 - DNA, 19 bp, Homo sapiens
tccctcagtctgccaggcc

SEQ ID NO: 7512820 - DNA, 19 bp, Homo sapiens
tccctcagtctgccaggcc

SEQ ID NO: 7512821 - DNA, 19 bp, Homo sapiens
tccctcagtctgccaggcc

SEQ ID NO: 7512822 - DNA, 19 bp, Homo sapiens
tccctcagtctgccaggcc

SEQ ID NO: 7512823 - DNA, 19 bp, Homo sapiens
tccctcagtctgccaggcc

SEQ ID NO: 7512824 - DNA, 19 bp, Homo sapiens
tccctcagtctgccaggcc

SEQ ID NO: 7512825 - DNA, 20 bp, Homo sapiens
tccctcagtcctggctttgt

SEQ ID NO: 7512826 - DNA, 22 bp, Homo sapiens
tccctccagaatggtgaggaag

SEQ ID NO: 7512827 - DNA, 22 bp, Homo sapiens
tccctccacacctgctggtacc

SEQ ID NO: 7512828 - DNA, 22 bp, Homo sapiens
tccctccacacctgctggtacc

SEQ ID NO: 7512829 - DNA, 22 bp, Homo sapiens
tccctccagaatggtgaggaag

SEQ ID NO: 7512830 - DNA, 22 bp, Homo sapiens
tccctccagaatggtgaggaag

SEQ ID NO: 7512831 - DNA, 22 bp, Homo sapiens
tccctccagaatggtgaggaag

SEQ ID NO: 7512832 - DNA, 20 bp, Homo sapiens
tccctcagtttccagccctg

SEQ ID NO: 7512833 - DNA, 20 bp, Homo sapiens
tccctcagtttccagccctg

SEQ ID NO: 7512834 - DNA, 20 bp, Homo sapiens
tccctcagtttccagccctg

SEQ ID NO: 7512835 - DNA, 20 bp, Homo sapiens
tccctcagtttccagccctg

SEQ ID NO: 7512836 - DNA, 20 bp, Homo sapiens
tccctcagtttccagccctg

SEQ ID NO: 7512837 - DNA, 22 bp, Homo sapiens
tccctccacacctgctggtacc

SEQ ID NO: 7512838 - DNA, 22 bp, Homo sapiens
tccctccccacttctgagcttt

SEQ ID NO: 7512839 - DNA, 22 bp, Homo sapiens
tccctccccacttctgagcttt

SEQ ID NO: 7512840 - DNA, 22 bp, Homo sapiens
tccctccccacttctgagcttt

SEQ ID NO: 7512841 - DNA, 22 bp, Homo sapiens
tccctccccacttctgagcttt

SEQ ID NO: 7512842 - DNA, 22 bp, Homo sapiens
tccctccccacttctgagcttt

SEQ ID NO: 7512843 - DNA, 22 bp, Homo sapiens
tccctccccacttctgagcttt

SEQ ID NO: 7512844 - DNA, 22 bp, Homo sapiens
tccctccaggcagctgggtact

SEQ ID NO: 7512845 - DNA, 22 bp, Homo sapiens
tccctccaggcagctgggtact

SEQ ID NO: 7512846 - DNA, 22 bp, Homo sapiens
tccctccaggcagctgggtact

SEQ ID NO: 7512847 - DNA, 22 bp, Homo sapiens
tccctccataacagaggtgagc

SEQ ID NO: 7512848 - DNA, 22 bp, Homo sapiens
tccctccataacagaggtgagc

SEQ ID NO: 7512849 - DNA, 22 bp, Homo sapiens
tccctccataacagaggtgagc

SEQ ID NO: 7512850 - DNA, 22 bp, Homo sapiens
tccctccccacttctgagcttt

SEQ ID NO: 7512851 - DNA, 22 bp, Homo sapiens
tccctccccacttctgagcttt

SEQ ID NO: 7512852 - DNA, 22 bp, Homo sapiens
tccctccccacttctgagcttt

SEQ ID NO: 7512853 - DNA, 22 bp, Homo sapiens
tccctccccacttctgagcttt

SEQ ID NO: 7512854 - DNA, 22 bp, Homo sapiens
tccctccccacttctgagcttt

SEQ ID NO: 7512855 - DNA, 20 bp, Homo sapiens
tccctccctccagctctggg

SEQ ID NO: 7512856 - DNA, 20 bp, Homo sapiens
tccctccctccagctctggg

SEQ ID NO: 7512857 - DNA, 20 bp, Homo sapiens
tccctccctccagctctggg

SEQ ID NO: 7512858 - DNA, 20 bp, Homo sapiens
tccctccctccagctctggg

SEQ ID NO: 7512859 - DNA, 20 bp, Homo sapiens
tccctccctccagctctggg

SEQ ID NO: 7512860 - DNA, 20 bp, Homo sapiens
tccctccctccagctctggg

SEQ ID NO: 7512861 - DNA, 22 bp, Homo sapiens
tccctccagaatggtgaggaag

SEQ ID NO: 7512862 - DNA, 20 bp, Homo sapiens
tccctccctccagctctggg

SEQ ID NO: 7512863 - DNA, 20 bp, Homo sapiens
tccctccctccagctctggg

SEQ ID NO: 7512864 - DNA, 22 bp, Homo sapiens
tccctcagtccctggacaggca

SEQ ID NO: 7512865 - DNA, 22 bp, Homo sapiens
tccctcagtccctggacaggca

SEQ ID NO: 7512866 - DNA, 22 bp, Homo sapiens
tccctcagtccctggacaggca

SEQ ID NO: 7512867 - DNA, 22 bp, Homo sapiens
tccctcaggtggttcttgtttc

SEQ ID NO: 7512868 - DNA, 22 bp, Homo sapiens
tccctcaggtggttcttgtttc

SEQ ID NO: 7512869 - DNA, 22 bp, Homo sapiens
tccctcagtccctggacaggca

SEQ ID NO: 7512870 - DNA, 22 bp, Homo sapiens
tccctcagtccctggacaggca

SEQ ID NO: 7512871 - DNA, 22 bp, Homo sapiens
tccctcagtccctggacaggca

SEQ ID NO: 7512872 - DNA, 22 bp, Homo sapiens
tccctcagtccctggacaggca

SEQ ID NO: 7512873 - DNA, 20 bp, Homo sapiens
tccctcagtcctggctttgt

SEQ ID NO: 7512874 - DNA, 22 bp, Homo sapiens
tccctcagggtgcagttgcttt

SEQ ID NO: 7512875 - DNA, 22 bp, Homo sapiens
tccctcagggtgcagttgcttt

SEQ ID NO: 7512876 - DNA, 23 bp, Homo sapiens
tccctcaggccttatctccatct

SEQ ID NO: 7512877 - DNA, 23 bp, Homo sapiens
tccctcaggccttatctccatct

SEQ ID NO: 7512878 - DNA, 20 bp, Homo sapiens
tccctcaggtcattgggctg

SEQ ID NO: 7512879 - DNA, 20 bp, Homo sapiens
tccctcaggtcattgggctg

SEQ ID NO: 7512880 - DNA, 22 bp, Homo sapiens
tccctcagctcatatttatgcc

SEQ ID NO: 7512881 - DNA, 15 bp, Homo sapiens
tccctcagctaaaga

SEQ ID NO: 7512882 - DNA, 22 bp, Homo sapiens
tccctcagcaggaatgtggcag

SEQ ID NO: 7512883 - DNA, 22 bp, Homo sapiens
tccctcagcttgtctccatgca

SEQ ID NO: 7512884 - DNA, 22 bp, Homo sapiens
tccctcagcttgtctccatgca

SEQ ID NO: 7512885 - DNA, 22 bp, Homo sapiens
tccctcagcttgtctccatgca

SEQ ID NO: 7512886 - DNA, 22 bp, Homo sapiens
tccctcagcttgtctccatgca

SEQ ID NO: 7512887 - DNA, 22 bp, Homo sapiens
tccctcagcttgtctccatgca

SEQ ID NO: 7512888 - DNA, 23 bp, Homo sapiens
tccctcaggccttatctccatct

SEQ ID NO: 7512889 - DNA, 23 bp, Homo sapiens
tccctcaggccttatctccatct

SEQ ID NO: 7512890 - DNA, 22 bp, Homo sapiens
tccctcaggacccaacttgtaa

SEQ ID NO: 7512891 - DNA, 22 bp, Homo sapiens
tccctcaggacccaacttgtaa

SEQ ID NO: 7512892 - DNA, 22 bp, Homo sapiens
tccctcaggacccaacttgtaa

SEQ ID NO: 7512893 - DNA, 23 bp, Homo sapiens
tccctcaggccttatctccatct

SEQ ID NO: 7512894 - DNA, 22 bp, Homo sapiens
tccctcagcttgtctccatgca

SEQ ID NO: 7512895 - DNA, 22 bp, Homo sapiens
tccctcagcttgtctccatgca

SEQ ID NO: 7512896 - DNA, 22 bp, Homo sapiens
tccctcagcttgtctccatgca

SEQ ID NO: 7512897 - DNA, 22 bp, Homo sapiens
tccctcaggacccaacttgtaa

SEQ ID NO: 7512898 - DNA, 22 bp, Homo sapiens
tccctctgctagtgcttgagct

SEQ ID NO: 7512899 - DNA, 22 bp, Homo sapiens
tccctctgctagtgcttgagct

SEQ ID NO: 7512900 - DNA, 22 bp, Homo sapiens
tccctctgctagtgcttgagct

SEQ ID NO: 7512901 - DNA, 22 bp, Homo sapiens
tccctctgctagtgcttgagct

SEQ ID NO: 7512902 - DNA, 22 bp, Homo sapiens
tccctctcttgggcgtggctca

SEQ ID NO: 7512903 - DNA, 19 bp, Homo sapiens
tccctccctgtaatctcac

SEQ ID NO: 7512904 - DNA, 19 bp, Homo sapiens
tccctccctgtaatctcac

SEQ ID NO: 7512905 - DNA, 20 bp, Homo sapiens
tccctcctgcagatagagaa

SEQ ID NO: 7512906 - DNA, 22 bp, Homo sapiens
tccctctggaggctctagggga

SEQ ID NO: 7512907 - DNA, 22 bp, Homo sapiens
tccctctggaggctctagggga

SEQ ID NO: 7512908 - DNA, 22 bp, Homo sapiens
tccctctggaggctctagggga

SEQ ID NO: 7512909 - DNA, 22 bp, Homo sapiens
tccctctgctagtgcttgagct

SEQ ID NO: 7512910 - DNA, 22 bp, Homo sapiens
tccctctgctagtgcttgagct

SEQ ID NO: 7512911 - DNA, 22 bp, Homo sapiens
tccctctggaggctctagggga

SEQ ID NO: 7512912 - DNA, 22 bp, Homo sapiens
tccctctgggctccagcacgga

SEQ ID NO: 7512913 - DNA, 22 bp, Homo sapiens
tccctctggaggctctagggga

SEQ ID NO: 7512914 - DNA, 22 bp, Homo sapiens
tccctctgggctccagcacgga

SEQ ID NO: 7512915 - DNA, 22 bp, Homo sapiens
tccctctgggctccagcacgga

SEQ ID NO: 7512916 - DNA, 22 bp, Homo sapiens
tccctctgggctggagcagggt

SEQ ID NO: 7512917 - DNA, 22 bp, Homo sapiens
tccctctgggctggagcagggt

SEQ ID NO: 7512918 - DNA, 22 bp, Homo sapiens
tccctctggtcctcggtggaga

SEQ ID NO: 7512919 - DNA, 22 bp, Homo sapiens
tccctctgggctggagcagggt

SEQ ID NO: 7512920 - DNA, 22 bp, Homo sapiens
tccctctgggctggagcagggt

SEQ ID NO: 7512921 - DNA, 22 bp, Homo sapiens
tccctctggtcctcggtggaga

SEQ ID NO: 7512922 - DNA, 22 bp, Homo sapiens
tccctctggtcctcggtggaga

SEQ ID NO: 7512923 - DNA, 22 bp, Homo sapiens
tccctctggtctggacgccata

SEQ ID NO: 7512924 - DNA, 22 bp, Homo sapiens
tccctctggtcctcggtggaga

SEQ ID NO: 7512925 - DNA, 22 bp, Homo sapiens
tccctctggtctggacgccata

SEQ ID NO: 7512926 - DNA, 22 bp, Homo sapiens
tccctctgtggttggttctgtc

SEQ ID NO: 7512927 - DNA, 22 bp, Homo sapiens
tccctctggtctggacgccata

SEQ ID NO: 7512928 - DNA, 18 bp, Homo sapiens
tccctccctgctgtggcc

SEQ ID NO: 7512929 - DNA, 18 bp, Homo sapiens
tccctccctgctgtggcc

SEQ ID NO: 7512930 - DNA, 18 bp, Homo sapiens
tccctccctgctgtggcc

SEQ ID NO: 7512931 - DNA, 18 bp, Homo sapiens
tccctccctgctgtggcc

SEQ ID NO: 7512932 - DNA, 18 bp, Homo sapiens
tccctccctgctgtggcc

SEQ ID NO: 7512933 - DNA, 20 bp, Homo sapiens
tccctccctccagctctggg

SEQ ID NO: 7512934 - DNA, 20 bp, Homo sapiens
tccctccctccagctctggg

SEQ ID NO: 7512935 - DNA, 20 bp, Homo sapiens
tccctccctccagctctggg

SEQ ID NO: 7512936 - DNA, 20 bp, Homo sapiens
tccctccctccagctctggg

SEQ ID NO: 7512937 - DNA, 20 bp, Homo sapiens
tccctccctccagctctggg

SEQ ID NO: 7512938 - DNA, 19 bp, Homo sapiens
tccctccctgtaatctcac

SEQ ID NO: 7512939 - DNA, 19 bp, Homo sapiens
tccctccctgtaatctcac

SEQ ID NO: 7512940 - DNA, 19 bp, Homo sapiens
tccctccctgtaatctcac

SEQ ID NO: 7512941 - DNA, 19 bp, Homo sapiens
tccctccctgtaatctcac

SEQ ID NO: 7512942 - DNA, 19 bp, Homo sapiens
tccctccctgtaatctcac

SEQ ID NO: 7512943 - DNA, 18 bp, Homo sapiens
tccctccctgctgtggcc

SEQ ID NO: 7512944 - DNA, 18 bp, Homo sapiens
tccctccctgctgtggcc

SEQ ID NO: 7512945 - DNA, 18 bp, Homo sapiens
tccctccctgctgtggcc

SEQ ID NO: 7512946 - DNA, 18 bp, Homo sapiens
tccctccctgctgtggcc

SEQ ID NO: 7512947 - DNA, 18 bp, Homo sapiens
tccctccctgctgtggcc

SEQ ID NO: 7512948 - DNA, 22 bp, Homo sapiens
tccctgcctcctggcagtgcca

SEQ ID NO: 7512949 - DNA, 22 bp, Homo sapiens
tccctgcctcctggcagtgcca

SEQ ID NO: 7512950 - DNA, 22 bp, Homo sapiens
tccctgccctgccttcatggtt

SEQ ID NO: 7512951 - DNA, 22 bp, Homo sapiens
tccctgccctgccttcatggtt

SEQ ID NO: 7512952 - DNA, 22 bp, Homo sapiens
tccctgccctgccttcatggtt

SEQ ID NO: 7512953 - DNA, 22 bp, Homo sapiens
tccctgccctgccttcatggtt

SEQ ID NO: 7512954 - DNA, 23 bp, Homo sapiens
tccctgactctgggagctcccag

SEQ ID NO: 7512955 - DNA, 22 bp, Homo sapiens
tccctgagaaagcccaggaggt

SEQ ID NO: 7512956 - DNA, 22 bp, Homo sapiens
tccctgagaaagcccaggaggt

SEQ ID NO: 7512957 - DNA, 22 bp, Homo sapiens
tccctgagaaagcccaggaggt

SEQ ID NO: 7512958 - DNA, 22 bp, Homo sapiens
tccctgagagcactggggagcc

SEQ ID NO: 7512959 - DNA, 22 bp, Homo sapiens
tccctgagagcactggggagcc

SEQ ID NO: 7512960 - DNA, 22 bp, Homo sapiens
tccctgagagcactggggagcc

SEQ ID NO: 7512961 - DNA, 22 bp, Homo sapiens
tccctgagactctggagtgtaa

SEQ ID NO: 7512962 - DNA, 22 bp, Homo sapiens
tccctgaagccagggaaggaag

SEQ ID NO: 7512963 - DNA, 22 bp, Homo sapiens
tccctgaatctcgaactagcct

SEQ ID NO: 7512964 - DNA, 22 bp, Homo sapiens
tccctgaatctcgaactagcct

SEQ ID NO: 7512965 - DNA, 22 bp, Homo sapiens
tccctgaagccagggaaggaag

SEQ ID NO: 7512966 - DNA, 22 bp, Homo sapiens
tccctgaagccagggaaggaag

SEQ ID NO: 7512967 - DNA, 22 bp, Homo sapiens
tccctgaagccagggaaggaag

SEQ ID NO: 7512968 - DNA, 22 bp, Homo sapiens
tccctgaaccactagtgatgag

SEQ ID NO: 7512969 - DNA, 22 bp, Homo sapiens
tccctgaaatttgaagaggaat

SEQ ID NO: 7512970 - DNA, 22 bp, Homo sapiens
tccctgaaccactagtgatgag

SEQ ID NO: 7512971 - DNA, 22 bp, Homo sapiens
tccctgaaatttgaagaggaat

SEQ ID NO: 7512972 - DNA, 22 bp, Homo sapiens
tccctgaaatttgaagaggaat

SEQ ID NO: 7512973 - DNA, 22 bp, Homo sapiens
tccctgaaacatctctgtggat

SEQ ID NO: 7512974 - DNA, 22 bp, Homo sapiens
tccctgaaacatctctgtggat

SEQ ID NO: 7512975 - DNA, 22 bp, Homo sapiens
tccctgaaacatctctgtggat

SEQ ID NO: 7512976 - DNA, 22 bp, Homo sapiens
tccctctgttctgttccaagtg

SEQ ID NO: 7512977 - DNA, 22 bp, Homo sapiens
tccctgaaacataatagatgcc

SEQ ID NO: 7512978 - DNA, 22 bp, Homo sapiens
tccctgaaacataatagatgcc

SEQ ID NO: 7512979 - DNA, 22 bp, Homo sapiens
tccctctgttctgttccaagtg

SEQ ID NO: 7512980 - DNA, 22 bp, Homo sapiens
tccctctgtgttgggcatgcct

SEQ ID NO: 7512981 - DNA, 22 bp, Homo sapiens
tccctctgtgttgggcatgcct

SEQ ID NO: 7512982 - DNA, 22 bp, Homo sapiens
tccctctgtggttggttctgtc

SEQ ID NO: 7512983 - DNA, 22 bp, Homo sapiens
tccctctgtggttggttctgtc

SEQ ID NO: 7512984 - DNA, 22 bp, Homo sapiens
tccctctgtggttggttctgtc

SEQ ID NO: 7512985 - DNA, 22 bp, Homo sapiens
tccctctgtgttgggcatgcct

SEQ ID NO: 7512986 - DNA, 22 bp, Homo sapiens
tccctctgtgttgggcatgcct

SEQ ID NO: 7512987 - DNA, 22 bp, Homo sapiens
tccctctgtgttgggcatgcct

SEQ ID NO: 7512988 - DNA, 22 bp, Homo sapiens
ggtggaagccttcagaacagca

SEQ ID NO: 7512989 - DNA, 22 bp, Homo sapiens
ggtggaagccttcagaacagca

SEQ ID NO: 7512990 - DNA, 22 bp, Homo sapiens
ggtggaagccttcagaacagca

SEQ ID NO: 7512991 - DNA, 22 bp, Homo sapiens
ggtggaagccttcagaacagca

SEQ ID NO: 7512992 - DNA, 22 bp, Homo sapiens
ggtggaaggcctggaaggaggc

SEQ ID NO: 7512993 - DNA, 22 bp, Homo sapiens
ggtggaaggcagcagtctcagg

SEQ ID NO: 7512994 - DNA, 22 bp, Homo sapiens
ggtggaaggcctggaaggaggc

SEQ ID NO: 7512995 - DNA, 22 bp, Homo sapiens
ggtggaaggcctggaaggaggc

SEQ ID NO: 7512996 - DNA, 22 bp, Homo sapiens
ggtggaaggcagcagtctcagg

SEQ ID NO: 7512997 - DNA, 22 bp, Homo sapiens
ggtggaaggcagcagtctcagg

SEQ ID NO: 7512998 - DNA, 22 bp, Homo sapiens
ggtggaaggcctggaaggaggc

SEQ ID NO: 7512999 - DNA, 22 bp, Homo sapiens
ggtggaaggcctggaaggaggc

SEQ ID NO: 7513000 - DNA, 22 bp, Homo sapiens
ggtggacaaatgaatgactgaa

SEQ ID NO: 7513001 - DNA, 22 bp, Homo sapiens
ggtggacaaatgaatgactgaa

SEQ ID NO: 7513002 - DNA, 17 bp, Homo sapiens
ggtggaagtttctagtt

SEQ ID NO: 7513003 - DNA, 22 bp, Homo sapiens
ggtggacagtgttagctctggg

SEQ ID NO: 7513004 - DNA, 22 bp, Homo sapiens
ggtggacagtgttagctctggg

SEQ ID NO: 7513005 - DNA, 22 bp, Homo sapiens
ggtggacagtgttagctctggg

SEQ ID NO: 7513006 - DNA, 22 bp, Homo sapiens
ggtggaaggcctggaaggaggc

SEQ ID NO: 7513007 - DNA, 21 bp, Homo sapiens
ggtgctcgctgatgaggagtg

SEQ ID NO: 7513008 - DNA, 21 bp, Homo sapiens
ggtgctcctccatgctgctct

SEQ ID NO: 7513009 - DNA, 22 bp, Homo sapiens
ggtgctcaaggtgacaggacat

SEQ ID NO: 7513010 - DNA, 22 bp, Homo sapiens
ggtgctcagagttagaccagga

SEQ ID NO: 7513011 - DNA, 22 bp, Homo sapiens
ggtgctcagagttagaccagga

SEQ ID NO: 7513012 - DNA, 21 bp, Homo sapiens
ggtgctcctccatgctgctct

SEQ ID NO: 7513013 - DNA, 22 bp, Homo sapiens
ggtgagggagtggaacgaggtg

SEQ ID NO: 7513014 - DNA, 22 bp, Homo sapiens
ggtgagggagtggaacgaggtg

SEQ ID NO: 7513015 - DNA, 22 bp, Homo sapiens
ggtgagggagtggaacgaggtg

SEQ ID NO: 7513016 - DNA, 22 bp, Homo sapiens
ggtgagggagtggaacgaggtg

SEQ ID NO: 7513017 - DNA, 21 bp, Homo sapiens
ggtgctcgctgatgaggagtg

SEQ ID NO: 7513018 - DNA, 21 bp, Homo sapiens
ggtgctcgctgatgaggagtg

SEQ ID NO: 7513019 - DNA, 21 bp, Homo sapiens
ggtgctcgctgatgaggagtg

SEQ ID NO: 7513020 - DNA, 21 bp, Homo sapiens
ggtgctcgctgatgaggagtg

SEQ ID NO: 7513021 - DNA, 22 bp, Homo sapiens
ggtggaagccttcagaacagca

SEQ ID NO: 7513022 - DNA, 22 bp, Homo sapiens
ggtggaagccttcagaacagca

SEQ ID NO: 7513023 - DNA, 22 bp, Homo sapiens
ggtgcttctgggcatagcagga

SEQ ID NO: 7513024 - DNA, 18 bp, Homo sapiens
ggtgagggagctggaagc

SEQ ID NO: 7513025 - DNA, 22 bp, Homo sapiens
ggtgagggagtggaacgaggtg

SEQ ID NO: 7513026 - DNA, 22 bp, Homo sapiens
ggtgagggagtggaacgaggtg

SEQ ID NO: 7513027 - DNA, 22 bp, Homo sapiens
ggtgagggagtggaacgaggtg

SEQ ID NO: 7513028 - DNA, 22 bp, Homo sapiens
ggtgagggagtggaacgaggtg

SEQ ID NO: 7513029 - DNA, 18 bp, Homo sapiens
ggtgagggagctggaagc

SEQ ID NO: 7513030 - DNA, 18 bp, Homo sapiens
ggtgagggagctggaagc

SEQ ID NO: 7513031 - DNA, 18 bp, Homo sapiens
ggtgagggagctggaagc

SEQ ID NO: 7513032 - DNA, 22 bp, Homo sapiens
ggtgagggacatcactcagcca

SEQ ID NO: 7513033 - DNA, 22 bp, Homo sapiens
ggtgagggacatcactcagcca

SEQ ID NO: 7513034 - DNA, 22 bp, Homo sapiens
ggtgaggctggcttgccttctt

SEQ ID NO: 7513035 - DNA, 18 bp, Homo sapiens
ggtgagggagctggaagc

SEQ ID NO: 7513036 - DNA, 18 bp, Homo sapiens
ggtgagggagctggaagc

SEQ ID NO: 7513037 - DNA, 18 bp, Homo sapiens
ggtgagggagctggaagc

SEQ ID NO: 7513038 - DNA, 22 bp, Homo sapiens
ggtgagggacatcactcagcca

SEQ ID NO: 7513039 - DNA, 18 bp, Homo sapiens
ggtgagggagctggaagc

SEQ ID NO: 7513040 - DNA, 18 bp, Homo sapiens
ggtgagggagctggaagc

SEQ ID NO: 7513041 - DNA, 18 bp, Homo sapiens
ggtgagggagctggaagc

SEQ ID NO: 7513042 - DNA, 18 bp, Homo sapiens
ggtgagggagctggaagc

SEQ ID NO: 7513043 - DNA, 18 bp, Homo sapiens
ggtgagggagctggaagc

SEQ ID NO: 7513044 - DNA, 18 bp, Homo sapiens
ggtgagggagctggaagc

SEQ ID NO: 7513045 - DNA, 22 bp, Homo sapiens
ggtgaggcccagtgatctgtgt

SEQ ID NO: 7513046 - DNA, 22 bp, Homo sapiens
ggtgaggcaggtggctgctgag

SEQ ID NO: 7513047 - DNA, 18 bp, Homo sapiens
ggtgaggcggcggccagc

SEQ ID NO: 7513048 - DNA, 18 bp, Homo sapiens
ggtgaggcggcggccagc

SEQ ID NO: 7513049 - DNA, 22 bp, Homo sapiens
ggtgaggcctgtacaaagctgc

SEQ ID NO: 7513050 - DNA, 22 bp, Homo sapiens
ggtgaggctaagtgacacaggg

SEQ ID NO: 7513051 - DNA, 22 bp, Homo sapiens
ggtgaggcgtccccaccatggg

SEQ ID NO: 7513052 - DNA, 22 bp, Homo sapiens
ggtgaggctaagtgacacaggg

SEQ ID NO: 7513053 - DNA, 22 bp, Homo sapiens
ggtgagggacatcactcagcca

SEQ ID NO: 7513054 - DNA, 22 bp, Homo sapiens
ggtgagggacatcactcagcca

SEQ ID NO: 7513055 - DNA, 22 bp, Homo sapiens
ggtgagggacatcactcagcca

SEQ ID NO: 7513056 - DNA, 22 bp, Homo sapiens
ggtgagggacatcactcagcca

SEQ ID NO: 7513057 - DNA, 22 bp, Homo sapiens
ggtgagcaaagcttcatctgta

SEQ ID NO: 7513058 - DNA, 22 bp, Homo sapiens
ggtgagcactgccctgggtctc

SEQ ID NO: 7513059 - DNA, 22 bp, Homo sapiens
ggtgagcactgccctgggtctc

SEQ ID NO: 7513060 - DNA, 22 bp, Homo sapiens
ggtgagcactgccctgggtctc

SEQ ID NO: 7513061 - DNA, 22 bp, Homo sapiens
ggtgagcactgccctgggtctc

SEQ ID NO: 7513062 - DNA, 22 bp, Homo sapiens
ggtgagcactgccctgggtctc

SEQ ID NO: 7513063 - DNA, 22 bp, Homo sapiens
ggtgagcagctgtctgtatgga

SEQ ID NO: 7513064 - DNA, 19 bp, Homo sapiens
ggtgagccctcgcctgcct

SEQ ID NO: 7513065 - DNA, 19 bp, Homo sapiens
ggtgagccctcgcctgcct

SEQ ID NO: 7513066 - DNA, 19 bp, Homo sapiens
ggtgagccctcgcctgcct

SEQ ID NO: 7513067 - DNA, 22 bp, Homo sapiens
ggtgagcactgccctgggtctc

SEQ ID NO: 7513068 - DNA, 22 bp, Homo sapiens
ggtgagcagctgtctgtatgga

SEQ ID NO: 7513069 - DNA, 22 bp, Homo sapiens
ggtgaggaaagatggtgacagt

SEQ ID NO: 7513070 - DNA, 22 bp, Homo sapiens
ggtgaggaaagatggtgacagt

SEQ ID NO: 7513071 - DNA, 22 bp, Homo sapiens
ggtgaggaaagatggtgacagt

SEQ ID NO: 7513072 - DNA, 22 bp, Homo sapiens
ggtgaggaaagatggtgacagt

SEQ ID NO: 7513073 - DNA, 22 bp, Homo sapiens
ggtgagcttgctgctagaggct

SEQ ID NO: 7513074 - DNA, 22 bp, Homo sapiens
ggtgagcttgctgctagaggct

SEQ ID NO: 7513075 - DNA, 22 bp, Homo sapiens
ggtgagcgtggaaggagtggga

SEQ ID NO: 7513076 - DNA, 22 bp, Homo sapiens
ggtgagctggtctggggctgct

SEQ ID NO: 7513077 - DNA, 22 bp, Homo sapiens
ggtgagcttgctgctagaggct

SEQ ID NO: 7513078 - DNA, 19 bp, Homo sapiens
ggtgagccctcgcctgcct

SEQ ID NO: 7513079 - DNA, 22 bp, Homo sapiens
ggtgagccgaaaagggtcataa

SEQ ID NO: 7513080 - DNA, 22 bp, Homo sapiens
ggtgagcctggagtcttgctgg

SEQ ID NO: 7513081 - DNA, 22 bp, Homo sapiens
ggtgagcctggagtcttgctgg

SEQ ID NO: 7513082 - DNA, 22 bp, Homo sapiens
ggtgaggaattggggactgacc

SEQ ID NO: 7513083 - DNA, 22 bp, Homo sapiens
ggtgaggaattggggactgacc

SEQ ID NO: 7513084 - DNA, 22 bp, Homo sapiens
ggtgaggaattggggactgacc

SEQ ID NO: 7513085 - DNA, 22 bp, Homo sapiens
ggtgaggaaagatggtgacagt

SEQ ID NO: 7513086 - DNA, 22 bp, Homo sapiens
ggtgaggaattggggactgacc

SEQ ID NO: 7513087 - DNA, 22 bp, Homo sapiens
ggtgaggaattggggactgacc

SEQ ID NO: 7513088 - DNA, 22 bp, Homo sapiens
ggtgaggaattggggactgacc

SEQ ID NO: 7513089 - DNA, 22 bp, Homo sapiens
ggtgaggaaagatggtgacagt

SEQ ID NO: 7513090 - DNA, 22 bp, Homo sapiens
ggtgaggaaagatggtgacagt

SEQ ID NO: 7513091 - DNA, 22 bp, Homo sapiens
ggtgaggcagagggagtaacct

SEQ ID NO: 7513092 - DNA, 22 bp, Homo sapiens
ggtgaggcagagggagtaacct

SEQ ID NO: 7513093 - DNA, 22 bp, Homo sapiens
ggtgaggcaggtggctgctgag

SEQ ID NO: 7513094 - DNA, 22 bp, Homo sapiens
ggtgaggcaggtggctgctgag

SEQ ID NO: 7513095 - DNA, 22 bp, Homo sapiens
ggtgaggcaggtggctgctgag

SEQ ID NO: 7513096 - DNA, 22 bp, Homo sapiens
ggtgaggaattggggactgacc

SEQ ID NO: 7513097 - DNA, 22 bp, Homo sapiens
ggtgaggaattggggactgacc

SEQ ID NO: 7513098 - DNA, 22 bp, Homo sapiens
ggtgaggaattggggactgacc

SEQ ID NO: 7513099 - DNA, 22 bp, Homo sapiens
ggtgaggaattggggactgacc

SEQ ID NO: 7513100 - DNA, 22 bp, Homo sapiens
ggtgaggaattggggactgacc

SEQ ID NO: 7513101 - DNA, 22 bp, Homo sapiens
ggtgaggaattggggactgacc

SEQ ID NO: 7513102 - DNA, 21 bp, Homo sapiens
ggtgacacgtggccccgctct

SEQ ID NO: 7513103 - DNA, 21 bp, Homo sapiens
ggtgacacgtggccccgctct

SEQ ID NO: 7513104 - DNA, 21 bp, Homo sapiens
ggtgacacgtggccccgctct

SEQ ID NO: 7513105 - DNA, 22 bp, Homo sapiens
ggtgacagccgcttggcgctag

SEQ ID NO: 7513106 - DNA, 22 bp, Homo sapiens
ggtgacagccgcttgccctgta

SEQ ID NO: 7513107 - DNA, 22 bp, Homo sapiens
ggtccctggaaggccaagcttg

SEQ ID NO: 7513108 - DNA, 22 bp, Homo sapiens
ggtgacacagggaccagagtct

SEQ ID NO: 7513109 - DNA, 22 bp, Homo sapiens
ggtgacacagggaccagagtct

SEQ ID NO: 7513110 - DNA, 22 bp, Homo sapiens
ggtccctggaagtccctcttct

SEQ ID NO: 7513111 - DNA, 21 bp, Homo sapiens
ggtgacacgtggccccgctct

SEQ ID NO: 7513112 - DNA, 21 bp, Homo sapiens
ggtgacacgtggccccgctct

SEQ ID NO: 7513113 - DNA, 21 bp, Homo sapiens
ggtgacacgtggccccgctct

SEQ ID NO: 7513114 - DNA, 22 bp, Homo sapiens
ggtccctggaaggcactagtga

SEQ ID NO: 7513115 - DNA, 22 bp, Homo sapiens
ggtccctggaaggcactagtga

SEQ ID NO: 7513116 - DNA, 22 bp, Homo sapiens
ggtccctggaaggccaagcttg

SEQ ID NO: 7513117 - DNA, 22 bp, Homo sapiens
ggtccctggaaggccaagcttg

SEQ ID NO: 7513118 - DNA, 22 bp, Homo sapiens
ggtccctgctgaagccttggtg

SEQ ID NO: 7513119 - DNA, 22 bp, Homo sapiens
ggtccctgctgaagccttggtg

SEQ ID NO: 7513120 - DNA, 22 bp, Homo sapiens
ggtccctgctgaagccttggtg

SEQ ID NO: 7513121 - DNA, 22 bp, Homo sapiens
ggtgacagcgggtcaagaggag

SEQ ID NO: 7513122 - DNA, 22 bp, Homo sapiens
ggtgacagccgcttggcgctag

SEQ ID NO: 7513123 - DNA, 22 bp, Homo sapiens
ggtgacagcgggtcaagaggag

SEQ ID NO: 7513124 - DNA, 22 bp, Homo sapiens
ggtgacagcgggtcaagaggag

SEQ ID NO: 7513125 - DNA, 22 bp, Homo sapiens
ggtgagaggcagtgctgtggaa

SEQ ID NO: 7513126 - DNA, 22 bp, Homo sapiens
ggtgagaggcagtgctgtggaa

SEQ ID NO: 7513127 - DNA, 22 bp, Homo sapiens
ggtgacagcgggtcaagaggag

SEQ ID NO: 7513128 - DNA, 22 bp, Homo sapiens
ggtgagaggcagtgctgtggaa

SEQ ID NO: 7513129 - DNA, 22 bp, Homo sapiens
ggtgagaggcagtgctgtggaa

SEQ ID NO: 7513130 - DNA, 22 bp, Homo sapiens
ggtgagcaaagcttcatctgta

SEQ ID NO: 7513131 - DNA, 22 bp, Homo sapiens
ggtgagcaaagcttcatctgta

SEQ ID NO: 7513132 - DNA, 22 bp, Homo sapiens
ggtgagcaaagcttcatctgta

SEQ ID NO: 7513133 - DNA, 22 bp, Homo sapiens
ggtgagagtcttgtggtcccag

SEQ ID NO: 7513134 - DNA, 22 bp, Homo sapiens
ggtgagagttatgattccaatt

SEQ ID NO: 7513135 - DNA, 22 bp, Homo sapiens
ggtgagaggcctgagagctgga

SEQ ID NO: 7513136 - DNA, 22 bp, Homo sapiens
ggtgagaggcctgagagctgga

SEQ ID NO: 7513137 - DNA, 22 bp, Homo sapiens
ggtgagaggcctgagagctgga

SEQ ID NO: 7513138 - DNA, 22 bp, Homo sapiens
ggtgagaggcctgagagctgga

SEQ ID NO: 7513139 - DNA, 22 bp, Homo sapiens
ggtcccagtcctctccctgcta

SEQ ID NO: 7513140 - DNA, 22 bp, Homo sapiens
ggtcccaggttgacagggagac

SEQ ID NO: 7513141 - DNA, 22 bp, Homo sapiens
ggtcccagtccctttccaccgt

SEQ ID NO: 7513142 - DNA, 23 bp, Homo sapiens
ggtcccagtggagaggcctcacc

SEQ ID NO: 7513143 - DNA, 22 bp, Homo sapiens
ggtcccagtcctctccctgcta

SEQ ID NO: 7513144 - DNA, 22 bp, Homo sapiens
ggtcccagtcctctccctgcta

SEQ ID NO: 7513145 - DNA, 23 bp, Homo sapiens
ggtcccagtggagaggcctcacc

SEQ ID NO: 7513146 - DNA, 22 bp, Homo sapiens
ggtcccaggctgcgggctggtg

SEQ ID NO: 7513147 - DNA, 22 bp, Homo sapiens
ggtcccaggctgcgggctggtg

SEQ ID NO: 7513148 - DNA, 22 bp, Homo sapiens
ggtcccaggttgacagggagac

SEQ ID NO: 7513149 - DNA, 22 bp, Homo sapiens
ggtcccaggttgacagggagac

SEQ ID NO: 7513150 - DNA, 22 bp, Homo sapiens
ggtcccaggttgacagggagac

SEQ ID NO: 7513151 - DNA, 23 bp, Homo sapiens
ggtcccagtggagaggcctcacc

SEQ ID NO: 7513152 - DNA, 22 bp, Homo sapiens
ggtcccagttgcccaggtcagg

SEQ ID NO: 7513153 - DNA, 23 bp, Homo sapiens
ggtcccagtggagaggcctcacc

SEQ ID NO: 7513154 - DNA, 22 bp, Homo sapiens
ggtcccagttgcccaggtcagg

SEQ ID NO: 7513155 - DNA, 22 bp, Homo sapiens
ggtcccagttgcccaggtcagg

SEQ ID NO: 7513156 - DNA, 22 bp, Homo sapiens
ggtcccagttgcccaggtcagg

SEQ ID NO: 7513157 - DNA, 22 bp, Homo sapiens
ggtccccgtggaggctggagcg

SEQ ID NO: 7513158 - DNA, 22 bp, Homo sapiens
ggtccccccatggtgagcactg

SEQ ID NO: 7513159 - DNA, 22 bp, Homo sapiens
ggtccccccatggtgagcactg

SEQ ID NO: 7513160 - DNA, 22 bp, Homo sapiens
ggtccccccatggtgagcactg

SEQ ID NO: 7513161 - DNA, 22 bp, Homo sapiens
ggtccccccatggtgagcactg

SEQ ID NO: 7513162 - DNA, 22 bp, Homo sapiens
ggtccccccatggtgagcactg

SEQ ID NO: 7513163 - DNA, 22 bp, Homo sapiens
ggtccccagcagtggctgcttc

SEQ ID NO: 7513164 - DNA, 22 bp, Homo sapiens
ggtcccatgaaagagggaggcc

SEQ ID NO: 7513165 - DNA, 22 bp, Homo sapiens
ggtcccagttgcccaggtcagg

SEQ ID NO: 7513166 - DNA, 23 bp, Homo sapiens
ggtccctgacagcgggcaagttg

SEQ ID NO: 7513167 - DNA, 23 bp, Homo sapiens
ggtccctgacagcgggcaagttg

SEQ ID NO: 7513168 - DNA, 23 bp, Homo sapiens
ggtccctgacagcgggcaagttg

SEQ ID NO: 7513169 - DNA, 22 bp, Homo sapiens
ggtccctgcccaaagcccttgg

SEQ ID NO: 7513170 - DNA, 22 bp, Homo sapiens
ggtccctgcccacctgggagct

SEQ ID NO: 7513171 - DNA, 22 bp, Homo sapiens
ggtccctgcccacctgggagct

SEQ ID NO: 7513172 - DNA, 22 bp, Homo sapiens
ggtccctgcccacctgggagct

SEQ ID NO: 7513173 - DNA, 22 bp, Homo sapiens
ggtccctgcccaaagcccttgg

SEQ ID NO: 7513174 - DNA, 22 bp, Homo sapiens
ggtccctgcccaaagcccttgg

SEQ ID NO: 7513175 - DNA, 20 bp, Homo sapiens
ggtccctgccctctgtcatc

SEQ ID NO: 7513176 - DNA, 20 bp, Homo sapiens
ggtccctgccctctgtcatc

SEQ ID NO: 7513177 - DNA, 22 bp, Homo sapiens
ggtccctgccctacattttctt

SEQ ID NO: 7513178 - DNA, 22 bp, Homo sapiens
ggtccctgcctgaggctggcct

SEQ ID NO: 7513179 - DNA, 22 bp, Homo sapiens
ggtccctgcctgaggctggcct

SEQ ID NO: 7513180 - DNA, 22 bp, Homo sapiens
ggtccctgcctgaggctggcct

SEQ ID NO: 7513181 - DNA, 20 bp, Homo sapiens
ggtccctgccctctgtcatc

SEQ ID NO: 7513182 - DNA, 22 bp, Homo sapiens
ggtccccgtggaggctggagcg

SEQ ID NO: 7513183 - DNA, 22 bp, Homo sapiens
ggtccccgtggaggctggagcg

SEQ ID NO: 7513184 - DNA, 22 bp, Homo sapiens
ggtccccgtggaggctggagcg

SEQ ID NO: 7513185 - DNA, 22 bp, Homo sapiens
ggtccccgtggaggctggagcg

SEQ ID NO: 7513186 - DNA, 22 bp, Homo sapiens
ggtccccgtggaggctggagcg

SEQ ID NO: 7513187 - DNA, 22 bp, Homo sapiens
ggtccccgtggaggctggagcg

SEQ ID NO: 7513188 - DNA, 22 bp, Homo sapiens
ggtccccgtggaggctggagcg

SEQ ID NO: 7513189 - DNA, 22 bp, Homo sapiens
ggtccctgaagatgcctgagga

SEQ ID NO: 7513190 - DNA, 22 bp, Homo sapiens
ggtccctgaagatgcctgagga

SEQ ID NO: 7513191 - DNA, 22 bp, Homo sapiens
ggtccctgaagatgcctgagga

SEQ ID NO: 7513192 - DNA, 22 bp, Homo sapiens
ggtccctgaagatgcctgagga

SEQ ID NO: 7513193 - DNA, 22 bp, Homo sapiens
ggtccctgaagatgcctgagga

SEQ ID NO: 7513194 - DNA, 22 bp, Homo sapiens
ggtccctgaagaggcctggggt

SEQ ID NO: 7513195 - DNA, 22 bp, Homo sapiens
ggtccctgaagaggcctggggt

SEQ ID NO: 7513196 - DNA, 22 bp, Homo sapiens
ggtccctgaagaggcctggggt

SEQ ID NO: 7513197 - DNA, 22 bp, Homo sapiens
ggtccctgaagaggcctggggt

SEQ ID NO: 7513198 - DNA, 22 bp, Homo sapiens
ggtccctgaagaggcctggggt

SEQ ID NO: 7513199 - DNA, 22 bp, Homo sapiens
ggtcccagctggtcactgtcag

SEQ ID NO: 7513200 - DNA, 22 bp, Homo sapiens
ggtcccagctggtcactgtcag

SEQ ID NO: 7513201 - DNA, 22 bp, Homo sapiens
ggtcccagctggtcactgtcag

SEQ ID NO: 7513202 - DNA, 22 bp, Homo sapiens
ggtcccagctggtcactgtcag

SEQ ID NO: 7513203 - DNA, 22 bp, Homo sapiens
ggtcccagctggtcactgtcag

SEQ ID NO: 7513204 - DNA, 22 bp, Homo sapiens
ggtcccaggaagtgcggcggcg

SEQ ID NO: 7513205 - DNA, 22 bp, Homo sapiens
ggtcccaggaagtgcggcggcg

SEQ ID NO: 7513206 - DNA, 22 bp, Homo sapiens
ggtcccaggagaataggtgcaa

SEQ ID NO: 7513207 - DNA, 22 bp, Homo sapiens
ggtcccaggctccctcttgtcc

SEQ ID NO: 7513208 - DNA, 22 bp, Homo sapiens
ggtaaaaatcacaaatacttta

SEQ ID NO: 7513209 - DNA, 17 bp, Homo sapiens
gggttttgggagcagct

SEQ ID NO: 7513210 - DNA, 22 bp, Homo sapiens
ggtaaaaatcacaaatacttta

SEQ ID NO: 7513211 - DNA, 22 bp, Homo sapiens
ggtaaaaatcacaaatacttta

SEQ ID NO: 7513212 - DNA, 22 bp, Homo sapiens
ggtaaaaatcacaaatacttta

SEQ ID NO: 7513213 - DNA, 22 bp, Homo sapiens
ggtcccagctgctcaagaggct

SEQ ID NO: 7513214 - DNA, 22 bp, Homo sapiens
gggttttcttcaaaagtctaga

SEQ ID NO: 7513215 - DNA, 22 bp, Homo sapiens
gggttttccttctgcattggag

SEQ ID NO: 7513216 - DNA, 22 bp, Homo sapiens
ggtaaaaatcacaaatacttta

SEQ ID NO: 7513217 - DNA, 22 bp, Homo sapiens
ggtaaaaatcacaaatacttta

SEQ ID NO: 7513218 - DNA, 22 bp, Homo sapiens
gggttgttggaggtgagtgtta

SEQ ID NO: 7513219 - DNA, 22 bp, Homo sapiens
gggttttatggttcacttgcaa

SEQ ID NO: 7513220 - DNA, 22 bp, Homo sapiens
gggttgtcaatcaaaagaaaac

SEQ ID NO: 7513221 - DNA, 22 bp, Homo sapiens
gggttggggcccagcagtctgc

SEQ ID NO: 7513222 - DNA, 22 bp, Homo sapiens
gggttggggcccagcagtctgc

SEQ ID NO: 7513223 - DNA, 22 bp, Homo sapiens
gggttggggcccagcagtctgc

SEQ ID NO: 7513224 - DNA, 22 bp, Homo sapiens
gggttgtagagctggaagggga

SEQ ID NO: 7513225 - DNA, 22 bp, Homo sapiens
gggttggggcccagcagtctgc

SEQ ID NO: 7513226 - DNA, 22 bp, Homo sapiens
gggttggggcccagcagtctgc

SEQ ID NO: 7513227 - DNA, 22 bp, Homo sapiens
gggttggcagcaccagaggagg

SEQ ID NO: 7513228 - DNA, 22 bp, Homo sapiens
gggttggcagcaccagaggagg

SEQ ID NO: 7513229 - DNA, 22 bp, Homo sapiens
gggttggcatcagggttctgtg

SEQ ID NO: 7513230 - DNA, 22 bp, Homo sapiens
gggttgggactgtcatctggag

SEQ ID NO: 7513231 - DNA, 22 bp, Homo sapiens
gggttgggactgtcatctggag

SEQ ID NO: 7513232 - DNA, 22 bp, Homo sapiens
gggttgggactgtcatctggag

SEQ ID NO: 7513233 - DNA, 22 bp, Homo sapiens
gggttggggcccagcagtctgc

SEQ ID NO: 7513234 - DNA, 22 bp, Homo sapiens
gggttggattacttagggagaa

SEQ ID NO: 7513235 - DNA, 22 bp, Homo sapiens
gggttggattacttagggagaa

SEQ ID NO: 7513236 - DNA, 22 bp, Homo sapiens
gggttggattacttagggagaa

SEQ ID NO: 7513237 - DNA, 22 bp, Homo sapiens
gggttggattacttagggagaa

SEQ ID NO: 7513238 - DNA, 22 bp, Homo sapiens
gggttggatcctggtggctgcc

SEQ ID NO: 7513239 - DNA, 22 bp, Homo sapiens
gggttggatcctggtggctgcc

SEQ ID NO: 7513240 - DNA, 22 bp, Homo sapiens
gggttggatcctggtggctgcc

SEQ ID NO: 7513241 - DNA, 22 bp, Homo sapiens
gggttggatcctggtggctgcc

SEQ ID NO: 7513242 - DNA, 22 bp, Homo sapiens
gggttggatcctggtggctgcc

SEQ ID NO: 7513243 - DNA, 22 bp, Homo sapiens
gggttgaggcggatgtcggcgg

SEQ ID NO: 7513244 - DNA, 22 bp, Homo sapiens
gggttgaggcggatgtcggcgg

SEQ ID NO: 7513245 - DNA, 18 bp, Homo sapiens
gggtggtgtgctcttcgc

SEQ ID NO: 7513246 - DNA, 18 bp, Homo sapiens
gggtggtgtgctcttcgc

SEQ ID NO: 7513247 - DNA, 18 bp, Homo sapiens
gggtggtgtgctcttcgc

SEQ ID NO: 7513248 - DNA, 18 bp, Homo sapiens
gggtggtgtgctcttcgc

SEQ ID NO: 7513249 - DNA, 22 bp, Homo sapiens
gggtggtgtattagagctgcag

SEQ ID NO: 7513250 - DNA, 22 bp, Homo sapiens
gggtgtagacacatgttcatct

SEQ ID NO: 7513251 - DNA, 22 bp, Homo sapiens
gggtgtccacaaaatggctttg

SEQ ID NO: 7513252 - DNA, 22 bp, Homo sapiens
gggtgtagaaagaaccctctgg

SEQ ID NO: 7513253 - DNA, 22 bp, Homo sapiens
gggtgtccagggcgtgtctgga

SEQ ID NO: 7513254 - DNA, 22 bp, Homo sapiens
gggtgtccagggcgtgtctgga

SEQ ID NO: 7513255 - DNA, 22 bp, Homo sapiens
gggtgtccagggcgtgtctgga

SEQ ID NO: 7513256 - DNA, 22 bp, Homo sapiens
gggtgtgcaggtcatggcgtct

SEQ ID NO: 7513257 - DNA, 22 bp, Homo sapiens
gggtgtccttctgtggactctg

SEQ ID NO: 7513258 - DNA, 22 bp, Homo sapiens
gggtgtccttctgtggactctg

SEQ ID NO: 7513259 - DNA, 22 bp, Homo sapiens
gggtgtcctgtgccaagctggg

SEQ ID NO: 7513260 - DNA, 22 bp, Homo sapiens
gggtgtcctgtgccaagctggg

SEQ ID NO: 7513261 - DNA, 22 bp, Homo sapiens
gggtgtcctgtgccaagctggg

SEQ ID NO: 7513262 - DNA, 22 bp, Homo sapiens
gggtgtcctgtgccaagctggg

SEQ ID NO: 7513263 - DNA, 22 bp, Homo sapiens
ggtggcagagaggaggtagttt

SEQ ID NO: 7513264 - DNA, 22 bp, Homo sapiens
ggtggcagagaggaggtagttt

SEQ ID NO: 7513265 - DNA, 22 bp, Homo sapiens
ggtgggcaggcgaggcccaggt

SEQ ID NO: 7513266 - DNA, 22 bp, Homo sapiens
ggtggcagagaggaggtagttt

SEQ ID NO: 7513267 - DNA, 22 bp, Homo sapiens
ggtgggcaggtcactctgcctc

SEQ ID NO: 7513268 - DNA, 22 bp, Homo sapiens
ggtgggcaggcgaggcccaggt

SEQ ID NO: 7513269 - DNA, 22 bp, Homo sapiens
ggtgggcaggtcactctgcctc

SEQ ID NO: 7513270 - DNA, 22 bp, Homo sapiens
ggtggcagagacataggacata

SEQ ID NO: 7513271 - DNA, 22 bp, Homo sapiens
ggtggcagagacataggacata

SEQ ID NO: 7513272 - DNA, 22 bp, Homo sapiens
ggtggcagagacataggacata

SEQ ID NO: 7513273 - DNA, 22 bp, Homo sapiens
ggtggcagagacataggacata

SEQ ID NO: 7513274 - DNA, 22 bp, Homo sapiens
ggtggcagagaggaggtagttt

SEQ ID NO: 7513275 - DNA, 22 bp, Homo sapiens
ggtggcagagacataggacata

SEQ ID NO: 7513276 - DNA, 22 bp, Homo sapiens
ggtggcagagacataggacata

SEQ ID NO: 7513277 - DNA, 22 bp, Homo sapiens
ggtggcagaataattgaaggtc

SEQ ID NO: 7513278 - DNA, 22 bp, Homo sapiens
ggtggcagagacataggacata

SEQ ID NO: 7513279 - DNA, 22 bp, Homo sapiens
ggtggcagagacataggacata

SEQ ID NO: 7513280 - DNA, 22 bp, Homo sapiens
ggtggcagagacataggacata

SEQ ID NO: 7513281 - DNA, 22 bp, Homo sapiens
ggtggcagaataattgaaggtc

SEQ ID NO: 7513282 - DNA, 19 bp, Homo sapiens
ggtggcagaacgtgggtcc

SEQ ID NO: 7513283 - DNA, 19 bp, Homo sapiens
ggtggcagaacgtgggtcc

SEQ ID NO: 7513284 - DNA, 22 bp, Homo sapiens
ggtggcagaataattgaaggtc

SEQ ID NO: 7513285 - DNA, 22 bp, Homo sapiens
ggtggcagaataattgaaggtc

SEQ ID NO: 7513286 - DNA, 22 bp, Homo sapiens
ggtggcagaataattgaaggtc

SEQ ID NO: 7513287 - DNA, 19 bp, Homo sapiens
ggtggcagaacgtgggtcc

SEQ ID NO: 7513288 - DNA, 19 bp, Homo sapiens
ggtggcagaacgtgggtcc

SEQ ID NO: 7513289 - DNA, 19 bp, Homo sapiens
ggtggcagaacgtgggtcc

SEQ ID NO: 7513290 - DNA, 19 bp, Homo sapiens
ggtggcagaacgtgggtcc

SEQ ID NO: 7513291 - DNA, 19 bp, Homo sapiens
ggtggcagaacgtgggtcc

SEQ ID NO: 7513292 - DNA, 19 bp, Homo sapiens
ggtggcagaacgtgggtcc

SEQ ID NO: 7513293 - DNA, 22 bp, Homo sapiens
ggtggcactcattatcaggtgc

SEQ ID NO: 7513294 - DNA, 22 bp, Homo sapiens
ggtggcactcattatcaggtgc

SEQ ID NO: 7513295 - DNA, 22 bp, Homo sapiens
ggtggcactcaaccttttatta

SEQ ID NO: 7513296 - DNA, 19 bp, Homo sapiens
ggtggcagaacgtgggtcc

SEQ ID NO: 7513297 - DNA, 22 bp, Homo sapiens
ggtggagctatacgggatggct

SEQ ID NO: 7513298 - DNA, 22 bp, Homo sapiens
ggtggagctatacgggatggct

SEQ ID NO: 7513299 - DNA, 22 bp, Homo sapiens
ggtggagctatacgggatggct

SEQ ID NO: 7513300 - DNA, 22 bp, Homo sapiens
ggtggagctggaccaggagagg

SEQ ID NO: 7513301 - DNA, 22 bp, Homo sapiens
ggtggagctggaccaggagagg

SEQ ID NO: 7513302 - DNA, 22 bp, Homo sapiens
ggtggagctggaccaggagagg

SEQ ID NO: 7513303 - DNA, 22 bp, Homo sapiens
ggtggagctggaccaggagagg

SEQ ID NO: 7513304 - DNA, 22 bp, Homo sapiens
ggtggagagctggatgagaggt

SEQ ID NO: 7513305 - DNA, 22 bp, Homo sapiens
ggtggagagctggatgagaggt

SEQ ID NO: 7513306 - DNA, 22 bp, Homo sapiens
ggtggagcgcagggtgctggcg

SEQ ID NO: 7513307 - DNA, 22 bp, Homo sapiens
ggtggagcgcagggtgctggcg

SEQ ID NO: 7513308 - DNA, 22 bp, Homo sapiens
ggtggactgtgttggagttgac

SEQ ID NO: 7513309 - DNA, 22 bp, Homo sapiens
ggtggactcaaaatgtgcttga

SEQ ID NO: 7513310 - DNA, 22 bp, Homo sapiens
ggtggagagctggatgagaggt

SEQ ID NO: 7513311 - DNA, 22 bp, Homo sapiens
ggtggagagctggatgagaggt

SEQ ID NO: 7513312 - DNA, 22 bp, Homo sapiens
ggtggagagctggatgagaggt

SEQ ID NO: 7513313 - DNA, 22 bp, Homo sapiens
ggtggagagctggatgagaggt

SEQ ID NO: 7513314 - DNA, 22 bp, Homo sapiens
ggtggatgctgactgttctgct

SEQ ID NO: 7513315 - DNA, 22 bp, Homo sapiens
ggtggatggactctcgggggcc

SEQ ID NO: 7513316 - DNA, 22 bp, Homo sapiens
ggtggatggactctcgggggcc

SEQ ID NO: 7513317 - DNA, 22 bp, Homo sapiens
ggtggatggactctcgggggcc

SEQ ID NO: 7513318 - DNA, 22 bp, Homo sapiens
ggtggagtaattcgcagaggtt

SEQ ID NO: 7513319 - DNA, 22 bp, Homo sapiens
ggtggatagctcagctccacgt

SEQ ID NO: 7513320 - DNA, 22 bp, Homo sapiens
ggtggataggtacatggacttt

SEQ ID NO: 7513321 - DNA, 22 bp, Homo sapiens
ggtggagtaattcgcagaggtt

SEQ ID NO: 7513322 - DNA, 22 bp, Homo sapiens
ggtggagctgtggacaggaagg

SEQ ID NO: 7513323 - DNA, 22 bp, Homo sapiens
ggtggagtaattcgcagaggtt

SEQ ID NO: 7513324 - DNA, 22 bp, Homo sapiens
ggtggagtaattcgcagaggtt

SEQ ID NO: 7513325 - DNA, 22 bp, Homo sapiens
ggtggagtaattcgcagaggtt

SEQ ID NO: 7513326 - DNA, 22 bp, Homo sapiens
ggtggagtaattcgcagaggtt

SEQ ID NO: 7513327 - DNA, 22 bp, Homo sapiens
ggtggagtaattcgcagaggtt

SEQ ID NO: 7513328 - DNA, 22 bp, Homo sapiens
ggtggcacactggggagctcgg

SEQ ID NO: 7513329 - DNA, 22 bp, Homo sapiens
ggtggcaagggcagccagtaac

SEQ ID NO: 7513330 - DNA, 22 bp, Homo sapiens
ggtggcaagggcagccagtaac

SEQ ID NO: 7513331 - DNA, 22 bp, Homo sapiens
ggtggcacactggggagctcgg

SEQ ID NO: 7513332 - DNA, 22 bp, Homo sapiens
ggtggcaccttaccctgcgcag

SEQ ID NO: 7513333 - DNA, 22 bp, Homo sapiens
ggtggcaccttaccctgcgcag

SEQ ID NO: 7513334 - DNA, 22 bp, Homo sapiens
ggtggcaccttaccctgcgcag

SEQ ID NO: 7513335 - DNA, 22 bp, Homo sapiens
ggtggcaccttaccctgcgcag

SEQ ID NO: 7513336 - DNA, 22 bp, Homo sapiens
ggtggcaccttgatcttggact

SEQ ID NO: 7513337 - DNA, 22 bp, Homo sapiens
ggtggcaccttgatcttggact

SEQ ID NO: 7513338 - DNA, 22 bp, Homo sapiens
ggtggggagtcaggcattcttg

SEQ ID NO: 7513339 - DNA, 22 bp, Homo sapiens
ggtggggagtcaggcattcttg

SEQ ID NO: 7513340 - DNA, 22 bp, Homo sapiens
ggtggggagtcaggcattcttg

SEQ ID NO: 7513341 - DNA, 22 bp, Homo sapiens
ggtgggcgactgagaggggttt

SEQ ID NO: 7513342 - DNA, 22 bp, Homo sapiens
ggtggggattcctgatcactgt

SEQ ID NO: 7513343 - DNA, 22 bp, Homo sapiens
ggtggggagtcaggcattcttg

SEQ ID NO: 7513344 - DNA, 22 bp, Homo sapiens
ggtggggagtcaggcattcttg

SEQ ID NO: 7513345 - DNA, 22 bp, Homo sapiens
ggtgggcgactgagaggggttt

SEQ ID NO: 7513346 - DNA, 22 bp, Homo sapiens
ggtgggcgactgagaggggttt

SEQ ID NO: 7513347 - DNA, 22 bp, Homo sapiens
ggtgggcgactgagaggggttt

SEQ ID NO: 7513348 - DNA, 22 bp, Homo sapiens
ggtgggccaggaaggccgccag

SEQ ID NO: 7513349 - DNA, 22 bp, Homo sapiens
ggtgggccaggaaggccgccag

SEQ ID NO: 7513350 - DNA, 22 bp, Homo sapiens
ggtgggccaggaaggccgccag

SEQ ID NO: 7513351 - DNA, 22 bp, Homo sapiens
ggtgggccaggaaggccgccag

SEQ ID NO: 7513352 - DNA, 22 bp, Homo sapiens
ggtgggccaggaaggccgccag

SEQ ID NO: 7513353 - DNA, 22 bp, Homo sapiens
ggtgggccacggcataacgggc

SEQ ID NO: 7513354 - DNA, 22 bp, Homo sapiens
ggtgggcaggtcactctgcctc

SEQ ID NO: 7513355 - DNA, 22 bp, Homo sapiens
ggtggggattcctgatcactgt

SEQ ID NO: 7513356 - DNA, 22 bp, Homo sapiens
ggtggggccagggctccaacct

SEQ ID NO: 7513357 - DNA, 22 bp, Homo sapiens
ggtggggccagggctccaacct

SEQ ID NO: 7513358 - DNA, 22 bp, Homo sapiens
ggtggggccagggctccaacct

SEQ ID NO: 7513359 - DNA, 22 bp, Homo sapiens
ggtggggccagggctccaacct

SEQ ID NO: 7513360 - DNA, 22 bp, Homo sapiens
ggtggggattcctgatcactgt

SEQ ID NO: 7513361 - DNA, 22 bp, Homo sapiens
ggtggggattcctgatcactgt

SEQ ID NO: 7513362 - DNA, 22 bp, Homo sapiens
ggtggggattcctgatcactgt

SEQ ID NO: 7513363 - DNA, 22 bp, Homo sapiens
ggtggggccagggctccaacct

SEQ ID NO: 7513364 - DNA, 22 bp, Homo sapiens
ggtggggcccaggcatctgatg

SEQ ID NO: 7513365 - DNA, 22 bp, Homo sapiens
ggtggggcccaggcatctgatg

SEQ ID NO: 7513366 - DNA, 22 bp, Homo sapiens
ggtggggcccaggcatctgatg

SEQ ID NO: 7513367 - DNA, 22 bp, Homo sapiens
ggtggggcccaggcatctgatg

SEQ ID NO: 7513368 - DNA, 22 bp, Homo sapiens
ggtggggccctggcactggtat

SEQ ID NO: 7513369 - DNA, 22 bp, Homo sapiens
ggtggggccctggcactggtat

SEQ ID NO: 7513370 - DNA, 22 bp, Homo sapiens
ggtggggccctggcactggtat

SEQ ID NO: 7513371 - DNA, 22 bp, Homo sapiens
ggtggggccctggcactggtat

SEQ ID NO: 7513372 - DNA, 22 bp, Homo sapiens
ggtggggccctggcactggtat

SEQ ID NO: 7513373 - DNA, 22 bp, Homo sapiens
ggtggggccctggcactggtat

SEQ ID NO: 7513374 - DNA, 22 bp, Homo sapiens
ggtggggcctgctccagcggcc

SEQ ID NO: 7513375 - DNA, 22 bp, Homo sapiens
ggtggggcctgctccagcggcc

SEQ ID NO: 7513376 - DNA, 22 bp, Homo sapiens
ggtggggcctgctccagcggcc

SEQ ID NO: 7513377 - DNA, 22 bp, Homo sapiens
ggtggggcctgctccagcggcc

SEQ ID NO: 7513378 - DNA, 22 bp, Homo sapiens
ggtggggcctgctccagcggcc

SEQ ID NO: 7513379 - DNA, 22 bp, Homo sapiens
ggtggggcctgctccagcggcc

SEQ ID NO: 7513380 - DNA, 19 bp, Homo sapiens
ggtgggtgacctccccacc

SEQ ID NO: 7513381 - DNA, 22 bp, Homo sapiens
ggtggggctaggacctcaggat

SEQ ID NO: 7513382 - DNA, 22 bp, Homo sapiens
ggtggggctaggacctcaggat

SEQ ID NO: 7513383 - DNA, 19 bp, Homo sapiens
ggtgggtgacctccccacc

SEQ ID NO: 7513384 - DNA, 22 bp, Homo sapiens
ggtggggcctgctccagcggcc

SEQ ID NO: 7513385 - DNA, 22 bp, Homo sapiens
ggtggggcctgctccagcggcc

SEQ ID NO: 7513386 - DNA, 22 bp, Homo sapiens
ggtggggcctgctccagcggcc

SEQ ID NO: 7513387 - DNA, 22 bp, Homo sapiens
ggtggggcctgctccagcggcc

SEQ ID NO: 7513388 - DNA, 22 bp, Homo sapiens
ggtggggcctgctccagcggcc

SEQ ID NO: 7513389 - DNA, 22 bp, Homo sapiens
ggtggggcctgctccagcggcc

SEQ ID NO: 7513390 - DNA, 22 bp, Homo sapiens
ggtgggtgagccctgggagctg

SEQ ID NO: 7513391 - DNA, 22 bp, Homo sapiens
ggtgggtgagccctgggagctg

SEQ ID NO: 7513392 - DNA, 22 bp, Homo sapiens
ggtgggtgagccctgggagctg

SEQ ID NO: 7513393 - DNA, 22 bp, Homo sapiens
ggtgggtgagccctgggagctg

SEQ ID NO: 7513394 - DNA, 19 bp, Homo sapiens
ggtgggtgacctccccacc

SEQ ID NO: 7513395 - DNA, 22 bp, Homo sapiens
ggtgggtgagccctgggagctg

SEQ ID NO: 7513396 - DNA, 22 bp, Homo sapiens
ggtgggtgagccctgggagctg

SEQ ID NO: 7513397 - DNA, 22 bp, Homo sapiens
ggtgggtgagccctgggagctg

SEQ ID NO: 7513398 - DNA, 22 bp, Homo sapiens
ggtgggtgagccctgggagctg

SEQ ID NO: 7513399 - DNA, 22 bp, Homo sapiens
ggtgggtgagccctgggagctg

SEQ ID NO: 7513400 - DNA, 22 bp, Homo sapiens
ggtgggtgcagggggcttctta

SEQ ID NO: 7513401 - DNA, 22 bp, Homo sapiens
ggtgggtgcagggggcttctta

SEQ ID NO: 7513402 - DNA, 22 bp, Homo sapiens
ggtgggtgcagggggcttctta

SEQ ID NO: 7513403 - DNA, 22 bp, Homo sapiens
ggtgggtgcagggggcttctta

SEQ ID NO: 7513404 - DNA, 22 bp, Homo sapiens
ggtgggtgcagggggcttctta

SEQ ID NO: 7513405 - DNA, 22 bp, Homo sapiens
ggtgggtgcagggggcttctta

SEQ ID NO: 7513406 - DNA, 22 bp, Homo sapiens
ggtgggtggaaacagcatgtac

SEQ ID NO: 7513407 - DNA, 22 bp, Homo sapiens
ggtgggtggaaacagcatgtac

SEQ ID NO: 7513408 - DNA, 22 bp, Homo sapiens
ggtgggtggaaacagcatgtac

SEQ ID NO: 7513409 - DNA, 22 bp, Homo sapiens
ggtgggtggaaacagcatgtac

SEQ ID NO: 7513410 - DNA, 22 bp, Homo sapiens
ggttcagtttacattaaaatct

SEQ ID NO: 7513411 - DNA, 22 bp, Homo sapiens
ggttcattctgaagtcttcagc

SEQ ID NO: 7513412 - DNA, 22 bp, Homo sapiens
ggttcagtttacattaaaatct

SEQ ID NO: 7513413 - DNA, 22 bp, Homo sapiens
ggttcattctgaagtcttcagc

SEQ ID NO: 7513414 - DNA, 22 bp, Homo sapiens
ggttccacctggcgaggggtat

SEQ ID NO: 7513415 - DNA, 23 bp, Homo sapiens
ggttggctgtacccaggctccct

SEQ ID NO: 7513416 - DNA, 19 bp, Homo sapiens
ggttggagaagagcggccc

SEQ ID NO: 7513417 - DNA, 22 bp, Homo sapiens
ggttcagggatgtgggtgatgc

SEQ ID NO: 7513418 - DNA, 22 bp, Homo sapiens
ggttcagggctaccagtgggtg

SEQ ID NO: 7513419 - DNA, 22 bp, Homo sapiens
ggttcagggctaccagtgggtg

SEQ ID NO: 7513420 - DNA, 17 bp, Homo sapiens
ggttcagttctgcattc

SEQ ID NO: 7513421 - DNA, 17 bp, Homo sapiens
ggttcagttctgcattc

SEQ ID NO: 7513422 - DNA, 22 bp, Homo sapiens
ggttcagagaaggctaaatagt

SEQ ID NO: 7513423 - DNA, 22 bp, Homo sapiens
ggttcactctcaagtctgccta

SEQ ID NO: 7513424 - DNA, 22 bp, Homo sapiens
ggttcactccgatctctgcctc

SEQ ID NO: 7513425 - DNA, 22 bp, Homo sapiens
ggttcagagtcaggatctaagt

SEQ ID NO: 7513426 - DNA, 22 bp, Homo sapiens
ggttcagcagcagccacaattc

SEQ ID NO: 7513427 - DNA, 22 bp, Homo sapiens
ggttggggcgagctggaggccc

SEQ ID NO: 7513428 - DNA, 17 bp, Homo sapiens
ggttggcttatcccagg

SEQ ID NO: 7513429 - DNA, 22 bp, Homo sapiens
ggttggggcgagctggaggccc

SEQ ID NO: 7513430 - DNA, 22 bp, Homo sapiens
ggttggggcgagctggaggccc

SEQ ID NO: 7513431 - DNA, 22 bp, Homo sapiens
ggttggggcgagctggaggccc

SEQ ID NO: 7513432 - DNA, 22 bp, Homo sapiens
ggttggggcgagctggaggccc

SEQ ID NO: 7513433 - DNA, 22 bp, Homo sapiens
ggttggggcgagctggaggccc

SEQ ID NO: 7513434 - DNA, 22 bp, Homo sapiens
ggttggggcgagctggaggccc

SEQ ID NO: 7513435 - DNA, 21 bp, Homo sapiens
ggttggtgtgtccagtggcca

SEQ ID NO: 7513436 - DNA, 21 bp, Homo sapiens
ggttggtgtgtccagtggcca

SEQ ID NO: 7513437 - DNA, 22 bp, Homo sapiens
ggttggtgcccaggccatactg

SEQ ID NO: 7513438 - DNA, 22 bp, Homo sapiens
ggttggtgagtgcagggtgtta

SEQ ID NO: 7513439 - DNA, 22 bp, Homo sapiens
ggttggtgctgcatttgcctca

SEQ ID NO: 7513440 - DNA, 22 bp, Homo sapiens
ggttggtgcccaggccatactg

SEQ ID NO: 7513441 - DNA, 22 bp, Homo sapiens
ggttggtaactccctgtgcagt

SEQ ID NO: 7513442 - DNA, 22 bp, Homo sapiens
ggttggggcgagctggaggccc

SEQ ID NO: 7513443 - DNA, 22 bp, Homo sapiens
ggttggggcgagctggaggccc

SEQ ID NO: 7513444 - DNA, 22 bp, Homo sapiens
ggttggggcgagctggaggccc

SEQ ID NO: 7513445 - DNA, 22 bp, Homo sapiens
ggttggtgagtgcagggtgtta

SEQ ID NO: 7513446 - DNA, 22 bp, Homo sapiens
gtaatttttagttcattctatc

SEQ ID NO: 7513447 - DNA, 22 bp, Homo sapiens
gtaatttttagttcattctatc

SEQ ID NO: 7513448 - DNA, 22 bp, Homo sapiens
gtaatttttagttcattctatc

SEQ ID NO: 7513449 - DNA, 22 bp, Homo sapiens
gtaatttttagttcattctatc

SEQ ID NO: 7513450 - DNA, 22 bp, Homo sapiens
gtaatttttagttcattctatc

SEQ ID NO: 7513451 - DNA, 22 bp, Homo sapiens
gtaattttggagtataacctgg

SEQ ID NO: 7513452 - DNA, 22 bp, Homo sapiens
gtaattttggagtataacctgg

SEQ ID NO: 7513453 - DNA, 22 bp, Homo sapiens
gtaattttggagtataacctgg

SEQ ID NO: 7513454 - DNA, 22 bp, Homo sapiens
gtaattttggagtataacctgg

SEQ ID NO: 7513455 - DNA, 22 bp, Homo sapiens
gtaattttggagtataacctgg

SEQ ID NO: 7513456 - DNA, 22 bp, Homo sapiens
gtaattttggagtataacctgg

SEQ ID NO: 7513457 - DNA, 22 bp, Homo sapiens
gtacaaaagttattgcggtttt

SEQ ID NO: 7513458 - DNA, 22 bp, Homo sapiens
gtacaaaagttattgcggtttt

SEQ ID NO: 7513459 - DNA, 22 bp, Homo sapiens
gtacaaaagttattgcggtttt

SEQ ID NO: 7513460 - DNA, 22 bp, Homo sapiens
gtacaaaagttattgcggtttt

SEQ ID NO: 7513461 - DNA, 22 bp, Homo sapiens
gtaatttttagttcattctatc

SEQ ID NO: 7513462 - DNA, 22 bp, Homo sapiens
gtaatttaattctctgacttga

SEQ ID NO: 7513463 - DNA, 22 bp, Homo sapiens
gtaattgtgggcttagtagagt

SEQ ID NO: 7513464 - DNA, 22 bp, Homo sapiens
gtaatttaattctctgacttga

SEQ ID NO: 7513465 - DNA, 22 bp, Homo sapiens
gtaattgtcttgaattcacaac

SEQ ID NO: 7513466 - DNA, 22 bp, Homo sapiens
gtaattgtcttgaattcacaac

SEQ ID NO: 7513467 - DNA, 22 bp, Homo sapiens
gtaattctgtgtgaatctatta

SEQ ID NO: 7513468 - DNA, 22 bp, Homo sapiens
gtaattctgtgtgaatctatta

SEQ ID NO: 7513469 - DNA, 22 bp, Homo sapiens
gtaattctgtgtgaatctatta

SEQ ID NO: 7513470 - DNA, 22 bp, Homo sapiens
gtaattctagagtttggacagc

SEQ ID NO: 7513471 - DNA, 21 bp, Homo sapiens
gtaattctgcctcatcttcac

SEQ ID NO: 7513472 - DNA, 22 bp, Homo sapiens
gtaattacattagggtaaataa

SEQ ID NO: 7513473 - DNA, 22 bp, Homo sapiens
gtaattacattagggtaaataa

SEQ ID NO: 7513474 - DNA, 22 bp, Homo sapiens
gtaattaggaataaaatgggaa

SEQ ID NO: 7513475 - DNA, 22 bp, Homo sapiens
ggtttaaaagccatgcatgggg

SEQ ID NO: 7513476 - DNA, 17 bp, Homo sapiens
ggtttaatccttacctg

SEQ ID NO: 7513477 - DNA, 22 bp, Homo sapiens
ggtttaaaagccatgcatgggg

SEQ ID NO: 7513478 - DNA, 22 bp, Homo sapiens
ggttgtagttggaggttgtata

SEQ ID NO: 7513479 - DNA, 22 bp, Homo sapiens
ggttgtagttggaggttgtata

SEQ ID NO: 7513480 - DNA, 21 bp, Homo sapiens
ggttggtgtgtccagtggcca

SEQ ID NO: 7513481 - DNA, 21 bp, Homo sapiens
ggttggtgtgtccagtggcca

SEQ ID NO: 7513482 - DNA, 21 bp, Homo sapiens
ggttggtgtgtccagtggcca

SEQ ID NO: 7513483 - DNA, 21 bp, Homo sapiens
ggttggtgtgtccagtggcca

SEQ ID NO: 7513484 - DNA, 22 bp, Homo sapiens
ggtttaagacaggcttcacagt

SEQ ID NO: 7513485 - DNA, 22 bp, Homo sapiens
ggtttaatggagatatttcaga

SEQ ID NO: 7513486 - DNA, 22 bp, Homo sapiens
ggtttaatgggtgaaggcatga

SEQ ID NO: 7513487 - DNA, 19 bp, Homo sapiens
gtaatgcatctgtgtatga

SEQ ID NO: 7513488 - DNA, 22 bp, Homo sapiens
gtaatgcatttattttatgaaa

SEQ ID NO: 7513489 - DNA, 22 bp, Homo sapiens
gtaatgcatttattttatgaaa

SEQ ID NO: 7513490 - DNA, 22 bp, Homo sapiens
gtaatgtgttttgaaaaacagt

SEQ ID NO: 7513491 - DNA, 22 bp, Homo sapiens
gtaattacatgagtactgtaag

SEQ ID NO: 7513492 - DNA, 22 bp, Homo sapiens
gtaatgcttttgatacagggac

SEQ ID NO: 7513493 - DNA, 22 bp, Homo sapiens
ggttatcagttcacttatgtaa

SEQ ID NO: 7513494 - DNA, 23 bp, Homo sapiens
ggttagggaatgatctcaggcat

SEQ ID NO: 7513495 - DNA, 22 bp, Homo sapiens
ggttattgtggagaagttccgg

SEQ ID NO: 7513496 - DNA, 22 bp, Homo sapiens
ggttattgtttatagagcataa

SEQ ID NO: 7513497 - DNA, 22 bp, Homo sapiens
ggttatggtgatgggaaaggat

SEQ ID NO: 7513498 - DNA, 22 bp, Homo sapiens
ggttatttctgattatatgata

SEQ ID NO: 7513499 - DNA, 19 bp, Homo sapiens
ggttatttgagggttaaga

SEQ ID NO: 7513500 - DNA, 22 bp, Homo sapiens
ggttatttctgattatatgata

SEQ ID NO: 7513501 - DNA, 19 bp, Homo sapiens
ggttatttgagggttaaga

SEQ ID NO: 7513502 - DNA, 23 bp, Homo sapiens
ggttatttgcatcctgtaattat

SEQ ID NO: 7513503 - DNA, 19 bp, Homo sapiens
ggttatttgagggttaaga

SEQ ID NO: 7513504 - DNA, 22 bp, Homo sapiens
ggttagagggcatgcgatcttt

SEQ ID NO: 7513505 - DNA, 16 bp, Homo sapiens
ggttaccataaccgcc

SEQ ID NO: 7513506 - DNA, 22 bp, Homo sapiens
ggttactcaagcctgccttctc

SEQ ID NO: 7513507 - DNA, 22 bp, Homo sapiens
ggttagagagctgagaaagttt

SEQ ID NO: 7513508 - DNA, 22 bp, Homo sapiens
ggttagagggcatgcgatcttt

SEQ ID NO: 7513509 - DNA, 23 bp, Homo sapiens
ggttagggaatgatctcaggcat

SEQ ID NO: 7513510 - DNA, 22 bp, Homo sapiens
ggttacatggaagaaatataat

SEQ ID NO: 7513511 - DNA, 22 bp, Homo sapiens
ggttacatggaagaaatataat

SEQ ID NO: 7513512 - DNA, 22 bp, Homo sapiens
ggttacatctcaagtggagtct

SEQ ID NO: 7513513 - DNA, 21 bp, Homo sapiens
ggttacaacagttaaacagag

SEQ ID NO: 7513514 - DNA, 22 bp, Homo sapiens
ggttacatagtaaggtcctatt

SEQ ID NO: 7513515 - DNA, 20 bp, Homo sapiens
ggttacattgtctacatgtg

SEQ ID NO: 7513516 - DNA, 22 bp, Homo sapiens
ggttacatgtatgtttggtata

SEQ ID NO: 7513517 - DNA, 19 bp, Homo sapiens
ggttaccagtgtgtctggc

SEQ ID NO: 7513518 - DNA, 22 bp, Homo sapiens
ggttcacactttcatgatttca

SEQ ID NO: 7513519 - DNA, 22 bp, Homo sapiens
ggttcacactaagcttaagtgg

SEQ ID NO: 7513520 - DNA, 22 bp, Homo sapiens
ggttcacactaagcttaagtgg

SEQ ID NO: 7513521 - DNA, 22 bp, Homo sapiens
ggttcacactaagcttaagtgg

SEQ ID NO: 7513522 - DNA, 22 bp, Homo sapiens
ggttatttttgattctgtggat

SEQ ID NO: 7513523 - DNA, 22 bp, Homo sapiens
ggttattttggttgtctaaggc

SEQ ID NO: 7513524 - DNA, 23 bp, Homo sapiens
ggttatttgcatcctgtaattat

SEQ ID NO: 7513525 - DNA, 23 bp, Homo sapiens
ggttatttgcatcctgtaattat

SEQ ID NO: 7513526 - DNA, 22 bp, Homo sapiens
ggttatttttgattctgtggat

SEQ ID NO: 7513527 - DNA, 22 bp, Homo sapiens
ggttattttggttgtctaaggc

SEQ ID NO: 7513528 - DNA, 22 bp, Homo sapiens
ggttcacagctgtggggttccc

SEQ ID NO: 7513529 - DNA, 22 bp, Homo sapiens
ggttcacactttcatgatttca

SEQ ID NO: 7513530 - DNA, 22 bp, Homo sapiens
ggttcacactttcatgatttca

SEQ ID NO: 7513531 - DNA, 22 bp, Homo sapiens
ggttcacaggtcctgggagcag

SEQ ID NO: 7513532 - DNA, 22 bp, Homo sapiens
ggttcacaggtccgactgctgg

SEQ ID NO: 7513533 - DNA, 22 bp, Homo sapiens
ggttcacatattgagagtattc

SEQ ID NO: 7513534 - DNA, 22 bp, Homo sapiens
ggttcacagtaaggtttgtgct

SEQ ID NO: 7513535 - DNA, 22 bp, Homo sapiens
ggttcacagtaaggtttgtgct

SEQ ID NO: 7513536 - DNA, 22 bp, Homo sapiens
ggttcacatattgagagtattc

SEQ ID NO: 7513537 - DNA, 22 bp, Homo sapiens
ggttcacatattgagagtattc

SEQ ID NO: 7513538 - DNA, 22 bp, Homo sapiens
ggttcacatattgagagtattc

SEQ ID NO: 7513539 - DNA, 22 bp, Homo sapiens
ggtggtctgcgcagcccagggt

SEQ ID NO: 7513540 - DNA, 22 bp, Homo sapiens
ggtggtgaagacaagtggaagt

SEQ ID NO: 7513541 - DNA, 22 bp, Homo sapiens
ggtgggtttggaagagcaggct

SEQ ID NO: 7513542 - DNA, 22 bp, Homo sapiens
ggtggtctgcgcagcccagggt

SEQ ID NO: 7513543 - DNA, 23 bp, Homo sapiens
ggtggtgctcatatctcaggcct

SEQ ID NO: 7513544 - DNA, 23 bp, Homo sapiens
ggtggtgctcatatctcaggcct

SEQ ID NO: 7513545 - DNA, 22 bp, Homo sapiens
ggtggtgactgtcctagggatg

SEQ ID NO: 7513546 - DNA, 22 bp, Homo sapiens
ggtggtgactgtcctagggatg

SEQ ID NO: 7513547 - DNA, 22 bp, Homo sapiens
ggtggtgaagacaagtggaagt

SEQ ID NO: 7513548 - DNA, 22 bp, Homo sapiens
ggtggtggagccagctgggagt

SEQ ID NO: 7513549 - DNA, 22 bp, Homo sapiens
ggtggtggagccagctgggagt

SEQ ID NO: 7513550 - DNA, 22 bp, Homo sapiens
ggtggtggagccagctgggagt

SEQ ID NO: 7513551 - DNA, 22 bp, Homo sapiens
ggtggtggagccagctgggagt

SEQ ID NO: 7513552 - DNA, 22 bp, Homo sapiens
ggtggtggagccagctgggagt

SEQ ID NO: 7513553 - DNA, 22 bp, Homo sapiens
ggtggtggagccagctgggagt

SEQ ID NO: 7513554 - DNA, 22 bp, Homo sapiens
ggtggtggagccagctgggagt

SEQ ID NO: 7513555 - DNA, 22 bp, Homo sapiens
ggtggtggagccagctgggagt

SEQ ID NO: 7513556 - DNA, 22 bp, Homo sapiens
ggtggtggagccagctgggagt

SEQ ID NO: 7513557 - DNA, 22 bp, Homo sapiens
ggtggtggagccagctgggagt

SEQ ID NO: 7513558 - DNA, 22 bp, Homo sapiens
ggtggtggagccagctgggagt

SEQ ID NO: 7513559 - DNA, 22 bp, Homo sapiens
ggttaaggaataggccatttag

SEQ ID NO: 7513560 - DNA, 19 bp, Homo sapiens
ggttaatgttaggatactt

SEQ ID NO: 7513561 - DNA, 22 bp, Homo sapiens
ggttaaggctttacagtcaaac

SEQ ID NO: 7513562 - DNA, 22 bp, Homo sapiens
ggttacaaggatattcaggtaa

SEQ ID NO: 7513563 - DNA, 21 bp, Homo sapiens
ggttacaacagttaaacagag

SEQ ID NO: 7513564 - DNA, 19 bp, Homo sapiens
ggttaatgttaggatactt

SEQ ID NO: 7513565 - DNA, 19 bp, Homo sapiens
ggttaatgttaggatactt

SEQ ID NO: 7513566 - DNA, 22 bp, Homo sapiens
ggttaaaatctaaaatgtgact

SEQ ID NO: 7513567 - DNA, 22 bp, Homo sapiens
ggttaaaatctaaaatgtgact

SEQ ID NO: 7513568 - DNA, 21 bp, Homo sapiens
ggttaaaagacacatctgttt

SEQ ID NO: 7513569 - DNA, 22 bp, Homo sapiens
ggttaaaactgatattatgggt

SEQ ID NO: 7513570 - DNA, 21 bp, Homo sapiens
ggttaaaagacacatctgttt

SEQ ID NO: 7513571 - DNA, 19 bp, Homo sapiens
ggtgtttcttcattttcca

SEQ ID NO: 7513572 - DNA, 22 bp, Homo sapiens
ggtgtttgcatggggccagttt

SEQ ID NO: 7513573 - DNA, 22 bp, Homo sapiens
ggttaaaaataatttacttggc

SEQ ID NO: 7513574 - DNA, 22 bp, Homo sapiens
ggttaaaaataatttacttggc

SEQ ID NO: 7513575 - DNA, 22 bp, Homo sapiens
ggttaaaaataatttacttggc

SEQ ID NO: 7513576 - DNA, 22 bp, Homo sapiens
ggtggtgggagagctttctgga

SEQ ID NO: 7513577 - DNA, 22 bp, Homo sapiens
ggtggtgggagagctttctgga

SEQ ID NO: 7513578 - DNA, 22 bp, Homo sapiens
gggtgcagcagagctcctctgt

SEQ ID NO: 7513579 - DNA, 22 bp, Homo sapiens
gggtgcagcagagctcctctgt

SEQ ID NO: 7513580 - DNA, 22 bp, Homo sapiens
gggtgcagcagagctcctctgt

SEQ ID NO: 7513581 - DNA, 22 bp, Homo sapiens
gggtgcagcagagctcctctgt

SEQ ID NO: 7513582 - DNA, 22 bp, Homo sapiens
gggtgcagctttgaaagcatgt

SEQ ID NO: 7513583 - DNA, 22 bp, Homo sapiens
gggtgcagctttgaaagcatgt

SEQ ID NO: 7513584 - DNA, 18 bp, Homo sapiens
gggtgcaggcactgactg

SEQ ID NO: 7513585 - DNA, 18 bp, Homo sapiens
gggtgcaggcactgactg

SEQ ID NO: 7513586 - DNA, 18 bp, Homo sapiens
gggtgcaggcactgactg

SEQ ID NO: 7513587 - DNA, 18 bp, Homo sapiens
gggtgcaggcactgactg

SEQ ID NO: 7513588 - DNA, 22 bp, Homo sapiens
gggtgcagctttgaaagcatgt

SEQ ID NO: 7513589 - DNA, 18 bp, Homo sapiens
gggtgcaggcactgactg

SEQ ID NO: 7513590 - DNA, 22 bp, Homo sapiens
gggtgcaggcagcccaggcagg

SEQ ID NO: 7513591 - DNA, 22 bp, Homo sapiens
gggtgcaggcagcccaggcagg

SEQ ID NO: 7513592 - DNA, 22 bp, Homo sapiens
gggtgcaggcagcccaggcagg

SEQ ID NO: 7513593 - DNA, 22 bp, Homo sapiens
gggtgcaggcagcccaggcagg

SEQ ID NO: 7513594 - DNA, 22 bp, Homo sapiens
gggtgcaggcagcccaggcagg

SEQ ID NO: 7513595 - DNA, 22 bp, Homo sapiens
gggtgcaggcagcccaggcagg

SEQ ID NO: 7513596 - DNA, 22 bp, Homo sapiens
gggtgcaggcagcccaggcagg

SEQ ID NO: 7513597 - DNA, 18 bp, Homo sapiens
gggtgcaggcactgactg

SEQ ID NO: 7513598 - DNA, 18 bp, Homo sapiens
gggtgcaggcactgactg

SEQ ID NO: 7513599 - DNA, 22 bp, Homo sapiens
gggtgctttggctcacgcctgt

SEQ ID NO: 7513600 - DNA, 22 bp, Homo sapiens
gggtggaagccagagaggtcat

SEQ ID NO: 7513601 - DNA, 22 bp, Homo sapiens
gggtggaagccagagaggtcat

SEQ ID NO: 7513602 - DNA, 21 bp, Homo sapiens
gggtgctgtggtcatgcagga

SEQ ID NO: 7513603 - DNA, 21 bp, Homo sapiens
gggtgctgtggtcatgcagga

SEQ ID NO: 7513604 - DNA, 21 bp, Homo sapiens
gggtgctgtggtcatgcagga

SEQ ID NO: 7513605 - DNA, 22 bp, Homo sapiens
gggtgctgggaggctgacatct

SEQ ID NO: 7513606 - DNA, 22 bp, Homo sapiens
gggtgctgggaggctgacatct

SEQ ID NO: 7513607 - DNA, 18 bp, Homo sapiens
gggtgctggggccccttg

SEQ ID NO: 7513608 - DNA, 18 bp, Homo sapiens
gggtgctggggccccttg

SEQ ID NO: 7513609 - DNA, 22 bp, Homo sapiens
gggtgctgggaggctgacatct

SEQ ID NO: 7513610 - DNA, 22 bp, Homo sapiens
gggtgcaggcagcccaggcagg

SEQ ID NO: 7513611 - DNA, 22 bp, Homo sapiens
gggtgcaggcagcccaggcagg

SEQ ID NO: 7513612 - DNA, 22 bp, Homo sapiens
gggtgcaggcagcccaggcagg

SEQ ID NO: 7513613 - DNA, 22 bp, Homo sapiens
gggtgaggcccatttgaggcca

SEQ ID NO: 7513614 - DNA, 22 bp, Homo sapiens
gggtgaggcccatttgaggcca

SEQ ID NO: 7513615 - DNA, 22 bp, Homo sapiens
gggtgaggcccatttgaggcca

SEQ ID NO: 7513616 - DNA, 22 bp, Homo sapiens
gggtgaggcccatttgaggcca

SEQ ID NO: 7513617 - DNA, 22 bp, Homo sapiens
gggtgaggcccatttgaggcca

SEQ ID NO: 7513618 - DNA, 22 bp, Homo sapiens
gggtgaggcccatttgaggcca

SEQ ID NO: 7513619 - DNA, 22 bp, Homo sapiens
gggtgaggcccatttgaggcca

SEQ ID NO: 7513620 - DNA, 22 bp, Homo sapiens
gggtgaggccttgctgccatca

SEQ ID NO: 7513621 - DNA, 22 bp, Homo sapiens
gggtgaggccttgctgccatca

SEQ ID NO: 7513622 - DNA, 22 bp, Homo sapiens
gggtgaggccttgctgccatca

SEQ ID NO: 7513623 - DNA, 22 bp, Homo sapiens
gggtgaggagctgccagtcatg

SEQ ID NO: 7513624 - DNA, 22 bp, Homo sapiens
gggtgaggagctgccagtcatg

SEQ ID NO: 7513625 - DNA, 22 bp, Homo sapiens
gggtgaggagctgccagtcatg

SEQ ID NO: 7513626 - DNA, 20 bp, Homo sapiens
gggtgaggatggagaatttg

SEQ ID NO: 7513627 - DNA, 20 bp, Homo sapiens
gggtgaggatggagaatttg

SEQ ID NO: 7513628 - DNA, 20 bp, Homo sapiens
gggtgaggatggagaatttg

SEQ ID NO: 7513629 - DNA, 20 bp, Homo sapiens
gggtgaggatggagaatttg

SEQ ID NO: 7513630 - DNA, 20 bp, Homo sapiens
gggtgaggatggagaatttg

SEQ ID NO: 7513631 - DNA, 20 bp, Homo sapiens
gggtgaggatggagaatttg

SEQ ID NO: 7513632 - DNA, 22 bp, Homo sapiens
gggtgagggatgagccttcttc

SEQ ID NO: 7513633 - DNA, 22 bp, Homo sapiens
gggtgagggatgagccttcttc

SEQ ID NO: 7513634 - DNA, 22 bp, Homo sapiens
gggtgagggatgagccttcttc

SEQ ID NO: 7513635 - DNA, 22 bp, Homo sapiens
gggtgagggatgagccttcttc

SEQ ID NO: 7513636 - DNA, 22 bp, Homo sapiens
gggtgagggatgagccttcttc

SEQ ID NO: 7513637 - DNA, 22 bp, Homo sapiens
gggtgagggatgagccttcttc

SEQ ID NO: 7513638 - DNA, 22 bp, Homo sapiens
gggtgagggatgagccttcttc

SEQ ID NO: 7513639 - DNA, 22 bp, Homo sapiens
gggtgaggccttgctgccatca

SEQ ID NO: 7513640 - DNA, 22 bp, Homo sapiens
gggtgagggatgagccttcttc

SEQ ID NO: 7513641 - DNA, 22 bp, Homo sapiens
gggtgaggccttgctgccatca

SEQ ID NO: 7513642 - DNA, 22 bp, Homo sapiens
gggtgaggccttgctgccatca

SEQ ID NO: 7513643 - DNA, 22 bp, Homo sapiens
gggtgaggccttgctgccatca

SEQ ID NO: 7513644 - DNA, 22 bp, Homo sapiens
gggtgaggccttgctgccatca

SEQ ID NO: 7513645 - DNA, 22 bp, Homo sapiens
gggtgcagcagagctcctctgt

SEQ ID NO: 7513646 - DNA, 22 bp, Homo sapiens
gggtgcagcagagctcctctgt

SEQ ID NO: 7513647 - DNA, 22 bp, Homo sapiens
gggtgcagagcttaactgtagg

SEQ ID NO: 7513648 - DNA, 22 bp, Homo sapiens
gggtgcagcagagctcctctgt

SEQ ID NO: 7513649 - DNA, 22 bp, Homo sapiens
gggtgcagcagagctcctctgt

SEQ ID NO: 7513650 - DNA, 22 bp, Homo sapiens
gggtgcagcagagctcctctgt

SEQ ID NO: 7513651 - DNA, 22 bp, Homo sapiens
gggtgatttgcaaaataagtgt

SEQ ID NO: 7513652 - DNA, 22 bp, Homo sapiens
gggtgcaaacccgttctgcacc

SEQ ID NO: 7513653 - DNA, 22 bp, Homo sapiens
gggtgcaactaagaagaggtga

SEQ ID NO: 7513654 - DNA, 22 bp, Homo sapiens
gggtgcaactaagaagaggtga

SEQ ID NO: 7513655 - DNA, 21 bp, Homo sapiens
gggtgcaagttctctgtcttt

SEQ ID NO: 7513656 - DNA, 22 bp, Homo sapiens
gggtgcaagccaaagaagactg

SEQ ID NO: 7513657 - DNA, 22 bp, Homo sapiens
gggtgcaagcaagtggcacaga

SEQ ID NO: 7513658 - DNA, 22 bp, Homo sapiens
gggtgcaagcaagtggcacaga

SEQ ID NO: 7513659 - DNA, 22 bp, Homo sapiens
gggtggagagaaagaaacgtga

SEQ ID NO: 7513660 - DNA, 22 bp, Homo sapiens
gggtggagagaaagaaacgtga

SEQ ID NO: 7513661 - DNA, 22 bp, Homo sapiens
gggtggaattgttggcatcgga

SEQ ID NO: 7513662 - DNA, 22 bp, Homo sapiens
gggtggaattgttggcatcgga

SEQ ID NO: 7513663 - DNA, 22 bp, Homo sapiens
gggtggagaggctaagtccagt

SEQ ID NO: 7513664 - DNA, 22 bp, Homo sapiens
gggtggagaggctaagtccagt

SEQ ID NO: 7513665 - DNA, 22 bp, Homo sapiens
gggtggagaggctaagtccagt

SEQ ID NO: 7513666 - DNA, 22 bp, Homo sapiens
gggtggagaggctaagtccagt

SEQ ID NO: 7513667 - DNA, 22 bp, Homo sapiens
gggtggagaggctaagtccagt

SEQ ID NO: 7513668 - DNA, 22 bp, Homo sapiens
gggtggagaggctaagtccagt

SEQ ID NO: 7513669 - DNA, 22 bp, Homo sapiens
gggtggagccagttgactctgt

SEQ ID NO: 7513670 - DNA, 22 bp, Homo sapiens
gggtggagaggctaagtccagt

SEQ ID NO: 7513671 - DNA, 22 bp, Homo sapiens
gggtggagaggctaagtccagt

SEQ ID NO: 7513672 - DNA, 22 bp, Homo sapiens
gggtggagccagttgactctgt

SEQ ID NO: 7513673 - DNA, 22 bp, Homo sapiens
gggtggagccagttgactctgt

SEQ ID NO: 7513674 - DNA, 22 bp, Homo sapiens
gggtggagccagttgactctgt

SEQ ID NO: 7513675 - DNA, 21 bp, Homo sapiens
gggtgggtggaattaggagtg

SEQ ID NO: 7513676 - DNA, 21 bp, Homo sapiens
gggtgggtggaattaggagtg

SEQ ID NO: 7513677 - DNA, 21 bp, Homo sapiens
gggtgggtggaattaggagtg

SEQ ID NO: 7513678 - DNA, 21 bp, Homo sapiens
gggtggggttccagccttttc

SEQ ID NO: 7513679 - DNA, 21 bp, Homo sapiens
gggtggggttccagccttttc

SEQ ID NO: 7513680 - DNA, 21 bp, Homo sapiens
gggtggggttccagccttttc

SEQ ID NO: 7513681 - DNA, 21 bp, Homo sapiens
gggtggggttccagccttttc

SEQ ID NO: 7513682 - DNA, 21 bp, Homo sapiens
gggtggggttccagccttttc

SEQ ID NO: 7513683 - DNA, 21 bp, Homo sapiens
gggtggggttccagccttttc

SEQ ID NO: 7513684 - DNA, 21 bp, Homo sapiens
gggtggggttccagccttttc

SEQ ID NO: 7513685 - DNA, 21 bp, Homo sapiens
gggtggggttccagccttttc

SEQ ID NO: 7513686 - DNA, 22 bp, Homo sapiens
gggtgggtggtccgcagacata

SEQ ID NO: 7513687 - DNA, 22 bp, Homo sapiens
gggtggtcatctgaaggtctgg

SEQ ID NO: 7513688 - DNA, 22 bp, Homo sapiens
gggtgggtggtccgcagacata

SEQ ID NO: 7513689 - DNA, 22 bp, Homo sapiens
gggtgggtggtccgcagacata

SEQ ID NO: 7513690 - DNA, 22 bp, Homo sapiens
gggtgggtggtccgcagacata

SEQ ID NO: 7513691 - DNA, 22 bp, Homo sapiens
gggtgggtggtccgcagacata

SEQ ID NO: 7513692 - DNA, 22 bp, Homo sapiens
gggtgggtggtccgcagacata

SEQ ID NO: 7513693 - DNA, 22 bp, Homo sapiens
gggtgggtggcagcaccgaggc

SEQ ID NO: 7513694 - DNA, 22 bp, Homo sapiens
gggtgggtggcagcaccgaggc

SEQ ID NO: 7513695 - DNA, 21 bp, Homo sapiens
gggtgggtggaattaggagtg

SEQ ID NO: 7513696 - DNA, 21 bp, Homo sapiens
gggtgggtggaattaggagtg

SEQ ID NO: 7513697 - DNA, 21 bp, Homo sapiens
gggtgggtggaattaggagtg

SEQ ID NO: 7513698 - DNA, 22 bp, Homo sapiens
gggtggtggccagcagtgggca

SEQ ID NO: 7513699 - DNA, 22 bp, Homo sapiens
gggtggtggccagcagtgggca

SEQ ID NO: 7513700 - DNA, 22 bp, Homo sapiens
gggtggtggcggaggctccagg

SEQ ID NO: 7513701 - DNA, 22 bp, Homo sapiens
gggtggtggcggaggctccagg

SEQ ID NO: 7513702 - DNA, 22 bp, Homo sapiens
gggtggtggcggaggctccagg

SEQ ID NO: 7513703 - DNA, 22 bp, Homo sapiens
gggtggtggcggaggctccagg

SEQ ID NO: 7513704 - DNA, 22 bp, Homo sapiens
gggtggtggcggaggctccagg

SEQ ID NO: 7513705 - DNA, 22 bp, Homo sapiens
gggtggtggcggaggctccagg

SEQ ID NO: 7513706 - DNA, 22 bp, Homo sapiens
gggtggtgtattagagctgcag

SEQ ID NO: 7513707 - DNA, 22 bp, Homo sapiens
gggtggtgtattagagctgcag

SEQ ID NO: 7513708 - DNA, 22 bp, Homo sapiens
gggtggtgtattagagctgcag

SEQ ID NO: 7513709 - DNA, 22 bp, Homo sapiens
gggtggtgtattagagctgcag

SEQ ID NO: 7513710 - DNA, 22 bp, Homo sapiens
gggtggtgtattagagctgcag

SEQ ID NO: 7513711 - DNA, 22 bp, Homo sapiens
gggtggtgtattagagctgcag

SEQ ID NO: 7513712 - DNA, 22 bp, Homo sapiens
gggtggtgggcacagaatctgg

SEQ ID NO: 7513713 - DNA, 22 bp, Homo sapiens
gggtggtgggcacagaatctgg

SEQ ID NO: 7513714 - DNA, 22 bp, Homo sapiens
gggtggtgggcacagaatctgg

SEQ ID NO: 7513715 - DNA, 22 bp, Homo sapiens
gggtggtgtattagagctgcag

SEQ ID NO: 7513716 - DNA, 22 bp, Homo sapiens
gggtggtgtattagagctgcag

SEQ ID NO: 7513717 - DNA, 22 bp, Homo sapiens
gggtggtgtattagagctgcag

SEQ ID NO: 7513718 - DNA, 22 bp, Homo sapiens
gggtggtgtattagagctgcag

SEQ ID NO: 7513719 - DNA, 22 bp, Homo sapiens
gggtggtctggcaggctggaaa

SEQ ID NO: 7513720 - DNA, 22 bp, Homo sapiens
gggtggtctggcaggctggaaa

SEQ ID NO: 7513721 - DNA, 22 bp, Homo sapiens
gggtggtctggcaggctggaaa

SEQ ID NO: 7513722 - DNA, 22 bp, Homo sapiens
gggtggtgagatgtagctgatg

SEQ ID NO: 7513723 - DNA, 21 bp, Homo sapiens
gggtggtctagctcaggaact

SEQ ID NO: 7513724 - DNA, 21 bp, Homo sapiens
gggtggtctgctgaagaggga

SEQ ID NO: 7513725 - DNA, 22 bp, Homo sapiens
gggtggtctggcaggctggaaa

SEQ ID NO: 7513726 - DNA, 21 bp, Homo sapiens
gggtggtctgctgaagaggga

SEQ ID NO: 7513727 - DNA, 22 bp, Homo sapiens
gggtggtggccagcagtgggca

SEQ ID NO: 7513728 - DNA, 22 bp, Homo sapiens
gggtggtggccagcagtgggca

SEQ ID NO: 7513729 - DNA, 22 bp, Homo sapiens
gggtggtggccagcagtgggca

SEQ ID NO: 7513730 - DNA, 22 bp, Homo sapiens
gggtggtggccagcagtgggca

SEQ ID NO: 7513731 - DNA, 22 bp, Homo sapiens
gggtggtggccagcagtgggca

SEQ ID NO: 7513732 - DNA, 22 bp, Homo sapiens
gggtggtgagatgtagctgatg

SEQ ID NO: 7513733 - DNA, 16 bp, Homo sapiens
gggtggtcttggagac

SEQ ID NO: 7513734 - DNA, 22 bp, Homo sapiens
gggtggtgagatgtagctgatg

SEQ ID NO: 7513735 - DNA, 22 bp, Homo sapiens
gggtggtgagatgtagctgatg

SEQ ID NO: 7513736 - DNA, 22 bp, Homo sapiens
ggggccagcaatgttgaggaat

SEQ ID NO: 7513737 - DNA, 22 bp, Homo sapiens
ggggccagcaatgttgaggaat

SEQ ID NO: 7513738 - DNA, 22 bp, Homo sapiens
ggggccagcaatgttgaggaat

SEQ ID NO: 7513739 - DNA, 22 bp, Homo sapiens
ggggccagcaatgttgaggaat

SEQ ID NO: 7513740 - DNA, 22 bp, Homo sapiens
ggggccagatatcactaaggtt

SEQ ID NO: 7513741 - DNA, 22 bp, Homo sapiens
ggggccagatatcactaaggtt

SEQ ID NO: 7513742 - DNA, 22 bp, Homo sapiens
ggggccagatatcactaaggtt

SEQ ID NO: 7513743 - DNA, 22 bp, Homo sapiens
ggggccagcttcgcgtgctctt

SEQ ID NO: 7513744 - DNA, 22 bp, Homo sapiens
ggggccagcactgtgcctttgt

SEQ ID NO: 7513745 - DNA, 22 bp, Homo sapiens
ggggccagcactgtgcctttgt

SEQ ID NO: 7513746 - DNA, 22 bp, Homo sapiens
ggggccagcaatgttgaggaat

SEQ ID NO: 7513747 - DNA, 22 bp, Homo sapiens
ggggccagcaatgttgaggaat

SEQ ID NO: 7513748 - DNA, 22 bp, Homo sapiens
ggggccagcactgtgcctttgt

SEQ ID NO: 7513749 - DNA, 22 bp, Homo sapiens
ggggccagcttcgcgtgctctt

SEQ ID NO: 7513750 - DNA, 22 bp, Homo sapiens
ggggccagcttcgcgtgctctt

SEQ ID NO: 7513751 - DNA, 22 bp, Homo sapiens
ggggccagcttcgcgtgctctt

SEQ ID NO: 7513752 - DNA, 22 bp, Homo sapiens
ggggccagtaggagtgatgtac

SEQ ID NO: 7513753 - DNA, 22 bp, Homo sapiens
ggggccagtaggagtgatgtac

SEQ ID NO: 7513754 - DNA, 20 bp, Homo sapiens
ggggcccaagccctcttgcc

SEQ ID NO: 7513755 - DNA, 22 bp, Homo sapiens
ggggcccagcacccctcctcgc

SEQ ID NO: 7513756 - DNA, 22 bp, Homo sapiens
ggggccagtaggagtgatgtac

SEQ ID NO: 7513757 - DNA, 22 bp, Homo sapiens
ggggccagtaggagtgatgtac

SEQ ID NO: 7513758 - DNA, 22 bp, Homo sapiens
ggggccagtaggagtgatgtac

SEQ ID NO: 7513759 - DNA, 22 bp, Homo sapiens
ggggccagtaggagtgatgtac

SEQ ID NO: 7513760 - DNA, 22 bp, Homo sapiens
ggggccagtaggagtgatgtac

SEQ ID NO: 7513761 - DNA, 22 bp, Homo sapiens
ggggccagtaggagtgatgtac

SEQ ID NO: 7513762 - DNA, 22 bp, Homo sapiens
ggggccaggtccagcttccaaa

SEQ ID NO: 7513763 - DNA, 22 bp, Homo sapiens
ggggccaggtccagcttccaaa

SEQ ID NO: 7513764 - DNA, 22 bp, Homo sapiens
ggggccaggtccagcttccaaa

SEQ ID NO: 7513765 - DNA, 22 bp, Homo sapiens
ggggccaggtccagcttccaaa

SEQ ID NO: 7513766 - DNA, 22 bp, Homo sapiens
ggggccagtaggagtgatgtac

SEQ ID NO: 7513767 - DNA, 22 bp, Homo sapiens
ggggccaggtccagcttccaaa

SEQ ID NO: 7513768 - DNA, 22 bp, Homo sapiens
ggggccaggtccagcttccaaa

SEQ ID NO: 7513769 - DNA, 22 bp, Homo sapiens
ggggccaggtccagcttccaaa

SEQ ID NO: 7513770 - DNA, 22 bp, Homo sapiens
ggggccaggtccagcttccaaa

SEQ ID NO: 7513771 - DNA, 22 bp, Homo sapiens
ggggcccagggcagcagtgcag

SEQ ID NO: 7513772 - DNA, 22 bp, Homo sapiens
ggggcccagcacccctcctcgc

SEQ ID NO: 7513773 - DNA, 22 bp, Homo sapiens
ggggcccagcacccctcctcgc

SEQ ID NO: 7513774 - DNA, 20 bp, Homo sapiens
ggggcccaagccctcttgcc

SEQ ID NO: 7513775 - DNA, 22 bp, Homo sapiens
ggggcccagcacccctcctcgc

SEQ ID NO: 7513776 - DNA, 22 bp, Homo sapiens
ggggcccctcggacacgtgcgg

SEQ ID NO: 7513777 - DNA, 22 bp, Homo sapiens
ggggcccctcggacacgtgcgg

SEQ ID NO: 7513778 - DNA, 22 bp, Homo sapiens
ggggcccagggcagcagtgcag

SEQ ID NO: 7513779 - DNA, 22 bp, Homo sapiens
ggggcccagggcagcagtgcag

SEQ ID NO: 7513780 - DNA, 22 bp, Homo sapiens
ggggcccagggcagcagtgcag

SEQ ID NO: 7513781 - DNA, 22 bp, Homo sapiens
ggggcccagggcagcagtgcag

SEQ ID NO: 7513782 - DNA, 22 bp, Homo sapiens
ggggcccttgtggctgcaggcc

SEQ ID NO: 7513783 - DNA, 22 bp, Homo sapiens
ggggcccttgtggctgcaggcc

SEQ ID NO: 7513784 - DNA, 22 bp, Homo sapiens
ggggcccttgtggctgcaggcc

SEQ ID NO: 7513785 - DNA, 22 bp, Homo sapiens
ggggcccagggcagcagtgcag

SEQ ID NO: 7513786 - DNA, 22 bp, Homo sapiens
ggggcccctcggacacgtgcgg

SEQ ID NO: 7513787 - DNA, 22 bp, Homo sapiens
ggggcccctcggacacgtgcgg

SEQ ID NO: 7513788 - DNA, 22 bp, Homo sapiens
ggggcccgggcactggccgtca

SEQ ID NO: 7513789 - DNA, 22 bp, Homo sapiens
ggggcccctgtggcttgatgcc

SEQ ID NO: 7513790 - DNA, 22 bp, Homo sapiens
ggggcccctgtggcttgatgcc

SEQ ID NO: 7513791 - DNA, 22 bp, Homo sapiens
ggggcccctgtggcttgatgcc

SEQ ID NO: 7513792 - DNA, 22 bp, Homo sapiens
ggggcccctgtggcttgatgcc

SEQ ID NO: 7513793 - DNA, 22 bp, Homo sapiens
ggggcccctgtggcttgatgcc

SEQ ID NO: 7513794 - DNA, 22 bp, Homo sapiens
ggggtgagttagcgtcggcttg

SEQ ID NO: 7513795 - DNA, 22 bp, Homo sapiens
ggggtgagttagcgtcggcttg

SEQ ID NO: 7513796 - DNA, 22 bp, Homo sapiens
ggggtgagttagcgtcggcttg

SEQ ID NO: 7513797 - DNA, 22 bp, Homo sapiens
ggggtgagttagcgtcggcttg

SEQ ID NO: 7513798 - DNA, 22 bp, Homo sapiens
ggggtgagtgctcagccccgga

SEQ ID NO: 7513799 - DNA, 22 bp, Homo sapiens
ggggtagggtgattgtgaagta

SEQ ID NO: 7513800 - DNA, 22 bp, Homo sapiens
ggggtagggcgattgctgcttt

SEQ ID NO: 7513801 - DNA, 22 bp, Homo sapiens
ggggtgagtgctcagccccgga

SEQ ID NO: 7513802 - DNA, 22 bp, Homo sapiens
ggggtagggtgattgtgaagta

SEQ ID NO: 7513803 - DNA, 22 bp, Homo sapiens
ggggcccttgtggctgcaggcc

SEQ ID NO: 7513804 - DNA, 22 bp, Homo sapiens
ggggtaggcaggtgatctgatc

SEQ ID NO: 7513805 - DNA, 22 bp, Homo sapiens
ggggtagggcgattgctgcttt

SEQ ID NO: 7513806 - DNA, 22 bp, Homo sapiens
ggggtagggcgattgctgcttt

SEQ ID NO: 7513807 - DNA, 22 bp, Homo sapiens
ggggtagggcgattgctgcttt

SEQ ID NO: 7513808 - DNA, 22 bp, Homo sapiens
ggggtgggagtgccatccttga

SEQ ID NO: 7513809 - DNA, 22 bp, Homo sapiens
ggggtgggagtgccatccttga

SEQ ID NO: 7513810 - DNA, 22 bp, Homo sapiens
ggggtgggagtgccatccttga

SEQ ID NO: 7513811 - DNA, 22 bp, Homo sapiens
ggggtgggagtgccatccttga

SEQ ID NO: 7513812 - DNA, 22 bp, Homo sapiens
ggggtgggagtgccatccttga

SEQ ID NO: 7513813 - DNA, 22 bp, Homo sapiens
ggggtgggagtgccatccttga

SEQ ID NO: 7513814 - DNA, 22 bp, Homo sapiens
ggggtgggagtgccatccttga

SEQ ID NO: 7513815 - DNA, 22 bp, Homo sapiens
ggggtgggagtgccatccttga

SEQ ID NO: 7513816 - DNA, 22 bp, Homo sapiens
ggggtgggagtgccatccttga

SEQ ID NO: 7513817 - DNA, 19 bp, Homo sapiens
ggggtggctggggctccag

SEQ ID NO: 7513818 - DNA, 19 bp, Homo sapiens
ggggtggctggggctccag

SEQ ID NO: 7513819 - DNA, 19 bp, Homo sapiens
ggggtggctggggctccag

SEQ ID NO: 7513820 - DNA, 22 bp, Homo sapiens
ggggtgggagtgccatccttga

SEQ ID NO: 7513821 - DNA, 22 bp, Homo sapiens
ggggtgggcgtgcagggacacc

SEQ ID NO: 7513822 - DNA, 22 bp, Homo sapiens
ggggtgggagtgccatccttga

SEQ ID NO: 7513823 - DNA, 22 bp, Homo sapiens
ggggtgggagtgccatccttga

SEQ ID NO: 7513824 - DNA, 22 bp, Homo sapiens
ggggtgggagtgccatccttga

SEQ ID NO: 7513825 - DNA, 22 bp, Homo sapiens
ggggtgggagtgccatccttga

SEQ ID NO: 7513826 - DNA, 22 bp, Homo sapiens
ggggtgggagtgccatccttga

SEQ ID NO: 7513827 - DNA, 22 bp, Homo sapiens
ggggtgggagtgccatccttga

SEQ ID NO: 7513828 - DNA, 22 bp, Homo sapiens
ggggtggcctgtaggcagcatg

SEQ ID NO: 7513829 - DNA, 22 bp, Homo sapiens
ggggtggcctgtaggcagcatg

SEQ ID NO: 7513830 - DNA, 22 bp, Homo sapiens
ggggtggcctgtaggcagcatg

SEQ ID NO: 7513831 - DNA, 22 bp, Homo sapiens
ggggtggcctgtaggcagcatg

SEQ ID NO: 7513832 - DNA, 22 bp, Homo sapiens
ggggtggcctgtaggcagcatg

SEQ ID NO: 7513833 - DNA, 22 bp, Homo sapiens
ggggtggcctgtaggcagcatg

SEQ ID NO: 7513834 - DNA, 22 bp, Homo sapiens
ggggtggcctgtaggcagcatg

SEQ ID NO: 7513835 - DNA, 22 bp, Homo sapiens
ggggtggcctgtaggcagcatg

SEQ ID NO: 7513836 - DNA, 22 bp, Homo sapiens
ggggtggccctaccctctggaa

SEQ ID NO: 7513837 - DNA, 22 bp, Homo sapiens
ggggtggccctaccctctggaa

SEQ ID NO: 7513838 - DNA, 22 bp, Homo sapiens
ggggtggccctaccctctggaa

SEQ ID NO: 7513839 - DNA, 22 bp, Homo sapiens
ggggtggccctaccctctggaa

SEQ ID NO: 7513840 - DNA, 19 bp, Homo sapiens
ggggtggctggggctccag

SEQ ID NO: 7513841 - DNA, 22 bp, Homo sapiens
ggggtggctggcacctcctggt

SEQ ID NO: 7513842 - DNA, 22 bp, Homo sapiens
ggggtggctggcacctcctggt

SEQ ID NO: 7513843 - DNA, 22 bp, Homo sapiens
ggggtggctggcacctcctggt

SEQ ID NO: 7513844 - DNA, 22 bp, Homo sapiens
ggggtggctggcacctcctggt

SEQ ID NO: 7513845 - DNA, 19 bp, Homo sapiens
ggggtggctggggctccag

SEQ ID NO: 7513846 - DNA, 19 bp, Homo sapiens
ggggtggctggggctccag

SEQ ID NO: 7513847 - DNA, 19 bp, Homo sapiens
ggggtggctggggctccag

SEQ ID NO: 7513848 - DNA, 19 bp, Homo sapiens
ggggtggctggggctccag

SEQ ID NO: 7513849 - DNA, 19 bp, Homo sapiens
ggggtggctggggctccag

SEQ ID NO: 7513850 - DNA, 19 bp, Homo sapiens
ggggtgctagggagggatc

SEQ ID NO: 7513851 - DNA, 19 bp, Homo sapiens
ggggtgctagggagggatc

SEQ ID NO: 7513852 - DNA, 19 bp, Homo sapiens
ggggtgctagggagggatc

SEQ ID NO: 7513853 - DNA, 22 bp, Homo sapiens
ggggtgctgaagatgtcatggt

SEQ ID NO: 7513854 - DNA, 22 bp, Homo sapiens
ggggtgctgaagatgtcatggt

SEQ ID NO: 7513855 - DNA, 18 bp, Homo sapiens
ggggtgcccagactgtct

SEQ ID NO: 7513856 - DNA, 18 bp, Homo sapiens
ggggtgcccagactgtct

SEQ ID NO: 7513857 - DNA, 22 bp, Homo sapiens
ggggtgcgggccccatctggct

SEQ ID NO: 7513858 - DNA, 22 bp, Homo sapiens
ggggtgctagagtggggccact

SEQ ID NO: 7513859 - DNA, 22 bp, Homo sapiens
ggggtgctagagtggggccact

SEQ ID NO: 7513860 - DNA, 19 bp, Homo sapiens
ggggtgctagggagggatc

SEQ ID NO: 7513861 - DNA, 22 bp, Homo sapiens
ggggtggagatggtggcccttt

SEQ ID NO: 7513862 - DNA, 22 bp, Homo sapiens
ggggtggagatggtggcccttt

SEQ ID NO: 7513863 - DNA, 22 bp, Homo sapiens
ggggtggagctaaatgtctact

SEQ ID NO: 7513864 - DNA, 22 bp, Homo sapiens
ggggtggagctaaatgtctact

SEQ ID NO: 7513865 - DNA, 22 bp, Homo sapiens
ggggtggatcaggcaggcccag

SEQ ID NO: 7513866 - DNA, 22 bp, Homo sapiens
ggggtggagctaaatgtctact

SEQ ID NO: 7513867 - DNA, 22 bp, Homo sapiens
ggggtggattcctacaggtcca

SEQ ID NO: 7513868 - DNA, 22 bp, Homo sapiens
ggggtggattcctacaggtcca

SEQ ID NO: 7513869 - DNA, 22 bp, Homo sapiens
ggggtggatttcaggcggtgtc

SEQ ID NO: 7513870 - DNA, 22 bp, Homo sapiens
ggggtggatcaggcaggcccag

SEQ ID NO: 7513871 - DNA, 22 bp, Homo sapiens
ggggtggattcctacaggtcca

SEQ ID NO: 7513872 - DNA, 22 bp, Homo sapiens
ggggtggattcctacaggtcca

SEQ ID NO: 7513873 - DNA, 22 bp, Homo sapiens
ggggtggattcctacaggtcca

SEQ ID NO: 7513874 - DNA, 22 bp, Homo sapiens
ggggtggccaaggactctgacc

SEQ ID NO: 7513875 - DNA, 22 bp, Homo sapiens
ggggtggccctaccctctggaa

SEQ ID NO: 7513876 - DNA, 22 bp, Homo sapiens
ggggtggatttcaggcggtgtc

SEQ ID NO: 7513877 - DNA, 22 bp, Homo sapiens
ggggtggccaaggactctgacc

SEQ ID NO: 7513878 - DNA, 22 bp, Homo sapiens
ggggtggatttcaggcggtgtc

SEQ ID NO: 7513879 - DNA, 22 bp, Homo sapiens
ggggtggatttcaggcggtgtc

SEQ ID NO: 7513880 - DNA, 22 bp, Homo sapiens
ggggtggatttcaggcggtgtc

SEQ ID NO: 7513881 - DNA, 22 bp, Homo sapiens
ggggccagagaggacccaggtg

SEQ ID NO: 7513882 - DNA, 22 bp, Homo sapiens
ggggccagagaggacccaggtg

SEQ ID NO: 7513883 - DNA, 22 bp, Homo sapiens
ggggccagagaggacccaggtg

SEQ ID NO: 7513884 - DNA, 22 bp, Homo sapiens
ggggccagagaggacccaggtg

SEQ ID NO: 7513885 - DNA, 22 bp, Homo sapiens
ggggccagagaggacccaggtg

SEQ ID NO: 7513886 - DNA, 22 bp, Homo sapiens
ggggccactggcaggaccttgg

SEQ ID NO: 7513887 - DNA, 22 bp, Homo sapiens
ggggccaagggaatgtattgtg

SEQ ID NO: 7513888 - DNA, 22 bp, Homo sapiens
ggggccactggcaggaccttgg

SEQ ID NO: 7513889 - DNA, 22 bp, Homo sapiens
ggggccactggcaggaccttgg

SEQ ID NO: 7513890 - DNA, 22 bp, Homo sapiens
ggggcattgtgtctgggttcct

SEQ ID NO: 7513891 - DNA, 22 bp, Homo sapiens
ggggcattgtgtctgggttcct

SEQ ID NO: 7513892 - DNA, 22 bp, Homo sapiens
ggggccagagaggacccaggtg

SEQ ID NO: 7513893 - DNA, 22 bp, Homo sapiens
ggggccagagaggacccaggtg

SEQ ID NO: 7513894 - DNA, 22 bp, Homo sapiens
ggggccagagaggacccaggtg

SEQ ID NO: 7513895 - DNA, 22 bp, Homo sapiens
ggggccagagaggacccaggtg

SEQ ID NO: 7513896 - DNA, 22 bp, Homo sapiens
ggggccagatatcactaaggtt

SEQ ID NO: 7513897 - DNA, 22 bp, Homo sapiens
ggggccagatatcactaaggtt

SEQ ID NO: 7513898 - DNA, 22 bp, Homo sapiens
ggggccagatatcactaaggtt

SEQ ID NO: 7513899 - DNA, 22 bp, Homo sapiens
ggggccagatatcactaaggtt

SEQ ID NO: 7513900 - DNA, 22 bp, Homo sapiens
ggggccagatatcactaaggtt

SEQ ID NO: 7513901 - DNA, 22 bp, Homo sapiens
ggggccagatatcactaaggtt

SEQ ID NO: 7513902 - DNA, 22 bp, Homo sapiens
ggggccagatatcactaaggtt

SEQ ID NO: 7513903 - DNA, 20 bp, Homo sapiens
ggggcagtggctcatgcctg

SEQ ID NO: 7513904 - DNA, 22 bp, Homo sapiens
ggggcagtgaggtggcagcccg

SEQ ID NO: 7513905 - DNA, 20 bp, Homo sapiens
ggggcaggtttttatggcta

SEQ ID NO: 7513906 - DNA, 22 bp, Homo sapiens
ggggcagtgaggtggcagcccg

SEQ ID NO: 7513907 - DNA, 22 bp, Homo sapiens
ggggcagtttctcgtttgccat

SEQ ID NO: 7513908 - DNA, 22 bp, Homo sapiens
ggggcatcagaaccctgtggga

SEQ ID NO: 7513909 - DNA, 22 bp, Homo sapiens
ggggcatcagaaccctgtggga

SEQ ID NO: 7513910 - DNA, 22 bp, Homo sapiens
ggggcattgtgtctgggttcct

SEQ ID NO: 7513911 - DNA, 22 bp, Homo sapiens
ggggcattgtgtctgggttcct

SEQ ID NO: 7513912 - DNA, 20 bp, Homo sapiens
ggggcagtggctcatgcctg

SEQ ID NO: 7513913 - DNA, 22 bp, Homo sapiens
ggggcagtttctcgtttgccat

SEQ ID NO: 7513914 - DNA, 21 bp, Homo sapiens
ggggcatcaagacagagttag

SEQ ID NO: 7513915 - DNA, 21 bp, Homo sapiens
ggggcatcaagacagagttag

SEQ ID NO: 7513916 - DNA, 20 bp, Homo sapiens
ggggcaggtttttatggcta

SEQ ID NO: 7513917 - DNA, 20 bp, Homo sapiens
ggggcaggtttttatggcta

SEQ ID NO: 7513918 - DNA, 20 bp, Homo sapiens
ggggcaggtttttatggcta

SEQ ID NO: 7513919 - DNA, 20 bp, Homo sapiens
ggggcaggtttttatggcta

SEQ ID NO: 7513920 - DNA, 20 bp, Homo sapiens
ggggcaggtttttatggcta

SEQ ID NO: 7513921 - DNA, 20 bp, Homo sapiens
ggggcaggtttttatggcta

SEQ ID NO: 7513922 - DNA, 20 bp, Homo sapiens
ggggcaggtttttatggcta

SEQ ID NO: 7513923 - DNA, 22 bp, Homo sapiens
ggggcagggaggttatcgccga

SEQ ID NO: 7513924 - DNA, 22 bp, Homo sapiens
ggggcaggaggtgttctctttt

SEQ ID NO: 7513925 - DNA, 22 bp, Homo sapiens
ggggcagggaggttatcgccga

SEQ ID NO: 7513926 - DNA, 22 bp, Homo sapiens
ggggcagggaggttatcgccga

SEQ ID NO: 7513927 - DNA, 22 bp, Homo sapiens
ggggcagggaggttatcgccga

SEQ ID NO: 7513928 - DNA, 22 bp, Homo sapiens
ggggcagggaggttatcgccga

SEQ ID NO: 7513929 - DNA, 22 bp, Homo sapiens
ggggcagggaggttatcgccga

SEQ ID NO: 7513930 - DNA, 22 bp, Homo sapiens
ggggcagggaggttatcgccga

SEQ ID NO: 7513931 - DNA, 22 bp, Homo sapiens
ggggcagggaggttatcgccga

SEQ ID NO: 7513932 - DNA, 22 bp, Homo sapiens
ggggatctaggcttatgagggc

SEQ ID NO: 7513933 - DNA, 22 bp, Homo sapiens
ggggatgagactagagctaaag

SEQ ID NO: 7513934 - DNA, 22 bp, Homo sapiens
ggggagttaaaatgtgctgcaa

SEQ ID NO: 7513935 - DNA, 22 bp, Homo sapiens
ggggatctaggatatttcatga

SEQ ID NO: 7513936 - DNA, 21 bp, Homo sapiens
ggggatgcgaccacaggctcc

SEQ ID NO: 7513937 - DNA, 22 bp, Homo sapiens
ggggatgagactagagctaaag

SEQ ID NO: 7513938 - DNA, 21 bp, Homo sapiens
ggggatgcgaccacaggctcc

SEQ ID NO: 7513939 - DNA, 22 bp, Homo sapiens
ggggcaggaggtgttctctttt

SEQ ID NO: 7513940 - DNA, 22 bp, Homo sapiens
ggggagtgttttcatgggcttg

SEQ ID NO: 7513941 - DNA, 22 bp, Homo sapiens
ggggagtgttttcatgggcttg

SEQ ID NO: 7513942 - DNA, 19 bp, Homo sapiens
ggggaggtattgttttcat

SEQ ID NO: 7513943 - DNA, 22 bp, Homo sapiens
ggggagtgttttcatgggcttg

SEQ ID NO: 7513944 - DNA, 22 bp, Homo sapiens
ggggagtggttgcctgtgatcc

SEQ ID NO: 7513945 - DNA, 22 bp, Homo sapiens
ggggagtgttttcatgggcttg

SEQ ID NO: 7513946 - DNA, 22 bp, Homo sapiens
ggggagtgttttcatgggcttg

SEQ ID NO: 7513947 - DNA, 22 bp, Homo sapiens
ggggagtgttttcatgggcttg

SEQ ID NO: 7513948 - DNA, 22 bp, Homo sapiens
ggggagtgacgcagggccatag

SEQ ID NO: 7513949 - DNA, 22 bp, Homo sapiens
ggggagtgacgcagggccatag

SEQ ID NO: 7513950 - DNA, 22 bp, Homo sapiens
ggggagtgacgcagggccatag

SEQ ID NO: 7513951 - DNA, 22 bp, Homo sapiens
ggggagtgacgcagggccatag

SEQ ID NO: 7513952 - DNA, 22 bp, Homo sapiens
ggggagtgacgcagggccatag

SEQ ID NO: 7513953 - DNA, 22 bp, Homo sapiens
ggggaggctgatgtgggcaaag

SEQ ID NO: 7513954 - DNA, 22 bp, Homo sapiens
ggggaggctgatgtgggcaaag

SEQ ID NO: 7513955 - DNA, 19 bp, Homo sapiens
ggggaggtattgttttcat

SEQ ID NO: 7513956 - DNA, 19 bp, Homo sapiens
ggggaggtattgttttcat

SEQ ID NO: 7513957 - DNA, 22 bp, Homo sapiens
ggggaggaagctggaacacggg

SEQ ID NO: 7513958 - DNA, 22 bp, Homo sapiens
ggggaggaagctggaacacggg

SEQ ID NO: 7513959 - DNA, 22 bp, Homo sapiens
ggggaggaagctggaacacggg

SEQ ID NO: 7513960 - DNA, 22 bp, Homo sapiens
ggggaggaagctggaacacggg

SEQ ID NO: 7513961 - DNA, 22 bp, Homo sapiens
ggggaggaagctggaacacggg

SEQ ID NO: 7513962 - DNA, 22 bp, Homo sapiens
ggggaggaagctggaacacggg

SEQ ID NO: 7513963 - DNA, 22 bp, Homo sapiens
ggggaggaagctggaacacggg

SEQ ID NO: 7513964 - DNA, 22 bp, Homo sapiens
ggggaggaagctggaacacggg

SEQ ID NO: 7513965 - DNA, 22 bp, Homo sapiens
ggggaggaagctggaacacggg

SEQ ID NO: 7513966 - DNA, 22 bp, Homo sapiens
ggggaggaagctggaacacggg

SEQ ID NO: 7513967 - DNA, 22 bp, Homo sapiens
ggggaggaagctctcagttcca

SEQ ID NO: 7513968 - DNA, 22 bp, Homo sapiens
ggggaggaagctggaacacggg

SEQ ID NO: 7513969 - DNA, 22 bp, Homo sapiens
ggggaggaagctggaacacggg

SEQ ID NO: 7513970 - DNA, 22 bp, Homo sapiens
ggggaggaagctggaacacggg

SEQ ID NO: 7513971 - DNA, 22 bp, Homo sapiens
ggggaggaagctggaacacggg

SEQ ID NO: 7513972 - DNA, 22 bp, Homo sapiens
ggggaggacctttccaaggctt

SEQ ID NO: 7513973 - DNA, 22 bp, Homo sapiens
ggggaggacctttccaaggctt

SEQ ID NO: 7513974 - DNA, 22 bp, Homo sapiens
ggggaggaagctggaacacggg

SEQ ID NO: 7513975 - DNA, 22 bp, Homo sapiens
ggggaggaagctggaacacggg

SEQ ID NO: 7513976 - DNA, 22 bp, Homo sapiens
ggggaggaagctggaacacggg

SEQ ID NO: 7513977 - DNA, 22 bp, Homo sapiens
ggggaggaagctggaacacggg

SEQ ID NO: 7513978 - DNA, 22 bp, Homo sapiens
ggggaggaagctggaacacggg

SEQ ID NO: 7513979 - DNA, 22 bp, Homo sapiens
ggggaggaagctggaacacggg

SEQ ID NO: 7513980 - DNA, 22 bp, Homo sapiens
gggcttctgtacctacctggaa

SEQ ID NO: 7513981 - DNA, 19 bp, Homo sapiens
ggggagaactagagacagc

SEQ ID NO: 7513982 - DNA, 19 bp, Homo sapiens
ggggagaactagagacagc

SEQ ID NO: 7513983 - DNA, 22 bp, Homo sapiens
gggcttctgttcctttcacttg

SEQ ID NO: 7513984 - DNA, 19 bp, Homo sapiens
ggggagaactagagacagc

SEQ ID NO: 7513985 - DNA, 19 bp, Homo sapiens
ggggagaactagagacagc

SEQ ID NO: 7513986 - DNA, 19 bp, Homo sapiens
ggggagaactagagacagc

SEQ ID NO: 7513987 - DNA, 22 bp, Homo sapiens
ggggagaattacatggcgtgga

SEQ ID NO: 7513988 - DNA, 22 bp, Homo sapiens
ggggagaataaatcagatttta

SEQ ID NO: 7513989 - DNA, 22 bp, Homo sapiens
ggggagaataaatcagatttta

SEQ ID NO: 7513990 - DNA, 22 bp, Homo sapiens
ggggagaattaccaaaagcgct

SEQ ID NO: 7513991 - DNA, 22 bp, Homo sapiens
ggggagaattacatggcgtgga

SEQ ID NO: 7513992 - DNA, 22 bp, Homo sapiens
ggggagaattaccaaaagcgct

SEQ ID NO: 7513993 - DNA, 22 bp, Homo sapiens
ggggagaccatctgaaggtgat

SEQ ID NO: 7513994 - DNA, 22 bp, Homo sapiens
ggggagaattaccaaaagcgct

SEQ ID NO: 7513995 - DNA, 22 bp, Homo sapiens
ggggaggagccatgtaactagt

SEQ ID NO: 7513996 - DNA, 22 bp, Homo sapiens
ggggaggagccatgtaactagt

SEQ ID NO: 7513997 - DNA, 22 bp, Homo sapiens
ggggaggagccatgtaactagt

SEQ ID NO: 7513998 - DNA, 22 bp, Homo sapiens
ggggaggagccatgtaactagt

SEQ ID NO: 7513999 - DNA, 22 bp, Homo sapiens
ggggaggagccatgtaactagt

SEQ ID NO: 7514000 - DNA, 22 bp, Homo sapiens
ggggaggagtgtacaggtttat

SEQ ID NO: 7514001 - DNA, 22 bp, Homo sapiens
ggggaggcaagatgaagtgagg

SEQ ID NO: 7514002 - DNA, 22 bp, Homo sapiens
ggggaggcaagatgaagtgagg

SEQ ID NO: 7514003 - DNA, 22 bp, Homo sapiens
ggggaggcaagatgaagtgagg

SEQ ID NO: 7514004 - DNA, 22 bp, Homo sapiens
ggggaggcaagatgaagtgagg

SEQ ID NO: 7514005 - DNA, 22 bp, Homo sapiens
ggggaggagtgtacaggtttat

SEQ ID NO: 7514006 - DNA, 22 bp, Homo sapiens
ggggaggagtgtacaggtttat

SEQ ID NO: 7514007 - DNA, 22 bp, Homo sapiens
ggggaggagtgtacaggtttat

SEQ ID NO: 7514008 - DNA, 22 bp, Homo sapiens
ggggaggagtgtacaggtttat

SEQ ID NO: 7514009 - DNA, 22 bp, Homo sapiens
ggggaggagtgtacaggtttat

SEQ ID NO: 7514010 - DNA, 22 bp, Homo sapiens
ggggaggacctttccaaggctt

SEQ ID NO: 7514011 - DNA, 22 bp, Homo sapiens
ggggaggacctttccaaggctt

SEQ ID NO: 7514012 - DNA, 22 bp, Homo sapiens
ggggaggacctttccaaggctt

SEQ ID NO: 7514013 - DNA, 22 bp, Homo sapiens
ggggaggacctttccaaggctt

SEQ ID NO: 7514014 - DNA, 22 bp, Homo sapiens
ggggaggacctttccaaggctt

SEQ ID NO: 7514015 - DNA, 22 bp, Homo sapiens
ggggaggacctttccaaggctt

SEQ ID NO: 7514016 - DNA, 22 bp, Homo sapiens
ggggaggacctttccaaggctt

SEQ ID NO: 7514017 - DNA, 22 bp, Homo sapiens
ggggaggacctttccaaggctt

SEQ ID NO: 7514018 - DNA, 22 bp, Homo sapiens
ggggaggagccatgtaactagt

SEQ ID NO: 7514019 - DNA, 22 bp, Homo sapiens
ggggaggctgatgtgggcaaag

SEQ ID NO: 7514020 - DNA, 22 bp, Homo sapiens
ggggaggctgatgtgggcaaag

SEQ ID NO: 7514021 - DNA, 22 bp, Homo sapiens
ggggaggctgatgtgggcaaag

SEQ ID NO: 7514022 - DNA, 22 bp, Homo sapiens
ggggaggctgatgtgggcaaag

SEQ ID NO: 7514023 - DNA, 22 bp, Homo sapiens
ggggaggctgatgtgggcaaag

SEQ ID NO: 7514024 - DNA, 22 bp, Homo sapiens
ggggaggccagtggaccgtccc

SEQ ID NO: 7514025 - DNA, 22 bp, Homo sapiens
ggggaggccagtggaccgtccc

SEQ ID NO: 7514026 - DNA, 22 bp, Homo sapiens
ggggaggctgatgtgggcaaag

SEQ ID NO: 7514027 - DNA, 22 bp, Homo sapiens
ggggaggctgatgtgggcaaag

SEQ ID NO: 7514028 - DNA, 22 bp, Homo sapiens
ggggaggctgatgtgggcaaag

SEQ ID NO: 7514029 - DNA, 22 bp, Homo sapiens
ggggaggctgatgtgggcaaag

SEQ ID NO: 7514030 - DNA, 22 bp, Homo sapiens
ggggaggcaagatgaagtgagg

SEQ ID NO: 7514031 - DNA, 22 bp, Homo sapiens
ggggaggccagtggaccgtccc

SEQ ID NO: 7514032 - DNA, 22 bp, Homo sapiens
ggggaggccagtggaccgtccc

SEQ ID NO: 7514033 - DNA, 22 bp, Homo sapiens
ggggaggccagtggaccgtccc

SEQ ID NO: 7514034 - DNA, 22 bp, Homo sapiens
ggggaggccagtggaccgtccc

SEQ ID NO: 7514035 - DNA, 22 bp, Homo sapiens
ggggaggccagtggaccgtccc

SEQ ID NO: 7514036 - DNA, 22 bp, Homo sapiens
ggggaggcaagatgaagtgagg

SEQ ID NO: 7514037 - DNA, 22 bp, Homo sapiens
ggggaggcaagatgaagtgagg

SEQ ID NO: 7514038 - DNA, 22 bp, Homo sapiens
ggggaggcaagatgaagtgagg

SEQ ID NO: 7514039 - DNA, 22 bp, Homo sapiens
ggggaggcaagatgaagtgagg

SEQ ID NO: 7514040 - DNA, 22 bp, Homo sapiens
gggctgtttgcatatgtttata

SEQ ID NO: 7514041 - DNA, 22 bp, Homo sapiens
gggcttcaaaattggcactctt

SEQ ID NO: 7514042 - DNA, 22 bp, Homo sapiens
gggcttatggagggctttgtac

SEQ ID NO: 7514043 - DNA, 22 bp, Homo sapiens
gggcttcaaaattggcactctt

SEQ ID NO: 7514044 - DNA, 22 bp, Homo sapiens
gggcttatggagggctttgtac

SEQ ID NO: 7514045 - DNA, 22 bp, Homo sapiens
gggcttcaaaattggcactctt

SEQ ID NO: 7514046 - DNA, 22 bp, Homo sapiens
gggcttcaggagggtcagccca

SEQ ID NO: 7514047 - DNA, 22 bp, Homo sapiens
gggcttcagggtacttcctcct

SEQ ID NO: 7514048 - DNA, 22 bp, Homo sapiens
gggcttcaggagggtcagccca

SEQ ID NO: 7514049 - DNA, 22 bp, Homo sapiens
gggcttcagatccagggacctc

SEQ ID NO: 7514050 - DNA, 22 bp, Homo sapiens
gggcttcagatccagggacctc

SEQ ID NO: 7514051 - DNA, 22 bp, Homo sapiens
gggcttcagttctgaccatctt

SEQ ID NO: 7514052 - DNA, 23 bp, Homo sapiens
gggcttcattttaattcagctgc

SEQ ID NO: 7514053 - DNA, 22 bp, Homo sapiens
gggcttctaagtgaaagtgtaa

SEQ ID NO: 7514054 - DNA, 22 bp, Homo sapiens
gggcttctacttgcaaaggata

SEQ ID NO: 7514055 - DNA, 23 bp, Homo sapiens
gggcttcattttaattcagctgc

SEQ ID NO: 7514056 - DNA, 22 bp, Homo sapiens
gggcttctaagtgaaagtgtaa

SEQ ID NO: 7514057 - DNA, 22 bp, Homo sapiens
gggcttctattcaagtctgttt

SEQ ID NO: 7514058 - DNA, 22 bp, Homo sapiens
gggcttctattcaagtctgttt

SEQ ID NO: 7514059 - DNA, 22 bp, Homo sapiens
gggcttctagaccagcagtgag

SEQ ID NO: 7514060 - DNA, 22 bp, Homo sapiens
gggcttctagaccagcagtgag

SEQ ID NO: 7514061 - DNA, 22 bp, Homo sapiens
gggcttctacttgcaaaggata

SEQ ID NO: 7514062 - DNA, 22 bp, Homo sapiens
gggcttctagaatttctgatat

SEQ ID NO: 7514063 - DNA, 22 bp, Homo sapiens
gggcttctctgatcaatatttc

SEQ ID NO: 7514064 - DNA, 22 bp, Homo sapiens
gggcttctctcaggggcatgag

SEQ ID NO: 7514065 - DNA, 22 bp, Homo sapiens
gggcttctctcaggggcatgag

SEQ ID NO: 7514066 - DNA, 22 bp, Homo sapiens
gggcttctctgggagtcctggt

SEQ ID NO: 7514067 - DNA, 22 bp, Homo sapiens
gggcttctctgggagtcctggt

SEQ ID NO: 7514068 - DNA, 22 bp, Homo sapiens
gggcttctctgggagtcctggt

SEQ ID NO: 7514069 - DNA, 22 bp, Homo sapiens
gggcttctctcagaaactatca

SEQ ID NO: 7514070 - DNA, 22 bp, Homo sapiens
gggcttctctcaggggcatgag

SEQ ID NO: 7514071 - DNA, 22 bp, Homo sapiens
gggcttctattctggcacaaga

SEQ ID NO: 7514072 - DNA, 22 bp, Homo sapiens
gggcttctattctggcacaaga

SEQ ID NO: 7514073 - DNA, 22 bp, Homo sapiens
gggcttctccctaaggactctg

SEQ ID NO: 7514074 - DNA, 22 bp, Homo sapiens
gggcttctctttagtgagctga

SEQ ID NO: 7514075 - DNA, 22 bp, Homo sapiens
gggcttctctttagtgagctga

SEQ ID NO: 7514076 - DNA, 22 bp, Homo sapiens
gggcttctgctcttttggtgct

SEQ ID NO: 7514077 - DNA, 22 bp, Homo sapiens
gggcttctgctcttttggtgct

SEQ ID NO: 7514078 - DNA, 22 bp, Homo sapiens
gggcttctctttagtgagctga

SEQ ID NO: 7514079 - DNA, 22 bp, Homo sapiens
gggcttctggtcattcctcatc

SEQ ID NO: 7514080 - DNA, 22 bp, Homo sapiens
gggcttctgggcaccactccct

SEQ ID NO: 7514081 - DNA, 22 bp, Homo sapiens
gggcttctgggcaccactccct

SEQ ID NO: 7514082 - DNA, 22 bp, Homo sapiens
gggcttctgggcaccactccct

SEQ ID NO: 7514083 - DNA, 22 bp, Homo sapiens
gggcttctggctactgtatgag

SEQ ID NO: 7514084 - DNA, 19 bp, Homo sapiens
gggcttctgggatcaagag

SEQ ID NO: 7514085 - DNA, 22 bp, Homo sapiens
gggcttctgggcaccactccct

SEQ ID NO: 7514086 - DNA, 22 bp, Homo sapiens
gggctctgggatgctcttagag

SEQ ID NO: 7514087 - DNA, 22 bp, Homo sapiens
gggctctgggatgctcttagag

SEQ ID NO: 7514088 - DNA, 19 bp, Homo sapiens
gggctctggcctcagtggg

SEQ ID NO: 7514089 - DNA, 19 bp, Homo sapiens
gggctctggcctcagtggg

SEQ ID NO: 7514090 - DNA, 19 bp, Homo sapiens
gggctctggcctcagtggg

SEQ ID NO: 7514091 - DNA, 19 bp, Homo sapiens
gggctctggcctcagtggg

SEQ ID NO: 7514092 - DNA, 19 bp, Homo sapiens
gggctctggcctcagtggg

SEQ ID NO: 7514093 - DNA, 19 bp, Homo sapiens
gggctctggcctcagtggg

SEQ ID NO: 7514094 - DNA, 18 bp, Homo sapiens
gggctctggcatctgggt

SEQ ID NO: 7514095 - DNA, 19 bp, Homo sapiens
gggctctggcctcagtggg

SEQ ID NO: 7514096 - DNA, 19 bp, Homo sapiens
gggctctggcctcagtggg

SEQ ID NO: 7514097 - DNA, 19 bp, Homo sapiens
gggctctggcctcagtggg

SEQ ID NO: 7514098 - DNA, 19 bp, Homo sapiens
gggctctggcctcagtggg

SEQ ID NO: 7514099 - DNA, 19 bp, Homo sapiens
gggctctggcctcagtggg

SEQ ID NO: 7514100 - DNA, 19 bp, Homo sapiens
gggctctggcctcagtggg

SEQ ID NO: 7514101 - DNA, 18 bp, Homo sapiens
gggctctggcatctgggt

SEQ ID NO: 7514102 - DNA, 18 bp, Homo sapiens
gggctctggcatctgggt

SEQ ID NO: 7514103 - DNA, 18 bp, Homo sapiens
gggctctggcatctgggt

SEQ ID NO: 7514104 - DNA, 22 bp, Homo sapiens
gggctctgggattcagagcaag

SEQ ID NO: 7514105 - DNA, 22 bp, Homo sapiens
gggctctgggattcagagcaag

SEQ ID NO: 7514106 - DNA, 22 bp, Homo sapiens
gggctctgggattcagagcaag

SEQ ID NO: 7514107 - DNA, 22 bp, Homo sapiens
gggctctgggattcagagcaag

SEQ ID NO: 7514108 - DNA, 22 bp, Homo sapiens
gggctctgggattcagagcaag

SEQ ID NO: 7514109 - DNA, 22 bp, Homo sapiens
gggctctgggattcagagcaag

SEQ ID NO: 7514110 - DNA, 22 bp, Homo sapiens
gggctctgggattcagagcaag

SEQ ID NO: 7514111 - DNA, 22 bp, Homo sapiens
gggctctgggattcagagcaag

SEQ ID NO: 7514112 - DNA, 22 bp, Homo sapiens
gggctctggggaggacccttca

SEQ ID NO: 7514113 - DNA, 22 bp, Homo sapiens
gggctctgggattcagagcaag

SEQ ID NO: 7514114 - DNA, 22 bp, Homo sapiens
gggctctggggtcagacagcct

SEQ ID NO: 7514115 - DNA, 22 bp, Homo sapiens
gggctctggggaggacccttca

SEQ ID NO: 7514116 - DNA, 22 bp, Homo sapiens
gggctctggggtcagacagcct

SEQ ID NO: 7514117 - DNA, 22 bp, Homo sapiens
gggctctggggtcagacagcct

SEQ ID NO: 7514118 - DNA, 22 bp, Homo sapiens
gggctctggggtcagacagcct

SEQ ID NO: 7514119 - DNA, 22 bp, Homo sapiens
gggctgtgtgcccacttcccat

SEQ ID NO: 7514120 - DNA, 22 bp, Homo sapiens
gggctgtgttaggtgcggttac

SEQ ID NO: 7514121 - DNA, 22 bp, Homo sapiens
gggctgtgttaggtgcggttac

SEQ ID NO: 7514122 - DNA, 18 bp, Homo sapiens
gggctgtgttcatgccca

SEQ ID NO: 7514123 - DNA, 18 bp, Homo sapiens
gggctgtgttcatgccca

SEQ ID NO: 7514124 - DNA, 22 bp, Homo sapiens
gggctgtgttaggtgcggttac

SEQ ID NO: 7514125 - DNA, 18 bp, Homo sapiens
gggctgtgttcatgccca

SEQ ID NO: 7514126 - DNA, 22 bp, Homo sapiens
gggctggtctggcttagtcagg

SEQ ID NO: 7514127 - DNA, 22 bp, Homo sapiens
gggctggtctggcttagtcagg

SEQ ID NO: 7514128 - DNA, 22 bp, Homo sapiens
gggctggtgaggctgccctgca

SEQ ID NO: 7514129 - DNA, 22 bp, Homo sapiens
gggctggtgaggctgccctgca

SEQ ID NO: 7514130 - DNA, 22 bp, Homo sapiens
gggctggtgaggctgccctgca

SEQ ID NO: 7514131 - DNA, 22 bp, Homo sapiens
gggctgtgtgcagtacgggtcc

SEQ ID NO: 7514132 - DNA, 22 bp, Homo sapiens
gggctggtgaggctgccctgca

SEQ ID NO: 7514133 - DNA, 22 bp, Homo sapiens
gggctggtgaggctgccctgca

SEQ ID NO: 7514134 - DNA, 16 bp, Homo sapiens
gggctgggggattctg

SEQ ID NO: 7514135 - DNA, 16 bp, Homo sapiens
gggctgggggattctg

SEQ ID NO: 7514136 - DNA, 16 bp, Homo sapiens
gggctgggggattctg

SEQ ID NO: 7514137 - DNA, 16 bp, Homo sapiens
gggctgggggattctg

SEQ ID NO: 7514138 - DNA, 16 bp, Homo sapiens
gggctgggggattctg

SEQ ID NO: 7514139 - DNA, 22 bp, Homo sapiens
gggctctggggtgccctggcat

SEQ ID NO: 7514140 - DNA, 16 bp, Homo sapiens
gggctgggggattctg

SEQ ID NO: 7514141 - DNA, 16 bp, Homo sapiens
gggctgggggattctg

SEQ ID NO: 7514142 - DNA, 16 bp, Homo sapiens
gggctgggggattctg

SEQ ID NO: 7514143 - DNA, 16 bp, Homo sapiens
gggctgggggattctg

SEQ ID NO: 7514144 - DNA, 22 bp, Homo sapiens
gggctctggggtgccctggcat

SEQ ID NO: 7514145 - DNA, 22 bp, Homo sapiens
gggctctggggtcagacagcct

SEQ ID NO: 7514146 - DNA, 22 bp, Homo sapiens
gggctctggggtgccctggcat

SEQ ID NO: 7514147 - DNA, 22 bp, Homo sapiens
gggctctggggtcagacagcct

SEQ ID NO: 7514148 - DNA, 22 bp, Homo sapiens
gggctctggggtgccctggcat

SEQ ID NO: 7514149 - DNA, 22 bp, Homo sapiens
gggctctggggtgccctggcat

SEQ ID NO: 7514150 - DNA, 22 bp, Homo sapiens
gggctctggggtgccctggcat

SEQ ID NO: 7514151 - DNA, 22 bp, Homo sapiens
gtgcccagctccacctcacaga

SEQ ID NO: 7514152 - DNA, 22 bp, Homo sapiens
gtgcccagctccacctcacaga

SEQ ID NO: 7514153 - DNA, 22 bp, Homo sapiens
gtgcccagctccacctcacaga

SEQ ID NO: 7514154 - DNA, 22 bp, Homo sapiens
gtgcccagctccacctcacaga

SEQ ID NO: 7514155 - DNA, 22 bp, Homo sapiens
gtgcccagctccacctcacaga

SEQ ID NO: 7514156 - DNA, 22 bp, Homo sapiens
gtgcccagcagcagcgtccccg

SEQ ID NO: 7514157 - DNA, 22 bp, Homo sapiens
gtgcccagcagcagcgtccccg

SEQ ID NO: 7514158 - DNA, 22 bp, Homo sapiens
gtgcccagctccacctcacaga

SEQ ID NO: 7514159 - DNA, 22 bp, Homo sapiens
gtgcccagctccacctcacaga

SEQ ID NO: 7514160 - DNA, 22 bp, Homo sapiens
gtgcccagctccacctcacaga

SEQ ID NO: 7514161 - DNA, 22 bp, Homo sapiens
gtgcccagctccacctcacaga

SEQ ID NO: 7514162 - DNA, 22 bp, Homo sapiens
gtgcccagctccacctcacaga

SEQ ID NO: 7514163 - DNA, 22 bp, Homo sapiens
gtgcccagcagcagcgtccccg

SEQ ID NO: 7514164 - DNA, 22 bp, Homo sapiens
gtgcccagcagcagcgtccccg

SEQ ID NO: 7514165 - DNA, 22 bp, Homo sapiens
gtgcccagcagcagcgtccccg

SEQ ID NO: 7514166 - DNA, 22 bp, Homo sapiens
gtgcccagcagcagcgtccccg

SEQ ID NO: 7514167 - DNA, 22 bp, Homo sapiens
gtgcccacgaggccaggctggt

SEQ ID NO: 7514168 - DNA, 22 bp, Homo sapiens
gtgcccacgaggccaggctggt

SEQ ID NO: 7514169 - DNA, 22 bp, Homo sapiens
gtgcccacgaggccaggctggt

SEQ ID NO: 7514170 - DNA, 22 bp, Homo sapiens
gtgcccacgaggccaggctggt

SEQ ID NO: 7514171 - DNA, 22 bp, Homo sapiens
gtgcccaccggtgccctgagct

SEQ ID NO: 7514172 - DNA, 22 bp, Homo sapiens
gtgcccaccacgggctgtggcg

SEQ ID NO: 7514173 - DNA, 22 bp, Homo sapiens
gtgcccaccggtgccctgagct

SEQ ID NO: 7514174 - DNA, 22 bp, Homo sapiens
gtgcccaccggtgccctgagct

SEQ ID NO: 7514175 - DNA, 22 bp, Homo sapiens
gtgcccaccggtgccctgagct

SEQ ID NO: 7514176 - DNA, 22 bp, Homo sapiens
gtgcccaccacgggctgtggcg

SEQ ID NO: 7514177 - DNA, 22 bp, Homo sapiens
gtgcccacacatgttcttacat

SEQ ID NO: 7514178 - DNA, 22 bp, Homo sapiens
gtgccatcgggctcctcctgct

SEQ ID NO: 7514179 - DNA, 22 bp, Homo sapiens
gtgccaggtgctaagctgtgct

SEQ ID NO: 7514180 - DNA, 22 bp, Homo sapiens
gtgccaggtgctaagctgtgct

SEQ ID NO: 7514181 - DNA, 22 bp, Homo sapiens
gtgccaggtgctaagctgtgct

SEQ ID NO: 7514182 - DNA, 22 bp, Homo sapiens
gtgccaggtgctaagctgtgct

SEQ ID NO: 7514183 - DNA, 22 bp, Homo sapiens
gtgccaggtgctaagctgtgct

SEQ ID NO: 7514184 - DNA, 22 bp, Homo sapiens
gtgccaggtgctaagctgtgct

SEQ ID NO: 7514185 - DNA, 22 bp, Homo sapiens
gtgccaggtgctaagctgtgct

SEQ ID NO: 7514186 - DNA, 22 bp, Homo sapiens
gtgccatcgggctcctcctgct

SEQ ID NO: 7514187 - DNA, 22 bp, Homo sapiens
gtgccatactcatatcattttt

SEQ ID NO: 7514188 - DNA, 22 bp, Homo sapiens
gtgccaggtgctaagctgtgct

SEQ ID NO: 7514189 - DNA, 22 bp, Homo sapiens
gtgccaggtgctaagctgtgct

SEQ ID NO: 7514190 - DNA, 22 bp, Homo sapiens
gtgccaggtgctaagctgtgct

SEQ ID NO: 7514191 - DNA, 22 bp, Homo sapiens
gtgccaggtgctaagctgtgct

SEQ ID NO: 7514192 - DNA, 22 bp, Homo sapiens
gtgccagggggcactgaacaga

SEQ ID NO: 7514193 - DNA, 22 bp, Homo sapiens
gtgccagggggcactgaacaga

SEQ ID NO: 7514194 - DNA, 22 bp, Homo sapiens
gtgccagggagtggaggagctt

SEQ ID NO: 7514195 - DNA, 22 bp, Homo sapiens
gtgccagggagtggaggagctt

SEQ ID NO: 7514196 - DNA, 22 bp, Homo sapiens
gtgccagggagtggaggagctt

SEQ ID NO: 7514197 - DNA, 22 bp, Homo sapiens
gtgccaggcctattgttaaact

SEQ ID NO: 7514198 - DNA, 22 bp, Homo sapiens
gtgccaggcccagggagcgggg

SEQ ID NO: 7514199 - DNA, 22 bp, Homo sapiens
gtgccagggagtggaggagctt

SEQ ID NO: 7514200 - DNA, 22 bp, Homo sapiens
gtgccagggagtggaggagctt

SEQ ID NO: 7514201 - DNA, 22 bp, Homo sapiens
gtgccagggagtggaggagctt

SEQ ID NO: 7514202 - DNA, 22 bp, Homo sapiens
gtgccagggagtggaggagctt

SEQ ID NO: 7514203 - DNA, 22 bp, Homo sapiens
gtgccagggagtggaggagctt

SEQ ID NO: 7514204 - DNA, 22 bp, Homo sapiens
gtgccaggcccagggagcgggg

SEQ ID NO: 7514205 - DNA, 22 bp, Homo sapiens
gtgccaggcccagggagcgggg

SEQ ID NO: 7514206 - DNA, 22 bp, Homo sapiens
gtgccaggcccagggagcgggg

SEQ ID NO: 7514207 - DNA, 22 bp, Homo sapiens
gtgccaggcccagggagcgggg

SEQ ID NO: 7514208 - DNA, 22 bp, Homo sapiens
gtgccaggcccagggagcgggg

SEQ ID NO: 7514209 - DNA, 22 bp, Homo sapiens
gtgccaggcccagggagcgggg

SEQ ID NO: 7514210 - DNA, 20 bp, Homo sapiens
gtgccaggcaagacaggtgg

SEQ ID NO: 7514211 - DNA, 20 bp, Homo sapiens
gtgccaggcaagacaggtgg

SEQ ID NO: 7514212 - DNA, 20 bp, Homo sapiens
gtgccaggcaagacaggtgg

SEQ ID NO: 7514213 - DNA, 20 bp, Homo sapiens
gtgccaggcaagacaggtgg

SEQ ID NO: 7514214 - DNA, 20 bp, Homo sapiens
gtgccaggcaagacaggtgg

SEQ ID NO: 7514215 - DNA, 20 bp, Homo sapiens
gtgccaggcaagacaggtgg

SEQ ID NO: 7514216 - DNA, 20 bp, Homo sapiens
gtgccaggcaagacaggtgg

SEQ ID NO: 7514217 - DNA, 20 bp, Homo sapiens
gtgccaggcaagacaggtgg

SEQ ID NO: 7514218 - DNA, 18 bp, Homo sapiens
gtgccaggaggcgcagcc

SEQ ID NO: 7514219 - DNA, 18 bp, Homo sapiens
gtgccaggaggcgcagcc

SEQ ID NO: 7514220 - DNA, 18 bp, Homo sapiens
gtgccaggaggcgcagcc

SEQ ID NO: 7514221 - DNA, 18 bp, Homo sapiens
gtgccaggaggcgcagcc

SEQ ID NO: 7514222 - DNA, 18 bp, Homo sapiens
gtgccaggaggcgcagcc

SEQ ID NO: 7514223 - DNA, 18 bp, Homo sapiens
gtgccaggaggcgcagcc

SEQ ID NO: 7514224 - DNA, 18 bp, Homo sapiens
gtgccaggaggcgcagcc

SEQ ID NO: 7514225 - DNA, 18 bp, Homo sapiens
gtgccaggaggcgcagcc

SEQ ID NO: 7514226 - DNA, 20 bp, Homo sapiens
gtgccaggcaagacaggtgg

SEQ ID NO: 7514227 - DNA, 18 bp, Homo sapiens
gtgccaggaggcgcagcc

SEQ ID NO: 7514228 - DNA, 18 bp, Homo sapiens
gtgccaggaggcgcagcc

SEQ ID NO: 7514229 - DNA, 18 bp, Homo sapiens
gtgccaggaggcgcagcc

SEQ ID NO: 7514230 - DNA, 22 bp, Homo sapiens
gtgccagcctggtgcgcctggg

SEQ ID NO: 7514231 - DNA, 22 bp, Homo sapiens
gtgccagctctccccacatctg

SEQ ID NO: 7514232 - DNA, 22 bp, Homo sapiens
gtgccagctctccccacatctg

SEQ ID NO: 7514233 - DNA, 22 bp, Homo sapiens
gtgccagcctggtgcgcctggg

SEQ ID NO: 7514234 - DNA, 22 bp, Homo sapiens
gtgccagctctccccacatctg

SEQ ID NO: 7514235 - DNA, 22 bp, Homo sapiens
gtgccagctgtccatgttcctc

SEQ ID NO: 7514236 - DNA, 22 bp, Homo sapiens
gtgccagctgtccatgttcctc

SEQ ID NO: 7514237 - DNA, 22 bp, Homo sapiens
gtgccagccgcaccccaggaga

SEQ ID NO: 7514238 - DNA, 22 bp, Homo sapiens
gtgccagcctggtgcgcctggg

SEQ ID NO: 7514239 - DNA, 22 bp, Homo sapiens
gtgccagccgcaccccaggaga

SEQ ID NO: 7514240 - DNA, 22 bp, Homo sapiens
gtgccagcctggtgcgcctggg

SEQ ID NO: 7514241 - DNA, 22 bp, Homo sapiens
gtgctgcagggtcagcaccctc

SEQ ID NO: 7514242 - DNA, 22 bp, Homo sapiens
gtgctgcatgacttgctcctga

SEQ ID NO: 7514243 - DNA, 22 bp, Homo sapiens
gtgctgcatgacttgctcctga

SEQ ID NO: 7514244 - DNA, 22 bp, Homo sapiens
gtgctgcagggcctcctgcacc

SEQ ID NO: 7514245 - DNA, 22 bp, Homo sapiens
gtgctgcagggtcagcaccctc

SEQ ID NO: 7514246 - DNA, 22 bp, Homo sapiens
gtgctgcagagtctcgtgccgc

SEQ ID NO: 7514247 - DNA, 22 bp, Homo sapiens
gtgctgcagagtctcgtgccgc

SEQ ID NO: 7514248 - DNA, 22 bp, Homo sapiens
gtgctgcagagtctcgtgccgc

SEQ ID NO: 7514249 - DNA, 22 bp, Homo sapiens
gtgctgcagggcctcctgcacc

SEQ ID NO: 7514250 - DNA, 22 bp, Homo sapiens
gtgctgattgggagctgggatt

SEQ ID NO: 7514251 - DNA, 22 bp, Homo sapiens
gtgctgattgggagctgggatt

SEQ ID NO: 7514252 - DNA, 23 bp, Homo sapiens
gtgctgcaaaatcggccactgca

SEQ ID NO: 7514253 - DNA, 23 bp, Homo sapiens
gtgctgcaaaatcggccactgca

SEQ ID NO: 7514254 - DNA, 22 bp, Homo sapiens
gtgctgatggccacccctgttc

SEQ ID NO: 7514255 - DNA, 22 bp, Homo sapiens
gtgctgatggccacccctgttc

SEQ ID NO: 7514256 - DNA, 22 bp, Homo sapiens
gtgctgatgttgcttcccttgg

SEQ ID NO: 7514257 - DNA, 18 bp, Homo sapiens
gtgctgatgagtggtttt

SEQ ID NO: 7514258 - DNA, 22 bp, Homo sapiens
gtgctgatggccacccctgttc

SEQ ID NO: 7514259 - DNA, 22 bp, Homo sapiens
gtgctgacaggagcctggcggt

SEQ ID NO: 7514260 - DNA, 22 bp, Homo sapiens
gtgctgagaacaaaagtggaca

SEQ ID NO: 7514261 - DNA, 22 bp, Homo sapiens
gtgctgagaacaaaagtggaca

SEQ ID NO: 7514262 - DNA, 22 bp, Homo sapiens
gtgctgagtgcagagtgcagag

SEQ ID NO: 7514263 - DNA, 22 bp, Homo sapiens
gtgctgagtgactttttcttca

SEQ ID NO: 7514264 - DNA, 20 bp, Homo sapiens
gtgctgagtgaaatgagatt

SEQ ID NO: 7514265 - DNA, 22 bp, Homo sapiens
gtgctgagtgcagagtgcagag

SEQ ID NO: 7514266 - DNA, 22 bp, Homo sapiens
gtgctgagtgcagagtgcagag

SEQ ID NO: 7514267 - DNA, 22 bp, Homo sapiens
gtgctgagtgcggccgaattct

SEQ ID NO: 7514268 - DNA, 20 bp, Homo sapiens
gtgctgagtgtctaactcct

SEQ ID NO: 7514269 - DNA, 22 bp, Homo sapiens
gtgctgatagcatcataaagtc

SEQ ID NO: 7514270 - DNA, 22 bp, Homo sapiens
gtgctgatcttcacttggctgc

SEQ ID NO: 7514271 - DNA, 22 bp, Homo sapiens
gtgctgacaggagcctggcggt

SEQ ID NO: 7514272 - DNA, 22 bp, Homo sapiens
gtgctgacaggagcctggcggt

SEQ ID NO: 7514273 - DNA, 22 bp, Homo sapiens
gtgctgacaggagcctggcggt

SEQ ID NO: 7514274 - DNA, 22 bp, Homo sapiens
gtgctgacaggagcctggcggt

SEQ ID NO: 7514275 - DNA, 22 bp, Homo sapiens
gtgctgacaggagcctggcggt

SEQ ID NO: 7514276 - DNA, 22 bp, Homo sapiens
gtgcccaggcccaaggcaccac

SEQ ID NO: 7514277 - DNA, 22 bp, Homo sapiens
gtgcccaggcccaaggcaccac

SEQ ID NO: 7514278 - DNA, 22 bp, Homo sapiens
gtgcccaggcccaaggcaccac

SEQ ID NO: 7514279 - DNA, 22 bp, Homo sapiens
gtgcccaggcccaaggcaccac

SEQ ID NO: 7514280 - DNA, 22 bp, Homo sapiens
gtgcccaggcccaaggcaccac

SEQ ID NO: 7514281 - DNA, 22 bp, Homo sapiens
gtgcccaggcccaaggcaccac

SEQ ID NO: 7514282 - DNA, 22 bp, Homo sapiens
gtgctgcttgggggcagagcag

SEQ ID NO: 7514283 - DNA, 22 bp, Homo sapiens
gtgctggaactgtgctaagaga

SEQ ID NO: 7514284 - DNA, 22 bp, Homo sapiens
gtgctggaactgtgctaagaga

SEQ ID NO: 7514285 - DNA, 22 bp, Homo sapiens
gtgctgcttgggggcagagcag

SEQ ID NO: 7514286 - DNA, 22 bp, Homo sapiens
gtgctggaactgtgctaagaga

SEQ ID NO: 7514287 - DNA, 22 bp, Homo sapiens
gtgctggaccctggaaggtggt

SEQ ID NO: 7514288 - DNA, 22 bp, Homo sapiens
gtgctggaccctggaaggtggt

SEQ ID NO: 7514289 - DNA, 20 bp, Homo sapiens
gtgctggagttaggaaaggt

SEQ ID NO: 7514290 - DNA, 20 bp, Homo sapiens
gtgctggagttaggaaaggt

SEQ ID NO: 7514291 - DNA, 20 bp, Homo sapiens
gtgctggagttaggaaaggt

SEQ ID NO: 7514292 - DNA, 20 bp, Homo sapiens
gtgctggagttaggaaaggt

SEQ ID NO: 7514293 - DNA, 22 bp, Homo sapiens
gtgctggccctgtcctcgagct

SEQ ID NO: 7514294 - DNA, 22 bp, Homo sapiens
gtgctggccctgtcctcgagct

SEQ ID NO: 7514295 - DNA, 22 bp, Homo sapiens
gtgctggccctgtcctcgagct

SEQ ID NO: 7514296 - DNA, 22 bp, Homo sapiens
gtgctggccctgtcctcgagct

SEQ ID NO: 7514297 - DNA, 22 bp, Homo sapiens
gtgctggccctgtcctcgagct

SEQ ID NO: 7514298 - DNA, 22 bp, Homo sapiens
gtgctggcacccctctccagtt

SEQ ID NO: 7514299 - DNA, 22 bp, Homo sapiens
gtgctggcacccctctccagtt

SEQ ID NO: 7514300 - DNA, 22 bp, Homo sapiens
gtgctggcacccctctccagtt

SEQ ID NO: 7514301 - DNA, 22 bp, Homo sapiens
gtgctggcacccctctccagtt

SEQ ID NO: 7514302 - DNA, 22 bp, Homo sapiens
gtgctggcacccctctccagtt

SEQ ID NO: 7514303 - DNA, 22 bp, Homo sapiens
gtgctggccctgtcctcgagct

SEQ ID NO: 7514304 - DNA, 22 bp, Homo sapiens
gtgctggccctgtcctcgagct

SEQ ID NO: 7514305 - DNA, 22 bp, Homo sapiens
gtgctgctgccagcaggatcct

SEQ ID NO: 7514306 - DNA, 21 bp, Homo sapiens
gtgctgctagcgggacgggag

SEQ ID NO: 7514307 - DNA, 22 bp, Homo sapiens
gtgctgctcaagggacaggaca

SEQ ID NO: 7514308 - DNA, 22 bp, Homo sapiens
gtgctgctcacatctggaggta

SEQ ID NO: 7514309 - DNA, 22 bp, Homo sapiens
gtgctgctcacatctggaggta

SEQ ID NO: 7514310 - DNA, 22 bp, Homo sapiens
gtgctgcctgccagcttctggg

SEQ ID NO: 7514311 - DNA, 22 bp, Homo sapiens
gtgctgctcaagggacaggaca

SEQ ID NO: 7514312 - DNA, 21 bp, Homo sapiens
gtgctgctagcgggacgggag

SEQ ID NO: 7514313 - DNA, 22 bp, Homo sapiens
gtgctgcctccatatccgtcag

SEQ ID NO: 7514314 - DNA, 22 bp, Homo sapiens
gtgctgcctgccagcttctggg

SEQ ID NO: 7514315 - DNA, 22 bp, Homo sapiens
gtgctgcctccatatccgtcag

SEQ ID NO: 7514316 - DNA, 22 bp, Homo sapiens
gtgctgccggcatagcagtgaa

SEQ ID NO: 7514317 - DNA, 22 bp, Homo sapiens
gtgctgccggcatagcagtgaa

SEQ ID NO: 7514318 - DNA, 22 bp, Homo sapiens
gtgctgccggcatagcagtgaa

SEQ ID NO: 7514319 - DNA, 22 bp, Homo sapiens
gtgctgccagacagtgagaggg

SEQ ID NO: 7514320 - DNA, 22 bp, Homo sapiens
gtgctgccagacagtgagaggg

SEQ ID NO: 7514321 - DNA, 22 bp, Homo sapiens
gtgctgcatgacttgctcctga

SEQ ID NO: 7514322 - DNA, 22 bp, Homo sapiens
gtgcaggatttatagcccagct

SEQ ID NO: 7514323 - DNA, 22 bp, Homo sapiens
gtgcaggatttatagcccagct

SEQ ID NO: 7514324 - DNA, 22 bp, Homo sapiens
gtgcaggatttatagcccagct

SEQ ID NO: 7514325 - DNA, 22 bp, Homo sapiens
gtgcaggcaaaagggccaggcc

SEQ ID NO: 7514326 - DNA, 22 bp, Homo sapiens
gtgcaggcaaaagggccaggcc

SEQ ID NO: 7514327 - DNA, 22 bp, Homo sapiens
gtgcaggcaaaagggccaggcc

SEQ ID NO: 7514328 - DNA, 22 bp, Homo sapiens
gtgcaggcattgggctagccat

SEQ ID NO: 7514329 - DNA, 22 bp, Homo sapiens
gtgcaggcattgggctagccat

SEQ ID NO: 7514330 - DNA, 22 bp, Homo sapiens
gtgcaggctagatccttcctac

SEQ ID NO: 7514331 - DNA, 22 bp, Homo sapiens
gtgcagggagcccagaaggtcc

SEQ ID NO: 7514332 - DNA, 22 bp, Homo sapiens
gtgcagggagcccagaaggtcc

SEQ ID NO: 7514333 - DNA, 22 bp, Homo sapiens
gtgcaggctctcgttcttgaca

SEQ ID NO: 7514334 - DNA, 22 bp, Homo sapiens
gtgcagggagcccagaaggtcc

SEQ ID NO: 7514335 - DNA, 22 bp, Homo sapiens
gtgcagggagcccagaaggtcc

SEQ ID NO: 7514336 - DNA, 22 bp, Homo sapiens
gtgcagggagcccagaaggtcc

SEQ ID NO: 7514337 - DNA, 22 bp, Homo sapiens
gtgcaggaggtaacatagcaaa

SEQ ID NO: 7514338 - DNA, 22 bp, Homo sapiens
gtgcaggaggtaacatagcaaa

SEQ ID NO: 7514339 - DNA, 22 bp, Homo sapiens
gtgcaggagtaggagagggctt

SEQ ID NO: 7514340 - DNA, 22 bp, Homo sapiens
gtgcaggagtaggagagggctt

SEQ ID NO: 7514341 - DNA, 22 bp, Homo sapiens
gtgcaggagtaggagagggctt

SEQ ID NO: 7514342 - DNA, 22 bp, Homo sapiens
gtgcaggagtaggagagggctt

SEQ ID NO: 7514343 - DNA, 22 bp, Homo sapiens
gtgcaggagtaggagagggctt

SEQ ID NO: 7514344 - DNA, 22 bp, Homo sapiens
gtgcaggagtaggagagggctt

SEQ ID NO: 7514345 - DNA, 20 bp, Homo sapiens
gtgcagcacttgggggtagg

SEQ ID NO: 7514346 - DNA, 22 bp, Homo sapiens
gtgcagcaggggccctctcacc

SEQ ID NO: 7514347 - DNA, 22 bp, Homo sapiens
gtgcagcaggggccctctcacc

SEQ ID NO: 7514348 - DNA, 22 bp, Homo sapiens
gtgcaggaggtaacatagcaaa

SEQ ID NO: 7514349 - DNA, 20 bp, Homo sapiens
gtgcagcacttgggggtagg

SEQ ID NO: 7514350 - DNA, 22 bp, Homo sapiens
gtgcagcaaagtttgagatata

SEQ ID NO: 7514351 - DNA, 22 bp, Homo sapiens
gtgcagcaaagtttgagatata

SEQ ID NO: 7514352 - DNA, 20 bp, Homo sapiens
gtgcagcacttgggggtagg

SEQ ID NO: 7514353 - DNA, 22 bp, Homo sapiens
gtgcaggatgttgggaatcagg

SEQ ID NO: 7514354 - DNA, 22 bp, Homo sapiens
gtgcaggatgttgggaatcagg

SEQ ID NO: 7514355 - DNA, 22 bp, Homo sapiens
gtgcaggatgttgggaatcagg

SEQ ID NO: 7514356 - DNA, 22 bp, Homo sapiens
gtgcaggatgttgggaatcagg

SEQ ID NO: 7514357 - DNA, 22 bp, Homo sapiens
gtgcaggatctcagaacaagtg

SEQ ID NO: 7514358 - DNA, 22 bp, Homo sapiens
gtgcaggatctcagaacaagtg

SEQ ID NO: 7514359 - DNA, 22 bp, Homo sapiens
gtgcaggagtaggagagggctt

SEQ ID NO: 7514360 - DNA, 22 bp, Homo sapiens
gtgaggatgtactgagataaat

SEQ ID NO: 7514361 - DNA, 22 bp, Homo sapiens
gtgaggatcaaatgaaatagca

SEQ ID NO: 7514362 - DNA, 22 bp, Homo sapiens
gtgaggatacttaagagaacac

SEQ ID NO: 7514363 - DNA, 22 bp, Homo sapiens
gtgaggagtctgaagcacataa

SEQ ID NO: 7514364 - DNA, 19 bp, Homo sapiens
gtgaggagtgtttacagaa

SEQ ID NO: 7514365 - DNA, 22 bp, Homo sapiens
gtgaggatacttaagagaacac

SEQ ID NO: 7514366 - DNA, 22 bp, Homo sapiens
gtgaggatacttaagagaacac

SEQ ID NO: 7514367 - DNA, 22 bp, Homo sapiens
gtgaggcaagggcatactaggc

SEQ ID NO: 7514368 - DNA, 22 bp, Homo sapiens
gtgaggattgctctggagaatt

SEQ ID NO: 7514369 - DNA, 22 bp, Homo sapiens
gtgaggcagaagttccctttta

SEQ ID NO: 7514370 - DNA, 22 bp, Homo sapiens
gtgaggcagaagttccctttta

SEQ ID NO: 7514371 - DNA, 22 bp, Homo sapiens
gtgaggcagagatgccaaaact

SEQ ID NO: 7514372 - DNA, 22 bp, Homo sapiens
gtgaggcaggcattctcctttc

SEQ ID NO: 7514373 - DNA, 22 bp, Homo sapiens
gtgaggcagggaaagaggataa

SEQ ID NO: 7514374 - DNA, 22 bp, Homo sapiens
gtgaggcagcaggagcctctgt

SEQ ID NO: 7514375 - DNA, 22 bp, Homo sapiens
gtgaggcaggcattctcctttc

SEQ ID NO: 7514376 - DNA, 22 bp, Homo sapiens
gtgaggcagcaggagcctctgt

SEQ ID NO: 7514377 - DNA, 22 bp, Homo sapiens
gtgaggcagcaggagcctctgt

SEQ ID NO: 7514378 - DNA, 22 bp, Homo sapiens
gtgcagcaaactagtgcgaggg

SEQ ID NO: 7514379 - DNA, 22 bp, Homo sapiens
gtgcagcaaactagtgcgaggg

SEQ ID NO: 7514380 - DNA, 22 bp, Homo sapiens
gtgcagcaaactagtgcgaggg

SEQ ID NO: 7514381 - DNA, 22 bp, Homo sapiens
gtgcagcaaactagtgcgaggg

SEQ ID NO: 7514382 - DNA, 22 bp, Homo sapiens
gtgcagcaaactagtgcgaggg

SEQ ID NO: 7514383 - DNA, 22 bp, Homo sapiens
gtgcagcaaactagtgcgaggg

SEQ ID NO: 7514384 - DNA, 22 bp, Homo sapiens
gtgcagcaaagtttgagatata

SEQ ID NO: 7514385 - DNA, 22 bp, Homo sapiens
gtgcagcaaactagtgcgaggg

SEQ ID NO: 7514386 - DNA, 22 bp, Homo sapiens
gtgcagcaaactagtgcgaggg

SEQ ID NO: 7514387 - DNA, 22 bp, Homo sapiens
gtgcagcaaagtttgagatata

SEQ ID NO: 7514388 - DNA, 22 bp, Homo sapiens
gtgcagcaaagtttgagatata

SEQ ID NO: 7514389 - DNA, 22 bp, Homo sapiens
gtgccagaaggttcccgctgca

SEQ ID NO: 7514390 - DNA, 22 bp, Homo sapiens
gtgccagacagggcagtggtat

SEQ ID NO: 7514391 - DNA, 22 bp, Homo sapiens
gtgccagagcaatcaggctctg

SEQ ID NO: 7514392 - DNA, 22 bp, Homo sapiens
gtgccagagcaatcaggctctg

SEQ ID NO: 7514393 - DNA, 22 bp, Homo sapiens
gtgccagagatgacaggcctgc

SEQ ID NO: 7514394 - DNA, 22 bp, Homo sapiens
gtgccagagatgacaggcctgc

SEQ ID NO: 7514395 - DNA, 22 bp, Homo sapiens
gtgccagagtttgaggacaatt

SEQ ID NO: 7514396 - DNA, 22 bp, Homo sapiens
gtgccagaggcagtgaggagtt

SEQ ID NO: 7514397 - DNA, 22 bp, Homo sapiens
gtgccagaggcagtgaggagtt

SEQ ID NO: 7514398 - DNA, 22 bp, Homo sapiens
gtgccagccgcaccccaggaga

SEQ ID NO: 7514399 - DNA, 22 bp, Homo sapiens
gtgccagccgcaccccaggaga

SEQ ID NO: 7514400 - DNA, 22 bp, Homo sapiens
gtgccagagtttgaggacaatt

SEQ ID NO: 7514401 - DNA, 22 bp, Homo sapiens
gtgccagcagttatggtgattt

SEQ ID NO: 7514402 - DNA, 22 bp, Homo sapiens
gtgcaggggatcaggttgcagc

SEQ ID NO: 7514403 - DNA, 22 bp, Homo sapiens
gtgcaggggatcaggttgcagc

SEQ ID NO: 7514404 - DNA, 22 bp, Homo sapiens
gtgcaggggatcaggttgcagc

SEQ ID NO: 7514405 - DNA, 22 bp, Homo sapiens
gtgcaggggatcaggttgcagc

SEQ ID NO: 7514406 - DNA, 22 bp, Homo sapiens
gtgcaggggcctccccttgctg

SEQ ID NO: 7514407 - DNA, 22 bp, Homo sapiens
gtgcagggtagcgacggcagga

SEQ ID NO: 7514408 - DNA, 22 bp, Homo sapiens
gtgccaccttcaaatcacattg

SEQ ID NO: 7514409 - DNA, 22 bp, Homo sapiens
gtgcagggtagcgacggcagga

SEQ ID NO: 7514410 - DNA, 22 bp, Homo sapiens
gtgcagggtagcgacggcagga

SEQ ID NO: 7514411 - DNA, 22 bp, Homo sapiens
gtgccactgataaatcagaatg

SEQ ID NO: 7514412 - DNA, 22 bp, Homo sapiens
gtgccactgataaatcagaatg

SEQ ID NO: 7514413 - DNA, 22 bp, Homo sapiens
gtgcagggtagcgacggcagga

SEQ ID NO: 7514414 - DNA, 22 bp, Homo sapiens
gtgcagggtagcgacggcagga

SEQ ID NO: 7514415 - DNA, 22 bp, Homo sapiens
gtgcagggtagcgacggcagga

SEQ ID NO: 7514416 - DNA, 22 bp, Homo sapiens
gtgcagggtagcgacggcagga

SEQ ID NO: 7514417 - DNA, 22 bp, Homo sapiens
gtgcagggctggcaccggaggc

SEQ ID NO: 7514418 - DNA, 22 bp, Homo sapiens
gtgcaggggatcaggttgcagc

SEQ ID NO: 7514419 - DNA, 22 bp, Homo sapiens
gtgcaggggatcaggttgcagc

SEQ ID NO: 7514420 - DNA, 22 bp, Homo sapiens
gtgcaggggatcaggttgcagc

SEQ ID NO: 7514421 - DNA, 22 bp, Homo sapiens
gtgcagggctggcaccggaggc

SEQ ID NO: 7514422 - DNA, 22 bp, Homo sapiens
gtgcagggcagccgaatgggct

SEQ ID NO: 7514423 - DNA, 22 bp, Homo sapiens
gtgcagggcagccgaatgggct

SEQ ID NO: 7514424 - DNA, 22 bp, Homo sapiens
gtgcagggcagccgaatgggct

SEQ ID NO: 7514425 - DNA, 22 bp, Homo sapiens
gtgcagggcaggtgtccttcca

SEQ ID NO: 7514426 - DNA, 22 bp, Homo sapiens
gtgcagggcaggtgtccttcca

SEQ ID NO: 7514427 - DNA, 22 bp, Homo sapiens
gtgcagggcaggtgtccttcca

SEQ ID NO: 7514428 - DNA, 17 bp, Homo sapiens
gtgcagggatgaaggat

SEQ ID NO: 7514429 - DNA, 17 bp, Homo sapiens
gtgcagggatgaaggat

SEQ ID NO: 7514430 - DNA, 17 bp, Homo sapiens
gtgcagggatgaaggat

SEQ ID NO: 7514431 - DNA, 17 bp, Homo sapiens
gtgcagggatgaaggat

SEQ ID NO: 7514432 - DNA, 17 bp, Homo sapiens
gtgcagggatgaaggat

SEQ ID NO: 7514433 - DNA, 17 bp, Homo sapiens
gtgcagggatgaaggat

SEQ ID NO: 7514434 - DNA, 17 bp, Homo sapiens
gtgcagggatgaaggat

SEQ ID NO: 7514435 - DNA, 22 bp, Homo sapiens
gtgcagggcagccgaatgggct

SEQ ID NO: 7514436 - DNA, 22 bp, Homo sapiens
gtgcagggcagccgaatgggct

SEQ ID NO: 7514437 - DNA, 22 bp, Homo sapiens
gtgcagggcagccgaatgggct

SEQ ID NO: 7514438 - DNA, 22 bp, Homo sapiens
gtgcagggcagccgaatgggct

SEQ ID NO: 7514439 - DNA, 22 bp, Homo sapiens
gtgcagggcagccgaatgggct

SEQ ID NO: 7514440 - DNA, 22 bp, Homo sapiens
gtgcagggcagccgaatgggct

SEQ ID NO: 7514441 - DNA, 22 bp, Homo sapiens
gtgcagggcagccgaatgggct

SEQ ID NO: 7514442 - DNA, 22 bp, Homo sapiens
gtgcagggcagccgaatgggct

SEQ ID NO: 7514443 - DNA, 22 bp, Homo sapiens
gtgagctgttggagtggcagag

SEQ ID NO: 7514444 - DNA, 22 bp, Homo sapiens
gtgagctgttggagtggcagag

SEQ ID NO: 7514445 - DNA, 22 bp, Homo sapiens
gtgagctgtctgagtctcttgg

SEQ ID NO: 7514446 - DNA, 22 bp, Homo sapiens
gtgagctgggtgaatggtaggg

SEQ ID NO: 7514447 - DNA, 17 bp, Homo sapiens
gtgagctgagtcaggac

SEQ ID NO: 7514448 - DNA, 22 bp, Homo sapiens
gtgagctggaatagtggagaaa

SEQ ID NO: 7514449 - DNA, 22 bp, Homo sapiens
gtgagctggaatagtggagaaa

SEQ ID NO: 7514450 - DNA, 17 bp, Homo sapiens
gtgagctgagtcaggac

SEQ ID NO: 7514451 - DNA, 22 bp, Homo sapiens
gtgagccgagtatagttcatag

SEQ ID NO: 7514452 - DNA, 22 bp, Homo sapiens
gtgagcgtggtcttctgtgggt

SEQ ID NO: 7514453 - DNA, 22 bp, Homo sapiens
gtgagctggaatagtggagaaa

SEQ ID NO: 7514454 - DNA, 22 bp, Homo sapiens
gtgagccattctactcctaacc

SEQ ID NO: 7514455 - DNA, 22 bp, Homo sapiens
gtgagccattctactcctaacc

SEQ ID NO: 7514456 - DNA, 22 bp, Homo sapiens
gtgagccagttcgactgtttct

SEQ ID NO: 7514457 - DNA, 22 bp, Homo sapiens
gtgagcatgtagtaatctggag

SEQ ID NO: 7514458 - DNA, 22 bp, Homo sapiens
gtgagccaataccatgctgttc

SEQ ID NO: 7514459 - DNA, 22 bp, Homo sapiens
gtgagcatcaaaaacgtgtatg

SEQ ID NO: 7514460 - DNA, 22 bp, Homo sapiens
gtgagcatcttggcagatatga

SEQ ID NO: 7514461 - DNA, 22 bp, Homo sapiens
gtgagcatatatgtaatcgttt

SEQ ID NO: 7514462 - DNA, 22 bp, Homo sapiens
gtgagcatatatgtaatcgttt

SEQ ID NO: 7514463 - DNA, 22 bp, Homo sapiens
gtgagcagtttgttccagaatc

SEQ ID NO: 7514464 - DNA, 22 bp, Homo sapiens
gtgagcagttgtgagccccaaa

SEQ ID NO: 7514465 - DNA, 22 bp, Homo sapiens
gtgagcagtttgttccagaatc

SEQ ID NO: 7514466 - DNA, 22 bp, Homo sapiens
gtgagcagttgtgagccccaaa

SEQ ID NO: 7514467 - DNA, 22 bp, Homo sapiens
gtgagcagttgtgagccccaaa

SEQ ID NO: 7514468 - DNA, 22 bp, Homo sapiens
gtgagcagttgtgagccccaaa

SEQ ID NO: 7514469 - DNA, 22 bp, Homo sapiens
gtgagcagttgtataaagactt

SEQ ID NO: 7514470 - DNA, 22 bp, Homo sapiens
gtgagcagtggccagggtccta

SEQ ID NO: 7514471 - DNA, 22 bp, Homo sapiens
gtgagcagtggccagggtccta

SEQ ID NO: 7514472 - DNA, 22 bp, Homo sapiens
gtgagcagtggccagggtccta

SEQ ID NO: 7514473 - DNA, 22 bp, Homo sapiens
gtgagcagtggccagggtccta

SEQ ID NO: 7514474 - DNA, 22 bp, Homo sapiens
gtgagcagttgtataaagactt

SEQ ID NO: 7514475 - DNA, 22 bp, Homo sapiens
gtgaggagctctttgactcacg

SEQ ID NO: 7514476 - DNA, 22 bp, Homo sapiens
gtgaggagctgacactggggtg

SEQ ID NO: 7514477 - DNA, 22 bp, Homo sapiens
gtgaggagctgacactggggtg

SEQ ID NO: 7514478 - DNA, 22 bp, Homo sapiens
gtgaggagctctttgactcacg

SEQ ID NO: 7514479 - DNA, 22 bp, Homo sapiens
gtgaggagctctttgactcacg

SEQ ID NO: 7514480 - DNA, 22 bp, Homo sapiens
gtgaggagctgacactggggtg

SEQ ID NO: 7514481 - DNA, 22 bp, Homo sapiens
gtgaggagctgacactggggtg

SEQ ID NO: 7514482 - DNA, 22 bp, Homo sapiens
gtgaggagctgacactggggtg

SEQ ID NO: 7514483 - DNA, 22 bp, Homo sapiens
gtgaggagctgacactggggtg

SEQ ID NO: 7514484 - DNA, 22 bp, Homo sapiens
gtgaggagctgacactggggtg

SEQ ID NO: 7514485 - DNA, 22 bp, Homo sapiens
gtgaggagctgacactggggtg

SEQ ID NO: 7514486 - DNA, 22 bp, Homo sapiens
gtgaggagtctgaagcacataa

SEQ ID NO: 7514487 - DNA, 22 bp, Homo sapiens
gtgaggagtctgaagcacataa

SEQ ID NO: 7514488 - DNA, 22 bp, Homo sapiens
gtgaggagtctgaagcacataa

SEQ ID NO: 7514489 - DNA, 22 bp, Homo sapiens
gtgaggagggctggtcccaggc

SEQ ID NO: 7514490 - DNA, 22 bp, Homo sapiens
gtgaggagtctgaagcacataa

SEQ ID NO: 7514491 - DNA, 22 bp, Homo sapiens
gtgaggagggctggtcccaggc

SEQ ID NO: 7514492 - DNA, 22 bp, Homo sapiens
gtgaggagggctggtcccaggc

SEQ ID NO: 7514493 - DNA, 22 bp, Homo sapiens
gtgaggagggctggtcccaggc

SEQ ID NO: 7514494 - DNA, 22 bp, Homo sapiens
gtgaggagggctggtcccaggc

SEQ ID NO: 7514495 - DNA, 22 bp, Homo sapiens
gtgaggactggtaaggactgca

SEQ ID NO: 7514496 - DNA, 22 bp, Homo sapiens
gtgaggactggtaaggactgca

SEQ ID NO: 7514497 - DNA, 22 bp, Homo sapiens
gtgaggaagtggtcaggcatcc

SEQ ID NO: 7514498 - DNA, 22 bp, Homo sapiens
gtgaggaatcggttcacggtga

SEQ ID NO: 7514499 - DNA, 22 bp, Homo sapiens
gtgaggaatcggttcacggtga

SEQ ID NO: 7514500 - DNA, 22 bp, Homo sapiens
gtgaggaatcggttcacggtga

SEQ ID NO: 7514501 - DNA, 22 bp, Homo sapiens
gtgaggaagtgtttgtcaaatt

SEQ ID NO: 7514502 - DNA, 22 bp, Homo sapiens
gtgaggaagtgtttgtcaaatt

SEQ ID NO: 7514503 - DNA, 22 bp, Homo sapiens
gtgaggaagtggtcaggcatcc

SEQ ID NO: 7514504 - DNA, 22 bp, Homo sapiens
gtgaggaagtggtcaggcatcc

SEQ ID NO: 7514505 - DNA, 22 bp, Homo sapiens
gtgaggaagtggtcaggcatcc

SEQ ID NO: 7514506 - DNA, 22 bp, Homo sapiens
gtgaggaagtctgagagccaca

SEQ ID NO: 7514507 - DNA, 22 bp, Homo sapiens
gtgagctttgtggtaatgaagt

SEQ ID NO: 7514508 - DNA, 22 bp, Homo sapiens
gtgagcttctgcctctcagtcc

SEQ ID NO: 7514509 - DNA, 22 bp, Homo sapiens
gtgagcttctgcctctcagtcc

SEQ ID NO: 7514510 - DNA, 22 bp, Homo sapiens
gtgagctttgtggtaatgaagt

SEQ ID NO: 7514511 - DNA, 22 bp, Homo sapiens
gtgagcttctgacagatgcacc

SEQ ID NO: 7514512 - DNA, 22 bp, Homo sapiens
gtgagctgttttggacccatct

SEQ ID NO: 7514513 - DNA, 22 bp, Homo sapiens
gtgagctgttggagtggcagag

SEQ ID NO: 7514514 - DNA, 22 bp, Homo sapiens
gtgagctgttttggacccatct

SEQ ID NO: 7514515 - DNA, 22 bp, Homo sapiens
gtctttatttgagattgtcatt

SEQ ID NO: 7514516 - DNA, 22 bp, Homo sapiens
gtctttcactgcggtttacatg

SEQ ID NO: 7514517 - DNA, 22 bp, Homo sapiens
gtctttcatggatattcagttt

SEQ ID NO: 7514518 - DNA, 22 bp, Homo sapiens
gtctttcatggatattcagttt

SEQ ID NO: 7514519 - DNA, 22 bp, Homo sapiens
gtctttatttgagattgtcatt

SEQ ID NO: 7514520 - DNA, 22 bp, Homo sapiens
gtctttatttgagattgtcatt

SEQ ID NO: 7514521 - DNA, 22 bp, Homo sapiens
gtctttatttgagattgtcatt

SEQ ID NO: 7514522 - DNA, 22 bp, Homo sapiens
gtctttatttgagattgtcatt

SEQ ID NO: 7514523 - DNA, 22 bp, Homo sapiens
gtctttcatggatattcagttt

SEQ ID NO: 7514524 - DNA, 22 bp, Homo sapiens
gtctttccttataatgccctaa

SEQ ID NO: 7514525 - DNA, 22 bp, Homo sapiens
gtctttccttataatgccctaa

SEQ ID NO: 7514526 - DNA, 21 bp, Homo sapiens
gtctttctacctctatgtggc

SEQ ID NO: 7514527 - DNA, 21 bp, Homo sapiens
gtctttctacctctatgtggc

SEQ ID NO: 7514528 - DNA, 21 bp, Homo sapiens
gtctttctacctctatgtggc

SEQ ID NO: 7514529 - DNA, 22 bp, Homo sapiens
gtctttggatgtaagataaagt

SEQ ID NO: 7514530 - DNA, 22 bp, Homo sapiens
gtctttgtggtagtcctcagcc

SEQ ID NO: 7514531 - DNA, 22 bp, Homo sapiens
gtctttctatgcatagagcaga

SEQ ID NO: 7514532 - DNA, 22 bp, Homo sapiens
gtctttggatgtaagataaagt

SEQ ID NO: 7514533 - DNA, 22 bp, Homo sapiens
gtctttctatgcatagagcaga

SEQ ID NO: 7514534 - DNA, 22 bp, Homo sapiens
gtctttctatgcatagagcaga

SEQ ID NO: 7514535 - DNA, 22 bp, Homo sapiens
gtctttctatgatgaactgttg

SEQ ID NO: 7514536 - DNA, 22 bp, Homo sapiens
gtctttctatgcatagagcaga

SEQ ID NO: 7514537 - DNA, 21 bp, Homo sapiens
gtctttttaattgcgatttcc

SEQ ID NO: 7514538 - DNA, 21 bp, Homo sapiens
gtctttttaattgcgatttcc

SEQ ID NO: 7514539 - DNA, 22 bp, Homo sapiens
gtcttttgctagccagagagct

SEQ ID NO: 7514540 - DNA, 22 bp, Homo sapiens
gtcttttgctagccagagagct

SEQ ID NO: 7514541 - DNA, 18 bp, Homo sapiens
gtcttttctcccttcctc

SEQ ID NO: 7514542 - DNA, 21 bp, Homo sapiens
gtctttttaattgcgatttcc

SEQ ID NO: 7514543 - DNA, 21 bp, Homo sapiens
gtctttttaattgcgatttcc

SEQ ID NO: 7514544 - DNA, 21 bp, Homo sapiens
gtctttttaattgcgatttcc

SEQ ID NO: 7514545 - DNA, 21 bp, Homo sapiens
gtcttttaagtgaagagaggc

SEQ ID NO: 7514546 - DNA, 21 bp, Homo sapiens
gtcttttaagtgaagagaggc

SEQ ID NO: 7514547 - DNA, 21 bp, Homo sapiens
gtcttttaagtgaagagaggc

SEQ ID NO: 7514548 - DNA, 21 bp, Homo sapiens
gtcttttaagtgaagagaggc

SEQ ID NO: 7514549 - DNA, 22 bp, Homo sapiens
gtcttttttacaccttacatca

SEQ ID NO: 7514550 - DNA, 22 bp, Homo sapiens
gtcttttttacaccttacatca

SEQ ID NO: 7514551 - DNA, 22 bp, Homo sapiens
gtcttttttacaccttacatca

SEQ ID NO: 7514552 - DNA, 22 bp, Homo sapiens
gtcttttttacaccttacatca

SEQ ID NO: 7514553 - DNA, 22 bp, Homo sapiens
gtcttttttacaccttacatca

SEQ ID NO: 7514554 - DNA, 22 bp, Homo sapiens
gtcttttttacaccttacatca

SEQ ID NO: 7514555 - DNA, 22 bp, Homo sapiens
gtcttttttacaccttacatca

SEQ ID NO: 7514556 - DNA, 22 bp, Homo sapiens
gtcttttttacaccttacatca

SEQ ID NO: 7514557 - DNA, 22 bp, Homo sapiens
gtcttttttacaccttacatca

SEQ ID NO: 7514558 - DNA, 22 bp, Homo sapiens
gtcttttttacaccttacatca

SEQ ID NO: 7514559 - DNA, 22 bp, Homo sapiens
gtctttttgtctggcagaggtc

SEQ ID NO: 7514560 - DNA, 22 bp, Homo sapiens
gtctttttgtctggcagaggtc

SEQ ID NO: 7514561 - DNA, 22 bp, Homo sapiens
gtctttttattatagagtggag

SEQ ID NO: 7514562 - DNA, 22 bp, Homo sapiens
gtctttttattatagagtggag

SEQ ID NO: 7514563 - DNA, 22 bp, Homo sapiens
gtctttttattatagagtggag

SEQ ID NO: 7514564 - DNA, 22 bp, Homo sapiens
gtctttttattatagagtggag

SEQ ID NO: 7514565 - DNA, 22 bp, Homo sapiens
gtctttttattatagagtggag

SEQ ID NO: 7514566 - DNA, 22 bp, Homo sapiens
gtctttttgtctggcagaggtc

SEQ ID NO: 7514567 - DNA, 22 bp, Homo sapiens
gtctttttgtctggcagaggtc

SEQ ID NO: 7514568 - DNA, 22 bp, Homo sapiens
gtctttttctacgatagcgcct

SEQ ID NO: 7514569 - DNA, 22 bp, Homo sapiens
gtctttttgtctggcagaggtc

SEQ ID NO: 7514570 - DNA, 22 bp, Homo sapiens
gtctttttgtctggcagaggtc

SEQ ID NO: 7514571 - DNA, 22 bp, Homo sapiens
gtctttttctacgatagcgcct

SEQ ID NO: 7514572 - DNA, 22 bp, Homo sapiens
gtctttttctacgatagcgcct

SEQ ID NO: 7514573 - DNA, 22 bp, Homo sapiens
gtctttttctacgatagcgcct

SEQ ID NO: 7514574 - DNA, 22 bp, Homo sapiens
gtgaaaaatcatcatgacttga

SEQ ID NO: 7514575 - DNA, 22 bp, Homo sapiens
gtgaaaaatcatcatgacttga

SEQ ID NO: 7514576 - DNA, 22 bp, Homo sapiens
gtgaaaaatcatcatgacttga

SEQ ID NO: 7514577 - DNA, 22 bp, Homo sapiens
gtgaaaaatcatcatgacttga

SEQ ID NO: 7514578 - DNA, 22 bp, Homo sapiens
gtgaaaaatcatcatgacttga

SEQ ID NO: 7514579 - DNA, 22 bp, Homo sapiens
gtgaaaaatgatttgttaactg

SEQ ID NO: 7514580 - DNA, 22 bp, Homo sapiens
gtgaaaagagagcctgtgtcag

SEQ ID NO: 7514581 - DNA, 22 bp, Homo sapiens
gtgagcagggcaggactgggga

SEQ ID NO: 7514582 - DNA, 22 bp, Homo sapiens
gtgagcagtggccagggtccta

SEQ ID NO: 7514583 - DNA, 22 bp, Homo sapiens
gtgaaaaatgatttgttaactg

SEQ ID NO: 7514584 - DNA, 22 bp, Homo sapiens
gtgaaaaatgatttgttaactg

SEQ ID NO: 7514585 - DNA, 22 bp, Homo sapiens
gtgaaaaatgatttgttaactg

SEQ ID NO: 7514586 - DNA, 22 bp, Homo sapiens
gtctttagagctcctggcatct

SEQ ID NO: 7514587 - DNA, 22 bp, Homo sapiens
gtctttagagctcctggcatct

SEQ ID NO: 7514588 - DNA, 22 bp, Homo sapiens
gtctttagttgaaacatgtggt

SEQ ID NO: 7514589 - DNA, 22 bp, Homo sapiens
gtctttagttgaaacatgtggt

SEQ ID NO: 7514590 - DNA, 22 bp, Homo sapiens
gtctttaagggactgaatttgg

SEQ ID NO: 7514591 - DNA, 22 bp, Homo sapiens
gtctttaagggactgaatttgg

SEQ ID NO: 7514592 - DNA, 22 bp, Homo sapiens
gtctttaagggactgaatttgg

SEQ ID NO: 7514593 - DNA, 22 bp, Homo sapiens
gtctttaagggactgaatttgg

SEQ ID NO: 7514594 - DNA, 22 bp, Homo sapiens
gtcttgttggagttcttgcagc

SEQ ID NO: 7514595 - DNA, 22 bp, Homo sapiens
gtcttgtttgggatgtggatgg

SEQ ID NO: 7514596 - DNA, 21 bp, Homo sapiens
gtctttaaaaaaggctgatac

SEQ ID NO: 7514597 - DNA, 21 bp, Homo sapiens
gtctttaaaaaaggctgatac

SEQ ID NO: 7514598 - DNA, 22 bp, Homo sapiens
gtcttgggacccgcactgtggg

SEQ ID NO: 7514599 - DNA, 22 bp, Homo sapiens
gtcttgtcagtgttggcagctt

SEQ ID NO: 7514600 - DNA, 19 bp, Homo sapiens
gtcttgtaacacataagtg

SEQ ID NO: 7514601 - DNA, 22 bp, Homo sapiens
gtcttgtccattccatgctgct

SEQ ID NO: 7514602 - DNA, 22 bp, Homo sapiens
gtcttgtccattccatgctgct

SEQ ID NO: 7514603 - DNA, 22 bp, Homo sapiens
gtcttgttaagattttggaata

SEQ ID NO: 7514604 - DNA, 23 bp, Homo sapiens
gtctttatagtggggcactttgt

SEQ ID NO: 7514605 - DNA, 23 bp, Homo sapiens
gtctttatagtggggcactttgt

SEQ ID NO: 7514606 - DNA, 22 bp, Homo sapiens
gtctttaagggactgaatttgg

SEQ ID NO: 7514607 - DNA, 22 bp, Homo sapiens
gtctttatatttactaaagaat

SEQ ID NO: 7514608 - DNA, 22 bp, Homo sapiens
gtctttatatttactaaagaat

SEQ ID NO: 7514609 - DNA, 22 bp, Homo sapiens
gtctttatatttactaaagaat

SEQ ID NO: 7514610 - DNA, 22 bp, Homo sapiens
gtctttatctttgaaattagtc

SEQ ID NO: 7514611 - DNA, 22 bp, Homo sapiens
gtctttatctttgaaattagtc

SEQ ID NO: 7514612 - DNA, 22 bp, Homo sapiens
gtctttatctttgaaattagtc

SEQ ID NO: 7514613 - DNA, 22 bp, Homo sapiens
gtctttatggtatgaaaactga

SEQ ID NO: 7514614 - DNA, 22 bp, Homo sapiens
gtctttatggtatgaaaactga

SEQ ID NO: 7514615 - DNA, 16 bp, Homo sapiens
gtctttattcacttag

SEQ ID NO: 7514616 - DNA, 16 bp, Homo sapiens
gtctttattcacttag

SEQ ID NO: 7514617 - DNA, 22 bp, Homo sapiens
gtctttattacaaatccttttc

SEQ ID NO: 7514618 - DNA, 22 bp, Homo sapiens
gtctttattacaaatccttttc

SEQ ID NO: 7514619 - DNA, 22 bp, Homo sapiens
gtctttattacaaatccttttc

SEQ ID NO: 7514620 - DNA, 22 bp, Homo sapiens
gtctttattacaaatccttttc

SEQ ID NO: 7514621 - DNA, 22 bp, Homo sapiens
gtctttattacaaatccttttc

SEQ ID NO: 7514622 - DNA, 20 bp, Homo sapiens
gtctttatgttttatgacct

SEQ ID NO: 7514623 - DNA, 20 bp, Homo sapiens
gtctttatgttttatgacct

SEQ ID NO: 7514624 - DNA, 20 bp, Homo sapiens
gtctttatgttttatgacct

SEQ ID NO: 7514625 - DNA, 20 bp, Homo sapiens
gtctttatgttttatgacct

SEQ ID NO: 7514626 - DNA, 22 bp, Homo sapiens
gtctcccaatccgggacagcct

SEQ ID NO: 7514627 - DNA, 22 bp, Homo sapiens
gtctcccaatccgggacagcct

SEQ ID NO: 7514628 - DNA, 22 bp, Homo sapiens
gtctcccaatccgggacagcct

SEQ ID NO: 7514629 - DNA, 22 bp, Homo sapiens
gtctcccaacccctgtgcccag

SEQ ID NO: 7514630 - DNA, 22 bp, Homo sapiens
gtctcccaaactctgatggtcc

SEQ ID NO: 7514631 - DNA, 22 bp, Homo sapiens
gtctccatggaaagtagccagt

SEQ ID NO: 7514632 - DNA, 22 bp, Homo sapiens
gtctccatggaaagtagccagt

SEQ ID NO: 7514633 - DNA, 22 bp, Homo sapiens
gtctccagttacagcagccagg

SEQ ID NO: 7514634 - DNA, 22 bp, Homo sapiens
gtctccagttacagcagccagg

SEQ ID NO: 7514635 - DNA, 22 bp, Homo sapiens
gtcttgatctcctgaccttgtg

SEQ ID NO: 7514636 - DNA, 22 bp, Homo sapiens
gtctcccaatccgggacagcct

SEQ ID NO: 7514637 - DNA, 22 bp, Homo sapiens
gtcttgatctcctgaccttgtg

SEQ ID NO: 7514638 - DNA, 22 bp, Homo sapiens
gtcttgatctcctgaccttgtg

SEQ ID NO: 7514639 - DNA, 22 bp, Homo sapiens
gtcttgcacatcttcactgtta

SEQ ID NO: 7514640 - DNA, 22 bp, Homo sapiens
gtcttgatctcctgaccttgtg

SEQ ID NO: 7514641 - DNA, 21 bp, Homo sapiens
gtcttggcaccaggagagaga

SEQ ID NO: 7514642 - DNA, 22 bp, Homo sapiens
gtcttggatatgtttgccttca

SEQ ID NO: 7514643 - DNA, 19 bp, Homo sapiens
gtcttggctctcaaccatc

SEQ ID NO: 7514644 - DNA, 22 bp, Homo sapiens
gtcttggccgtgcagatgaaga

SEQ ID NO: 7514645 - DNA, 22 bp, Homo sapiens
gtctccagttacagcagccagg

SEQ ID NO: 7514646 - DNA, 22 bp, Homo sapiens
gtctccagttacagcagccagg

SEQ ID NO: 7514647 - DNA, 22 bp, Homo sapiens
gtctccagtgttcaggtgactg

SEQ ID NO: 7514648 - DNA, 22 bp, Homo sapiens
gtctccagtgttcaggtgactg

SEQ ID NO: 7514649 - DNA, 22 bp, Homo sapiens
gtctccagggctgctggcgcct

SEQ ID NO: 7514650 - DNA, 22 bp, Homo sapiens
gtctccagggctgctggcgcct

SEQ ID NO: 7514651 - DNA, 22 bp, Homo sapiens
gtctccagtgttcaggtgactg

SEQ ID NO: 7514652 - DNA, 22 bp, Homo sapiens
gtctccagtgttcaggtgactg

SEQ ID NO: 7514653 - DNA, 22 bp, Homo sapiens
gtctccagtgttcaggtgactg

SEQ ID NO: 7514654 - DNA, 22 bp, Homo sapiens
gtctccagtgttcaggtgactg

SEQ ID NO: 7514655 - DNA, 22 bp, Homo sapiens
gtctccagggacacactagccg

SEQ ID NO: 7514656 - DNA, 22 bp, Homo sapiens
gtctccagggacacactagccg

SEQ ID NO: 7514657 - DNA, 22 bp, Homo sapiens
gtctccagggctgctggcgcct

SEQ ID NO: 7514658 - DNA, 22 bp, Homo sapiens
gtctccagggctgctggcgcct

SEQ ID NO: 7514659 - DNA, 22 bp, Homo sapiens
gtctccagggctgctggcgcct

SEQ ID NO: 7514660 - DNA, 22 bp, Homo sapiens
gtctccagcccactctagatat

SEQ ID NO: 7514661 - DNA, 22 bp, Homo sapiens
gtctacactgaatttccacaga

SEQ ID NO: 7514662 - DNA, 22 bp, Homo sapiens
gtctacactgaatttccacaga

SEQ ID NO: 7514663 - DNA, 22 bp, Homo sapiens
gtctacagtgaatgggtcctaa

SEQ ID NO: 7514664 - DNA, 22 bp, Homo sapiens
gtctacttttgtcatcattgca

SEQ ID NO: 7514665 - DNA, 22 bp, Homo sapiens
gtctacatgtgttcttaagaga

SEQ ID NO: 7514666 - DNA, 22 bp, Homo sapiens
gtctacaaagcatataaaagag

SEQ ID NO: 7514667 - DNA, 22 bp, Homo sapiens
gtctaattcctgctcttactca

SEQ ID NO: 7514668 - DNA, 22 bp, Homo sapiens
gtctacaaagcatataaaagag

SEQ ID NO: 7514669 - DNA, 20 bp, Homo sapiens
gtctacacgggcagtgtaga

SEQ ID NO: 7514670 - DNA, 20 bp, Homo sapiens
gtctacacgggcagtgtaga

SEQ ID NO: 7514671 - DNA, 20 bp, Homo sapiens
gtctacacgggcagtgtaga

SEQ ID NO: 7514672 - DNA, 22 bp, Homo sapiens
gtctaattcctgctcttactca

SEQ ID NO: 7514673 - DNA, 22 bp, Homo sapiens
gtctaagtgggtggcactgaca

SEQ ID NO: 7514674 - DNA, 22 bp, Homo sapiens
gtctaagtgggtggcactgaca

SEQ ID NO: 7514675 - DNA, 21 bp, Homo sapiens
gtctaactggtctccttgctt

SEQ ID NO: 7514676 - DNA, 22 bp, Homo sapiens
gtctaaactttacagagtcaag

SEQ ID NO: 7514677 - DNA, 22 bp, Homo sapiens
gtctaaagcccttagaatagta

SEQ ID NO: 7514678 - DNA, 22 bp, Homo sapiens
gtctaaagcccttagaatagta

SEQ ID NO: 7514679 - DNA, 22 bp, Homo sapiens
gtctaaagtctatacttttgtg

SEQ ID NO: 7514680 - DNA, 22 bp, Homo sapiens
gtctaaagtctatacttttgtg

SEQ ID NO: 7514681 - DNA, 22 bp, Homo sapiens
gtctagaaataggtttcagaaa

SEQ ID NO: 7514682 - DNA, 22 bp, Homo sapiens
gtctagaaaatgccgagggatg

SEQ ID NO: 7514683 - DNA, 22 bp, Homo sapiens
gtctagaaatgttctcaggggt

SEQ ID NO: 7514684 - DNA, 19 bp, Homo sapiens
gtctagaacattgtaggtg

SEQ ID NO: 7514685 - DNA, 22 bp, Homo sapiens
gtctagaaatgccatacgtgcc

SEQ ID NO: 7514686 - DNA, 22 bp, Homo sapiens
gtctagaaatcatgtactgtga

SEQ ID NO: 7514687 - DNA, 22 bp, Homo sapiens
gtctagaattgcttggcagatg

SEQ ID NO: 7514688 - DNA, 22 bp, Homo sapiens
gtctagaattgcttggcagatg

SEQ ID NO: 7514689 - DNA, 22 bp, Homo sapiens
gtctagaatggatgagcatttt

SEQ ID NO: 7514690 - DNA, 22 bp, Homo sapiens
gtctagaatatctagaaagatc

SEQ ID NO: 7514691 - DNA, 19 bp, Homo sapiens
gtctagaacattgtaggtg

SEQ ID NO: 7514692 - DNA, 22 bp, Homo sapiens
gtctagaatatctagaaagatc

SEQ ID NO: 7514693 - DNA, 22 bp, Homo sapiens
gtctatatattgcttgaataat

SEQ ID NO: 7514694 - DNA, 22 bp, Homo sapiens
gtctatatattgcttgaataat

SEQ ID NO: 7514695 - DNA, 22 bp, Homo sapiens
gtctatgatattttgttatagc

SEQ ID NO: 7514696 - DNA, 22 bp, Homo sapiens
gtctatgatattttgttatagc

SEQ ID NO: 7514697 - DNA, 22 bp, Homo sapiens
gtctatgatattttgttatagc

SEQ ID NO: 7514698 - DNA, 22 bp, Homo sapiens
gtctatgatattttgttatagc

SEQ ID NO: 7514699 - DNA, 22 bp, Homo sapiens
gtctatgatattttgttatagc

SEQ ID NO: 7514700 - DNA, 22 bp, Homo sapiens
gtctatgatattttgttatagc

SEQ ID NO: 7514701 - DNA, 18 bp, Homo sapiens
gtctaggaggtcacaagg

SEQ ID NO: 7514702 - DNA, 22 bp, Homo sapiens
gtctagagaggaaggaagtgtg

SEQ ID NO: 7514703 - DNA, 22 bp, Homo sapiens
gtctagagaggaaggaagtgtg

SEQ ID NO: 7514704 - DNA, 22 bp, Homo sapiens
gtctagggtctgtagtgcatgt

SEQ ID NO: 7514705 - DNA, 22 bp, Homo sapiens
gtctaggccatcacaggcgcca

SEQ ID NO: 7514706 - DNA, 22 bp, Homo sapiens
gtctagggctcctcagtgacaa

SEQ ID NO: 7514707 - DNA, 22 bp, Homo sapiens
gtctataagcaggggaaaactt

SEQ ID NO: 7514708 - DNA, 22 bp, Homo sapiens
gtctataagcaggggaaaactt

SEQ ID NO: 7514709 - DNA, 22 bp, Homo sapiens
gtctataagtacaattgcactc

SEQ ID NO: 7514710 - DNA, 22 bp, Homo sapiens
gtctataagtacaattgcactc

SEQ ID NO: 7514711 - DNA, 22 bp, Homo sapiens
gtctccagaggttacatcctgt

SEQ ID NO: 7514712 - DNA, 22 bp, Homo sapiens
gtctccagaggttacatcctgt

SEQ ID NO: 7514713 - DNA, 22 bp, Homo sapiens
gtctccagaattcttgggaggg

SEQ ID NO: 7514714 - DNA, 22 bp, Homo sapiens
gtctccagaattcttgggaggg

SEQ ID NO: 7514715 - DNA, 22 bp, Homo sapiens
gtctccagaattcttgggaggg

SEQ ID NO: 7514716 - DNA, 22 bp, Homo sapiens
gtctatgtgtaatagcatgtgt

SEQ ID NO: 7514717 - DNA, 22 bp, Homo sapiens
gtctccagaagcctagacagcc

SEQ ID NO: 7514718 - DNA, 22 bp, Homo sapiens
gtctatttgggatcatgatatg

SEQ ID NO: 7514719 - DNA, 22 bp, Homo sapiens
gtctatttgggatcatgatatg

SEQ ID NO: 7514720 - DNA, 22 bp, Homo sapiens
gtctatttgggatcatgatatg

SEQ ID NO: 7514721 - DNA, 22 bp, Homo sapiens
gtctccagatatcctacacaac

SEQ ID NO: 7514722 - DNA, 22 bp, Homo sapiens
gtctccagccattctctgatca

SEQ ID NO: 7514723 - DNA, 22 bp, Homo sapiens
gtctccagcccactctagatat

SEQ ID NO: 7514724 - DNA, 22 bp, Homo sapiens
gtctccagcccactctagatat

SEQ ID NO: 7514725 - DNA, 22 bp, Homo sapiens
gtccagcccctgactcccaggc

SEQ ID NO: 7514726 - DNA, 22 bp, Homo sapiens
gtccagcccctgactcccaggc

SEQ ID NO: 7514727 - DNA, 22 bp, Homo sapiens
gtccagcccctgactcccaggc

SEQ ID NO: 7514728 - DNA, 22 bp, Homo sapiens
gtccagccaggctgcagcaccc

SEQ ID NO: 7514729 - DNA, 22 bp, Homo sapiens
gtccagcccctgactcccaggc

SEQ ID NO: 7514730 - DNA, 22 bp, Homo sapiens
gtccagccaggcctgtctctgg

SEQ ID NO: 7514731 - DNA, 22 bp, Homo sapiens
gtccagccaggcctgtctctgg

SEQ ID NO: 7514732 - DNA, 22 bp, Homo sapiens
gtccagccaggcctgtctctgg

SEQ ID NO: 7514733 - DNA, 21 bp, Homo sapiens
gtccagagagccggctcctga

SEQ ID NO: 7514734 - DNA, 21 bp, Homo sapiens
gtccagagagccggctcctga

SEQ ID NO: 7514735 - DNA, 22 bp, Homo sapiens
gtccagccaggcctgtctctgg

SEQ ID NO: 7514736 - DNA, 22 bp, Homo sapiens
gtccagccaggctgcagcaccc

SEQ ID NO: 7514737 - DNA, 22 bp, Homo sapiens
gtccagccaggctgcagcaccc

SEQ ID NO: 7514738 - DNA, 22 bp, Homo sapiens
gtccagccctctgcctccaggt

SEQ ID NO: 7514739 - DNA, 22 bp, Homo sapiens
gtccagccctctgcctccaggt

SEQ ID NO: 7514740 - DNA, 22 bp, Homo sapiens
gtccagcccttgcagcttcttt

SEQ ID NO: 7514741 - DNA, 22 bp, Homo sapiens
gtccagccctctgcctccaggt

SEQ ID NO: 7514742 - DNA, 22 bp, Homo sapiens
gtccagcccgggctccgccagc

SEQ ID NO: 7514743 - DNA, 22 bp, Homo sapiens
gtccagcccgggctccgccagc

SEQ ID NO: 7514744 - DNA, 22 bp, Homo sapiens
gtccagcccgggctccgccagc

SEQ ID NO: 7514745 - DNA, 22 bp, Homo sapiens
gtccagccctctgcctccaggt

SEQ ID NO: 7514746 - DNA, 22 bp, Homo sapiens
gtccagcccgggctccgccagc

SEQ ID NO: 7514747 - DNA, 22 bp, Homo sapiens
gtccagccctctgcctccaggt

SEQ ID NO: 7514748 - DNA, 22 bp, Homo sapiens
gtccagctgggccagggcactc

SEQ ID NO: 7514749 - DNA, 22 bp, Homo sapiens
gtccagctgatcttgacccagc

SEQ ID NO: 7514750 - DNA, 22 bp, Homo sapiens
gtccagctgcagctgggcagaa

SEQ ID NO: 7514751 - DNA, 22 bp, Homo sapiens
gtccagctgatcttgacccagc

SEQ ID NO: 7514752 - DNA, 22 bp, Homo sapiens
gtccagctctgagaagaaacat

SEQ ID NO: 7514753 - DNA, 22 bp, Homo sapiens
gtccagctctcagatggctgca

SEQ ID NO: 7514754 - DNA, 22 bp, Homo sapiens
gtccagctccagggaggcaggc

SEQ ID NO: 7514755 - DNA, 22 bp, Homo sapiens
gtccagctccagggaggcaggc

SEQ ID NO: 7514756 - DNA, 22 bp, Homo sapiens
gtccagcctgaagagtgggggc

SEQ ID NO: 7514757 - DNA, 19 bp, Homo sapiens
gtccagcctttgggtctta

SEQ ID NO: 7514758 - DNA, 19 bp, Homo sapiens
gtccagcctttgggtctta

SEQ ID NO: 7514759 - DNA, 22 bp, Homo sapiens
gtccagctccagggaggcaggc

SEQ ID NO: 7514760 - DNA, 19 bp, Homo sapiens
gtccagcctttgggtctta

SEQ ID NO: 7514761 - DNA, 22 bp, Homo sapiens
gtccagcctgaagagtgggggc

SEQ ID NO: 7514762 - DNA, 22 bp, Homo sapiens
gtccagcctgaagagtgggggc

SEQ ID NO: 7514763 - DNA, 22 bp, Homo sapiens
gtccagcctgaagagtgggggc

SEQ ID NO: 7514764 - DNA, 22 bp, Homo sapiens
gtccagcccttgcagcttcttt

SEQ ID NO: 7514765 - DNA, 22 bp, Homo sapiens
gtccagcccttgcagcttcttt

SEQ ID NO: 7514766 - DNA, 22 bp, Homo sapiens
gtccagaaggaggtcaagttgg

SEQ ID NO: 7514767 - DNA, 22 bp, Homo sapiens
gtccagaagctcaagttgaact

SEQ ID NO: 7514768 - DNA, 22 bp, Homo sapiens
gtccagaaggaggtcaagttgg

SEQ ID NO: 7514769 - DNA, 22 bp, Homo sapiens
gtccagaattactactgtttga

SEQ ID NO: 7514770 - DNA, 22 bp, Homo sapiens
gtccagaattactactgtttga

SEQ ID NO: 7514771 - DNA, 22 bp, Homo sapiens
gtccagaattactactgtttga

SEQ ID NO: 7514772 - DNA, 22 bp, Homo sapiens
gtccagaattactactgtttga

SEQ ID NO: 7514773 - DNA, 22 bp, Homo sapiens
gtcagaggaggctgagtaggaa

SEQ ID NO: 7514774 - DNA, 22 bp, Homo sapiens
gtcagaggaggctgagtaggaa

SEQ ID NO: 7514775 - DNA, 22 bp, Homo sapiens
gtcagaggaggctgagtaggaa

SEQ ID NO: 7514776 - DNA, 22 bp, Homo sapiens
gtccagaagctcaagttgaact

SEQ ID NO: 7514777 - DNA, 22 bp, Homo sapiens
gtccagaagctcaagttgaact

SEQ ID NO: 7514778 - DNA, 22 bp, Homo sapiens
gtcagaggaggctgagtaggaa

SEQ ID NO: 7514779 - DNA, 22 bp, Homo sapiens
gtccagaagctcaagttgaact

SEQ ID NO: 7514780 - DNA, 22 bp, Homo sapiens
gtccagagagatcttctgatag

SEQ ID NO: 7514781 - DNA, 21 bp, Homo sapiens
gtccagagagccggctcctga

SEQ ID NO: 7514782 - DNA, 21 bp, Homo sapiens
gtccagagagccggctcctga

SEQ ID NO: 7514783 - DNA, 22 bp, Homo sapiens
gtccagagaagggaggggactc

SEQ ID NO: 7514784 - DNA, 22 bp, Homo sapiens
gtccagagaagggaggggactc

SEQ ID NO: 7514785 - DNA, 22 bp, Homo sapiens
gtccagagaagggaggggactc

SEQ ID NO: 7514786 - DNA, 22 bp, Homo sapiens
gtccagagaagtcattacttca

SEQ ID NO: 7514787 - DNA, 22 bp, Homo sapiens
gtccagagagatcttctgatag

SEQ ID NO: 7514788 - DNA, 22 bp, Homo sapiens
gtcagaggaatggatgagtgat

SEQ ID NO: 7514789 - DNA, 22 bp, Homo sapiens
gtcagaggaatggatgagtgat

SEQ ID NO: 7514790 - DNA, 22 bp, Homo sapiens
gtcagaggaatggatgagtgat

SEQ ID NO: 7514791 - DNA, 22 bp, Homo sapiens
gtcagagctgtgcaaggctgag

SEQ ID NO: 7514792 - DNA, 22 bp, Homo sapiens
gtcagaggaggctgagtaggaa

SEQ ID NO: 7514793 - DNA, 20 bp, Homo sapiens
gtcagaggaccctagagcga

SEQ ID NO: 7514794 - DNA, 20 bp, Homo sapiens
gtcagaggaccctagagcga

SEQ ID NO: 7514795 - DNA, 22 bp, Homo sapiens
gtcagagctggaggcaagttct

SEQ ID NO: 7514796 - DNA, 22 bp, Homo sapiens
gtcagagaactggattttccaa

SEQ ID NO: 7514797 - DNA, 22 bp, Homo sapiens
gtcagagacaaacttcctctct

SEQ ID NO: 7514798 - DNA, 22 bp, Homo sapiens
gtcagagagggcacgtgcacac

SEQ ID NO: 7514799 - DNA, 21 bp, Homo sapiens
gtcagagatgcccaactgcct

SEQ ID NO: 7514800 - DNA, 21 bp, Homo sapiens
gtcagagatgcccaactgcct

SEQ ID NO: 7514801 - DNA, 22 bp, Homo sapiens
gtcagagatggcatgaaagatt

SEQ ID NO: 7514802 - DNA, 22 bp, Homo sapiens
gtcacctggaggctgattaatg

SEQ ID NO: 7514803 - DNA, 22 bp, Homo sapiens
gtcacctctcatcacatgctac

SEQ ID NO: 7514804 - DNA, 22 bp, Homo sapiens
gtcaccctgctggctgttcagc

SEQ ID NO: 7514805 - DNA, 22 bp, Homo sapiens
gtcacctgaggggaggtgacag

SEQ ID NO: 7514806 - DNA, 22 bp, Homo sapiens
gtcacccgtttgactatccacc

SEQ ID NO: 7514807 - DNA, 22 bp, Homo sapiens
gtcaccctgctggctgttcagc

SEQ ID NO: 7514808 - DNA, 22 bp, Homo sapiens
gtcaccctgctgtttgtccatt

SEQ ID NO: 7514809 - DNA, 22 bp, Homo sapiens
gtcaccctgctgtttgtccatt

SEQ ID NO: 7514810 - DNA, 22 bp, Homo sapiens
gtcacctcgctgtcttcctgag

SEQ ID NO: 7514811 - DNA, 18 bp, Homo sapiens
gtcacctggatcagatta

SEQ ID NO: 7514812 - DNA, 22 bp, Homo sapiens
gtcaccttgaacaggctactca

SEQ ID NO: 7514813 - DNA, 22 bp, Homo sapiens
gtcaccttgaacaggctactca

SEQ ID NO: 7514814 - DNA, 22 bp, Homo sapiens
gtcactcaggctggagttcagt

SEQ ID NO: 7514815 - DNA, 18 bp, Homo sapiens
gtcactagttcaaacttc

SEQ ID NO: 7514816 - DNA, 22 bp, Homo sapiens
gtcactatcctgtgttgtttgt

SEQ ID NO: 7514817 - DNA, 22 bp, Homo sapiens
gtcacggttctctaaaacagga

SEQ ID NO: 7514818 - DNA, 18 bp, Homo sapiens
gtcactagttcaaacttc

SEQ ID NO: 7514819 - DNA, 22 bp, Homo sapiens
gtcactgactctgggagatgtg

SEQ ID NO: 7514820 - DNA, 22 bp, Homo sapiens
gtcactggaaatttcctttgtt

SEQ ID NO: 7514821 - DNA, 22 bp, Homo sapiens
gtcactggaattacaggcatgc

SEQ ID NO: 7514822 - DNA, 22 bp, Homo sapiens
gtcactggaattacaggcatgc

SEQ ID NO: 7514823 - DNA, 22 bp, Homo sapiens
gtcactgacaagagagaagaac

SEQ ID NO: 7514824 - DNA, 22 bp, Homo sapiens
gtcactgacatggtcattggca

SEQ ID NO: 7514825 - DNA, 22 bp, Homo sapiens
gtcactgcctcttaactttttc

SEQ ID NO: 7514826 - DNA, 22 bp, Homo sapiens
gtcactggagctcttgcggttc

SEQ ID NO: 7514827 - DNA, 22 bp, Homo sapiens
gtcactggaattacaggcatgc

SEQ ID NO: 7514828 - DNA, 22 bp, Homo sapiens
gtcactggaattacaggcatgc

SEQ ID NO: 7514829 - DNA, 22 bp, Homo sapiens
gtcactggggccacatgcagaa

SEQ ID NO: 7514830 - DNA, 22 bp, Homo sapiens
gtcactggggccacatgcagaa

SEQ ID NO: 7514831 - DNA, 22 bp, Homo sapiens
gtcactggggccacatgcagaa

SEQ ID NO: 7514832 - DNA, 22 bp, Homo sapiens
gtcactggggccacatgcagaa

SEQ ID NO: 7514833 - DNA, 22 bp, Homo sapiens
gtcactgtatccaggttccagc

SEQ ID NO: 7514834 - DNA, 22 bp, Homo sapiens
gtcactggggccacatgcagaa

SEQ ID NO: 7514835 - DNA, 22 bp, Homo sapiens
gtcactgtatccaggttccagc

SEQ ID NO: 7514836 - DNA, 22 bp, Homo sapiens
gtcactgtatccaggttccagc

SEQ ID NO: 7514837 - DNA, 22 bp, Homo sapiens
gtcactggagctcttgcggttc

SEQ ID NO: 7514838 - DNA, 22 bp, Homo sapiens
gtcactgtatccaggttccagc

SEQ ID NO: 7514839 - DNA, 22 bp, Homo sapiens
gtcactgtatccaggttccagc

SEQ ID NO: 7514840 - DNA, 22 bp, Homo sapiens
gtcagaaaccagtcaaacaaga

SEQ ID NO: 7514841 - DNA, 22 bp, Homo sapiens
gtcagaaaccagtcaaacaaga

SEQ ID NO: 7514842 - DNA, 22 bp, Homo sapiens
gtcagaaaccagtcaaacaaga

SEQ ID NO: 7514843 - DNA, 22 bp, Homo sapiens
gtcagaaaccagtcaaacaaga

SEQ ID NO: 7514844 - DNA, 22 bp, Homo sapiens
gtcagaagcatttgtggctgaa

SEQ ID NO: 7514845 - DNA, 22 bp, Homo sapiens
gtcagagaactggattttccaa

SEQ ID NO: 7514846 - DNA, 22 bp, Homo sapiens
gtcagacacatttctttcagtg

SEQ ID NO: 7514847 - DNA, 22 bp, Homo sapiens
gtcagacacatttctttcagtg

SEQ ID NO: 7514848 - DNA, 22 bp, Homo sapiens
gtcagaatttacttaatagcca

SEQ ID NO: 7514849 - DNA, 22 bp, Homo sapiens
gtcagaagcatttgtggctgaa

SEQ ID NO: 7514850 - DNA, 22 bp, Homo sapiens
gtcagaagcatttgtggctgaa

SEQ ID NO: 7514851 - DNA, 22 bp, Homo sapiens
gtcagaatttacttaatagcca

SEQ ID NO: 7514852 - DNA, 22 bp, Homo sapiens
gtcagaaaaagcaaggctgggc

SEQ ID NO: 7514853 - DNA, 22 bp, Homo sapiens
gtcagaaaaagcaaggctgggc

SEQ ID NO: 7514854 - DNA, 22 bp, Homo sapiens
gtcagaaaaagcaaggctgggc

SEQ ID NO: 7514855 - DNA, 22 bp, Homo sapiens
gtcacttttaagggccttttct

SEQ ID NO: 7514856 - DNA, 17 bp, Homo sapiens
gtcactttgtttaaagg

SEQ ID NO: 7514857 - DNA, 22 bp, Homo sapiens
gtcacttttaagggccttttct

SEQ ID NO: 7514858 - DNA, 17 bp, Homo sapiens
gtcactttgtttaaagg

SEQ ID NO: 7514859 - DNA, 22 bp, Homo sapiens
gtcactttggcctctacagcca

SEQ ID NO: 7514860 - DNA, 17 bp, Homo sapiens
gtcactttgtttaaagg

SEQ ID NO: 7514861 - DNA, 22 bp, Homo sapiens
gtcactttggcctctacagcca

SEQ ID NO: 7514862 - DNA, 22 bp, Homo sapiens
gtcactttggcctctacagcca

SEQ ID NO: 7514863 - DNA, 22 bp, Homo sapiens
gtcactttgaagctgtttttag

SEQ ID NO: 7514864 - DNA, 22 bp, Homo sapiens
gtcactttattaattttggtga

SEQ ID NO: 7514865 - DNA, 22 bp, Homo sapiens
gtcactttacactcctactaaa

SEQ ID NO: 7514866 - DNA, 22 bp, Homo sapiens
gtcactttcacactttattgct

SEQ ID NO: 7514867 - DNA, 22 bp, Homo sapiens
gtcactttattaattttggtga

SEQ ID NO: 7514868 - DNA, 22 bp, Homo sapiens
gtcactttattaattttggtga

SEQ ID NO: 7514869 - DNA, 22 bp, Homo sapiens
gtcactttgaagctgtttttag

SEQ ID NO: 7514870 - DNA, 22 bp, Homo sapiens
gtcactttgaagctgtttttag

SEQ ID NO: 7514871 - DNA, 22 bp, Homo sapiens
gtcactttctgtgagatgtagt

SEQ ID NO: 7514872 - DNA, 22 bp, Homo sapiens
gtcactttctgtgagatgtagt

SEQ ID NO: 7514873 - DNA, 22 bp, Homo sapiens
gtcactttcacactttattgct

SEQ ID NO: 7514874 - DNA, 22 bp, Homo sapiens
gtcactttcacactttattgct

SEQ ID NO: 7514875 - DNA, 22 bp, Homo sapiens
gtcactttacactcctactaaa

SEQ ID NO: 7514876 - DNA, 22 bp, Homo sapiens
gtcactttattaattttggtga

SEQ ID NO: 7514877 - DNA, 22 bp, Homo sapiens
gtcactttacactcctactaaa

SEQ ID NO: 7514878 - DNA, 22 bp, Homo sapiens
gtcactttaaagggttaacagg

SEQ ID NO: 7514879 - DNA, 22 bp, Homo sapiens
gtcactttaaagggttaacagg

SEQ ID NO: 7514880 - DNA, 22 bp, Homo sapiens
gtcactttaaagggttaacagg

SEQ ID NO: 7514881 - DNA, 22 bp, Homo sapiens
gtcactgtttcctattatattt

SEQ ID NO: 7514882 - DNA, 22 bp, Homo sapiens
gtcactgtttcctattatattt

SEQ ID NO: 7514883 - DNA, 17 bp, Homo sapiens
gtcactgtctaatgaag

SEQ ID NO: 7514884 - DNA, 18 bp, Homo sapiens
gtcactgtgtttctgagc

SEQ ID NO: 7514885 - DNA, 22 bp, Homo sapiens
gtcgtggagctcacagtgtgcc

SEQ ID NO: 7514886 - DNA, 22 bp, Homo sapiens
gtcgtggagctcacagtgtgcc

SEQ ID NO: 7514887 - DNA, 22 bp, Homo sapiens
gtcgtggagctcacagtgtgcc

SEQ ID NO: 7514888 - DNA, 20 bp, Homo sapiens
gtcggctctacccagactgt

SEQ ID NO: 7514889 - DNA, 22 bp, Homo sapiens
gtcgtgcagacctcacagcatt

SEQ ID NO: 7514890 - DNA, 22 bp, Homo sapiens
gtcgtggtcagacaccagaaaa

SEQ ID NO: 7514891 - DNA, 22 bp, Homo sapiens
gtcgtggtcagacaccagaaaa

SEQ ID NO: 7514892 - DNA, 22 bp, Homo sapiens
gtcgttgaaatgtttactgggg

SEQ ID NO: 7514893 - DNA, 22 bp, Homo sapiens
gtctaaacacaatgcaagaagt

SEQ ID NO: 7514894 - DNA, 22 bp, Homo sapiens
gtctaaacacagccttttctgt

SEQ ID NO: 7514895 - DNA, 22 bp, Homo sapiens
gtcctgggaactggacagctaa

SEQ ID NO: 7514896 - DNA, 22 bp, Homo sapiens
gtcctgggaactggacagctaa

SEQ ID NO: 7514897 - DNA, 22 bp, Homo sapiens
gtcctggcttagttcgctgtaa

SEQ ID NO: 7514898 - DNA, 22 bp, Homo sapiens
gtcctggcttagttcgctgtaa

SEQ ID NO: 7514899 - DNA, 22 bp, Homo sapiens
gtcctggctggttctgtggggc

SEQ ID NO: 7514900 - DNA, 22 bp, Homo sapiens
gtcctggctgtcttatgttgaa

SEQ ID NO: 7514901 - DNA, 19 bp, Homo sapiens
gtcctggcgccgccacacc

SEQ ID NO: 7514902 - DNA, 19 bp, Homo sapiens
gtcctggcgccgccacacc

SEQ ID NO: 7514903 - DNA, 22 bp, Homo sapiens
gtcctggcccaggagtacacat

SEQ ID NO: 7514904 - DNA, 22 bp, Homo sapiens
gtcctggcccaggagtacacat

SEQ ID NO: 7514905 - DNA, 22 bp, Homo sapiens
gtcctggcccaggagtacacat

SEQ ID NO: 7514906 - DNA, 22 bp, Homo sapiens
gtcctggctggttctgtggggc

SEQ ID NO: 7514907 - DNA, 22 bp, Homo sapiens
gtcctggcccactggcaggctg

SEQ ID NO: 7514908 - DNA, 22 bp, Homo sapiens
gtcctggcccactggcaggctg

SEQ ID NO: 7514909 - DNA, 22 bp, Homo sapiens
gtcctggcccactggcaggctg

SEQ ID NO: 7514910 - DNA, 22 bp, Homo sapiens
gtcctggattgaacataggcag

SEQ ID NO: 7514911 - DNA, 22 bp, Homo sapiens
gtcctggattgaacataggcag

SEQ ID NO: 7514912 - DNA, 22 bp, Homo sapiens
gtcctggattgaacataggcag

SEQ ID NO: 7514913 - DNA, 22 bp, Homo sapiens
gtcctggattgaacataggcag

SEQ ID NO: 7514914 - DNA, 22 bp, Homo sapiens
gtcctggattgaacataggcag

SEQ ID NO: 7514915 - DNA, 22 bp, Homo sapiens
gtcctggcacctcactggctac

SEQ ID NO: 7514916 - DNA, 22 bp, Homo sapiens
gtcctggcacctcactggctac

SEQ ID NO: 7514917 - DNA, 22 bp, Homo sapiens
gtcctctggtgaaagcattccc

SEQ ID NO: 7514918 - DNA, 22 bp, Homo sapiens
gtcctctggtgaaagcattccc

SEQ ID NO: 7514919 - DNA, 22 bp, Homo sapiens
gtcctctggtgaaagcattccc

SEQ ID NO: 7514920 - DNA, 22 bp, Homo sapiens
gtcctctggtgaaagcattccc

SEQ ID NO: 7514921 - DNA, 22 bp, Homo sapiens
gtcctctggtgaaagcattccc

SEQ ID NO: 7514922 - DNA, 22 bp, Homo sapiens
gtcctctgggctttgagcagtc

SEQ ID NO: 7514923 - DNA, 22 bp, Homo sapiens
gtcctctgggctttgagcagtc

SEQ ID NO: 7514924 - DNA, 22 bp, Homo sapiens
gtcctctgggctttgagcagtc

SEQ ID NO: 7514925 - DNA, 22 bp, Homo sapiens
gtcctctgggctttgagcagtc

SEQ ID NO: 7514926 - DNA, 22 bp, Homo sapiens
gtcctctgtccctggggcacgg

SEQ ID NO: 7514927 - DNA, 22 bp, Homo sapiens
gtcctctgtccctggggcacgg

SEQ ID NO: 7514928 - DNA, 22 bp, Homo sapiens
gtcctctgtccctggggcacgg

SEQ ID NO: 7514929 - DNA, 22 bp, Homo sapiens
gtcctctgtagggctgggccac

SEQ ID NO: 7514930 - DNA, 22 bp, Homo sapiens
gtcctctgtagggctgggccac

SEQ ID NO: 7514931 - DNA, 22 bp, Homo sapiens
gtcctctgtagggctgggccac

SEQ ID NO: 7514932 - DNA, 22 bp, Homo sapiens
gtcctctgtagggctgggccac

SEQ ID NO: 7514933 - DNA, 22 bp, Homo sapiens
gtcctgctaccatgctgtgtga

SEQ ID NO: 7514934 - DNA, 22 bp, Homo sapiens
gtcctgcggcctcagtggtgag

SEQ ID NO: 7514935 - DNA, 22 bp, Homo sapiens
gtcctgctctggcccaggtttg

SEQ ID NO: 7514936 - DNA, 22 bp, Homo sapiens
gtcctgcttcccacagaaaccg

SEQ ID NO: 7514937 - DNA, 22 bp, Homo sapiens
gtcctgctggcttcaggagatt

SEQ ID NO: 7514938 - DNA, 22 bp, Homo sapiens
gtcctgcacatggagggcaatg

SEQ ID NO: 7514939 - DNA, 22 bp, Homo sapiens
gtcctgcaggagttgtactctg

SEQ ID NO: 7514940 - DNA, 22 bp, Homo sapiens
gtcctgcacatggagggcaatg

SEQ ID NO: 7514941 - DNA, 22 bp, Homo sapiens
gtcctgcacatggagggcaatg

SEQ ID NO: 7514942 - DNA, 22 bp, Homo sapiens
gtcctctgtgtaggctgcagac

SEQ ID NO: 7514943 - DNA, 22 bp, Homo sapiens
gtcctctgtgtaggctgcagac

SEQ ID NO: 7514944 - DNA, 22 bp, Homo sapiens
gtcctctgtgtaggctgcagac

SEQ ID NO: 7514945 - DNA, 22 bp, Homo sapiens
gtcctggagtggcatggcatgg

SEQ ID NO: 7514946 - DNA, 22 bp, Homo sapiens
gtcctggagtggcatggcatgg

SEQ ID NO: 7514947 - DNA, 22 bp, Homo sapiens
gtcctggagtggcatggcatgg

SEQ ID NO: 7514948 - DNA, 22 bp, Homo sapiens
gtcctggagtggcatggcatgg

SEQ ID NO: 7514949 - DNA, 22 bp, Homo sapiens
gtcctggaatcctagaacagtg

SEQ ID NO: 7514950 - DNA, 22 bp, Homo sapiens
gtcctggaatcctagaacagtg

SEQ ID NO: 7514951 - DNA, 22 bp, Homo sapiens
gtcctgcttcccacagaaaccg

SEQ ID NO: 7514952 - DNA, 22 bp, Homo sapiens
gtcctgcttgttaggcctagtc

SEQ ID NO: 7514953 - DNA, 22 bp, Homo sapiens
gtcctgcttgttaggcctagtc

SEQ ID NO: 7514954 - DNA, 22 bp, Homo sapiens
gtcctgcttgttaggcctagtc

SEQ ID NO: 7514955 - DNA, 22 bp, Homo sapiens
gtcctgcttgttaggcctagtc

SEQ ID NO: 7514956 - DNA, 23 bp, Homo sapiens
gtcctctggagagaaaggcagta

SEQ ID NO: 7514957 - DNA, 22 bp, Homo sapiens
gtcctctggaggtttttaggtg

SEQ ID NO: 7514958 - DNA, 22 bp, Homo sapiens
gtcctctggaggtttttaggtg

SEQ ID NO: 7514959 - DNA, 22 bp, Homo sapiens
gtcctctggcctttcccaggac

SEQ ID NO: 7514960 - DNA, 22 bp, Homo sapiens
gtcctctggcctttcccaggac

SEQ ID NO: 7514961 - DNA, 22 bp, Homo sapiens
gtcctctggcctttcccaggac

SEQ ID NO: 7514962 - DNA, 22 bp, Homo sapiens
gtcctctggcctttcccaggac

SEQ ID NO: 7514963 - DNA, 22 bp, Homo sapiens
gtcctctgggagccttgagcct

SEQ ID NO: 7514964 - DNA, 22 bp, Homo sapiens
gtcctctgggagccttgagcct

SEQ ID NO: 7514965 - DNA, 22 bp, Homo sapiens
gtcctctgggagccttgagcct

SEQ ID NO: 7514966 - DNA, 22 bp, Homo sapiens
gtcctctgggagccttgagcct

SEQ ID NO: 7514967 - DNA, 22 bp, Homo sapiens
gtcctctgggcagctgccccac

SEQ ID NO: 7514968 - DNA, 22 bp, Homo sapiens
gtcctctgggcagctgccccac

SEQ ID NO: 7514969 - DNA, 22 bp, Homo sapiens
gtcctctgggcagctgccccac

SEQ ID NO: 7514970 - DNA, 22 bp, Homo sapiens
gtccaggctgacccctagagga

SEQ ID NO: 7514971 - DNA, 22 bp, Homo sapiens
gtccaggctgacccctagagga

SEQ ID NO: 7514972 - DNA, 22 bp, Homo sapiens
gtccaggctgacccctagagga

SEQ ID NO: 7514973 - DNA, 22 bp, Homo sapiens
gtccaggctgacccctagagga

SEQ ID NO: 7514974 - DNA, 22 bp, Homo sapiens
gtccaggctgcccagggtcctg

SEQ ID NO: 7514975 - DNA, 22 bp, Homo sapiens
gtccaggctgcccagggtcctg

SEQ ID NO: 7514976 - DNA, 22 bp, Homo sapiens
gtccaggctgacccctagagga

SEQ ID NO: 7514977 - DNA, 22 bp, Homo sapiens
gtccaggctgcccagggtcctg

SEQ ID NO: 7514978 - DNA, 22 bp, Homo sapiens
gtccagggaaatagcgacaggg

SEQ ID NO: 7514979 - DNA, 22 bp, Homo sapiens
gtccagggaaatagcgacaggg

SEQ ID NO: 7514980 - DNA, 22 bp, Homo sapiens
gtccagggaaatagcgacaggg

SEQ ID NO: 7514981 - DNA, 22 bp, Homo sapiens
gtcctctgcttcatgccctgat

SEQ ID NO: 7514982 - DNA, 23 bp, Homo sapiens
gtcctctggagagaaaggcagta

SEQ ID NO: 7514983 - DNA, 23 bp, Homo sapiens
gtcctctggagagaaaggcagta

SEQ ID NO: 7514984 - DNA, 22 bp, Homo sapiens
gtcctctggaagatgagttctt

SEQ ID NO: 7514985 - DNA, 22 bp, Homo sapiens
gtcctctggaagatgagttctt

SEQ ID NO: 7514986 - DNA, 22 bp, Homo sapiens
gtcctctggaagatgagttctt

SEQ ID NO: 7514987 - DNA, 22 bp, Homo sapiens
gtcctctggaagatgagttctt

SEQ ID NO: 7514988 - DNA, 22 bp, Homo sapiens
gtccaggagtttccaattaagc

SEQ ID NO: 7514989 - DNA, 22 bp, Homo sapiens
gtccaggagctcagggcttatt

SEQ ID NO: 7514990 - DNA, 22 bp, Homo sapiens
gtccaggcacctcccttgtgct

SEQ ID NO: 7514991 - DNA, 22 bp, Homo sapiens
gtccaggcacctcccttgtgct

SEQ ID NO: 7514992 - DNA, 19 bp, Homo sapiens
gtccaggcattgggttggt

SEQ ID NO: 7514993 - DNA, 19 bp, Homo sapiens
gtccaggcattgggttggt

SEQ ID NO: 7514994 - DNA, 19 bp, Homo sapiens
gtccaggcattgggttggt

SEQ ID NO: 7514995 - DNA, 22 bp, Homo sapiens
gtccaggccatggtggacacag

SEQ ID NO: 7514996 - DNA, 22 bp, Homo sapiens
gtccaggccatggtggacacag

SEQ ID NO: 7514997 - DNA, 22 bp, Homo sapiens
gtccaggaatcaaaagatggaa

SEQ ID NO: 7514998 - DNA, 22 bp, Homo sapiens
gtccaggaatcaaaagatggaa

SEQ ID NO: 7514999 - DNA, 22 bp, Homo sapiens
gtccaggaagcaataaatagaa

SEQ ID NO: 7515000 - DNA, 22 bp, Homo sapiens
gtccaggaatcaaaagatggaa

SEQ ID NO: 7515001 - DNA, 22 bp, Homo sapiens
gtccaggaatcaaaagatggaa

SEQ ID NO: 7515002 - DNA, 22 bp, Homo sapiens
gtccaggaatcaaaagatggaa

SEQ ID NO: 7515003 - DNA, 22 bp, Homo sapiens
gtccaggaatcaaaagatggaa

SEQ ID NO: 7515004 - DNA, 20 bp, Homo sapiens
gtccaggacccagcaggagg

SEQ ID NO: 7515005 - DNA, 20 bp, Homo sapiens
gtccaggacccagcaggagg

SEQ ID NO: 7515006 - DNA, 20 bp, Homo sapiens
gtccaggacccagcaggagg

SEQ ID NO: 7515007 - DNA, 20 bp, Homo sapiens
gtccaggacccagcaggagg

SEQ ID NO: 7515008 - DNA, 22 bp, Homo sapiens
gtccaggagctcagggcttatt

SEQ ID NO: 7515009 - DNA, 20 bp, Homo sapiens
gtccaggacccagcaggagg

SEQ ID NO: 7515010 - DNA, 20 bp, Homo sapiens
gtccaggacccagcaggagg

SEQ ID NO: 7515011 - DNA, 20 bp, Homo sapiens
gtccaggacccagcaggagg

SEQ ID NO: 7515012 - DNA, 22 bp, Homo sapiens
gtccaggcctgcctctgaggag

SEQ ID NO: 7515013 - DNA, 22 bp, Homo sapiens
gtccaggcctgcctctgaggag

SEQ ID NO: 7515014 - DNA, 22 bp, Homo sapiens
gtccaggcctgcctctgaggag

SEQ ID NO: 7515015 - DNA, 22 bp, Homo sapiens
gtccaggcctgcctctgaggag

SEQ ID NO: 7515016 - DNA, 22 bp, Homo sapiens
gtccaggccccagggattcttg

SEQ ID NO: 7515017 - DNA, 22 bp, Homo sapiens
gtccaggccccagggattcttg

SEQ ID NO: 7515018 - DNA, 22 bp, Homo sapiens
gtccaggccccagggattcttg

SEQ ID NO: 7515019 - DNA, 22 bp, Homo sapiens
gtccaggccatggtggacacag

SEQ ID NO: 7515020 - DNA, 22 bp, Homo sapiens
gtccaggccatggtggacacag

SEQ ID NO: 7515021 - DNA, 22 bp, Homo sapiens
gtccaggccatggtggacacag

SEQ ID NO: 7515022 - DNA, 22 bp, Homo sapiens
gtccaggctaagtcccttctgc

SEQ ID NO: 7515023 - DNA, 22 bp, Homo sapiens
gtccaggcctgcctctgaggag

SEQ ID NO: 7515024 - DNA, 22 bp, Homo sapiens
gtccaggcctgcctctgaggag

SEQ ID NO: 7515025 - DNA, 22 bp, Homo sapiens
gtccaggctaagtcccttctgc

SEQ ID NO: 7515026 - DNA, 22 bp, Homo sapiens
gtccaggctaagtcccttctgc

SEQ ID NO: 7515027 - DNA, 22 bp, Homo sapiens
gtccaggctgacccctagagga

SEQ ID NO: 7515028 - DNA, 22 bp, Homo sapiens
gtccaggctgacccctagagga

SEQ ID NO: 7515029 - DNA, 22 bp, Homo sapiens
gtccaggctgacccctagagga

SEQ ID NO: 7515030 - DNA, 22 bp, Homo sapiens
gtccaggctgacccctagagga

SEQ ID NO: 7515031 - DNA, 22 bp, Homo sapiens
gtccaggctgacccctagagga

SEQ ID NO: 7515032 - DNA, 22 bp, Homo sapiens
gtccaggctcaaaaggttgtta

SEQ ID NO: 7515033 - DNA, 22 bp, Homo sapiens
gtccaggctcaaaaggttgtta

SEQ ID NO: 7515034 - DNA, 22 bp, Homo sapiens
gtccaggctcaaaaggttgtta

SEQ ID NO: 7515035 - DNA, 22 bp, Homo sapiens
gtatttttagtagagtcggggt

SEQ ID NO: 7515036 - DNA, 22 bp, Homo sapiens
gtatttttagtagagtcggggt

SEQ ID NO: 7515037 - DNA, 22 bp, Homo sapiens
gtatttttaggtaaggaaagta

SEQ ID NO: 7515038 - DNA, 22 bp, Homo sapiens
gtatttttagtagagtcggggt

SEQ ID NO: 7515039 - DNA, 22 bp, Homo sapiens
gtatttttagtagagtcggggt

SEQ ID NO: 7515040 - DNA, 22 bp, Homo sapiens
gtatttttcagttaggagctta

SEQ ID NO: 7515041 - DNA, 22 bp, Homo sapiens
gtatttttcagttaggagctta

SEQ ID NO: 7515042 - DNA, 22 bp, Homo sapiens
gtatttttcagttaggagctta

SEQ ID NO: 7515043 - DNA, 22 bp, Homo sapiens
gtatttttcagttaggagctta

SEQ ID NO: 7515044 - DNA, 22 bp, Homo sapiens
gtatttttcagttaggagctta

SEQ ID NO: 7515045 - DNA, 22 bp, Homo sapiens
gtatttttcagttaggagctta

SEQ ID NO: 7515046 - DNA, 22 bp, Homo sapiens
gtatttttagtagagtcggggt

SEQ ID NO: 7515047 - DNA, 22 bp, Homo sapiens
gtatttttcagttaggagctta

SEQ ID NO: 7515048 - DNA, 22 bp, Homo sapiens
gtatttttcattccaagtgaga

SEQ ID NO: 7515049 - DNA, 22 bp, Homo sapiens
gtatttttcattccaagtgaga

SEQ ID NO: 7515050 - DNA, 22 bp, Homo sapiens
gtatttttcattccaagtgaga

SEQ ID NO: 7515051 - DNA, 22 bp, Homo sapiens
gtatttttcattccaagtgaga

SEQ ID NO: 7515052 - DNA, 22 bp, Homo sapiens
gtatttttcattccaagtgaga

SEQ ID NO: 7515053 - DNA, 22 bp, Homo sapiens
gtatttttcattccaagtgaga

SEQ ID NO: 7515054 - DNA, 22 bp, Homo sapiens
gtatttttcattccaagtgaga

SEQ ID NO: 7515055 - DNA, 22 bp, Homo sapiens
gtcaaaaagtagtcatttctgt

SEQ ID NO: 7515056 - DNA, 22 bp, Homo sapiens
gtcaaaaagtagtcatttctgt

SEQ ID NO: 7515057 - DNA, 22 bp, Homo sapiens
gtcaaaacaaagttaagaattc

SEQ ID NO: 7515058 - DNA, 22 bp, Homo sapiens
gtcaaaacaaagttaagaattc

SEQ ID NO: 7515059 - DNA, 22 bp, Homo sapiens
gtcaaaaagtagtcatttctgt

SEQ ID NO: 7515060 - DNA, 22 bp, Homo sapiens
gtcaaaaagtagtcatttctgt

SEQ ID NO: 7515061 - DNA, 22 bp, Homo sapiens
gtatttttcattccaagtgaga

SEQ ID NO: 7515062 - DNA, 22 bp, Homo sapiens
gtcaaaaagtagtcatttctgt

SEQ ID NO: 7515063 - DNA, 22 bp, Homo sapiens
gtcaaaaagtagtcatttctgt

SEQ ID NO: 7515064 - DNA, 22 bp, Homo sapiens
gtcaaatatatgcaaaactatt

SEQ ID NO: 7515065 - DNA, 22 bp, Homo sapiens
gtcaaatatatgcaaaactatt

SEQ ID NO: 7515066 - DNA, 22 bp, Homo sapiens
gtcaaatgcacagaaccattaa

SEQ ID NO: 7515067 - DNA, 22 bp, Homo sapiens
gtcaaatattatgcagcttgga

SEQ ID NO: 7515068 - DNA, 22 bp, Homo sapiens
gtcaaatatatgcaaaactatt

SEQ ID NO: 7515069 - DNA, 22 bp, Homo sapiens
gtcaaatattatgcagcttgga

SEQ ID NO: 7515070 - DNA, 22 bp, Homo sapiens
gtcaaatatatgcaaaactatt

SEQ ID NO: 7515071 - DNA, 22 bp, Homo sapiens
gtcaaatatatgcaaaactatt

SEQ ID NO: 7515072 - DNA, 22 bp, Homo sapiens
gtcaaatatactaagaggtaaa

SEQ ID NO: 7515073 - DNA, 22 bp, Homo sapiens
gtcaaatatactaagaggtaaa

SEQ ID NO: 7515074 - DNA, 22 bp, Homo sapiens
gtcaaatatactaagaggtaaa

SEQ ID NO: 7515075 - DNA, 22 bp, Homo sapiens
gtcacccactccctgctgctgt

SEQ ID NO: 7515076 - DNA, 22 bp, Homo sapiens
gtcacccactccctgctgctgt

SEQ ID NO: 7515077 - DNA, 22 bp, Homo sapiens
gtcaacaaggtttgcttatctt

SEQ ID NO: 7515078 - DNA, 22 bp, Homo sapiens
gtcaaatgcacagaaccattaa

SEQ ID NO: 7515079 - DNA, 22 bp, Homo sapiens
gtcaacaaagaaaattgttaat

SEQ ID NO: 7515080 - DNA, 22 bp, Homo sapiens
gtcaacaaagaaaattgttaat

SEQ ID NO: 7515081 - DNA, 22 bp, Homo sapiens
gtcaacaaagaaaattgttaat

SEQ ID NO: 7515082 - DNA, 22 bp, Homo sapiens
gtcaaataattttctcaatagt

SEQ ID NO: 7515083 - DNA, 22 bp, Homo sapiens
gtcaaataattttctcaatagt

SEQ ID NO: 7515084 - DNA, 22 bp, Homo sapiens
gtcaaataattttctcaatagt

SEQ ID NO: 7515085 - DNA, 22 bp, Homo sapiens
gtcaaagatcctatgagttaaa

SEQ ID NO: 7515086 - DNA, 22 bp, Homo sapiens
gtcaaagatcctatgagttaaa

SEQ ID NO: 7515087 - DNA, 22 bp, Homo sapiens
gtcaaacatagggactttgtgg

SEQ ID NO: 7515088 - DNA, 20 bp, Homo sapiens
gtcaaactactggcagtgcc

SEQ ID NO: 7515089 - DNA, 22 bp, Homo sapiens
gtcaaacaaattaacatatcca

SEQ ID NO: 7515090 - DNA, 22 bp, Homo sapiens
gtcaaacaaattaacatatcca

SEQ ID NO: 7515091 - DNA, 22 bp, Homo sapiens
gtcaaacagcctcctgttctaa

SEQ ID NO: 7515092 - DNA, 22 bp, Homo sapiens
gtcaaacaaattaacatatcca

SEQ ID NO: 7515093 - DNA, 22 bp, Homo sapiens
gtcaaacaaattaacatatcca

SEQ ID NO: 7515094 - DNA, 22 bp, Homo sapiens
gtcaaacagcctcctgttctaa

SEQ ID NO: 7515095 - DNA, 22 bp, Homo sapiens
gtagttctttctcaatgttcaa

SEQ ID NO: 7515096 - DNA, 22 bp, Homo sapiens
gtagttctgcagtgtcacctga

SEQ ID NO: 7515097 - DNA, 22 bp, Homo sapiens
gtagttctgcagtgtcacctga

SEQ ID NO: 7515098 - DNA, 22 bp, Homo sapiens
gtagttctgcagtgtcacctga

SEQ ID NO: 7515099 - DNA, 22 bp, Homo sapiens
gtagttctgcagtgtcacctga

SEQ ID NO: 7515100 - DNA, 22 bp, Homo sapiens
gtagttctttctcaatgttcaa

SEQ ID NO: 7515101 - DNA, 22 bp, Homo sapiens
gtataaacatggagtgcattct

SEQ ID NO: 7515102 - DNA, 22 bp, Homo sapiens
gtagttagttaagatgagttta

SEQ ID NO: 7515103 - DNA, 22 bp, Homo sapiens
gtagtgtgtaggcactgtgctc

SEQ ID NO: 7515104 - DNA, 22 bp, Homo sapiens
gtagtgctttcatctggagtgt

SEQ ID NO: 7515105 - DNA, 22 bp, Homo sapiens
gtagttatcagtatgacaccag

SEQ ID NO: 7515106 - DNA, 22 bp, Homo sapiens
gtagttatcatcatactccaga

SEQ ID NO: 7515107 - DNA, 22 bp, Homo sapiens
gtagttattgctgtttacttct

SEQ ID NO: 7515108 - DNA, 22 bp, Homo sapiens
gtagttatgtttacatgccatc

SEQ ID NO: 7515109 - DNA, 22 bp, Homo sapiens
gtagttattctgcctttaagga

SEQ ID NO: 7515110 - DNA, 22 bp, Homo sapiens
gtagttattgctgtttacttct

SEQ ID NO: 7515111 - DNA, 22 bp, Homo sapiens
gtagttatttatttaccactcc

SEQ ID NO: 7515112 - DNA, 22 bp, Homo sapiens
gtagttctgcagtgtcacctga

SEQ ID NO: 7515113 - DNA, 22 bp, Homo sapiens
gtataaggtatgtaaactattt

SEQ ID NO: 7515114 - DNA, 22 bp, Homo sapiens
gtataagcccattctcagagac

SEQ ID NO: 7515115 - DNA, 22 bp, Homo sapiens
gtataagcccattctcagagac

SEQ ID NO: 7515116 - DNA, 22 bp, Homo sapiens
gtataaggtatgtaaactattt

SEQ ID NO: 7515117 - DNA, 22 bp, Homo sapiens
gtatacaactattgttgggtaa

SEQ ID NO: 7515118 - DNA, 22 bp, Homo sapiens
gtatacaactattgttgggtaa

SEQ ID NO: 7515119 - DNA, 22 bp, Homo sapiens
gtataaagtataagcttgtttt

SEQ ID NO: 7515120 - DNA, 22 bp, Homo sapiens
gtataactgctaccacctgatg

SEQ ID NO: 7515121 - DNA, 22 bp, Homo sapiens
gtataaagtataagcttgtttt

SEQ ID NO: 7515122 - DNA, 22 bp, Homo sapiens
gtataactgctaccacctgatg

SEQ ID NO: 7515123 - DNA, 19 bp, Homo sapiens
gtataacttacaccagcaa

SEQ ID NO: 7515124 - DNA, 22 bp, Homo sapiens
gtatacagatacttagacgtgc

SEQ ID NO: 7515125 - DNA, 22 bp, Homo sapiens
gtatacactgtctcctctaggt

SEQ ID NO: 7515126 - DNA, 22 bp, Homo sapiens
gtatacactggtaagatttgtc

SEQ ID NO: 7515127 - DNA, 22 bp, Homo sapiens
gtatacagatacttagacgtgc

SEQ ID NO: 7515128 - DNA, 22 bp, Homo sapiens
gtatacagatacttagacgtgc

SEQ ID NO: 7515129 - DNA, 22 bp, Homo sapiens
gtatacagatacttagacgtgc

SEQ ID NO: 7515130 - DNA, 22 bp, Homo sapiens
gtatacactggtaagatttgtc

SEQ ID NO: 7515131 - DNA, 22 bp, Homo sapiens
gtatacaatacacaatgctctg

SEQ ID NO: 7515132 - DNA, 22 bp, Homo sapiens
gtatacaatacacaatgctctg

SEQ ID NO: 7515133 - DNA, 22 bp, Homo sapiens
gtatacaatacacaatgctctg

SEQ ID NO: 7515134 - DNA, 22 bp, Homo sapiens
gtattttatggcctggggccta

SEQ ID NO: 7515135 - DNA, 22 bp, Homo sapiens
gtattttcaagagcagtagtat

SEQ ID NO: 7515136 - DNA, 22 bp, Homo sapiens
gtattttcaagagcagtagtat

SEQ ID NO: 7515137 - DNA, 22 bp, Homo sapiens
gtattttatggcctggggccta

SEQ ID NO: 7515138 - DNA, 22 bp, Homo sapiens
gtattttatggcctggggccta

SEQ ID NO: 7515139 - DNA, 22 bp, Homo sapiens
gtattttatggcctggggccta

SEQ ID NO: 7515140 - DNA, 22 bp, Homo sapiens
gtattttcatgatttcagacca

SEQ ID NO: 7515141 - DNA, 22 bp, Homo sapiens
gtattttcaagagcagtagtat

SEQ ID NO: 7515142 - DNA, 22 bp, Homo sapiens
gtattttcaagagcagtagtat

SEQ ID NO: 7515143 - DNA, 22 bp, Homo sapiens
gtatttttaggtaaggaaagta

SEQ ID NO: 7515144 - DNA, 22 bp, Homo sapiens
gtatttttaggtaaggaaagta

SEQ ID NO: 7515145 - DNA, 22 bp, Homo sapiens
gtatttttaggtaaggaaagta

SEQ ID NO: 7515146 - DNA, 22 bp, Homo sapiens
gtatttttaggtaaggaaagta

SEQ ID NO: 7515147 - DNA, 22 bp, Homo sapiens
gtattttgttagggtgtggtat

SEQ ID NO: 7515148 - DNA, 22 bp, Homo sapiens
gtatttttaggtaaggaaagta

SEQ ID NO: 7515149 - DNA, 22 bp, Homo sapiens
gtatttttaggtaaggaaagta

SEQ ID NO: 7515150 - DNA, 22 bp, Homo sapiens
gtatttttaggtaaggaaagta

SEQ ID NO: 7515151 - DNA, 22 bp, Homo sapiens
gtatttttaggtaaggaaagta

SEQ ID NO: 7515152 - DNA, 22 bp, Homo sapiens
gtatttttaggtaaggaaagta

SEQ ID NO: 7515153 - DNA, 22 bp, Homo sapiens
gtattttatggcatgcagtggc

SEQ ID NO: 7515154 - DNA, 22 bp, Homo sapiens
gtattttatggcatgcagtggc

SEQ ID NO: 7515155 - DNA, 22 bp, Homo sapiens
gtattttatggcatgcagtggc

SEQ ID NO: 7515156 - DNA, 22 bp, Homo sapiens
gtatttcctatagtgagggcct

SEQ ID NO: 7515157 - DNA, 22 bp, Homo sapiens
gtatttcctcgcttgtgggatt

SEQ ID NO: 7515158 - DNA, 22 bp, Homo sapiens
gtatacatagatgatgaacaag

SEQ ID NO: 7515159 - DNA, 22 bp, Homo sapiens
gtatacatagatgatgaacaag

SEQ ID NO: 7515160 - DNA, 22 bp, Homo sapiens
gtatacatagatgatgaacaag

SEQ ID NO: 7515161 - DNA, 22 bp, Homo sapiens
gtatacatagatgatgaacaag

SEQ ID NO: 7515162 - DNA, 22 bp, Homo sapiens
gtatacatacttctagattaaa

SEQ ID NO: 7515163 - DNA, 22 bp, Homo sapiens
gtatacatagatgatgaacaag

SEQ ID NO: 7515164 - DNA, 22 bp, Homo sapiens
gtatacatacttctagattaaa

SEQ ID NO: 7515165 - DNA, 22 bp, Homo sapiens
gtatacatacttctagattaaa

SEQ ID NO: 7515166 - DNA, 22 bp, Homo sapiens
gtatttcccccagactccctgg

SEQ ID NO: 7515167 - DNA, 22 bp, Homo sapiens
gtatacatagatgatgaacaag

SEQ ID NO: 7515168 - DNA, 22 bp, Homo sapiens
gtatacatagatgatgaacaag

SEQ ID NO: 7515169 - DNA, 22 bp, Homo sapiens
gtatttccctgagttctgtgag

SEQ ID NO: 7515170 - DNA, 22 bp, Homo sapiens
gtaggagctcatggggccagga

SEQ ID NO: 7515171 - DNA, 22 bp, Homo sapiens
gtaggaattttgtgagctttcc

SEQ ID NO: 7515172 - DNA, 22 bp, Homo sapiens
gtacaattatttaaatggtgaa

SEQ ID NO: 7515173 - DNA, 22 bp, Homo sapiens
gtacaattaagtgcacaaatag

SEQ ID NO: 7515174 - DNA, 22 bp, Homo sapiens
gtacaattatttaaatggtgaa

SEQ ID NO: 7515175 - DNA, 22 bp, Homo sapiens
gtacaattatttaaatggtgaa

SEQ ID NO: 7515176 - DNA, 22 bp, Homo sapiens
gtaggaagctctgaggctagtt

SEQ ID NO: 7515177 - DNA, 22 bp, Homo sapiens
gtacaatagtccctgtttggat

SEQ ID NO: 7515178 - DNA, 22 bp, Homo sapiens
gtacaatagtccctgtttggat

SEQ ID NO: 7515179 - DNA, 22 bp, Homo sapiens
gtacaattaagtgcacaaatag

SEQ ID NO: 7515180 - DNA, 22 bp, Homo sapiens
gtacaattaagtgcacaaatag

SEQ ID NO: 7515181 - DNA, 22 bp, Homo sapiens
gtacaattaagtgcacaaatag

SEQ ID NO: 7515182 - DNA, 22 bp, Homo sapiens
gtacaataactagtcttatagt

SEQ ID NO: 7515183 - DNA, 22 bp, Homo sapiens
gtacaataactagtcttatagt

SEQ ID NO: 7515184 - DNA, 22 bp, Homo sapiens
gtaggcagaccagtggatgggt

SEQ ID NO: 7515185 - DNA, 22 bp, Homo sapiens
gtaggcagaccagtggatgggt

SEQ ID NO: 7515186 - DNA, 22 bp, Homo sapiens
gtaggcagaccagtggatgggt

SEQ ID NO: 7515187 - DNA, 22 bp, Homo sapiens
gtaggcagaataattcctcctt

SEQ ID NO: 7515188 - DNA, 22 bp, Homo sapiens
gtaggcagataggagtgcagcc

SEQ ID NO: 7515189 - DNA, 22 bp, Homo sapiens
gtaggcagataggagtgcagcc

SEQ ID NO: 7515190 - DNA, 22 bp, Homo sapiens
gtagggcatagagatgttggca

SEQ ID NO: 7515191 - DNA, 22 bp, Homo sapiens
gtaggcagataggagtgcagcc

SEQ ID NO: 7515192 - DNA, 22 bp, Homo sapiens
gtagggcatgtaagtcaccata

SEQ ID NO: 7515193 - DNA, 22 bp, Homo sapiens
gtagggctcagtaaatactttg

SEQ ID NO: 7515194 - DNA, 22 bp, Homo sapiens
gtagggctcagtaaatactttg

SEQ ID NO: 7515195 - DNA, 22 bp, Homo sapiens
gtagggctcagtaaatactttg

SEQ ID NO: 7515196 - DNA, 22 bp, Homo sapiens
gtaggggatggttccctagaaa

SEQ ID NO: 7515197 - DNA, 22 bp, Homo sapiens
gtaggggatggttccctagaaa

SEQ ID NO: 7515198 - DNA, 22 bp, Homo sapiens
gtaggggtgctgagatctggaa

SEQ ID NO: 7515199 - DNA, 22 bp, Homo sapiens
gtaggggtgctgagatctggaa

SEQ ID NO: 7515200 - DNA, 22 bp, Homo sapiens
gtagggttggagagcacaacca

SEQ ID NO: 7515201 - DNA, 22 bp, Homo sapiens
gtaggggtcaggtagggactct

SEQ ID NO: 7515202 - DNA, 22 bp, Homo sapiens
gtagtacatgaagcacttggca

SEQ ID NO: 7515203 - DNA, 19 bp, Homo sapiens
gtagtacaattaggacaat

SEQ ID NO: 7515204 - DNA, 22 bp, Homo sapiens
gtagtacatcgttatgtaatat

SEQ ID NO: 7515205 - DNA, 22 bp, Homo sapiens
gtagtacatcgttatgtaatat

SEQ ID NO: 7515206 - DNA, 22 bp, Homo sapiens
gtagtacagtgagacaatgttt

SEQ ID NO: 7515207 - DNA, 22 bp, Homo sapiens
gtagtacagtgagacaatgttt

SEQ ID NO: 7515208 - DNA, 19 bp, Homo sapiens
gtagtacaattaggacaat

SEQ ID NO: 7515209 - DNA, 22 bp, Homo sapiens
gtagtaaagcaggttttgctgt

SEQ ID NO: 7515210 - DNA, 22 bp, Homo sapiens
gtagtaaagcggaaagggtgat

SEQ ID NO: 7515211 - DNA, 22 bp, Homo sapiens
gtaggtgagtgatgctcagatt

SEQ ID NO: 7515212 - DNA, 22 bp, Homo sapiens
gtaggtgataatgcaaaaggaa

SEQ ID NO: 7515213 - DNA, 22 bp, Homo sapiens
gtaggtgagtgatgctcagatt

SEQ ID NO: 7515214 - DNA, 22 bp, Homo sapiens
gtaggtatagattctctgagga

SEQ ID NO: 7515215 - DNA, 22 bp, Homo sapiens
gtaggtcagacataagaggaca

SEQ ID NO: 7515216 - DNA, 22 bp, Homo sapiens
gtaggtcagacataagaggaca

SEQ ID NO: 7515217 - DNA, 22 bp, Homo sapiens
gtaggtcagacataagaggaca

SEQ ID NO: 7515218 - DNA, 22 bp, Homo sapiens
gtaggtcagacataagaggaca

SEQ ID NO: 7515219 - DNA, 22 bp, Homo sapiens
gtaggtcagacataagaggaca

SEQ ID NO: 7515220 - DNA, 22 bp, Homo sapiens
gtaggtcagacataagaggaca

SEQ ID NO: 7515221 - DNA, 22 bp, Homo sapiens
gtagtctgaacagtaattttgt

SEQ ID NO: 7515222 - DNA, 22 bp, Homo sapiens
gtagtctgaacagtaattttgt

SEQ ID NO: 7515223 - DNA, 22 bp, Homo sapiens
gtagtctgaacagtaattttgt

SEQ ID NO: 7515224 - DNA, 22 bp, Homo sapiens
gtagtctgaacagtaattttgt

SEQ ID NO: 7515225 - DNA, 22 bp, Homo sapiens
gtagtctgaacagtaattttgt

SEQ ID NO: 7515226 - DNA, 22 bp, Homo sapiens
gtagtgcgcatggcctgtttgt

SEQ ID NO: 7515227 - DNA, 22 bp, Homo sapiens
gtagtcttggattttaaaaagt

SEQ ID NO: 7515228 - DNA, 22 bp, Homo sapiens
gtagtggagtctcctgtcctgg

SEQ ID NO: 7515229 - DNA, 22 bp, Homo sapiens
gtagtgctttcatctggagtgt

SEQ ID NO: 7515230 - DNA, 22 bp, Homo sapiens
gtagtagatgagaatctcttta

SEQ ID NO: 7515231 - DNA, 22 bp, Homo sapiens
gtagtatgaacatgtaggtaga

SEQ ID NO: 7515232 - DNA, 22 bp, Homo sapiens
gtagtataaatgggaaatacat

SEQ ID NO: 7515233 - DNA, 22 bp, Homo sapiens
gtagtcccagctaccccggagg

SEQ ID NO: 7515234 - DNA, 22 bp, Homo sapiens
gtagtcccagctaccccggagg

SEQ ID NO: 7515235 - DNA, 22 bp, Homo sapiens
gtacaaaagttattgcggtttt

SEQ ID NO: 7515236 - DNA, 22 bp, Homo sapiens
gtacaaaagttattgcggtttt

SEQ ID NO: 7515237 - DNA, 22 bp, Homo sapiens
gtacaaaagttattgcggtttt

SEQ ID NO: 7515238 - DNA, 22 bp, Homo sapiens
gtacaaaagttattgcggtttt

SEQ ID NO: 7515239 - DNA, 22 bp, Homo sapiens
gtacaaaagttattgcggtttt

SEQ ID NO: 7515240 - DNA, 22 bp, Homo sapiens
gtaatttttagttcattctatc

SEQ ID NO: 7515241 - DNA, 22 bp, Homo sapiens
gtacaaaagttattgcggtttt

SEQ ID NO: 7515242 - DNA, 22 bp, Homo sapiens
gtacaaaagttattgcggtttt

SEQ ID NO: 7515243 - DNA, 22 bp, Homo sapiens
gtacaaatacattctgaaggta

SEQ ID NO: 7515244 - DNA, 22 bp, Homo sapiens
gtacaaatacattctgaaggta

SEQ ID NO: 7515245 - DNA, 22 bp, Homo sapiens
gtacaaatacattctgaaggta

SEQ ID NO: 7515246 - DNA, 22 bp, Homo sapiens
gtacaaagtggacctgatagta

SEQ ID NO: 7515247 - DNA, 22 bp, Homo sapiens
gtacaaatgaaaatagaccact

SEQ ID NO: 7515248 - DNA, 22 bp, Homo sapiens
gtacaaatgaaaatagaccact

SEQ ID NO: 7515249 - DNA, 22 bp, Homo sapiens
gtacaaatacattctgaaggta

SEQ ID NO: 7515250 - DNA, 22 bp, Homo sapiens
gtacaaagtggacctgatagta

SEQ ID NO: 7515251 - DNA, 22 bp, Homo sapiens
gtacaaaggcagaattgggtag

SEQ ID NO: 7515252 - DNA, 22 bp, Homo sapiens
gtacaaaggcagaattgggtag

SEQ ID NO: 7515253 - DNA, 22 bp, Homo sapiens
gtacaaattaggaagctttgtg

SEQ ID NO: 7515254 - DNA, 22 bp, Homo sapiens
gtacaaattaggaagctttgtg

SEQ ID NO: 7515255 - DNA, 22 bp, Homo sapiens
gtacaaattaggaagctttgtg

SEQ ID NO: 7515256 - DNA, 22 bp, Homo sapiens
gtacaaattaggaagctttgtg

SEQ ID NO: 7515257 - DNA, 22 bp, Homo sapiens
gtacaaatgtacacttgtataa

SEQ ID NO: 7515258 - DNA, 22 bp, Homo sapiens
gtacaaatgtacacttgtataa

SEQ ID NO: 7515259 - DNA, 22 bp, Homo sapiens
gtacaaatgtacacttgtataa

SEQ ID NO: 7515260 - DNA, 22 bp, Homo sapiens
gtacaaatgtacacttgtataa

SEQ ID NO: 7515261 - DNA, 22 bp, Homo sapiens
gtacaaatgtacacttgtataa

SEQ ID NO: 7515262 - DNA, 22 bp, Homo sapiens
gtacaaatgtacacttgtataa

SEQ ID NO: 7515263 - DNA, 22 bp, Homo sapiens
gtacaaatgagagttctgtttt

SEQ ID NO: 7515264 - DNA, 22 bp, Homo sapiens
gtacaaatgagagttctgtttt

SEQ ID NO: 7515265 - DNA, 22 bp, Homo sapiens
gtacaaatgagagttctgtttt

SEQ ID NO: 7515266 - DNA, 22 bp, Homo sapiens
gtacaaatgagagttctgtttt

SEQ ID NO: 7515267 - DNA, 22 bp, Homo sapiens
gtacaaatgagagttctgtttt

SEQ ID NO: 7515268 - DNA, 22 bp, Homo sapiens
gtacaaatgagagttctgtttt

SEQ ID NO: 7515269 - DNA, 22 bp, Homo sapiens
gtacaaatgcaggtttgttaca

SEQ ID NO: 7515270 - DNA, 22 bp, Homo sapiens
gtacaaatgcaggtttgttaca

SEQ ID NO: 7515271 - DNA, 22 bp, Homo sapiens
gtacaaatgcaggtttgttaca

SEQ ID NO: 7515272 - DNA, 22 bp, Homo sapiens
gtacaaatgcaggtttgttaca

SEQ ID NO: 7515273 - DNA, 22 bp, Homo sapiens
gtacaaatgcaggtttgttaca

SEQ ID NO: 7515274 - DNA, 22 bp, Homo sapiens
gtacaaatgcaggtttgttaca

SEQ ID NO: 7515275 - DNA, 22 bp, Homo sapiens
gtacaacaggattgatgtacca

SEQ ID NO: 7515276 - DNA, 22 bp, Homo sapiens
gtacaacaggattgatgtacca

SEQ ID NO: 7515277 - DNA, 22 bp, Homo sapiens
gtacaaattttgacatctagga

SEQ ID NO: 7515278 - DNA, 22 bp, Homo sapiens
gtacaaattttgacatctagga

SEQ ID NO: 7515279 - DNA, 22 bp, Homo sapiens
gtacaaattttgacatctagga

SEQ ID NO: 7515280 - DNA, 22 bp, Homo sapiens
gtacaaattttgacatctagga

SEQ ID NO: 7515281 - DNA, 22 bp, Homo sapiens
gtacaaattttgacatctagga

SEQ ID NO: 7515282 - DNA, 22 bp, Homo sapiens
gtacaacatgattttactctct

SEQ ID NO: 7515283 - DNA, 22 bp, Homo sapiens
gtacaacaggattgatgtacca

SEQ ID NO: 7515284 - DNA, 22 bp, Homo sapiens
gtacaaattgatacagatttga

SEQ ID NO: 7515285 - DNA, 22 bp, Homo sapiens
gtacaaattgatacagatttga

SEQ ID NO: 7515286 - DNA, 22 bp, Homo sapiens
gtacaaattgatacagatttga

SEQ ID NO: 7515287 - DNA, 22 bp, Homo sapiens
gtacaaattgatacagatttga

SEQ ID NO: 7515288 - DNA, 22 bp, Homo sapiens
gtacaaattgatacagatttga

SEQ ID NO: 7515289 - DNA, 22 bp, Homo sapiens
gtacaaattgatacagatttga

SEQ ID NO: 7515290 - DNA, 22 bp, Homo sapiens
gtacaaattgatacagatttga

SEQ ID NO: 7515291 - DNA, 22 bp, Homo sapiens
gtacaaattgatacagatttga

SEQ ID NO: 7515292 - DNA, 22 bp, Homo sapiens
gtacaaattgatacaggttttc

SEQ ID NO: 7515293 - DNA, 22 bp, Homo sapiens
gtacaaattgatacaggttttc

SEQ ID NO: 7515294 - DNA, 22 bp, Homo sapiens
gtacaaattgatacaggttttc

SEQ ID NO: 7515295 - DNA, 22 bp, Homo sapiens
gtacaaattgatacaggttttc

SEQ ID NO: 7515296 - DNA, 22 bp, Homo sapiens
gtacaagaggagaaaatggagt

SEQ ID NO: 7515297 - DNA, 22 bp, Homo sapiens
gtacaagtgctgtgagggaaaa

SEQ ID NO: 7515298 - DNA, 22 bp, Homo sapiens
gtacaagtaagaaaattgccca

SEQ ID NO: 7515299 - DNA, 22 bp, Homo sapiens
gtacaagaggagaaaatggagt

SEQ ID NO: 7515300 - DNA, 19 bp, Homo sapiens
gtacaagaatgactgagca

SEQ ID NO: 7515301 - DNA, 19 bp, Homo sapiens
gtacaagaatgactgagca

SEQ ID NO: 7515302 - DNA, 22 bp, Homo sapiens
gtacaataactagtcttatagt

SEQ ID NO: 7515303 - DNA, 22 bp, Homo sapiens
gtacaataactagtcttatagt

SEQ ID NO: 7515304 - DNA, 22 bp, Homo sapiens
gtacaataactagtcttatagt

SEQ ID NO: 7515305 - DNA, 22 bp, Homo sapiens
gtacaagttgcctaccttaagt

SEQ ID NO: 7515306 - DNA, 22 bp, Homo sapiens
gtacaagttgcctaccttaagt

SEQ ID NO: 7515307 - DNA, 22 bp, Homo sapiens
gtacaataactagtcttatagt

SEQ ID NO: 7515308 - DNA, 22 bp, Homo sapiens
gtacaataactagtcttatagt

SEQ ID NO: 7515309 - DNA, 22 bp, Homo sapiens
gtacaataactagtcttatagt

SEQ ID NO: 7515310 - DNA, 22 bp, Homo sapiens
gtacaagtgtatttggcttgat

SEQ ID NO: 7515311 - DNA, 22 bp, Homo sapiens
gtacaagtgtatttggcttgat

SEQ ID NO: 7515312 - DNA, 22 bp, Homo sapiens
gtacaagtgtgtgtttgagcag

SEQ ID NO: 7515313 - DNA, 22 bp, Homo sapiens
gtacaagttctactctataaat

SEQ ID NO: 7515314 - DNA, 22 bp, Homo sapiens
gtacaagttctactctataaat

SEQ ID NO: 7515315 - DNA, 22 bp, Homo sapiens
gggccggagctgggtcccgcgc

SEQ ID NO: 7515316 - DNA, 22 bp, Homo sapiens
gggccggagctgggtcccgcgc

SEQ ID NO: 7515317 - DNA, 22 bp, Homo sapiens
gggccggagctgggtcccgcgc

SEQ ID NO: 7515318 - DNA, 22 bp, Homo sapiens
gggccggagctgggtcccgcgc

SEQ ID NO: 7515319 - DNA, 22 bp, Homo sapiens
gggccggagctgggtcccgcgc

SEQ ID NO: 7515320 - DNA, 22 bp, Homo sapiens
gggccgtagaccacgtccgggc

SEQ ID NO: 7515321 - DNA, 22 bp, Homo sapiens
gggcctcaaatctcccgcttat

SEQ ID NO: 7515322 - DNA, 22 bp, Homo sapiens
gggcctcaaatctcccgcttat

SEQ ID NO: 7515323 - DNA, 22 bp, Homo sapiens
gggcctcaaatctcccgcttat

SEQ ID NO: 7515324 - DNA, 22 bp, Homo sapiens
gggccctgtgatttcttgagga

SEQ ID NO: 7515325 - DNA, 22 bp, Homo sapiens
gggccctgtgatttcttgagga

SEQ ID NO: 7515326 - DNA, 22 bp, Homo sapiens
gggccctgtgatttcttgagga

SEQ ID NO: 7515327 - DNA, 22 bp, Homo sapiens
gggccctgtgatttcttgagga

SEQ ID NO: 7515328 - DNA, 22 bp, Homo sapiens
gggccctgtgatttcttgagga

SEQ ID NO: 7515329 - DNA, 22 bp, Homo sapiens
gggccctggggcctgatttgca

SEQ ID NO: 7515330 - DNA, 22 bp, Homo sapiens
gggccctggggatgtggacgcg

SEQ ID NO: 7515331 - DNA, 22 bp, Homo sapiens
gggccctggggcctgatttgca

SEQ ID NO: 7515332 - DNA, 22 bp, Homo sapiens
gggccctggggcctgatttgca

SEQ ID NO: 7515333 - DNA, 22 bp, Homo sapiens
gggccctggggcctgatttgca

SEQ ID NO: 7515334 - DNA, 22 bp, Homo sapiens
gggctcagacatccctcctgga

SEQ ID NO: 7515335 - DNA, 18 bp, Homo sapiens
gggctcacacaggtcatc

SEQ ID NO: 7515336 - DNA, 18 bp, Homo sapiens
gggctcacacaggtcatc

SEQ ID NO: 7515337 - DNA, 22 bp, Homo sapiens
gggctatagcactatgtatggg

SEQ ID NO: 7515338 - DNA, 22 bp, Homo sapiens
gggctatagcactatgtatggg

SEQ ID NO: 7515339 - DNA, 22 bp, Homo sapiens
gggctaggtctgatcagagaag

SEQ ID NO: 7515340 - DNA, 22 bp, Homo sapiens
gggctatggccacctggaccca

SEQ ID NO: 7515341 - DNA, 22 bp, Homo sapiens
gggctatgtgtgtcttagtcaa

SEQ ID NO: 7515342 - DNA, 22 bp, Homo sapiens
gggcctcacctctccaccgcct

SEQ ID NO: 7515343 - DNA, 22 bp, Homo sapiens
gggcctcacctctccaccgcct

SEQ ID NO: 7515344 - DNA, 22 bp, Homo sapiens
gggcctcacctctccaccgcct

SEQ ID NO: 7515345 - DNA, 19 bp, Homo sapiens
gggcctcacccacacctcc

SEQ ID NO: 7515346 - DNA, 19 bp, Homo sapiens
gggcctcacccacacctcc

SEQ ID NO: 7515347 - DNA, 19 bp, Homo sapiens
gggcctcacccacacctcc

SEQ ID NO: 7515348 - DNA, 22 bp, Homo sapiens
gggcctcactatgtggtccagg

SEQ ID NO: 7515349 - DNA, 22 bp, Homo sapiens
gggcctcactatgtggtccagg

SEQ ID NO: 7515350 - DNA, 22 bp, Homo sapiens
gggcctcactatgtggtccagg

SEQ ID NO: 7515351 - DNA, 22 bp, Homo sapiens
gggcctcagagatggtcagtga

SEQ ID NO: 7515352 - DNA, 22 bp, Homo sapiens
gggctaggtctgatcagagaag

SEQ ID NO: 7515353 - DNA, 22 bp, Homo sapiens
gggcctcagagatggtcagtga

SEQ ID NO: 7515354 - DNA, 22 bp, Homo sapiens
gggcctcagagatggtcagtga

SEQ ID NO: 7515355 - DNA, 22 bp, Homo sapiens
gggccctgatctgtgagcgcag

SEQ ID NO: 7515356 - DNA, 22 bp, Homo sapiens
gggccctgatctgtgagcgcag

SEQ ID NO: 7515357 - DNA, 22 bp, Homo sapiens
gggccctgatctgtgagcgcag

SEQ ID NO: 7515358 - DNA, 22 bp, Homo sapiens
gggccctgatctgtgagcgcag

SEQ ID NO: 7515359 - DNA, 22 bp, Homo sapiens
gggccctgatctgtgagcgcag

SEQ ID NO: 7515360 - DNA, 22 bp, Homo sapiens
gggccctcagtcccaggccttc

SEQ ID NO: 7515361 - DNA, 22 bp, Homo sapiens
gggccctcagtcccaggccttc

SEQ ID NO: 7515362 - DNA, 22 bp, Homo sapiens
gggccctcagtcccaggccttc

SEQ ID NO: 7515363 - DNA, 22 bp, Homo sapiens
gggccccttgtatctctggctc

SEQ ID NO: 7515364 - DNA, 22 bp, Homo sapiens
gggcccggaccttcctctctga

SEQ ID NO: 7515365 - DNA, 22 bp, Homo sapiens
gggccctctgcagctgcccagg

SEQ ID NO: 7515366 - DNA, 22 bp, Homo sapiens
gggccctctgcagctgcccagg

SEQ ID NO: 7515367 - DNA, 22 bp, Homo sapiens
gggccctctgcagctgcccagg

SEQ ID NO: 7515368 - DNA, 22 bp, Homo sapiens
gggccctgccccgtggctctga

SEQ ID NO: 7515369 - DNA, 22 bp, Homo sapiens
gggccctgccccgtggctctga

SEQ ID NO: 7515370 - DNA, 22 bp, Homo sapiens
gggccctgccccgtggctctga

SEQ ID NO: 7515371 - DNA, 22 bp, Homo sapiens
gggccctgccccgtggctctga

SEQ ID NO: 7515372 - DNA, 22 bp, Homo sapiens
gggccctgccccgtggctctga

SEQ ID NO: 7515373 - DNA, 22 bp, Homo sapiens
gggccctgcctaaggaacacac

SEQ ID NO: 7515374 - DNA, 22 bp, Homo sapiens
gggccctgcctaaggaacacac

SEQ ID NO: 7515375 - DNA, 22 bp, Homo sapiens
gggccctgcctaaggaacacac

SEQ ID NO: 7515376 - DNA, 22 bp, Homo sapiens
gggccctgcctaaggaacacac

SEQ ID NO: 7515377 - DNA, 22 bp, Homo sapiens
gggccctgcctaaggaacacac

SEQ ID NO: 7515378 - DNA, 22 bp, Homo sapiens
gggccctgcctaaggaacacac

SEQ ID NO: 7515379 - DNA, 22 bp, Homo sapiens
gggccctgcgactcgcggcgga

SEQ ID NO: 7515380 - DNA, 22 bp, Homo sapiens
gggccctgcgactcgcggcgga

SEQ ID NO: 7515381 - DNA, 22 bp, Homo sapiens
gggccctgggattcagagcaag

SEQ ID NO: 7515382 - DNA, 22 bp, Homo sapiens
gggccctggggatgtggacgcg

SEQ ID NO: 7515383 - DNA, 22 bp, Homo sapiens
gggccctggggatgtggacgcg

SEQ ID NO: 7515384 - DNA, 22 bp, Homo sapiens
gggccctggggatgtggacgcg

SEQ ID NO: 7515385 - DNA, 22 bp, Homo sapiens
gggccctgggattcagagcaag

SEQ ID NO: 7515386 - DNA, 22 bp, Homo sapiens
gggccctgggattcagagcaag

SEQ ID NO: 7515387 - DNA, 22 bp, Homo sapiens
gggccctgggattcagagcaag

SEQ ID NO: 7515388 - DNA, 22 bp, Homo sapiens
gggcaggtgtttccaaggtgag

SEQ ID NO: 7515389 - DNA, 22 bp, Homo sapiens
gggcaggtgtttccaaggtgag

SEQ ID NO: 7515390 - DNA, 22 bp, Homo sapiens
gggcaggtgtttccaaggtgag

SEQ ID NO: 7515391 - DNA, 22 bp, Homo sapiens
gggcaggtgtttccaaggtgag

SEQ ID NO: 7515392 - DNA, 22 bp, Homo sapiens
gggcaggtgtttccaaggtgag

SEQ ID NO: 7515393 - DNA, 22 bp, Homo sapiens
gggcaggtgtttccaaggtgag

SEQ ID NO: 7515394 - DNA, 22 bp, Homo sapiens
gggcaggtgttgtcaatctaat

SEQ ID NO: 7515395 - DNA, 22 bp, Homo sapiens
gggcaggtgtttccaaggtgag

SEQ ID NO: 7515396 - DNA, 22 bp, Homo sapiens
gggcaggtgtgcagagctgttg

SEQ ID NO: 7515397 - DNA, 22 bp, Homo sapiens
gggcaggtgtgcagagctgttg

SEQ ID NO: 7515398 - DNA, 22 bp, Homo sapiens
gggcaggtgtgcagagctgttg

SEQ ID NO: 7515399 - DNA, 22 bp, Homo sapiens
gggcaggtgtgcagagctgttg

SEQ ID NO: 7515400 - DNA, 22 bp, Homo sapiens
gggcaggtggcaaagccagagg

SEQ ID NO: 7515401 - DNA, 22 bp, Homo sapiens
gggcaggtggcagggtctctgg

SEQ ID NO: 7515402 - DNA, 22 bp, Homo sapiens
gggcaggtggcaaagccagagg

SEQ ID NO: 7515403 - DNA, 22 bp, Homo sapiens
gggcaggtggcagggtctctgg

SEQ ID NO: 7515404 - DNA, 22 bp, Homo sapiens
gggcaggtggcagggtctctgg

SEQ ID NO: 7515405 - DNA, 22 bp, Homo sapiens
gggcaggtggcagggtctctgg

SEQ ID NO: 7515406 - DNA, 22 bp, Homo sapiens
gggcaggtggcctcttgtacta

SEQ ID NO: 7515407 - DNA, 22 bp, Homo sapiens
gggcaggtgcccagggccagag

SEQ ID NO: 7515408 - DNA, 22 bp, Homo sapiens
gggcaggtggagggcccagcca

SEQ ID NO: 7515409 - DNA, 22 bp, Homo sapiens
gggcaggtggagggcccagcca

SEQ ID NO: 7515410 - DNA, 22 bp, Homo sapiens
gggcaggtggagggcccagcca

SEQ ID NO: 7515411 - DNA, 22 bp, Homo sapiens
gggccccagtcctcccacgtgg

SEQ ID NO: 7515412 - DNA, 22 bp, Homo sapiens
gggccccagtcctcccacgtgg

SEQ ID NO: 7515413 - DNA, 22 bp, Homo sapiens
gggccccactggggctgcctgc

SEQ ID NO: 7515414 - DNA, 22 bp, Homo sapiens
gggccccactggggctgcctgc

SEQ ID NO: 7515415 - DNA, 22 bp, Homo sapiens
gggccccactggggctgcctgc

SEQ ID NO: 7515416 - DNA, 22 bp, Homo sapiens
gggcccctgggaattctgtgat

SEQ ID NO: 7515417 - DNA, 22 bp, Homo sapiens
gggcccctgggaattctgtgat

SEQ ID NO: 7515418 - DNA, 22 bp, Homo sapiens
gggccccagtcctcccacgtgg

SEQ ID NO: 7515419 - DNA, 22 bp, Homo sapiens
gggccccttgtatctctggctc

SEQ ID NO: 7515420 - DNA, 22 bp, Homo sapiens
gggccccttgtatctctggctc

SEQ ID NO: 7515421 - DNA, 22 bp, Homo sapiens
gggccccttgtatctctggctc

SEQ ID NO: 7515422 - DNA, 22 bp, Homo sapiens
gggccccttgtatctctggctc

SEQ ID NO: 7515423 - DNA, 22 bp, Homo sapiens
gggccccttgctgctctgctgg

SEQ ID NO: 7515424 - DNA, 22 bp, Homo sapiens
gggccccttgctgctctgctgg

SEQ ID NO: 7515425 - DNA, 22 bp, Homo sapiens
gggcccctgggaattctgtgat

SEQ ID NO: 7515426 - DNA, 22 bp, Homo sapiens
gggccccttgctgctctgctgg

SEQ ID NO: 7515427 - DNA, 22 bp, Homo sapiens
gggccccttgctgctctgctgg

SEQ ID NO: 7515428 - DNA, 22 bp, Homo sapiens
gggccccttgctgctctgctgg

SEQ ID NO: 7515429 - DNA, 22 bp, Homo sapiens
gggcccagtaccctctgccaag

SEQ ID NO: 7515430 - DNA, 22 bp, Homo sapiens
gggcccagtaccctctgccaag

SEQ ID NO: 7515431 - DNA, 22 bp, Homo sapiens
gggcccagtaccctctgccaag

SEQ ID NO: 7515432 - DNA, 22 bp, Homo sapiens
gggcccagtaccctctgccaag

SEQ ID NO: 7515433 - DNA, 22 bp, Homo sapiens
gggcccaggcctccttccttcc

SEQ ID NO: 7515434 - DNA, 22 bp, Homo sapiens
gggcccagtaccctctgccaag

SEQ ID NO: 7515435 - DNA, 22 bp, Homo sapiens
gggcccagtaccctctgccaag

SEQ ID NO: 7515436 - DNA, 22 bp, Homo sapiens
gggcccaggcctccttccttcc

SEQ ID NO: 7515437 - DNA, 22 bp, Homo sapiens
gggcaggtgtttccaaggtgag

SEQ ID NO: 7515438 - DNA, 22 bp, Homo sapiens
gggccccaagaacctcctcctg

SEQ ID NO: 7515439 - DNA, 22 bp, Homo sapiens
gggccccaagaacctcctcctg

SEQ ID NO: 7515440 - DNA, 22 bp, Homo sapiens
gggccccaaaatgccaggctct

SEQ ID NO: 7515441 - DNA, 22 bp, Homo sapiens
gggccccaagaacctcctcctg

SEQ ID NO: 7515442 - DNA, 22 bp, Homo sapiens
gggccccaaaatgccaggctct

SEQ ID NO: 7515443 - DNA, 22 bp, Homo sapiens
gggcccagtaccctctgccaag

SEQ ID NO: 7515444 - DNA, 22 bp, Homo sapiens
gggcccagtaccctctgccaag

SEQ ID NO: 7515445 - DNA, 22 bp, Homo sapiens
gggcccagtaccctctgccaag

SEQ ID NO: 7515446 - DNA, 22 bp, Homo sapiens
gggctcagctgggcgtgctggt

SEQ ID NO: 7515447 - DNA, 22 bp, Homo sapiens
gggctcagctccttccttccta

SEQ ID NO: 7515448 - DNA, 22 bp, Homo sapiens
gggctcagctccttccttccta

SEQ ID NO: 7515449 - DNA, 22 bp, Homo sapiens
gggctcagctccttccttccta

SEQ ID NO: 7515450 - DNA, 22 bp, Homo sapiens
gggctcagctccttccttccta

SEQ ID NO: 7515451 - DNA, 22 bp, Homo sapiens
gggctcagctgggcgtgctggt

SEQ ID NO: 7515452 - DNA, 22 bp, Homo sapiens
gggctcagctgggcgtgctggt

SEQ ID NO: 7515453 - DNA, 22 bp, Homo sapiens
gggctcagctgggcgtgctggt

SEQ ID NO: 7515454 - DNA, 22 bp, Homo sapiens
gggctcagctgggcgtgctggt

SEQ ID NO: 7515455 - DNA, 22 bp, Homo sapiens
gggctcagctgggcgtgctggt

SEQ ID NO: 7515456 - DNA, 21 bp, Homo sapiens
gggctcagcgctcggctcctc

SEQ ID NO: 7515457 - DNA, 21 bp, Homo sapiens
gggctcagcgctcggctcctc

SEQ ID NO: 7515458 - DNA, 21 bp, Homo sapiens
gggctcagcgctcggctcctc

SEQ ID NO: 7515459 - DNA, 22 bp, Homo sapiens
gggctcagctccttccttccta

SEQ ID NO: 7515460 - DNA, 22 bp, Homo sapiens
gggctcagctccttccttccta

SEQ ID NO: 7515461 - DNA, 22 bp, Homo sapiens
gggctcagctccttccttccta

SEQ ID NO: 7515462 - DNA, 22 bp, Homo sapiens
gggctcagctccttccttccta

SEQ ID NO: 7515463 - DNA, 22 bp, Homo sapiens
gggctcagttctgcttcatgct

SEQ ID NO: 7515464 - DNA, 22 bp, Homo sapiens
gggctcagttctgcttcatgct

SEQ ID NO: 7515465 - DNA, 22 bp, Homo sapiens
gggctcatcaagcctctccgcc

SEQ ID NO: 7515466 - DNA, 22 bp, Homo sapiens
gggctcatcagctaggaaaatg

SEQ ID NO: 7515467 - DNA, 22 bp, Homo sapiens
gggctcatcatctgtgggggat

SEQ ID NO: 7515468 - DNA, 22 bp, Homo sapiens
gggctcattcatctgggcttgg

SEQ ID NO: 7515469 - DNA, 22 bp, Homo sapiens
gggctcatggacagctctccag

SEQ ID NO: 7515470 - DNA, 22 bp, Homo sapiens
gggctcatggacagctctccag

SEQ ID NO: 7515471 - DNA, 22 bp, Homo sapiens
gggctcatgatgtaggctggta

SEQ ID NO: 7515472 - DNA, 22 bp, Homo sapiens
gggctcatcaagcctctccgcc

SEQ ID NO: 7515473 - DNA, 22 bp, Homo sapiens
gggctcatcatctgtgggggat

SEQ ID NO: 7515474 - DNA, 22 bp, Homo sapiens
gggctcatgatgtaggctggta

SEQ ID NO: 7515475 - DNA, 22 bp, Homo sapiens
gggctcaggagtttgaggctgc

SEQ ID NO: 7515476 - DNA, 21 bp, Homo sapiens
gggctcagtggaaaagagtgt

SEQ ID NO: 7515477 - DNA, 21 bp, Homo sapiens
gggctcagtggaaaagagtgt

SEQ ID NO: 7515478 - DNA, 21 bp, Homo sapiens
gggctcagtggaaaagagtgt

SEQ ID NO: 7515479 - DNA, 22 bp, Homo sapiens
gggctcagttctgcttcatgct

SEQ ID NO: 7515480 - DNA, 22 bp, Homo sapiens
gggctcagttctgcttcatgct

SEQ ID NO: 7515481 - DNA, 22 bp, Homo sapiens
gggctcagttctgcttcatgct

SEQ ID NO: 7515482 - DNA, 22 bp, Homo sapiens
gggctcagttctgcttcatgct

SEQ ID NO: 7515483 - DNA, 22 bp, Homo sapiens
gggctcagttctgcttcatgct

SEQ ID NO: 7515484 - DNA, 16 bp, Homo sapiens
gggctcagatctttga

SEQ ID NO: 7515485 - DNA, 22 bp, Homo sapiens
gggctcagaggagtggcctggg

SEQ ID NO: 7515486 - DNA, 23 bp, Homo sapiens
gggctcagatttcattctgtgcc

SEQ ID NO: 7515487 - DNA, 23 bp, Homo sapiens
gggctcagatttcattctgtgcc

SEQ ID NO: 7515488 - DNA, 23 bp, Homo sapiens
gggctcagatttcattctgtgcc

SEQ ID NO: 7515489 - DNA, 22 bp, Homo sapiens
gggctcagccccattgaaccag

SEQ ID NO: 7515490 - DNA, 23 bp, Homo sapiens
gggctcagatttcattctgtgcc

SEQ ID NO: 7515491 - DNA, 22 bp, Homo sapiens
gggctcagcctcctcacttcga

SEQ ID NO: 7515492 - DNA, 22 bp, Homo sapiens
gggctcagcctcctcacttcga

SEQ ID NO: 7515493 - DNA, 22 bp, Homo sapiens
gggctcagccccattgaaccag

SEQ ID NO: 7515494 - DNA, 22 bp, Homo sapiens
gggctcagcctcctcacttcga

SEQ ID NO: 7515495 - DNA, 22 bp, Homo sapiens
gggctcagcctcctcacttcga

SEQ ID NO: 7515496 - DNA, 21 bp, Homo sapiens
gggctcagcgctcggctcctc

SEQ ID NO: 7515497 - DNA, 22 bp, Homo sapiens
gggctcagacatccctcctgga

SEQ ID NO: 7515498 - DNA, 22 bp, Homo sapiens
gggctcagagcatttgggttgg

SEQ ID NO: 7515499 - DNA, 22 bp, Homo sapiens
gggctcagagcatttgggttgg

SEQ ID NO: 7515500 - DNA, 22 bp, Homo sapiens
gggctcagagcatttgggttgg

SEQ ID NO: 7515501 - DNA, 22 bp, Homo sapiens
gggctcagacatccctcctgga

SEQ ID NO: 7515502 - DNA, 22 bp, Homo sapiens
gggctcagacatccctcctgga

SEQ ID NO: 7515503 - DNA, 22 bp, Homo sapiens
gggctcagacatccctcctgga

SEQ ID NO: 7515504 - DNA, 22 bp, Homo sapiens
gggctcagacatccctcctgga

SEQ ID NO: 7515505 - DNA, 22 bp, Homo sapiens
gggctcagacatccctcctgga

SEQ ID NO: 7515506 - DNA, 22 bp, Homo sapiens
gggctcagagcatttgggttgg

SEQ ID NO: 7515507 - DNA, 22 bp, Homo sapiens
gggctcagaggagtggcctggg

SEQ ID NO: 7515508 - DNA, 22 bp, Homo sapiens
gggctcagaggagtggcctggg

SEQ ID NO: 7515509 - DNA, 22 bp, Homo sapiens
gggctcagaggagtggcctggg

SEQ ID NO: 7515510 - DNA, 22 bp, Homo sapiens
gggctcagaggagtggcctggg

SEQ ID NO: 7515511 - DNA, 22 bp, Homo sapiens
gggctcagaggagtggcctggg

SEQ ID NO: 7515512 - DNA, 22 bp, Homo sapiens
gggctcagaggagtggcctggg

SEQ ID NO: 7515513 - DNA, 22 bp, Homo sapiens
gggctcagaggagtggcctggg

SEQ ID NO: 7515514 - DNA, 22 bp, Homo sapiens
gggctcagaggagtggcctggg

SEQ ID NO: 7515515 - DNA, 22 bp, Homo sapiens
gggctctgaatgagttaccaag

SEQ ID NO: 7515516 - DNA, 22 bp, Homo sapiens
gggctctgactgaatattgaat

SEQ ID NO: 7515517 - DNA, 22 bp, Homo sapiens
gggctctgactgaatattgaat

SEQ ID NO: 7515518 - DNA, 22 bp, Homo sapiens
gggctctgagctctgggaatta

SEQ ID NO: 7515519 - DNA, 22 bp, Homo sapiens
gggctctggaaatgggagctcc

SEQ ID NO: 7515520 - DNA, 22 bp, Homo sapiens
gggctccaactacatcagcctt

SEQ ID NO: 7515521 - DNA, 22 bp, Homo sapiens
gggctccaactacatcagcctt

SEQ ID NO: 7515522 - DNA, 22 bp, Homo sapiens
gggctccaactacatcagcctt

SEQ ID NO: 7515523 - DNA, 22 bp, Homo sapiens
gggctccaactacatcagcctt

SEQ ID NO: 7515524 - DNA, 22 bp, Homo sapiens
gggctccaactacatcagcctt

SEQ ID NO: 7515525 - DNA, 22 bp, Homo sapiens
gggctctgaatcccaggtctgc

SEQ ID NO: 7515526 - DNA, 22 bp, Homo sapiens
gggctctgaatcccaggtctgc

SEQ ID NO: 7515527 - DNA, 22 bp, Homo sapiens
gggctccaaggaggccagcctg

SEQ ID NO: 7515528 - DNA, 22 bp, Homo sapiens
gggctccaaggaggccagcctg

SEQ ID NO: 7515529 - DNA, 22 bp, Homo sapiens
gggctccaactacatcagcctt

SEQ ID NO: 7515530 - DNA, 22 bp, Homo sapiens
gggctccaaggaggccagcctg

SEQ ID NO: 7515531 - DNA, 22 bp, Homo sapiens
gggctccaacggtgagcatgga

SEQ ID NO: 7515532 - DNA, 22 bp, Homo sapiens
gggctccaacggtgagcatgga

SEQ ID NO: 7515533 - DNA, 22 bp, Homo sapiens
gggctccaacggtgagcatgga

SEQ ID NO: 7515534 - DNA, 22 bp, Homo sapiens
gggctccaacggtgagcatgga

SEQ ID NO: 7515535 - DNA, 22 bp, Homo sapiens
gggctccaacggtgagcatgga

SEQ ID NO: 7515536 - DNA, 22 bp, Homo sapiens
gggctccaaccccagtgaactc

SEQ ID NO: 7515537 - DNA, 22 bp, Homo sapiens
gggctccaacggtgagcatgga

SEQ ID NO: 7515538 - DNA, 22 bp, Homo sapiens
gggctccaaccccagtgaactc

SEQ ID NO: 7515539 - DNA, 22 bp, Homo sapiens
gggctccaaaatctatgtcttc

SEQ ID NO: 7515540 - DNA, 22 bp, Homo sapiens
gggctccaaaatctatgtcttc

SEQ ID NO: 7515541 - DNA, 22 bp, Homo sapiens
gggctccaaagtaagctttagt

SEQ ID NO: 7515542 - DNA, 22 bp, Homo sapiens
gggctccaaaatcctgtagcct

SEQ ID NO: 7515543 - DNA, 22 bp, Homo sapiens
gggctcattcatctgggcttgg

SEQ ID NO: 7515544 - DNA, 22 bp, Homo sapiens
gggctcattcatctgggcttgg

SEQ ID NO: 7515545 - DNA, 22 bp, Homo sapiens
gggctcattgggcgctttctaa

SEQ ID NO: 7515546 - DNA, 22 bp, Homo sapiens
gggctccaaaatcctgtagcct

SEQ ID NO: 7515547 - DNA, 22 bp, Homo sapiens
gggctccaaaatcctgtagcct

SEQ ID NO: 7515548 - DNA, 22 bp, Homo sapiens
gggctccaaaatcctgtagcct

SEQ ID NO: 7515549 - DNA, 22 bp, Homo sapiens
gggctccaaaatcctgtagcct

SEQ ID NO: 7515550 - DNA, 22 bp, Homo sapiens
gggctctggatggagcctgcag

SEQ ID NO: 7515551 - DNA, 18 bp, Homo sapiens
gggctctggcatctgggt

SEQ ID NO: 7515552 - DNA, 18 bp, Homo sapiens
gggctctggcatctgggt

SEQ ID NO: 7515553 - DNA, 18 bp, Homo sapiens
gggctctggcatctgggt

SEQ ID NO: 7515554 - DNA, 18 bp, Homo sapiens
gggctctggcatctgggt

SEQ ID NO: 7515555 - DNA, 22 bp, Homo sapiens
gggctctggatggagcctgcag

SEQ ID NO: 7515556 - DNA, 22 bp, Homo sapiens
gggctctggatggagcctgcag

SEQ ID NO: 7515557 - DNA, 22 bp, Homo sapiens
gggctctggagttctagaaaga

SEQ ID NO: 7515558 - DNA, 22 bp, Homo sapiens
gggctctggagttctagaaaga

SEQ ID NO: 7515559 - DNA, 22 bp, Homo sapiens
gggctctggagttctagaaaga

SEQ ID NO: 7515560 - DNA, 22 bp, Homo sapiens
gggctctggagttctagaaaga

SEQ ID NO: 7515561 - DNA, 22 bp, Homo sapiens
gggctctggatggagcctgcag

SEQ ID NO: 7515562 - DNA, 22 bp, Homo sapiens
gggctctggatggagcctgcag

SEQ ID NO: 7515563 - DNA, 22 bp, Homo sapiens
gggctctggagttctagaaaga

SEQ ID NO: 7515564 - DNA, 22 bp, Homo sapiens
gggctctggatggagcctgcag

SEQ ID NO: 7515565 - DNA, 22 bp, Homo sapiens
gggctctggatggagcctgcag

SEQ ID NO: 7515566 - DNA, 22 bp, Homo sapiens
gggctctggatggagcctgcag

SEQ ID NO: 7515567 - DNA, 22 bp, Homo sapiens
gggctctggatggagcctgcag

SEQ ID NO: 7515568 - DNA, 22 bp, Homo sapiens
gggctctggaaggtgcaccatg

SEQ ID NO: 7515569 - DNA, 22 bp, Homo sapiens
gggctctggaaggtgcaccatg

SEQ ID NO: 7515570 - DNA, 22 bp, Homo sapiens
gggctctggaaggtgcaccatg

SEQ ID NO: 7515571 - DNA, 22 bp, Homo sapiens
gggctctggaaggtgcaccatg

SEQ ID NO: 7515572 - DNA, 22 bp, Homo sapiens
gggctctggaaatgggagctcc

SEQ ID NO: 7515573 - DNA, 20 bp, Homo sapiens
gggctctgcttggcagaagt

SEQ ID NO: 7515574 - DNA, 22 bp, Homo sapiens
gggctctggaaatgggagctcc

SEQ ID NO: 7515575 - DNA, 22 bp, Homo sapiens
gggctctggaaatgggagctcc

SEQ ID NO: 7515576 - DNA, 22 bp, Homo sapiens
gggctctggaaatgggagctcc

SEQ ID NO: 7515577 - DNA, 22 bp, Homo sapiens
gggctctggacccaggcaagag

SEQ ID NO: 7515578 - DNA, 22 bp, Homo sapiens
gggctctggacccaggcaagag

SEQ ID NO: 7515579 - DNA, 22 bp, Homo sapiens
gggctctggacccaggcaagag

SEQ ID NO: 7515580 - DNA, 22 bp, Homo sapiens
gggctctggaaggtgcaccatg

SEQ ID NO: 7515581 - DNA, 22 bp, Homo sapiens
gggctctggaaggtgcaccatg

SEQ ID NO: 7515582 - DNA, 22 bp, Homo sapiens
gggctctggacccaggcaagag

SEQ ID NO: 7515583 - DNA, 22 bp, Homo sapiens
gggctctggacccaggcaagag

SEQ ID NO: 7515584 - DNA, 22 bp, Homo sapiens
gggagtcagtgaaggagtcaga

SEQ ID NO: 7515585 - DNA, 22 bp, Homo sapiens
gggagtcagtgaaggagtcaga

SEQ ID NO: 7515586 - DNA, 22 bp, Homo sapiens
gggagtcaggctccctcagaga

SEQ ID NO: 7515587 - DNA, 22 bp, Homo sapiens
gggagtcaggctccctcagaga

SEQ ID NO: 7515588 - DNA, 22 bp, Homo sapiens
gggagtccaaattggtacaata

SEQ ID NO: 7515589 - DNA, 22 bp, Homo sapiens
gggagtctgggctagactcctt

SEQ ID NO: 7515590 - DNA, 22 bp, Homo sapiens
gggagtggagagcaatggatga

SEQ ID NO: 7515591 - DNA, 22 bp, Homo sapiens
gggagtggagagcaatggatga

SEQ ID NO: 7515592 - DNA, 22 bp, Homo sapiens
gggagtggagagcaatggatga

SEQ ID NO: 7515593 - DNA, 22 bp, Homo sapiens
gggagtggattatgtggaccca

SEQ ID NO: 7515594 - DNA, 22 bp, Homo sapiens
gggagtggattatgtggaccca

SEQ ID NO: 7515595 - DNA, 22 bp, Homo sapiens
gggagtggattatgtggaccca

SEQ ID NO: 7515596 - DNA, 22 bp, Homo sapiens
gggagtggagagcaatggatga

SEQ ID NO: 7515597 - DNA, 22 bp, Homo sapiens
gggagtggattatgtggaccca

SEQ ID NO: 7515598 - DNA, 22 bp, Homo sapiens
gggaggttgaggctgcagtgag

SEQ ID NO: 7515599 - DNA, 22 bp, Homo sapiens
gggaggttgaggctgcagtgag

SEQ ID NO: 7515600 - DNA, 22 bp, Homo sapiens
gggagtcagagaggtaatggga

SEQ ID NO: 7515601 - DNA, 22 bp, Homo sapiens
gggaggttgaggctgcagtgag

SEQ ID NO: 7515602 - DNA, 22 bp, Homo sapiens
gggaggttgaggctgcagtgag

SEQ ID NO: 7515603 - DNA, 22 bp, Homo sapiens
gggaggttgaggctgcagtgag

SEQ ID NO: 7515604 - DNA, 22 bp, Homo sapiens
gggaggttgaggctgcagtgag

SEQ ID NO: 7515605 - DNA, 22 bp, Homo sapiens
gggaggttgaggctgcagtgag

SEQ ID NO: 7515606 - DNA, 22 bp, Homo sapiens
gggagctgaatggcaatggaga

SEQ ID NO: 7515607 - DNA, 22 bp, Homo sapiens
gggagctgaatggcaatggaga

SEQ ID NO: 7515608 - DNA, 22 bp, Homo sapiens
gggagctgaatggcaatggaga

SEQ ID NO: 7515609 - DNA, 22 bp, Homo sapiens
gggagcgggactgcgcaggctt

SEQ ID NO: 7515610 - DNA, 22 bp, Homo sapiens
gggagcgggactgcgcaggctt

SEQ ID NO: 7515611 - DNA, 22 bp, Homo sapiens
gggagcgggactgcgcaggctt

SEQ ID NO: 7515612 - DNA, 22 bp, Homo sapiens
gggagcgggactgcgcaggctt

SEQ ID NO: 7515613 - DNA, 22 bp, Homo sapiens
gggagccttgggagtgccagcc

SEQ ID NO: 7515614 - DNA, 22 bp, Homo sapiens
gggagcgggactgcgcaggctt

SEQ ID NO: 7515615 - DNA, 22 bp, Homo sapiens
gggagccttgggagtgccagcc

SEQ ID NO: 7515616 - DNA, 22 bp, Homo sapiens
gggagcgcccctgcctgtttga

SEQ ID NO: 7515617 - DNA, 22 bp, Homo sapiens
gggagccttgggagtgccagcc

SEQ ID NO: 7515618 - DNA, 22 bp, Homo sapiens
gggagctatttatagaggctga

SEQ ID NO: 7515619 - DNA, 22 bp, Homo sapiens
gggagctatgacactagcacca

SEQ ID NO: 7515620 - DNA, 22 bp, Homo sapiens
gggagctccactgcctctcatt

SEQ ID NO: 7515621 - DNA, 22 bp, Homo sapiens
gggagcgcccctgcctgtttga

SEQ ID NO: 7515622 - DNA, 22 bp, Homo sapiens
gggagctccactgcctctcatt

SEQ ID NO: 7515623 - DNA, 22 bp, Homo sapiens
gggagctcgtgcgcccaggtgc

SEQ ID NO: 7515624 - DNA, 22 bp, Homo sapiens
gggagctctccctgaggcctgg

SEQ ID NO: 7515625 - DNA, 22 bp, Homo sapiens
gggagctctccctgaggcctgg

SEQ ID NO: 7515626 - DNA, 22 bp, Homo sapiens
gggagctctccctgaggcctgg

SEQ ID NO: 7515627 - DNA, 22 bp, Homo sapiens
gggagctctccctgaggcctgg

SEQ ID NO: 7515628 - DNA, 22 bp, Homo sapiens
gggagctctccctgaggcctgg

SEQ ID NO: 7515629 - DNA, 22 bp, Homo sapiens
gggagctgaactgctgaagttg

SEQ ID NO: 7515630 - DNA, 22 bp, Homo sapiens
gggagctgaaggagccggcggg

SEQ ID NO: 7515631 - DNA, 22 bp, Homo sapiens
gggagctgaaggagccggcggg

SEQ ID NO: 7515632 - DNA, 22 bp, Homo sapiens
gggagctgaactgctgaagttg

SEQ ID NO: 7515633 - DNA, 22 bp, Homo sapiens
gggagctgaaggagccggcggg

SEQ ID NO: 7515634 - DNA, 22 bp, Homo sapiens
gggagctgaagtaggggtaaat

SEQ ID NO: 7515635 - DNA, 22 bp, Homo sapiens
gggagctgaaggagccggcggg

SEQ ID NO: 7515636 - DNA, 22 bp, Homo sapiens
gggagctgaactgctgaagttg

SEQ ID NO: 7515637 - DNA, 22 bp, Homo sapiens
gggagctgaagtaggggtaaat

SEQ ID NO: 7515638 - DNA, 22 bp, Homo sapiens
gggagctgaatggcaatggaga

SEQ ID NO: 7515639 - DNA, 22 bp, Homo sapiens
gggagctgaagtaggggtaaat

SEQ ID NO: 7515640 - DNA, 22 bp, Homo sapiens
gggagtgggtttggcctaggcc

SEQ ID NO: 7515641 - DNA, 22 bp, Homo sapiens
gggagtgggtttggcctaggcc

SEQ ID NO: 7515642 - DNA, 22 bp, Homo sapiens
gggagtgggtttggcctaggcc

SEQ ID NO: 7515643 - DNA, 22 bp, Homo sapiens
gggagtgggtttggcctaggcc

SEQ ID NO: 7515644 - DNA, 22 bp, Homo sapiens
gggagtgggtttggcctaggcc

SEQ ID NO: 7515645 - DNA, 22 bp, Homo sapiens
gggagtgggtttggcctaggcc

SEQ ID NO: 7515646 - DNA, 22 bp, Homo sapiens
gggagtgggtttggcctaggcc

SEQ ID NO: 7515647 - DNA, 22 bp, Homo sapiens
gggagtgggtttggcctaggcc

SEQ ID NO: 7515648 - DNA, 22 bp, Homo sapiens
gggagtgggtttggcctaggcc

SEQ ID NO: 7515649 - DNA, 22 bp, Homo sapiens
gggagtgggtttggcctaggcc

SEQ ID NO: 7515650 - DNA, 22 bp, Homo sapiens
gggagtgggtttggcctaggcc

SEQ ID NO: 7515651 - DNA, 22 bp, Homo sapiens
gggagtgggtttggcctaggcc

SEQ ID NO: 7515652 - DNA, 22 bp, Homo sapiens
gggagtggggcttaccttgaag

SEQ ID NO: 7515653 - DNA, 22 bp, Homo sapiens
gggagtggggcttaccttgaag

SEQ ID NO: 7515654 - DNA, 22 bp, Homo sapiens
gggagtggggcttaccttgaag

SEQ ID NO: 7515655 - DNA, 22 bp, Homo sapiens
gggagtggggcttaccttgaag

SEQ ID NO: 7515656 - DNA, 22 bp, Homo sapiens
gggagtggggcttaccttgaag

SEQ ID NO: 7515657 - DNA, 22 bp, Homo sapiens
gggagtggattatgtggaccca

SEQ ID NO: 7515658 - DNA, 22 bp, Homo sapiens
gggagtggattatgtggaccca

SEQ ID NO: 7515659 - DNA, 22 bp, Homo sapiens
gggagtggattatgtggaccca

SEQ ID NO: 7515660 - DNA, 22 bp, Homo sapiens
gggagtggttgatggtgaaaat

SEQ ID NO: 7515661 - DNA, 22 bp, Homo sapiens
gggagtggttgatggtgaaaat

SEQ ID NO: 7515662 - DNA, 20 bp, Homo sapiens
gggagtggtggtagcctgtg

SEQ ID NO: 7515663 - DNA, 22 bp, Homo sapiens
gggagtggttgatggtgaaaat

SEQ ID NO: 7515664 - DNA, 20 bp, Homo sapiens
gggagtggtggtagcctgtg

SEQ ID NO: 7515665 - DNA, 22 bp, Homo sapiens
gggagtgggtttggcctaggcc

SEQ ID NO: 7515666 - DNA, 22 bp, Homo sapiens
gggagtgggtttggcctaggcc

SEQ ID NO: 7515667 - DNA, 22 bp, Homo sapiens
gggagtggtcctttcctatctg

SEQ ID NO: 7515668 - DNA, 22 bp, Homo sapiens
gggagtgggtttggcctaggcc

SEQ ID NO: 7515669 - DNA, 22 bp, Homo sapiens
gggagtgggtttggcctaggcc

SEQ ID NO: 7515670 - DNA, 22 bp, Homo sapiens
gggagtgggtttggcctaggcc

SEQ ID NO: 7515671 - DNA, 20 bp, Homo sapiens
gggagtggtggtagcctgtg

SEQ ID NO: 7515672 - DNA, 22 bp, Homo sapiens
gggagtggtcctttcctatctg

SEQ ID NO: 7515673 - DNA, 20 bp, Homo sapiens
gggagtggtggtagcctgtg

SEQ ID NO: 7515674 - DNA, 20 bp, Homo sapiens
gggagtggtggtagcctgtg

SEQ ID NO: 7515675 - DNA, 22 bp, Homo sapiens
gggataggtttggaagaggtgg

SEQ ID NO: 7515676 - DNA, 22 bp, Homo sapiens
gggataggagattgggagtgtt

SEQ ID NO: 7515677 - DNA, 22 bp, Homo sapiens
gggataggtttggaagaggtgg

SEQ ID NO: 7515678 - DNA, 22 bp, Homo sapiens
gggataggtttggaagaggtgg

SEQ ID NO: 7515679 - DNA, 22 bp, Homo sapiens
gggataggtttggaagaggtgg

SEQ ID NO: 7515680 - DNA, 22 bp, Homo sapiens
gggataggagattgggagtgtt

SEQ ID NO: 7515681 - DNA, 22 bp, Homo sapiens
gggataggagattgggagtgtt

SEQ ID NO: 7515682 - DNA, 22 bp, Homo sapiens
gggataggagattgggagtgtt

SEQ ID NO: 7515683 - DNA, 22 bp, Homo sapiens
gggataggagattgggagtgtt

SEQ ID NO: 7515684 - DNA, 22 bp, Homo sapiens
gggataggagattgggagtgtt

SEQ ID NO: 7515685 - DNA, 22 bp, Homo sapiens
gggagtgtgcacacatggtata

SEQ ID NO: 7515686 - DNA, 22 bp, Homo sapiens
gggagtggttgatggtgaaaat

SEQ ID NO: 7515687 - DNA, 22 bp, Homo sapiens
gggagtgtgcagaagctggggg

SEQ ID NO: 7515688 - DNA, 22 bp, Homo sapiens
gggagtgtgcacacatggtata

SEQ ID NO: 7515689 - DNA, 22 bp, Homo sapiens
gggagtgtgcagaagctggggg

SEQ ID NO: 7515690 - DNA, 22 bp, Homo sapiens
gggagtgttgagcgccctgcca

SEQ ID NO: 7515691 - DNA, 22 bp, Homo sapiens
gggagtgttgagcgccctgcca

SEQ ID NO: 7515692 - DNA, 19 bp, Homo sapiens
gggagttgttctgatccta

SEQ ID NO: 7515693 - DNA, 22 bp, Homo sapiens
gggataggaaacttaggtacac

SEQ ID NO: 7515694 - DNA, 22 bp, Homo sapiens
gggataggaaacttaggtacac

SEQ ID NO: 7515695 - DNA, 22 bp, Homo sapiens
gggataggagattgggagtgtt

SEQ ID NO: 7515696 - DNA, 22 bp, Homo sapiens
gggataggaaacttaggtacac

SEQ ID NO: 7515697 - DNA, 22 bp, Homo sapiens
gggatcagattccctgtcccaa

SEQ ID NO: 7515698 - DNA, 22 bp, Homo sapiens
gggatcagcaagccactgcacc

SEQ ID NO: 7515699 - DNA, 22 bp, Homo sapiens
gggatcagaaacatagccctga

SEQ ID NO: 7515700 - DNA, 22 bp, Homo sapiens
gggatcaataatggcaggtgtt

SEQ ID NO: 7515701 - DNA, 18 bp, Homo sapiens
gggatatatcagtgaaga

SEQ ID NO: 7515702 - DNA, 23 bp, Homo sapiens
gggatatggaccttggaggagtc

SEQ ID NO: 7515703 - DNA, 22 bp, Homo sapiens
gggatatgtttaggtgttggag

SEQ ID NO: 7515704 - DNA, 22 bp, Homo sapiens
gggatcagcaagccactgcacc

SEQ ID NO: 7515705 - DNA, 19 bp, Homo sapiens
gggatcagcccagggctct

SEQ ID NO: 7515706 - DNA, 19 bp, Homo sapiens
gggatcagcccagggctct

SEQ ID NO: 7515707 - DNA, 19 bp, Homo sapiens
gggatcagcccagggctct

SEQ ID NO: 7515708 - DNA, 20 bp, Homo sapiens
gggatcaggaaaggaggcta

SEQ ID NO: 7515709 - DNA, 20 bp, Homo sapiens
gggatcaggaaaggaggcta

SEQ ID NO: 7515710 - DNA, 19 bp, Homo sapiens
gggatcagcccagggctct

SEQ ID NO: 7515711 - DNA, 20 bp, Homo sapiens
gggatcaggaaaggaggcta

SEQ ID NO: 7515712 - DNA, 22 bp, Homo sapiens
gggcactgtacactgtgcatgg

SEQ ID NO: 7515713 - DNA, 22 bp, Homo sapiens
gggcactgtacactgtgcatgg

SEQ ID NO: 7515714 - DNA, 22 bp, Homo sapiens
gggcactggtgctgccatcttg

SEQ ID NO: 7515715 - DNA, 22 bp, Homo sapiens
gggcactggtgctgccatcttg

SEQ ID NO: 7515716 - DNA, 22 bp, Homo sapiens
gggcactggtgctgccatcttg

SEQ ID NO: 7515717 - DNA, 22 bp, Homo sapiens
gggcactgtgctaggtgctgag

SEQ ID NO: 7515718 - DNA, 22 bp, Homo sapiens
gggcactgtgctaggtgctgag

SEQ ID NO: 7515719 - DNA, 22 bp, Homo sapiens
gggcactgtacactgtgcatgg

SEQ ID NO: 7515720 - DNA, 18 bp, Homo sapiens
gggatcaggctgcctagg

SEQ ID NO: 7515721 - DNA, 18 bp, Homo sapiens
gggatcaggctgcctagg

SEQ ID NO: 7515722 - DNA, 22 bp, Homo sapiens
gggcactgggtcttctccacgc

SEQ ID NO: 7515723 - DNA, 22 bp, Homo sapiens
gggatccatccgtgcagcagag

SEQ ID NO: 7515724 - DNA, 22 bp, Homo sapiens
gggcactgggtcttctccacgc

SEQ ID NO: 7515725 - DNA, 22 bp, Homo sapiens
gggcactggtgctgccatcttg

SEQ ID NO: 7515726 - DNA, 22 bp, Homo sapiens
gggatccatccgtgcagcagag

SEQ ID NO: 7515727 - DNA, 22 bp, Homo sapiens
gggcagagactcagaaacagaa

SEQ ID NO: 7515728 - DNA, 22 bp, Homo sapiens
gggcagagagctggaactcctt

SEQ ID NO: 7515729 - DNA, 22 bp, Homo sapiens
gggcagagagctggaactcctt

SEQ ID NO: 7515730 - DNA, 22 bp, Homo sapiens
gggcagagagctggaactcctt

SEQ ID NO: 7515731 - DNA, 22 bp, Homo sapiens
gggcagagagctggaactcctt

SEQ ID NO: 7515732 - DNA, 22 bp, Homo sapiens
gggcagagagctggaactcctt

SEQ ID NO: 7515733 - DNA, 22 bp, Homo sapiens
gggcagagagctggaactcctt

SEQ ID NO: 7515734 - DNA, 22 bp, Homo sapiens
gggcagagagctggaactcctt

SEQ ID NO: 7515735 - DNA, 22 bp, Homo sapiens
gggcagagagctggaactcctt

SEQ ID NO: 7515736 - DNA, 22 bp, Homo sapiens
gggcagagactcagaaacagaa

SEQ ID NO: 7515737 - DNA, 22 bp, Homo sapiens
gggcagagactcagaaacagaa

SEQ ID NO: 7515738 - DNA, 22 bp, Homo sapiens
gggcagagactcagaaacagaa

SEQ ID NO: 7515739 - DNA, 22 bp, Homo sapiens
gggcagagactcagaaacagaa

SEQ ID NO: 7515740 - DNA, 22 bp, Homo sapiens
gggcagagactcagaaacagaa

SEQ ID NO: 7515741 - DNA, 22 bp, Homo sapiens
gggcagagactcagaaacagaa

SEQ ID NO: 7515742 - DNA, 22 bp, Homo sapiens
gggcagagactcagaaacagaa

SEQ ID NO: 7515743 - DNA, 22 bp, Homo sapiens
gggcagagactcagaaacagaa

SEQ ID NO: 7515744 - DNA, 22 bp, Homo sapiens
gggcagagactcagaaacagaa

SEQ ID NO: 7515745 - DNA, 22 bp, Homo sapiens
gggcactgtgctaggtgctgag

SEQ ID NO: 7515746 - DNA, 22 bp, Homo sapiens
gggcagagactcagaaacagaa

SEQ ID NO: 7515747 - DNA, 22 bp, Homo sapiens
gggcagagactcagaaacagaa

SEQ ID NO: 7515748 - DNA, 20 bp, Homo sapiens
gggcagagccagccagtccc

SEQ ID NO: 7515749 - DNA, 20 bp, Homo sapiens
gggcagagccagccagtccc

SEQ ID NO: 7515750 - DNA, 20 bp, Homo sapiens
gggcagagccagccagtccc

SEQ ID NO: 7515751 - DNA, 20 bp, Homo sapiens
gggcagagccagccagtccc

SEQ ID NO: 7515752 - DNA, 20 bp, Homo sapiens
gggcagagccagccagtccc

SEQ ID NO: 7515753 - DNA, 20 bp, Homo sapiens
gggcagagccagccagtccc

SEQ ID NO: 7515754 - DNA, 20 bp, Homo sapiens
gggcagagccagccagtccc

SEQ ID NO: 7515755 - DNA, 20 bp, Homo sapiens
gggcagagccagccagtccc

SEQ ID NO: 7515756 - DNA, 20 bp, Homo sapiens
gggcagagccagccagtccc

SEQ ID NO: 7515757 - DNA, 20 bp, Homo sapiens
gggcagagccagccagtccc

SEQ ID NO: 7515758 - DNA, 22 bp, Homo sapiens
gggcagaggctctggcccatcc

SEQ ID NO: 7515759 - DNA, 22 bp, Homo sapiens
gggcagaggctctggcccatcc

SEQ ID NO: 7515760 - DNA, 22 bp, Homo sapiens
gggcagaggctctggcccatcc

SEQ ID NO: 7515761 - DNA, 22 bp, Homo sapiens
gggcagaggctctggcccatcc

SEQ ID NO: 7515762 - DNA, 22 bp, Homo sapiens
gggcagaggctctggcccatcc

SEQ ID NO: 7515763 - DNA, 22 bp, Homo sapiens
gggcagaggctctggcccatcc

SEQ ID NO: 7515764 - DNA, 20 bp, Homo sapiens
gggcagagccagccagtccc

SEQ ID NO: 7515765 - DNA, 20 bp, Homo sapiens
gggcagagccagccagtccc

SEQ ID NO: 7515766 - DNA, 20 bp, Homo sapiens
gggcagagccagccagtccc

SEQ ID NO: 7515767 - DNA, 20 bp, Homo sapiens
gggcagagccagccagtccc

SEQ ID NO: 7515768 - DNA, 20 bp, Homo sapiens
gggcagagccagccagtccc

SEQ ID NO: 7515769 - DNA, 20 bp, Homo sapiens
gggcagagccagccagtccc

SEQ ID NO: 7515770 - DNA, 20 bp, Homo sapiens
gggcagagccagccagtccc

SEQ ID NO: 7515771 - DNA, 20 bp, Homo sapiens
gggcagagccagccagtccc

SEQ ID NO: 7515772 - DNA, 22 bp, Homo sapiens
gggcagagagctggaactcctt

SEQ ID NO: 7515773 - DNA, 22 bp, Homo sapiens
gggcagagagctggaactcctt

SEQ ID NO: 7515774 - DNA, 22 bp, Homo sapiens
gggcagagagctggaactcctt

SEQ ID NO: 7515775 - DNA, 22 bp, Homo sapiens
gggcagagagctggaactcctt

SEQ ID NO: 7515776 - DNA, 22 bp, Homo sapiens
gggcagagagctggaactcctt

SEQ ID NO: 7515777 - DNA, 17 bp, Homo sapiens
gggcagggactcctggg

SEQ ID NO: 7515778 - DNA, 17 bp, Homo sapiens
gggcagggactcctggg

SEQ ID NO: 7515779 - DNA, 17 bp, Homo sapiens
gggcagggactcctggg

SEQ ID NO: 7515780 - DNA, 17 bp, Homo sapiens
gggcagggactcctggg

SEQ ID NO: 7515781 - DNA, 17 bp, Homo sapiens
gggcagggactcctggg

SEQ ID NO: 7515782 - DNA, 21 bp, Homo sapiens
gggcagaggggcctcctgggt

SEQ ID NO: 7515783 - DNA, 21 bp, Homo sapiens
gggcagaggggcctcctgggt

SEQ ID NO: 7515784 - DNA, 21 bp, Homo sapiens
gggcagaggggcctcctgggt

SEQ ID NO: 7515785 - DNA, 21 bp, Homo sapiens
gggcagaggggcctcctgggt

SEQ ID NO: 7515786 - DNA, 21 bp, Homo sapiens
gggcagaggggcctcctgggt

SEQ ID NO: 7515787 - DNA, 21 bp, Homo sapiens
gggcagaggggcctcctgggt

SEQ ID NO: 7515788 - DNA, 21 bp, Homo sapiens
gggcagaggggcctcctgggt

SEQ ID NO: 7515789 - DNA, 21 bp, Homo sapiens
gggcagaggggcctcctgggt

SEQ ID NO: 7515790 - DNA, 21 bp, Homo sapiens
gggcagaggggcctcctgggt

SEQ ID NO: 7515791 - DNA, 21 bp, Homo sapiens
gggcagaggggcctcctgggt

SEQ ID NO: 7515792 - DNA, 21 bp, Homo sapiens
gggcagaggggcctcctgggt

SEQ ID NO: 7515793 - DNA, 21 bp, Homo sapiens
gggcagaggggcctcctgggt

SEQ ID NO: 7515794 - DNA, 21 bp, Homo sapiens
gggcagaggggcctcctgggt

SEQ ID NO: 7515795 - DNA, 21 bp, Homo sapiens
gggcagaggggcctcctgggt

SEQ ID NO: 7515796 - DNA, 22 bp, Homo sapiens
gggcagaggctctggcccatcc

SEQ ID NO: 7515797 - DNA, 22 bp, Homo sapiens
gggcagaggctctggcccatcc

SEQ ID NO: 7515798 - DNA, 22 bp, Homo sapiens
gggcagaggctctggcccatcc

SEQ ID NO: 7515799 - DNA, 22 bp, Homo sapiens
gggcagaggctctggcccatcc

SEQ ID NO: 7515800 - DNA, 22 bp, Homo sapiens
gggcaggtctgggtcagcctga

SEQ ID NO: 7515801 - DNA, 22 bp, Homo sapiens
gggcaggtctgggtcagcctga

SEQ ID NO: 7515802 - DNA, 21 bp, Homo sapiens
gggcaggtctctgatgtcaac

SEQ ID NO: 7515803 - DNA, 21 bp, Homo sapiens
gggcaggtctctgatgtcaac

SEQ ID NO: 7515804 - DNA, 21 bp, Homo sapiens
gggcaggtctctgatgtcaac

SEQ ID NO: 7515805 - DNA, 21 bp, Homo sapiens
gggcaggtctctgatgtcaac

SEQ ID NO: 7515806 - DNA, 21 bp, Homo sapiens
gggcaggtctctgatgtcaac

SEQ ID NO: 7515807 - DNA, 21 bp, Homo sapiens
gggcaggtctctgatgtcaac

SEQ ID NO: 7515808 - DNA, 21 bp, Homo sapiens
gggcaggtctctgatgtcaac

SEQ ID NO: 7515809 - DNA, 17 bp, Homo sapiens
gggcagggactcctggg

SEQ ID NO: 7515810 - DNA, 17 bp, Homo sapiens
gggcagggactcctggg

SEQ ID NO: 7515811 - DNA, 17 bp, Homo sapiens
gggcagggactcctggg

SEQ ID NO: 7515812 - DNA, 17 bp, Homo sapiens
gggcagggactcctggg

SEQ ID NO: 7515813 - DNA, 17 bp, Homo sapiens
gggcagggactcctggg

SEQ ID NO: 7515814 - DNA, 22 bp, Homo sapiens
gggcaggtgccagctccctgtc

SEQ ID NO: 7515815 - DNA, 22 bp, Homo sapiens
gggcaggtgccagctccctgtc

SEQ ID NO: 7515816 - DNA, 22 bp, Homo sapiens
gggcaggtgccagctccctgtc

SEQ ID NO: 7515817 - DNA, 22 bp, Homo sapiens
gggcaggtgcccagggccagag

SEQ ID NO: 7515818 - DNA, 22 bp, Homo sapiens
gggcaggtgcccagggccagag

SEQ ID NO: 7515819 - DNA, 22 bp, Homo sapiens
gggcaggtgcccagggccagag

SEQ ID NO: 7515820 - DNA, 22 bp, Homo sapiens
gggcaggtgcccagggccagag

SEQ ID NO: 7515821 - DNA, 22 bp, Homo sapiens
gggcaggtgcccagggccagag

SEQ ID NO: 7515822 - DNA, 22 bp, Homo sapiens
gggcaggtgcccagggccagag

SEQ ID NO: 7515823 - DNA, 22 bp, Homo sapiens
gggcaggtgattttggctccat

SEQ ID NO: 7515824 - DNA, 22 bp, Homo sapiens
gggcaggtgacctcttgtcctg

SEQ ID NO: 7515825 - DNA, 22 bp, Homo sapiens
gggcaggtgattttggctccat

SEQ ID NO: 7515826 - DNA, 22 bp, Homo sapiens
gggcaggtgattttggctccat

SEQ ID NO: 7515827 - DNA, 22 bp, Homo sapiens
gggcaggtgattttggctccat

SEQ ID NO: 7515828 - DNA, 22 bp, Homo sapiens
ggctggagtgggctccagagtt

SEQ ID NO: 7515829 - DNA, 19 bp, Homo sapiens
ggctggagtggccatctgt

SEQ ID NO: 7515830 - DNA, 22 bp, Homo sapiens
ggctggagtgggctccagagtt

SEQ ID NO: 7515831 - DNA, 22 bp, Homo sapiens
ggctggagtgggctccagagtt

SEQ ID NO: 7515832 - DNA, 22 bp, Homo sapiens
ggctggagtgggctccagagtt

SEQ ID NO: 7515833 - DNA, 19 bp, Homo sapiens
ggctggagtggccatctgt

SEQ ID NO: 7515834 - DNA, 19 bp, Homo sapiens
ggctggagtggccatctgt

SEQ ID NO: 7515835 - DNA, 19 bp, Homo sapiens
ggctggagtggccatctgt

SEQ ID NO: 7515836 - DNA, 22 bp, Homo sapiens
ggctggagtgggctccagagtt

SEQ ID NO: 7515837 - DNA, 19 bp, Homo sapiens
ggctggagtggccatctgt

SEQ ID NO: 7515838 - DNA, 22 bp, Homo sapiens
ggctggcagaagtgtgctggct

SEQ ID NO: 7515839 - DNA, 22 bp, Homo sapiens
ggctggcagaagtgtgctggct

SEQ ID NO: 7515840 - DNA, 22 bp, Homo sapiens
ggctggataccaggagacaggg

SEQ ID NO: 7515841 - DNA, 18 bp, Homo sapiens
ggctggataccttaggaa

SEQ ID NO: 7515842 - DNA, 22 bp, Homo sapiens
ggctggatgtactttggggctg

SEQ ID NO: 7515843 - DNA, 22 bp, Homo sapiens
ggctggataccaggagacaggg

SEQ ID NO: 7515844 - DNA, 22 bp, Homo sapiens
ggctggagtgggctccagagtt

SEQ ID NO: 7515845 - DNA, 22 bp, Homo sapiens
ggctggagtgggctccagagtt

SEQ ID NO: 7515846 - DNA, 22 bp, Homo sapiens
ggctggagtgggctccagagtt

SEQ ID NO: 7515847 - DNA, 22 bp, Homo sapiens
ggctggagtgggctccagagtt

SEQ ID NO: 7515848 - DNA, 17 bp, Homo sapiens
ggctggaggggacccgg

SEQ ID NO: 7515849 - DNA, 17 bp, Homo sapiens
ggctggaggggacccgg

SEQ ID NO: 7515850 - DNA, 17 bp, Homo sapiens
ggctggaggggacccgg

SEQ ID NO: 7515851 - DNA, 22 bp, Homo sapiens
ggctggaggagaatgggtgtga

SEQ ID NO: 7515852 - DNA, 22 bp, Homo sapiens
ggctggaggagaatgggtgtga

SEQ ID NO: 7515853 - DNA, 17 bp, Homo sapiens
ggctggaggggacccgg

SEQ ID NO: 7515854 - DNA, 17 bp, Homo sapiens
ggctggaggggacccgg

SEQ ID NO: 7515855 - DNA, 17 bp, Homo sapiens
ggctggaggggacccgg

SEQ ID NO: 7515856 - DNA, 22 bp, Homo sapiens
ggctggaggtagaagaacactt

SEQ ID NO: 7515857 - DNA, 19 bp, Homo sapiens
ggctggagtggccatctgt

SEQ ID NO: 7515858 - DNA, 22 bp, Homo sapiens
ggctggaggtagaagaacactt

SEQ ID NO: 7515859 - DNA, 22 bp, Homo sapiens
ggctggaggtagaagaacactt

SEQ ID NO: 7515860 - DNA, 22 bp, Homo sapiens
ggctggaggtagaagaacactt

SEQ ID NO: 7515861 - DNA, 22 bp, Homo sapiens
ggctggaggtagaagaacactt

SEQ ID NO: 7515862 - DNA, 22 bp, Homo sapiens
ggctggaggtagaagaacactt

SEQ ID NO: 7515863 - DNA, 19 bp, Homo sapiens
ggctggagtggccatctgt

SEQ ID NO: 7515864 - DNA, 19 bp, Homo sapiens
ggctggagtggccatctgt

SEQ ID NO: 7515865 - DNA, 19 bp, Homo sapiens
ggctggagtggccatctgt

SEQ ID NO: 7515866 - DNA, 19 bp, Homo sapiens
ggctggagtggccatctgt

SEQ ID NO: 7515867 - DNA, 22 bp, Homo sapiens
ggctggcagtgtgagagaggga

SEQ ID NO: 7515868 - DNA, 22 bp, Homo sapiens
ggctggcagtgtgagagaggga

SEQ ID NO: 7515869 - DNA, 22 bp, Homo sapiens
ggctggcagtgtgagagaggga

SEQ ID NO: 7515870 - DNA, 22 bp, Homo sapiens
ggctggcaggggatgtcagatg

SEQ ID NO: 7515871 - DNA, 22 bp, Homo sapiens
ggctggcaggggatgtcagatg

SEQ ID NO: 7515872 - DNA, 22 bp, Homo sapiens
ggctggcaggggatgtcagatg

SEQ ID NO: 7515873 - DNA, 22 bp, Homo sapiens
ggctggcagtgtgagagaggga

SEQ ID NO: 7515874 - DNA, 22 bp, Homo sapiens
ggctggcagttaatacctgaag

SEQ ID NO: 7515875 - DNA, 22 bp, Homo sapiens
ggctggcagtgtgagagaggga

SEQ ID NO: 7515876 - DNA, 22 bp, Homo sapiens
ggctggcagttaatacctgaag

SEQ ID NO: 7515877 - DNA, 22 bp, Homo sapiens
ggctggcagttaatacctgaag

SEQ ID NO: 7515878 - DNA, 22 bp, Homo sapiens
ggctggcattgctctattgcct

SEQ ID NO: 7515879 - DNA, 22 bp, Homo sapiens
ggctggccagggccctcgctgg

SEQ ID NO: 7515880 - DNA, 22 bp, Homo sapiens
ggctggccagggccctcgctgg

SEQ ID NO: 7515881 - DNA, 22 bp, Homo sapiens
ggctggcatttacacaatgcat

SEQ ID NO: 7515882 - DNA, 22 bp, Homo sapiens
ggctggcatttacacaatgcat

SEQ ID NO: 7515883 - DNA, 22 bp, Homo sapiens
ggctggcatttacacaatgcat

SEQ ID NO: 7515884 - DNA, 22 bp, Homo sapiens
ggctggcatccagggaaatcca

SEQ ID NO: 7515885 - DNA, 22 bp, Homo sapiens
ggctggcatccagggaaatcca

SEQ ID NO: 7515886 - DNA, 22 bp, Homo sapiens
ggctggcattgctctattgcct

SEQ ID NO: 7515887 - DNA, 22 bp, Homo sapiens
ggctggcattgctctattgcct

SEQ ID NO: 7515888 - DNA, 22 bp, Homo sapiens
ggctggcagaggggagtctgtg

SEQ ID NO: 7515889 - DNA, 22 bp, Homo sapiens
ggctggcagaggggagtctgtg

SEQ ID NO: 7515890 - DNA, 22 bp, Homo sapiens
ggctggcagaggggagtctgtg

SEQ ID NO: 7515891 - DNA, 22 bp, Homo sapiens
ggctggcagaggggagtctgtg

SEQ ID NO: 7515892 - DNA, 22 bp, Homo sapiens
ggctggcagaagtgtgctggct

SEQ ID NO: 7515893 - DNA, 22 bp, Homo sapiens
ggctggcagaagtgtgctggct

SEQ ID NO: 7515894 - DNA, 22 bp, Homo sapiens
ggctggcagaagtgtgctggct

SEQ ID NO: 7515895 - DNA, 22 bp, Homo sapiens
ggctggcagaagtgtgctggct

SEQ ID NO: 7515896 - DNA, 22 bp, Homo sapiens
ggctggcaggcacagtatgcaa

SEQ ID NO: 7515897 - DNA, 22 bp, Homo sapiens
ggctggcaggcacagtatgcaa

SEQ ID NO: 7515898 - DNA, 22 bp, Homo sapiens
ggctggcaggcacagtatgcaa

SEQ ID NO: 7515899 - DNA, 22 bp, Homo sapiens
ggctggcaggcacagtatgcaa

SEQ ID NO: 7515900 - DNA, 22 bp, Homo sapiens
ggctggcaggcacagtatgcaa

SEQ ID NO: 7515901 - DNA, 22 bp, Homo sapiens
ggctggcagcttcatcccagat

SEQ ID NO: 7515902 - DNA, 22 bp, Homo sapiens
ggctggcagaggggagtctgtg

SEQ ID NO: 7515903 - DNA, 22 bp, Homo sapiens
ggctggcaggactcacacttgg

SEQ ID NO: 7515904 - DNA, 22 bp, Homo sapiens
ggctggcagcttcatcccagat

SEQ ID NO: 7515905 - DNA, 22 bp, Homo sapiens
ggctggcagcttcatcccagat

SEQ ID NO: 7515906 - DNA, 22 bp, Homo sapiens
ggctgcctctgatgtgcagacg

SEQ ID NO: 7515907 - DNA, 22 bp, Homo sapiens
ggctgcctctgatgtgcagacg

SEQ ID NO: 7515908 - DNA, 22 bp, Homo sapiens
ggctgcctctgatgtgcagacg

SEQ ID NO: 7515909 - DNA, 22 bp, Homo sapiens
ggctgcctctgatgtgcagacg

SEQ ID NO: 7515910 - DNA, 22 bp, Homo sapiens
ggctgcctctgatgtgcagacg

SEQ ID NO: 7515911 - DNA, 22 bp, Homo sapiens
ggctgcctctggaagctggaga

SEQ ID NO: 7515912 - DNA, 22 bp, Homo sapiens
ggctgcctctggaagctggaga

SEQ ID NO: 7515913 - DNA, 22 bp, Homo sapiens
ggctgcctctggaagctggaga

SEQ ID NO: 7515914 - DNA, 22 bp, Homo sapiens
ggctgcctctggaagctggaga

SEQ ID NO: 7515915 - DNA, 22 bp, Homo sapiens
ggctgcctgaggcagtgagaga

SEQ ID NO: 7515916 - DNA, 22 bp, Homo sapiens
ggctgcctgaggcagtgagaga

SEQ ID NO: 7515917 - DNA, 22 bp, Homo sapiens
ggctgcctctttcttagtgtct

SEQ ID NO: 7515918 - DNA, 22 bp, Homo sapiens
ggctgcctctttcttagtgtct

SEQ ID NO: 7515919 - DNA, 22 bp, Homo sapiens
ggctgcctgaactttggggaaa

SEQ ID NO: 7515920 - DNA, 22 bp, Homo sapiens
ggctgcctgaactttggggaaa

SEQ ID NO: 7515921 - DNA, 22 bp, Homo sapiens
ggctgcctgaactttggggaaa

SEQ ID NO: 7515922 - DNA, 22 bp, Homo sapiens
ggctgcctgaactttggggaaa

SEQ ID NO: 7515923 - DNA, 22 bp, Homo sapiens
ggctgcctgaggctgaggcccg

SEQ ID NO: 7515924 - DNA, 22 bp, Homo sapiens
ggctgcctgaggctgaggcccg

SEQ ID NO: 7515925 - DNA, 22 bp, Homo sapiens
ggctgcctgaggctgaggcccg

SEQ ID NO: 7515926 - DNA, 22 bp, Homo sapiens
ggctgcctgaggctgaggcccg

SEQ ID NO: 7515927 - DNA, 22 bp, Homo sapiens
ggctgcctgaggctgaggcccg

SEQ ID NO: 7515928 - DNA, 22 bp, Homo sapiens
ggctgcctgccgcccacttggc

SEQ ID NO: 7515929 - DNA, 22 bp, Homo sapiens
ggctgcctgccgcccacttggc

SEQ ID NO: 7515930 - DNA, 22 bp, Homo sapiens
ggctgcctgccgcccacttggc

SEQ ID NO: 7515931 - DNA, 22 bp, Homo sapiens
ggctgcctgccgcccacttggc

SEQ ID NO: 7515932 - DNA, 22 bp, Homo sapiens
ggctgcctgccgcccacttggc

SEQ ID NO: 7515933 - DNA, 22 bp, Homo sapiens
ggctgcctgcctccaagccggg

SEQ ID NO: 7515934 - DNA, 22 bp, Homo sapiens
ggctgcctgccgcccacttggc

SEQ ID NO: 7515935 - DNA, 22 bp, Homo sapiens
ggctgcctgcctccaagccggg

SEQ ID NO: 7515936 - DNA, 22 bp, Homo sapiens
ggctgcctgcctccaagccggg

SEQ ID NO: 7515937 - DNA, 22 bp, Homo sapiens
ggctgcctgctcaggtgcggcg

SEQ ID NO: 7515938 - DNA, 22 bp, Homo sapiens
ggctgcctgctcaggtgcggcg

SEQ ID NO: 7515939 - DNA, 22 bp, Homo sapiens
ggctgcctgcctccaagccggg

SEQ ID NO: 7515940 - DNA, 22 bp, Homo sapiens
ggctgcctgctcaggtgcggcg

SEQ ID NO: 7515941 - DNA, 22 bp, Homo sapiens
ggctgcctgctcaggtgcggcg

SEQ ID NO: 7515942 - DNA, 22 bp, Homo sapiens
ggctgcctgctcctcctgcacg

SEQ ID NO: 7515943 - DNA, 22 bp, Homo sapiens
ggctgcctgctcctcctgcacg

SEQ ID NO: 7515944 - DNA, 22 bp, Homo sapiens
ggctgcctgctcctcctgcacg

SEQ ID NO: 7515945 - DNA, 22 bp, Homo sapiens
ggctgcctgctcctcctgcacg

SEQ ID NO: 7515946 - DNA, 17 bp, Homo sapiens
ggctggagcagctcccc

SEQ ID NO: 7515947 - DNA, 17 bp, Homo sapiens
ggctggagcagctcccc

SEQ ID NO: 7515948 - DNA, 17 bp, Homo sapiens
ggctggagcagctcccc

SEQ ID NO: 7515949 - DNA, 17 bp, Homo sapiens
ggctggagcagctcccc

SEQ ID NO: 7515950 - DNA, 22 bp, Homo sapiens
ggctggagatatgtctggaaca

SEQ ID NO: 7515951 - DNA, 22 bp, Homo sapiens
ggctggagatatgtctggaaca

SEQ ID NO: 7515952 - DNA, 17 bp, Homo sapiens
ggctggagcagctcccc

SEQ ID NO: 7515953 - DNA, 17 bp, Homo sapiens
ggctggagcagctcccc

SEQ ID NO: 7515954 - DNA, 17 bp, Homo sapiens
ggctggagcagctcccc

SEQ ID NO: 7515955 - DNA, 17 bp, Homo sapiens
ggctggagcagctcccc

SEQ ID NO: 7515956 - DNA, 17 bp, Homo sapiens
ggctggagcagctcccc

SEQ ID NO: 7515957 - DNA, 22 bp, Homo sapiens
ggctggaggagaatgggtgtga

SEQ ID NO: 7515958 - DNA, 22 bp, Homo sapiens
ggctggaggagaatgggtgtga

SEQ ID NO: 7515959 - DNA, 22 bp, Homo sapiens
ggctggaggagaatgggtgtga

SEQ ID NO: 7515960 - DNA, 17 bp, Homo sapiens
ggctggagcagctcccc

SEQ ID NO: 7515961 - DNA, 17 bp, Homo sapiens
ggctggagcagctcccc

SEQ ID NO: 7515962 - DNA, 22 bp, Homo sapiens
ggctggaggagaatgggtgtga

SEQ ID NO: 7515963 - DNA, 22 bp, Homo sapiens
ggctggaggagaatgggtgtga

SEQ ID NO: 7515964 - DNA, 22 bp, Homo sapiens
ggctggaggagaatgggtgtga

SEQ ID NO: 7515965 - DNA, 22 bp, Homo sapiens
ggctggaggagaatgggtgtga

SEQ ID NO: 7515966 - DNA, 22 bp, Homo sapiens
ggctgcctgctcctcctgcacg

SEQ ID NO: 7515967 - DNA, 22 bp, Homo sapiens
ggctgcctgctcctcctgcacg

SEQ ID NO: 7515968 - DNA, 22 bp, Homo sapiens
ggctgcctgctcctcctgcacg

SEQ ID NO: 7515969 - DNA, 22 bp, Homo sapiens
ggctgcctggacctcctctttc

SEQ ID NO: 7515970 - DNA, 22 bp, Homo sapiens
ggctgcctggacctcctctttc

SEQ ID NO: 7515971 - DNA, 22 bp, Homo sapiens
ggctgcctggacctcctctttc

SEQ ID NO: 7515972 - DNA, 22 bp, Homo sapiens
ggctgcctggacctcctctttc

SEQ ID NO: 7515973 - DNA, 19 bp, Homo sapiens
ggctgcctggagcgagggc

SEQ ID NO: 7515974 - DNA, 22 bp, Homo sapiens
ggctggagacaacgtcctgccc

SEQ ID NO: 7515975 - DNA, 22 bp, Homo sapiens
ggctggagacaacgtcctgccc

SEQ ID NO: 7515976 - DNA, 22 bp, Homo sapiens
ggctggagacaacgtcctgccc

SEQ ID NO: 7515977 - DNA, 22 bp, Homo sapiens
ggctggagacaacgtcctgccc

SEQ ID NO: 7515978 - DNA, 22 bp, Homo sapiens
ggctggagacaacgtcctgccc

SEQ ID NO: 7515979 - DNA, 22 bp, Homo sapiens
ggctggagacaacgtcctgccc

SEQ ID NO: 7515980 - DNA, 22 bp, Homo sapiens
ggctggagacaacgtcctgccc

SEQ ID NO: 7515981 - DNA, 22 bp, Homo sapiens
ggctggagatatgtctggaaca

SEQ ID NO: 7515982 - DNA, 22 bp, Homo sapiens
ggctggagatatgtctggaaca

SEQ ID NO: 7515983 - DNA, 22 bp, Homo sapiens
ggctggagatatgtctggaaca

SEQ ID NO: 7515984 - DNA, 22 bp, Homo sapiens
ggctggagatatgtctggaaca

SEQ ID NO: 7515985 - DNA, 22 bp, Homo sapiens
ggctggagatatgtctggaaca

SEQ ID NO: 7515986 - DNA, 17 bp, Homo sapiens
ggctgcagtccaggagg

SEQ ID NO: 7515987 - DNA, 20 bp, Homo sapiens
ggctgcagtgcacctcatct

SEQ ID NO: 7515988 - DNA, 20 bp, Homo sapiens
ggctgcagtgcacctcatct

SEQ ID NO: 7515989 - DNA, 20 bp, Homo sapiens
ggctgcagtgcacctcatct

SEQ ID NO: 7515990 - DNA, 20 bp, Homo sapiens
ggctgcagtgcacctcatct

SEQ ID NO: 7515991 - DNA, 20 bp, Homo sapiens
ggctgcagtgcacctcatct

SEQ ID NO: 7515992 - DNA, 17 bp, Homo sapiens
ggctgcagtccaggagg

SEQ ID NO: 7515993 - DNA, 17 bp, Homo sapiens
ggctgcagtccaggagg

SEQ ID NO: 7515994 - DNA, 22 bp, Homo sapiens
ggctgcaggttggttggcagct

SEQ ID NO: 7515995 - DNA, 17 bp, Homo sapiens
ggctgcagtccaggagg

SEQ ID NO: 7515996 - DNA, 17 bp, Homo sapiens
ggctgcagtccaggagg

SEQ ID NO: 7515997 - DNA, 17 bp, Homo sapiens
ggctgcagtccaggagg

SEQ ID NO: 7515998 - DNA, 22 bp, Homo sapiens
ggctgcaggttggttggcagct

SEQ ID NO: 7515999 - DNA, 17 bp, Homo sapiens
ggctgcagtccaggagg

SEQ ID NO: 7516000 - DNA, 17 bp, Homo sapiens
ggctgcagtccaggagg

SEQ ID NO: 7516001 - DNA, 22 bp, Homo sapiens
ggctgcaggttggttggcagct

SEQ ID NO: 7516002 - DNA, 22 bp, Homo sapiens
ggctgcaggttggttggcagct

SEQ ID NO: 7516003 - DNA, 22 bp, Homo sapiens
ggctgcaggttggttggcagct

SEQ ID NO: 7516004 - DNA, 22 bp, Homo sapiens
ggctgcaggttggttggcagct

SEQ ID NO: 7516005 - DNA, 22 bp, Homo sapiens
ggctgcagggcagctggtgtgg

SEQ ID NO: 7516006 - DNA, 22 bp, Homo sapiens
ggctgcagggcagctggtgtgg

SEQ ID NO: 7516007 - DNA, 22 bp, Homo sapiens
ggctgcagggcagctggtgtgg

SEQ ID NO: 7516008 - DNA, 22 bp, Homo sapiens
ggctgcaggttggttggcagct

SEQ ID NO: 7516009 - DNA, 22 bp, Homo sapiens
ggctgcaggttggttggcagct

SEQ ID NO: 7516010 - DNA, 22 bp, Homo sapiens
ggctgcagggcagctggtgtgg

SEQ ID NO: 7516011 - DNA, 21 bp, Homo sapiens
ggctgcagggagccctggggt

SEQ ID NO: 7516012 - DNA, 22 bp, Homo sapiens
ggctgcagggcagctggtgtgg

SEQ ID NO: 7516013 - DNA, 22 bp, Homo sapiens
ggctctgcggcgtgtgcgcagg

SEQ ID NO: 7516014 - DNA, 22 bp, Homo sapiens
ggctctgcggcgtgtgcgcagg

SEQ ID NO: 7516015 - DNA, 22 bp, Homo sapiens
ggctctgcgcggtaaagtgact

SEQ ID NO: 7516016 - DNA, 22 bp, Homo sapiens
ggctctgcgcggtaaagtgact

SEQ ID NO: 7516017 - DNA, 22 bp, Homo sapiens
ggctctgcgcctgcggggactt

SEQ ID NO: 7516018 - DNA, 22 bp, Homo sapiens
ggctctgcgcggtaaagtgact

SEQ ID NO: 7516019 - DNA, 22 bp, Homo sapiens
ggctctgcggcgtgtgcgcagg

SEQ ID NO: 7516020 - DNA, 22 bp, Homo sapiens
ggctctgcggcgtgtgcgcagg

SEQ ID NO: 7516021 - DNA, 22 bp, Homo sapiens
ggctctgcggcgtgtgcgcagg

SEQ ID NO: 7516022 - DNA, 22 bp, Homo sapiens
ggctctgctcacagcccgcagc

SEQ ID NO: 7516023 - DNA, 22 bp, Homo sapiens
ggctgcaggcagggtatccact

SEQ ID NO: 7516024 - DNA, 22 bp, Homo sapiens
ggctgcaggcttccctccagca

SEQ ID NO: 7516025 - DNA, 22 bp, Homo sapiens
ggctgcaggcttccctccagca

SEQ ID NO: 7516026 - DNA, 22 bp, Homo sapiens
ggctgcaggcttccctccagca

SEQ ID NO: 7516027 - DNA, 22 bp, Homo sapiens
ggctgcaggcttccctccagca

SEQ ID NO: 7516028 - DNA, 22 bp, Homo sapiens
ggctgcaggcttccctccagca

SEQ ID NO: 7516029 - DNA, 22 bp, Homo sapiens
ggctctgcggcgtgtgcgcagg

SEQ ID NO: 7516030 - DNA, 22 bp, Homo sapiens
ggctctgctcacagcccgcagc

SEQ ID NO: 7516031 - DNA, 22 bp, Homo sapiens
ggctgcaggcagggtatccact

SEQ ID NO: 7516032 - DNA, 22 bp, Homo sapiens
ggctgcaggcagggtatccact

SEQ ID NO: 7516033 - DNA, 22 bp, Homo sapiens
ggctgcaggcagggtatccact

SEQ ID NO: 7516034 - DNA, 22 bp, Homo sapiens
ggctgcaggcttccctccagca

SEQ ID NO: 7516035 - DNA, 22 bp, Homo sapiens
ggctgcaggcttccctccagca

SEQ ID NO: 7516036 - DNA, 22 bp, Homo sapiens
ggctgcaggcttccctccagca

SEQ ID NO: 7516037 - DNA, 21 bp, Homo sapiens
ggctgcagggagccctggggt

SEQ ID NO: 7516038 - DNA, 21 bp, Homo sapiens
ggctgcagggagccctggggt

SEQ ID NO: 7516039 - DNA, 21 bp, Homo sapiens
ggctgcagggagccctggggt

SEQ ID NO: 7516040 - DNA, 21 bp, Homo sapiens
ggctgcagggagccctggggt

SEQ ID NO: 7516041 - DNA, 21 bp, Homo sapiens
ggctgcagggagccctggggt

SEQ ID NO: 7516042 - DNA, 21 bp, Homo sapiens
ggctgcagggagccctggggt

SEQ ID NO: 7516043 - DNA, 21 bp, Homo sapiens
ggctgcagggagccctggggt

SEQ ID NO: 7516044 - DNA, 21 bp, Homo sapiens
ggctgcagggagccctggggt

SEQ ID NO: 7516045 - DNA, 22 bp, Homo sapiens
ggctgcctcctgctgggctgga

SEQ ID NO: 7516046 - DNA, 22 bp, Homo sapiens
ggctgcctcctgctgggctgga

SEQ ID NO: 7516047 - DNA, 22 bp, Homo sapiens
ggctgcctcctgctgggctgga

SEQ ID NO: 7516048 - DNA, 22 bp, Homo sapiens
ggctgcctcctcgagacaggat

SEQ ID NO: 7516049 - DNA, 19 bp, Homo sapiens
ggctgcctcctgggagatt

SEQ ID NO: 7516050 - DNA, 19 bp, Homo sapiens
ggctgcctcctgggagatt

SEQ ID NO: 7516051 - DNA, 19 bp, Homo sapiens
ggctgcctcctgggagatt

SEQ ID NO: 7516052 - DNA, 22 bp, Homo sapiens
ggctgcctcctgctgggctgga

SEQ ID NO: 7516053 - DNA, 22 bp, Homo sapiens
ggctgcctcctgctgggctgga

SEQ ID NO: 7516054 - DNA, 22 bp, Homo sapiens
ggctgcctcctgctgggctgga

SEQ ID NO: 7516055 - DNA, 22 bp, Homo sapiens
ggctgcctcctgctgggctgga

SEQ ID NO: 7516056 - DNA, 22 bp, Homo sapiens
ggctgcctctatttaggatcaa

SEQ ID NO: 7516057 - DNA, 22 bp, Homo sapiens
ggctgcctctatttaggatcaa

SEQ ID NO: 7516058 - DNA, 22 bp, Homo sapiens
ggctgcctctatttaggatcaa

SEQ ID NO: 7516059 - DNA, 20 bp, Homo sapiens
ggctgcctccttcctttcct

SEQ ID NO: 7516060 - DNA, 20 bp, Homo sapiens
ggctgcctccttcctttcct

SEQ ID NO: 7516061 - DNA, 19 bp, Homo sapiens
ggctgcctcctgggagatt

SEQ ID NO: 7516062 - DNA, 19 bp, Homo sapiens
ggctgcctcctgggagatt

SEQ ID NO: 7516063 - DNA, 19 bp, Homo sapiens
ggctgcctcctgggagatt

SEQ ID NO: 7516064 - DNA, 20 bp, Homo sapiens
ggctgcctccttcctttcct

SEQ ID NO: 7516065 - DNA, 20 bp, Homo sapiens
ggctgcctccttcctttcct

SEQ ID NO: 7516066 - DNA, 22 bp, Homo sapiens
ggctgcctcccaggagaatctg

SEQ ID NO: 7516067 - DNA, 22 bp, Homo sapiens
ggctgcctccactgcttgtccc

SEQ ID NO: 7516068 - DNA, 22 bp, Homo sapiens
ggctgcctcccaggagaatctg

SEQ ID NO: 7516069 - DNA, 22 bp, Homo sapiens
ggctgcctcccaggagaatctg

SEQ ID NO: 7516070 - DNA, 22 bp, Homo sapiens
ggctgcctccactgcttgtccc

SEQ ID NO: 7516071 - DNA, 22 bp, Homo sapiens
ggctgcctccactgcttgtccc

SEQ ID NO: 7516072 - DNA, 22 bp, Homo sapiens
ggctgcctccactgcttgtccc

SEQ ID NO: 7516073 - DNA, 22 bp, Homo sapiens
ggctgcctccactgcttgtccc

SEQ ID NO: 7516074 - DNA, 22 bp, Homo sapiens
ggctgcctcctcgagacaggat

SEQ ID NO: 7516075 - DNA, 22 bp, Homo sapiens
ggctgcctcctcgagacaggat

SEQ ID NO: 7516076 - DNA, 22 bp, Homo sapiens
ggctgcctcctcgagacaggat

SEQ ID NO: 7516077 - DNA, 22 bp, Homo sapiens
ggctgcctcctcgagacaggat

SEQ ID NO: 7516078 - DNA, 22 bp, Homo sapiens
ggctgcctcctcgagacaggat

SEQ ID NO: 7516079 - DNA, 22 bp, Homo sapiens
ggctgcctcccaggagaatctg

SEQ ID NO: 7516080 - DNA, 22 bp, Homo sapiens
ggctgcctcagatttgctgact

SEQ ID NO: 7516081 - DNA, 22 bp, Homo sapiens
ggctgcctcagatttgctgact

SEQ ID NO: 7516082 - DNA, 22 bp, Homo sapiens
ggctgccagtgagtgcagaccg

SEQ ID NO: 7516083 - DNA, 22 bp, Homo sapiens
ggctgccaggagggaggccagt

SEQ ID NO: 7516084 - DNA, 22 bp, Homo sapiens
ggctgccagtgagtgcagaccg

SEQ ID NO: 7516085 - DNA, 22 bp, Homo sapiens
ggctgcagttgtgtgaaggccg

SEQ ID NO: 7516086 - DNA, 22 bp, Homo sapiens
ggctgcagtttgtcttttgctt

SEQ ID NO: 7516087 - DNA, 22 bp, Homo sapiens
ggctgcagttgtgtgaaggccg

SEQ ID NO: 7516088 - DNA, 22 bp, Homo sapiens
ggctgcagtttgtcttttgctt

SEQ ID NO: 7516089 - DNA, 22 bp, Homo sapiens
ggctgcatgccaggctttgagc

SEQ ID NO: 7516090 - DNA, 22 bp, Homo sapiens
ggctgcagttgtgtgaaggccg

SEQ ID NO: 7516091 - DNA, 22 bp, Homo sapiens
ggctgcagttgtgtgaaggccg

SEQ ID NO: 7516092 - DNA, 22 bp, Homo sapiens
ggctgcagttgtgtgaaggccg

SEQ ID NO: 7516093 - DNA, 22 bp, Homo sapiens
ggctgcagttgtgtgaaggccg

SEQ ID NO: 7516094 - DNA, 22 bp, Homo sapiens
ggctgcagttgtgtgaaggccg

SEQ ID NO: 7516095 - DNA, 22 bp, Homo sapiens
ggctgcagttgtgtgaaggccg

SEQ ID NO: 7516096 - DNA, 22 bp, Homo sapiens
ggctgcagttgtgtgaaggccg

SEQ ID NO: 7516097 - DNA, 22 bp, Homo sapiens
ggctgcagttgtgtgaaggccg

SEQ ID NO: 7516098 - DNA, 22 bp, Homo sapiens
ggctgcagttgtgtgaaggccg

SEQ ID NO: 7516099 - DNA, 22 bp, Homo sapiens
ggctgccaggagaagctcagtg

SEQ ID NO: 7516100 - DNA, 22 bp, Homo sapiens
ggctgccaggagaagctcagtg

SEQ ID NO: 7516101 - DNA, 22 bp, Homo sapiens
ggctgccaggagaagctcagtg

SEQ ID NO: 7516102 - DNA, 22 bp, Homo sapiens
ggctgccagcactggtgtagag

SEQ ID NO: 7516103 - DNA, 22 bp, Homo sapiens
ggctgccaggagaagctcagtg

SEQ ID NO: 7516104 - DNA, 22 bp, Homo sapiens
ggctgccaggagaagctcagtg

SEQ ID NO: 7516105 - DNA, 22 bp, Homo sapiens
ggctgccaggagggaggccagt

SEQ ID NO: 7516106 - DNA, 22 bp, Homo sapiens
ggctgccaggagggaggccagt

SEQ ID NO: 7516107 - DNA, 22 bp, Homo sapiens
ggctgccaggagggaggccagt

SEQ ID NO: 7516108 - DNA, 22 bp, Homo sapiens
ggctgccaggagggaggccagt

SEQ ID NO: 7516109 - DNA, 22 bp, Homo sapiens
ggctgccacatgccatgtcctc

SEQ ID NO: 7516110 - DNA, 22 bp, Homo sapiens
ggctgccacatgccatgtcctc

SEQ ID NO: 7516111 - DNA, 22 bp, Homo sapiens
ggctgccacatgccatgtcctc

SEQ ID NO: 7516112 - DNA, 22 bp, Homo sapiens
ggctgccacgtcgagggtccaa

SEQ ID NO: 7516113 - DNA, 22 bp, Homo sapiens
ggctgccaccctcggacttccg

SEQ ID NO: 7516114 - DNA, 22 bp, Homo sapiens
ggctgccacgtcgagggtccaa

SEQ ID NO: 7516115 - DNA, 22 bp, Homo sapiens
ggctgccacgtcgagggtccaa

SEQ ID NO: 7516116 - DNA, 22 bp, Homo sapiens
ggctgccacgtcgagggtccaa

SEQ ID NO: 7516117 - DNA, 22 bp, Homo sapiens
ggctgccacgtcgagggtccaa

SEQ ID NO: 7516118 - DNA, 22 bp, Homo sapiens
ggctgccagcactggtgtagag

SEQ ID NO: 7516119 - DNA, 22 bp, Homo sapiens
ggctgccagcactggtgtagag

SEQ ID NO: 7516120 - DNA, 22 bp, Homo sapiens
ggctgccagcactggtgtagag

SEQ ID NO: 7516121 - DNA, 22 bp, Homo sapiens
ggctgccagcactggtgtagag

SEQ ID NO: 7516122 - DNA, 22 bp, Homo sapiens
gggaagagggagctggaatgat

SEQ ID NO: 7516123 - DNA, 22 bp, Homo sapiens
gggaagagggagctggaatgat

SEQ ID NO: 7516124 - DNA, 22 bp, Homo sapiens
gggaagagggagctggaatgat

SEQ ID NO: 7516125 - DNA, 22 bp, Homo sapiens
gggaagagggagctggaatgat

SEQ ID NO: 7516126 - DNA, 22 bp, Homo sapiens
gggaagagggagctggaatgat

SEQ ID NO: 7516127 - DNA, 22 bp, Homo sapiens
gggaagagggagctggaatgat

SEQ ID NO: 7516128 - DNA, 22 bp, Homo sapiens
gggaagagggagctggaatgat

SEQ ID NO: 7516129 - DNA, 22 bp, Homo sapiens
gggaagagggagctggaatgat

SEQ ID NO: 7516130 - DNA, 22 bp, Homo sapiens
gggaagagggagctggaatgat

SEQ ID NO: 7516131 - DNA, 18 bp, Homo sapiens
gggaagaggatctggccc

SEQ ID NO: 7516132 - DNA, 22 bp, Homo sapiens
gggaagagggagctggaatgat

SEQ ID NO: 7516133 - DNA, 22 bp, Homo sapiens
ggctgtggtctgggtgctcccc

SEQ ID NO: 7516134 - DNA, 18 bp, Homo sapiens
gggaagaggatctggccc

SEQ ID NO: 7516135 - DNA, 22 bp, Homo sapiens
gggaagagggagctggaatgat

SEQ ID NO: 7516136 - DNA, 22 bp, Homo sapiens
gggaagagggagctggaatgat

SEQ ID NO: 7516137 - DNA, 22 bp, Homo sapiens
gggaagagggagctggaatgat

SEQ ID NO: 7516138 - DNA, 22 bp, Homo sapiens
gggaagagggagctggaatgat

SEQ ID NO: 7516139 - DNA, 22 bp, Homo sapiens
gggaagagggagctggaatgat

SEQ ID NO: 7516140 - DNA, 22 bp, Homo sapiens
gggaagagggagctggaatgat

SEQ ID NO: 7516141 - DNA, 22 bp, Homo sapiens
gggaagagggagctggaatgat

SEQ ID NO: 7516142 - DNA, 22 bp, Homo sapiens
gggaagagggagctggaatgat

SEQ ID NO: 7516143 - DNA, 22 bp, Homo sapiens
gggaagagggagctggaatgat

SEQ ID NO: 7516144 - DNA, 22 bp, Homo sapiens
gggaagagggagctggaatgat

SEQ ID NO: 7516145 - DNA, 22 bp, Homo sapiens
gggaagagggagctggaatgat

SEQ ID NO: 7516146 - DNA, 22 bp, Homo sapiens
ggctgtggtctcatctagcctt

SEQ ID NO: 7516147 - DNA, 22 bp, Homo sapiens
ggctgtggtctcatctagcctt

SEQ ID NO: 7516148 - DNA, 22 bp, Homo sapiens
ggctgtggtctcatctagcctt

SEQ ID NO: 7516149 - DNA, 22 bp, Homo sapiens
ggctgtggtcattaggaggttg

SEQ ID NO: 7516150 - DNA, 22 bp, Homo sapiens
ggctgtggtctgggtgctcccc

SEQ ID NO: 7516151 - DNA, 22 bp, Homo sapiens
ggctgtggtcattaggaggttg

SEQ ID NO: 7516152 - DNA, 22 bp, Homo sapiens
ggctgtggtctgggtgctcccc

SEQ ID NO: 7516153 - DNA, 22 bp, Homo sapiens
ggctgtggtctgggtgctcccc

SEQ ID NO: 7516154 - DNA, 22 bp, Homo sapiens
ggctgtggtctgggtgctcccc

SEQ ID NO: 7516155 - DNA, 22 bp, Homo sapiens
ggctgtggtctgggtgctcccc

SEQ ID NO: 7516156 - DNA, 22 bp, Homo sapiens
ggctgtggtctgggtgctcccc

SEQ ID NO: 7516157 - DNA, 22 bp, Homo sapiens
ggctgtggtcattaggaggttg

SEQ ID NO: 7516158 - DNA, 22 bp, Homo sapiens
ggctgtggtcattaggaggttg

SEQ ID NO: 7516159 - DNA, 22 bp, Homo sapiens
ggctgtggtcattaggaggttg

SEQ ID NO: 7516160 - DNA, 22 bp, Homo sapiens
ggctgtgggtgtgacaggcctc

SEQ ID NO: 7516161 - DNA, 22 bp, Homo sapiens
ggctgtgggtgtgacaggcctc

SEQ ID NO: 7516162 - DNA, 22 bp, Homo sapiens
ggctgtgggccagctagaccct

SEQ ID NO: 7516163 - DNA, 22 bp, Homo sapiens
ggctgtgggatgcataggagct

SEQ ID NO: 7516164 - DNA, 22 bp, Homo sapiens
ggctgtgggccagctagaccct

SEQ ID NO: 7516165 - DNA, 22 bp, Homo sapiens
ggctgtgggatgcataggagct

SEQ ID NO: 7516166 - DNA, 22 bp, Homo sapiens
ggctgtgggatgcataggagct

SEQ ID NO: 7516167 - DNA, 22 bp, Homo sapiens
ggctgtggccagcggggctgag

SEQ ID NO: 7516168 - DNA, 22 bp, Homo sapiens
ggctgtgggatgcataggagct

SEQ ID NO: 7516169 - DNA, 22 bp, Homo sapiens
ggctgtgggatgcataggagct

SEQ ID NO: 7516170 - DNA, 22 bp, Homo sapiens
ggctgtgggatgcataggagct

SEQ ID NO: 7516171 - DNA, 22 bp, Homo sapiens
ggctgtggccagcggggctgag

SEQ ID NO: 7516172 - DNA, 22 bp, Homo sapiens
ggctgtggccagcggggctgag

SEQ ID NO: 7516173 - DNA, 22 bp, Homo sapiens
ggctgtggccagcggggctgag

SEQ ID NO: 7516174 - DNA, 22 bp, Homo sapiens
ggctgtggccagcggggctgag

SEQ ID NO: 7516175 - DNA, 22 bp, Homo sapiens
ggctgtggccagcggggctgag

SEQ ID NO: 7516176 - DNA, 22 bp, Homo sapiens
ggctgtggccagcggggctgag

SEQ ID NO: 7516177 - DNA, 22 bp, Homo sapiens
ggctgtggccagcggggctgag

SEQ ID NO: 7516178 - DNA, 22 bp, Homo sapiens
ggctgtggccagcggggctgag

SEQ ID NO: 7516179 - DNA, 22 bp, Homo sapiens
ggctgtggccagcggggctgag

SEQ ID NO: 7516180 - DNA, 22 bp, Homo sapiens
ggctgtggggggagcctgcccg

SEQ ID NO: 7516181 - DNA, 22 bp, Homo sapiens
ggctgtggggccgggtacagtg

SEQ ID NO: 7516182 - DNA, 22 bp, Homo sapiens
ggctgtggggggagcctgcccg

SEQ ID NO: 7516183 - DNA, 22 bp, Homo sapiens
ggctgtgggtgtgacaggcctc

SEQ ID NO: 7516184 - DNA, 22 bp, Homo sapiens
ggctgtgggtgtgacaggcctc

SEQ ID NO: 7516185 - DNA, 22 bp, Homo sapiens
ggctgtggggggagcctgcccg

SEQ ID NO: 7516186 - DNA, 22 bp, Homo sapiens
ggctgtgggccagctagaccct

SEQ ID NO: 7516187 - DNA, 22 bp, Homo sapiens
ggctgtggggaccaacaggact

SEQ ID NO: 7516188 - DNA, 22 bp, Homo sapiens
ggctgtggggccgggtacagtg

SEQ ID NO: 7516189 - DNA, 22 bp, Homo sapiens
ggctgtggggccgggtacagtg

SEQ ID NO: 7516190 - DNA, 22 bp, Homo sapiens
ggctgtggggccgggtacagtg

SEQ ID NO: 7516191 - DNA, 22 bp, Homo sapiens
ggctgtggggaccaacaggact

SEQ ID NO: 7516192 - DNA, 22 bp, Homo sapiens
ggctgtgcgggcagccgtggga

SEQ ID NO: 7516193 - DNA, 22 bp, Homo sapiens
ggctgtgcgtcatccggctgca

SEQ ID NO: 7516194 - DNA, 23 bp, Homo sapiens
ggctggcccggggctgctcctga

SEQ ID NO: 7516195 - DNA, 23 bp, Homo sapiens
ggctggcccggggctgctcctga

SEQ ID NO: 7516196 - DNA, 23 bp, Homo sapiens
ggctggcccggggctgctcctga

SEQ ID NO: 7516197 - DNA, 22 bp, Homo sapiens
ggctggccagggccctcgctgg

SEQ ID NO: 7516198 - DNA, 22 bp, Homo sapiens
ggctggccagggccctcgctgg

SEQ ID NO: 7516199 - DNA, 22 bp, Homo sapiens
ggctggccagggccctcgctgg

SEQ ID NO: 7516200 - DNA, 22 bp, Homo sapiens
ggctggccagggccctcgctgg

SEQ ID NO: 7516201 - DNA, 22 bp, Homo sapiens
ggctgtgcgtcatccggctgca

SEQ ID NO: 7516202 - DNA, 18 bp, Homo sapiens
ggctgtgcgtggaggctg

SEQ ID NO: 7516203 - DNA, 18 bp, Homo sapiens
ggctgtgcgtggaggctg

SEQ ID NO: 7516204 - DNA, 18 bp, Homo sapiens
ggctgtgcgtggaggctg

SEQ ID NO: 7516205 - DNA, 22 bp, Homo sapiens
ggctgtggacactgagctcaga

SEQ ID NO: 7516206 - DNA, 22 bp, Homo sapiens
ggctgtggacactgagctcaga

SEQ ID NO: 7516207 - DNA, 22 bp, Homo sapiens
ggctgtgctttgttaggttgtc

SEQ ID NO: 7516208 - DNA, 22 bp, Homo sapiens
ggctgtgctttgcccaaagggc

SEQ ID NO: 7516209 - DNA, 22 bp, Homo sapiens
ggctgtggacactgagctcaga

SEQ ID NO: 7516210 - DNA, 22 bp, Homo sapiens
ggctgtggacactgagctcaga

SEQ ID NO: 7516211 - DNA, 18 bp, Homo sapiens
ggctgtggacaagattag

SEQ ID NO: 7516212 - DNA, 22 bp, Homo sapiens
ggctgtggacactgagctcaga

SEQ ID NO: 7516213 - DNA, 22 bp, Homo sapiens
ggctgtgcttggtgtccttgga

SEQ ID NO: 7516214 - DNA, 22 bp, Homo sapiens
ggctgtgctgagggggaagccc

SEQ ID NO: 7516215 - DNA, 22 bp, Homo sapiens
ggctgtgctttgcccaaagggc

SEQ ID NO: 7516216 - DNA, 22 bp, Homo sapiens
ggctgtgctgagggggaagccc

SEQ ID NO: 7516217 - DNA, 22 bp, Homo sapiens
ggctgtggcattaggtgaggcc

SEQ ID NO: 7516218 - DNA, 22 bp, Homo sapiens
ggctgtggcattaggtgaggcc

SEQ ID NO: 7516219 - DNA, 22 bp, Homo sapiens
ggctgtggccagcggggctgag

SEQ ID NO: 7516220 - DNA, 22 bp, Homo sapiens
ggctgtggcattaggtgaggcc

SEQ ID NO: 7516221 - DNA, 22 bp, Homo sapiens
ggctgtggcattaggtgaggcc

SEQ ID NO: 7516222 - DNA, 22 bp, Homo sapiens
ggctgtggcattaggtgaggcc

SEQ ID NO: 7516223 - DNA, 22 bp, Homo sapiens
ggctgtggcattaggtgaggcc

SEQ ID NO: 7516224 - DNA, 22 bp, Homo sapiens
ggctgtggcagctggaagtggt

SEQ ID NO: 7516225 - DNA, 22 bp, Homo sapiens
ggctgtggcagctggaagtggt

SEQ ID NO: 7516226 - DNA, 22 bp, Homo sapiens
ggctgtggcagctggaagtggt

SEQ ID NO: 7516227 - DNA, 22 bp, Homo sapiens
ggctgtggcagctggaagtggt

SEQ ID NO: 7516228 - DNA, 22 bp, Homo sapiens
ggctgtggcattaggtgaggcc

SEQ ID NO: 7516229 - DNA, 22 bp, Homo sapiens
ggctgtggcattaggtgaggcc

SEQ ID NO: 7516230 - DNA, 22 bp, Homo sapiens
ggctgtggagctgcagagttgg

SEQ ID NO: 7516231 - DNA, 22 bp, Homo sapiens
ggctgtggagctgcagagttgg

SEQ ID NO: 7516232 - DNA, 22 bp, Homo sapiens
ggctgtggagctgcagagttgg

SEQ ID NO: 7516233 - DNA, 22 bp, Homo sapiens
ggctgtggcagctggaagtggt

SEQ ID NO: 7516234 - DNA, 21 bp, Homo sapiens
ggctgtggagccatgactcac

SEQ ID NO: 7516235 - DNA, 21 bp, Homo sapiens
ggctgtggagccatgactcac

SEQ ID NO: 7516236 - DNA, 21 bp, Homo sapiens
ggctgtggagccatgactcac

SEQ ID NO: 7516237 - DNA, 21 bp, Homo sapiens
ggctgtggagccatgactcac

SEQ ID NO: 7516238 - DNA, 22 bp, Homo sapiens
ggctgtggacactgagctcaga

SEQ ID NO: 7516239 - DNA, 21 bp, Homo sapiens
ggctgtggagccatgactcac

SEQ ID NO: 7516240 - DNA, 22 bp, Homo sapiens
ggctgtggcagctggaagtggt

SEQ ID NO: 7516241 - DNA, 22 bp, Homo sapiens
ggctgtggcagctggaagtggt

SEQ ID NO: 7516242 - DNA, 22 bp, Homo sapiens
ggctgtggcagctggaagtggt

SEQ ID NO: 7516243 - DNA, 22 bp, Homo sapiens
ggctgtggagctgcagagttgg

SEQ ID NO: 7516244 - DNA, 22 bp, Homo sapiens
ggctgtggcagctggaagtggt

SEQ ID NO: 7516245 - DNA, 22 bp, Homo sapiens
ggctgtggcagctggaagtggt

SEQ ID NO: 7516246 - DNA, 22 bp, Homo sapiens
ggctgtggcagctggaagtggt

SEQ ID NO: 7516247 - DNA, 22 bp, Homo sapiens
ggctgtggcagctggaagtggt

SEQ ID NO: 7516248 - DNA, 22 bp, Homo sapiens
ggctgtggcagctggaagtggt

SEQ ID NO: 7516249 - DNA, 22 bp, Homo sapiens
ggctgtggcagctggaagtggt

SEQ ID NO: 7516250 - DNA, 22 bp, Homo sapiens
gggagccatgctggtcttcttt

SEQ ID NO: 7516251 - DNA, 22 bp, Homo sapiens
gggagccatgctggtcttcttt

SEQ ID NO: 7516252 - DNA, 22 bp, Homo sapiens
gggagccatgctggtcttcttt

SEQ ID NO: 7516253 - DNA, 22 bp, Homo sapiens
gggagccatgctggtcttcttt

SEQ ID NO: 7516254 - DNA, 22 bp, Homo sapiens
gggagccccacctcggtgcccg

SEQ ID NO: 7516255 - DNA, 23 bp, Homo sapiens
gggagccatgggtggtcatggag

SEQ ID NO: 7516256 - DNA, 23 bp, Homo sapiens
gggagccatgggtggtcatggag

SEQ ID NO: 7516257 - DNA, 23 bp, Homo sapiens
gggagccatgggtggtcatggag

SEQ ID NO: 7516258 - DNA, 23 bp, Homo sapiens
gggagccatgggtggtcatggag

SEQ ID NO: 7516259 - DNA, 23 bp, Homo sapiens
gggagccatgggtggtcatggag

SEQ ID NO: 7516260 - DNA, 23 bp, Homo sapiens
gggagccatgggtggtcatggag

SEQ ID NO: 7516261 - DNA, 22 bp, Homo sapiens
gggagccagcctttgcctataa

SEQ ID NO: 7516262 - DNA, 22 bp, Homo sapiens
gggagccagcctttgcctataa

SEQ ID NO: 7516263 - DNA, 22 bp, Homo sapiens
gggagccagcctttgcctataa

SEQ ID NO: 7516264 - DNA, 22 bp, Homo sapiens
gggagccagccatccagaacct

SEQ ID NO: 7516265 - DNA, 23 bp, Homo sapiens
gggagccaggacctcgcgcccca

SEQ ID NO: 7516266 - DNA, 23 bp, Homo sapiens
gggagccaggacctcgcgcccca

SEQ ID NO: 7516267 - DNA, 23 bp, Homo sapiens
gggagccaggacctcgcgcccca

SEQ ID NO: 7516268 - DNA, 22 bp, Homo sapiens
gggagccactcagctgagagtt

SEQ ID NO: 7516269 - DNA, 22 bp, Homo sapiens
gggagccactcagctgagagtt

SEQ ID NO: 7516270 - DNA, 22 bp, Homo sapiens
gggagccactcagctgagagtt

SEQ ID NO: 7516271 - DNA, 22 bp, Homo sapiens
gggagccactcagctgagagtt

SEQ ID NO: 7516272 - DNA, 22 bp, Homo sapiens
gggagccactcagctgagagtt

SEQ ID NO: 7516273 - DNA, 22 bp, Homo sapiens
gggagccagagtcacctagaga

SEQ ID NO: 7516274 - DNA, 19 bp, Homo sapiens
gggagccagaccctttgct

SEQ ID NO: 7516275 - DNA, 19 bp, Homo sapiens
gggagccagaccctttgct

SEQ ID NO: 7516276 - DNA, 22 bp, Homo sapiens
gggagccactcagctgagagtt

SEQ ID NO: 7516277 - DNA, 22 bp, Homo sapiens
gggagccactcagctgagagtt

SEQ ID NO: 7516278 - DNA, 22 bp, Homo sapiens
gggagccagcagggcatggagc

SEQ ID NO: 7516279 - DNA, 22 bp, Homo sapiens
gggagccagcagggcatggagc

SEQ ID NO: 7516280 - DNA, 22 bp, Homo sapiens
gggagccagcagggcatggagc

SEQ ID NO: 7516281 - DNA, 22 bp, Homo sapiens
gggagccagcagggcatggagc

SEQ ID NO: 7516282 - DNA, 22 bp, Homo sapiens
gggagccagcagggcatggagc

SEQ ID NO: 7516283 - DNA, 22 bp, Homo sapiens
gggagccagcagggcatggagc

SEQ ID NO: 7516284 - DNA, 22 bp, Homo sapiens
gggagccagcagggcatggagc

SEQ ID NO: 7516285 - DNA, 22 bp, Homo sapiens
gggagccagagtcacctagaga

SEQ ID NO: 7516286 - DNA, 19 bp, Homo sapiens
gggagccagaccctttgct

SEQ ID NO: 7516287 - DNA, 22 bp, Homo sapiens
gggagccagagtcacctagaga

SEQ ID NO: 7516288 - DNA, 22 bp, Homo sapiens
gggagccacagtgaggtgcatg

SEQ ID NO: 7516289 - DNA, 22 bp, Homo sapiens
gggagccacagtgaggtgcatg

SEQ ID NO: 7516290 - DNA, 22 bp, Homo sapiens
gggagccacagtgaggtgcatg

SEQ ID NO: 7516291 - DNA, 22 bp, Homo sapiens
gggagccacagtgaggtgcatg

SEQ ID NO: 7516292 - DNA, 22 bp, Homo sapiens
gggagccacagtgaggtgcatg

SEQ ID NO: 7516293 - DNA, 22 bp, Homo sapiens
gggagccacagtgaggtgcatg

SEQ ID NO: 7516294 - DNA, 22 bp, Homo sapiens
gggagccacagtgaggtgcatg

SEQ ID NO: 7516295 - DNA, 22 bp, Homo sapiens
gggagccacagtgaggtgcatg

SEQ ID NO: 7516296 - DNA, 22 bp, Homo sapiens
gggagccacagtttatagtgat

SEQ ID NO: 7516297 - DNA, 22 bp, Homo sapiens
gggagccacagtttatagtgat

SEQ ID NO: 7516298 - DNA, 22 bp, Homo sapiens
gggagccacagtagcagctact

SEQ ID NO: 7516299 - DNA, 22 bp, Homo sapiens
gggagccacagtagcagctact

SEQ ID NO: 7516300 - DNA, 22 bp, Homo sapiens
gggagccacagtagcagctact

SEQ ID NO: 7516301 - DNA, 22 bp, Homo sapiens
gggagccacagtagcagctact

SEQ ID NO: 7516302 - DNA, 22 bp, Homo sapiens
gggagccacagtagcagctact

SEQ ID NO: 7516303 - DNA, 22 bp, Homo sapiens
gggagccacagtagcagctact

SEQ ID NO: 7516304 - DNA, 22 bp, Homo sapiens
gggagatggctcagaggccgcg

SEQ ID NO: 7516305 - DNA, 22 bp, Homo sapiens
gggagatggctcagaggccgcg

SEQ ID NO: 7516306 - DNA, 22 bp, Homo sapiens
gggagatgactcagtgacctcg

SEQ ID NO: 7516307 - DNA, 22 bp, Homo sapiens
gggagatggctcagaggccgcg

SEQ ID NO: 7516308 - DNA, 23 bp, Homo sapiens
gggagatgggaaatgaaggctct

SEQ ID NO: 7516309 - DNA, 23 bp, Homo sapiens
gggagatgggaaatgaaggctct

SEQ ID NO: 7516310 - DNA, 22 bp, Homo sapiens
gggagatggctcagaggccgcg

SEQ ID NO: 7516311 - DNA, 22 bp, Homo sapiens
gggagatggctcagaggccgcg

SEQ ID NO: 7516312 - DNA, 22 bp, Homo sapiens
gggagatggctcagaggccgcg

SEQ ID NO: 7516313 - DNA, 22 bp, Homo sapiens
gggaaggccggtccagtcaggt

SEQ ID NO: 7516314 - DNA, 22 bp, Homo sapiens
gggaaggccggtccagtcaggt

SEQ ID NO: 7516315 - DNA, 22 bp, Homo sapiens
gggaaggccggtccagtcaggt

SEQ ID NO: 7516316 - DNA, 22 bp, Homo sapiens
gggaaggccggtccagtcaggt

SEQ ID NO: 7516317 - DNA, 22 bp, Homo sapiens
gggaaggccttgtcagcggatt

SEQ ID NO: 7516318 - DNA, 22 bp, Homo sapiens
gggaaggccggtccagtcaggt

SEQ ID NO: 7516319 - DNA, 22 bp, Homo sapiens
gggaaggccggtccagtcaggt

SEQ ID NO: 7516320 - DNA, 22 bp, Homo sapiens
gggaaggccttgtcagcggatt

SEQ ID NO: 7516321 - DNA, 22 bp, Homo sapiens
gggaagcaggtgcagctcgcct

SEQ ID NO: 7516322 - DNA, 22 bp, Homo sapiens
gggaagcaggtgcagctcgcct

SEQ ID NO: 7516323 - DNA, 22 bp, Homo sapiens
gggaagcaggtgcagctcgcct

SEQ ID NO: 7516324 - DNA, 22 bp, Homo sapiens
gggaagcagcattgtgctggct

SEQ ID NO: 7516325 - DNA, 22 bp, Homo sapiens
gggaagcagatcataccagacc

SEQ ID NO: 7516326 - DNA, 22 bp, Homo sapiens
gggaagcagcattgtgctggct

SEQ ID NO: 7516327 - DNA, 22 bp, Homo sapiens
gggaagcagatcataccagacc

SEQ ID NO: 7516328 - DNA, 22 bp, Homo sapiens
gggaagatagtgttgagggccc

SEQ ID NO: 7516329 - DNA, 22 bp, Homo sapiens
gggaagcagatcataccagacc

SEQ ID NO: 7516330 - DNA, 22 bp, Homo sapiens
gggaagagtgtcggttgaagtg

SEQ ID NO: 7516331 - DNA, 22 bp, Homo sapiens
gggaagatagtgttgagggccc

SEQ ID NO: 7516332 - DNA, 22 bp, Homo sapiens
gggaagagtgtcggttgaagtg

SEQ ID NO: 7516333 - DNA, 22 bp, Homo sapiens
gggaagatagtgttgagggccc

SEQ ID NO: 7516334 - DNA, 22 bp, Homo sapiens
gggaagatagtgttgagggccc

SEQ ID NO: 7516335 - DNA, 22 bp, Homo sapiens
gggaagatagtgttgagggccc

SEQ ID NO: 7516336 - DNA, 22 bp, Homo sapiens
gggaagatagtgttgagggccc

SEQ ID NO: 7516337 - DNA, 22 bp, Homo sapiens
gggaagatagtgttgagggccc

SEQ ID NO: 7516338 - DNA, 22 bp, Homo sapiens
gggaagatagtgttgagggccc

SEQ ID NO: 7516339 - DNA, 22 bp, Homo sapiens
gggaagatagtgttgagggccc

SEQ ID NO: 7516340 - DNA, 22 bp, Homo sapiens
gggaagagtgtcggttgaagtg

SEQ ID NO: 7516341 - DNA, 22 bp, Homo sapiens
gggaagagtgtcggttgaagtg

SEQ ID NO: 7516342 - DNA, 22 bp, Homo sapiens
gggaagagtgtcggttgaagtg

SEQ ID NO: 7516343 - DNA, 22 bp, Homo sapiens
gggaagagtgtcggttgaagtg

SEQ ID NO: 7516344 - DNA, 22 bp, Homo sapiens
gggaagagtgtcggttgaagtg

SEQ ID NO: 7516345 - DNA, 22 bp, Homo sapiens
gggaagagtgtcggttgaagtg

SEQ ID NO: 7516346 - DNA, 22 bp, Homo sapiens
gggaagagtaactagcccatgt

SEQ ID NO: 7516347 - DNA, 22 bp, Homo sapiens
gggaagagtaactagcccatgt

SEQ ID NO: 7516348 - DNA, 22 bp, Homo sapiens
gggaagagtaactagcccatgt

SEQ ID NO: 7516349 - DNA, 22 bp, Homo sapiens
gggaagagtaactagcccatgt

SEQ ID NO: 7516350 - DNA, 22 bp, Homo sapiens
gggaagagtaactagcccatgt

SEQ ID NO: 7516351 - DNA, 22 bp, Homo sapiens
gggaagagtaactagcccatgt

SEQ ID NO: 7516352 - DNA, 22 bp, Homo sapiens
gggaagagtaactagcccatgt

SEQ ID NO: 7516353 - DNA, 22 bp, Homo sapiens
gggaagagtaactagcccatgt

SEQ ID NO: 7516354 - DNA, 22 bp, Homo sapiens
gggaagagtaactagcccatgt

SEQ ID NO: 7516355 - DNA, 22 bp, Homo sapiens
gggaagagtaactagcccatgt

SEQ ID NO: 7516356 - DNA, 22 bp, Homo sapiens
gggaagagtaactagcccatgt

SEQ ID NO: 7516357 - DNA, 22 bp, Homo sapiens
gggaagagggagctggaatgat

SEQ ID NO: 7516358 - DNA, 22 bp, Homo sapiens
gggaagagggagctggaatgat

SEQ ID NO: 7516359 - DNA, 22 bp, Homo sapiens
gggaaggcagtgggaggaactg

SEQ ID NO: 7516360 - DNA, 22 bp, Homo sapiens
gggaaggcagtgtctggttgaa

SEQ ID NO: 7516361 - DNA, 22 bp, Homo sapiens
gggaaggcagtgtctggttgaa

SEQ ID NO: 7516362 - DNA, 22 bp, Homo sapiens
gggaaggcagtgggaggaactg

SEQ ID NO: 7516363 - DNA, 22 bp, Homo sapiens
gggaaggcagtgggaggaactg

SEQ ID NO: 7516364 - DNA, 22 bp, Homo sapiens
gggaaggcaggcctctgttgga

SEQ ID NO: 7516365 - DNA, 22 bp, Homo sapiens
gggaaggcagtgggaggaactg

SEQ ID NO: 7516366 - DNA, 22 bp, Homo sapiens
gggaaggcagtgggaggaactg

SEQ ID NO: 7516367 - DNA, 22 bp, Homo sapiens
gggaaggcagtgggaggaactg

SEQ ID NO: 7516368 - DNA, 22 bp, Homo sapiens
gggaaggcagtgtctggttgaa

SEQ ID NO: 7516369 - DNA, 22 bp, Homo sapiens
gggaaggcagtgtctggttgaa

SEQ ID NO: 7516370 - DNA, 22 bp, Homo sapiens
gggaaggcatacctgagggaga

SEQ ID NO: 7516371 - DNA, 22 bp, Homo sapiens
gggaaggcatacctgagggaga

SEQ ID NO: 7516372 - DNA, 22 bp, Homo sapiens
gggaaggcatacctgagggaga

SEQ ID NO: 7516373 - DNA, 22 bp, Homo sapiens
gggaaggcatacctgagggaga

SEQ ID NO: 7516374 - DNA, 22 bp, Homo sapiens
gggaaggcatacctgagggaga

SEQ ID NO: 7516375 - DNA, 22 bp, Homo sapiens
gggaaggcatacctgagggaga

SEQ ID NO: 7516376 - DNA, 22 bp, Homo sapiens
gggaaggcatacctgagggaga

SEQ ID NO: 7516377 - DNA, 22 bp, Homo sapiens
gggaaggcaggattctctggtg

SEQ ID NO: 7516378 - DNA, 22 bp, Homo sapiens
gggaaggcaccatggtgttcca

SEQ ID NO: 7516379 - DNA, 22 bp, Homo sapiens
gggaaggcaccatggtgttcca

SEQ ID NO: 7516380 - DNA, 22 bp, Homo sapiens
gggaaggaggtggcttgaagtg

SEQ ID NO: 7516381 - DNA, 22 bp, Homo sapiens
gggaaggcaccatggtgttcca

SEQ ID NO: 7516382 - DNA, 22 bp, Homo sapiens
gggaaggcaccatggtgttcca

SEQ ID NO: 7516383 - DNA, 22 bp, Homo sapiens
gggaaggcaccatggtgttcca

SEQ ID NO: 7516384 - DNA, 22 bp, Homo sapiens
gggaaggcaggcctctgttgga

SEQ ID NO: 7516385 - DNA, 22 bp, Homo sapiens
gggaaggcaggattctctggtg

SEQ ID NO: 7516386 - DNA, 22 bp, Homo sapiens
gggaaggcaggattctctggtg

SEQ ID NO: 7516387 - DNA, 22 bp, Homo sapiens
gggaagccatgctcagaggtac

SEQ ID NO: 7516388 - DNA, 22 bp, Homo sapiens
gggaagccatgctcagaggtac

SEQ ID NO: 7516389 - DNA, 22 bp, Homo sapiens
gggaagccctgtgcttgcctgg

SEQ ID NO: 7516390 - DNA, 18 bp, Homo sapiens
gggaagccgggaagccgg

SEQ ID NO: 7516391 - DNA, 22 bp, Homo sapiens
gggaaggaggtggcttgaagtg

SEQ ID NO: 7516392 - DNA, 22 bp, Homo sapiens
gggaaggaggtggcttgaagtg

SEQ ID NO: 7516393 - DNA, 22 bp, Homo sapiens
gggaagcatctgagggtccact

SEQ ID NO: 7516394 - DNA, 22 bp, Homo sapiens
gggaagccatgctcagaggtac

SEQ ID NO: 7516395 - DNA, 22 bp, Homo sapiens
gggaagcatctgagggtccact

SEQ ID NO: 7516396 - DNA, 22 bp, Homo sapiens
ggctctgaaattctcactttta

SEQ ID NO: 7516397 - DNA, 17 bp, Homo sapiens
ggctctcttccagactt

SEQ ID NO: 7516398 - DNA, 22 bp, Homo sapiens
ggctctgaacatggggaggagt

SEQ ID NO: 7516399 - DNA, 22 bp, Homo sapiens
ggctctgaacatggggaggagt

SEQ ID NO: 7516400 - DNA, 22 bp, Homo sapiens
ggctctgaacatggggaggagt

SEQ ID NO: 7516401 - DNA, 22 bp, Homo sapiens
ggctctgaaggagacagctgct

SEQ ID NO: 7516402 - DNA, 22 bp, Homo sapiens
ggctctgaaggagacagctgct

SEQ ID NO: 7516403 - DNA, 22 bp, Homo sapiens
ggctctgaacatggggaggagt

SEQ ID NO: 7516404 - DNA, 22 bp, Homo sapiens
ggctctgaaggagacagctgct

SEQ ID NO: 7516405 - DNA, 22 bp, Homo sapiens
ggctctgaagggtgacaggttt

SEQ ID NO: 7516406 - DNA, 22 bp, Homo sapiens
ggctctcttaactggccatcct

SEQ ID NO: 7516407 - DNA, 22 bp, Homo sapiens
ggctctcttaactggccatcct

SEQ ID NO: 7516408 - DNA, 22 bp, Homo sapiens
ggctctctggaggagctcaccc

SEQ ID NO: 7516409 - DNA, 22 bp, Homo sapiens
ggctctctggaggagctcaccc

SEQ ID NO: 7516410 - DNA, 22 bp, Homo sapiens
ggctctctgaggaaacccttcc

SEQ ID NO: 7516411 - DNA, 22 bp, Homo sapiens
ggctctctgaggaaacccttcc

SEQ ID NO: 7516412 - DNA, 22 bp, Homo sapiens
ggctcagcaatgatgagcccct

SEQ ID NO: 7516413 - DNA, 22 bp, Homo sapiens
ggctcagcaatgatgagcccct

SEQ ID NO: 7516414 - DNA, 22 bp, Homo sapiens
ggctcagattccgagtggccct

SEQ ID NO: 7516415 - DNA, 22 bp, Homo sapiens
ggctcagcacagggctggcatc

SEQ ID NO: 7516416 - DNA, 22 bp, Homo sapiens
ggctcagcaatgatgagcccct

SEQ ID NO: 7516417 - DNA, 22 bp, Homo sapiens
ggctcagcaatgatgagcccct

SEQ ID NO: 7516418 - DNA, 22 bp, Homo sapiens
ggctcagcacagggctggcatc

SEQ ID NO: 7516419 - DNA, 22 bp, Homo sapiens
ggctcagcacagggctggcatc

SEQ ID NO: 7516420 - DNA, 22 bp, Homo sapiens
ggctcagatggtttgttctaga

SEQ ID NO: 7516421 - DNA, 22 bp, Homo sapiens
ggctcagagttaggacccatgt

SEQ ID NO: 7516422 - DNA, 22 bp, Homo sapiens
ggctcagagttaggacccatgt

SEQ ID NO: 7516423 - DNA, 22 bp, Homo sapiens
ggctcagagttaggacccatgt

SEQ ID NO: 7516424 - DNA, 22 bp, Homo sapiens
ggctcagaggttgaggccggca

SEQ ID NO: 7516425 - DNA, 22 bp, Homo sapiens
ggctcagaggttgaggccggca

SEQ ID NO: 7516426 - DNA, 22 bp, Homo sapiens
ggctcagattccgagtggccct

SEQ ID NO: 7516427 - DNA, 22 bp, Homo sapiens
ggctcagattccgagtggccct

SEQ ID NO: 7516428 - DNA, 22 bp, Homo sapiens
ggctcagattccgagtggccct

SEQ ID NO: 7516429 - DNA, 22 bp, Homo sapiens
ggctcagattccgagtggccct

SEQ ID NO: 7516430 - DNA, 22 bp, Homo sapiens
ggctcagattccgagtggccct

SEQ ID NO: 7516431 - DNA, 23 bp, Homo sapiens
ggctcagaaaaagtcctggcctc

SEQ ID NO: 7516432 - DNA, 23 bp, Homo sapiens
ggctcagaaaaagtcctggcctc

SEQ ID NO: 7516433 - DNA, 23 bp, Homo sapiens
ggctcagaaaaagtcctggcctc

SEQ ID NO: 7516434 - DNA, 22 bp, Homo sapiens
ggctcactgcaagctccgcctc

SEQ ID NO: 7516435 - DNA, 22 bp, Homo sapiens
ggctcactttggggtcagctgg

SEQ ID NO: 7516436 - DNA, 22 bp, Homo sapiens
ggctcactttggggtcagctgg

SEQ ID NO: 7516437 - DNA, 22 bp, Homo sapiens
ggctcactgcaacttccgcctc

SEQ ID NO: 7516438 - DNA, 22 bp, Homo sapiens
ggctcagaaggccatgctctgc

SEQ ID NO: 7516439 - DNA, 22 bp, Homo sapiens
ggctcagaaggccatgctctgc

SEQ ID NO: 7516440 - DNA, 22 bp, Homo sapiens
ggctcagaaactaaaggcgctg

SEQ ID NO: 7516441 - DNA, 22 bp, Homo sapiens
ggctcagaaggccatgctctgc

SEQ ID NO: 7516442 - DNA, 22 bp, Homo sapiens
ggctcagaaacctctggtgtct

SEQ ID NO: 7516443 - DNA, 22 bp, Homo sapiens
ggctcagaaacctctggtgtct

SEQ ID NO: 7516444 - DNA, 22 bp, Homo sapiens
ggctcagaaactaaaggcgctg

SEQ ID NO: 7516445 - DNA, 22 bp, Homo sapiens
ggctcagaaactaaaggcgctg

SEQ ID NO: 7516446 - DNA, 22 bp, Homo sapiens
ggctcagaaacctctggtgtct

SEQ ID NO: 7516447 - DNA, 22 bp, Homo sapiens
ggctcagaaacctctggtgtct

SEQ ID NO: 7516448 - DNA, 23 bp, Homo sapiens
ggctcagaaaaagtcctggcctc

SEQ ID NO: 7516449 - DNA, 23 bp, Homo sapiens
ggctcagaaaaagtcctggcctc

SEQ ID NO: 7516450 - DNA, 22 bp, Homo sapiens
ggctcagaggttgaggccggca

SEQ ID NO: 7516451 - DNA, 22 bp, Homo sapiens
ggctcagaggttgaggccggca

SEQ ID NO: 7516452 - DNA, 22 bp, Homo sapiens
ggctcagaggttgaggccggca

SEQ ID NO: 7516453 - DNA, 22 bp, Homo sapiens
ggctcagaggttgaggccggca

SEQ ID NO: 7516454 - DNA, 22 bp, Homo sapiens
ggctcagaggccagcaggtaga

SEQ ID NO: 7516455 - DNA, 22 bp, Homo sapiens
ggctcagaggccagcaggtaga

SEQ ID NO: 7516456 - DNA, 22 bp, Homo sapiens
ggctcagaggccagcaggtaga

SEQ ID NO: 7516457 - DNA, 22 bp, Homo sapiens
ggctcagaggagctggaacggt

SEQ ID NO: 7516458 - DNA, 22 bp, Homo sapiens
ggctcagaggagctggaacggt

SEQ ID NO: 7516459 - DNA, 22 bp, Homo sapiens
ggctcagaggagctggaacggt

SEQ ID NO: 7516460 - DNA, 22 bp, Homo sapiens
ggctcagaggagctggaacggt

SEQ ID NO: 7516461 - DNA, 22 bp, Homo sapiens
ggctcagagacctgcgatctga

SEQ ID NO: 7516462 - DNA, 22 bp, Homo sapiens
ggctcactgcaacctccacctc

SEQ ID NO: 7516463 - DNA, 22 bp, Homo sapiens
ggctcagacctcccagctccag

SEQ ID NO: 7516464 - DNA, 22 bp, Homo sapiens
ggctcagacctcccagctccag

SEQ ID NO: 7516465 - DNA, 22 bp, Homo sapiens
ggctcagacctcccagctccag

SEQ ID NO: 7516466 - DNA, 22 bp, Homo sapiens
ggctcagacctcccagctccag

SEQ ID NO: 7516467 - DNA, 22 bp, Homo sapiens
ggctcagacctcccagctccag

SEQ ID NO: 7516468 - DNA, 22 bp, Homo sapiens
ggctcagacctcccagctccag

SEQ ID NO: 7516469 - DNA, 22 bp, Homo sapiens
ggctcagagacctgcgatctga

SEQ ID NO: 7516470 - DNA, 22 bp, Homo sapiens
ggctcagagacctgcgatctga

SEQ ID NO: 7516471 - DNA, 22 bp, Homo sapiens
ggctcagactcccaggccctct

SEQ ID NO: 7516472 - DNA, 22 bp, Homo sapiens
ggctcagactcccaggccctct

SEQ ID NO: 7516473 - DNA, 22 bp, Homo sapiens
ggctcagactcccaggccctct

SEQ ID NO: 7516474 - DNA, 22 bp, Homo sapiens
ggctcagactcccaggccctct

SEQ ID NO: 7516475 - DNA, 22 bp, Homo sapiens
ggctctgaattattcctgagtc

SEQ ID NO: 7516476 - DNA, 22 bp, Homo sapiens
ggctctgaagggtgacaggttt

SEQ ID NO: 7516477 - DNA, 22 bp, Homo sapiens
ggctctgacctcccaggcagtt

SEQ ID NO: 7516478 - DNA, 22 bp, Homo sapiens
ggctctgaggcagatcgatggg

SEQ ID NO: 7516479 - DNA, 23 bp, Homo sapiens
ggctctgaggatggagctggtgg

SEQ ID NO: 7516480 - DNA, 23 bp, Homo sapiens
ggctctgaggatggagctggtgg

SEQ ID NO: 7516481 - DNA, 22 bp, Homo sapiens
ggctctgacctcccaggcagtt

SEQ ID NO: 7516482 - DNA, 22 bp, Homo sapiens
ggctctgcactcagagtcattc

SEQ ID NO: 7516483 - DNA, 22 bp, Homo sapiens
ggctctgcactcagagtcattc

SEQ ID NO: 7516484 - DNA, 22 bp, Homo sapiens
ggctctgcactcagagtcattc

SEQ ID NO: 7516485 - DNA, 22 bp, Homo sapiens
ggctctgcaaaagtagatactt

SEQ ID NO: 7516486 - DNA, 22 bp, Homo sapiens
ggctctgcaaaagtagatactt

SEQ ID NO: 7516487 - DNA, 22 bp, Homo sapiens
ggctctgcaaaagtagatactt

SEQ ID NO: 7516488 - DNA, 22 bp, Homo sapiens
ggctctgcaaaagtagatactt

SEQ ID NO: 7516489 - DNA, 22 bp, Homo sapiens
ggctctgagtttagaagggtgg

SEQ ID NO: 7516490 - DNA, 22 bp, Homo sapiens
ggctctgagtttagaagggtgg

SEQ ID NO: 7516491 - DNA, 22 bp, Homo sapiens
ggctctgagtttagaagggtgg

SEQ ID NO: 7516492 - DNA, 22 bp, Homo sapiens
ggctctgagtttagaagggtgg

SEQ ID NO: 7516493 - DNA, 22 bp, Homo sapiens
ggctctgaggcagatcgatggg

SEQ ID NO: 7516494 - DNA, 22 bp, Homo sapiens
ggctctgcagagggcccagctt

SEQ ID NO: 7516495 - DNA, 22 bp, Homo sapiens
ggctctgcagagggcccagctt

SEQ ID NO: 7516496 - DNA, 22 bp, Homo sapiens
ggctctgcagagggcccagctt

SEQ ID NO: 7516497 - DNA, 22 bp, Homo sapiens
ggctctgcagagggcccagctt

SEQ ID NO: 7516498 - DNA, 22 bp, Homo sapiens
ggctctgcagagggcccagctt

SEQ ID NO: 7516499 - DNA, 22 bp, Homo sapiens
ggctctgcagagggcccagctt

SEQ ID NO: 7516500 - DNA, 22 bp, Homo sapiens
ggctctgcagcttggggtcctg

SEQ ID NO: 7516501 - DNA, 22 bp, Homo sapiens
ggctctgcagcttggggtcctg

SEQ ID NO: 7516502 - DNA, 22 bp, Homo sapiens
ggctctgcagcttgctaactgt

SEQ ID NO: 7516503 - DNA, 22 bp, Homo sapiens
ggctctgcagcttgctaactgt

SEQ ID NO: 7516504 - DNA, 22 bp, Homo sapiens
ggctctgcagcttgctaactgt

SEQ ID NO: 7516505 - DNA, 22 bp, Homo sapiens
ggctctgcagcttgctaactgt

SEQ ID NO: 7516506 - DNA, 22 bp, Homo sapiens
ggctctgcagcttgctaactgt

SEQ ID NO: 7516507 - DNA, 22 bp, Homo sapiens
ggctctgcatgcaggttgtcag

SEQ ID NO: 7516508 - DNA, 22 bp, Homo sapiens
ggctctgcatgcaggttgtcag

SEQ ID NO: 7516509 - DNA, 22 bp, Homo sapiens
ggctctgcatgcaggttgtcag

SEQ ID NO: 7516510 - DNA, 22 bp, Homo sapiens
ggctctgcagtgacttgagggg

SEQ ID NO: 7516511 - DNA, 22 bp, Homo sapiens
ggctctgcagcttggggtcctg

SEQ ID NO: 7516512 - DNA, 22 bp, Homo sapiens
ggctctgcagagggcccagctt

SEQ ID NO: 7516513 - DNA, 22 bp, Homo sapiens
ggctctgcagtgacttgagggg

SEQ ID NO: 7516514 - DNA, 22 bp, Homo sapiens
ggctctgcagtgacttgagggg

SEQ ID NO: 7516515 - DNA, 22 bp, Homo sapiens
ggctctgcatgtgagtgggtgg

SEQ ID NO: 7516516 - DNA, 22 bp, Homo sapiens
ggctctgcatgtgagtgggtgg

SEQ ID NO: 7516517 - DNA, 22 bp, Homo sapiens
ggctctgcatgtgagtgggtgg

SEQ ID NO: 7516518 - DNA, 22 bp, Homo sapiens
ggctctgcatgtgagtgggtgg

SEQ ID NO: 7516519 - DNA, 22 bp, Homo sapiens
ggctctgcatgtgagtgggtgg

SEQ ID NO: 7516520 - DNA, 22 bp, Homo sapiens
ggctctgcctgcctgagtgtcc

SEQ ID NO: 7516521 - DNA, 22 bp, Homo sapiens
ggctctgcctgcctgagtgtcc

SEQ ID NO: 7516522 - DNA, 22 bp, Homo sapiens
ggctctgcctgcccagcagcac

SEQ ID NO: 7516523 - DNA, 22 bp, Homo sapiens
ggctctgcctgcccagcagcac

SEQ ID NO: 7516524 - DNA, 22 bp, Homo sapiens
ggctctgcctgcctgagtgtcc

SEQ ID NO: 7516525 - DNA, 22 bp, Homo sapiens
ggctctgcctgcctgagtgtcc

SEQ ID NO: 7516526 - DNA, 22 bp, Homo sapiens
ggctctgcctgcctgagtgtcc

SEQ ID NO: 7516527 - DNA, 22 bp, Homo sapiens
ggctctgccgtgtgctcacatg

SEQ ID NO: 7516528 - DNA, 22 bp, Homo sapiens
ggctctgcgcctgcggggactt

SEQ ID NO: 7516529 - DNA, 22 bp, Homo sapiens
ggctctgcgcctgcggggactt

SEQ ID NO: 7516530 - DNA, 22 bp, Homo sapiens
ggctctgcgcctgcggggactt

SEQ ID NO: 7516531 - DNA, 22 bp, Homo sapiens
ggctctgcctctgaccctctgg

SEQ ID NO: 7516532 - DNA, 22 bp, Homo sapiens
ggctctgcctgcccagcagcac

SEQ ID NO: 7516533 - DNA, 22 bp, Homo sapiens
ggctctgcctctgaccctctgg

SEQ ID NO: 7516534 - DNA, 22 bp, Homo sapiens
ggctctgcctctgaccctctgg

SEQ ID NO: 7516535 - DNA, 22 bp, Homo sapiens
ggctctgccgtgtgctcacatg

SEQ ID NO: 7516536 - DNA, 22 bp, Homo sapiens
ggctctgccgtgtgctcacatg

SEQ ID NO: 7516537 - DNA, 22 bp, Homo sapiens
ggctctgcctctgaccctctgg

SEQ ID NO: 7516538 - DNA, 22 bp, Homo sapiens
ggctctgccgtgtgctcacatg

SEQ ID NO: 7516539 - DNA, 22 bp, Homo sapiens
ggctctgccgtgtgctcacatg

SEQ ID NO: 7516540 - DNA, 22 bp, Homo sapiens
ggctctgccgtgtgctcacatg

SEQ ID NO: 7516541 - DNA, 22 bp, Homo sapiens
ggctctgcccgcggctgcccac

SEQ ID NO: 7516542 - DNA, 22 bp, Homo sapiens
ggctctgccgtgtgctcacatg

SEQ ID NO: 7516543 - DNA, 20 bp, Homo sapiens
ggctctgccccaccccgtcc

SEQ ID NO: 7516544 - DNA, 20 bp, Homo sapiens
ggctctgccccaccccgtcc

SEQ ID NO: 7516545 - DNA, 22 bp, Homo sapiens
ggctctgcccgcggctgcccac

SEQ ID NO: 7516546 - DNA, 22 bp, Homo sapiens
ggctctgcccgcggctgcccac

SEQ ID NO: 7516547 - DNA, 22 bp, Homo sapiens
ggctctgcccgcggctgcccac

SEQ ID NO: 7516548 - DNA, 22 bp, Homo sapiens
ggctctgcccaggtggacagca

SEQ ID NO: 7516549 - DNA, 22 bp, Homo sapiens
ggctctgcccaggtggacagca

SEQ ID NO: 7516550 - DNA, 22 bp, Homo sapiens
ggctctgcccagatgaagagga

SEQ ID NO: 7516551 - DNA, 22 bp, Homo sapiens
ggctctgcccagatgaagagga

SEQ ID NO: 7516552 - DNA, 22 bp, Homo sapiens
ggctctgcccaggtggacagca

SEQ ID NO: 7516553 - DNA, 22 bp, Homo sapiens
ggctctgcccaggtggacagca

SEQ ID NO: 7516554 - DNA, 22 bp, Homo sapiens
ggctctgcccaggtggacagca

SEQ ID NO: 7516555 - DNA, 22 bp, Homo sapiens
ggctctgcccagatgaagagga

SEQ ID NO: 7516556 - DNA, 22 bp, Homo sapiens
ggctctgccatttcctagctgc

SEQ ID NO: 7516557 - DNA, 22 bp, Homo sapiens
ggctctgccatttcctagctgc

SEQ ID NO: 7516558 - DNA, 22 bp, Homo sapiens
ggctctgccatttcctagctgc

SEQ ID NO: 7516559 - DNA, 22 bp, Homo sapiens
ggctctgccatttcctagctgc

SEQ ID NO: 7516560 - DNA, 22 bp, Homo sapiens
ggctctgccatttcctagctgc

SEQ ID NO: 7516561 - DNA, 22 bp, Homo sapiens
ggctctgccacttcttggctgt

SEQ ID NO: 7516562 - DNA, 22 bp, Homo sapiens
ggctctgccacttcttggctgt

SEQ ID NO: 7516563 - DNA, 22 bp, Homo sapiens
ggctctgccacttcttggctgt

SEQ ID NO: 7516564 - DNA, 22 bp, Homo sapiens
ggctctgccacttcttggctgt

SEQ ID NO: 7516565 - DNA, 22 bp, Homo sapiens
ggctctgccacttcttggctgt

SEQ ID NO: 7516566 - DNA, 22 bp, Homo sapiens
ggctcactgcaacctccacctc

SEQ ID NO: 7516567 - DNA, 22 bp, Homo sapiens
ggctcacgcaattatcccggcc

SEQ ID NO: 7516568 - DNA, 22 bp, Homo sapiens
ggctcactacaacctccgcctt

SEQ ID NO: 7516569 - DNA, 22 bp, Homo sapiens
ggctcacgcaattatcccggcc

SEQ ID NO: 7516570 - DNA, 22 bp, Homo sapiens
ggctcacgcaattatcccggcc

SEQ ID NO: 7516571 - DNA, 22 bp, Homo sapiens
ggctcacgcaattatcccggcc

SEQ ID NO: 7516572 - DNA, 22 bp, Homo sapiens
ggctcacgcaattatcccggcc

SEQ ID NO: 7516573 - DNA, 22 bp, Homo sapiens
ggctcactgcaacttccgcctc

SEQ ID NO: 7516574 - DNA, 22 bp, Homo sapiens
ggctcactgcaacttccgcctc

SEQ ID NO: 7516575 - DNA, 22 bp, Homo sapiens
ggctcactgcaacttccgcctc

SEQ ID NO: 7516576 - DNA, 22 bp, Homo sapiens
ggctcactgcaacttccgcctc

SEQ ID NO: 7516577 - DNA, 22 bp, Homo sapiens
ggctcactgcaacttccgcctc

SEQ ID NO: 7516578 - DNA, 22 bp, Homo sapiens
ggctcactgcaacctctgcctc

SEQ ID NO: 7516579 - DNA, 22 bp, Homo sapiens
ggctcactgcaacttccgcctc

SEQ ID NO: 7516580 - DNA, 22 bp, Homo sapiens
ggctcaccatggcctccctgct

SEQ ID NO: 7516581 - DNA, 22 bp, Homo sapiens
ggctcaccattttcactctctg

SEQ ID NO: 7516582 - DNA, 22 bp, Homo sapiens
ggctcacgcaattatcccggcc

SEQ ID NO: 7516583 - DNA, 22 bp, Homo sapiens
ggctagggactcctcctcaggg

SEQ ID NO: 7516584 - DNA, 22 bp, Homo sapiens
ggctagggacacagctctgctc

SEQ ID NO: 7516585 - DNA, 22 bp, Homo sapiens
ggctagggacacagctctgctc

SEQ ID NO: 7516586 - DNA, 22 bp, Homo sapiens
ggctcaccatggcctccctgct

SEQ ID NO: 7516587 - DNA, 22 bp, Homo sapiens
ggctagggactcctcctcaggg

SEQ ID NO: 7516588 - DNA, 22 bp, Homo sapiens
ggctagggacacagctctgctc

SEQ ID NO: 7516589 - DNA, 22 bp, Homo sapiens
ggctagggacacagctctgctc

SEQ ID NO: 7516590 - DNA, 22 bp, Homo sapiens
ggctagggaaatcctgatccaa

SEQ ID NO: 7516591 - DNA, 22 bp, Homo sapiens
ggctagggacacagctctgctc

SEQ ID NO: 7516592 - DNA, 22 bp, Homo sapiens
ggctagggaaatcctgatccaa

SEQ ID NO: 7516593 - DNA, 22 bp, Homo sapiens
ggctagggaaaatgattggata

SEQ ID NO: 7516594 - DNA, 22 bp, Homo sapiens
ggctagggaaaatgattggata

SEQ ID NO: 7516595 - DNA, 22 bp, Homo sapiens
ggctagggaaaatgattggata

SEQ ID NO: 7516596 - DNA, 22 bp, Homo sapiens
ggctagggaaatcctgatccaa

SEQ ID NO: 7516597 - DNA, 22 bp, Homo sapiens
ggctagggaaaatgattggata

SEQ ID NO: 7516598 - DNA, 18 bp, Homo sapiens
ggcctctggactggcagc

SEQ ID NO: 7516599 - DNA, 18 bp, Homo sapiens
ggcctctggactggcagc

SEQ ID NO: 7516600 - DNA, 18 bp, Homo sapiens
ggcctctggactggcagc

SEQ ID NO: 7516601 - DNA, 22 bp, Homo sapiens
ggcctctgcttatgctgatgac

SEQ ID NO: 7516602 - DNA, 18 bp, Homo sapiens
ggcctctggactggcagc

SEQ ID NO: 7516603 - DNA, 18 bp, Homo sapiens
ggcctctggactggcagc

SEQ ID NO: 7516604 - DNA, 22 bp, Homo sapiens
ggcctctgcttatgctgatgac

SEQ ID NO: 7516605 - DNA, 22 bp, Homo sapiens
ggcctctgcttatgctgatgac

SEQ ID NO: 7516606 - DNA, 22 bp, Homo sapiens
ggcctctgcttatgctgatgac

SEQ ID NO: 7516607 - DNA, 22 bp, Homo sapiens
ggcctctggcaggcaggccctc

SEQ ID NO: 7516608 - DNA, 22 bp, Homo sapiens
ggcctctggcaggcaggccctc

SEQ ID NO: 7516609 - DNA, 18 bp, Homo sapiens
ggcctctggactggcagc

SEQ ID NO: 7516610 - DNA, 22 bp, Homo sapiens
ggcctctggcaggcaggccctc

SEQ ID NO: 7516611 - DNA, 22 bp, Homo sapiens
ggcctctggcaggcaggccctc

SEQ ID NO: 7516612 - DNA, 22 bp, Homo sapiens
ggcctctggcaggcaggccctc

SEQ ID NO: 7516613 - DNA, 22 bp, Homo sapiens
ggcctctggggtcctgagccca

SEQ ID NO: 7516614 - DNA, 22 bp, Homo sapiens
ggcctctggggtcctgagccca

SEQ ID NO: 7516615 - DNA, 22 bp, Homo sapiens
ggcctctggggtcctgagccca

SEQ ID NO: 7516616 - DNA, 22 bp, Homo sapiens
ggcctctggggtcctgagccca

SEQ ID NO: 7516617 - DNA, 22 bp, Homo sapiens
ggcctctggggtcctgagccca

SEQ ID NO: 7516618 - DNA, 22 bp, Homo sapiens
ggcctctggggtcctgagccca

SEQ ID NO: 7516619 - DNA, 22 bp, Homo sapiens
ggcctctggtcaagacaagcat

SEQ ID NO: 7516620 - DNA, 22 bp, Homo sapiens
ggcctctggtcaagacaagcat

SEQ ID NO: 7516621 - DNA, 22 bp, Homo sapiens
ggcctctggtgcctgaagcgcc

SEQ ID NO: 7516622 - DNA, 22 bp, Homo sapiens
ggcctctggttcacagggagga

SEQ ID NO: 7516623 - DNA, 22 bp, Homo sapiens
ggcctctggttcacagggagga

SEQ ID NO: 7516624 - DNA, 22 bp, Homo sapiens
ggcctctggttcacagggagga

SEQ ID NO: 7516625 - DNA, 22 bp, Homo sapiens
ggcctctggttcacagggagga

SEQ ID NO: 7516626 - DNA, 22 bp, Homo sapiens
ggctaggctcacctggagagtt

SEQ ID NO: 7516627 - DNA, 22 bp, Homo sapiens
ggctaggctcacctggagagtt

SEQ ID NO: 7516628 - DNA, 22 bp, Homo sapiens
ggcctctctggcatggctgccc

SEQ ID NO: 7516629 - DNA, 22 bp, Homo sapiens
ggcctctcttgggacagctgtc

SEQ ID NO: 7516630 - DNA, 22 bp, Homo sapiens
ggcctctcttgggacagctgtc

SEQ ID NO: 7516631 - DNA, 22 bp, Homo sapiens
ggcctctcttgggacagctgtc

SEQ ID NO: 7516632 - DNA, 20 bp, Homo sapiens
ggcctctgaggacaaggaga

SEQ ID NO: 7516633 - DNA, 20 bp, Homo sapiens
ggcctctgaggacaaggaga

SEQ ID NO: 7516634 - DNA, 22 bp, Homo sapiens
ggcctctcttgggacagctgtc

SEQ ID NO: 7516635 - DNA, 22 bp, Homo sapiens
ggcctctgaggacagccttggc

SEQ ID NO: 7516636 - DNA, 22 bp, Homo sapiens
ggcctctgaggacagccttggc

SEQ ID NO: 7516637 - DNA, 22 bp, Homo sapiens
ggcctctgaggacagccttggc

SEQ ID NO: 7516638 - DNA, 22 bp, Homo sapiens
ggcctccaggcctactcagggc

SEQ ID NO: 7516639 - DNA, 22 bp, Homo sapiens
ggcccatgcatcctgtgcagcc

SEQ ID NO: 7516640 - DNA, 22 bp, Homo sapiens
ggcctccaggcctactcagggc

SEQ ID NO: 7516641 - DNA, 22 bp, Homo sapiens
ggcctccatcttatcttactct

SEQ ID NO: 7516642 - DNA, 21 bp, Homo sapiens
ggcctcccggaccgcagcgcc

SEQ ID NO: 7516643 - DNA, 21 bp, Homo sapiens
ggcctcccggaccgcagcgcc

SEQ ID NO: 7516644 - DNA, 22 bp, Homo sapiens
ggcctccatcttatcttactct

SEQ ID NO: 7516645 - DNA, 21 bp, Homo sapiens
ggcctcccggaccgcagcgcc

SEQ ID NO: 7516646 - DNA, 21 bp, Homo sapiens
ggcctcccggaccgcagcgcc

SEQ ID NO: 7516647 - DNA, 22 bp, Homo sapiens
ggcctctctgagagcagacgtt

SEQ ID NO: 7516648 - DNA, 22 bp, Homo sapiens
ggcctctctgagagcagacgtt

SEQ ID NO: 7516649 - DNA, 22 bp, Homo sapiens
ggcctctctccttggcttgcag

SEQ ID NO: 7516650 - DNA, 22 bp, Homo sapiens
ggcctcctcaccctgctcaggc

SEQ ID NO: 7516651 - DNA, 22 bp, Homo sapiens
ggcctcctcaccctgctcaggc

SEQ ID NO: 7516652 - DNA, 22 bp, Homo sapiens
ggcctcctcaccctgctcaggc

SEQ ID NO: 7516653 - DNA, 21 bp, Homo sapiens
ggcctcctacagtcatgggcc

SEQ ID NO: 7516654 - DNA, 22 bp, Homo sapiens
ggcctcctcaccctgctcaggc

SEQ ID NO: 7516655 - DNA, 22 bp, Homo sapiens
ggcctcctcaccctgctcaggc

SEQ ID NO: 7516656 - DNA, 22 bp, Homo sapiens
ggcctcctcaccctgctcaggc

SEQ ID NO: 7516657 - DNA, 21 bp, Homo sapiens
ggcctcctacagtcatgggcc

SEQ ID NO: 7516658 - DNA, 21 bp, Homo sapiens
ggcctcctacagtcatgggcc

SEQ ID NO: 7516659 - DNA, 21 bp, Homo sapiens
ggcctcctacagtcatgggcc

SEQ ID NO: 7516660 - DNA, 21 bp, Homo sapiens
ggcctcctacagtcatgggcc

SEQ ID NO: 7516661 - DNA, 21 bp, Homo sapiens
ggcctcctacagtcatgggcc

SEQ ID NO: 7516662 - DNA, 21 bp, Homo sapiens
ggcctcctacagtcatgggcc

SEQ ID NO: 7516663 - DNA, 22 bp, Homo sapiens
ggcctctgccccagccacacct

SEQ ID NO: 7516664 - DNA, 22 bp, Homo sapiens
ggcctctgccccagccacacct

SEQ ID NO: 7516665 - DNA, 22 bp, Homo sapiens
ggcctctgccccagccacacct

SEQ ID NO: 7516666 - DNA, 22 bp, Homo sapiens
ggcctctgccccagccacacct

SEQ ID NO: 7516667 - DNA, 22 bp, Homo sapiens
ggcctctgcaggcctcgacaag

SEQ ID NO: 7516668 - DNA, 22 bp, Homo sapiens
ggcctctgcaggcctcgacaag

SEQ ID NO: 7516669 - DNA, 19 bp, Homo sapiens
ggcctctgcaggccgcccc

SEQ ID NO: 7516670 - DNA, 19 bp, Homo sapiens
ggcctctgcaggccgcccc

SEQ ID NO: 7516671 - DNA, 19 bp, Homo sapiens
ggcctctgcaggccgcccc

SEQ ID NO: 7516672 - DNA, 19 bp, Homo sapiens
ggcctctgcaggccgcccc

SEQ ID NO: 7516673 - DNA, 22 bp, Homo sapiens
ggcctctgcaactggctgtggc

SEQ ID NO: 7516674 - DNA, 22 bp, Homo sapiens
ggcctctgcaactggctgtggc

SEQ ID NO: 7516675 - DNA, 22 bp, Homo sapiens
ggcctctgcaactggctgtggc

SEQ ID NO: 7516676 - DNA, 22 bp, Homo sapiens
ggcctctgccccagccacacct

SEQ ID NO: 7516677 - DNA, 22 bp, Homo sapiens
ggcctctgccctcactcctgtc

SEQ ID NO: 7516678 - DNA, 22 bp, Homo sapiens
ggcctctgccctcactcctgtc

SEQ ID NO: 7516679 - DNA, 22 bp, Homo sapiens
ggcctctgccccgcggggctcg

SEQ ID NO: 7516680 - DNA, 22 bp, Homo sapiens
ggcctctgccccgcggggctcg

SEQ ID NO: 7516681 - DNA, 22 bp, Homo sapiens
ggcctctgccccagccacacct

SEQ ID NO: 7516682 - DNA, 22 bp, Homo sapiens
ggcctctgccccagccacacct

SEQ ID NO: 7516683 - DNA, 22 bp, Homo sapiens
ggcctctgcctcatctgggcac

SEQ ID NO: 7516684 - DNA, 22 bp, Homo sapiens
ggcctctgccctcactcctgtc

SEQ ID NO: 7516685 - DNA, 22 bp, Homo sapiens
ggcctctgccctcactcctgtc

SEQ ID NO: 7516686 - DNA, 22 bp, Homo sapiens
ggcctctgccctcactcctgtc

SEQ ID NO: 7516687 - DNA, 22 bp, Homo sapiens
ggcctctgccctcactcctgtc

SEQ ID NO: 7516688 - DNA, 22 bp, Homo sapiens
ggcctctgcctcatctgggcac

SEQ ID NO: 7516689 - DNA, 22 bp, Homo sapiens
ggcctctgcctcatctgggcac

SEQ ID NO: 7516690 - DNA, 22 bp, Homo sapiens
ggcctctgcctcatctgggcac

SEQ ID NO: 7516691 - DNA, 22 bp, Homo sapiens
ggcctctgcctcatctgggcac

SEQ ID NO: 7516692 - DNA, 21 bp, Homo sapiens
ggcctctgccttgccccactc

SEQ ID NO: 7516693 - DNA, 21 bp, Homo sapiens
ggcctctgccttgccccactc

SEQ ID NO: 7516694 - DNA, 21 bp, Homo sapiens
ggcctctgccttgccccactc

SEQ ID NO: 7516695 - DNA, 22 bp, Homo sapiens
ggcccaggatgcaagaactgaa

SEQ ID NO: 7516696 - DNA, 22 bp, Homo sapiens
ggcccaggatgcaagaactgaa

SEQ ID NO: 7516697 - DNA, 22 bp, Homo sapiens
ggcccaggatgcaagaactgaa

SEQ ID NO: 7516698 - DNA, 22 bp, Homo sapiens
ggcccaggatgcaagaactgaa

SEQ ID NO: 7516699 - DNA, 22 bp, Homo sapiens
ggcccagctttcattccttgct

SEQ ID NO: 7516700 - DNA, 22 bp, Homo sapiens
ggcccaggatgcaagaactgaa

SEQ ID NO: 7516701 - DNA, 22 bp, Homo sapiens
ggcccaggatgcaagaactgaa

SEQ ID NO: 7516702 - DNA, 22 bp, Homo sapiens
ggcccaggatgcaagaactgaa

SEQ ID NO: 7516703 - DNA, 22 bp, Homo sapiens
ggcccaggatgcaagaactgaa

SEQ ID NO: 7516704 - DNA, 22 bp, Homo sapiens
ggcccaggatgcaagaactgaa

SEQ ID NO: 7516705 - DNA, 22 bp, Homo sapiens
ggcccaggatgcaagaactgaa

SEQ ID NO: 7516706 - DNA, 22 bp, Homo sapiens
ggcccaggatgcaagaactgaa

SEQ ID NO: 7516707 - DNA, 22 bp, Homo sapiens
ggcccaggctggagtgcagtgg

SEQ ID NO: 7516708 - DNA, 22 bp, Homo sapiens
ggcccaggctggagtgcagtgg

SEQ ID NO: 7516709 - DNA, 22 bp, Homo sapiens
ggcccaggctggagtgcagtgg

SEQ ID NO: 7516710 - DNA, 22 bp, Homo sapiens
ggcccaggctggagtgcagtgg

SEQ ID NO: 7516711 - DNA, 22 bp, Homo sapiens
ggcccaggctggagtgcagtgg

SEQ ID NO: 7516712 - DNA, 22 bp, Homo sapiens
ggcccaggctggagtgcagtgg

SEQ ID NO: 7516713 - DNA, 22 bp, Homo sapiens
ggcccaggctggagtgcggtgg

SEQ ID NO: 7516714 - DNA, 22 bp, Homo sapiens
ggcccaggctggagtgcggtgg

SEQ ID NO: 7516715 - DNA, 22 bp, Homo sapiens
ggcccaggctggagtgcagtgg

SEQ ID NO: 7516716 - DNA, 22 bp, Homo sapiens
ggcccaggctggagtgcagtgg

SEQ ID NO: 7516717 - DNA, 22 bp, Homo sapiens
ggcccaggctggagtgcagtgg

SEQ ID NO: 7516718 - DNA, 22 bp, Homo sapiens
ggcccagctgtgcttccagccc

SEQ ID NO: 7516719 - DNA, 22 bp, Homo sapiens
ggcccagctgtgcttccagccc

SEQ ID NO: 7516720 - DNA, 22 bp, Homo sapiens
ggcccagctgtgcttccagccc

SEQ ID NO: 7516721 - DNA, 22 bp, Homo sapiens
ggcccagctgtgcttccagccc

SEQ ID NO: 7516722 - DNA, 22 bp, Homo sapiens
ggcccagctgtgcttccagccc

SEQ ID NO: 7516723 - DNA, 22 bp, Homo sapiens
ggcccagctttcattccttgct

SEQ ID NO: 7516724 - DNA, 22 bp, Homo sapiens
ggcccagctttcattccttgct

SEQ ID NO: 7516725 - DNA, 22 bp, Homo sapiens
ggcccagctttcattccttgct

SEQ ID NO: 7516726 - DNA, 22 bp, Homo sapiens
ggcccagctgtatattacagtt

SEQ ID NO: 7516727 - DNA, 22 bp, Homo sapiens
ggcccagctgtatattacagtt

SEQ ID NO: 7516728 - DNA, 22 bp, Homo sapiens
ggcccagctgtatattacagtt

SEQ ID NO: 7516729 - DNA, 22 bp, Homo sapiens
ggcccagctgtatattacagtt

SEQ ID NO: 7516730 - DNA, 22 bp, Homo sapiens
ggcccagctgtatattacagtt

SEQ ID NO: 7516731 - DNA, 22 bp, Homo sapiens
ggcccagctgggcggggacacg

SEQ ID NO: 7516732 - DNA, 22 bp, Homo sapiens
ggcccagctgggcggggacacg

SEQ ID NO: 7516733 - DNA, 22 bp, Homo sapiens
ggcccagctgggcggggacacg

SEQ ID NO: 7516734 - DNA, 22 bp, Homo sapiens
ggcccagctgggcggggacacg

SEQ ID NO: 7516735 - DNA, 22 bp, Homo sapiens
ggcccagtgtaccccaggcagt

SEQ ID NO: 7516736 - DNA, 22 bp, Homo sapiens
ggcccagtgtaccccaggcagt

SEQ ID NO: 7516737 - DNA, 22 bp, Homo sapiens
ggcccagtgtaccccaggcagt

SEQ ID NO: 7516738 - DNA, 22 bp, Homo sapiens
ggcccagtgtaccccaggcagt

SEQ ID NO: 7516739 - DNA, 22 bp, Homo sapiens
ggcccagtgtcccggtcgtggc

SEQ ID NO: 7516740 - DNA, 22 bp, Homo sapiens
ggcccagtgtgggtggatgttg

SEQ ID NO: 7516741 - DNA, 22 bp, Homo sapiens
ggcccagtgtgggtggatgttg

SEQ ID NO: 7516742 - DNA, 22 bp, Homo sapiens
ggcccagtgtcccggtcgtggc

SEQ ID NO: 7516743 - DNA, 22 bp, Homo sapiens
ggcccagtgtcccggtcgtggc

SEQ ID NO: 7516744 - DNA, 22 bp, Homo sapiens
ggcccagtgtaccccaggcagt

SEQ ID NO: 7516745 - DNA, 22 bp, Homo sapiens
ggcccatgcatcctgtgcagcc

SEQ ID NO: 7516746 - DNA, 22 bp, Homo sapiens
ggcccatgaccctagccaactg

SEQ ID NO: 7516747 - DNA, 22 bp, Homo sapiens
ggcccatgaccctagccaactg

SEQ ID NO: 7516748 - DNA, 22 bp, Homo sapiens
ggcccatgaccctagccaactg

SEQ ID NO: 7516749 - DNA, 22 bp, Homo sapiens
ggcccatccatgctgctggtct

SEQ ID NO: 7516750 - DNA, 22 bp, Homo sapiens
ggcccagttgagaatgaatgat

SEQ ID NO: 7516751 - DNA, 22 bp, Homo sapiens
ggcccagtgtgggtggatgttg

SEQ ID NO: 7516752 - DNA, 22 bp, Homo sapiens
ggcccagtgttgccagacctga

SEQ ID NO: 7516753 - DNA, 22 bp, Homo sapiens
ggcccagtgttgccagacctga

SEQ ID NO: 7516754 - DNA, 22 bp, Homo sapiens
ggcccagtgctgttcacccagt

SEQ ID NO: 7516755 - DNA, 22 bp, Homo sapiens
ggcccagtgctgttcacccagt

SEQ ID NO: 7516756 - DNA, 20 bp, Homo sapiens
ggcccagtgaaccaggacgg

SEQ ID NO: 7516757 - DNA, 20 bp, Homo sapiens
ggcccagtgaaccaggacgg

SEQ ID NO: 7516758 - DNA, 20 bp, Homo sapiens
ggcccagtgaaccaggacgg

SEQ ID NO: 7516759 - DNA, 22 bp, Homo sapiens
ggcccaggtccagcgagtacct

SEQ ID NO: 7516760 - DNA, 22 bp, Homo sapiens
ggcccagtctggggccctgtga

SEQ ID NO: 7516761 - DNA, 22 bp, Homo sapiens
ggcccagtctggggccctgtga

SEQ ID NO: 7516762 - DNA, 20 bp, Homo sapiens
ggcccagtgaaccaggacgg

SEQ ID NO: 7516763 - DNA, 22 bp, Homo sapiens
ggcccaggtccagcgagtacct

SEQ ID NO: 7516764 - DNA, 22 bp, Homo sapiens
ggcccaggctggagtgcggtgg

SEQ ID NO: 7516765 - DNA, 22 bp, Homo sapiens
ggcccaggctggagtgcggtgg

SEQ ID NO: 7516766 - DNA, 22 bp, Homo sapiens
ggcccaggtccagcgagtacct

SEQ ID NO: 7516767 - DNA, 22 bp, Homo sapiens
ggcccaggtccagcgagtacct

SEQ ID NO: 7516768 - DNA, 22 bp, Homo sapiens
ggcccaggtccagcgagtacct

SEQ ID NO: 7516769 - DNA, 22 bp, Homo sapiens
ggcccaggtccagcgagtacct

SEQ ID NO: 7516770 - DNA, 22 bp, Homo sapiens
ggcccaggtccagcgagtacct

SEQ ID NO: 7516771 - DNA, 22 bp, Homo sapiens
ggcccaggtccagcgagtacct

SEQ ID NO: 7516772 - DNA, 22 bp, Homo sapiens
ggccagctggatgtgggtgacg

SEQ ID NO: 7516773 - DNA, 22 bp, Homo sapiens
ggccagctggatgtgggtgacg

SEQ ID NO: 7516774 - DNA, 22 bp, Homo sapiens
ggccagctgggccaccaggtgc

SEQ ID NO: 7516775 - DNA, 22 bp, Homo sapiens
ggccagctgggccaccaggtgc

SEQ ID NO: 7516776 - DNA, 22 bp, Homo sapiens
ggccagctggatgtgggtgacg

SEQ ID NO: 7516777 - DNA, 22 bp, Homo sapiens
ggccagctggatgtgggtgacg

SEQ ID NO: 7516778 - DNA, 22 bp, Homo sapiens
ggccagctggatgtgggtgacg

SEQ ID NO: 7516779 - DNA, 20 bp, Homo sapiens
ggccagctggaggcgccggg

SEQ ID NO: 7516780 - DNA, 22 bp, Homo sapiens
ggcccagctctattgaattaca

SEQ ID NO: 7516781 - DNA, 22 bp, Homo sapiens
ggcccagctctattgaattaca

SEQ ID NO: 7516782 - DNA, 22 bp, Homo sapiens
ggcccagctctattgaattaca

SEQ ID NO: 7516783 - DNA, 22 bp, Homo sapiens
ggcccagctgggcggggacacg

SEQ ID NO: 7516784 - DNA, 22 bp, Homo sapiens
ggccagctgcctgaccttctgt

SEQ ID NO: 7516785 - DNA, 22 bp, Homo sapiens
ggccagctgcctgaccttctgt

SEQ ID NO: 7516786 - DNA, 22 bp, Homo sapiens
ggccagctgccaccagccctat

SEQ ID NO: 7516787 - DNA, 22 bp, Homo sapiens
ggccagctgctcagtgtctctg

SEQ ID NO: 7516788 - DNA, 22 bp, Homo sapiens
ggccagctgctcagtgtctctg

SEQ ID NO: 7516789 - DNA, 22 bp, Homo sapiens
ggccagctgctcagtgtctctg

SEQ ID NO: 7516790 - DNA, 22 bp, Homo sapiens
ggccagctgctcagtgtctctg

SEQ ID NO: 7516791 - DNA, 22 bp, Homo sapiens
ggccagctgagctgctgcacag

SEQ ID NO: 7516792 - DNA, 22 bp, Homo sapiens
ggccagctgagctgctgcacag

SEQ ID NO: 7516793 - DNA, 20 bp, Homo sapiens
ggccagctgatgcacgatgc

SEQ ID NO: 7516794 - DNA, 21 bp, Homo sapiens
ggccagctgcatatgtcactg

SEQ ID NO: 7516795 - DNA, 21 bp, Homo sapiens
ggccagctgcatatgtcactg

SEQ ID NO: 7516796 - DNA, 21 bp, Homo sapiens
ggccagctgcatatgtcactg

SEQ ID NO: 7516797 - DNA, 22 bp, Homo sapiens
ggccagctgccaccagccctat

SEQ ID NO: 7516798 - DNA, 22 bp, Homo sapiens
ggccagctgccaccagccctat

SEQ ID NO: 7516799 - DNA, 22 bp, Homo sapiens
ggccagctgccaccagccctat

SEQ ID NO: 7516800 - DNA, 22 bp, Homo sapiens
ggccagcatatagagtgaagta

SEQ ID NO: 7516801 - DNA, 22 bp, Homo sapiens
ggccagcatatagagtgaagta

SEQ ID NO: 7516802 - DNA, 22 bp, Homo sapiens
ggccagcagtcacagggtcaga

SEQ ID NO: 7516803 - DNA, 22 bp, Homo sapiens
ggccagcagtcacagggtcaga

SEQ ID NO: 7516804 - DNA, 22 bp, Homo sapiens
ggccagcagtcacagggtcaga

SEQ ID NO: 7516805 - DNA, 22 bp, Homo sapiens
ggccagcagtcacagggtcaga

SEQ ID NO: 7516806 - DNA, 22 bp, Homo sapiens
ggccagcagtatatagctaatt

SEQ ID NO: 7516807 - DNA, 22 bp, Homo sapiens
ggccagcaggccctgtgatcct

SEQ ID NO: 7516808 - DNA, 22 bp, Homo sapiens
ggccagcaggccctgtgatcct

SEQ ID NO: 7516809 - DNA, 21 bp, Homo sapiens
ggccagcagcgtccactgtgg

SEQ ID NO: 7516810 - DNA, 21 bp, Homo sapiens
ggccagcagcgtccactgtgg

SEQ ID NO: 7516811 - DNA, 21 bp, Homo sapiens
ggccagcagcgtccactgtgg

SEQ ID NO: 7516812 - DNA, 21 bp, Homo sapiens
ggccagcagcgtccactgtgg

SEQ ID NO: 7516813 - DNA, 22 bp, Homo sapiens
ggccagcagtcacagggtcaga

SEQ ID NO: 7516814 - DNA, 22 bp, Homo sapiens
ggccagcagtcacagggtcaga

SEQ ID NO: 7516815 - DNA, 22 bp, Homo sapiens
ggccagcagtatatagctaatt

SEQ ID NO: 7516816 - DNA, 22 bp, Homo sapiens
ggccagcagtatatagctaatt

SEQ ID NO: 7516817 - DNA, 22 bp, Homo sapiens
ggccagctctgcacagcagctg

SEQ ID NO: 7516818 - DNA, 22 bp, Homo sapiens
ggccagctctgcacagcagctg

SEQ ID NO: 7516819 - DNA, 22 bp, Homo sapiens
ggccagcccagtggtcctctct

SEQ ID NO: 7516820 - DNA, 22 bp, Homo sapiens
ggccagcccagtggtcctctct

SEQ ID NO: 7516821 - DNA, 22 bp, Homo sapiens
ggccagctctgcacagcagctg

SEQ ID NO: 7516822 - DNA, 22 bp, Homo sapiens
ggccagctctgcacagcagctg

SEQ ID NO: 7516823 - DNA, 22 bp, Homo sapiens
ggccagctctgcacagcagctg

SEQ ID NO: 7516824 - DNA, 22 bp, Homo sapiens
ggccagctcttgtccacggagg

SEQ ID NO: 7516825 - DNA, 22 bp, Homo sapiens
ggccagctcttgtccacggagg

SEQ ID NO: 7516826 - DNA, 22 bp, Homo sapiens
ggccagctcttgtccacggagg

SEQ ID NO: 7516827 - DNA, 22 bp, Homo sapiens
ggccagctgagctgctgcacag

SEQ ID NO: 7516828 - DNA, 22 bp, Homo sapiens
ggccagctgagctgctgcacag

SEQ ID NO: 7516829 - DNA, 22 bp, Homo sapiens
ggccagctgagctgctgcacag

SEQ ID NO: 7516830 - DNA, 22 bp, Homo sapiens
ggccagctgagctgctgcacag

SEQ ID NO: 7516831 - DNA, 22 bp, Homo sapiens
ggccagcccagtggtcctctct

SEQ ID NO: 7516832 - DNA, 19 bp, Homo sapiens
ggccagccacctcgcctgg

SEQ ID NO: 7516833 - DNA, 19 bp, Homo sapiens
ggccagccacctcgcctgg

SEQ ID NO: 7516834 - DNA, 19 bp, Homo sapiens
ggccagccacctcgcctgg

SEQ ID NO: 7516835 - DNA, 19 bp, Homo sapiens
ggccagccacctcgcctgg

SEQ ID NO: 7516836 - DNA, 19 bp, Homo sapiens
ggccagccacctcgcctgg

SEQ ID NO: 7516837 - DNA, 22 bp, Homo sapiens
ggccagcatggcaagaccaact

SEQ ID NO: 7516838 - DNA, 22 bp, Homo sapiens
ggccagcatggcaagaccaact

SEQ ID NO: 7516839 - DNA, 22 bp, Homo sapiens
ggccagcatggcaagaccaact

SEQ ID NO: 7516840 - DNA, 22 bp, Homo sapiens
ggccagcatggcaagaccaact

SEQ ID NO: 7516841 - DNA, 22 bp, Homo sapiens
ggcagtgggaaataagtgagaa

SEQ ID NO: 7516842 - DNA, 22 bp, Homo sapiens
ggcagtgggaaataagtgagaa

SEQ ID NO: 7516843 - DNA, 22 bp, Homo sapiens
ggcagtgggaaataagtgagaa

SEQ ID NO: 7516844 - DNA, 22 bp, Homo sapiens
ggcagtggctgtagtctcttgg

SEQ ID NO: 7516845 - DNA, 22 bp, Homo sapiens
ggcagtggctgtagtctcttgg

SEQ ID NO: 7516846 - DNA, 22 bp, Homo sapiens
ggcagtggctgtagtctcttgg

SEQ ID NO: 7516847 - DNA, 22 bp, Homo sapiens
ggcagtggctcctctctactcc

SEQ ID NO: 7516848 - DNA, 22 bp, Homo sapiens
ggcagtggcatgtgggtagtgg

SEQ ID NO: 7516849 - DNA, 22 bp, Homo sapiens
ggcagtggcatgtgggtagtgg

SEQ ID NO: 7516850 - DNA, 22 bp, Homo sapiens
ggcagtggcatgtgggtagtgg

SEQ ID NO: 7516851 - DNA, 22 bp, Homo sapiens
ggcagtggcatgtgggtagtgg

SEQ ID NO: 7516852 - DNA, 22 bp, Homo sapiens
ggcagtggctcctctctactcc

SEQ ID NO: 7516853 - DNA, 22 bp, Homo sapiens
ggcagtggctcctctctactcc

SEQ ID NO: 7516854 - DNA, 22 bp, Homo sapiens
ggcagtggcatgtgggtagtgg

SEQ ID NO: 7516855 - DNA, 22 bp, Homo sapiens
ggcagtggcagagcttggtcta

SEQ ID NO: 7516856 - DNA, 22 bp, Homo sapiens
ggcagtggcatgtgggtagtgg

SEQ ID NO: 7516857 - DNA, 22 bp, Homo sapiens
ggcagtggcatgtgggtagtgg

SEQ ID NO: 7516858 - DNA, 22 bp, Homo sapiens
ggcagtgggaaataagtgagaa

SEQ ID NO: 7516859 - DNA, 22 bp, Homo sapiens
ggcagtgggtggatctcaggga

SEQ ID NO: 7516860 - DNA, 22 bp, Homo sapiens
ggcagtgggtggatctcaggga

SEQ ID NO: 7516861 - DNA, 22 bp, Homo sapiens
ggcagtgggtggatctcaggga

SEQ ID NO: 7516862 - DNA, 17 bp, Homo sapiens
ggccacagagcttgggg

SEQ ID NO: 7516863 - DNA, 22 bp, Homo sapiens
ggccacagagggcgggatgctg

SEQ ID NO: 7516864 - DNA, 22 bp, Homo sapiens
ggccacagagggcgggatgctg

SEQ ID NO: 7516865 - DNA, 22 bp, Homo sapiens
ggccacagagggcgggatgctg

SEQ ID NO: 7516866 - DNA, 22 bp, Homo sapiens
ggccacagagggcgggatgctg

SEQ ID NO: 7516867 - DNA, 22 bp, Homo sapiens
ggccacagagggcgggatgctg

SEQ ID NO: 7516868 - DNA, 17 bp, Homo sapiens
ggccacagagcttgggg

SEQ ID NO: 7516869 - DNA, 17 bp, Homo sapiens
ggccacagagcttgggg

SEQ ID NO: 7516870 - DNA, 17 bp, Homo sapiens
ggccacagagcttgggg

SEQ ID NO: 7516871 - DNA, 17 bp, Homo sapiens
ggccacagagcttgggg

SEQ ID NO: 7516872 - DNA, 17 bp, Homo sapiens
ggccacagagcttgggg

SEQ ID NO: 7516873 - DNA, 17 bp, Homo sapiens
ggccacagagcttgggg

SEQ ID NO: 7516874 - DNA, 17 bp, Homo sapiens
ggccacagagcttgggg

SEQ ID NO: 7516875 - DNA, 22 bp, Homo sapiens
ggccacagcagatgcttcagat

SEQ ID NO: 7516876 - DNA, 22 bp, Homo sapiens
ggccacagcagatgcttcagat

SEQ ID NO: 7516877 - DNA, 22 bp, Homo sapiens
ggccacagcagatgcttcagat

SEQ ID NO: 7516878 - DNA, 22 bp, Homo sapiens
ggccacagcagatgcttcagat

SEQ ID NO: 7516879 - DNA, 22 bp, Homo sapiens
ggccacagcagatgcttcagat

SEQ ID NO: 7516880 - DNA, 22 bp, Homo sapiens
ggccacagcaatgctgtgatgt

SEQ ID NO: 7516881 - DNA, 22 bp, Homo sapiens
ggccacagcagatgcttcagat

SEQ ID NO: 7516882 - DNA, 22 bp, Homo sapiens
ggccacagcagatgcttcagat

SEQ ID NO: 7516883 - DNA, 22 bp, Homo sapiens
ggccacagcagatgcttcagat

SEQ ID NO: 7516884 - DNA, 22 bp, Homo sapiens
ggccacagcaatgctgtgatgt

SEQ ID NO: 7516885 - DNA, 22 bp, Homo sapiens
ggccacagcaatgctgtgatgt

SEQ ID NO: 7516886 - DNA, 22 bp, Homo sapiens
ggccacagagggcgggatgctg

SEQ ID NO: 7516887 - DNA, 22 bp, Homo sapiens
ggccacagagggcgggatgctg

SEQ ID NO: 7516888 - DNA, 22 bp, Homo sapiens
ggccacagcaatgctgtgatgt

SEQ ID NO: 7516889 - DNA, 22 bp, Homo sapiens
ggccacagcaatgctgtgatgt

SEQ ID NO: 7516890 - DNA, 22 bp, Homo sapiens
ggccacagcaatgctgtgatgt

SEQ ID NO: 7516891 - DNA, 22 bp, Homo sapiens
ggccacagcaatgctgtgatgt

SEQ ID NO: 7516892 - DNA, 22 bp, Homo sapiens
ggccacagcaatgctgtgatgt

SEQ ID NO: 7516893 - DNA, 22 bp, Homo sapiens
ggccacagtctctggaaggatg

SEQ ID NO: 7516894 - DNA, 22 bp, Homo sapiens
ggccacagtctctggaaggatg

SEQ ID NO: 7516895 - DNA, 22 bp, Homo sapiens
ggccacagtctctggaaggatg

SEQ ID NO: 7516896 - DNA, 22 bp, Homo sapiens
ggccacagtctctggaaggatg

SEQ ID NO: 7516897 - DNA, 20 bp, Homo sapiens
ggccacagggtgctggtgga

SEQ ID NO: 7516898 - DNA, 20 bp, Homo sapiens
ggccacagggtgctggtgga

SEQ ID NO: 7516899 - DNA, 22 bp, Homo sapiens
ggccacagtctctggaaggatg

SEQ ID NO: 7516900 - DNA, 20 bp, Homo sapiens
ggccacagggtgctggtgga

SEQ ID NO: 7516901 - DNA, 22 bp, Homo sapiens
ggccacagggctgaacgtggac

SEQ ID NO: 7516902 - DNA, 22 bp, Homo sapiens
ggccacagggctgaacgtggac

SEQ ID NO: 7516903 - DNA, 22 bp, Homo sapiens
ggccacagggctgaacgtggac

SEQ ID NO: 7516904 - DNA, 20 bp, Homo sapiens
ggccacagggtgctggtgga

SEQ ID NO: 7516905 - DNA, 20 bp, Homo sapiens
ggccacagggtgctggtgga

SEQ ID NO: 7516906 - DNA, 20 bp, Homo sapiens
ggccacagggtgctggtgga

SEQ ID NO: 7516907 - DNA, 22 bp, Homo sapiens
ggccacagggctgaacgtggac

SEQ ID NO: 7516908 - DNA, 22 bp, Homo sapiens
ggccacagcagatgcttcagat

SEQ ID NO: 7516909 - DNA, 20 bp, Homo sapiens
ggccacagggtgctggtgga

SEQ ID NO: 7516910 - DNA, 20 bp, Homo sapiens
ggccacagggtgctggtgga

SEQ ID NO: 7516911 - DNA, 20 bp, Homo sapiens
ggccacagggtgctggtgga

SEQ ID NO: 7516912 - DNA, 20 bp, Homo sapiens
ggccacagggtgctggtgga

SEQ ID NO: 7516913 - DNA, 20 bp, Homo sapiens
ggccacagggtgctggtgga

SEQ ID NO: 7516914 - DNA, 20 bp, Homo sapiens
ggccacagggtgctggtgga

SEQ ID NO: 7516915 - DNA, 22 bp, Homo sapiens
ggccacagtgggaaatcctggg

SEQ ID NO: 7516916 - DNA, 22 bp, Homo sapiens
ggccacagtgggaaatcctggg

SEQ ID NO: 7516917 - DNA, 22 bp, Homo sapiens
ggccacagtgggaaatcctggg

SEQ ID NO: 7516918 - DNA, 22 bp, Homo sapiens
ggccacagtgggaaatcctggg

SEQ ID NO: 7516919 - DNA, 22 bp, Homo sapiens
ggccacagtgggaaatcctggg

SEQ ID NO: 7516920 - DNA, 21 bp, Homo sapiens
ggccacagttagggctcagga

SEQ ID NO: 7516921 - DNA, 22 bp, Homo sapiens
ggccacagtgggaaatcctggg

SEQ ID NO: 7516922 - DNA, 22 bp, Homo sapiens
ggccacagtgggaaatcctggg

SEQ ID NO: 7516923 - DNA, 22 bp, Homo sapiens
ggccacagtgggaaatcctggg

SEQ ID NO: 7516924 - DNA, 22 bp, Homo sapiens
ggccacagtgggaaatcctggg

SEQ ID NO: 7516925 - DNA, 21 bp, Homo sapiens
ggccacagttagggctcagga

SEQ ID NO: 7516926 - DNA, 21 bp, Homo sapiens
ggccacagttagggctcagga

SEQ ID NO: 7516927 - DNA, 21 bp, Homo sapiens
ggccacagttagggctcagga

SEQ ID NO: 7516928 - DNA, 21 bp, Homo sapiens
ggccacagttagggctcagga

SEQ ID NO: 7516929 - DNA, 21 bp, Homo sapiens
ggccacagttagggctcagga

SEQ ID NO: 7516930 - DNA, 21 bp, Homo sapiens
ggccacagttagggctcagga

SEQ ID NO: 7516931 - DNA, 21 bp, Homo sapiens
ggccacagttagggctcagga

SEQ ID NO: 7516932 - DNA, 21 bp, Homo sapiens
ggccacagttagggctcagga

SEQ ID NO: 7516933 - DNA, 21 bp, Homo sapiens
ggccacagttagggctcagga

SEQ ID NO: 7516934 - DNA, 21 bp, Homo sapiens
ggccacagttagggctcagga

SEQ ID NO: 7516935 - DNA, 22 bp, Homo sapiens
ggccacatgaattcttggacag

SEQ ID NO: 7516936 - DNA, 22 bp, Homo sapiens
ggccacatgaattcttggacag

SEQ ID NO: 7516937 - DNA, 22 bp, Homo sapiens
ggccacatgtggctgctcgtat

SEQ ID NO: 7516938 - DNA, 22 bp, Homo sapiens
ggccaccaaagtcctgtggctt

SEQ ID NO: 7516939 - DNA, 22 bp, Homo sapiens
ggccaccaaagtcctgtggctt

SEQ ID NO: 7516940 - DNA, 22 bp, Homo sapiens
ggccaccaaagtcctgtggctt

SEQ ID NO: 7516941 - DNA, 22 bp, Homo sapiens
ggccaccaaagtcctgtggctt

SEQ ID NO: 7516942 - DNA, 22 bp, Homo sapiens
ggccacatgaattcttggacag

SEQ ID NO: 7516943 - DNA, 22 bp, Homo sapiens
ggccacattcaaagctgtcctg

SEQ ID NO: 7516944 - DNA, 22 bp, Homo sapiens
ggccaccaaagtcctgtggctt

SEQ ID NO: 7516945 - DNA, 22 bp, Homo sapiens
ggccaccagtcctctggcaggg

SEQ ID NO: 7516946 - DNA, 22 bp, Homo sapiens
ggccaccaaagtcctgtggctt

SEQ ID NO: 7516947 - DNA, 22 bp, Homo sapiens
ggccaccaaagtcctgtggctt

SEQ ID NO: 7516948 - DNA, 22 bp, Homo sapiens
ggccacctaggagccacagtga

SEQ ID NO: 7516949 - DNA, 22 bp, Homo sapiens
ggccacctaggagccacagtga

SEQ ID NO: 7516950 - DNA, 22 bp, Homo sapiens
ggccacctaggagccacagtga

SEQ ID NO: 7516951 - DNA, 22 bp, Homo sapiens
ggccaccagtcctctggcaggg

SEQ ID NO: 7516952 - DNA, 22 bp, Homo sapiens
ggccacctaggagccacagtga

SEQ ID NO: 7516953 - DNA, 22 bp, Homo sapiens
ggccaccagtcctctggcaggg

SEQ ID NO: 7516954 - DNA, 22 bp, Homo sapiens
ggccaccagtcctctggcaggg

SEQ ID NO: 7516955 - DNA, 22 bp, Homo sapiens
ggccaccagtcctctggcaggg

SEQ ID NO: 7516956 - DNA, 22 bp, Homo sapiens
ggccagagtctatatgcagaca

SEQ ID NO: 7516957 - DNA, 22 bp, Homo sapiens
ggccagagtctatatgcagaca

SEQ ID NO: 7516958 - DNA, 22 bp, Homo sapiens
ggccagagtctatatgcagaca

SEQ ID NO: 7516959 - DNA, 22 bp, Homo sapiens
ggccagagtctatatgcagaca

SEQ ID NO: 7516960 - DNA, 22 bp, Homo sapiens
ggccagagtctatatgcagaca

SEQ ID NO: 7516961 - DNA, 22 bp, Homo sapiens
ggccagagtctatatgcagaca

SEQ ID NO: 7516962 - DNA, 22 bp, Homo sapiens
ggccagagtctatatgcagaca

SEQ ID NO: 7516963 - DNA, 22 bp, Homo sapiens
ggccagagtctatatgcagaca

SEQ ID NO: 7516964 - DNA, 19 bp, Homo sapiens
ggccacctctcttcccagg

SEQ ID NO: 7516965 - DNA, 19 bp, Homo sapiens
ggccacctctcttcccagg

SEQ ID NO: 7516966 - DNA, 19 bp, Homo sapiens
ggccacctctcttcccagg

SEQ ID NO: 7516967 - DNA, 22 bp, Homo sapiens
ggccacctccgtgaaggaatga

SEQ ID NO: 7516968 - DNA, 22 bp, Homo sapiens
ggccacctccgtgaaggaatga

SEQ ID NO: 7516969 - DNA, 19 bp, Homo sapiens
ggccacctctcttcccagg

SEQ ID NO: 7516970 - DNA, 22 bp, Homo sapiens
ggccacctctgccctactgagt

SEQ ID NO: 7516971 - DNA, 22 bp, Homo sapiens
ggccagaggtgtcctcagttct

SEQ ID NO: 7516972 - DNA, 22 bp, Homo sapiens
ggccagaggtgtcctcagttct

SEQ ID NO: 7516973 - DNA, 22 bp, Homo sapiens
ggccacctctgccctaccgagt

SEQ ID NO: 7516974 - DNA, 22 bp, Homo sapiens
ggccacctctgccctaccgagt

SEQ ID NO: 7516975 - DNA, 21 bp, Homo sapiens
ggccagcagcgtccactgtgg

SEQ ID NO: 7516976 - DNA, 22 bp, Homo sapiens
ggccagcagacctcagggactc

SEQ ID NO: 7516977 - DNA, 22 bp, Homo sapiens
ggccagcagacctcagggactc

SEQ ID NO: 7516978 - DNA, 22 bp, Homo sapiens
ggccagcagacctcagggactc

SEQ ID NO: 7516979 - DNA, 22 bp, Homo sapiens
ggccagcagacctcagggactc

SEQ ID NO: 7516980 - DNA, 22 bp, Homo sapiens
ggccagcagacctcagggactc

SEQ ID NO: 7516981 - DNA, 22 bp, Homo sapiens
ggccagcagacctcagggactc

SEQ ID NO: 7516982 - DNA, 22 bp, Homo sapiens
ggccagcagacctcagggactc

SEQ ID NO: 7516983 - DNA, 22 bp, Homo sapiens
ggccagcagacctcagggactc

SEQ ID NO: 7516984 - DNA, 22 bp, Homo sapiens
ggccagcagacctcagggactc

SEQ ID NO: 7516985 - DNA, 19 bp, Homo sapiens
ggccagcacagggctctgt

SEQ ID NO: 7516986 - DNA, 22 bp, Homo sapiens
ggccagagttgatggcatcttg

SEQ ID NO: 7516987 - DNA, 19 bp, Homo sapiens
ggccagcacagggctctgt

SEQ ID NO: 7516988 - DNA, 19 bp, Homo sapiens
ggccagcacagggctctgt

SEQ ID NO: 7516989 - DNA, 22 bp, Homo sapiens
ggccagagttgatggcatcttg

SEQ ID NO: 7516990 - DNA, 22 bp, Homo sapiens
ggccagagttgatggcatcttg

SEQ ID NO: 7516991 - DNA, 22 bp, Homo sapiens
ggccagagttgatggcatcttg

SEQ ID NO: 7516992 - DNA, 22 bp, Homo sapiens
ggccagagttgatggcatcttg

SEQ ID NO: 7516993 - DNA, 22 bp, Homo sapiens
ggccagagttgatggcatcttg

SEQ ID NO: 7516994 - DNA, 22 bp, Homo sapiens
ggccagagttgatggcatcttg

SEQ ID NO: 7516995 - DNA, 20 bp, Homo sapiens
ggcaggctttatatggaggg

SEQ ID NO: 7516996 - DNA, 20 bp, Homo sapiens
ggcaggctttatatggaggg

SEQ ID NO: 7516997 - DNA, 20 bp, Homo sapiens
ggcaggctttatatggaggg

SEQ ID NO: 7516998 - DNA, 20 bp, Homo sapiens
ggcaggctttatatggaggg

SEQ ID NO: 7516999 - DNA, 22 bp, Homo sapiens
ggcaggctttcagcatcaagtc

SEQ ID NO: 7517000 - DNA, 22 bp, Homo sapiens
ggcaggctttcagcatcaagtc

SEQ ID NO: 7517001 - DNA, 22 bp, Homo sapiens
ggcaggctttcagcatcaagtc

SEQ ID NO: 7517002 - DNA, 22 bp, Homo sapiens
ggcaggctttcagcatcaagtc

SEQ ID NO: 7517003 - DNA, 22 bp, Homo sapiens
ggcaggctttcagcatcaagtc

SEQ ID NO: 7517004 - DNA, 22 bp, Homo sapiens
ggcaggctttcagcatcaagtc

SEQ ID NO: 7517005 - DNA, 22 bp, Homo sapiens
ggcaggctttcagcatcaagtc

SEQ ID NO: 7517006 - DNA, 22 bp, Homo sapiens
ggcaggctttgagaaagagcat

SEQ ID NO: 7517007 - DNA, 22 bp, Homo sapiens
ggcaggctttcagcatcaagtc

SEQ ID NO: 7517008 - DNA, 22 bp, Homo sapiens
ggcaggctttgagaaagagcat

SEQ ID NO: 7517009 - DNA, 18 bp, Homo sapiens
ggcagggaaaagataggg

SEQ ID NO: 7517010 - DNA, 22 bp, Homo sapiens
ggcaggctttgagaaagagcat

SEQ ID NO: 7517011 - DNA, 18 bp, Homo sapiens
ggcagggaaaagataggg

SEQ ID NO: 7517012 - DNA, 18 bp, Homo sapiens
ggcagggaaaagataggg

SEQ ID NO: 7517013 - DNA, 18 bp, Homo sapiens
ggcagggaaaagataggg

SEQ ID NO: 7517014 - DNA, 18 bp, Homo sapiens
ggcagggaaaagataggg

SEQ ID NO: 7517015 - DNA, 18 bp, Homo sapiens
ggcagggaaaagataggg

SEQ ID NO: 7517016 - DNA, 22 bp, Homo sapiens
ggcaggctgttcacctgctttt

SEQ ID NO: 7517017 - DNA, 22 bp, Homo sapiens
ggcaggctgttcacctgctttt

SEQ ID NO: 7517018 - DNA, 22 bp, Homo sapiens
ggcaggcttgatatggggggac

SEQ ID NO: 7517019 - DNA, 22 bp, Homo sapiens
ggcaggcttgatatggggggac

SEQ ID NO: 7517020 - DNA, 22 bp, Homo sapiens
ggcaggcttgatatggggggac

SEQ ID NO: 7517021 - DNA, 22 bp, Homo sapiens
ggcaggcttgatatggggggac

SEQ ID NO: 7517022 - DNA, 22 bp, Homo sapiens
ggcaggctgttcacctgctttt

SEQ ID NO: 7517023 - DNA, 22 bp, Homo sapiens
ggcaggctgttcacctgctttt

SEQ ID NO: 7517024 - DNA, 22 bp, Homo sapiens
ggcaggctgttcacctgctttt

SEQ ID NO: 7517025 - DNA, 22 bp, Homo sapiens
ggcaggctgttcacctgctttt

SEQ ID NO: 7517026 - DNA, 22 bp, Homo sapiens
ggcaggctgttcacctgctttt

SEQ ID NO: 7517027 - DNA, 22 bp, Homo sapiens
ggcaggcttgatatggggggac

SEQ ID NO: 7517028 - DNA, 22 bp, Homo sapiens
ggcaggcttgatatggggggac

SEQ ID NO: 7517029 - DNA, 22 bp, Homo sapiens
ggcaggcttggtggcaccggtt

SEQ ID NO: 7517030 - DNA, 22 bp, Homo sapiens
ggcaggcttgatatggggggac

SEQ ID NO: 7517031 - DNA, 20 bp, Homo sapiens
ggcaggctttatatggaggg

SEQ ID NO: 7517032 - DNA, 20 bp, Homo sapiens
ggcaggctttatatggaggg

SEQ ID NO: 7517033 - DNA, 20 bp, Homo sapiens
ggcaggctttatatggaggg

SEQ ID NO: 7517034 - DNA, 22 bp, Homo sapiens
ggcaggcttggtggcaccggtt

SEQ ID NO: 7517035 - DNA, 22 bp, Homo sapiens
ggcaggcttggtggcaccggtt

SEQ ID NO: 7517036 - DNA, 22 bp, Homo sapiens
ggcagctcacgggcatggggtg

SEQ ID NO: 7517037 - DNA, 22 bp, Homo sapiens
ggcagctcacgggcatggggtg

SEQ ID NO: 7517038 - DNA, 22 bp, Homo sapiens
ggcagctcacgggcatggggtg

SEQ ID NO: 7517039 - DNA, 22 bp, Homo sapiens
ggcagctcacgggcatggggtg

SEQ ID NO: 7517040 - DNA, 20 bp, Homo sapiens
ggcagctcactactttctgt

SEQ ID NO: 7517041 - DNA, 20 bp, Homo sapiens
ggcagctcactactttctgt

SEQ ID NO: 7517042 - DNA, 22 bp, Homo sapiens
ggcagctcacgggcatggggtg

SEQ ID NO: 7517043 - DNA, 21 bp, Homo sapiens
ggcagctcagcagatggggac

SEQ ID NO: 7517044 - DNA, 21 bp, Homo sapiens
ggcagctcagcagatggggac

SEQ ID NO: 7517045 - DNA, 22 bp, Homo sapiens
ggcagctccaaaaggaaacact

SEQ ID NO: 7517046 - DNA, 22 bp, Homo sapiens
ggcagctccaaaaggaaacact

SEQ ID NO: 7517047 - DNA, 21 bp, Homo sapiens
ggcagctcagcagatggggac

SEQ ID NO: 7517048 - DNA, 22 bp, Homo sapiens
ggcagctcactgattagcaatt

SEQ ID NO: 7517049 - DNA, 21 bp, Homo sapiens
ggcagctcccagtttgggtgt

SEQ ID NO: 7517050 - DNA, 22 bp, Homo sapiens
ggcagctcccctgggttttatt

SEQ ID NO: 7517051 - DNA, 21 bp, Homo sapiens
ggcagctcccagtttgggtgt

SEQ ID NO: 7517052 - DNA, 21 bp, Homo sapiens
ggcagctcccagtttgggtgt

SEQ ID NO: 7517053 - DNA, 22 bp, Homo sapiens
ggcagctcctcctagtctgccc

SEQ ID NO: 7517054 - DNA, 22 bp, Homo sapiens
ggcagctcctcctagtctgccc

SEQ ID NO: 7517055 - DNA, 22 bp, Homo sapiens
ggcagctcctcaaaaaattaaa

SEQ ID NO: 7517056 - DNA, 22 bp, Homo sapiens
ggcagctcgatgacttctgcat

SEQ ID NO: 7517057 - DNA, 22 bp, Homo sapiens
ggcagctcgatgacttctgcat

SEQ ID NO: 7517058 - DNA, 22 bp, Homo sapiens
ggcagctcgatgacttctgcat

SEQ ID NO: 7517059 - DNA, 22 bp, Homo sapiens
ggcagctcctctcagcaaaaga

SEQ ID NO: 7517060 - DNA, 22 bp, Homo sapiens
ggcagctcctctcagcaaaaga

SEQ ID NO: 7517061 - DNA, 22 bp, Homo sapiens
ggcagctcacctctggtccagg

SEQ ID NO: 7517062 - DNA, 22 bp, Homo sapiens
ggcagctcacctctggtccagg

SEQ ID NO: 7517063 - DNA, 22 bp, Homo sapiens
ggcagctattccaagcagcact

SEQ ID NO: 7517064 - DNA, 22 bp, Homo sapiens
ggcagctagagctctttaaagt

SEQ ID NO: 7517065 - DNA, 20 bp, Homo sapiens
ggcagcgggttcgggcgcag

SEQ ID NO: 7517066 - DNA, 20 bp, Homo sapiens
ggcagcgggttcgggcgcag

SEQ ID NO: 7517067 - DNA, 20 bp, Homo sapiens
ggcagcgggttcgggcgcag

SEQ ID NO: 7517068 - DNA, 22 bp, Homo sapiens
ggcagcgcccgagtccgcagct

SEQ ID NO: 7517069 - DNA, 22 bp, Homo sapiens
ggcagccttgagggaggcctgg

SEQ ID NO: 7517070 - DNA, 22 bp, Homo sapiens
ggcagcgagtcgccaagtctcg

SEQ ID NO: 7517071 - DNA, 22 bp, Homo sapiens
ggcagcgagtcgccaagtctcg

SEQ ID NO: 7517072 - DNA, 22 bp, Homo sapiens
ggcagccttgactagtgactta

SEQ ID NO: 7517073 - DNA, 22 bp, Homo sapiens
ggcagccttgagggaggcctgg

SEQ ID NO: 7517074 - DNA, 22 bp, Homo sapiens
ggcagccttgagggaggcctgg

SEQ ID NO: 7517075 - DNA, 22 bp, Homo sapiens
ggcagccttgagggaggcctgg

SEQ ID NO: 7517076 - DNA, 22 bp, Homo sapiens
ggcagccttgagggaggcctgg

SEQ ID NO: 7517077 - DNA, 22 bp, Homo sapiens
ggcagccttgagggaggcctgg

SEQ ID NO: 7517078 - DNA, 22 bp, Homo sapiens
ggcagcctcaggttttctttga

SEQ ID NO: 7517079 - DNA, 22 bp, Homo sapiens
ggcagcctcaggttttctttga

SEQ ID NO: 7517080 - DNA, 17 bp, Homo sapiens
ggcagcctcaggcgttt

SEQ ID NO: 7517081 - DNA, 17 bp, Homo sapiens
ggcagcctcaggcgttt

SEQ ID NO: 7517082 - DNA, 17 bp, Homo sapiens
ggcagcctcaggcgttt

SEQ ID NO: 7517083 - DNA, 17 bp, Homo sapiens
ggcagcctcaggcgttt

SEQ ID NO: 7517084 - DNA, 17 bp, Homo sapiens
ggcagcctcaggcgttt

SEQ ID NO: 7517085 - DNA, 17 bp, Homo sapiens
ggcagcctcaggcgttt

SEQ ID NO: 7517086 - DNA, 22 bp, Homo sapiens
ggcagccctttctggccagctc

SEQ ID NO: 7517087 - DNA, 22 bp, Homo sapiens
ggcagccctttctggccagctc

SEQ ID NO: 7517088 - DNA, 22 bp, Homo sapiens
ggcagccctgtggagaggccca

SEQ ID NO: 7517089 - DNA, 22 bp, Homo sapiens
ggcagccctgtggagaggccca

SEQ ID NO: 7517090 - DNA, 22 bp, Homo sapiens
ggcagccctgtggagaggccca

SEQ ID NO: 7517091 - DNA, 22 bp, Homo sapiens
ggcagccccagaaacagttcag

SEQ ID NO: 7517092 - DNA, 22 bp, Homo sapiens
ggcagcccaccagcccacgtct

SEQ ID NO: 7517093 - DNA, 22 bp, Homo sapiens
ggcagccccagaaacagttcag

SEQ ID NO: 7517094 - DNA, 21 bp, Homo sapiens
ggcagcccgccctctcctggc

SEQ ID NO: 7517095 - DNA, 22 bp, Homo sapiens
ggcagccccatcagagacgctg

SEQ ID NO: 7517096 - DNA, 21 bp, Homo sapiens
ggcagcccgccctctcctggc

SEQ ID NO: 7517097 - DNA, 21 bp, Homo sapiens
ggcagcccgccctctcctggc

SEQ ID NO: 7517098 - DNA, 21 bp, Homo sapiens
ggcagcccgccctctcctggc

SEQ ID NO: 7517099 - DNA, 22 bp, Homo sapiens
ggcagccatgtgggcagcgagt

SEQ ID NO: 7517100 - DNA, 22 bp, Homo sapiens
ggcagccatgtgggcagcgagt

SEQ ID NO: 7517101 - DNA, 22 bp, Homo sapiens
ggcagccatgtgggcagcgagt

SEQ ID NO: 7517102 - DNA, 22 bp, Homo sapiens
ggcagcccaccagcccacgtct

SEQ ID NO: 7517103 - DNA, 22 bp, Homo sapiens
ggcagccatgtcccagggcttc

SEQ ID NO: 7517104 - DNA, 22 bp, Homo sapiens
ggcagccatgtcccagggcttc

SEQ ID NO: 7517105 - DNA, 22 bp, Homo sapiens
ggcagccatgtcccagggcttc

SEQ ID NO: 7517106 - DNA, 22 bp, Homo sapiens
ggcagccatgtcccagggcttc

SEQ ID NO: 7517107 - DNA, 22 bp, Homo sapiens
ggcagccatgtcccagggcttc

SEQ ID NO: 7517108 - DNA, 22 bp, Homo sapiens
ggcagccatgtcccagggcttc

SEQ ID NO: 7517109 - DNA, 22 bp, Homo sapiens
ggcagccatgtcccagggcttc

SEQ ID NO: 7517110 - DNA, 22 bp, Homo sapiens
ggcagccatgtcccagggcttc

SEQ ID NO: 7517111 - DNA, 22 bp, Homo sapiens
ggcagccatgtcccagggcttc

SEQ ID NO: 7517112 - DNA, 22 bp, Homo sapiens
ggcagccatgtcccagggcttc

SEQ ID NO: 7517113 - DNA, 22 bp, Homo sapiens
ggcagcctggagactttgtgaa

SEQ ID NO: 7517114 - DNA, 22 bp, Homo sapiens
ggcagcctggagactttgtgaa

SEQ ID NO: 7517115 - DNA, 18 bp, Homo sapiens
ggcagcctggacatgctc

SEQ ID NO: 7517116 - DNA, 18 bp, Homo sapiens
ggcagcctggacatgctc

SEQ ID NO: 7517117 - DNA, 18 bp, Homo sapiens
ggcagcctggacatgctc

SEQ ID NO: 7517118 - DNA, 19 bp, Homo sapiens
ggcagcctgcacgggctgc

SEQ ID NO: 7517119 - DNA, 19 bp, Homo sapiens
ggcagcctgcacgggctgc

SEQ ID NO: 7517120 - DNA, 19 bp, Homo sapiens
ggcagcctgcacgggctgc

SEQ ID NO: 7517121 - DNA, 18 bp, Homo sapiens
ggcagcctggacatgctc

SEQ ID NO: 7517122 - DNA, 18 bp, Homo sapiens
ggcagcctggacatgctc

SEQ ID NO: 7517123 - DNA, 22 bp, Homo sapiens
ggcagccttgactagtgactta

SEQ ID NO: 7517124 - DNA, 22 bp, Homo sapiens
ggcagccttgagggaggcctgg

SEQ ID NO: 7517125 - DNA, 22 bp, Homo sapiens
ggcagccttctctcataggtga

SEQ ID NO: 7517126 - DNA, 22 bp, Homo sapiens
ggcagccttctctcataggtga

SEQ ID NO: 7517127 - DNA, 22 bp, Homo sapiens
ggcagccttgactagtgactta

SEQ ID NO: 7517128 - DNA, 22 bp, Homo sapiens
ggcagccttctctcataggtga

SEQ ID NO: 7517129 - DNA, 23 bp, Homo sapiens
ggcagcctctgactctgctttgc

SEQ ID NO: 7517130 - DNA, 23 bp, Homo sapiens
ggcagcctctgactctgctttgc

SEQ ID NO: 7517131 - DNA, 23 bp, Homo sapiens
ggcagcctctgactctgctttgc

SEQ ID NO: 7517132 - DNA, 22 bp, Homo sapiens
ggcagcctccagggcactggtg

SEQ ID NO: 7517133 - DNA, 22 bp, Homo sapiens
ggcagcctccagggcactggtg

SEQ ID NO: 7517134 - DNA, 22 bp, Homo sapiens
ggcagcctccagggcactggtg

SEQ ID NO: 7517135 - DNA, 22 bp, Homo sapiens
ggcagcctccagggcactggtg

SEQ ID NO: 7517136 - DNA, 21 bp, Homo sapiens
ggcagcctctgtggaagggga

SEQ ID NO: 7517137 - DNA, 21 bp, Homo sapiens
ggcagcctctgtggaagggga

SEQ ID NO: 7517138 - DNA, 21 bp, Homo sapiens
ggcagcctgacccccagagag

SEQ ID NO: 7517139 - DNA, 21 bp, Homo sapiens
ggcagcctctgtggaagggga

SEQ ID NO: 7517140 - DNA, 21 bp, Homo sapiens
ggcagcctctgtggaagggga

SEQ ID NO: 7517141 - DNA, 21 bp, Homo sapiens
ggcagcctctgtggaagggga

SEQ ID NO: 7517142 - DNA, 21 bp, Homo sapiens
ggcagcctgacccccagagag

SEQ ID NO: 7517143 - DNA, 21 bp, Homo sapiens
ggcagcctgacccccagagag

SEQ ID NO: 7517144 - DNA, 19 bp, Homo sapiens
ggcagcctgcacgggctgc

SEQ ID NO: 7517145 - DNA, 21 bp, Homo sapiens
ggcagcctgacccccagagag

SEQ ID NO: 7517146 - DNA, 21 bp, Homo sapiens
ggcagcctgacccccagagag

SEQ ID NO: 7517147 - DNA, 22 bp, Homo sapiens
ggcagtgccttagaatctgtgg

SEQ ID NO: 7517148 - DNA, 17 bp, Homo sapiens
ggcagtggaggaagaga

SEQ ID NO: 7517149 - DNA, 17 bp, Homo sapiens
ggcagtggaggaagaga

SEQ ID NO: 7517150 - DNA, 17 bp, Homo sapiens
ggcagtggaggaagaga

SEQ ID NO: 7517151 - DNA, 22 bp, Homo sapiens
ggcagtggaggaccctgtgtct

SEQ ID NO: 7517152 - DNA, 22 bp, Homo sapiens
ggcagtggaggaccctgtgtct

SEQ ID NO: 7517153 - DNA, 22 bp, Homo sapiens
ggcagtggcagagcttggtcta

SEQ ID NO: 7517154 - DNA, 22 bp, Homo sapiens
ggcagtggcagagcttggtcta

SEQ ID NO: 7517155 - DNA, 22 bp, Homo sapiens
ggcagtggcagagcttggtcta

SEQ ID NO: 7517156 - DNA, 22 bp, Homo sapiens
ggcagtggcagagcttggtcta

SEQ ID NO: 7517157 - DNA, 22 bp, Homo sapiens
ggcagtgcaaggctggcacagt

SEQ ID NO: 7517158 - DNA, 22 bp, Homo sapiens
ggcagtgcaaggctggcacagt

SEQ ID NO: 7517159 - DNA, 22 bp, Homo sapiens
ggcagtgcaggcccttcagcct

SEQ ID NO: 7517160 - DNA, 18 bp, Homo sapiens
ggcagtgcagtctcaggg

SEQ ID NO: 7517161 - DNA, 22 bp, Homo sapiens
ggcagtgcaggcccttcagcct

SEQ ID NO: 7517162 - DNA, 22 bp, Homo sapiens
ggcagtgcaggcccttcagcct

SEQ ID NO: 7517163 - DNA, 22 bp, Homo sapiens
ggcagtgcaggcccttcagcct

SEQ ID NO: 7517164 - DNA, 22 bp, Homo sapiens
ggcagtgcccggtgcctcctct

SEQ ID NO: 7517165 - DNA, 22 bp, Homo sapiens
ggcagtgcccggtgcctcctct

SEQ ID NO: 7517166 - DNA, 22 bp, Homo sapiens
ggcagtgcctgatgctgcagga

SEQ ID NO: 7517167 - DNA, 22 bp, Homo sapiens
ggcagtgcctgatgctgcagga

SEQ ID NO: 7517168 - DNA, 22 bp, Homo sapiens
ggcagtgcctgatgctgcagga

SEQ ID NO: 7517169 - DNA, 18 bp, Homo sapiens
ggcagtgcagtctcaggg

SEQ ID NO: 7517170 - DNA, 18 bp, Homo sapiens
ggcagtgcagtctcaggg

SEQ ID NO: 7517171 - DNA, 18 bp, Homo sapiens
ggcagtgcagtctcaggg

SEQ ID NO: 7517172 - DNA, 22 bp, Homo sapiens
ggcagtgccactaagctctgct

SEQ ID NO: 7517173 - DNA, 22 bp, Homo sapiens
ggcagtgccactaagctctgct

SEQ ID NO: 7517174 - DNA, 22 bp, Homo sapiens
ggcagtgccactaagctctgct

SEQ ID NO: 7517175 - DNA, 22 bp, Homo sapiens
ggcagtgccactaagctctgct

SEQ ID NO: 7517176 - DNA, 22 bp, Homo sapiens
ggcagtgccactaagctctgct

SEQ ID NO: 7517177 - DNA, 22 bp, Homo sapiens
ggcagtgccactaagctctgct

SEQ ID NO: 7517178 - DNA, 22 bp, Homo sapiens
ggcagtgagtcccggagaggcc

SEQ ID NO: 7517179 - DNA, 22 bp, Homo sapiens
ggcagtgagtcccggagaggcc

SEQ ID NO: 7517180 - DNA, 22 bp, Homo sapiens
ggcagtgagtcccggagaggcc

SEQ ID NO: 7517181 - DNA, 22 bp, Homo sapiens
ggcagtgagtcccggagaggcc

SEQ ID NO: 7517182 - DNA, 22 bp, Homo sapiens
ggcagtgagtcccggagaggcc

SEQ ID NO: 7517183 - DNA, 22 bp, Homo sapiens
ggcagtgagtcccggagaggcc

SEQ ID NO: 7517184 - DNA, 22 bp, Homo sapiens
ggcagtgagctggagggaagga

SEQ ID NO: 7517185 - DNA, 22 bp, Homo sapiens
ggcagtgagtcccggagaggcc

SEQ ID NO: 7517186 - DNA, 22 bp, Homo sapiens
ggcagtgagtcccggagaggcc

SEQ ID NO: 7517187 - DNA, 22 bp, Homo sapiens
ggcagtgagtcccggagaggcc

SEQ ID NO: 7517188 - DNA, 21 bp, Homo sapiens
ggcagtgatgtgaagtgcatc

SEQ ID NO: 7517189 - DNA, 21 bp, Homo sapiens
ggcagtgatgtgaagtgcatc

SEQ ID NO: 7517190 - DNA, 22 bp, Homo sapiens
ggcagtgcaaggcagcctggat

SEQ ID NO: 7517191 - DNA, 22 bp, Homo sapiens
ggcagtgcaaggcagcctggat

SEQ ID NO: 7517192 - DNA, 22 bp, Homo sapiens
ggcagtgcaaggcagcctggat

SEQ ID NO: 7517193 - DNA, 22 bp, Homo sapiens
ggcagtgcaaggcagcctggat

SEQ ID NO: 7517194 - DNA, 22 bp, Homo sapiens
ggcagtgatgtcaaacagtgaa

SEQ ID NO: 7517195 - DNA, 21 bp, Homo sapiens
ggcagtgatgtgaagtgcatc

SEQ ID NO: 7517196 - DNA, 22 bp, Homo sapiens
ggcagtgatgtcaaacagtgaa

SEQ ID NO: 7517197 - DNA, 22 bp, Homo sapiens
ggcagtgatgtcaaacagtgaa

SEQ ID NO: 7517198 - DNA, 22 bp, Homo sapiens
ggcagtgatgtcaaacagtgaa

SEQ ID NO: 7517199 - DNA, 22 bp, Homo sapiens
ggcagtgactggggacccccaa

SEQ ID NO: 7517200 - DNA, 22 bp, Homo sapiens
ggcaggggtcctggtgttgact

SEQ ID NO: 7517201 - DNA, 18 bp, Homo sapiens
ggcaggggtgaaccacag

SEQ ID NO: 7517202 - DNA, 18 bp, Homo sapiens
ggcaggggtgaaccacag

SEQ ID NO: 7517203 - DNA, 22 bp, Homo sapiens
ggcagtgactgttcagacgtcc

SEQ ID NO: 7517204 - DNA, 22 bp, Homo sapiens
ggcagtgactggggacccccaa

SEQ ID NO: 7517205 - DNA, 22 bp, Homo sapiens
ggcagtgagaggtctcctggtc

SEQ ID NO: 7517206 - DNA, 18 bp, Homo sapiens
ggcaggggtgaaccacag

SEQ ID NO: 7517207 - DNA, 22 bp, Homo sapiens
ggcagtgagaggtctcctggtc

SEQ ID NO: 7517208 - DNA, 19 bp, Homo sapiens
ggcagtgagaagactcctg

SEQ ID NO: 7517209 - DNA, 19 bp, Homo sapiens
ggcagtgagaagactcctg

SEQ ID NO: 7517210 - DNA, 19 bp, Homo sapiens
ggcagtgagaagactcctg

SEQ ID NO: 7517211 - DNA, 19 bp, Homo sapiens
ggcagtgagaagactcctg

SEQ ID NO: 7517212 - DNA, 19 bp, Homo sapiens
ggcagtgagaagactcctg

SEQ ID NO: 7517213 - DNA, 22 bp, Homo sapiens
ggcagtgagctggagggaagga

SEQ ID NO: 7517214 - DNA, 22 bp, Homo sapiens
ggcagtgagctggagggaagga

SEQ ID NO: 7517215 - DNA, 22 bp, Homo sapiens
ggcagtgagaggtctcctggtc

SEQ ID NO: 7517216 - DNA, 22 bp, Homo sapiens
ggcagtgagctggagggaagga

SEQ ID NO: 7517217 - DNA, 22 bp, Homo sapiens
ggcagtgagctggagggaagga

SEQ ID NO: 7517218 - DNA, 22 bp, Homo sapiens
ggcagtgagaggtctcctggtc

SEQ ID NO: 7517219 - DNA, 22 bp, Homo sapiens
ggcaggggtcctggtgttgact

SEQ ID NO: 7517220 - DNA, 22 bp, Homo sapiens
ggcaggggtcctggtgttgact

SEQ ID NO: 7517221 - DNA, 22 bp, Homo sapiens
ggcagggcttgtctctgtgatg

SEQ ID NO: 7517222 - DNA, 22 bp, Homo sapiens
ggcagggcttgtctctgtgatg

SEQ ID NO: 7517223 - DNA, 22 bp, Homo sapiens
ggcagggcttgtctctgtgatg

SEQ ID NO: 7517224 - DNA, 22 bp, Homo sapiens
ggcagggcttgtctctgtgatg

SEQ ID NO: 7517225 - DNA, 22 bp, Homo sapiens
ggcagggcttgtctctgtgatg

SEQ ID NO: 7517226 - DNA, 22 bp, Homo sapiens
ggcagggcttgtctctgtgatg

SEQ ID NO: 7517227 - DNA, 22 bp, Homo sapiens
ggcagggcttgtctctgtgatg

SEQ ID NO: 7517228 - DNA, 18 bp, Homo sapiens
ggcaggggtgaaccacag

SEQ ID NO: 7517229 - DNA, 22 bp, Homo sapiens
ggcaggggtcctggtgttgact

SEQ ID NO: 7517230 - DNA, 22 bp, Homo sapiens
ggcaggggtcctggtgttgact

SEQ ID NO: 7517231 - DNA, 22 bp, Homo sapiens
ggcaggggtcctggtgttgact

SEQ ID NO: 7517232 - DNA, 22 bp, Homo sapiens
ggcaggggtcctggtgttgact

SEQ ID NO: 7517233 - DNA, 22 bp, Homo sapiens
ggcaggggtcctggtgttgact

SEQ ID NO: 7517234 - DNA, 22 bp, Homo sapiens
ggcaggggtcctggtgttgact

SEQ ID NO: 7517235 - DNA, 20 bp, Homo sapiens
ggcagggcatcaacagctct

SEQ ID NO: 7517236 - DNA, 20 bp, Homo sapiens
ggcagggcatcaacagctct

SEQ ID NO: 7517237 - DNA, 20 bp, Homo sapiens
ggcagggcatcaacagctct

SEQ ID NO: 7517238 - DNA, 20 bp, Homo sapiens
ggcagggcatcaacagctct

SEQ ID NO: 7517239 - DNA, 20 bp, Homo sapiens
ggcagggcatcaacagctct

SEQ ID NO: 7517240 - DNA, 22 bp, Homo sapiens
ggcagggccctgattcctgggg

SEQ ID NO: 7517241 - DNA, 22 bp, Homo sapiens
ggcagggccctgattcctgggg

SEQ ID NO: 7517242 - DNA, 22 bp, Homo sapiens
ggcagggccctgattcctgggg

SEQ ID NO: 7517243 - DNA, 22 bp, Homo sapiens
ggcagggccctgattcctgggg

SEQ ID NO: 7517244 - DNA, 22 bp, Homo sapiens
ggcagggccctgattcctgggg

SEQ ID NO: 7517245 - DNA, 18 bp, Homo sapiens
ggcagggaaaagataggg

SEQ ID NO: 7517246 - DNA, 22 bp, Homo sapiens
ggcagggaaacagctgatccca

SEQ ID NO: 7517247 - DNA, 18 bp, Homo sapiens
ggcagggaaaagataggg

SEQ ID NO: 7517248 - DNA, 22 bp, Homo sapiens
ggcagggaaacagctgatccca

SEQ ID NO: 7517249 - DNA, 22 bp, Homo sapiens
ggcagggaaacagctgatccca

SEQ ID NO: 7517250 - DNA, 22 bp, Homo sapiens
ggcagggaaacagctgatccca

SEQ ID NO: 7517251 - DNA, 22 bp, Homo sapiens
ggcagggaaacagctgatccca

SEQ ID NO: 7517252 - DNA, 22 bp, Homo sapiens
ggcagggaaacagctgatccca

SEQ ID NO: 7517253 - DNA, 22 bp, Homo sapiens
ggcagggaagctggcatcacgg

SEQ ID NO: 7517254 - DNA, 22 bp, Homo sapiens
ggcagggaagctggcatcacgg

SEQ ID NO: 7517255 - DNA, 22 bp, Homo sapiens
ggcagggaagctggcatcacgg

SEQ ID NO: 7517256 - DNA, 22 bp, Homo sapiens
ggcagggaagctggcatcacgg

SEQ ID NO: 7517257 - DNA, 22 bp, Homo sapiens
ggcagggaagctggcatcacgg

SEQ ID NO: 7517258 - DNA, 22 bp, Homo sapiens
ggcagggaagctggcatcacgg

SEQ ID NO: 7517259 - DNA, 22 bp, Homo sapiens
ggcagggaaacagctgatccca

SEQ ID NO: 7517260 - DNA, 22 bp, Homo sapiens
ggcagggaaacagctgatccca

SEQ ID NO: 7517261 - DNA, 22 bp, Homo sapiens
ggcagggaaacagctgatccca

SEQ ID NO: 7517262 - DNA, 22 bp, Homo sapiens
ggcagggactatgtttcatgga

SEQ ID NO: 7517263 - DNA, 22 bp, Homo sapiens
ggcagggactatgtttcatgga

SEQ ID NO: 7517264 - DNA, 22 bp, Homo sapiens
ggcagggactatgtttcatgga

SEQ ID NO: 7517265 - DNA, 22 bp, Homo sapiens
ggcagggactttgcaaatcttt

SEQ ID NO: 7517266 - DNA, 22 bp, Homo sapiens
ggcagggactttgcaaatcttt

SEQ ID NO: 7517267 - DNA, 22 bp, Homo sapiens
ggcagggagagcatgctgataa

SEQ ID NO: 7517268 - DNA, 22 bp, Homo sapiens
ggcagggagagcatgctgataa

SEQ ID NO: 7517269 - DNA, 22 bp, Homo sapiens
ggcagggactttgcaaatcttt

SEQ ID NO: 7517270 - DNA, 22 bp, Homo sapiens
ggcagggacaggatagggtttt

SEQ ID NO: 7517271 - DNA, 22 bp, Homo sapiens
ggcagggacaggatagggtttt

SEQ ID NO: 7517272 - DNA, 22 bp, Homo sapiens
ggcagggacaggatagggtttt

SEQ ID NO: 7517273 - DNA, 22 bp, Homo sapiens
ggcagggacaggatagggtttt

SEQ ID NO: 7517274 - DNA, 22 bp, Homo sapiens
ggcagggaagctggcatcacgg

SEQ ID NO: 7517275 - DNA, 22 bp, Homo sapiens
ggcagggaagctggcatcacgg

SEQ ID NO: 7517276 - DNA, 22 bp, Homo sapiens
ggcagggaagctggcatcacgg

SEQ ID NO: 7517277 - DNA, 22 bp, Homo sapiens
ggcagggaagctggcatcacgg

SEQ ID NO: 7517278 - DNA, 22 bp, Homo sapiens
ggcagcaatgctgtgcaggcat

SEQ ID NO: 7517279 - DNA, 22 bp, Homo sapiens
ggcagcaatgctgtgcaggcat

SEQ ID NO: 7517280 - DNA, 22 bp, Homo sapiens
ggcagcaatgctgtgcaggcat

SEQ ID NO: 7517281 - DNA, 22 bp, Homo sapiens
ggcagcaagtaggattcttatt

SEQ ID NO: 7517282 - DNA, 22 bp, Homo sapiens
ggcagcaagtaggattcttatt

SEQ ID NO: 7517283 - DNA, 22 bp, Homo sapiens
ggcagcaagtggtgggagactt

SEQ ID NO: 7517284 - DNA, 22 bp, Homo sapiens
ggcagcaatgctgtgcaggcat

SEQ ID NO: 7517285 - DNA, 20 bp, Homo sapiens
ggcagcaattcaccctatcc

SEQ ID NO: 7517286 - DNA, 20 bp, Homo sapiens
ggcagcaattcaccctatcc

SEQ ID NO: 7517287 - DNA, 22 bp, Homo sapiens
ggcagcaattcttcagaatcat

SEQ ID NO: 7517288 - DNA, 22 bp, Homo sapiens
ggcagcactgcagcttgttggg

SEQ ID NO: 7517289 - DNA, 22 bp, Homo sapiens
ggcagcactgcagcttgttggg

SEQ ID NO: 7517290 - DNA, 22 bp, Homo sapiens
ggcagcactgcagcttgttggg

SEQ ID NO: 7517291 - DNA, 22 bp, Homo sapiens
ggcagcactgcagcttgttggg

SEQ ID NO: 7517292 - DNA, 21 bp, Homo sapiens
ggcagcactacctgaagcata

SEQ ID NO: 7517293 - DNA, 22 bp, Homo sapiens
ggcagcacgacaggagtggaag

SEQ ID NO: 7517294 - DNA, 21 bp, Homo sapiens
ggcagcactacctgaagcata

SEQ ID NO: 7517295 - DNA, 21 bp, Homo sapiens
ggcagcactacctgaagcata

SEQ ID NO: 7517296 - DNA, 22 bp, Homo sapiens
ggcagcacgacaggagtggaag

SEQ ID NO: 7517297 - DNA, 22 bp, Homo sapiens
ggcagcagaactggccctgtat

SEQ ID NO: 7517298 - DNA, 22 bp, Homo sapiens
ggcagcagaactggccctgtat

SEQ ID NO: 7517299 - DNA, 22 bp, Homo sapiens
ggcagcagaactggccctgtat

SEQ ID NO: 7517300 - DNA, 22 bp, Homo sapiens
ggcagcagacccctaagtctac

SEQ ID NO: 7517301 - DNA, 22 bp, Homo sapiens
ggcagcagacccctaagtctac

SEQ ID NO: 7517302 - DNA, 22 bp, Homo sapiens
ggcagcagacccctaagtctac

SEQ ID NO: 7517303 - DNA, 22 bp, Homo sapiens
ggcagccatggacactggctag

SEQ ID NO: 7517304 - DNA, 22 bp, Homo sapiens
ggcagcactgcagcttgttggg

SEQ ID NO: 7517305 - DNA, 22 bp, Homo sapiens
ggcagcactgcagcttgttggg

SEQ ID NO: 7517306 - DNA, 22 bp, Homo sapiens
ggcagcactgcagcttgttggg

SEQ ID NO: 7517307 - DNA, 22 bp, Homo sapiens
ggcagcagaactggccctgtat

SEQ ID NO: 7517308 - DNA, 22 bp, Homo sapiens
ggcagcagaactggccctgtat

SEQ ID NO: 7517309 - DNA, 22 bp, Homo sapiens
ggcagcagaactggccctgtat

SEQ ID NO: 7517310 - DNA, 22 bp, Homo sapiens
ggcagcagaactggccctgtat

SEQ ID NO: 7517311 - DNA, 22 bp, Homo sapiens
ggcagcagaactggccctgtat

SEQ ID NO: 7517312 - DNA, 22 bp, Homo sapiens
ggcagcactgcagcttgttggg

SEQ ID NO: 7517313 - DNA, 22 bp, Homo sapiens
ggcagattcaagggtggagagg

SEQ ID NO: 7517314 - DNA, 23 bp, Homo sapiens
ggcagatttggtttgttttaata

SEQ ID NO: 7517315 - DNA, 22 bp, Homo sapiens
ggcagcaaaaagcctggttgaa

SEQ ID NO: 7517316 - DNA, 22 bp, Homo sapiens
ggcagcaaaaagcctggttgaa

SEQ ID NO: 7517317 - DNA, 22 bp, Homo sapiens
ggcagcaaaaagcctggttgaa

SEQ ID NO: 7517318 - DNA, 22 bp, Homo sapiens
ggcagcaaactggcttcaggct

SEQ ID NO: 7517319 - DNA, 22 bp, Homo sapiens
ggcagatgttgcagtgagcaga

SEQ ID NO: 7517320 - DNA, 22 bp, Homo sapiens
ggcagatgttgcagtgagcaga

SEQ ID NO: 7517321 - DNA, 22 bp, Homo sapiens
ggcagatgttgcagtgagcaga

SEQ ID NO: 7517322 - DNA, 22 bp, Homo sapiens
ggcagatgttgcagtgagcaga

SEQ ID NO: 7517323 - DNA, 22 bp, Homo sapiens
ggcagatgttgcagtgagcaga

SEQ ID NO: 7517324 - DNA, 22 bp, Homo sapiens
ggcagcaaatattgtcagctgt

SEQ ID NO: 7517325 - DNA, 22 bp, Homo sapiens
ggcagcaaatattgtcagctgt

SEQ ID NO: 7517326 - DNA, 22 bp, Homo sapiens
ggcagcaaactggcttcaggct

SEQ ID NO: 7517327 - DNA, 22 bp, Homo sapiens
ggcagcaaagtcacatggaaaa

SEQ ID NO: 7517328 - DNA, 22 bp, Homo sapiens
ggcagcaaccaaccaggcattt

SEQ ID NO: 7517329 - DNA, 22 bp, Homo sapiens
ggcagcaaccaaccaggcattt

SEQ ID NO: 7517330 - DNA, 22 bp, Homo sapiens
ggcagcaaatattgtcagctgt

SEQ ID NO: 7517331 - DNA, 22 bp, Homo sapiens
ggcagcaacacgagtgagctaa

SEQ ID NO: 7517332 - DNA, 22 bp, Homo sapiens
ggcagcaacaggtgtgttgtga

SEQ ID NO: 7517333 - DNA, 22 bp, Homo sapiens
ggcagcaaccaaccaggcattt

SEQ ID NO: 7517334 - DNA, 18 bp, Homo sapiens
ggcagcaagaagggaggg

SEQ ID NO: 7517335 - DNA, 22 bp, Homo sapiens
ggcagcaagagaggttcagctt

SEQ ID NO: 7517336 - DNA, 22 bp, Homo sapiens
ggcagcaagagaggttcagctt

SEQ ID NO: 7517337 - DNA, 22 bp, Homo sapiens
ggcagcaagcagaagttctatg

SEQ ID NO: 7517338 - DNA, 22 bp, Homo sapiens
ggcagcaagcagaagttctatg

SEQ ID NO: 7517339 - DNA, 22 bp, Homo sapiens
ggcagcaagcagaagttctatg

SEQ ID NO: 7517340 - DNA, 22 bp, Homo sapiens
ggcagcaagtggtgggagactt

SEQ ID NO: 7517341 - DNA, 22 bp, Homo sapiens
ggcagcaaggcctcgggtgagc

SEQ ID NO: 7517342 - DNA, 22 bp, Homo sapiens
ggcagcaaggtggcggaaatga

SEQ ID NO: 7517343 - DNA, 22 bp, Homo sapiens
ggcagcaagcagaagttctatg

SEQ ID NO: 7517344 - DNA, 19 bp, Homo sapiens
ggcagcaagctctgaaggc

SEQ ID NO: 7517345 - DNA, 19 bp, Homo sapiens
ggcagcaagctctgaaggc

SEQ ID NO: 7517346 - DNA, 19 bp, Homo sapiens
ggcagcaagctctgaaggc

SEQ ID NO: 7517347 - DNA, 19 bp, Homo sapiens
ggcagcaagctctgaaggc

SEQ ID NO: 7517348 - DNA, 22 bp, Homo sapiens
ggcagcaactcggagagaagag

SEQ ID NO: 7517349 - DNA, 20 bp, Homo sapiens
ggcagcaaccatatgctaca

SEQ ID NO: 7517350 - DNA, 22 bp, Homo sapiens
ggcagcaacgaggcttgatacc

SEQ ID NO: 7517351 - DNA, 22 bp, Homo sapiens
ggcagcaacgaggcttgatacc

SEQ ID NO: 7517352 - DNA, 22 bp, Homo sapiens
ggcagcaactcattattcctgt

SEQ ID NO: 7517353 - DNA, 22 bp, Homo sapiens
ggcagcaactcggagagaagag

SEQ ID NO: 7517354 - DNA, 18 bp, Homo sapiens
ggcagcaagaagggaggg

SEQ ID NO: 7517355 - DNA, 22 bp, Homo sapiens
ggcagcaactcggagagaagag

SEQ ID NO: 7517356 - DNA, 22 bp, Homo sapiens
ggcagcaactcggagagaagag

SEQ ID NO: 7517357 - DNA, 22 bp, Homo sapiens
ggcagcaactcggagagaagag

SEQ ID NO: 7517358 - DNA, 22 bp, Homo sapiens
ggcagatgttatatgatctgag

SEQ ID NO: 7517359 - DNA, 22 bp, Homo sapiens
ggcagatgttatatgatctgag

SEQ ID NO: 7517360 - DNA, 22 bp, Homo sapiens
ggcagatgttgcagtgagcaga

SEQ ID NO: 7517361 - DNA, 22 bp, Homo sapiens
ggcagatgttgcagtgagcaga

SEQ ID NO: 7517362 - DNA, 22 bp, Homo sapiens
ggcagatgttgcagtgagcaga

SEQ ID NO: 7517363 - DNA, 22 bp, Homo sapiens
ggcagatggggtgacaagagag

SEQ ID NO: 7517364 - DNA, 22 bp, Homo sapiens
ggcagatggggtgacaagagag

SEQ ID NO: 7517365 - DNA, 22 bp, Homo sapiens
ggcagatggggtgacaagagag

SEQ ID NO: 7517366 - DNA, 22 bp, Homo sapiens
ggcagatgttatatgatctgag

SEQ ID NO: 7517367 - DNA, 22 bp, Homo sapiens
ggcagatggggtgacaagagag

SEQ ID NO: 7517368 - DNA, 22 bp, Homo sapiens
ggcagatggagaagcagcaggt

SEQ ID NO: 7517369 - DNA, 22 bp, Homo sapiens
ggcagatggagaagcagcaggt

SEQ ID NO: 7517370 - DNA, 22 bp, Homo sapiens
ggcagatggaatgagctgtcta

SEQ ID NO: 7517371 - DNA, 22 bp, Homo sapiens
ggcagatggagaagcagcaggt

SEQ ID NO: 7517372 - DNA, 22 bp, Homo sapiens
ggcagatggagaagcagcaggt

SEQ ID NO: 7517373 - DNA, 22 bp, Homo sapiens
ggcagatggaatgagctgtcta

SEQ ID NO: 7517374 - DNA, 22 bp, Homo sapiens
ggcagatggggtgacaagagag

SEQ ID NO: 7517375 - DNA, 22 bp, Homo sapiens
ggcagatggagaagcagcaggt

SEQ ID NO: 7517376 - DNA, 22 bp, Homo sapiens
ggcagatggagaagcagcaggt

SEQ ID NO: 7517377 - DNA, 22 bp, Homo sapiens
ggcagaggtgaagttcacaagg

SEQ ID NO: 7517378 - DNA, 22 bp, Homo sapiens
ggcagaggtgaagttcacaagg

SEQ ID NO: 7517379 - DNA, 22 bp, Homo sapiens
ggcagaggtgaagttcacaagg

SEQ ID NO: 7517380 - DNA, 22 bp, Homo sapiens
ggcagaggtgacagtgtctttt

SEQ ID NO: 7517381 - DNA, 22 bp, Homo sapiens
ggcagaggtgacagtgtctttt

SEQ ID NO: 7517382 - DNA, 22 bp, Homo sapiens
ggcagaggtgacagtgtctttt

SEQ ID NO: 7517383 - DNA, 22 bp, Homo sapiens
ggcagaggtgacagtgtctttt

SEQ ID NO: 7517384 - DNA, 22 bp, Homo sapiens
ggcagaggtgacagtgtctttt

SEQ ID NO: 7517385 - DNA, 22 bp, Homo sapiens
ggcagaggtgacagtgtctttt

SEQ ID NO: 7517386 - DNA, 22 bp, Homo sapiens
ggcagaggtgacagtgtctttt

SEQ ID NO: 7517387 - DNA, 22 bp, Homo sapiens
ggcactgattccattcatgaag

SEQ ID NO: 7517388 - DNA, 22 bp, Homo sapiens
ggcactgattccattcatgaag

SEQ ID NO: 7517389 - DNA, 22 bp, Homo sapiens
ggcagaggtgaagttcacaagg

SEQ ID NO: 7517390 - DNA, 22 bp, Homo sapiens
ggcagaggtgaagttcacaagg

SEQ ID NO: 7517391 - DNA, 22 bp, Homo sapiens
ggcagaggtgaagttcacaagg

SEQ ID NO: 7517392 - DNA, 22 bp, Homo sapiens
ggcactgataatgtcctctctc

SEQ ID NO: 7517393 - DNA, 22 bp, Homo sapiens
ggcactgagcgggctctgagcg

SEQ ID NO: 7517394 - DNA, 22 bp, Homo sapiens
ggcactgataatgtcctctctc

SEQ ID NO: 7517395 - DNA, 22 bp, Homo sapiens
ggcactgagctgccttggggca

SEQ ID NO: 7517396 - DNA, 22 bp, Homo sapiens
ggcactgatctgatttccctcc

SEQ ID NO: 7517397 - DNA, 22 bp, Homo sapiens
ggcactgatctgatttccctcc

SEQ ID NO: 7517398 - DNA, 22 bp, Homo sapiens
ggcactgatctgatttccctcc

SEQ ID NO: 7517399 - DNA, 22 bp, Homo sapiens
ggcactgattccattcatgaag

SEQ ID NO: 7517400 - DNA, 22 bp, Homo sapiens
ggcactgattccattcatgaag

SEQ ID NO: 7517401 - DNA, 22 bp, Homo sapiens
ggcactgaaccaggacacaagc

SEQ ID NO: 7517402 - DNA, 23 bp, Homo sapiens
ggcactgaagctacaatggtgag

SEQ ID NO: 7517403 - DNA, 23 bp, Homo sapiens
ggcactgaagctacaatggtgag

SEQ ID NO: 7517404 - DNA, 22 bp, Homo sapiens
ggcactgaaccaggacacaagc

SEQ ID NO: 7517405 - DNA, 23 bp, Homo sapiens
ggcactcggccgtgaactcgtgc

SEQ ID NO: 7517406 - DNA, 22 bp, Homo sapiens
ggcactcagagattcaggctgt

SEQ ID NO: 7517407 - DNA, 22 bp, Homo sapiens
ggcactgaatttcttggcatct

SEQ ID NO: 7517408 - DNA, 22 bp, Homo sapiens
ggcactgaatttcttggcatct

SEQ ID NO: 7517409 - DNA, 22 bp, Homo sapiens
ggcactgaagtgggtgttgggt

SEQ ID NO: 7517410 - DNA, 22 bp, Homo sapiens
ggcactgaagtgggtgttgggt

SEQ ID NO: 7517411 - DNA, 22 bp, Homo sapiens
ggcactcaataaatgttgccaa

SEQ ID NO: 7517412 - DNA, 22 bp, Homo sapiens
ggcactattaattttgagagaa

SEQ ID NO: 7517413 - DNA, 22 bp, Homo sapiens
ggcactatgagttataagtgga

SEQ ID NO: 7517414 - DNA, 22 bp, Homo sapiens
ggcactagtgacaaggggacat

SEQ ID NO: 7517415 - DNA, 22 bp, Homo sapiens
ggcactagtgacaaggggacat

SEQ ID NO: 7517416 - DNA, 22 bp, Homo sapiens
ggcactcaataaatgttgccaa

SEQ ID NO: 7517417 - DNA, 22 bp, Homo sapiens
ggcactcaataaatgttgccaa

SEQ ID NO: 7517418 - DNA, 22 bp, Homo sapiens
ggcactcaataaatgttgccaa

SEQ ID NO: 7517419 - DNA, 22 bp, Homo sapiens
ggcacgtgcctaaggagcaggc

SEQ ID NO: 7517420 - DNA, 22 bp, Homo sapiens
ggcactaggagacctgggggtc

SEQ ID NO: 7517421 - DNA, 22 bp, Homo sapiens
ggcacctgtctgctcacagtga

SEQ ID NO: 7517422 - DNA, 21 bp, Homo sapiens
ggcactaggcccggaggaagc

SEQ ID NO: 7517423 - DNA, 21 bp, Homo sapiens
ggcactaggcccggaggaagc

SEQ ID NO: 7517424 - DNA, 22 bp, Homo sapiens
ggcactgacactagcatggcac

SEQ ID NO: 7517425 - DNA, 22 bp, Homo sapiens
ggcactgacactagcatggcac

SEQ ID NO: 7517426 - DNA, 22 bp, Homo sapiens
ggcactgacactagcatggcac

SEQ ID NO: 7517427 - DNA, 22 bp, Homo sapiens
ggcactgactgtgcagcgcacc

SEQ ID NO: 7517428 - DNA, 22 bp, Homo sapiens
ggcactgacactagcatggcac

SEQ ID NO: 7517429 - DNA, 22 bp, Homo sapiens
ggcactgagaacaggctgactt

SEQ ID NO: 7517430 - DNA, 22 bp, Homo sapiens
ggcactgagaacaggctgactt

SEQ ID NO: 7517431 - DNA, 22 bp, Homo sapiens
ggcactgactgtgcagcgcacc

SEQ ID NO: 7517432 - DNA, 22 bp, Homo sapiens
ggcactgactgtgcagcgcacc

SEQ ID NO: 7517433 - DNA, 23 bp, Homo sapiens
ggcactgaagctacaatggtgag

SEQ ID NO: 7517434 - DNA, 22 bp, Homo sapiens
ggcactgactgtgcagcgcacc

SEQ ID NO: 7517435 - DNA, 21 bp, Homo sapiens
ggcactgagccagatggactc

SEQ ID NO: 7517436 - DNA, 21 bp, Homo sapiens
ggcactgagccagatggactc

SEQ ID NO: 7517437 - DNA, 21 bp, Homo sapiens
ggcactgagccagatggactc

SEQ ID NO: 7517438 - DNA, 22 bp, Homo sapiens
ggcactgagaggctcttcctaa

SEQ ID NO: 7517439 - DNA, 22 bp, Homo sapiens
ggcactgagaacaggctgactt

SEQ ID NO: 7517440 - DNA, 22 bp, Homo sapiens
ggcactgagaggctcttcctaa

SEQ ID NO: 7517441 - DNA, 22 bp, Homo sapiens
ggcactgagaggctcttcctaa

SEQ ID NO: 7517442 - DNA, 22 bp, Homo sapiens
ggcactgagaacaggctgactt

SEQ ID NO: 7517443 - DNA, 22 bp, Homo sapiens
ggcactgagctgccttggggca

SEQ ID NO: 7517444 - DNA, 22 bp, Homo sapiens
ggcactgagctgccttggggca

SEQ ID NO: 7517445 - DNA, 22 bp, Homo sapiens
ggcactgagcgggctctgagcg

SEQ ID NO: 7517446 - DNA, 22 bp, Homo sapiens
ggcactgagcgggctctgagcg

SEQ ID NO: 7517447 - DNA, 22 bp, Homo sapiens
ggcaccagggaaggaaggctgg

SEQ ID NO: 7517448 - DNA, 22 bp, Homo sapiens
ggcaccaggctgggcataggcc

SEQ ID NO: 7517449 - DNA, 22 bp, Homo sapiens
ggcaccagggaaggaaggctgg

SEQ ID NO: 7517450 - DNA, 22 bp, Homo sapiens
ggcaccagggaaggaaggctgg

SEQ ID NO: 7517451 - DNA, 22 bp, Homo sapiens
ggcaccagggaaggaaggctgg

SEQ ID NO: 7517452 - DNA, 22 bp, Homo sapiens
ggcaccagggaaggaaggctgg

SEQ ID NO: 7517453 - DNA, 22 bp, Homo sapiens
ggcaccaggctgggcataggcc

SEQ ID NO: 7517454 - DNA, 22 bp, Homo sapiens
ggaggcagaacttcccgtcagt

SEQ ID NO: 7517455 - DNA, 22 bp, Homo sapiens
ggaggcagaacttcccgtcagt

SEQ ID NO: 7517456 - DNA, 22 bp, Homo sapiens
ggaggcagaacttcccgtcagt

SEQ ID NO: 7517457 - DNA, 22 bp, Homo sapiens
ggcaccaggctgggcataggcc

SEQ ID NO: 7517458 - DNA, 22 bp, Homo sapiens
ggcaccaggctgggcataggcc

SEQ ID NO: 7517459 - DNA, 22 bp, Homo sapiens
ggaggcagaacttcccgtcagt

SEQ ID NO: 7517460 - DNA, 22 bp, Homo sapiens
ggaggcagaacttcccgtcagt

SEQ ID NO: 7517461 - DNA, 22 bp, Homo sapiens
ggaggcagaacttcccgtcagt

SEQ ID NO: 7517462 - DNA, 22 bp, Homo sapiens
ggaggcagaacttcccgtcagt

SEQ ID NO: 7517463 - DNA, 22 bp, Homo sapiens
ggaggcagaacttcccgtcagt

SEQ ID NO: 7517464 - DNA, 22 bp, Homo sapiens
ggaggcagaacttcccgtcagt

SEQ ID NO: 7517465 - DNA, 22 bp, Homo sapiens
ggaggcagaacttcccgtcagt

SEQ ID NO: 7517466 - DNA, 22 bp, Homo sapiens
ggaggcagaacttcccgtcagt

SEQ ID NO: 7517467 - DNA, 22 bp, Homo sapiens
ggaggcagaacttcccgtcagt

SEQ ID NO: 7517468 - DNA, 22 bp, Homo sapiens
ggaggcacttcccgtctcagcc

SEQ ID NO: 7517469 - DNA, 22 bp, Homo sapiens
ggaggcacttcatgctgacccg

SEQ ID NO: 7517470 - DNA, 22 bp, Homo sapiens
ggaggcacttcccgtctcagcc

SEQ ID NO: 7517471 - DNA, 22 bp, Homo sapiens
ggaggcacttcccgtctcagcc

SEQ ID NO: 7517472 - DNA, 22 bp, Homo sapiens
ggaggcacttcccgtctcagcc

SEQ ID NO: 7517473 - DNA, 16 bp, Homo sapiens
ggcaccagtgaacaca

SEQ ID NO: 7517474 - DNA, 22 bp, Homo sapiens
ggcacccttggggggccacagc

SEQ ID NO: 7517475 - DNA, 18 bp, Homo sapiens
ggcacctctcttgcctta

SEQ ID NO: 7517476 - DNA, 18 bp, Homo sapiens
ggcacctctcttgcctta

SEQ ID NO: 7517477 - DNA, 16 bp, Homo sapiens
ggcaccagtgaacaca

SEQ ID NO: 7517478 - DNA, 16 bp, Homo sapiens
ggcaccagtgaacaca

SEQ ID NO: 7517479 - DNA, 22 bp, Homo sapiens
ggcaccagggcaagggtctttc

SEQ ID NO: 7517480 - DNA, 22 bp, Homo sapiens
ggcaccagggcaagggtctttc

SEQ ID NO: 7517481 - DNA, 22 bp, Homo sapiens
ggcaccaggggatgtaatgtcc

SEQ ID NO: 7517482 - DNA, 22 bp, Homo sapiens
ggcaccagggcaagggtctttc

SEQ ID NO: 7517483 - DNA, 22 bp, Homo sapiens
ggcaccagggacaatcctcttc

SEQ ID NO: 7517484 - DNA, 22 bp, Homo sapiens
ggcaccagggacaatcctcttc

SEQ ID NO: 7517485 - DNA, 22 bp, Homo sapiens
ggcaccagggacaatcctcttc

SEQ ID NO: 7517486 - DNA, 22 bp, Homo sapiens
ggcacctctgggctctgttagg

SEQ ID NO: 7517487 - DNA, 22 bp, Homo sapiens
ggcacctgatgactgcttccct

SEQ ID NO: 7517488 - DNA, 22 bp, Homo sapiens
ggcacctgatgactgcttccct

SEQ ID NO: 7517489 - DNA, 22 bp, Homo sapiens
ggcacctgctcatctggactca

SEQ ID NO: 7517490 - DNA, 22 bp, Homo sapiens
ggcacctggaggtttactggat

SEQ ID NO: 7517491 - DNA, 22 bp, Homo sapiens
ggcacctgctcatctggactca

SEQ ID NO: 7517492 - DNA, 22 bp, Homo sapiens
ggcacctgctcatctggactca

SEQ ID NO: 7517493 - DNA, 22 bp, Homo sapiens
ggcacctggatgtagcagtgaa

SEQ ID NO: 7517494 - DNA, 22 bp, Homo sapiens
ggcacctggtaagtgctcagta

SEQ ID NO: 7517495 - DNA, 22 bp, Homo sapiens
ggcacctggtaagtgctcagta

SEQ ID NO: 7517496 - DNA, 22 bp, Homo sapiens
ggcacctggtaagtgctcagta

SEQ ID NO: 7517497 - DNA, 22 bp, Homo sapiens
ggcacctggtaagtgctcagta

SEQ ID NO: 7517498 - DNA, 22 bp, Homo sapiens
ggcacctggatgtagcagtgaa

SEQ ID NO: 7517499 - DNA, 22 bp, Homo sapiens
ggcacctggatgtagcagtgaa

SEQ ID NO: 7517500 - DNA, 22 bp, Homo sapiens
ggcacctggatgtagcagtgaa

SEQ ID NO: 7517501 - DNA, 22 bp, Homo sapiens
ggcacctggatgtagcagtgaa

SEQ ID NO: 7517502 - DNA, 22 bp, Homo sapiens
ggcacctgtgtaagatctggaa

SEQ ID NO: 7517503 - DNA, 22 bp, Homo sapiens
ggcaccttgagggcagaacctt

SEQ ID NO: 7517504 - DNA, 22 bp, Homo sapiens
ggcaccttgagggcagaacctt

SEQ ID NO: 7517505 - DNA, 19 bp, Homo sapiens
ggcaccttggctatgcctg

SEQ ID NO: 7517506 - DNA, 19 bp, Homo sapiens
ggcaccttggctatgcctg

SEQ ID NO: 7517507 - DNA, 19 bp, Homo sapiens
ggcacctttctgctgtgtc

SEQ ID NO: 7517508 - DNA, 19 bp, Homo sapiens
ggcaccttggtcttggact

SEQ ID NO: 7517509 - DNA, 22 bp, Homo sapiens
ggcacctgtctgctcacagtga

SEQ ID NO: 7517510 - DNA, 22 bp, Homo sapiens
ggcacctgtagttattttgttt

SEQ ID NO: 7517511 - DNA, 22 bp, Homo sapiens
ggcacctgtgtaagatctggaa

SEQ ID NO: 7517512 - DNA, 22 bp, Homo sapiens
ggcacctgtgtaagatctggaa

SEQ ID NO: 7517513 - DNA, 22 bp, Homo sapiens
ggcacctgtgtaagatctggaa

SEQ ID NO: 7517514 - DNA, 22 bp, Homo sapiens
ggcacctggtaagtgctcagta

SEQ ID NO: 7517515 - DNA, 22 bp, Homo sapiens
ggcacctggtaagtgctcagta

SEQ ID NO: 7517516 - DNA, 23 bp, Homo sapiens
ggaggagttcccagccctcctgg

SEQ ID NO: 7517517 - DNA, 22 bp, Homo sapiens
ggaggagtgtggggcactctgc

SEQ ID NO: 7517518 - DNA, 22 bp, Homo sapiens
ggaggagtgtggggcactctgc

SEQ ID NO: 7517519 - DNA, 22 bp, Homo sapiens
ggaggagtcagttgggctgctt

SEQ ID NO: 7517520 - DNA, 22 bp, Homo sapiens
ggaggagtgtggggcactctgc

SEQ ID NO: 7517521 - DNA, 22 bp, Homo sapiens
ggaggatgagctacgaggagct

SEQ ID NO: 7517522 - DNA, 22 bp, Homo sapiens
ggaggatgagctacgaggagct

SEQ ID NO: 7517523 - DNA, 22 bp, Homo sapiens
ggaggatgagctacgaggagct

SEQ ID NO: 7517524 - DNA, 23 bp, Homo sapiens
ggaggagttcccagccctcctgg

SEQ ID NO: 7517525 - DNA, 23 bp, Homo sapiens
ggaggagttcccagccctcctgg

SEQ ID NO: 7517526 - DNA, 22 bp, Homo sapiens
ggaggaggggtttacattggaa

SEQ ID NO: 7517527 - DNA, 22 bp, Homo sapiens
ggaggaggggtttacattggaa

SEQ ID NO: 7517528 - DNA, 22 bp, Homo sapiens
ggaggaggtgggttaagttgta

SEQ ID NO: 7517529 - DNA, 22 bp, Homo sapiens
ggaggaggggtttacattggaa

SEQ ID NO: 7517530 - DNA, 22 bp, Homo sapiens
ggaggaggtgggttaagttgta

SEQ ID NO: 7517531 - DNA, 22 bp, Homo sapiens
ggaggaggtgggttaagttgta

SEQ ID NO: 7517532 - DNA, 22 bp, Homo sapiens
ggaggagtcagttgggctgctt

SEQ ID NO: 7517533 - DNA, 22 bp, Homo sapiens
ggaggagtcagttgggctgctt

SEQ ID NO: 7517534 - DNA, 22 bp, Homo sapiens
ggaggagtcagttgggctgctt

SEQ ID NO: 7517535 - DNA, 22 bp, Homo sapiens
ggaggaggtgggttaagttgta

SEQ ID NO: 7517536 - DNA, 22 bp, Homo sapiens
ggaggaggggtttacattggaa

SEQ ID NO: 7517537 - DNA, 22 bp, Homo sapiens
ggaggaggggtttacattggaa

SEQ ID NO: 7517538 - DNA, 22 bp, Homo sapiens
ggaggaggggtttacattggaa

SEQ ID NO: 7517539 - DNA, 22 bp, Homo sapiens
ggaggaggggtttacattggaa

SEQ ID NO: 7517540 - DNA, 22 bp, Homo sapiens
ggaggaggggtttacattggaa

SEQ ID NO: 7517541 - DNA, 22 bp, Homo sapiens
ggaggaggggtttacattggaa

SEQ ID NO: 7517542 - DNA, 22 bp, Homo sapiens
ggaggaggggtttacattggaa

SEQ ID NO: 7517543 - DNA, 22 bp, Homo sapiens
ggaggaggggtttacattggaa

SEQ ID NO: 7517544 - DNA, 22 bp, Homo sapiens
ggaggaggggtgactgaatgct

SEQ ID NO: 7517545 - DNA, 22 bp, Homo sapiens
ggaggaggggtgactgaatgct

SEQ ID NO: 7517546 - DNA, 22 bp, Homo sapiens
ggaggaggggtgactgaatgct

SEQ ID NO: 7517547 - DNA, 22 bp, Homo sapiens
ggaggaggggtgactgaatgct

SEQ ID NO: 7517548 - DNA, 22 bp, Homo sapiens
ggaggaggggtgactgaatgct

SEQ ID NO: 7517549 - DNA, 22 bp, Homo sapiens
ggaggaggggtgactgaatgct

SEQ ID NO: 7517550 - DNA, 22 bp, Homo sapiens
ggaggaggggtgactgaatgct

SEQ ID NO: 7517551 - DNA, 22 bp, Homo sapiens
ggaggcacacctcagactggga

SEQ ID NO: 7517552 - DNA, 22 bp, Homo sapiens
ggaggcacacctcagactggga

SEQ ID NO: 7517553 - DNA, 22 bp, Homo sapiens
ggaggcaccactcatcatcctc

SEQ ID NO: 7517554 - DNA, 22 bp, Homo sapiens
ggaggcaacatgcttgtttcta

SEQ ID NO: 7517555 - DNA, 22 bp, Homo sapiens
ggaggcacacctcagactggga

SEQ ID NO: 7517556 - DNA, 22 bp, Homo sapiens
ggaggcacacctcagactggga

SEQ ID NO: 7517557 - DNA, 23 bp, Homo sapiens
ggaggcacttaggcagagcagag

SEQ ID NO: 7517558 - DNA, 23 bp, Homo sapiens
ggaggcacttaggcagagcagag

SEQ ID NO: 7517559 - DNA, 23 bp, Homo sapiens
ggaggcacttaggcagagcagag

SEQ ID NO: 7517560 - DNA, 22 bp, Homo sapiens
ggaggcacccttcattgagttt

SEQ ID NO: 7517561 - DNA, 22 bp, Homo sapiens
ggaggcacacctcagactggga

SEQ ID NO: 7517562 - DNA, 22 bp, Homo sapiens
ggaggcaccctatttgaggcct

SEQ ID NO: 7517563 - DNA, 22 bp, Homo sapiens
ggaggcaccctatttgaggcct

SEQ ID NO: 7517564 - DNA, 23 bp, Homo sapiens
ggaggcacttaggcagagcagag

SEQ ID NO: 7517565 - DNA, 23 bp, Homo sapiens
ggaggcacttaggcagagcagag

SEQ ID NO: 7517566 - DNA, 23 bp, Homo sapiens
ggaggcacttaggcagagcagag

SEQ ID NO: 7517567 - DNA, 17 bp, Homo sapiens
ggaggcaacagacaggg

SEQ ID NO: 7517568 - DNA, 17 bp, Homo sapiens
ggaggcaacagacaggg

SEQ ID NO: 7517569 - DNA, 17 bp, Homo sapiens
ggaggcaacagacaggg

SEQ ID NO: 7517570 - DNA, 17 bp, Homo sapiens
ggaggcaacagacaggg

SEQ ID NO: 7517571 - DNA, 22 bp, Homo sapiens
ggaggcaacacagggtgtgttt

SEQ ID NO: 7517572 - DNA, 22 bp, Homo sapiens
ggaggcaacacagggtgtgttt

SEQ ID NO: 7517573 - DNA, 22 bp, Homo sapiens
ggaggcaaagcactttgcttgg

SEQ ID NO: 7517574 - DNA, 22 bp, Homo sapiens
ggaggcaaagcactttgcttgg

SEQ ID NO: 7517575 - DNA, 22 bp, Homo sapiens
ggaggagtgtggggcactctgc

SEQ ID NO: 7517576 - DNA, 22 bp, Homo sapiens
ggaggatgccaagctgtgcaca

SEQ ID NO: 7517577 - DNA, 22 bp, Homo sapiens
ggaggatgccaagctgtgcaca

SEQ ID NO: 7517578 - DNA, 22 bp, Homo sapiens
ggaggatgagctacgaggagct

SEQ ID NO: 7517579 - DNA, 22 bp, Homo sapiens
ggaggatgagctacgaggagct

SEQ ID NO: 7517580 - DNA, 22 bp, Homo sapiens
ggaggatgccaagctgtgcaca

SEQ ID NO: 7517581 - DNA, 22 bp, Homo sapiens
ggaggatgccaagctgtgcaca

SEQ ID NO: 7517582 - DNA, 22 bp, Homo sapiens
ggaggatgccaagctgtgcaca

SEQ ID NO: 7517583 - DNA, 19 bp, Homo sapiens
gctctccctctcagttgag

SEQ ID NO: 7517584 - DNA, 22 bp, Homo sapiens
gctctcctgtgcagatgctgct

SEQ ID NO: 7517585 - DNA, 22 bp, Homo sapiens
gctctcctgtgcagatgctgct

SEQ ID NO: 7517586 - DNA, 19 bp, Homo sapiens
gctctccctctcagttgag

SEQ ID NO: 7517587 - DNA, 19 bp, Homo sapiens
gctctccctctcagttgag

SEQ ID NO: 7517588 - DNA, 19 bp, Homo sapiens
gctctccctctcagttgag

SEQ ID NO: 7517589 - DNA, 19 bp, Homo sapiens
gctctccctctcagttgag

SEQ ID NO: 7517590 - DNA, 22 bp, Homo sapiens
gctctcccgcagcctggtgggc

SEQ ID NO: 7517591 - DNA, 22 bp, Homo sapiens
gctctccaggtctcatgcactg

SEQ ID NO: 7517592 - DNA, 22 bp, Homo sapiens
gctctcccgcagcctggtgggc

SEQ ID NO: 7517593 - DNA, 22 bp, Homo sapiens
gctctcccgcagcctggtgggc

SEQ ID NO: 7517594 - DNA, 22 bp, Homo sapiens
gctctccaggtctcatgcactg

SEQ ID NO: 7517595 - DNA, 22 bp, Homo sapiens
gctctccaggtctcatgcactg

SEQ ID NO: 7517596 - DNA, 22 bp, Homo sapiens
gctctccaggggctcccaggat

SEQ ID NO: 7517597 - DNA, 22 bp, Homo sapiens
gctctccaggggctcccaggat

SEQ ID NO: 7517598 - DNA, 22 bp, Homo sapiens
gctctccaggtccaagaatcca

SEQ ID NO: 7517599 - DNA, 22 bp, Homo sapiens
gctctccaggtccaagaatcca

SEQ ID NO: 7517600 - DNA, 22 bp, Homo sapiens
gctccctgaaaagaacaaagtc

SEQ ID NO: 7517601 - DNA, 22 bp, Homo sapiens
gctccctctgctcaggcacttg

SEQ ID NO: 7517602 - DNA, 22 bp, Homo sapiens
gctccctctgctcaggcacttg

SEQ ID NO: 7517603 - DNA, 22 bp, Homo sapiens
gctccctctgctcaggcacttg

SEQ ID NO: 7517604 - DNA, 22 bp, Homo sapiens
gctccctctgctcaggcacttg

SEQ ID NO: 7517605 - DNA, 22 bp, Homo sapiens
gctccctctgctcaggcacttg

SEQ ID NO: 7517606 - DNA, 22 bp, Homo sapiens
gctccctcccaccagcctgcag

SEQ ID NO: 7517607 - DNA, 22 bp, Homo sapiens
gctccctctgctcaggcacttg

SEQ ID NO: 7517608 - DNA, 21 bp, Homo sapiens
gctctctgcatggtggctcag

SEQ ID NO: 7517609 - DNA, 21 bp, Homo sapiens
gctctctgcatggtggctcag

SEQ ID NO: 7517610 - DNA, 22 bp, Homo sapiens
gctctctgccatatgaggatac

SEQ ID NO: 7517611 - DNA, 21 bp, Homo sapiens
gctctctgcatggtggctcag

SEQ ID NO: 7517612 - DNA, 22 bp, Homo sapiens
gctctctgcagcctccttggag

SEQ ID NO: 7517613 - DNA, 22 bp, Homo sapiens
gctctctgcagcctccttggag

SEQ ID NO: 7517614 - DNA, 22 bp, Homo sapiens
gctctctgcagcctccttggag

SEQ ID NO: 7517615 - DNA, 21 bp, Homo sapiens
gctctctgcatggtggctcag

SEQ ID NO: 7517616 - DNA, 22 bp, Homo sapiens
gctctctgcagcctccttggag

SEQ ID NO: 7517617 - DNA, 22 bp, Homo sapiens
gctctctgcaagtcagcagcct

SEQ ID NO: 7517618 - DNA, 22 bp, Homo sapiens
gctctctgcaagtcagcagcct

SEQ ID NO: 7517619 - DNA, 22 bp, Homo sapiens
gctctctgcagcctccttggag

SEQ ID NO: 7517620 - DNA, 22 bp, Homo sapiens
gctctctgcaagtcagcagcct

SEQ ID NO: 7517621 - DNA, 22 bp, Homo sapiens
gctctctgaggtgctggcagag

SEQ ID NO: 7517622 - DNA, 22 bp, Homo sapiens
gctctctgaggtgctggcagag

SEQ ID NO: 7517623 - DNA, 22 bp, Homo sapiens
gctctctgaggtgctggcagag

SEQ ID NO: 7517624 - DNA, 22 bp, Homo sapiens
gctctctcgtgaacaggtggtt

SEQ ID NO: 7517625 - DNA, 22 bp, Homo sapiens
gctctctcttggggattcagca

SEQ ID NO: 7517626 - DNA, 22 bp, Homo sapiens
gctctctgaggtgctggcagag

SEQ ID NO: 7517627 - DNA, 22 bp, Homo sapiens
gctctctgaggtgctggcagag

SEQ ID NO: 7517628 - DNA, 22 bp, Homo sapiens
gctctctgaggtgctggcagag

SEQ ID NO: 7517629 - DNA, 22 bp, Homo sapiens
gctctctgaggtgctggcagag

SEQ ID NO: 7517630 - DNA, 22 bp, Homo sapiens
gctctctccctaggcaagtgag

SEQ ID NO: 7517631 - DNA, 22 bp, Homo sapiens
gctctcctgtgcagatgctgct

SEQ ID NO: 7517632 - DNA, 22 bp, Homo sapiens
gctctctccctaggcaagtgag

SEQ ID NO: 7517633 - DNA, 22 bp, Homo sapiens
gctctctcgtgaacaggtggtt

SEQ ID NO: 7517634 - DNA, 22 bp, Homo sapiens
gctctctcgtgaacaggtggtt

SEQ ID NO: 7517635 - DNA, 22 bp, Homo sapiens
gctccccttggtcctcctggga

SEQ ID NO: 7517636 - DNA, 22 bp, Homo sapiens
gctccccttggtcctcctggga

SEQ ID NO: 7517637 - DNA, 20 bp, Homo sapiens
gctccccttctctgggcctc

SEQ ID NO: 7517638 - DNA, 20 bp, Homo sapiens
gctccccttctctgggcctc

SEQ ID NO: 7517639 - DNA, 20 bp, Homo sapiens
gctccccttctctgggcctc

SEQ ID NO: 7517640 - DNA, 22 bp, Homo sapiens
gctccccattgatctgcaggct

SEQ ID NO: 7517641 - DNA, 22 bp, Homo sapiens
gctccccattgatctgcaggct

SEQ ID NO: 7517642 - DNA, 22 bp, Homo sapiens
gctccccattgatctgcaggct

SEQ ID NO: 7517643 - DNA, 22 bp, Homo sapiens
gctccccattgatctgcaggct

SEQ ID NO: 7517644 - DNA, 22 bp, Homo sapiens
gctcccaggatgaggagccagg

SEQ ID NO: 7517645 - DNA, 22 bp, Homo sapiens
gctccccattgatctgcaggct

SEQ ID NO: 7517646 - DNA, 22 bp, Homo sapiens
gctccccattgatctgcaggct

SEQ ID NO: 7517647 - DNA, 22 bp, Homo sapiens
gctccccattgatctgcaggct

SEQ ID NO: 7517648 - DNA, 22 bp, Homo sapiens
gctccccattgatctgcaggct

SEQ ID NO: 7517649 - DNA, 22 bp, Homo sapiens
gctccccattgatctgcaggct

SEQ ID NO: 7517650 - DNA, 22 bp, Homo sapiens
gctccccttggtcctcctggga

SEQ ID NO: 7517651 - DNA, 22 bp, Homo sapiens
gctccccttggtcctcctggga

SEQ ID NO: 7517652 - DNA, 22 bp, Homo sapiens
gctccctatttggccttctctg

SEQ ID NO: 7517653 - DNA, 22 bp, Homo sapiens
gctccctaatttgttaatgctg

SEQ ID NO: 7517654 - DNA, 22 bp, Homo sapiens
gctccctcatctgtgctgtttt

SEQ ID NO: 7517655 - DNA, 22 bp, Homo sapiens
gctccctcatctgtgctgtttt

SEQ ID NO: 7517656 - DNA, 22 bp, Homo sapiens
gctccctccatgaggcagaccg

SEQ ID NO: 7517657 - DNA, 22 bp, Homo sapiens
gctccctccatgaggcagaccg

SEQ ID NO: 7517658 - DNA, 22 bp, Homo sapiens
gctccctccatgaggcagaccg

SEQ ID NO: 7517659 - DNA, 22 bp, Homo sapiens
gctccctccatgaggcagaccg

SEQ ID NO: 7517660 - DNA, 22 bp, Homo sapiens
gctccctcatctgtgctgtttt

SEQ ID NO: 7517661 - DNA, 22 bp, Homo sapiens
gctccctcccaccagcctgcag

SEQ ID NO: 7517662 - DNA, 22 bp, Homo sapiens
gctccctcccaccagcctgcag

SEQ ID NO: 7517663 - DNA, 22 bp, Homo sapiens
gctccctcccaccagcctgcag

SEQ ID NO: 7517664 - DNA, 22 bp, Homo sapiens
gctccctccatgaggcagaccg

SEQ ID NO: 7517665 - DNA, 22 bp, Homo sapiens
gctccctccatgaggcagaccg

SEQ ID NO: 7517666 - DNA, 22 bp, Homo sapiens
gctccctcccaccagcctgcag

SEQ ID NO: 7517667 - DNA, 22 bp, Homo sapiens
gctccctcccaccagcctgcag

SEQ ID NO: 7517668 - DNA, 22 bp, Homo sapiens
gctccctcccaccagcctgcag

SEQ ID NO: 7517669 - DNA, 22 bp, Homo sapiens
gctccctcccaccagcctgcag

SEQ ID NO: 7517670 - DNA, 22 bp, Homo sapiens
gctccctcccaccagcctgcag

SEQ ID NO: 7517671 - DNA, 22 bp, Homo sapiens
gctcccaggatgaggagccagg

SEQ ID NO: 7517672 - DNA, 22 bp, Homo sapiens
gctcccaggatgaggagccagg

SEQ ID NO: 7517673 - DNA, 22 bp, Homo sapiens
gctcccaggatgaggagccagg

SEQ ID NO: 7517674 - DNA, 22 bp, Homo sapiens
gctcccaggatgaggagccagg

SEQ ID NO: 7517675 - DNA, 22 bp, Homo sapiens
gctcccaggaagagaagggcca

SEQ ID NO: 7517676 - DNA, 22 bp, Homo sapiens
gctcccaggatgaggagccagg

SEQ ID NO: 7517677 - DNA, 22 bp, Homo sapiens
gctcccaggatgaggagccagg

SEQ ID NO: 7517678 - DNA, 22 bp, Homo sapiens
gctcccaggatgaggagccagg

SEQ ID NO: 7517679 - DNA, 22 bp, Homo sapiens
gctcccaggaagagaagggcca

SEQ ID NO: 7517680 - DNA, 22 bp, Homo sapiens
gctcccaggaagagaagggcca

SEQ ID NO: 7517681 - DNA, 22 bp, Homo sapiens
gctcccaggaagagaagggcca

SEQ ID NO: 7517682 - DNA, 22 bp, Homo sapiens
gctcccaggaagagaagggcca

SEQ ID NO: 7517683 - DNA, 22 bp, Homo sapiens
gctcccagctggagcctcaaca

SEQ ID NO: 7517684 - DNA, 22 bp, Homo sapiens
gctcccagctggagcctcaaca

SEQ ID NO: 7517685 - DNA, 22 bp, Homo sapiens
gctcccagctggagcctcaaca

SEQ ID NO: 7517686 - DNA, 20 bp, Homo sapiens
gctcccagcctgcagtcccc

SEQ ID NO: 7517687 - DNA, 22 bp, Homo sapiens
gctcccagctggagcctcaaca

SEQ ID NO: 7517688 - DNA, 22 bp, Homo sapiens
gctcccagctggagcctcaaca

SEQ ID NO: 7517689 - DNA, 22 bp, Homo sapiens
gctcccagctggagcctcaaca

SEQ ID NO: 7517690 - DNA, 22 bp, Homo sapiens
gctcccagcattgctgctgaat

SEQ ID NO: 7517691 - DNA, 22 bp, Homo sapiens
gctcccagcattgctgctgaat

SEQ ID NO: 7517692 - DNA, 22 bp, Homo sapiens
gctcccagcattgctgctgaat

SEQ ID NO: 7517693 - DNA, 22 bp, Homo sapiens
gctcccagcattgctgctgaat

SEQ ID NO: 7517694 - DNA, 22 bp, Homo sapiens
gctcccagcattgctgctgaat

SEQ ID NO: 7517695 - DNA, 22 bp, Homo sapiens
gctcccagcattgctgctgaat

SEQ ID NO: 7517696 - DNA, 22 bp, Homo sapiens
gctcccagcattgcttcccagg

SEQ ID NO: 7517697 - DNA, 22 bp, Homo sapiens
gctcccagcattgcttcccagg

SEQ ID NO: 7517698 - DNA, 22 bp, Homo sapiens
gctcccagcattgctgctgaat

SEQ ID NO: 7517699 - DNA, 22 bp, Homo sapiens
gctcccagcattgcttcccagg

SEQ ID NO: 7517700 - DNA, 22 bp, Homo sapiens
gctcccagcattgcttcccagg

SEQ ID NO: 7517701 - DNA, 22 bp, Homo sapiens
gctcccagcattgcttcccagg

SEQ ID NO: 7517702 - DNA, 20 bp, Homo sapiens
gctcccagcctgcagtcccc

SEQ ID NO: 7517703 - DNA, 20 bp, Homo sapiens
gctcccagcctgcagtcccc

SEQ ID NO: 7517704 - DNA, 20 bp, Homo sapiens
gctcccagcctgcagtcccc

SEQ ID NO: 7517705 - DNA, 20 bp, Homo sapiens
gctcccagcctgcagtcccc

SEQ ID NO: 7517706 - DNA, 20 bp, Homo sapiens
gctcccagcctgcagtcccc

SEQ ID NO: 7517707 - DNA, 20 bp, Homo sapiens
gctcccagcctgcagtcccc

SEQ ID NO: 7517708 - DNA, 22 bp, Homo sapiens
gctctgtccagcgtgcacagaa

SEQ ID NO: 7517709 - DNA, 22 bp, Homo sapiens
gctctgtccagcgtgcacagaa

SEQ ID NO: 7517710 - DNA, 21 bp, Homo sapiens
gctctgtccctgctgtgtgtc

SEQ ID NO: 7517711 - DNA, 20 bp, Homo sapiens
gctctgtctggcctactttt

SEQ ID NO: 7517712 - DNA, 22 bp, Homo sapiens
gctctgtatgagggtgagagat

SEQ ID NO: 7517713 - DNA, 22 bp, Homo sapiens
gctctgtcaacagctagctgtg

SEQ ID NO: 7517714 - DNA, 22 bp, Homo sapiens
gctctgtcaacagctagctgtg

SEQ ID NO: 7517715 - DNA, 22 bp, Homo sapiens
gctctgtcaacagctagctgtg

SEQ ID NO: 7517716 - DNA, 22 bp, Homo sapiens
gctctgtcattttgcagacact

SEQ ID NO: 7517717 - DNA, 19 bp, Homo sapiens
gctctgtgatgctgagggg

SEQ ID NO: 7517718 - DNA, 22 bp, Homo sapiens
gctctgtgagtattggccctgg

SEQ ID NO: 7517719 - DNA, 22 bp, Homo sapiens
gctctgtgagtattggccctgg

SEQ ID NO: 7517720 - DNA, 22 bp, Homo sapiens
gctctgtgagtattggccctgg

SEQ ID NO: 7517721 - DNA, 22 bp, Homo sapiens
gctctgtgagccacttgatgta

SEQ ID NO: 7517722 - DNA, 22 bp, Homo sapiens
gctctgtgagccacttgatgta

SEQ ID NO: 7517723 - DNA, 22 bp, Homo sapiens
gctctgtgagccacttgatgta

SEQ ID NO: 7517724 - DNA, 18 bp, Homo sapiens
gctctgtgaccttgagca

SEQ ID NO: 7517725 - DNA, 22 bp, Homo sapiens
gctctgtgagccacttgatgta

SEQ ID NO: 7517726 - DNA, 21 bp, Homo sapiens
gctctgtgaaatttcaccagg

SEQ ID NO: 7517727 - DNA, 22 bp, Homo sapiens
gctctgtgaccttaggcaagtt

SEQ ID NO: 7517728 - DNA, 22 bp, Homo sapiens
gctctgtgaagggtgttgctca

SEQ ID NO: 7517729 - DNA, 22 bp, Homo sapiens
gctctgtgaagggtgttgctca

SEQ ID NO: 7517730 - DNA, 22 bp, Homo sapiens
gctctgtgaccttaggcaagtt

SEQ ID NO: 7517731 - DNA, 22 bp, Homo sapiens
gctctgtgaccttaggcaagtt

SEQ ID NO: 7517732 - DNA, 22 bp, Homo sapiens
gctctgtgccacatgcagtgtt

SEQ ID NO: 7517733 - DNA, 22 bp, Homo sapiens
gctctgtgcagttcagggacac

SEQ ID NO: 7517734 - DNA, 22 bp, Homo sapiens
gctctgtgccacatgcagtgtt

SEQ ID NO: 7517735 - DNA, 22 bp, Homo sapiens
gctctgtgccacatgcagtgtt

SEQ ID NO: 7517736 - DNA, 19 bp, Homo sapiens
gctctgtgatgctgagggg

SEQ ID NO: 7517737 - DNA, 22 bp, Homo sapiens
gctctgtgcaaatagcacccct

SEQ ID NO: 7517738 - DNA, 19 bp, Homo sapiens
gctctgtgatgctgagggg

SEQ ID NO: 7517739 - DNA, 19 bp, Homo sapiens
gctctgtgatgctgagggg

SEQ ID NO: 7517740 - DNA, 19 bp, Homo sapiens
gctctgtgatgctgagggg

SEQ ID NO: 7517741 - DNA, 22 bp, Homo sapiens
gctctgtgccagggctgggcca

SEQ ID NO: 7517742 - DNA, 22 bp, Homo sapiens
gctctgtgcccctgccgtggac

SEQ ID NO: 7517743 - DNA, 22 bp, Homo sapiens
gctctgtgcccctgccgtggac

SEQ ID NO: 7517744 - DNA, 22 bp, Homo sapiens
gctctgtgccagggctgggcca

SEQ ID NO: 7517745 - DNA, 22 bp, Homo sapiens
gctctgtgccagggctgggcca

SEQ ID NO: 7517746 - DNA, 22 bp, Homo sapiens
gctctgtgctactttgaactct

SEQ ID NO: 7517747 - DNA, 22 bp, Homo sapiens
gctctgtgcccctgccgtggac

SEQ ID NO: 7517748 - DNA, 20 bp, Homo sapiens
gctctgtgctggcggaggct

SEQ ID NO: 7517749 - DNA, 20 bp, Homo sapiens
gctctgtgctggcggaggct

SEQ ID NO: 7517750 - DNA, 22 bp, Homo sapiens
gctctgtggcaggaggtcttgt

SEQ ID NO: 7517751 - DNA, 22 bp, Homo sapiens
gctctgtggcattcatgggcag

SEQ ID NO: 7517752 - DNA, 22 bp, Homo sapiens
gctctgtggcaggaggtcttgt

SEQ ID NO: 7517753 - DNA, 22 bp, Homo sapiens
gctctgtatgagggtgagagat

SEQ ID NO: 7517754 - DNA, 22 bp, Homo sapiens
gctctgtatcttacaacagggt

SEQ ID NO: 7517755 - DNA, 22 bp, Homo sapiens
gctctgtagtgggcatgtgatt

SEQ ID NO: 7517756 - DNA, 22 bp, Homo sapiens
gctctgtatctgtggggcttcc

SEQ ID NO: 7517757 - DNA, 22 bp, Homo sapiens
gctctgtatcttacaacagggt

SEQ ID NO: 7517758 - DNA, 22 bp, Homo sapiens
gctctgtacgcaggatgagggg

SEQ ID NO: 7517759 - DNA, 22 bp, Homo sapiens
gctctgtagtatttagtaaata

SEQ ID NO: 7517760 - DNA, 21 bp, Homo sapiens
gctctgtacgttggtgccttc

SEQ ID NO: 7517761 - DNA, 22 bp, Homo sapiens
gctctgggtagccactgcctgg

SEQ ID NO: 7517762 - DNA, 22 bp, Homo sapiens
gctctgggtagccactgcctgg

SEQ ID NO: 7517763 - DNA, 22 bp, Homo sapiens
gctctgggtagccactgcctgg

SEQ ID NO: 7517764 - DNA, 22 bp, Homo sapiens
gctctgggtagccactgcctgg

SEQ ID NO: 7517765 - DNA, 22 bp, Homo sapiens
gctctgggtagccactgcctgg

SEQ ID NO: 7517766 - DNA, 22 bp, Homo sapiens
gctctgggtagccactgcctgg

SEQ ID NO: 7517767 - DNA, 22 bp, Homo sapiens
gctctctgttattaagatcttt

SEQ ID NO: 7517768 - DNA, 22 bp, Homo sapiens
gctctcttgacagcttgctgtt

SEQ ID NO: 7517769 - DNA, 22 bp, Homo sapiens
gctctctgtcgttatgcttcat

SEQ ID NO: 7517770 - DNA, 22 bp, Homo sapiens
gctctctgtcgttatgcttcat

SEQ ID NO: 7517771 - DNA, 22 bp, Homo sapiens
gctctctgtcgttatgcttcat

SEQ ID NO: 7517772 - DNA, 22 bp, Homo sapiens
gctctctgtcgttatgcttcat

SEQ ID NO: 7517773 - DNA, 22 bp, Homo sapiens
gctctctgtcgttatgcttcat

SEQ ID NO: 7517774 - DNA, 22 bp, Homo sapiens
gctctctgtcgttatgcttcat

SEQ ID NO: 7517775 - DNA, 22 bp, Homo sapiens
gctctcttggtggctgtcctgg

SEQ ID NO: 7517776 - DNA, 22 bp, Homo sapiens
gctctcttgacagcttgctgtt

SEQ ID NO: 7517777 - DNA, 22 bp, Homo sapiens
gctctcttgacagcttgctgtt

SEQ ID NO: 7517778 - DNA, 22 bp, Homo sapiens
gctctggggttggaaagtgatc

SEQ ID NO: 7517779 - DNA, 22 bp, Homo sapiens
gctctcttggtggctgtcctgg

SEQ ID NO: 7517780 - DNA, 22 bp, Homo sapiens
gctctcttggtggctgtcctgg

SEQ ID NO: 7517781 - DNA, 22 bp, Homo sapiens
gctctctgcctttctcaatgac

SEQ ID NO: 7517782 - DNA, 22 bp, Homo sapiens
gctctctgcctttctcaatgac

SEQ ID NO: 7517783 - DNA, 22 bp, Homo sapiens
gctctctgccatatgaggatac

SEQ ID NO: 7517784 - DNA, 22 bp, Homo sapiens
gctctctgccatatgaggatac

SEQ ID NO: 7517785 - DNA, 22 bp, Homo sapiens
gctctctgcctttctcaatgac

SEQ ID NO: 7517786 - DNA, 22 bp, Homo sapiens
gctctctggaggccatggacag

SEQ ID NO: 7517787 - DNA, 22 bp, Homo sapiens
gctctctggaggccatggacag

SEQ ID NO: 7517788 - DNA, 22 bp, Homo sapiens
gctctctggaggccatggacag

SEQ ID NO: 7517789 - DNA, 22 bp, Homo sapiens
gctctctggaggccatggacag

SEQ ID NO: 7517790 - DNA, 22 bp, Homo sapiens
gctctctggaggccatggacag

SEQ ID NO: 7517791 - DNA, 22 bp, Homo sapiens
gctctctggaaggtatcattat

SEQ ID NO: 7517792 - DNA, 22 bp, Homo sapiens
gctctctgcctttctcaatgac

SEQ ID NO: 7517793 - DNA, 22 bp, Homo sapiens
gctctctgcctttctcaatgac

SEQ ID NO: 7517794 - DNA, 22 bp, Homo sapiens
gctctctggaaggtatcattat

SEQ ID NO: 7517795 - DNA, 22 bp, Homo sapiens
gctctctggaaggtatcattat

SEQ ID NO: 7517796 - DNA, 22 bp, Homo sapiens
gctctctggaaggtatcattat

SEQ ID NO: 7517797 - DNA, 22 bp, Homo sapiens
gctctctggaaggtatcattat

SEQ ID NO: 7517798 - DNA, 22 bp, Homo sapiens
gctctctggctagtccatcggg

SEQ ID NO: 7517799 - DNA, 22 bp, Homo sapiens
gctctctggctagtccatcggg

SEQ ID NO: 7517800 - DNA, 22 bp, Homo sapiens
gctctctggctagtccatcggg

SEQ ID NO: 7517801 - DNA, 22 bp, Homo sapiens
gctctctggctagtccatcggg

SEQ ID NO: 7517802 - DNA, 22 bp, Homo sapiens
gctctctggaggccatggacag

SEQ ID NO: 7517803 - DNA, 22 bp, Homo sapiens
gctctctggaggccatggacag

SEQ ID NO: 7517804 - DNA, 22 bp, Homo sapiens
gctctctgggtggtgggcaaca

SEQ ID NO: 7517805 - DNA, 22 bp, Homo sapiens
gctctctgggtggtgggcaaca

SEQ ID NO: 7517806 - DNA, 22 bp, Homo sapiens
gctctctgggtggtgggcaaca

SEQ ID NO: 7517807 - DNA, 22 bp, Homo sapiens
gctctctgggtggtgggcaaca

SEQ ID NO: 7517808 - DNA, 22 bp, Homo sapiens
gctctctgggcgggagctaaga

SEQ ID NO: 7517809 - DNA, 22 bp, Homo sapiens
gctctctggctagtccatcggg

SEQ ID NO: 7517810 - DNA, 22 bp, Homo sapiens
gctctctgggcgggagctaaga

SEQ ID NO: 7517811 - DNA, 22 bp, Homo sapiens
gctctctgggcgggagctaaga

SEQ ID NO: 7517812 - DNA, 22 bp, Homo sapiens
gctctctgggtgtgtctagata

SEQ ID NO: 7517813 - DNA, 22 bp, Homo sapiens
gctctctgggtgtgtctagata

SEQ ID NO: 7517814 - DNA, 22 bp, Homo sapiens
gctctctgggtggtgggcaaca

SEQ ID NO: 7517815 - DNA, 22 bp, Homo sapiens
gctctctgggtgtgtctagata

SEQ ID NO: 7517816 - DNA, 22 bp, Homo sapiens
gctctctggttccagtcaggaa

SEQ ID NO: 7517817 - DNA, 22 bp, Homo sapiens
gctctctggttccagtcaggaa

SEQ ID NO: 7517818 - DNA, 22 bp, Homo sapiens
gctctctggttccagtcaggaa

SEQ ID NO: 7517819 - DNA, 22 bp, Homo sapiens
gctctctggttccagtcaggaa

SEQ ID NO: 7517820 - DNA, 22 bp, Homo sapiens
gctctctggttccagtcaggaa

SEQ ID NO: 7517821 - DNA, 22 bp, Homo sapiens
gctctctggttccagtcaggaa

SEQ ID NO: 7517822 - DNA, 22 bp, Homo sapiens
gctaggttggggaagttctcct

SEQ ID NO: 7517823 - DNA, 22 bp, Homo sapiens
gctaggttggggaagttctcct

SEQ ID NO: 7517824 - DNA, 22 bp, Homo sapiens
gctaggtgcagcagacagctta

SEQ ID NO: 7517825 - DNA, 23 bp, Homo sapiens
gctaggtgcttccacacgtgctg

SEQ ID NO: 7517826 - DNA, 23 bp, Homo sapiens
gctaggtgcttccacacgtgctg

SEQ ID NO: 7517827 - DNA, 19 bp, Homo sapiens
gctaggtgaccagctggat

SEQ ID NO: 7517828 - DNA, 22 bp, Homo sapiens
gctaggtgcagcagacagctta

SEQ ID NO: 7517829 - DNA, 22 bp, Homo sapiens
gctaggtgcagcagacagctta

SEQ ID NO: 7517830 - DNA, 22 bp, Homo sapiens
gctaggtgcagcagacagctta

SEQ ID NO: 7517831 - DNA, 23 bp, Homo sapiens
gctaggtgcttccacacgtgctg

SEQ ID NO: 7517832 - DNA, 22 bp, Homo sapiens
gctagtttcttgaatactctaa

SEQ ID NO: 7517833 - DNA, 22 bp, Homo sapiens
gctagtgcagggaaatctttgg

SEQ ID NO: 7517834 - DNA, 22 bp, Homo sapiens
gctatacacatttcttggtagt

SEQ ID NO: 7517835 - DNA, 22 bp, Homo sapiens
gctatacacatttcttggtagt

SEQ ID NO: 7517836 - DNA, 22 bp, Homo sapiens
gctatacaagtgtagaatagag

SEQ ID NO: 7517837 - DNA, 22 bp, Homo sapiens
gctagtttcttgttggcagaga

SEQ ID NO: 7517838 - DNA, 22 bp, Homo sapiens
gctatacaagtgtagaatagag

SEQ ID NO: 7517839 - DNA, 22 bp, Homo sapiens
gctcagggagagagggcagccg

SEQ ID NO: 7517840 - DNA, 22 bp, Homo sapiens
gctcagggagagagggcagccg

SEQ ID NO: 7517841 - DNA, 22 bp, Homo sapiens
gctcagggagagagggcagccg

SEQ ID NO: 7517842 - DNA, 22 bp, Homo sapiens
gctcagggagagagggcagccg

SEQ ID NO: 7517843 - DNA, 22 bp, Homo sapiens
gctcagggagagagggcagccg

SEQ ID NO: 7517844 - DNA, 20 bp, Homo sapiens
gctcagggaattcaggaagc

SEQ ID NO: 7517845 - DNA, 20 bp, Homo sapiens
gctcagggaattcaggaagc

SEQ ID NO: 7517846 - DNA, 20 bp, Homo sapiens
gctcagggaattcaggaagc

SEQ ID NO: 7517847 - DNA, 20 bp, Homo sapiens
gctcagggaattcaggaagc

SEQ ID NO: 7517848 - DNA, 22 bp, Homo sapiens
gctcagggaatgagaagatgtt

SEQ ID NO: 7517849 - DNA, 22 bp, Homo sapiens
gctcagggaaggccacgtgaga

SEQ ID NO: 7517850 - DNA, 22 bp, Homo sapiens
gctcagggaaggccacgtgaga

SEQ ID NO: 7517851 - DNA, 22 bp, Homo sapiens
gctcagggaaggccacgtgaga

SEQ ID NO: 7517852 - DNA, 21 bp, Homo sapiens
gctatacagaatggccagagg

SEQ ID NO: 7517853 - DNA, 22 bp, Homo sapiens
gctcagggaatgagaagatgtt

SEQ ID NO: 7517854 - DNA, 22 bp, Homo sapiens
gctcagggaatgagaagatgtt

SEQ ID NO: 7517855 - DNA, 22 bp, Homo sapiens
gctcagggaaggccacgtgaga

SEQ ID NO: 7517856 - DNA, 22 bp, Homo sapiens
gctcagggaaggccacgtgaga

SEQ ID NO: 7517857 - DNA, 22 bp, Homo sapiens
gctcagggagtttcacagtgta

SEQ ID NO: 7517858 - DNA, 22 bp, Homo sapiens
gctcagggagtttcacagtgta

SEQ ID NO: 7517859 - DNA, 22 bp, Homo sapiens
gctcagggagtttcacagtgta

SEQ ID NO: 7517860 - DNA, 22 bp, Homo sapiens
gctcagggagtttcacagtgta

SEQ ID NO: 7517861 - DNA, 22 bp, Homo sapiens
gctcagggagtttcacagtgta

SEQ ID NO: 7517862 - DNA, 22 bp, Homo sapiens
gctcagggccatggaccagcag

SEQ ID NO: 7517863 - DNA, 22 bp, Homo sapiens
gctcagggccatggaccagcag

SEQ ID NO: 7517864 - DNA, 22 bp, Homo sapiens
gctcagggccatggaccagcag

SEQ ID NO: 7517865 - DNA, 22 bp, Homo sapiens
gctcagggccatggaccagcag

SEQ ID NO: 7517866 - DNA, 22 bp, Homo sapiens
gctcagggccatggaccagcag

SEQ ID NO: 7517867 - DNA, 22 bp, Homo sapiens
gctcagggccatggaccagcag

SEQ ID NO: 7517868 - DNA, 22 bp, Homo sapiens
gctcagggagtttcacagtgta

SEQ ID NO: 7517869 - DNA, 22 bp, Homo sapiens
gctcagggagtttcacagtgta

SEQ ID NO: 7517870 - DNA, 22 bp, Homo sapiens
gctcagggagtttcacagtgta

SEQ ID NO: 7517871 - DNA, 22 bp, Homo sapiens
gctcagggagagagggcagccg

SEQ ID NO: 7517872 - DNA, 22 bp, Homo sapiens
gctcagggagcgatttaccatg

SEQ ID NO: 7517873 - DNA, 22 bp, Homo sapiens
gctcagggagcgatttaccatg

SEQ ID NO: 7517874 - DNA, 22 bp, Homo sapiens
gctcagggagagagggcagccg

SEQ ID NO: 7517875 - DNA, 22 bp, Homo sapiens
gctcagggagagagggcagccg

SEQ ID NO: 7517876 - DNA, 22 bp, Homo sapiens
gctcagggagagagggcagccg

SEQ ID NO: 7517877 - DNA, 22 bp, Homo sapiens
gctcagggagagagggcagccg

SEQ ID NO: 7517878 - DNA, 22 bp, Homo sapiens
gctcagggcgcgagggacgtgg

SEQ ID NO: 7517879 - DNA, 22 bp, Homo sapiens
gctcagggcgcgagggacgtgg

SEQ ID NO: 7517880 - DNA, 20 bp, Homo sapiens
gctcagggcctgggtctgga

SEQ ID NO: 7517881 - DNA, 20 bp, Homo sapiens
gctcagggcctgggtctgga

SEQ ID NO: 7517882 - DNA, 20 bp, Homo sapiens
gctcagggcctgggtctgga

SEQ ID NO: 7517883 - DNA, 20 bp, Homo sapiens
gctcagggcctgggtctgga

SEQ ID NO: 7517884 - DNA, 20 bp, Homo sapiens
gctcagggcctgggtctgga

SEQ ID NO: 7517885 - DNA, 20 bp, Homo sapiens
gctcagggcctgggtctgga

SEQ ID NO: 7517886 - DNA, 20 bp, Homo sapiens
gctcagggcctgggtctgga

SEQ ID NO: 7517887 - DNA, 22 bp, Homo sapiens
gctcagggcctggctgcggact

SEQ ID NO: 7517888 - DNA, 22 bp, Homo sapiens
gctcagggccatggaccagcag

SEQ ID NO: 7517889 - DNA, 22 bp, Homo sapiens
gctcagggccatggaccagcag

SEQ ID NO: 7517890 - DNA, 22 bp, Homo sapiens
gctcagggccatggaccagcag

SEQ ID NO: 7517891 - DNA, 22 bp, Homo sapiens
gctcagggcctggctgcggact

SEQ ID NO: 7517892 - DNA, 22 bp, Homo sapiens
gctcagggcctggctgcggact

SEQ ID NO: 7517893 - DNA, 22 bp, Homo sapiens
gctcagggcctggctgcggact

SEQ ID NO: 7517894 - DNA, 22 bp, Homo sapiens
gctcagggcctggctgcggact

SEQ ID NO: 7517895 - DNA, 20 bp, Homo sapiens
gctcagtggagaaatgcacc

SEQ ID NO: 7517896 - DNA, 20 bp, Homo sapiens
gctcagtggagaaatgcacc

SEQ ID NO: 7517897 - DNA, 20 bp, Homo sapiens
gctcagtggagaaatgcacc

SEQ ID NO: 7517898 - DNA, 22 bp, Homo sapiens
gctcagtggtattcggaaactg

SEQ ID NO: 7517899 - DNA, 22 bp, Homo sapiens
gctcagtgcatcattccaggct

SEQ ID NO: 7517900 - DNA, 19 bp, Homo sapiens
gctcagtgatgccagacca

SEQ ID NO: 7517901 - DNA, 19 bp, Homo sapiens
gctcagtgatgccagacca

SEQ ID NO: 7517902 - DNA, 19 bp, Homo sapiens
gctcagtgatgccagacca

SEQ ID NO: 7517903 - DNA, 19 bp, Homo sapiens
gctcagtgatgccagacca

SEQ ID NO: 7517904 - DNA, 22 bp, Homo sapiens
gctcagtgcagcctttctgtat

SEQ ID NO: 7517905 - DNA, 22 bp, Homo sapiens
gctcagtgaatttttgcccatg

SEQ ID NO: 7517906 - DNA, 22 bp, Homo sapiens
gctcagtgaagggtgccaagta

SEQ ID NO: 7517907 - DNA, 22 bp, Homo sapiens
gctcagtgaagggtgccaagta

SEQ ID NO: 7517908 - DNA, 22 bp, Homo sapiens
gctcagtgagatattgactcca

SEQ ID NO: 7517909 - DNA, 22 bp, Homo sapiens
gctcagggcgcgagggacgtgg

SEQ ID NO: 7517910 - DNA, 22 bp, Homo sapiens
gctcagggcgcgagggacgtgg

SEQ ID NO: 7517911 - DNA, 22 bp, Homo sapiens
gctcagggcgcgagggacgtgg

SEQ ID NO: 7517912 - DNA, 22 bp, Homo sapiens
gctcagggcgcgagggacgtgg

SEQ ID NO: 7517913 - DNA, 22 bp, Homo sapiens
gctcagggctaaggctgagggg

SEQ ID NO: 7517914 - DNA, 22 bp, Homo sapiens
gctcatattcaactatcttcac

SEQ ID NO: 7517915 - DNA, 22 bp, Homo sapiens
gctcagtttcttctattgtatt

SEQ ID NO: 7517916 - DNA, 22 bp, Homo sapiens
gctcagtttcttctattgtatt

SEQ ID NO: 7517917 - DNA, 22 bp, Homo sapiens
gctcagttatccgtgtgtgact

SEQ ID NO: 7517918 - DNA, 22 bp, Homo sapiens
gctcagttatccgtgtgtgact

SEQ ID NO: 7517919 - DNA, 23 bp, Homo sapiens
gctcatcaggcttagagtcaagg

SEQ ID NO: 7517920 - DNA, 23 bp, Homo sapiens
gctcatcaggcttagagtcaagg

SEQ ID NO: 7517921 - DNA, 23 bp, Homo sapiens
gctcatcaggcttagagtcaagg

SEQ ID NO: 7517922 - DNA, 23 bp, Homo sapiens
gctcatcaggcttagagtcaagg

SEQ ID NO: 7517923 - DNA, 22 bp, Homo sapiens
gctcagtgttcatctgtatgca

SEQ ID NO: 7517924 - DNA, 22 bp, Homo sapiens
gctcagtgtgttcaagggctca

SEQ ID NO: 7517925 - DNA, 22 bp, Homo sapiens
gctcagtgtgttcaagggctca

SEQ ID NO: 7517926 - DNA, 18 bp, Homo sapiens
gctcagtgtgttaacact

SEQ ID NO: 7517927 - DNA, 22 bp, Homo sapiens
gctcccagcaattgaggcagcc

SEQ ID NO: 7517928 - DNA, 22 bp, Homo sapiens
gctcccagcaattgaggcagcc

SEQ ID NO: 7517929 - DNA, 22 bp, Homo sapiens
gctcccagcaattgaggcagcc

SEQ ID NO: 7517930 - DNA, 22 bp, Homo sapiens
gctcccagcaattgaggcagcc

SEQ ID NO: 7517931 - DNA, 22 bp, Homo sapiens
gctcccagcaattgaggcagcc

SEQ ID NO: 7517932 - DNA, 22 bp, Homo sapiens
gctcccagatttcagccttgtg

SEQ ID NO: 7517933 - DNA, 22 bp, Homo sapiens
gctcccagatttcagccttgtg

SEQ ID NO: 7517934 - DNA, 22 bp, Homo sapiens
gctcccagatttcagccttgtg

SEQ ID NO: 7517935 - DNA, 22 bp, Homo sapiens
gctcccagatttcagccttgtg

SEQ ID NO: 7517936 - DNA, 22 bp, Homo sapiens
gctcccagcaattgaggcagcc

SEQ ID NO: 7517937 - DNA, 22 bp, Homo sapiens
gctcccagcaattgaggcagcc

SEQ ID NO: 7517938 - DNA, 22 bp, Homo sapiens
gctcccagcaattgaggcagcc

SEQ ID NO: 7517939 - DNA, 22 bp, Homo sapiens
gctcccagcaattgaggcagcc

SEQ ID NO: 7517940 - DNA, 22 bp, Homo sapiens
gctcccagcaattgaggcagcc

SEQ ID NO: 7517941 - DNA, 22 bp, Homo sapiens
gctcccagcaattgaggcagcc

SEQ ID NO: 7517942 - DNA, 22 bp, Homo sapiens
gctcccagcaattgaggcagcc

SEQ ID NO: 7517943 - DNA, 22 bp, Homo sapiens
gctcccagactgaccagaggtg

SEQ ID NO: 7517944 - DNA, 22 bp, Homo sapiens
gctcccagactgaccagaggtg

SEQ ID NO: 7517945 - DNA, 22 bp, Homo sapiens
gctcccagactgaccagaggtg

SEQ ID NO: 7517946 - DNA, 22 bp, Homo sapiens
gctcccagactgaccagaggtg

SEQ ID NO: 7517947 - DNA, 22 bp, Homo sapiens
gctcccagactgaccagaggtg

SEQ ID NO: 7517948 - DNA, 23 bp, Homo sapiens
gctcatctagaatggtttcagct

SEQ ID NO: 7517949 - DNA, 23 bp, Homo sapiens
gctcatctagaatggtttcagct

SEQ ID NO: 7517950 - DNA, 18 bp, Homo sapiens
gctcatcccacaatcagg

SEQ ID NO: 7517951 - DNA, 22 bp, Homo sapiens
gctcatcccttaggaggaaggc

SEQ ID NO: 7517952 - DNA, 22 bp, Homo sapiens
gctcatccagcaagccagggcc

SEQ ID NO: 7517953 - DNA, 22 bp, Homo sapiens
gctcatccagcaagccagggcc

SEQ ID NO: 7517954 - DNA, 22 bp, Homo sapiens
gctcagtttttagtttgtgaga

SEQ ID NO: 7517955 - DNA, 23 bp, Homo sapiens
gctcatccacggagaggggctcc

SEQ ID NO: 7517956 - DNA, 23 bp, Homo sapiens
gctcatcaggcttagagtcaagg

SEQ ID NO: 7517957 - DNA, 22 bp, Homo sapiens
gctcccagatttcagccttgtg

SEQ ID NO: 7517958 - DNA, 22 bp, Homo sapiens
gctcccagatttcagccttgtg

SEQ ID NO: 7517959 - DNA, 22 bp, Homo sapiens
gctcccagatttcagccttgtg

SEQ ID NO: 7517960 - DNA, 22 bp, Homo sapiens
gctcccagactgaccagaggtg

SEQ ID NO: 7517961 - DNA, 22 bp, Homo sapiens
gctcccagactgaccagaggtg

SEQ ID NO: 7517962 - DNA, 22 bp, Homo sapiens
gctcccagactgaccagaggtg

SEQ ID NO: 7517963 - DNA, 22 bp, Homo sapiens
gctcccagactgaccagaggtg

SEQ ID NO: 7517964 - DNA, 22 bp, Homo sapiens
gctcccagactgaccagaggtg

SEQ ID NO: 7517965 - DNA, 22 bp, Homo sapiens
gctcccagactgaccagaggtg

SEQ ID NO: 7517966 - DNA, 22 bp, Homo sapiens
gctagcctccattttattacta

SEQ ID NO: 7517967 - DNA, 22 bp, Homo sapiens
gctagcaggttgcatctgtctt

SEQ ID NO: 7517968 - DNA, 22 bp, Homo sapiens
gctagcaaatgtcatttggaag

SEQ ID NO: 7517969 - DNA, 22 bp, Homo sapiens
gctagcaagtggcatagcaggg

SEQ ID NO: 7517970 - DNA, 22 bp, Homo sapiens
gctagcagaaagcaggctgctc

SEQ ID NO: 7517971 - DNA, 22 bp, Homo sapiens
gctagcctgcagtggctatggt

SEQ ID NO: 7517972 - DNA, 22 bp, Homo sapiens
gctagcctgcagtggctatggt

SEQ ID NO: 7517973 - DNA, 22 bp, Homo sapiens
gctagcctgcagtggctatggt

SEQ ID NO: 7517974 - DNA, 22 bp, Homo sapiens
gctagcctcccttttccatggt

SEQ ID NO: 7517975 - DNA, 22 bp, Homo sapiens
gctagaggcaacaactttatag

SEQ ID NO: 7517976 - DNA, 22 bp, Homo sapiens
gctagatctctcataaattcca

SEQ ID NO: 7517977 - DNA, 22 bp, Homo sapiens
gctagaatattgggtaggcaag

SEQ ID NO: 7517978 - DNA, 22 bp, Homo sapiens
gctagagaccagaggccttgaa

SEQ ID NO: 7517979 - DNA, 22 bp, Homo sapiens
gctagaaatcgacttcagaatt

SEQ ID NO: 7517980 - DNA, 22 bp, Homo sapiens
gctagaaatcgacttcagaatt

SEQ ID NO: 7517981 - DNA, 22 bp, Homo sapiens
gctagaaatcgacttcagaatt

SEQ ID NO: 7517982 - DNA, 19 bp, Homo sapiens
gctagaagatagaatgaaa

SEQ ID NO: 7517983 - DNA, 19 bp, Homo sapiens
gctagaagatagaatgaaa

SEQ ID NO: 7517984 - DNA, 19 bp, Homo sapiens
gctagaagatagaatgaaa

SEQ ID NO: 7517985 - DNA, 22 bp, Homo sapiens
gctagaagttgggcctggtgct

SEQ ID NO: 7517986 - DNA, 22 bp, Homo sapiens
gctagctttataatgctgggcg

SEQ ID NO: 7517987 - DNA, 22 bp, Homo sapiens
gctagctgggtttcactgtgga

SEQ ID NO: 7517988 - DNA, 22 bp, Homo sapiens
gctagctgggtttcactgtgga

SEQ ID NO: 7517989 - DNA, 22 bp, Homo sapiens
gctagctgggtttcactgtgga

SEQ ID NO: 7517990 - DNA, 20 bp, Homo sapiens
gctaggaaggggaaaaagtg

SEQ ID NO: 7517991 - DNA, 22 bp, Homo sapiens
gctaggaagctggggagaagtc

SEQ ID NO: 7517992 - DNA, 22 bp, Homo sapiens
gctaggaagaagggtgcttgaa

SEQ ID NO: 7517993 - DNA, 22 bp, Homo sapiens
gctaggaggccctgcacgctta

SEQ ID NO: 7517994 - DNA, 22 bp, Homo sapiens
gctaggagccgctgcactaggt

SEQ ID NO: 7517995 - DNA, 17 bp, Homo sapiens
gctaggagagggaggag

SEQ ID NO: 7517996 - DNA, 22 bp, Homo sapiens
gctaggaatcggacccaggaag

SEQ ID NO: 7517997 - DNA, 17 bp, Homo sapiens
gctaggagagggaggag

SEQ ID NO: 7517998 - DNA, 18 bp, Homo sapiens
gctagggcatgcatggtg

SEQ ID NO: 7517999 - DNA, 22 bp, Homo sapiens
gctagggctcttgtccttgctc

SEQ ID NO: 7518000 - DNA, 19 bp, Homo sapiens
gctaggtgaccagctggat

SEQ ID NO: 7518001 - DNA, 19 bp, Homo sapiens
gctaggtgaccagctggat

SEQ ID NO: 7518002 - DNA, 19 bp, Homo sapiens
gctagggttggtggcgtgc

SEQ ID NO: 7518003 - DNA, 22 bp, Homo sapiens
gctaggtctgtgcgcagccgct

SEQ ID NO: 7518004 - DNA, 19 bp, Homo sapiens
gctagggttggtggcgtgc

SEQ ID NO: 7518005 - DNA, 19 bp, Homo sapiens
gctagggttggtggcgtgc

SEQ ID NO: 7518006 - DNA, 22 bp, Homo sapiens
gctagggtggctaataggagag

SEQ ID NO: 7518007 - DNA, 22 bp, Homo sapiens
gctagggactagggaaggagca

SEQ ID NO: 7518008 - DNA, 22 bp, Homo sapiens
gctagggactagggaaggagca

SEQ ID NO: 7518009 - DNA, 22 bp, Homo sapiens
gctagggaacctcttctgagga

SEQ ID NO: 7518010 - DNA, 22 bp, Homo sapiens
gctaggcttcaaaatctccctg

SEQ ID NO: 7518011 - DNA, 20 bp, Homo sapiens
gctaggctgtgtcctgccca

SEQ ID NO: 7518012 - DNA, 22 bp, Homo sapiens
gctaggcttcaaaatctccctg

SEQ ID NO: 7518013 - DNA, 22 bp, Homo sapiens
gctagggactagggaaggagca

SEQ ID NO: 7518014 - DNA, 22 bp, Homo sapiens
gctaggctgtgtttcagaccct

SEQ ID NO: 7518015 - DNA, 22 bp, Homo sapiens
gctagggagacttgtgtcatca

SEQ ID NO: 7518016 - DNA, 22 bp, Homo sapiens
gctaggcttcaaaatctccctg

SEQ ID NO: 7518017 - DNA, 22 bp, Homo sapiens
gctaggctgtgtttcagaccct

SEQ ID NO: 7518018 - DNA, 22 bp, Homo sapiens
gctaggctgtgtttcagaccct

SEQ ID NO: 7518019 - DNA, 19 bp, Homo sapiens
gctaggctggccttgaggg

SEQ ID NO: 7518020 - DNA, 19 bp, Homo sapiens
gctaggctggccttgaggg

SEQ ID NO: 7518021 - DNA, 22 bp, Homo sapiens
gctaggctcttccatcagggca

SEQ ID NO: 7518022 - DNA, 22 bp, Homo sapiens
gctaggctgaatatggtgctta

SEQ ID NO: 7518023 - DNA, 22 bp, Homo sapiens
gctaggctgaatatggtgctta

SEQ ID NO: 7518024 - DNA, 22 bp, Homo sapiens
gctaggctcggaagcagcaggg

SEQ ID NO: 7518025 - DNA, 22 bp, Homo sapiens
gctaggctcggaagcagcaggg

SEQ ID NO: 7518026 - DNA, 22 bp, Homo sapiens
gctaggctcttccatcagggca

SEQ ID NO: 7518027 - DNA, 22 bp, Homo sapiens
gctaggctcggaagcagcaggg

SEQ ID NO: 7518028 - DNA, 22 bp, Homo sapiens
gctaggctcggaagcagcaggg

SEQ ID NO: 7518029 - DNA, 22 bp, Homo sapiens
gctaggaggccctgcacgctta

SEQ ID NO: 7518030 - DNA, 22 bp, Homo sapiens
gctaggagtgggatggaagtcg

SEQ ID NO: 7518031 - DNA, 22 bp, Homo sapiens
gctaggagtaaggagaccttca

SEQ ID NO: 7518032 - DNA, 22 bp, Homo sapiens
gctaggagtggtgggtcaagga

SEQ ID NO: 7518033 - DNA, 22 bp, Homo sapiens
gcctggcactcaatcatctgct

SEQ ID NO: 7518034 - DNA, 22 bp, Homo sapiens
gcctggcactcaatcatctgct

SEQ ID NO: 7518035 - DNA, 22 bp, Homo sapiens
gcctggcacgggctcggcccac

SEQ ID NO: 7518036 - DNA, 22 bp, Homo sapiens
gcctggcacgggctcggcccac

SEQ ID NO: 7518037 - DNA, 22 bp, Homo sapiens
gcctggcacgggctcggcccac

SEQ ID NO: 7518038 - DNA, 16 bp, Homo sapiens
gcctggcaccgtcggc

SEQ ID NO: 7518039 - DNA, 22 bp, Homo sapiens
gcctggcactcactgaagaggc

SEQ ID NO: 7518040 - DNA, 22 bp, Homo sapiens
gcctggcactcactgaagaggc

SEQ ID NO: 7518041 - DNA, 22 bp, Homo sapiens
gcctggcactgggctcctggcc

SEQ ID NO: 7518042 - DNA, 22 bp, Homo sapiens
gcctggcactgggctcctggcc

SEQ ID NO: 7518043 - DNA, 22 bp, Homo sapiens
gcctggcactgggctcctggcc

SEQ ID NO: 7518044 - DNA, 22 bp, Homo sapiens
gcctggcactgggctcctggcc

SEQ ID NO: 7518045 - DNA, 22 bp, Homo sapiens
gcctggcactgggctcctggcc

SEQ ID NO: 7518046 - DNA, 22 bp, Homo sapiens
gcctggcagattgacatagcca

SEQ ID NO: 7518047 - DNA, 22 bp, Homo sapiens
gcctggcagattgacatagcca

SEQ ID NO: 7518048 - DNA, 22 bp, Homo sapiens
gcctggcagattgacatagcca

SEQ ID NO: 7518049 - DNA, 22 bp, Homo sapiens
gcctggcagattgacatagcca

SEQ ID NO: 7518050 - DNA, 22 bp, Homo sapiens
gcctggcagattgacatagcca

SEQ ID NO: 7518051 - DNA, 22 bp, Homo sapiens
gcctggcaggaatctcagtgct

SEQ ID NO: 7518052 - DNA, 22 bp, Homo sapiens
gcctggcaggaatctcagtgct

SEQ ID NO: 7518053 - DNA, 22 bp, Homo sapiens
gcctggcaggaatctcagtgct

SEQ ID NO: 7518054 - DNA, 22 bp, Homo sapiens
gcctggcagcctccaaccttca

SEQ ID NO: 7518055 - DNA, 22 bp, Homo sapiens
gcctggcagcctccaaccttca

SEQ ID NO: 7518056 - DNA, 22 bp, Homo sapiens
gcctggcagcccctagacattt

SEQ ID NO: 7518057 - DNA, 22 bp, Homo sapiens
gcctggcagcccctagacattt

SEQ ID NO: 7518058 - DNA, 22 bp, Homo sapiens
gcctggcaggcctcatgagggg

SEQ ID NO: 7518059 - DNA, 22 bp, Homo sapiens
gcctggcaggcctcatgagggg

SEQ ID NO: 7518060 - DNA, 22 bp, Homo sapiens
gcctggcaggcctcatgagggg

SEQ ID NO: 7518061 - DNA, 22 bp, Homo sapiens
gctagaaaatgaaagataattt

SEQ ID NO: 7518062 - DNA, 22 bp, Homo sapiens
gcctggcaggcctcatgagggg

SEQ ID NO: 7518063 - DNA, 22 bp, Homo sapiens
gctagaaactgtttaatctctt

SEQ ID NO: 7518064 - DNA, 22 bp, Homo sapiens
gctagaaactgtttaatctctt

SEQ ID NO: 7518065 - DNA, 22 bp, Homo sapiens
gctagaaaatgaaagataattt

SEQ ID NO: 7518066 - DNA, 22 bp, Homo sapiens
gctagaaaatgaaagataattt

SEQ ID NO: 7518067 - DNA, 22 bp, Homo sapiens
gctagaaaatgaaagataattt

SEQ ID NO: 7518068 - DNA, 22 bp, Homo sapiens
gctagaaaatgaaagataattt

SEQ ID NO: 7518069 - DNA, 22 bp, Homo sapiens
gcctggagttcagccaagtccc

SEQ ID NO: 7518070 - DNA, 22 bp, Homo sapiens
gcctggagttcagccaagtccc

SEQ ID NO: 7518071 - DNA, 22 bp, Homo sapiens
gcctggagttcagccaagtccc

SEQ ID NO: 7518072 - DNA, 22 bp, Homo sapiens
gcctggagttcagccaagtccc

SEQ ID NO: 7518073 - DNA, 22 bp, Homo sapiens
gcctggagttcagccaagtccc

SEQ ID NO: 7518074 - DNA, 22 bp, Homo sapiens
gcctggagttcagccaagtccc

SEQ ID NO: 7518075 - DNA, 22 bp, Homo sapiens
gcctggagttcagccaagtccc

SEQ ID NO: 7518076 - DNA, 16 bp, Homo sapiens
gcctggcaccgtcggc

SEQ ID NO: 7518077 - DNA, 20 bp, Homo sapiens
gcctggcacccggggctggc

SEQ ID NO: 7518078 - DNA, 20 bp, Homo sapiens
gcctggcacccggggctggc

SEQ ID NO: 7518079 - DNA, 20 bp, Homo sapiens
gcctggcacccggggctggc

SEQ ID NO: 7518080 - DNA, 20 bp, Homo sapiens
gcctggcacccggggctggc

SEQ ID NO: 7518081 - DNA, 22 bp, Homo sapiens
gcctggagttcagccaagtccc

SEQ ID NO: 7518082 - DNA, 20 bp, Homo sapiens
gcctggcacccggggctggc

SEQ ID NO: 7518083 - DNA, 20 bp, Homo sapiens
gcctggagttagttttcctt

SEQ ID NO: 7518084 - DNA, 22 bp, Homo sapiens
gcctggagtggtcctgctgccc

SEQ ID NO: 7518085 - DNA, 20 bp, Homo sapiens
gcctggagttagttttcctt

SEQ ID NO: 7518086 - DNA, 22 bp, Homo sapiens
gcctggagtgttggtatttctc

SEQ ID NO: 7518087 - DNA, 22 bp, Homo sapiens
gcctggagtgttggtatttctc

SEQ ID NO: 7518088 - DNA, 22 bp, Homo sapiens
gcctggagtggtcctgctgccc

SEQ ID NO: 7518089 - DNA, 22 bp, Homo sapiens
gcctggagtggtcctgctgccc

SEQ ID NO: 7518090 - DNA, 16 bp, Homo sapiens
gcctggagtggcaggg

SEQ ID NO: 7518091 - DNA, 22 bp, Homo sapiens
gcctggagtggtcctgctgccc

SEQ ID NO: 7518092 - DNA, 22 bp, Homo sapiens
gcctggagtggtcctgctgccc

SEQ ID NO: 7518093 - DNA, 22 bp, Homo sapiens
gcctggagtggtcctgctgccc

SEQ ID NO: 7518094 - DNA, 22 bp, Homo sapiens
gcctggagtggtcctgctgccc

SEQ ID NO: 7518095 - DNA, 22 bp, Homo sapiens
gcctggagtggtcctgctgccc

SEQ ID NO: 7518096 - DNA, 22 bp, Homo sapiens
gctctgtggtggggcagagttt

SEQ ID NO: 7518097 - DNA, 22 bp, Homo sapiens
gctctgtggtggggcagagttt

SEQ ID NO: 7518098 - DNA, 22 bp, Homo sapiens
gctctgtggcattcatgggcag

SEQ ID NO: 7518099 - DNA, 22 bp, Homo sapiens
gctctgtggcattcatgggcag

SEQ ID NO: 7518100 - DNA, 20 bp, Homo sapiens
gctctgtggtttgagtctcc

SEQ ID NO: 7518101 - DNA, 20 bp, Homo sapiens
gctctgtggtttgagtctcc

SEQ ID NO: 7518102 - DNA, 22 bp, Homo sapiens
gctctgtgtatgtggcaggtgc

SEQ ID NO: 7518103 - DNA, 22 bp, Homo sapiens
gctctgtgtatgtggcaggtgc

SEQ ID NO: 7518104 - DNA, 20 bp, Homo sapiens
gctctgtggtttgagtctcc

SEQ ID NO: 7518105 - DNA, 20 bp, Homo sapiens
gctctgtggtttgagtctcc

SEQ ID NO: 7518106 - DNA, 22 bp, Homo sapiens
gctgagggctgtaacagcagag

SEQ ID NO: 7518107 - DNA, 22 bp, Homo sapiens
gctgagggctgtaacagcagag

SEQ ID NO: 7518108 - DNA, 22 bp, Homo sapiens
gctctgtgtccacagctggaaa

SEQ ID NO: 7518109 - DNA, 20 bp, Homo sapiens
gctgaggggtctatggcata

SEQ ID NO: 7518110 - DNA, 20 bp, Homo sapiens
gctgaggggtctatggcata

SEQ ID NO: 7518111 - DNA, 22 bp, Homo sapiens
gctgagggggaaggaaagctga

SEQ ID NO: 7518112 - DNA, 22 bp, Homo sapiens
gctgagggggaaggaaagctga

SEQ ID NO: 7518113 - DNA, 22 bp, Homo sapiens
gctgagggggaaggaaagctga

SEQ ID NO: 7518114 - DNA, 22 bp, Homo sapiens
gctgagggtaacacttcgggat

SEQ ID NO: 7518115 - DNA, 22 bp, Homo sapiens
gctgagggtctgttcatgttgc

SEQ ID NO: 7518116 - DNA, 22 bp, Homo sapiens
gctgagggtctgttcatgttgc

SEQ ID NO: 7518117 - DNA, 22 bp, Homo sapiens
gctgagggtctgttcatgttgc

SEQ ID NO: 7518118 - DNA, 23 bp, Homo sapiens
gctgaggtacatttacaggaaga

SEQ ID NO: 7518119 - DNA, 22 bp, Homo sapiens
gctgagggtaacacttcgggat

SEQ ID NO: 7518120 - DNA, 22 bp, Homo sapiens
gctgagggtaacacttcgggat

SEQ ID NO: 7518121 - DNA, 20 bp, Homo sapiens
gctgaggggtctatggcata

SEQ ID NO: 7518122 - DNA, 22 bp, Homo sapiens
gctgaggtggtgatggttcatc

SEQ ID NO: 7518123 - DNA, 22 bp, Homo sapiens
gctgaggtggtgatggttcatc

SEQ ID NO: 7518124 - DNA, 18 bp, Homo sapiens
gctgaggtggtgtcagag

SEQ ID NO: 7518125 - DNA, 22 bp, Homo sapiens
gctgaggtggtgatggttcatc

SEQ ID NO: 7518126 - DNA, 18 bp, Homo sapiens
gctgaggtggtgtcagag

SEQ ID NO: 7518127 - DNA, 22 bp, Homo sapiens
gctgaggtggctgccttagtaa

SEQ ID NO: 7518128 - DNA, 22 bp, Homo sapiens
gctgaggtggtgatggttcatc

SEQ ID NO: 7518129 - DNA, 22 bp, Homo sapiens
gctgaggtggctgccttagtaa

SEQ ID NO: 7518130 - DNA, 22 bp, Homo sapiens
gctgaggtgtcaccttgctggg

SEQ ID NO: 7518131 - DNA, 18 bp, Homo sapiens
gctgaggtggtgtcagag

SEQ ID NO: 7518132 - DNA, 18 bp, Homo sapiens
gctgaggtggtgtcagag

SEQ ID NO: 7518133 - DNA, 22 bp, Homo sapiens
gctgaggtttcaggagtggcag

SEQ ID NO: 7518134 - DNA, 22 bp, Homo sapiens
gctgaggtttcaggagtggcag

SEQ ID NO: 7518135 - DNA, 22 bp, Homo sapiens
gctgaggtgtcaccttgctggg

SEQ ID NO: 7518136 - DNA, 22 bp, Homo sapiens
gctgaggtgtcaccttgctggg

SEQ ID NO: 7518137 - DNA, 22 bp, Homo sapiens
gctgaggtgtcaccttgctggg

SEQ ID NO: 7518138 - DNA, 20 bp, Homo sapiens
gctgaggtttcttcctatat

SEQ ID NO: 7518139 - DNA, 22 bp, Homo sapiens
gctgaggttttctgcctgctca

SEQ ID NO: 7518140 - DNA, 20 bp, Homo sapiens
gctgaggtttcttcctatat

SEQ ID NO: 7518141 - DNA, 22 bp, Homo sapiens
gctgaggttttctgcctgctca

SEQ ID NO: 7518142 - DNA, 22 bp, Homo sapiens
gctgaggtttcaggagtggcag

SEQ ID NO: 7518143 - DNA, 20 bp, Homo sapiens
gctgaggtttcttcctatat

SEQ ID NO: 7518144 - DNA, 22 bp, Homo sapiens
gctgaggtttcaggagtggcag

SEQ ID NO: 7518145 - DNA, 22 bp, Homo sapiens
gctgagtcttgagcactgagca

SEQ ID NO: 7518146 - DNA, 22 bp, Homo sapiens
gctgaggttttctgcctgctca

SEQ ID NO: 7518147 - DNA, 22 bp, Homo sapiens
gctgaggttttctgcctgctca

SEQ ID NO: 7518148 - DNA, 22 bp, Homo sapiens
gctgagtcagattgcagtcttg

SEQ ID NO: 7518149 - DNA, 17 bp, Homo sapiens
gctgagtgcagggagtc

SEQ ID NO: 7518150 - DNA, 17 bp, Homo sapiens
gctgagtgcagggagtc

SEQ ID NO: 7518151 - DNA, 17 bp, Homo sapiens
gctgagtgcagggagtc

SEQ ID NO: 7518152 - DNA, 17 bp, Homo sapiens
gctgagtgcagggagtc

SEQ ID NO: 7518153 - DNA, 17 bp, Homo sapiens
gctgagtgcagggagtc

SEQ ID NO: 7518154 - DNA, 17 bp, Homo sapiens
gctgagtgcagggagtc

SEQ ID NO: 7518155 - DNA, 22 bp, Homo sapiens
gctgagtggagcagtcagcgct

SEQ ID NO: 7518156 - DNA, 22 bp, Homo sapiens
gctgagtggagcagtcagcgct

SEQ ID NO: 7518157 - DNA, 22 bp, Homo sapiens
gctgagtggagcagtcagcgct

SEQ ID NO: 7518158 - DNA, 22 bp, Homo sapiens
gctgagtgtaatgatggcagag

SEQ ID NO: 7518159 - DNA, 22 bp, Homo sapiens
gctgagtgtaatgatggcagag

SEQ ID NO: 7518160 - DNA, 22 bp, Homo sapiens
gctgagtgtaatgatggcagag

SEQ ID NO: 7518161 - DNA, 22 bp, Homo sapiens
gctgagtgtaatgatggcagag

SEQ ID NO: 7518162 - DNA, 22 bp, Homo sapiens
gctgagtgtaatgatggcagag

SEQ ID NO: 7518163 - DNA, 22 bp, Homo sapiens
gctgagttgaaagcagaggata

SEQ ID NO: 7518164 - DNA, 22 bp, Homo sapiens
gctgagttgaaagcagaggata

SEQ ID NO: 7518165 - DNA, 22 bp, Homo sapiens
gctgagtgtaatgatggcagag

SEQ ID NO: 7518166 - DNA, 22 bp, Homo sapiens
gctgagtgaggctgtcaaaatg

SEQ ID NO: 7518167 - DNA, 22 bp, Homo sapiens
gctgagtgaggaaaaggttata

SEQ ID NO: 7518168 - DNA, 22 bp, Homo sapiens
gctgagtgaaagtttgctgtgt

SEQ ID NO: 7518169 - DNA, 22 bp, Homo sapiens
gctgagtgaaagtttgctgtgt

SEQ ID NO: 7518170 - DNA, 22 bp, Homo sapiens
gctgagtgaggaaaaggttata

SEQ ID NO: 7518171 - DNA, 22 bp, Homo sapiens
gctgagtcttgcctgtgctgtc

SEQ ID NO: 7518172 - DNA, 22 bp, Homo sapiens
gctgagtgattcatacgctgct

SEQ ID NO: 7518173 - DNA, 22 bp, Homo sapiens
gctgagtgaggtccagagcttg

SEQ ID NO: 7518174 - DNA, 22 bp, Homo sapiens
gctgagtgaggtccagagcttg

SEQ ID NO: 7518175 - DNA, 22 bp, Homo sapiens
gctgagtgattgatattttagt

SEQ ID NO: 7518176 - DNA, 22 bp, Homo sapiens
gctgagtgattcatacgctgct

SEQ ID NO: 7518177 - DNA, 17 bp, Homo sapiens
gctgagtgcagggagtc

SEQ ID NO: 7518178 - DNA, 22 bp, Homo sapiens
gctgcaggcgcctgcggtctct

SEQ ID NO: 7518179 - DNA, 22 bp, Homo sapiens
gctgcaggcgcctgcggtctct

SEQ ID NO: 7518180 - DNA, 22 bp, Homo sapiens
gctgcaggcgcctgcggtctct

SEQ ID NO: 7518181 - DNA, 22 bp, Homo sapiens
gctgcaggcgcctgcggtctct

SEQ ID NO: 7518182 - DNA, 18 bp, Homo sapiens
gctgcaggcgcctgcggt

SEQ ID NO: 7518183 - DNA, 18 bp, Homo sapiens
gctgcaggcgcctgcggt

SEQ ID NO: 7518184 - DNA, 18 bp, Homo sapiens
gctgcaggcgcctgcggt

SEQ ID NO: 7518185 - DNA, 18 bp, Homo sapiens
gctgcaggcgcctgcggt

SEQ ID NO: 7518186 - DNA, 18 bp, Homo sapiens
gctgcaggcgcctgcggt

SEQ ID NO: 7518187 - DNA, 18 bp, Homo sapiens
gctgcaggcgcctgcggt

SEQ ID NO: 7518188 - DNA, 18 bp, Homo sapiens
gctgcaggccctccgagg

SEQ ID NO: 7518189 - DNA, 22 bp, Homo sapiens
gctgcaggcattttcctgggca

SEQ ID NO: 7518190 - DNA, 22 bp, Homo sapiens
gctgcaggcattttcctgggca

SEQ ID NO: 7518191 - DNA, 22 bp, Homo sapiens
gctgatagactgaatgttggga

SEQ ID NO: 7518192 - DNA, 22 bp, Homo sapiens
gctgataagaagacccatcctg

SEQ ID NO: 7518193 - DNA, 22 bp, Homo sapiens
gctgataaatagttgatgtacc

SEQ ID NO: 7518194 - DNA, 22 bp, Homo sapiens
gctgataaatagttgatgtacc

SEQ ID NO: 7518195 - DNA, 22 bp, Homo sapiens
gctgagttggagatcactttga

SEQ ID NO: 7518196 - DNA, 22 bp, Homo sapiens
gctgcaggcattttcctgggca

SEQ ID NO: 7518197 - DNA, 22 bp, Homo sapiens
gctgcaggcattttcctgggca

SEQ ID NO: 7518198 - DNA, 22 bp, Homo sapiens
gctgcaggcattttcctgggca

SEQ ID NO: 7518199 - DNA, 22 bp, Homo sapiens
gctgcaggcattttcctgggca

SEQ ID NO: 7518200 - DNA, 22 bp, Homo sapiens
gctgcaggcattttcctgggca

SEQ ID NO: 7518201 - DNA, 22 bp, Homo sapiens
gctgcaggcagaatctcccaat

SEQ ID NO: 7518202 - DNA, 22 bp, Homo sapiens
gctgcaggcagaatctcccaat

SEQ ID NO: 7518203 - DNA, 22 bp, Homo sapiens
gctgcagggctctcacaggggg

SEQ ID NO: 7518204 - DNA, 22 bp, Homo sapiens
gctgcagggctctcacaggggg

SEQ ID NO: 7518205 - DNA, 22 bp, Homo sapiens
gctgcagggctctcacaggggg

SEQ ID NO: 7518206 - DNA, 22 bp, Homo sapiens
gctgcagggctctcacaggggg

SEQ ID NO: 7518207 - DNA, 22 bp, Homo sapiens
gctgcagggctctcacaggggg

SEQ ID NO: 7518208 - DNA, 22 bp, Homo sapiens
gctgcagggctctcacaggggg

SEQ ID NO: 7518209 - DNA, 22 bp, Homo sapiens
gctgcagggctctcacaggggg

SEQ ID NO: 7518210 - DNA, 22 bp, Homo sapiens
gctgcagggctctcacaggggg

SEQ ID NO: 7518211 - DNA, 22 bp, Homo sapiens
gctgcaggggggtctggacttg

SEQ ID NO: 7518212 - DNA, 22 bp, Homo sapiens
gctgcaggggggtctggacttg

SEQ ID NO: 7518213 - DNA, 22 bp, Homo sapiens
gctgcaggggggtctggacttg

SEQ ID NO: 7518214 - DNA, 22 bp, Homo sapiens
gctgcaggggggtctggacttg

SEQ ID NO: 7518215 - DNA, 21 bp, Homo sapiens
gctgcagggcccagggcaccc

SEQ ID NO: 7518216 - DNA, 21 bp, Homo sapiens
gctgcagggcccagggcaccc

SEQ ID NO: 7518217 - DNA, 21 bp, Homo sapiens
gctgcagggcccagggcaccc

SEQ ID NO: 7518218 - DNA, 21 bp, Homo sapiens
gctgcagggcccagggcaccc

SEQ ID NO: 7518219 - DNA, 22 bp, Homo sapiens
gctgcagggagctggaaggctc

SEQ ID NO: 7518220 - DNA, 21 bp, Homo sapiens
gctgcagggcccagggcaccc

SEQ ID NO: 7518221 - DNA, 21 bp, Homo sapiens
gctgcagggcccagggcaccc

SEQ ID NO: 7518222 - DNA, 21 bp, Homo sapiens
gctgcagggcccagggcaccc

SEQ ID NO: 7518223 - DNA, 21 bp, Homo sapiens
gctgcagggcccagggcaccc

SEQ ID NO: 7518224 - DNA, 21 bp, Homo sapiens
gctgcagggcccagggcaccc

SEQ ID NO: 7518225 - DNA, 22 bp, Homo sapiens
gctgcagggagctggaaggctc

SEQ ID NO: 7518226 - DNA, 22 bp, Homo sapiens
gctgcagggagctggaaggctc

SEQ ID NO: 7518227 - DNA, 22 bp, Homo sapiens
gctgcagggagctggaaggctc

SEQ ID NO: 7518228 - DNA, 22 bp, Homo sapiens
gctgcagggagctggaaggctc

SEQ ID NO: 7518229 - DNA, 22 bp, Homo sapiens
gctgcagggagctggaaggctc

SEQ ID NO: 7518230 - DNA, 22 bp, Homo sapiens
gctgcagggagctggaaggctc

SEQ ID NO: 7518231 - DNA, 22 bp, Homo sapiens
gctgcagggagctggaaggctc

SEQ ID NO: 7518232 - DNA, 22 bp, Homo sapiens
gctgcaggctctgcaggaattg

SEQ ID NO: 7518233 - DNA, 22 bp, Homo sapiens
gctgcaggcggccgtggtggcg

SEQ ID NO: 7518234 - DNA, 22 bp, Homo sapiens
gctgcaggcggccgtggtggcg

SEQ ID NO: 7518235 - DNA, 22 bp, Homo sapiens
gctgcaggcggccgtggtggcg

SEQ ID NO: 7518236 - DNA, 22 bp, Homo sapiens
gctgcaggcggccgtggtggcg

SEQ ID NO: 7518237 - DNA, 22 bp, Homo sapiens
gctgcaggcggccgtggtggcg

SEQ ID NO: 7518238 - DNA, 22 bp, Homo sapiens
gctgcaggctctgcaggaattg

SEQ ID NO: 7518239 - DNA, 22 bp, Homo sapiens
gctgcaggctctgcaggaattg

SEQ ID NO: 7518240 - DNA, 22 bp, Homo sapiens
gctgcaggctctgcaggaattg

SEQ ID NO: 7518241 - DNA, 22 bp, Homo sapiens
gctgcaggctgtggcaggggag

SEQ ID NO: 7518242 - DNA, 22 bp, Homo sapiens
gctgcaggctgtggcaggggag

SEQ ID NO: 7518243 - DNA, 22 bp, Homo sapiens
gctgcaggctgtggcaggggag

SEQ ID NO: 7518244 - DNA, 22 bp, Homo sapiens
gctgcaggctgtggcaggggag

SEQ ID NO: 7518245 - DNA, 22 bp, Homo sapiens
gctgcaggctgtggcaggggag

SEQ ID NO: 7518246 - DNA, 22 bp, Homo sapiens
gctgcaggctgtggcaggggag

SEQ ID NO: 7518247 - DNA, 22 bp, Homo sapiens
gctgcaggctgtggcaggggag

SEQ ID NO: 7518248 - DNA, 22 bp, Homo sapiens
gctgcaggctgtggcaggggag

SEQ ID NO: 7518249 - DNA, 22 bp, Homo sapiens
gctgcaggctgtggcaggggag

SEQ ID NO: 7518250 - DNA, 22 bp, Homo sapiens
gctgcaggctgtggcaggggag

SEQ ID NO: 7518251 - DNA, 22 bp, Homo sapiens
gctgcaggctgtggcaggggag

SEQ ID NO: 7518252 - DNA, 22 bp, Homo sapiens
gctgcaggctgtggcaggggag

SEQ ID NO: 7518253 - DNA, 22 bp, Homo sapiens
gctgcagggaatgtatggattt

SEQ ID NO: 7518254 - DNA, 22 bp, Homo sapiens
gctgcagggaatgtatggattt

SEQ ID NO: 7518255 - DNA, 22 bp, Homo sapiens
gctgcagggagctggaaggctc

SEQ ID NO: 7518256 - DNA, 22 bp, Homo sapiens
gctgcagggagctggaaggctc

SEQ ID NO: 7518257 - DNA, 22 bp, Homo sapiens
gctgcagggagctggaaggctc

SEQ ID NO: 7518258 - DNA, 22 bp, Homo sapiens
gctgcagggagctggaaggctc

SEQ ID NO: 7518259 - DNA, 22 bp, Homo sapiens
gctgcagggagctggaaggctc

SEQ ID NO: 7518260 - DNA, 22 bp, Homo sapiens
gctgcctctgcgactctgggcg

SEQ ID NO: 7518261 - DNA, 22 bp, Homo sapiens
gctgcctctgcgactctgggcg

SEQ ID NO: 7518262 - DNA, 22 bp, Homo sapiens
gctgcctctgcgactctgggcg

SEQ ID NO: 7518263 - DNA, 22 bp, Homo sapiens
gctgcctctgcgactctgggcg

SEQ ID NO: 7518264 - DNA, 22 bp, Homo sapiens
gctgcctctgcgactctgggcg

SEQ ID NO: 7518265 - DNA, 22 bp, Homo sapiens
gctgcctctgcgactctgggcg

SEQ ID NO: 7518266 - DNA, 22 bp, Homo sapiens
gctgcctctgcgactctgggcg

SEQ ID NO: 7518267 - DNA, 22 bp, Homo sapiens
gctgcctctgtagctttggacc

SEQ ID NO: 7518268 - DNA, 22 bp, Homo sapiens
gctgcctctgtagctttggacc

SEQ ID NO: 7518269 - DNA, 22 bp, Homo sapiens
gctgcctctgtagctttggacc

SEQ ID NO: 7518270 - DNA, 22 bp, Homo sapiens
gctgcctctgcacagctcactc

SEQ ID NO: 7518271 - DNA, 22 bp, Homo sapiens
gctgcctctgcacagctcactc

SEQ ID NO: 7518272 - DNA, 22 bp, Homo sapiens
gctgcctctgcacagctcactc

SEQ ID NO: 7518273 - DNA, 22 bp, Homo sapiens
gctgcctctgcacagctcactc

SEQ ID NO: 7518274 - DNA, 22 bp, Homo sapiens
gctgcctctgcacagctcactc

SEQ ID NO: 7518275 - DNA, 22 bp, Homo sapiens
gctgcctctgcacagctcactc

SEQ ID NO: 7518276 - DNA, 22 bp, Homo sapiens
gctgcctctgcacagctcactc

SEQ ID NO: 7518277 - DNA, 22 bp, Homo sapiens
gctgcctctgcacagctcactc

SEQ ID NO: 7518278 - DNA, 22 bp, Homo sapiens
gctgcctctgcacagctcactc

SEQ ID NO: 7518279 - DNA, 22 bp, Homo sapiens
gctgcctctcctgagttgacag

SEQ ID NO: 7518280 - DNA, 22 bp, Homo sapiens
gctgcctctcctgagttgacag

SEQ ID NO: 7518281 - DNA, 22 bp, Homo sapiens
gctgcctctcctgagttgacag

SEQ ID NO: 7518282 - DNA, 22 bp, Homo sapiens
gctgcctcctgagatttgggca

SEQ ID NO: 7518283 - DNA, 22 bp, Homo sapiens
gctgcctcctgagatttgggca

SEQ ID NO: 7518284 - DNA, 22 bp, Homo sapiens
gctgcctcctgagatttgggca

SEQ ID NO: 7518285 - DNA, 22 bp, Homo sapiens
gctgcctcctgaaagcgctctg

SEQ ID NO: 7518286 - DNA, 22 bp, Homo sapiens
gctgcctcctgagatttgggca

SEQ ID NO: 7518287 - DNA, 22 bp, Homo sapiens
gctgcctctcctgagttgacag

SEQ ID NO: 7518288 - DNA, 22 bp, Homo sapiens
gctgcctctcctgagttgacag

SEQ ID NO: 7518289 - DNA, 22 bp, Homo sapiens
gctgcctctcctgagttgacag

SEQ ID NO: 7518290 - DNA, 22 bp, Homo sapiens
gctgcctcctgaaagcgctctg

SEQ ID NO: 7518291 - DNA, 22 bp, Homo sapiens
gctgcctcctgaaagcgctctg

SEQ ID NO: 7518292 - DNA, 22 bp, Homo sapiens
gctgcctcctgaaagcgctctg

SEQ ID NO: 7518293 - DNA, 22 bp, Homo sapiens
gctgcctcctgaaagcgctctg

SEQ ID NO: 7518294 - DNA, 22 bp, Homo sapiens
gctgcctcctgaaagcgctctg

SEQ ID NO: 7518295 - DNA, 23 bp, Homo sapiens
gctgcctcctacaaaagcccagc

SEQ ID NO: 7518296 - DNA, 23 bp, Homo sapiens
gctgcctcctacaaaagcccagc

SEQ ID NO: 7518297 - DNA, 23 bp, Homo sapiens
gctgcctcctacaaaagcccagc

SEQ ID NO: 7518298 - DNA, 22 bp, Homo sapiens
gctgcctcctgaaagcgctctg

SEQ ID NO: 7518299 - DNA, 22 bp, Homo sapiens
gctgcctcccccatggctggaa

SEQ ID NO: 7518300 - DNA, 22 bp, Homo sapiens
gctgcctcccccatggctggaa

SEQ ID NO: 7518301 - DNA, 22 bp, Homo sapiens
gctgcctcccccatggctggaa

SEQ ID NO: 7518302 - DNA, 22 bp, Homo sapiens
gctgcctcccccatggctggaa

SEQ ID NO: 7518303 - DNA, 22 bp, Homo sapiens
gctgcctcccccatggctggaa

SEQ ID NO: 7518304 - DNA, 22 bp, Homo sapiens
gctgcctcccccatggctggaa

SEQ ID NO: 7518305 - DNA, 22 bp, Homo sapiens
gctgcctccgccggctccacag

SEQ ID NO: 7518306 - DNA, 22 bp, Homo sapiens
gctgcctccgccggctccacag

SEQ ID NO: 7518307 - DNA, 22 bp, Homo sapiens
gctgcctccgccggctccacag

SEQ ID NO: 7518308 - DNA, 22 bp, Homo sapiens
gctgcctcccccatggctggaa

SEQ ID NO: 7518309 - DNA, 22 bp, Homo sapiens
gctgcctccgccggctccacag

SEQ ID NO: 7518310 - DNA, 22 bp, Homo sapiens
gctgcctccgccggctccacag

SEQ ID NO: 7518311 - DNA, 22 bp, Homo sapiens
gctgcctccgccggctccacag

SEQ ID NO: 7518312 - DNA, 22 bp, Homo sapiens
gctgcctccgccggctccacag

SEQ ID NO: 7518313 - DNA, 22 bp, Homo sapiens
gctgcctccgccggctccacag

SEQ ID NO: 7518314 - DNA, 22 bp, Homo sapiens
gctgcctccgccggctccacag

SEQ ID NO: 7518315 - DNA, 22 bp, Homo sapiens
gctgcctccgccggctccacag

SEQ ID NO: 7518316 - DNA, 23 bp, Homo sapiens
gctgcctcctacaaaagcccagc

SEQ ID NO: 7518317 - DNA, 22 bp, Homo sapiens
gctgcctccgccggctccacag

SEQ ID NO: 7518318 - DNA, 22 bp, Homo sapiens
gctgcctccactggctcccagt

SEQ ID NO: 7518319 - DNA, 22 bp, Homo sapiens
gctgcctccactggctcccagt

SEQ ID NO: 7518320 - DNA, 22 bp, Homo sapiens
gctgcctccactggctcccagt

SEQ ID NO: 7518321 - DNA, 22 bp, Homo sapiens
gctgcctccactggctcccagt

SEQ ID NO: 7518322 - DNA, 22 bp, Homo sapiens
gctgcctccactggctcccagt

SEQ ID NO: 7518323 - DNA, 22 bp, Homo sapiens
gctgcctccactggctcccagt

SEQ ID NO: 7518324 - DNA, 22 bp, Homo sapiens
gctgcctccactggctcccagt

SEQ ID NO: 7518325 - DNA, 22 bp, Homo sapiens
gctgcctccactggctcccagt

SEQ ID NO: 7518326 - DNA, 22 bp, Homo sapiens
gctgcctccactggctcccagt

SEQ ID NO: 7518327 - DNA, 22 bp, Homo sapiens
gctgcctccactggctcccagt

SEQ ID NO: 7518328 - DNA, 22 bp, Homo sapiens
gctgcctccactggctcccagt

SEQ ID NO: 7518329 - DNA, 22 bp, Homo sapiens
gctgcctcccagagccctgcag

SEQ ID NO: 7518330 - DNA, 22 bp, Homo sapiens
gctgcctcccagagccctgcag

SEQ ID NO: 7518331 - DNA, 22 bp, Homo sapiens
gctgcctcccagagccctgcag

SEQ ID NO: 7518332 - DNA, 22 bp, Homo sapiens
gctgcctcccagagccctgcag

SEQ ID NO: 7518333 - DNA, 22 bp, Homo sapiens
gctgcctcccagagccctgcag

SEQ ID NO: 7518334 - DNA, 22 bp, Homo sapiens
gctgcctcccagagccctgcag

SEQ ID NO: 7518335 - DNA, 22 bp, Homo sapiens
gctgcctcccagagccctgcag

SEQ ID NO: 7518336 - DNA, 22 bp, Homo sapiens
gctgcctctgtagctttggacc

SEQ ID NO: 7518337 - DNA, 22 bp, Homo sapiens
gctgcctctgtagctttggacc

SEQ ID NO: 7518338 - DNA, 22 bp, Homo sapiens
gctgcctctgtagctttggacc

SEQ ID NO: 7518339 - DNA, 23 bp, Homo sapiens
gctgcctctgttggtcttcagtt

SEQ ID NO: 7518340 - DNA, 23 bp, Homo sapiens
gctgcctctgttggtcttcagtt

SEQ ID NO: 7518341 - DNA, 23 bp, Homo sapiens
gctgcctctgttggtcttcagtt

SEQ ID NO: 7518342 - DNA, 23 bp, Homo sapiens
gctgcctctgttggtcttcagtt

SEQ ID NO: 7518343 - DNA, 23 bp, Homo sapiens
gctgcctctgttggtcttcagtt

SEQ ID NO: 7518344 - DNA, 23 bp, Homo sapiens
gctgcctctgttggtcttcagtt

SEQ ID NO: 7518345 - DNA, 22 bp, Homo sapiens
gctgcctctgtagctttggacc

SEQ ID NO: 7518346 - DNA, 22 bp, Homo sapiens
gctgcctgaagtgtctacactg

SEQ ID NO: 7518347 - DNA, 22 bp, Homo sapiens
gctgcctgaagtgtctacactg

SEQ ID NO: 7518348 - DNA, 22 bp, Homo sapiens
gctgcctgaagtgtctacactg

SEQ ID NO: 7518349 - DNA, 22 bp, Homo sapiens
gctgcctgaagtgtctacactg

SEQ ID NO: 7518350 - DNA, 22 bp, Homo sapiens
gctgcctgaagtgtctacactg

SEQ ID NO: 7518351 - DNA, 22 bp, Homo sapiens
gctgcctgaaatgttgcctagc

SEQ ID NO: 7518352 - DNA, 22 bp, Homo sapiens
gctgcctgaaatgttgcctagc

SEQ ID NO: 7518353 - DNA, 23 bp, Homo sapiens
gctgcctctgttggtcttcagtt

SEQ ID NO: 7518354 - DNA, 22 bp, Homo sapiens
gctgctggaacaaatcacccca

SEQ ID NO: 7518355 - DNA, 22 bp, Homo sapiens
gctgctggaacaaatcacccca

SEQ ID NO: 7518356 - DNA, 22 bp, Homo sapiens
gctgctggaacaaatcacccca

SEQ ID NO: 7518357 - DNA, 22 bp, Homo sapiens
gctgctgcttgaaggctcggag

SEQ ID NO: 7518358 - DNA, 22 bp, Homo sapiens
gctgctggaagcatgcgatgaa

SEQ ID NO: 7518359 - DNA, 22 bp, Homo sapiens
gctgctggaagcatgcgatgaa

SEQ ID NO: 7518360 - DNA, 22 bp, Homo sapiens
gctgctggaacaaatcacccca

SEQ ID NO: 7518361 - DNA, 22 bp, Homo sapiens
gctgctggaacaaatcacccca

SEQ ID NO: 7518362 - DNA, 22 bp, Homo sapiens
gctgctggaacaaatcacccca

SEQ ID NO: 7518363 - DNA, 19 bp, Homo sapiens
gctgctggctctggctgga

SEQ ID NO: 7518364 - DNA, 19 bp, Homo sapiens
gctgctggctctggctgga

SEQ ID NO: 7518365 - DNA, 22 bp, Homo sapiens
gctgctggcgctgggcgtccgg

SEQ ID NO: 7518366 - DNA, 22 bp, Homo sapiens
gctgctggcgctgggcgtccgg

SEQ ID NO: 7518367 - DNA, 22 bp, Homo sapiens
gctgctggcgctgggcgtccgg

SEQ ID NO: 7518368 - DNA, 22 bp, Homo sapiens
gctgctggcgctgggcgtccgg

SEQ ID NO: 7518369 - DNA, 22 bp, Homo sapiens
gctgctggaagcatgcgatgaa

SEQ ID NO: 7518370 - DNA, 22 bp, Homo sapiens
gctgctggaagcatgcgatgaa

SEQ ID NO: 7518371 - DNA, 22 bp, Homo sapiens
gctgctggaagcatgcgatgaa

SEQ ID NO: 7518372 - DNA, 22 bp, Homo sapiens
gctgctggaagcatgcgatgaa

SEQ ID NO: 7518373 - DNA, 19 bp, Homo sapiens
gctgctggctctggctgga

SEQ ID NO: 7518374 - DNA, 19 bp, Homo sapiens
gctgctggctctggctgga

SEQ ID NO: 7518375 - DNA, 19 bp, Homo sapiens
gctgctggctctggctgga

SEQ ID NO: 7518376 - DNA, 19 bp, Homo sapiens
gctgctggctctggctgga

SEQ ID NO: 7518377 - DNA, 22 bp, Homo sapiens
gctgctggcttcctgctgtttt

SEQ ID NO: 7518378 - DNA, 22 bp, Homo sapiens
gctgctggcttcctgctgtttt

SEQ ID NO: 7518379 - DNA, 19 bp, Homo sapiens
gctgctggctctggctgga

SEQ ID NO: 7518380 - DNA, 22 bp, Homo sapiens
gctgctggcttcctgctgtttt

SEQ ID NO: 7518381 - DNA, 19 bp, Homo sapiens
gctgctggctctggctgga

SEQ ID NO: 7518382 - DNA, 19 bp, Homo sapiens
gctgctggctctggctgga

SEQ ID NO: 7518383 - DNA, 22 bp, Homo sapiens
gctgctgggatcctgggtctca

SEQ ID NO: 7518384 - DNA, 22 bp, Homo sapiens
gctgctgggatcctgggtctca

SEQ ID NO: 7518385 - DNA, 22 bp, Homo sapiens
gctgctgggaatgaacagtgtt

SEQ ID NO: 7518386 - DNA, 22 bp, Homo sapiens
gctgctgggaatgaacagtgtt

SEQ ID NO: 7518387 - DNA, 22 bp, Homo sapiens
gctgctgggaatgaacagtgtt

SEQ ID NO: 7518388 - DNA, 22 bp, Homo sapiens
gctgctgggaatgaacagtgtt

SEQ ID NO: 7518389 - DNA, 22 bp, Homo sapiens
gctgctgggaatgaacagtgtt

SEQ ID NO: 7518390 - DNA, 22 bp, Homo sapiens
gctgctgggaatgaacagtgtt

SEQ ID NO: 7518391 - DNA, 22 bp, Homo sapiens
gctgctggcttcctgctgtttt

SEQ ID NO: 7518392 - DNA, 22 bp, Homo sapiens
gctgctggcttcctgctgtttt

SEQ ID NO: 7518393 - DNA, 22 bp, Homo sapiens
gctgctggcttcctgctgtttt

SEQ ID NO: 7518394 - DNA, 22 bp, Homo sapiens
gctgctgggcaccccctgagct

SEQ ID NO: 7518395 - DNA, 22 bp, Homo sapiens
gctgctgggcaccccctgagct

SEQ ID NO: 7518396 - DNA, 22 bp, Homo sapiens
gctgctgggcaccccctgagct

SEQ ID NO: 7518397 - DNA, 22 bp, Homo sapiens
gctgctgggcaccccctgagct

SEQ ID NO: 7518398 - DNA, 22 bp, Homo sapiens
gctgctgggcaccccctgagct

SEQ ID NO: 7518399 - DNA, 22 bp, Homo sapiens
gctgctggggccttccctcggg

SEQ ID NO: 7518400 - DNA, 22 bp, Homo sapiens
gctgctggggccttccctcggg

SEQ ID NO: 7518401 - DNA, 22 bp, Homo sapiens
gctgctggggccttccctcggg

SEQ ID NO: 7518402 - DNA, 22 bp, Homo sapiens
gctgctgggatcctgggtctca

SEQ ID NO: 7518403 - DNA, 22 bp, Homo sapiens
gctgctgggatcctgggtctca

SEQ ID NO: 7518404 - DNA, 22 bp, Homo sapiens
gctgctgggatcctgggtctca

SEQ ID NO: 7518405 - DNA, 22 bp, Homo sapiens
gctgctggggtcacatggtaag

SEQ ID NO: 7518406 - DNA, 22 bp, Homo sapiens
gctgctgggggaacagttaaaa

SEQ ID NO: 7518407 - DNA, 22 bp, Homo sapiens
gctgctggggtcacatggtaag

SEQ ID NO: 7518408 - DNA, 22 bp, Homo sapiens
gctgctggggtcacatggtaag

SEQ ID NO: 7518409 - DNA, 22 bp, Homo sapiens
gctgctggggtcacatggtaag

SEQ ID NO: 7518410 - DNA, 22 bp, Homo sapiens
gctgctggggtcacatggtaag

SEQ ID NO: 7518411 - DNA, 22 bp, Homo sapiens
gctgctgggggaacagttaaaa

SEQ ID NO: 7518412 - DNA, 22 bp, Homo sapiens
gctgctgggggaacagttaaaa

SEQ ID NO: 7518413 - DNA, 22 bp, Homo sapiens
gctgctggggtcacatggtaag

SEQ ID NO: 7518414 - DNA, 22 bp, Homo sapiens
gctgctggggccttccctcggg

SEQ ID NO: 7518415 - DNA, 22 bp, Homo sapiens
gctgctggggccttccctcggg

SEQ ID NO: 7518416 - DNA, 22 bp, Homo sapiens
gctggaggggtaataggatggg

SEQ ID NO: 7518417 - DNA, 22 bp, Homo sapiens
gctggaggggtaataggatggg

SEQ ID NO: 7518418 - DNA, 22 bp, Homo sapiens
gctggaggggtaataggatggg

SEQ ID NO: 7518419 - DNA, 22 bp, Homo sapiens
gctggaggggtaataggatggg

SEQ ID NO: 7518420 - DNA, 22 bp, Homo sapiens
gctggaggggtaataggatggg

SEQ ID NO: 7518421 - DNA, 22 bp, Homo sapiens
gctggaggggtaataggatggg

SEQ ID NO: 7518422 - DNA, 22 bp, Homo sapiens
gctggaggggtaataggatggg

SEQ ID NO: 7518423 - DNA, 22 bp, Homo sapiens
gctggaggggtaataggatggg

SEQ ID NO: 7518424 - DNA, 22 bp, Homo sapiens
gctggagcttgagaggacaggg

SEQ ID NO: 7518425 - DNA, 22 bp, Homo sapiens
gctggagcttgagaggacaggg

SEQ ID NO: 7518426 - DNA, 22 bp, Homo sapiens
gctggagcttgagaggacaggg

SEQ ID NO: 7518427 - DNA, 22 bp, Homo sapiens
gctggagcttgagaggacaggg

SEQ ID NO: 7518428 - DNA, 22 bp, Homo sapiens
gctggagcttgagaggacaggg

SEQ ID NO: 7518429 - DNA, 22 bp, Homo sapiens
gctggagcttgagaggacaggg

SEQ ID NO: 7518430 - DNA, 22 bp, Homo sapiens
gctggagcttgagaggacaggg

SEQ ID NO: 7518431 - DNA, 22 bp, Homo sapiens
gctggagcttgagaggacaggg

SEQ ID NO: 7518432 - DNA, 22 bp, Homo sapiens
gctggagctgcagcctgggcct

SEQ ID NO: 7518433 - DNA, 22 bp, Homo sapiens
gctggagctgcagcctgggcct

SEQ ID NO: 7518434 - DNA, 22 bp, Homo sapiens
gctgctgtctcatgcgatgcgg

SEQ ID NO: 7518435 - DNA, 22 bp, Homo sapiens
gctgctgtctcatgcgatgcgg

SEQ ID NO: 7518436 - DNA, 22 bp, Homo sapiens
gctgctgtctcatgcgatgcgg

SEQ ID NO: 7518437 - DNA, 22 bp, Homo sapiens
gctgctgtccttagggagttct

SEQ ID NO: 7518438 - DNA, 22 bp, Homo sapiens
gctgctgtccttcaagtctgcg

SEQ ID NO: 7518439 - DNA, 22 bp, Homo sapiens
gctgctgtcagtggtggcagtt

SEQ ID NO: 7518440 - DNA, 22 bp, Homo sapiens
gctgctgtcagtggtggcagtt

SEQ ID NO: 7518441 - DNA, 22 bp, Homo sapiens
gctgctgtcagtggtggcagtt

SEQ ID NO: 7518442 - DNA, 22 bp, Homo sapiens
gctgctgtccttagggagttct

SEQ ID NO: 7518443 - DNA, 22 bp, Homo sapiens
gctgctgtcagtggtggcagtt

SEQ ID NO: 7518444 - DNA, 18 bp, Homo sapiens
gctgctggtggagggagc

SEQ ID NO: 7518445 - DNA, 18 bp, Homo sapiens
gctgctggtggagggagc

SEQ ID NO: 7518446 - DNA, 18 bp, Homo sapiens
gctgctggtggagggagc

SEQ ID NO: 7518447 - DNA, 22 bp, Homo sapiens
gctgctgtacttggggggtgct

SEQ ID NO: 7518448 - DNA, 18 bp, Homo sapiens
gctgctggtggagggagc

SEQ ID NO: 7518449 - DNA, 18 bp, Homo sapiens
gctgctggtggagggagc

SEQ ID NO: 7518450 - DNA, 22 bp, Homo sapiens
gctgctgtcacccacatctgtc

SEQ ID NO: 7518451 - DNA, 22 bp, Homo sapiens
gctgctgtcacggtgctaaggg

SEQ ID NO: 7518452 - DNA, 22 bp, Homo sapiens
gctgctgtcagtctgaatctga

SEQ ID NO: 7518453 - DNA, 22 bp, Homo sapiens
gctgctgtcagcaggccttgtt

SEQ ID NO: 7518454 - DNA, 22 bp, Homo sapiens
gctgctggggtggagaaacgct

SEQ ID NO: 7518455 - DNA, 22 bp, Homo sapiens
gctgctggggtggagaaacgct

SEQ ID NO: 7518456 - DNA, 22 bp, Homo sapiens
gctgctggggtggagaaacgct

SEQ ID NO: 7518457 - DNA, 22 bp, Homo sapiens
gctgctggggtggagaaacgct

SEQ ID NO: 7518458 - DNA, 22 bp, Homo sapiens
gctgctgggtccctctgtgcca

SEQ ID NO: 7518459 - DNA, 22 bp, Homo sapiens
gctgctgggtccctctgtgcca

SEQ ID NO: 7518460 - DNA, 22 bp, Homo sapiens
gctgctgggtccctctgtgcca

SEQ ID NO: 7518461 - DNA, 22 bp, Homo sapiens
gctgctggtcctcagagctcat

SEQ ID NO: 7518462 - DNA, 22 bp, Homo sapiens
gctgctgggtccctctgtgcca

SEQ ID NO: 7518463 - DNA, 22 bp, Homo sapiens
gctgctgggtccctctgtgcca

SEQ ID NO: 7518464 - DNA, 18 bp, Homo sapiens
gctgctggtggagggagc

SEQ ID NO: 7518465 - DNA, 22 bp, Homo sapiens
gctgctggtcctcagagctcat

SEQ ID NO: 7518466 - DNA, 22 bp, Homo sapiens
gctgctggtcctcagagctcat

SEQ ID NO: 7518467 - DNA, 22 bp, Homo sapiens
gctgctggtcctcagagctcat

SEQ ID NO: 7518468 - DNA, 22 bp, Homo sapiens
gctgctggtcctcagagctcat

SEQ ID NO: 7518469 - DNA, 22 bp, Homo sapiens
gctgctggtcctcagagctcat

SEQ ID NO: 7518470 - DNA, 22 bp, Homo sapiens
gctgctggtcctcagagctcat

SEQ ID NO: 7518471 - DNA, 22 bp, Homo sapiens
gctgctggtcctcagagctcat

SEQ ID NO: 7518472 - DNA, 22 bp, Homo sapiens
gctgctggtcctcagagctcat

SEQ ID NO: 7518473 - DNA, 22 bp, Homo sapiens
gctgctggtcctcagagctcat

SEQ ID NO: 7518474 - DNA, 22 bp, Homo sapiens
gctggaggtagggaggtcctgt

SEQ ID NO: 7518475 - DNA, 22 bp, Homo sapiens
gctggaggtagggaggtcctgt

SEQ ID NO: 7518476 - DNA, 22 bp, Homo sapiens
gctggaggtagggaggtcctgt

SEQ ID NO: 7518477 - DNA, 22 bp, Homo sapiens
gctggaggtagggaggtcctgt

SEQ ID NO: 7518478 - DNA, 22 bp, Homo sapiens
gctggaggtagggaggtcctgt

SEQ ID NO: 7518479 - DNA, 22 bp, Homo sapiens
gctggaggtagggaggtcctgt

SEQ ID NO: 7518480 - DNA, 22 bp, Homo sapiens
gctggaggtagggaggtcctgt

SEQ ID NO: 7518481 - DNA, 22 bp, Homo sapiens
gctggaggtagggaggtcctgt

SEQ ID NO: 7518482 - DNA, 22 bp, Homo sapiens
gctggaggtggtgagaaaaggt

SEQ ID NO: 7518483 - DNA, 22 bp, Homo sapiens
gctggaggtttcacctgagttt

SEQ ID NO: 7518484 - DNA, 22 bp, Homo sapiens
gctggaggtttcacctgagttt

SEQ ID NO: 7518485 - DNA, 22 bp, Homo sapiens
gctggaggtttcacctgagttt

SEQ ID NO: 7518486 - DNA, 22 bp, Homo sapiens
gctggaggtttcacctgagttt

SEQ ID NO: 7518487 - DNA, 22 bp, Homo sapiens
gctggagtacatctttggcggc

SEQ ID NO: 7518488 - DNA, 22 bp, Homo sapiens
gctggagtaggaccatgcttga

SEQ ID NO: 7518489 - DNA, 22 bp, Homo sapiens
gctggagtaggaccatgcttga

SEQ ID NO: 7518490 - DNA, 22 bp, Homo sapiens
gctggagtccagtggcatgatc

SEQ ID NO: 7518491 - DNA, 22 bp, Homo sapiens
gctggagtccagtggcatgatc

SEQ ID NO: 7518492 - DNA, 22 bp, Homo sapiens
gctggagtccagtggcatgatc

SEQ ID NO: 7518493 - DNA, 22 bp, Homo sapiens
gctggagtatctggggaaggag

SEQ ID NO: 7518494 - DNA, 22 bp, Homo sapiens
gctggagtatctggggaaggag

SEQ ID NO: 7518495 - DNA, 22 bp, Homo sapiens
gctggagtatctggggaaggag

SEQ ID NO: 7518496 - DNA, 22 bp, Homo sapiens
gctggagtatctggggaaggag

SEQ ID NO: 7518497 - DNA, 22 bp, Homo sapiens
gctggagtgagtatgtgtagtc

SEQ ID NO: 7518498 - DNA, 22 bp, Homo sapiens
gctggagtgagtatgtgtagtc

SEQ ID NO: 7518499 - DNA, 22 bp, Homo sapiens
gctggagtgatgcctgtgtctc

SEQ ID NO: 7518500 - DNA, 22 bp, Homo sapiens
gctggagtgatgcctgtgtctc

SEQ ID NO: 7518501 - DNA, 22 bp, Homo sapiens
gctggagtgagtatgtgtagtc

SEQ ID NO: 7518502 - DNA, 22 bp, Homo sapiens
gctggagtcttgaaagtggact

SEQ ID NO: 7518503 - DNA, 22 bp, Homo sapiens
gctggagtcttgaaagtggact

SEQ ID NO: 7518504 - DNA, 22 bp, Homo sapiens
gctggagtctggaggtgtgcca

SEQ ID NO: 7518505 - DNA, 22 bp, Homo sapiens
gctggagtctacattcaagaat

SEQ ID NO: 7518506 - DNA, 22 bp, Homo sapiens
gctggagtctggaggtgtgcca

SEQ ID NO: 7518507 - DNA, 22 bp, Homo sapiens
gctggagtctggaggtgtgcca

SEQ ID NO: 7518508 - DNA, 22 bp, Homo sapiens
gctggagtctggaggtgtgcca

SEQ ID NO: 7518509 - DNA, 22 bp, Homo sapiens
gctggagtccctgcctttcctt

SEQ ID NO: 7518510 - DNA, 22 bp, Homo sapiens
gctggagtgcagttgcacagtc

SEQ ID NO: 7518511 - DNA, 22 bp, Homo sapiens
gctggagtgcagttgcacagtc

SEQ ID NO: 7518512 - DNA, 22 bp, Homo sapiens
gctggagtgatgcctgtgtctc

SEQ ID NO: 7518513 - DNA, 22 bp, Homo sapiens
gctggagtgcagttgcacagtc

SEQ ID NO: 7518514 - DNA, 22 bp, Homo sapiens
gctggagtgcagttgcacagtc

SEQ ID NO: 7518515 - DNA, 22 bp, Homo sapiens
gctggagtgctggagtgcagtg

SEQ ID NO: 7518516 - DNA, 22 bp, Homo sapiens
gctggagtgctgaggtgcagtg

SEQ ID NO: 7518517 - DNA, 22 bp, Homo sapiens
gctggagtgctgaggtgcagtg

SEQ ID NO: 7518518 - DNA, 22 bp, Homo sapiens
gctggagtgctgaggtgcagtg

SEQ ID NO: 7518519 - DNA, 22 bp, Homo sapiens
gctggagtgctgaggtgcagtg

SEQ ID NO: 7518520 - DNA, 22 bp, Homo sapiens
gctggagtgctggagtgcagtg

SEQ ID NO: 7518521 - DNA, 22 bp, Homo sapiens
gctggagtgctggagtgcagtg

SEQ ID NO: 7518522 - DNA, 22 bp, Homo sapiens
gctggagtgctggagtgcagtg

SEQ ID NO: 7518523 - DNA, 22 bp, Homo sapiens
gctggagtgctggagtgcagtg

SEQ ID NO: 7518524 - DNA, 22 bp, Homo sapiens
gctggagttagaactagcctgg

SEQ ID NO: 7518525 - DNA, 22 bp, Homo sapiens
gctggagttagaactagcctgg

SEQ ID NO: 7518526 - DNA, 22 bp, Homo sapiens
gctggagttagaactagcctgg

SEQ ID NO: 7518527 - DNA, 22 bp, Homo sapiens
gctggagttagaactagcctgg

SEQ ID NO: 7518528 - DNA, 22 bp, Homo sapiens
gctggagttaggtgggcttgaa

SEQ ID NO: 7518529 - DNA, 22 bp, Homo sapiens
gctggagttaggtgggcttgaa

SEQ ID NO: 7518530 - DNA, 22 bp, Homo sapiens
gctggagttaggtgggcttgaa

SEQ ID NO: 7518531 - DNA, 22 bp, Homo sapiens
gctggatccctgtgggagtggt

SEQ ID NO: 7518532 - DNA, 22 bp, Homo sapiens
gctggatccctgtgggagtggt

SEQ ID NO: 7518533 - DNA, 19 bp, Homo sapiens
gctggatggatcctggagt

SEQ ID NO: 7518534 - DNA, 22 bp, Homo sapiens
gctggcagggtggttgagagag

SEQ ID NO: 7518535 - DNA, 22 bp, Homo sapiens
gctggcagggtggttgagagag

SEQ ID NO: 7518536 - DNA, 19 bp, Homo sapiens
gctggatggatcctggagt

SEQ ID NO: 7518537 - DNA, 22 bp, Homo sapiens
gctggcagggtggttgagagag

SEQ ID NO: 7518538 - DNA, 22 bp, Homo sapiens
gctggcagggtggttgagagag

SEQ ID NO: 7518539 - DNA, 22 bp, Homo sapiens
gctggcagggttctcactgaaa

SEQ ID NO: 7518540 - DNA, 22 bp, Homo sapiens
gctggcagggtggttgagagag

SEQ ID NO: 7518541 - DNA, 22 bp, Homo sapiens
gctggcagggtggttgagagag

SEQ ID NO: 7518542 - DNA, 22 bp, Homo sapiens
gctggagttggcaaggcatgta

SEQ ID NO: 7518543 - DNA, 22 bp, Homo sapiens
gctggagttggcaaggcatgta

SEQ ID NO: 7518544 - DNA, 22 bp, Homo sapiens
gctggagttggcaaggcatgta

SEQ ID NO: 7518545 - DNA, 22 bp, Homo sapiens
gctggagttaggtgggcttgaa

SEQ ID NO: 7518546 - DNA, 22 bp, Homo sapiens
gctggagttggcaaggcatgta

SEQ ID NO: 7518547 - DNA, 22 bp, Homo sapiens
gctggagttggcaaggcatgta

SEQ ID NO: 7518548 - DNA, 22 bp, Homo sapiens
gctggagttgtgggtttactaa

SEQ ID NO: 7518549 - DNA, 22 bp, Homo sapiens
gctggatcaagtccttcaccca

SEQ ID NO: 7518550 - DNA, 22 bp, Homo sapiens
gctggatcatatggtggttcta

SEQ ID NO: 7518551 - DNA, 22 bp, Homo sapiens
gctggcaggtccaagatagagc

SEQ ID NO: 7518552 - DNA, 22 bp, Homo sapiens
gctggcaggtccaagatagagc

SEQ ID NO: 7518553 - DNA, 22 bp, Homo sapiens
gctggcaggtaaagccccgggg

SEQ ID NO: 7518554 - DNA, 22 bp, Homo sapiens
gctggcaggtccaagatagagc

SEQ ID NO: 7518555 - DNA, 22 bp, Homo sapiens
gctggcaggtccaagatagagc

SEQ ID NO: 7518556 - DNA, 22 bp, Homo sapiens
gctggcagggttctcactgaaa

SEQ ID NO: 7518557 - DNA, 22 bp, Homo sapiens
gctggcagggttctcactgaaa

SEQ ID NO: 7518558 - DNA, 22 bp, Homo sapiens
gctggcaggtaaagccccgggg

SEQ ID NO: 7518559 - DNA, 22 bp, Homo sapiens
gctggcagggttctcactgaaa

SEQ ID NO: 7518560 - DNA, 22 bp, Homo sapiens
gctggcaggtaaagccccgggg

SEQ ID NO: 7518561 - DNA, 22 bp, Homo sapiens
gctggcagggttctcactgaaa

SEQ ID NO: 7518562 - DNA, 22 bp, Homo sapiens
gctggcaggtaaagccccgggg

SEQ ID NO: 7518563 - DNA, 22 bp, Homo sapiens
gctggcagtcccatcagctggg

SEQ ID NO: 7518564 - DNA, 22 bp, Homo sapiens
gctggcagtgtattgttagctg

SEQ ID NO: 7518565 - DNA, 22 bp, Homo sapiens
gctggcagtcccatcagctggg

SEQ ID NO: 7518566 - DNA, 22 bp, Homo sapiens
gctggcagtcccatcagctggg

SEQ ID NO: 7518567 - DNA, 22 bp, Homo sapiens
gctggcagtcccatcagctggg

SEQ ID NO: 7518568 - DNA, 22 bp, Homo sapiens
gctggcagtcccatcagctggg

SEQ ID NO: 7518569 - DNA, 22 bp, Homo sapiens
gctggcagtcccatcagctggg

SEQ ID NO: 7518570 - DNA, 22 bp, Homo sapiens
gctggcagtcccatcagctggg

SEQ ID NO: 7518571 - DNA, 22 bp, Homo sapiens
gctggcagtaaagggtttggca

SEQ ID NO: 7518572 - DNA, 22 bp, Homo sapiens
gctggcagtaaagggtttggca

SEQ ID NO: 7518573 - DNA, 22 bp, Homo sapiens
gctggcagtaaagggtttggca

SEQ ID NO: 7518574 - DNA, 22 bp, Homo sapiens
gctggcaggtccaagatagagc

SEQ ID NO: 7518575 - DNA, 22 bp, Homo sapiens
gctggcaggtccaagatagagc

SEQ ID NO: 7518576 - DNA, 22 bp, Homo sapiens
gctggcagtttcctcaccgagg

SEQ ID NO: 7518577 - DNA, 22 bp, Homo sapiens
gctggcagtttcctcaccgagg

SEQ ID NO: 7518578 - DNA, 22 bp, Homo sapiens
gctggcagtttcctcaccgagg

SEQ ID NO: 7518579 - DNA, 22 bp, Homo sapiens
gctggcagtgtgaatgacaagc

SEQ ID NO: 7518580 - DNA, 22 bp, Homo sapiens
gctggcagtgtattgttagctg

SEQ ID NO: 7518581 - DNA, 22 bp, Homo sapiens
gctggcagtgtgaatgacaagc

SEQ ID NO: 7518582 - DNA, 22 bp, Homo sapiens
gctggcagtgtgaatgacaagc

SEQ ID NO: 7518583 - DNA, 22 bp, Homo sapiens
gctggcagtgtattgttagctg

SEQ ID NO: 7518584 - DNA, 22 bp, Homo sapiens
gctggccaaagtgtacctggag

SEQ ID NO: 7518585 - DNA, 22 bp, Homo sapiens
gctggccaaagtgtacctggag

SEQ ID NO: 7518586 - DNA, 22 bp, Homo sapiens
gctggccaaagtgtacctggag

SEQ ID NO: 7518587 - DNA, 22 bp, Homo sapiens
gctggccaaagtgtacctggag

SEQ ID NO: 7518588 - DNA, 22 bp, Homo sapiens
gctggcatggagactctgggtc

SEQ ID NO: 7518589 - DNA, 22 bp, Homo sapiens
gctggcattacaggagagaacc

SEQ ID NO: 7518590 - DNA, 22 bp, Homo sapiens
gctggcatggagactctgggtc

SEQ ID NO: 7518591 - DNA, 22 bp, Homo sapiens
gctggcatggagactctgggtc

SEQ ID NO: 7518592 - DNA, 22 bp, Homo sapiens
gctggcatggagactctgggtc

SEQ ID NO: 7518593 - DNA, 22 bp, Homo sapiens
gctggcatcactggcttcggtg

SEQ ID NO: 7518594 - DNA, 22 bp, Homo sapiens
gctggcatcactggcttcggtg

SEQ ID NO: 7518595 - DNA, 22 bp, Homo sapiens
gctggcagtttcctcaccgagg

SEQ ID NO: 7518596 - DNA, 22 bp, Homo sapiens
gctttacataaacatttattat

SEQ ID NO: 7518597 - DNA, 22 bp, Homo sapiens
gctttacatgatttctcaccct

SEQ ID NO: 7518598 - DNA, 22 bp, Homo sapiens
gctttacagagaaagtttgcct

SEQ ID NO: 7518599 - DNA, 22 bp, Homo sapiens
gctttaatgcaatttcacctca

SEQ ID NO: 7518600 - DNA, 22 bp, Homo sapiens
gctttacaagtggtgcagatta

SEQ ID NO: 7518601 - DNA, 22 bp, Homo sapiens
gctttacaagtggtgcagatta

SEQ ID NO: 7518602 - DNA, 22 bp, Homo sapiens
gcttgtttctatttatcaagta

SEQ ID NO: 7518603 - DNA, 22 bp, Homo sapiens
gcttgtttgtgatttctccaga

SEQ ID NO: 7518604 - DNA, 22 bp, Homo sapiens
gctttaaacctctactctgtcc

SEQ ID NO: 7518605 - DNA, 22 bp, Homo sapiens
gctttaaacctctactctgtcc

SEQ ID NO: 7518606 - DNA, 22 bp, Homo sapiens
gcttgtttgtgcctctgcagaa

SEQ ID NO: 7518607 - DNA, 23 bp, Homo sapiens
gcttgtctagtgaattcatatct

SEQ ID NO: 7518608 - DNA, 23 bp, Homo sapiens
gcttgtgtatacaggaggccacc

SEQ ID NO: 7518609 - DNA, 22 bp, Homo sapiens
gcttgtttctatttatcaagta

SEQ ID NO: 7518610 - DNA, 23 bp, Homo sapiens
gcttgtgtatacaggaggccacc

SEQ ID NO: 7518611 - DNA, 22 bp, Homo sapiens
gcttgttgaattgcattttcca

SEQ ID NO: 7518612 - DNA, 22 bp, Homo sapiens
gcttgtttgtgatttctccaga

SEQ ID NO: 7518613 - DNA, 22 bp, Homo sapiens
gcttgtttgtgatttctccaga

SEQ ID NO: 7518614 - DNA, 22 bp, Homo sapiens
gctttaaatggcttgcccaagt

SEQ ID NO: 7518615 - DNA, 22 bp, Homo sapiens
gctttaaatggcttgcccaagt

SEQ ID NO: 7518616 - DNA, 22 bp, Homo sapiens
gctttaaatggcttgcccaagt

SEQ ID NO: 7518617 - DNA, 22 bp, Homo sapiens
gctttaaacctctactctgtcc

SEQ ID NO: 7518618 - DNA, 22 bp, Homo sapiens
gctttaaacctctactctgtcc

SEQ ID NO: 7518619 - DNA, 22 bp, Homo sapiens
gctttaaacctctactctgtcc

SEQ ID NO: 7518620 - DNA, 22 bp, Homo sapiens
gctttaaacctctactctgtcc

SEQ ID NO: 7518621 - DNA, 22 bp, Homo sapiens
gctttaaacctctactctgtcc

SEQ ID NO: 7518622 - DNA, 22 bp, Homo sapiens
gctttaaacctctactctgtcc

SEQ ID NO: 7518623 - DNA, 20 bp, Homo sapiens
gctttaagccaaaatgtgaa

SEQ ID NO: 7518624 - DNA, 22 bp, Homo sapiens
gctttaatgaagtcacgcaaag

SEQ ID NO: 7518625 - DNA, 22 bp, Homo sapiens
gctttaacacaaaagcagccaa

SEQ ID NO: 7518626 - DNA, 22 bp, Homo sapiens
gctttaaatggcttgcccaagt

SEQ ID NO: 7518627 - DNA, 22 bp, Homo sapiens
gctttaaatggcttgcccaagt

SEQ ID NO: 7518628 - DNA, 22 bp, Homo sapiens
gcttaaatcccaatgctagacc

SEQ ID NO: 7518629 - DNA, 22 bp, Homo sapiens
gcttaaatcccaatgctagacc

SEQ ID NO: 7518630 - DNA, 22 bp, Homo sapiens
gcttaaattgtttgtggatagt

SEQ ID NO: 7518631 - DNA, 22 bp, Homo sapiens
gcttaaattgtttgtggatagt

SEQ ID NO: 7518632 - DNA, 22 bp, Homo sapiens
gcttggaagtaggattgggaga

SEQ ID NO: 7518633 - DNA, 22 bp, Homo sapiens
gcttggaagtaggattgggaga

SEQ ID NO: 7518634 - DNA, 22 bp, Homo sapiens
gcttggagaagatgttctcaat

SEQ ID NO: 7518635 - DNA, 22 bp, Homo sapiens
gcttggagaagatgttctcaat

SEQ ID NO: 7518636 - DNA, 22 bp, Homo sapiens
gcttggagatgggggatgagcc

SEQ ID NO: 7518637 - DNA, 22 bp, Homo sapiens
gcttggagtagaatgcattctt

SEQ ID NO: 7518638 - DNA, 22 bp, Homo sapiens
gcttggagatgggggatgagcc

SEQ ID NO: 7518639 - DNA, 22 bp, Homo sapiens
gcttggagatgggggatgagcc

SEQ ID NO: 7518640 - DNA, 22 bp, Homo sapiens
gcttggcacacttggacctgag

SEQ ID NO: 7518641 - DNA, 22 bp, Homo sapiens
gcttggcacacttggacctgag

SEQ ID NO: 7518642 - DNA, 21 bp, Homo sapiens
gcttggagtagcttgaaggag

SEQ ID NO: 7518643 - DNA, 22 bp, Homo sapiens
gcttggagtagaatgcattctt

SEQ ID NO: 7518644 - DNA, 22 bp, Homo sapiens
gcttggagtagaatgcattctt

SEQ ID NO: 7518645 - DNA, 21 bp, Homo sapiens
gcttggagtagcttgaaggag

SEQ ID NO: 7518646 - DNA, 21 bp, Homo sapiens
gcttggagtagcttgaaggag

SEQ ID NO: 7518647 - DNA, 22 bp, Homo sapiens
gcttggggtcatgaggctgctg

SEQ ID NO: 7518648 - DNA, 22 bp, Homo sapiens
gcttggggtcatgaggctgctg

SEQ ID NO: 7518649 - DNA, 22 bp, Homo sapiens
gcttggggtcatgaggctgctg

SEQ ID NO: 7518650 - DNA, 20 bp, Homo sapiens
gcttggcaggttttgttgcc

SEQ ID NO: 7518651 - DNA, 22 bp, Homo sapiens
gcttggggtcatgaggctgctg

SEQ ID NO: 7518652 - DNA, 20 bp, Homo sapiens
gcttggcacctgctcattgt

SEQ ID NO: 7518653 - DNA, 20 bp, Homo sapiens
gcttggcacctgctcattgt

SEQ ID NO: 7518654 - DNA, 22 bp, Homo sapiens
gcttggcagcaacaggcatccc

SEQ ID NO: 7518655 - DNA, 22 bp, Homo sapiens
gcttggcagcaacaggcatccc

SEQ ID NO: 7518656 - DNA, 22 bp, Homo sapiens
gcttggcaggtctgggattgtt

SEQ ID NO: 7518657 - DNA, 22 bp, Homo sapiens
gcttggcagggcctgctggagc

SEQ ID NO: 7518658 - DNA, 22 bp, Homo sapiens
gcttggcagggcctgctggagc

SEQ ID NO: 7518659 - DNA, 22 bp, Homo sapiens
gcttgtctctcagccccagtca

SEQ ID NO: 7518660 - DNA, 23 bp, Homo sapiens
gcttgtctagtgaattcatatct

SEQ ID NO: 7518661 - DNA, 21 bp, Homo sapiens
gcttggttttggttacttgcc

SEQ ID NO: 7518662 - DNA, 21 bp, Homo sapiens
gcttggttttggttacttgcc

SEQ ID NO: 7518663 - DNA, 22 bp, Homo sapiens
gcttgtcatagttgttacaaat

SEQ ID NO: 7518664 - DNA, 22 bp, Homo sapiens
gcttgtcatagttgttacaaat

SEQ ID NO: 7518665 - DNA, 22 bp, Homo sapiens
gcttggtttctaacttttcata

SEQ ID NO: 7518666 - DNA, 22 bp, Homo sapiens
gcttggtttctaacttttcata

SEQ ID NO: 7518667 - DNA, 18 bp, Homo sapiens
gcttggtttccacaaacc

SEQ ID NO: 7518668 - DNA, 22 bp, Homo sapiens
gcttaaaagccacttagtctat

SEQ ID NO: 7518669 - DNA, 22 bp, Homo sapiens
gcttaaaagccacttagtctat

SEQ ID NO: 7518670 - DNA, 22 bp, Homo sapiens
gcttaaaatccatgatttttac

SEQ ID NO: 7518671 - DNA, 22 bp, Homo sapiens
gctgtttctttggcaaactgat

SEQ ID NO: 7518672 - DNA, 22 bp, Homo sapiens
gctgtttgaggcacatgattaa

SEQ ID NO: 7518673 - DNA, 22 bp, Homo sapiens
gcttaaaagccacttagtctat

SEQ ID NO: 7518674 - DNA, 22 bp, Homo sapiens
gcttaaaagccacttagtctat

SEQ ID NO: 7518675 - DNA, 22 bp, Homo sapiens
gctgtttctgtggtgtatagcc

SEQ ID NO: 7518676 - DNA, 22 bp, Homo sapiens
gctgtttctttcctggcacttg

SEQ ID NO: 7518677 - DNA, 22 bp, Homo sapiens
gctgtttctttcctggcacttg

SEQ ID NO: 7518678 - DNA, 22 bp, Homo sapiens
gctgtttctttgatgatggaat

SEQ ID NO: 7518679 - DNA, 22 bp, Homo sapiens
gctgtttctgagtagctaggct

SEQ ID NO: 7518680 - DNA, 22 bp, Homo sapiens
gctgtttctcttgagtcaaaat

SEQ ID NO: 7518681 - DNA, 22 bp, Homo sapiens
gctgtttctgagtagctaggct

SEQ ID NO: 7518682 - DNA, 22 bp, Homo sapiens
gctgtttctccaggtcaggaag

SEQ ID NO: 7518683 - DNA, 22 bp, Homo sapiens
gctgtttctaccagaagaatca

SEQ ID NO: 7518684 - DNA, 22 bp, Homo sapiens
gctgtttctaccagaagaatca

SEQ ID NO: 7518685 - DNA, 22 bp, Homo sapiens
gctgtttcgggtggaggtggag

SEQ ID NO: 7518686 - DNA, 22 bp, Homo sapiens
gctgtttcctacatggtgttat

SEQ ID NO: 7518687 - DNA, 22 bp, Homo sapiens
gctgtttctaagctggttccta

SEQ ID NO: 7518688 - DNA, 22 bp, Homo sapiens
gctgtttcctacatggtgttat

SEQ ID NO: 7518689 - DNA, 22 bp, Homo sapiens
gctgtttcctacatggtgttat

SEQ ID NO: 7518690 - DNA, 22 bp, Homo sapiens
gctgtttcggcctcctggggaa

SEQ ID NO: 7518691 - DNA, 22 bp, Homo sapiens
gctgtttccccttcacagtggc

SEQ ID NO: 7518692 - DNA, 23 bp, Homo sapiens
gctgtttccccatgtgctgaagg

SEQ ID NO: 7518693 - DNA, 22 bp, Homo sapiens
gctgtttccatttaagtgaatc

SEQ ID NO: 7518694 - DNA, 22 bp, Homo sapiens
gctgtttccatttaagtgaatc

SEQ ID NO: 7518695 - DNA, 22 bp, Homo sapiens
gctgtttccccttcacagtggc

SEQ ID NO: 7518696 - DNA, 22 bp, Homo sapiens
gctgtttccagacaatgtcttt

SEQ ID NO: 7518697 - DNA, 22 bp, Homo sapiens
gctgtttagtggcagagtcaga

SEQ ID NO: 7518698 - DNA, 22 bp, Homo sapiens
gctgtttagatccacactgttg

SEQ ID NO: 7518699 - DNA, 22 bp, Homo sapiens
gctgtttagctgggtaaatgga

SEQ ID NO: 7518700 - DNA, 22 bp, Homo sapiens
gctgttggcgaggagctcagct

SEQ ID NO: 7518701 - DNA, 22 bp, Homo sapiens
gctgtttacatgaaaaatgctc

SEQ ID NO: 7518702 - DNA, 22 bp, Homo sapiens
gctgtgttttatgttaggttaa

SEQ ID NO: 7518703 - DNA, 22 bp, Homo sapiens
gctgttggggccagcaggtcat

SEQ ID NO: 7518704 - DNA, 22 bp, Homo sapiens
gctgttggggccagcaggtcat

SEQ ID NO: 7518705 - DNA, 22 bp, Homo sapiens
gctgtttaaatttaagtgtttc

SEQ ID NO: 7518706 - DNA, 22 bp, Homo sapiens
gctgttggcgaggagctcagct

SEQ ID NO: 7518707 - DNA, 22 bp, Homo sapiens
gctgtgtgttcaataatgtgat

SEQ ID NO: 7518708 - DNA, 22 bp, Homo sapiens
gctgtgtgttcaataatgtgat

SEQ ID NO: 7518709 - DNA, 22 bp, Homo sapiens
gctgtgtgttcaataatgtgat

SEQ ID NO: 7518710 - DNA, 22 bp, Homo sapiens
gctgtgtgttcaataatgtgat

SEQ ID NO: 7518711 - DNA, 22 bp, Homo sapiens
gctgtgtgttcaataatgtgat

SEQ ID NO: 7518712 - DNA, 22 bp, Homo sapiens
gctgtgtgttcaataatgtgat

SEQ ID NO: 7518713 - DNA, 22 bp, Homo sapiens
gctgtgtgttcaataatgtgat

SEQ ID NO: 7518714 - DNA, 22 bp, Homo sapiens
gctgtgtgttcaataatgtgat

SEQ ID NO: 7518715 - DNA, 22 bp, Homo sapiens
gctgtgtgctgggcatggcact

SEQ ID NO: 7518716 - DNA, 22 bp, Homo sapiens
gctgtgtgctgggcatggcact

SEQ ID NO: 7518717 - DNA, 22 bp, Homo sapiens
gctgtgtgctgggcatggcact

SEQ ID NO: 7518718 - DNA, 22 bp, Homo sapiens
gctgtgtgctgggcatggcact

SEQ ID NO: 7518719 - DNA, 22 bp, Homo sapiens
gctgtgtgctgggcatggcact

SEQ ID NO: 7518720 - DNA, 22 bp, Homo sapiens
gctgtgtgctctggtctttctt

SEQ ID NO: 7518721 - DNA, 22 bp, Homo sapiens
gctgtgtgctcacgtagtggaa

SEQ ID NO: 7518722 - DNA, 22 bp, Homo sapiens
gctgtgtgctcacgtagtggaa

SEQ ID NO: 7518723 - DNA, 22 bp, Homo sapiens
gctgtgtgctcacgtagtggaa

SEQ ID NO: 7518724 - DNA, 22 bp, Homo sapiens
gctgtgtgctgggcatggcact

SEQ ID NO: 7518725 - DNA, 22 bp, Homo sapiens
gctgtgtggcaaagggattaca

SEQ ID NO: 7518726 - DNA, 22 bp, Homo sapiens
gctgtgtgctgggcatggcact

SEQ ID NO: 7518727 - DNA, 22 bp, Homo sapiens
gctgtgtgctgggcatggcact

SEQ ID NO: 7518728 - DNA, 22 bp, Homo sapiens
gctgtgtggctgtgccgtcacg

SEQ ID NO: 7518729 - DNA, 22 bp, Homo sapiens
gctgtgtggctgtgccgtcacg

SEQ ID NO: 7518730 - DNA, 22 bp, Homo sapiens
gctgtgtggcaaagggattaca

SEQ ID NO: 7518731 - DNA, 22 bp, Homo sapiens
gctgtgtggctgtgccgtcacg

SEQ ID NO: 7518732 - DNA, 22 bp, Homo sapiens
gctgtgtggctgtgccgtcacg

SEQ ID NO: 7518733 - DNA, 19 bp, Homo sapiens
gctttagtttactcatcta

SEQ ID NO: 7518734 - DNA, 22 bp, Homo sapiens
gctttaggaatgaataaaaatc

SEQ ID NO: 7518735 - DNA, 19 bp, Homo sapiens
gctttagtttactcatcta

SEQ ID NO: 7518736 - DNA, 23 bp, Homo sapiens
gctttatagttctcccaacatta

SEQ ID NO: 7518737 - DNA, 23 bp, Homo sapiens
gctttatagttctcccaacatta

SEQ ID NO: 7518738 - DNA, 22 bp, Homo sapiens
gctttatagccctattacatga

SEQ ID NO: 7518739 - DNA, 22 bp, Homo sapiens
gctttatagccctattacatga

SEQ ID NO: 7518740 - DNA, 22 bp, Homo sapiens
gctttatagccctattacatga

SEQ ID NO: 7518741 - DNA, 22 bp, Homo sapiens
gctttatagccctattacatga

SEQ ID NO: 7518742 - DNA, 22 bp, Homo sapiens
gctttatagccctattacatga

SEQ ID NO: 7518743 - DNA, 22 bp, Homo sapiens
gctttatagccctattacatga

SEQ ID NO: 7518744 - DNA, 22 bp, Homo sapiens
gctttagatactcccaatgtcc

SEQ ID NO: 7518745 - DNA, 22 bp, Homo sapiens
gctttagatagatttagtcttt

SEQ ID NO: 7518746 - DNA, 22 bp, Homo sapiens
gctttagatctgactttctgtg

SEQ ID NO: 7518747 - DNA, 22 bp, Homo sapiens
gctttactgagatgacacaggg

SEQ ID NO: 7518748 - DNA, 22 bp, Homo sapiens
gctttacattttggaaaggtga

SEQ ID NO: 7518749 - DNA, 22 bp, Homo sapiens
gctttactgtctggaaagtttg

SEQ ID NO: 7518750 - DNA, 22 bp, Homo sapiens
gctttagaaatatcactgtgga

SEQ ID NO: 7518751 - DNA, 22 bp, Homo sapiens
gctttagaaatatcactgtgga

SEQ ID NO: 7518752 - DNA, 22 bp, Homo sapiens
gctttagacataaagttcttca

SEQ ID NO: 7518753 - DNA, 22 bp, Homo sapiens
gctttagaagacactctgtttt

SEQ ID NO: 7518754 - DNA, 22 bp, Homo sapiens
gctttagagcccagcttggtgg

SEQ ID NO: 7518755 - DNA, 22 bp, Homo sapiens
gctttatccgcttgacccttac

SEQ ID NO: 7518756 - DNA, 22 bp, Homo sapiens
gctttgggggctgcagtgcgtg

SEQ ID NO: 7518757 - DNA, 22 bp, Homo sapiens
gctttgggggctgcagtgcgtg

SEQ ID NO: 7518758 - DNA, 22 bp, Homo sapiens
gctttgggggctgcagtgcgtg

SEQ ID NO: 7518759 - DNA, 22 bp, Homo sapiens
gctttgggagtcagatttgcgc

SEQ ID NO: 7518760 - DNA, 22 bp, Homo sapiens
gctttgggggctgcagtgcgtg

SEQ ID NO: 7518761 - DNA, 22 bp, Homo sapiens
gctttggatgtgtgcctgaggt

SEQ ID NO: 7518762 - DNA, 22 bp, Homo sapiens
gctttgggagtcagatttgcgc

SEQ ID NO: 7518763 - DNA, 22 bp, Homo sapiens
gctttggatgtgtgcctgaggt

SEQ ID NO: 7518764 - DNA, 22 bp, Homo sapiens
gctttggagttaggactcggcc

SEQ ID NO: 7518765 - DNA, 22 bp, Homo sapiens
gctttggatgtgtgcctgaggt

SEQ ID NO: 7518766 - DNA, 22 bp, Homo sapiens
gctttatggattgtaaactgca

SEQ ID NO: 7518767 - DNA, 22 bp, Homo sapiens
gctttgggtgtcctctgggcct

SEQ ID NO: 7518768 - DNA, 22 bp, Homo sapiens
gctttgggtgtcctctgggcct

SEQ ID NO: 7518769 - DNA, 22 bp, Homo sapiens
gctttgggtgtcctctgggcct

SEQ ID NO: 7518770 - DNA, 22 bp, Homo sapiens
gctttggtacctcctgctgatc

SEQ ID NO: 7518771 - DNA, 22 bp, Homo sapiens
gctttggtacctcctgctgatc

SEQ ID NO: 7518772 - DNA, 22 bp, Homo sapiens
gctttggtcaggtgtccagccc

SEQ ID NO: 7518773 - DNA, 22 bp, Homo sapiens
gctttggtcaggtgtccagccc

SEQ ID NO: 7518774 - DNA, 22 bp, Homo sapiens
gctttggtcaggtgtccagccc

SEQ ID NO: 7518775 - DNA, 22 bp, Homo sapiens
gctttggtcaggtgtccagccc

SEQ ID NO: 7518776 - DNA, 22 bp, Homo sapiens
gctttggtcttctagctgtgag

SEQ ID NO: 7518777 - DNA, 22 bp, Homo sapiens
gctttggtcttctagctgtgag

SEQ ID NO: 7518778 - DNA, 22 bp, Homo sapiens
gctttggtcttctagctgtgag

SEQ ID NO: 7518779 - DNA, 22 bp, Homo sapiens
gctttggtgatacttgctggct

SEQ ID NO: 7518780 - DNA, 22 bp, Homo sapiens
gctttggttcaaccaggcaatt

SEQ ID NO: 7518781 - DNA, 22 bp, Homo sapiens
gctttgtgaattattactcaca

SEQ ID NO: 7518782 - DNA, 22 bp, Homo sapiens
gctttggttcaaccaggcaatt

SEQ ID NO: 7518783 - DNA, 22 bp, Homo sapiens
gctttgtgaattattactcaca

SEQ ID NO: 7518784 - DNA, 18 bp, Homo sapiens
gctttttagtgcatcttc

SEQ ID NO: 7518785 - DNA, 18 bp, Homo sapiens
gctttttagtgcatcttc

SEQ ID NO: 7518786 - DNA, 22 bp, Homo sapiens
gctttttcaaatgaaagctggt

SEQ ID NO: 7518787 - DNA, 22 bp, Homo sapiens
gctttttcaaatgaaagctggt

SEQ ID NO: 7518788 - DNA, 21 bp, Homo sapiens
gctttttgtatggcccaggaa

SEQ ID NO: 7518789 - DNA, 21 bp, Homo sapiens
gctttttgtatggcccaggaa

SEQ ID NO: 7518790 - DNA, 21 bp, Homo sapiens
gctttttgtatggcccaggaa

SEQ ID NO: 7518791 - DNA, 20 bp, Homo sapiens
gctttttctaatagcagtcc

SEQ ID NO: 7518792 - DNA, 22 bp, Homo sapiens
gcttttttgggatgcctgcctt

SEQ ID NO: 7518793 - DNA, 23 bp, Homo sapiens
ggaaaaacactgtgtcttggcag

SEQ ID NO: 7518794 - DNA, 22 bp, Homo sapiens
gcttttttgctattgaagtggt

SEQ ID NO: 7518795 - DNA, 22 bp, Homo sapiens
gcttttttgggatgcctgcctt

SEQ ID NO: 7518796 - DNA, 22 bp, Homo sapiens
gcttttttgggatgcctgcctt

SEQ ID NO: 7518797 - DNA, 22 bp, Homo sapiens
gcttttttgctattgaagtggt

SEQ ID NO: 7518798 - DNA, 22 bp, Homo sapiens
gcttttttgctattgaagtggt

SEQ ID NO: 7518799 - DNA, 22 bp, Homo sapiens
gcttttttaggtaagacccagg

SEQ ID NO: 7518800 - DNA, 19 bp, Homo sapiens
gctttttgttgtcaaaggt

SEQ ID NO: 7518801 - DNA, 22 bp, Homo sapiens
gctttttcaaatgaaagctggt

SEQ ID NO: 7518802 - DNA, 19 bp, Homo sapiens
gctttttgttgtcaaaggt

SEQ ID NO: 7518803 - DNA, 19 bp, Homo sapiens
gctttttgttgtcaaaggt

SEQ ID NO: 7518804 - DNA, 19 bp, Homo sapiens
gctttttgttgtcaaaggt

SEQ ID NO: 7518805 - DNA, 22 bp, Homo sapiens
gcttttttaggtaagacccagg

SEQ ID NO: 7518806 - DNA, 22 bp, Homo sapiens
gcttttttaggtaagacccagg

SEQ ID NO: 7518807 - DNA, 22 bp, Homo sapiens
gcttttggacctctgatgtttc

SEQ ID NO: 7518808 - DNA, 22 bp, Homo sapiens
gcttttgtcatggtgactcagt

SEQ ID NO: 7518809 - DNA, 22 bp, Homo sapiens
gcttttgtcattcaaatgctct

SEQ ID NO: 7518810 - DNA, 22 bp, Homo sapiens
gcttttgtcatggtgactcagt

SEQ ID NO: 7518811 - DNA, 22 bp, Homo sapiens
gcttttgcctacatcttggtct

SEQ ID NO: 7518812 - DNA, 22 bp, Homo sapiens
gcttttggacctctgatgtttc

SEQ ID NO: 7518813 - DNA, 19 bp, Homo sapiens
gcttttctccttcaagcca

SEQ ID NO: 7518814 - DNA, 22 bp, Homo sapiens
gcttttcttcagcagcctgatg

SEQ ID NO: 7518815 - DNA, 22 bp, Homo sapiens
gcttttcttcagcagcctgatg

SEQ ID NO: 7518816 - DNA, 22 bp, Homo sapiens
gcttttcttcagcagcctgatg

SEQ ID NO: 7518817 - DNA, 22 bp, Homo sapiens
gcttttgttccacagttttgaa

SEQ ID NO: 7518818 - DNA, 22 bp, Homo sapiens
gcttttgttccacagttttgaa

SEQ ID NO: 7518819 - DNA, 22 bp, Homo sapiens
gcttttgtggctgtcttcattg

SEQ ID NO: 7518820 - DNA, 22 bp, Homo sapiens
gcttttgtggtgatggagaggc

SEQ ID NO: 7518821 - DNA, 22 bp, Homo sapiens
gcttttgtggtgatggagaggc

SEQ ID NO: 7518822 - DNA, 18 bp, Homo sapiens
gctttttagtgcatcttc

SEQ ID NO: 7518823 - DNA, 18 bp, Homo sapiens
gctttttagtgcatcttc

SEQ ID NO: 7518824 - DNA, 22 bp, Homo sapiens
gcttttgtgagctctcactttg

SEQ ID NO: 7518825 - DNA, 22 bp, Homo sapiens
gcttttgtgagctctcactttg

SEQ ID NO: 7518826 - DNA, 22 bp, Homo sapiens
gcttttgtgagattaagctact

SEQ ID NO: 7518827 - DNA, 22 bp, Homo sapiens
gcttttgtcattcaaatgctct

SEQ ID NO: 7518828 - DNA, 22 bp, Homo sapiens
gcttttcatgacaactcagcga

SEQ ID NO: 7518829 - DNA, 22 bp, Homo sapiens
gcttttcctgactttccattag

SEQ ID NO: 7518830 - DNA, 22 bp, Homo sapiens
gcttttcatgacaactcagcga

SEQ ID NO: 7518831 - DNA, 22 bp, Homo sapiens
gcttttcatagataaaattcta

SEQ ID NO: 7518832 - DNA, 22 bp, Homo sapiens
gcttttcctgactttccattag

SEQ ID NO: 7518833 - DNA, 22 bp, Homo sapiens
gcttttctagctagaacatccg

SEQ ID NO: 7518834 - DNA, 22 bp, Homo sapiens
gcttttctagctagaacatccg

SEQ ID NO: 7518835 - DNA, 22 bp, Homo sapiens
gcttttatttcttcacaaaagt

SEQ ID NO: 7518836 - DNA, 22 bp, Homo sapiens
gcttttatttcttcacaaaagt

SEQ ID NO: 7518837 - DNA, 22 bp, Homo sapiens
gcttttcatagataaaattcta

SEQ ID NO: 7518838 - DNA, 22 bp, Homo sapiens
gcttttctataagaactttcaa

SEQ ID NO: 7518839 - DNA, 22 bp, Homo sapiens
gcttttctataagaactttcaa

SEQ ID NO: 7518840 - DNA, 22 bp, Homo sapiens
gcttttctataagaactttcaa

SEQ ID NO: 7518841 - DNA, 22 bp, Homo sapiens
gcttttctagctagaacatccg

SEQ ID NO: 7518842 - DNA, 22 bp, Homo sapiens
gcttttctagctagaacatccg

SEQ ID NO: 7518843 - DNA, 22 bp, Homo sapiens
gcttttctataagaactttcaa

SEQ ID NO: 7518844 - DNA, 22 bp, Homo sapiens
gcttttctccttagtgtccctg

SEQ ID NO: 7518845 - DNA, 22 bp, Homo sapiens
gcttttctccttagtgtccctg

SEQ ID NO: 7518846 - DNA, 22 bp, Homo sapiens
gcttttctccttagtgtccctg

SEQ ID NO: 7518847 - DNA, 19 bp, Homo sapiens
gcttttctccttcaagcca

SEQ ID NO: 7518848 - DNA, 19 bp, Homo sapiens
gcttttctccttcaagcca

SEQ ID NO: 7518849 - DNA, 19 bp, Homo sapiens
gcttttctccttcaagcca

SEQ ID NO: 7518850 - DNA, 22 bp, Homo sapiens
gcttttaattagttgcttccat

SEQ ID NO: 7518851 - DNA, 22 bp, Homo sapiens
gcttttaattagttgcttccat

SEQ ID NO: 7518852 - DNA, 22 bp, Homo sapiens
gcttttaattagttgcttccat

SEQ ID NO: 7518853 - DNA, 23 bp, Homo sapiens
gcttttaaacctgtgactgccgc

SEQ ID NO: 7518854 - DNA, 22 bp, Homo sapiens
gcttttaattagttgcttccat

SEQ ID NO: 7518855 - DNA, 22 bp, Homo sapiens
gcttttatgcacataagggtca

SEQ ID NO: 7518856 - DNA, 22 bp, Homo sapiens
gcttttacaagagccagagagg

SEQ ID NO: 7518857 - DNA, 22 bp, Homo sapiens
gcttttatgcacataagggtca

SEQ ID NO: 7518858 - DNA, 22 bp, Homo sapiens
gcttttatgcacataagggtca

SEQ ID NO: 7518859 - DNA, 22 bp, Homo sapiens
gcttttatgcacataagggtca

SEQ ID NO: 7518860 - DNA, 22 bp, Homo sapiens
gcttttatgcacataagggtca

SEQ ID NO: 7518861 - DNA, 22 bp, Homo sapiens
gctttgtgtgaagtccatggcg

SEQ ID NO: 7518862 - DNA, 23 bp, Homo sapiens
gcttttaaacctgtgactgccgc

SEQ ID NO: 7518863 - DNA, 19 bp, Homo sapiens
gcttttattgctcaggtgc

SEQ ID NO: 7518864 - DNA, 19 bp, Homo sapiens
gcttttattgctcaggtgc

SEQ ID NO: 7518865 - DNA, 19 bp, Homo sapiens
gcttttattgctcaggtgc

SEQ ID NO: 7518866 - DNA, 19 bp, Homo sapiens
gcttttattgctcaggtgc

SEQ ID NO: 7518867 - DNA, 22 bp, Homo sapiens
gcttttattgtctttacgacga

SEQ ID NO: 7518868 - DNA, 22 bp, Homo sapiens
gcttttattgtctttacgacga

SEQ ID NO: 7518869 - DNA, 22 bp, Homo sapiens
gcttttattgtctttacgacga

SEQ ID NO: 7518870 - DNA, 22 bp, Homo sapiens
gcttttattgtctttacgacga

SEQ ID NO: 7518871 - DNA, 22 bp, Homo sapiens
gcttttattgtctttacgacga

SEQ ID NO: 7518872 - DNA, 22 bp, Homo sapiens
gcttttatttcttcacaaaagt

SEQ ID NO: 7518873 - DNA, 22 bp, Homo sapiens
gcttttatttcttcacaaaagt

SEQ ID NO: 7518874 - DNA, 22 bp, Homo sapiens
gcttttattgtctttacgacga

SEQ ID NO: 7518875 - DNA, 22 bp, Homo sapiens
gcttttatttcttcacaaaagt

SEQ ID NO: 7518876 - DNA, 22 bp, Homo sapiens
gcttttatttcttcacaaaagt

SEQ ID NO: 7518877 - DNA, 22 bp, Homo sapiens
gctggccaggaagagtctcaga

SEQ ID NO: 7518878 - DNA, 22 bp, Homo sapiens
gctggccaggaagagtctcaga

SEQ ID NO: 7518879 - DNA, 22 bp, Homo sapiens
gctggccagggctgctcgcgga

SEQ ID NO: 7518880 - DNA, 22 bp, Homo sapiens
gctggccagggctgctcgcgga

SEQ ID NO: 7518881 - DNA, 22 bp, Homo sapiens
gctggtcagagagaaaggaggc

SEQ ID NO: 7518882 - DNA, 22 bp, Homo sapiens
gctggtcagagagaaaggaggc

SEQ ID NO: 7518883 - DNA, 22 bp, Homo sapiens
gctggtccacatcctggtacgt

SEQ ID NO: 7518884 - DNA, 22 bp, Homo sapiens
gctggtccaattatgaactgtt

SEQ ID NO: 7518885 - DNA, 22 bp, Homo sapiens
gctggtccacatcctggtacgt

SEQ ID NO: 7518886 - DNA, 22 bp, Homo sapiens
gctggtcagggagggcacccat

SEQ ID NO: 7518887 - DNA, 22 bp, Homo sapiens
gctggtccactccctggaggct

SEQ ID NO: 7518888 - DNA, 22 bp, Homo sapiens
gctggtccagggcctctgtggg

SEQ ID NO: 7518889 - DNA, 22 bp, Homo sapiens
gctggtccactccctggaggct

SEQ ID NO: 7518890 - DNA, 22 bp, Homo sapiens
gctggtccactccctggaggct

SEQ ID NO: 7518891 - DNA, 22 bp, Homo sapiens
gctggtccactccctggaggct

SEQ ID NO: 7518892 - DNA, 22 bp, Homo sapiens
gctggtccagggcctctgtggg

SEQ ID NO: 7518893 - DNA, 22 bp, Homo sapiens
gctggtccattggcactgctca

SEQ ID NO: 7518894 - DNA, 22 bp, Homo sapiens
gctggtcccaatgtgtttcctt

SEQ ID NO: 7518895 - DNA, 22 bp, Homo sapiens
gctgtacagtttactaggtggg

SEQ ID NO: 7518896 - DNA, 19 bp, Homo sapiens
gctgtacagtaaggagaca

SEQ ID NO: 7518897 - DNA, 22 bp, Homo sapiens
gctgtacatcacaatttgctgt

SEQ ID NO: 7518898 - DNA, 22 bp, Homo sapiens
gctgtacatcacaatttgctgt

SEQ ID NO: 7518899 - DNA, 22 bp, Homo sapiens
gctgtacatcacaatttgctgt

SEQ ID NO: 7518900 - DNA, 22 bp, Homo sapiens
gctgtacagggttatcctttcc

SEQ ID NO: 7518901 - DNA, 22 bp, Homo sapiens
gctgtacagggttatcctttcc

SEQ ID NO: 7518902 - DNA, 19 bp, Homo sapiens
gctgtacagtaaggagaca

SEQ ID NO: 7518903 - DNA, 19 bp, Homo sapiens
gctgtacagtaaggagaca

SEQ ID NO: 7518904 - DNA, 23 bp, Homo sapiens
gctgtacaggaaccagtttggag

SEQ ID NO: 7518905 - DNA, 22 bp, Homo sapiens
gctggtcccaatgtgtttcctt

SEQ ID NO: 7518906 - DNA, 22 bp, Homo sapiens
gctgtacattctgcacaggccc

SEQ ID NO: 7518907 - DNA, 22 bp, Homo sapiens
gctgtacattctgcacaggccc

SEQ ID NO: 7518908 - DNA, 22 bp, Homo sapiens
gctgtacattctgcacaggccc

SEQ ID NO: 7518909 - DNA, 22 bp, Homo sapiens
gctgtacagtttactaggtggg

SEQ ID NO: 7518910 - DNA, 22 bp, Homo sapiens
gctgtacattctgtgggtttgg

SEQ ID NO: 7518911 - DNA, 22 bp, Homo sapiens
gctgtacattctgtgggtttgg

SEQ ID NO: 7518912 - DNA, 22 bp, Homo sapiens
gctgtacattctgcacaggccc

SEQ ID NO: 7518913 - DNA, 22 bp, Homo sapiens
gctgtacatttgtgtacacttg

SEQ ID NO: 7518914 - DNA, 22 bp, Homo sapiens
gctgtacctccatcagcacctc

SEQ ID NO: 7518915 - DNA, 19 bp, Homo sapiens
gctgtaccctgaaaactct

SEQ ID NO: 7518916 - DNA, 22 bp, Homo sapiens
gctggccacactgctgatggag

SEQ ID NO: 7518917 - DNA, 22 bp, Homo sapiens
gctggccacactgctgatggag

SEQ ID NO: 7518918 - DNA, 22 bp, Homo sapiens
gctggccacactgctgatggag

SEQ ID NO: 7518919 - DNA, 22 bp, Homo sapiens
gctggccacactgctgatggag

SEQ ID NO: 7518920 - DNA, 22 bp, Homo sapiens
gctggccacactgctgatggag

SEQ ID NO: 7518921 - DNA, 22 bp, Homo sapiens
gctggccaaagtgtacctggag

SEQ ID NO: 7518922 - DNA, 22 bp, Homo sapiens
gctggccacactgctgatggag

SEQ ID NO: 7518923 - DNA, 22 bp, Homo sapiens
gctggccacactgctgatggag

SEQ ID NO: 7518924 - DNA, 22 bp, Homo sapiens
gctggccacagatccccaggga

SEQ ID NO: 7518925 - DNA, 22 bp, Homo sapiens
gctggccacagatccccaggga

SEQ ID NO: 7518926 - DNA, 22 bp, Homo sapiens
gctggccacagatccccaggga

SEQ ID NO: 7518927 - DNA, 22 bp, Homo sapiens
gctggccacagatccccaggga

SEQ ID NO: 7518928 - DNA, 22 bp, Homo sapiens
gctggccacagatccccaggga

SEQ ID NO: 7518929 - DNA, 22 bp, Homo sapiens
gctggccacagatccccaggga

SEQ ID NO: 7518930 - DNA, 22 bp, Homo sapiens
gctggccacagatccccaggga

SEQ ID NO: 7518931 - DNA, 22 bp, Homo sapiens
gctggccacattgtgccgtcct

SEQ ID NO: 7518932 - DNA, 22 bp, Homo sapiens
gctggccacattgtgccgtcct

SEQ ID NO: 7518933 - DNA, 22 bp, Homo sapiens
gctggccacagatccccaggga

SEQ ID NO: 7518934 - DNA, 22 bp, Homo sapiens
gctggccacagatccccaggga

SEQ ID NO: 7518935 - DNA, 19 bp, Homo sapiens
gctggccacgccccagttg

SEQ ID NO: 7518936 - DNA, 19 bp, Homo sapiens
gctggccacgccccagttg

SEQ ID NO: 7518937 - DNA, 22 bp, Homo sapiens
gctggccacattgtgccgtcct

SEQ ID NO: 7518938 - DNA, 22 bp, Homo sapiens
gctggccacattgtgccgtcct

SEQ ID NO: 7518939 - DNA, 19 bp, Homo sapiens
gctggccacgccccagttg

SEQ ID NO: 7518940 - DNA, 19 bp, Homo sapiens
gctggccacgccccagttg

SEQ ID NO: 7518941 - DNA, 19 bp, Homo sapiens
gctggccacgccccagttg

SEQ ID NO: 7518942 - DNA, 22 bp, Homo sapiens
gctggccagccctcttcctcca

SEQ ID NO: 7518943 - DNA, 22 bp, Homo sapiens
gctggccaggaagagtctcaga

SEQ ID NO: 7518944 - DNA, 22 bp, Homo sapiens
gctggccaggaagagtctcaga

SEQ ID NO: 7518945 - DNA, 22 bp, Homo sapiens
gctggccaggaagagtctcaga

SEQ ID NO: 7518946 - DNA, 22 bp, Homo sapiens
gctggccagccctcttcctcca

SEQ ID NO: 7518947 - DNA, 22 bp, Homo sapiens
gctggccagccctcttcctcca

SEQ ID NO: 7518948 - DNA, 22 bp, Homo sapiens
gctggccagccctcttcctcca

SEQ ID NO: 7518949 - DNA, 22 bp, Homo sapiens
gctggccagccctcttcctcca

SEQ ID NO: 7518950 - DNA, 19 bp, Homo sapiens
gctggccacgccccagttg

SEQ ID NO: 7518951 - DNA, 19 bp, Homo sapiens
gctggccacgccccagttg

SEQ ID NO: 7518952 - DNA, 22 bp, Homo sapiens
gctgtcactggcatgttccggg

SEQ ID NO: 7518953 - DNA, 22 bp, Homo sapiens
gctgtcagccccaaagacaaag

SEQ ID NO: 7518954 - DNA, 22 bp, Homo sapiens
gctgtcagccccaaagacaaag

SEQ ID NO: 7518955 - DNA, 22 bp, Homo sapiens
gctgtcagcgcccaaggagctc

SEQ ID NO: 7518956 - DNA, 22 bp, Homo sapiens
gctgtcactctccggccttccc

SEQ ID NO: 7518957 - DNA, 22 bp, Homo sapiens
gctgtcactcaccaggcctgca

SEQ ID NO: 7518958 - DNA, 22 bp, Homo sapiens
gctgtcagttttacccacagac

SEQ ID NO: 7518959 - DNA, 22 bp, Homo sapiens
gctgtcagttttacccacagac

SEQ ID NO: 7518960 - DNA, 22 bp, Homo sapiens
gctgtcagtgaggtgagacatg

SEQ ID NO: 7518961 - DNA, 23 bp, Homo sapiens
gctgtcagttgtttttgtctcta

SEQ ID NO: 7518962 - DNA, 22 bp, Homo sapiens
gctgtcagtgaggtgagacatg

SEQ ID NO: 7518963 - DNA, 22 bp, Homo sapiens
gctgtcagtgaggtgagacatg

SEQ ID NO: 7518964 - DNA, 22 bp, Homo sapiens
gctgtcactctccggccttccc

SEQ ID NO: 7518965 - DNA, 22 bp, Homo sapiens
gctgtcaggaacatgccttggt

SEQ ID NO: 7518966 - DNA, 22 bp, Homo sapiens
gctgtcaggccatgtgggcctt

SEQ ID NO: 7518967 - DNA, 22 bp, Homo sapiens
gctgtcaggccatgtgggcctt

SEQ ID NO: 7518968 - DNA, 22 bp, Homo sapiens
gctgtcacaagcatctggggca

SEQ ID NO: 7518969 - DNA, 22 bp, Homo sapiens
gctgtcacaagcatctggggca

SEQ ID NO: 7518970 - DNA, 22 bp, Homo sapiens
gctgtcacaaattgggttcttt

SEQ ID NO: 7518971 - DNA, 22 bp, Homo sapiens
gctgtcacaaatatttctcagc

SEQ ID NO: 7518972 - DNA, 22 bp, Homo sapiens
gctgtcacacatgggatctcag

SEQ ID NO: 7518973 - DNA, 22 bp, Homo sapiens
gctgtcacacatggccccagct

SEQ ID NO: 7518974 - DNA, 22 bp, Homo sapiens
gctgtcacacatggccccagct

SEQ ID NO: 7518975 - DNA, 22 bp, Homo sapiens
gctgtcaccaaagcaggcactg

SEQ ID NO: 7518976 - DNA, 22 bp, Homo sapiens
gctgtcacatttggagcactgg

SEQ ID NO: 7518977 - DNA, 22 bp, Homo sapiens
gctgtcacatttggagcactgg

SEQ ID NO: 7518978 - DNA, 22 bp, Homo sapiens
gctgtcaccaaagcaggcactg

SEQ ID NO: 7518979 - DNA, 22 bp, Homo sapiens
gctgtcacatcaaggcactaaa

SEQ ID NO: 7518980 - DNA, 22 bp, Homo sapiens
gctgtatttaacaactggctca

SEQ ID NO: 7518981 - DNA, 22 bp, Homo sapiens
gctgtattggaacacatccatg

SEQ ID NO: 7518982 - DNA, 22 bp, Homo sapiens
gctgtatttaacaactggctca

SEQ ID NO: 7518983 - DNA, 22 bp, Homo sapiens
gctgtatttattttctagggtt

SEQ ID NO: 7518984 - DNA, 22 bp, Homo sapiens
gctgtatttatatgaaggcatg

SEQ ID NO: 7518985 - DNA, 22 bp, Homo sapiens
gctgtcaaggtagaaaacagag

SEQ ID NO: 7518986 - DNA, 22 bp, Homo sapiens
gctgtatttatatgaaggcatg

SEQ ID NO: 7518987 - DNA, 22 bp, Homo sapiens
gctgtcacaaatatttctcagc

SEQ ID NO: 7518988 - DNA, 22 bp, Homo sapiens
gctgtattcaacagtgaaaaga

SEQ ID NO: 7518989 - DNA, 22 bp, Homo sapiens
gctgtattcctgcactgtatag

SEQ ID NO: 7518990 - DNA, 22 bp, Homo sapiens
gctgtattcctgcactgtatag

SEQ ID NO: 7518991 - DNA, 22 bp, Homo sapiens
gctgtattggaacacatccatg

SEQ ID NO: 7518992 - DNA, 22 bp, Homo sapiens
gctgtattggaacacatccatg

SEQ ID NO: 7518993 - DNA, 19 bp, Homo sapiens
gctgtattaaagatacatg

SEQ ID NO: 7518994 - DNA, 19 bp, Homo sapiens
gctgtattaaagatacatg

SEQ ID NO: 7518995 - DNA, 22 bp, Homo sapiens
gctgtatgtttatttgggaatt

SEQ ID NO: 7518996 - DNA, 22 bp, Homo sapiens
gctgtatgtttatttgggaatt

SEQ ID NO: 7518997 - DNA, 17 bp, Homo sapiens
gctgtagtttgataaga

SEQ ID NO: 7518998 - DNA, 19 bp, Homo sapiens
gctgtattaaagatacatg

SEQ ID NO: 7518999 - DNA, 22 bp, Homo sapiens
gctgtatgtgaggccacagtga

SEQ ID NO: 7519000 - DNA, 22 bp, Homo sapiens
gctgtatgtgaggccacagtga

SEQ ID NO: 7519001 - DNA, 22 bp, Homo sapiens
gctgtatgtgaggccacagtga

SEQ ID NO: 7519002 - DNA, 22 bp, Homo sapiens
gctgtatgagttcatgtgtaga

SEQ ID NO: 7519003 - DNA, 22 bp, Homo sapiens
gctgtatgtgaggccacagtga

SEQ ID NO: 7519004 - DNA, 22 bp, Homo sapiens
gctgtatgtttatttgggaatt

SEQ ID NO: 7519005 - DNA, 22 bp, Homo sapiens
gctgtatgtgaggccacagtga

SEQ ID NO: 7519006 - DNA, 22 bp, Homo sapiens
gctgtagtgaatggccgcgttc

SEQ ID NO: 7519007 - DNA, 22 bp, Homo sapiens
gctgtagtgaatggccgcgttc

SEQ ID NO: 7519008 - DNA, 22 bp, Homo sapiens
gctgtaggtaaggatggcaaag

SEQ ID NO: 7519009 - DNA, 22 bp, Homo sapiens
gctgtagggtgtcatatgaagc

SEQ ID NO: 7519010 - DNA, 22 bp, Homo sapiens
gctgtaggtaaggatggcaaag

SEQ ID NO: 7519011 - DNA, 22 bp, Homo sapiens
gctgtaggtcatttaatcacct

SEQ ID NO: 7519012 - DNA, 22 bp, Homo sapiens
gctgtaggtttttccaggagtt

SEQ ID NO: 7519013 - DNA, 22 bp, Homo sapiens
gctgtaggtttttccaggagtt

SEQ ID NO: 7519014 - DNA, 22 bp, Homo sapiens
gctgtagatggactggcatcca

SEQ ID NO: 7519015 - DNA, 22 bp, Homo sapiens
gctgtaggaagacagaatgcag

SEQ ID NO: 7519016 - DNA, 22 bp, Homo sapiens
gctgtaggaatgacatgtacct

SEQ ID NO: 7519017 - DNA, 22 bp, Homo sapiens
gctgtagggctgagctggaccg

SEQ ID NO: 7519018 - DNA, 19 bp, Homo sapiens
gctgtgtgaccttgggcaa

SEQ ID NO: 7519019 - DNA, 19 bp, Homo sapiens
gctgtgtgaccttgggcaa

SEQ ID NO: 7519020 - DNA, 22 bp, Homo sapiens
gctgtgtgacctgggcaagtct

SEQ ID NO: 7519021 - DNA, 22 bp, Homo sapiens
gctgtgtgacctgggcaagtct

SEQ ID NO: 7519022 - DNA, 22 bp, Homo sapiens
gctgtgtgacctgggcaagtct

SEQ ID NO: 7519023 - DNA, 22 bp, Homo sapiens
gctgtctgtggtgtcagctgac

SEQ ID NO: 7519024 - DNA, 22 bp, Homo sapiens
gctgtgtgacctgggcaagtct

SEQ ID NO: 7519025 - DNA, 19 bp, Homo sapiens
gctgtgtgaccttgggcaa

SEQ ID NO: 7519026 - DNA, 19 bp, Homo sapiens
gctgtgtgaccttgggcaa

SEQ ID NO: 7519027 - DNA, 22 bp, Homo sapiens
gctgtgtgactgagagcctggc

SEQ ID NO: 7519028 - DNA, 22 bp, Homo sapiens
gctgtgtgactgagagcctggc

SEQ ID NO: 7519029 - DNA, 22 bp, Homo sapiens
gctgtgtgactgagagcctggc

SEQ ID NO: 7519030 - DNA, 22 bp, Homo sapiens
gctgtgtgactgagagcctggc

SEQ ID NO: 7519031 - DNA, 22 bp, Homo sapiens
gctgtgtgactgagagcctggc

SEQ ID NO: 7519032 - DNA, 22 bp, Homo sapiens
gctgtgtgactgagagcctggc

SEQ ID NO: 7519033 - DNA, 19 bp, Homo sapiens
gctgtgtgaccttgggcaa

SEQ ID NO: 7519034 - DNA, 19 bp, Homo sapiens
gctgtgtgaccttgggcaa

SEQ ID NO: 7519035 - DNA, 22 bp, Homo sapiens
gctgtgtgactgagagcctggc

SEQ ID NO: 7519036 - DNA, 22 bp, Homo sapiens
gctgtgtgactgagagcctggc

SEQ ID NO: 7519037 - DNA, 22 bp, Homo sapiens
gctgtgtgactgagagcctggc

SEQ ID NO: 7519038 - DNA, 18 bp, Homo sapiens
gctgtgtgcacctgataa

SEQ ID NO: 7519039 - DNA, 18 bp, Homo sapiens
gctgtgtgcacctgataa

SEQ ID NO: 7519040 - DNA, 22 bp, Homo sapiens
gctgtgtgccaggggaaggctg

SEQ ID NO: 7519041 - DNA, 22 bp, Homo sapiens
gctgtgtgccaggggaaggctg

SEQ ID NO: 7519042 - DNA, 22 bp, Homo sapiens
gctgtgtgctaggatatgtttt

SEQ ID NO: 7519043 - DNA, 22 bp, Homo sapiens
gctgtgtgccaggggaaggctg

SEQ ID NO: 7519044 - DNA, 22 bp, Homo sapiens
gctgtgtgctaggatatgtttt

SEQ ID NO: 7519045 - DNA, 22 bp, Homo sapiens
gctgtgtgccaggggaaggctg

SEQ ID NO: 7519046 - DNA, 22 bp, Homo sapiens
gctgtgtgccaggggaaggctg

SEQ ID NO: 7519047 - DNA, 22 bp, Homo sapiens
gctgtgtgctcacgtagtggaa

SEQ ID NO: 7519048 - DNA, 22 bp, Homo sapiens
gctgtgtgctcacgtagtggaa

SEQ ID NO: 7519049 - DNA, 22 bp, Homo sapiens
gctgtgtgctcacgtagtggaa

SEQ ID NO: 7519050 - DNA, 22 bp, Homo sapiens
gctgtgtgctcacgtagtggaa

SEQ ID NO: 7519051 - DNA, 22 bp, Homo sapiens
gctgtgtgctcacgtagtggaa

SEQ ID NO: 7519052 - DNA, 22 bp, Homo sapiens
gctgtgtgctcacgtagtggaa

SEQ ID NO: 7519053 - DNA, 22 bp, Homo sapiens
gctgtgtgctaggatatgtttt

SEQ ID NO: 7519054 - DNA, 22 bp, Homo sapiens
gctgtgtgctaggatatgtttt

SEQ ID NO: 7519055 - DNA, 22 bp, Homo sapiens
gctgtctgtctctgtcccacca

SEQ ID NO: 7519056 - DNA, 22 bp, Homo sapiens
gctgtctgtctctgtcccacca

SEQ ID NO: 7519057 - DNA, 22 bp, Homo sapiens
gctgtctgtctctgtcccacca

SEQ ID NO: 7519058 - DNA, 23 bp, Homo sapiens
gctgtctgtcatctctgcgggag

SEQ ID NO: 7519059 - DNA, 22 bp, Homo sapiens
gctgtctgggttgagggccctg

SEQ ID NO: 7519060 - DNA, 22 bp, Homo sapiens
gctgtctgggttgagggccctg

SEQ ID NO: 7519061 - DNA, 22 bp, Homo sapiens
gctgtctgggtgcccaaaagaa

SEQ ID NO: 7519062 - DNA, 22 bp, Homo sapiens
gctgtctgggtgcccaaaagaa

SEQ ID NO: 7519063 - DNA, 22 bp, Homo sapiens
gctgtctgggttgagggccctg

SEQ ID NO: 7519064 - DNA, 22 bp, Homo sapiens
gctgtctgtggtgtcagctgac

SEQ ID NO: 7519065 - DNA, 22 bp, Homo sapiens
gctgtctgtggtgtcagctgac

SEQ ID NO: 7519066 - DNA, 22 bp, Homo sapiens
gctgtctgttcgagcgtgtgtt

SEQ ID NO: 7519067 - DNA, 22 bp, Homo sapiens
gctgtgtgaccctagccagtag

SEQ ID NO: 7519068 - DNA, 22 bp, Homo sapiens
gctgtctgtctctgtcccacca

SEQ ID NO: 7519069 - DNA, 22 bp, Homo sapiens
gctgtctgtctctgtgacttaa

SEQ ID NO: 7519070 - DNA, 22 bp, Homo sapiens
gctgtctgtcttcacatctcgc

SEQ ID NO: 7519071 - DNA, 22 bp, Homo sapiens
gctgtctgtcttcacatctcgc

SEQ ID NO: 7519072 - DNA, 20 bp, Homo sapiens
gctgtctggattagaagcct

SEQ ID NO: 7519073 - DNA, 22 bp, Homo sapiens
gctgtctggcatggcgtggctg

SEQ ID NO: 7519074 - DNA, 22 bp, Homo sapiens
gctgtctggcatggcgtggctg

SEQ ID NO: 7519075 - DNA, 22 bp, Homo sapiens
gctgtctggcatggcgtggctg

SEQ ID NO: 7519076 - DNA, 22 bp, Homo sapiens
gctgtctggcatggcgtggctg

SEQ ID NO: 7519077 - DNA, 22 bp, Homo sapiens
gctgtctgggaggcctccactt

SEQ ID NO: 7519078 - DNA, 22 bp, Homo sapiens
gctgtctgggaggcctccactt

SEQ ID NO: 7519079 - DNA, 22 bp, Homo sapiens
gctgtctgggaggcctccactt

SEQ ID NO: 7519080 - DNA, 22 bp, Homo sapiens
gctgtctgggatgtcactgctg

SEQ ID NO: 7519081 - DNA, 22 bp, Homo sapiens
gctgtctgctgtgcactgagca

SEQ ID NO: 7519082 - DNA, 22 bp, Homo sapiens
gctgtctgctgtgcactgagca

SEQ ID NO: 7519083 - DNA, 22 bp, Homo sapiens
gctgtctggaggctctgaggga

SEQ ID NO: 7519084 - DNA, 22 bp, Homo sapiens
gctgtctgctgtgcactgagca

SEQ ID NO: 7519085 - DNA, 22 bp, Homo sapiens
gctgtctggatatcttggaatt

SEQ ID NO: 7519086 - DNA, 22 bp, Homo sapiens
gctgtctggaggctctgaggga

SEQ ID NO: 7519087 - DNA, 22 bp, Homo sapiens
gctgtctggaggctctgaggga

SEQ ID NO: 7519088 - DNA, 22 bp, Homo sapiens
gctgtctggaggctctgaggga

SEQ ID NO: 7519089 - DNA, 22 bp, Homo sapiens
gctgtcctctgatctctggagg

SEQ ID NO: 7519090 - DNA, 22 bp, Homo sapiens
gctgtcctctgatctctggagg

SEQ ID NO: 7519091 - DNA, 22 bp, Homo sapiens
gctgtcctcgtctctcacgcaa

SEQ ID NO: 7519092 - DNA, 22 bp, Homo sapiens
gctgtcctcgtctctcacgcaa

SEQ ID NO: 7519093 - DNA, 23 bp, Homo sapiens
gctgtcctcctgggcccagcagc

SEQ ID NO: 7519094 - DNA, 22 bp, Homo sapiens
gctgtcctcttggactcagggc

SEQ ID NO: 7519095 - DNA, 22 bp, Homo sapiens
gctgtcctcttggactcagggc

SEQ ID NO: 7519096 - DNA, 22 bp, Homo sapiens
gctgtcctcttggactcagggc

SEQ ID NO: 7519097 - DNA, 22 bp, Homo sapiens
gctgtcctctgatctctggagg

SEQ ID NO: 7519098 - DNA, 23 bp, Homo sapiens
gctgtcctcctgggcccagcagc

SEQ ID NO: 7519099 - DNA, 23 bp, Homo sapiens
gctgtcctcctgggcccagcagc

SEQ ID NO: 7519100 - DNA, 23 bp, Homo sapiens
gctgtcctcctgggcccagcagc

SEQ ID NO: 7519101 - DNA, 22 bp, Homo sapiens
gctgtccctttcacaaggtttt

SEQ ID NO: 7519102 - DNA, 22 bp, Homo sapiens
gctgtcccttgtcccaccttgc

SEQ ID NO: 7519103 - DNA, 22 bp, Homo sapiens
gctgtcccttgtcccaccttgc

SEQ ID NO: 7519104 - DNA, 17 bp, Homo sapiens
gctgtcccttcaagagt

SEQ ID NO: 7519105 - DNA, 22 bp, Homo sapiens
gctgtcccgctgacttccagct

SEQ ID NO: 7519106 - DNA, 22 bp, Homo sapiens
gctgtcccgctgacttccagct

SEQ ID NO: 7519107 - DNA, 22 bp, Homo sapiens
gctgtcccgctgacttccagct

SEQ ID NO: 7519108 - DNA, 22 bp, Homo sapiens
gctgtcccgctgacttccagct

SEQ ID NO: 7519109 - DNA, 22 bp, Homo sapiens
gctgtcccgctgacttccagct

SEQ ID NO: 7519110 - DNA, 22 bp, Homo sapiens
gctgtccttcctggctggggtg

SEQ ID NO: 7519111 - DNA, 22 bp, Homo sapiens
gctgtccttcctggctggggtg

SEQ ID NO: 7519112 - DNA, 22 bp, Homo sapiens
gctgtccttcctggctggggtg

SEQ ID NO: 7519113 - DNA, 22 bp, Homo sapiens
gctgtctagggaggctgtcacc

SEQ ID NO: 7519114 - DNA, 22 bp, Homo sapiens
gctgtcctgggaacaggcacta

SEQ ID NO: 7519115 - DNA, 22 bp, Homo sapiens
gctgtcctgggaacaggcacta

SEQ ID NO: 7519116 - DNA, 22 bp, Homo sapiens
gctgtcctgggaacaggcacta

SEQ ID NO: 7519117 - DNA, 17 bp, Homo sapiens
gctgtcccttcaagagt

SEQ ID NO: 7519118 - DNA, 22 bp, Homo sapiens
gctgtcctgggaacaggcacta

SEQ ID NO: 7519119 - DNA, 22 bp, Homo sapiens
gctgtcctgggaacaggcacta

SEQ ID NO: 7519120 - DNA, 22 bp, Homo sapiens
gctgtcctggggagggagaatg

SEQ ID NO: 7519121 - DNA, 22 bp, Homo sapiens
gctgtctcatacaaggccctgc

SEQ ID NO: 7519122 - DNA, 22 bp, Homo sapiens
gctgtctcatacaaggccctgc

SEQ ID NO: 7519123 - DNA, 22 bp, Homo sapiens
gctgtctgctgggtcgctcagg

SEQ ID NO: 7519124 - DNA, 22 bp, Homo sapiens
gctgtctgctgggtcgctcagg

SEQ ID NO: 7519125 - DNA, 22 bp, Homo sapiens
gctgtctcatgggtgctagtcc

SEQ ID NO: 7519126 - DNA, 22 bp, Homo sapiens
gctgtctgctgtgcactgagca

SEQ ID NO: 7519127 - DNA, 22 bp, Homo sapiens
gctgtctgctgtgcactgagca

SEQ ID NO: 7519128 - DNA, 22 bp, Homo sapiens
gctgtctgctgtgcactgagca

SEQ ID NO: 7519129 - DNA, 22 bp, Homo sapiens
gctgtccagctccagccagcca

SEQ ID NO: 7519130 - DNA, 22 bp, Homo sapiens
gctgtccaggagtgcagagatt

SEQ ID NO: 7519131 - DNA, 22 bp, Homo sapiens
gctgtccagctccagccagcca

SEQ ID NO: 7519132 - DNA, 22 bp, Homo sapiens
gctgtccagctccagccagcca

SEQ ID NO: 7519133 - DNA, 22 bp, Homo sapiens
gctgtccagctccagccagcca

SEQ ID NO: 7519134 - DNA, 22 bp, Homo sapiens
gctgtccagctccagccagcca

SEQ ID NO: 7519135 - DNA, 22 bp, Homo sapiens
gctgtccaggagtgcagagatt

SEQ ID NO: 7519136 - DNA, 22 bp, Homo sapiens
gctgtccaggttgtggagcaac

SEQ ID NO: 7519137 - DNA, 22 bp, Homo sapiens
gctgtccaggttgtggagcaac

SEQ ID NO: 7519138 - DNA, 22 bp, Homo sapiens
gctgtccaggagtgcagagatt

SEQ ID NO: 7519139 - DNA, 22 bp, Homo sapiens
gctgtccaggttgtggagcaac

SEQ ID NO: 7519140 - DNA, 22 bp, Homo sapiens
gctgtccaggttgtggagcaac

SEQ ID NO: 7519141 - DNA, 22 bp, Homo sapiens
gctgtccaacctgcactcgcgt

SEQ ID NO: 7519142 - DNA, 22 bp, Homo sapiens
gctgtccaacctgcactcgcgt

SEQ ID NO: 7519143 - DNA, 22 bp, Homo sapiens
gctgtccaacctgcactcgcgt

SEQ ID NO: 7519144 - DNA, 22 bp, Homo sapiens
gctgtccacctccagagcctta

SEQ ID NO: 7519145 - DNA, 22 bp, Homo sapiens
gctgtccacctccagagcctta

SEQ ID NO: 7519146 - DNA, 22 bp, Homo sapiens
gctgtccacctccagagcctta

SEQ ID NO: 7519147 - DNA, 22 bp, Homo sapiens
gctgtccacctccagagcctta

SEQ ID NO: 7519148 - DNA, 22 bp, Homo sapiens
gctgtccagagcatgggagcaa

SEQ ID NO: 7519149 - DNA, 22 bp, Homo sapiens
gctgtccatccacttcccagcg

SEQ ID NO: 7519150 - DNA, 20 bp, Homo sapiens
gctgtcccaggccaaagggc

SEQ ID NO: 7519151 - DNA, 22 bp, Homo sapiens
gctgtccatgtctggcctcagt

SEQ ID NO: 7519152 - DNA, 22 bp, Homo sapiens
gctgtccatgtctggcctcagt

SEQ ID NO: 7519153 - DNA, 20 bp, Homo sapiens
gctgtcccaggccaaagggc

SEQ ID NO: 7519154 - DNA, 22 bp, Homo sapiens
gctgtcccatggttgcaagatg

SEQ ID NO: 7519155 - DNA, 22 bp, Homo sapiens
gctgtcccatggttgcaagatg

SEQ ID NO: 7519156 - DNA, 22 bp, Homo sapiens
gctgtcccatggttgcaagatg

SEQ ID NO: 7519157 - DNA, 22 bp, Homo sapiens
gctgtccatccacttcccagcg

SEQ ID NO: 7519158 - DNA, 22 bp, Homo sapiens
gctgtccatccacttcccagcg

SEQ ID NO: 7519159 - DNA, 22 bp, Homo sapiens
gctgtcccgaacccctggtaat

SEQ ID NO: 7519160 - DNA, 22 bp, Homo sapiens
gctgtcccgaacccctggtaat

SEQ ID NO: 7519161 - DNA, 22 bp, Homo sapiens
gctgtcccgctgacttccagct

SEQ ID NO: 7519162 - DNA, 22 bp, Homo sapiens
gctgtcccgaacccctggtaat

SEQ ID NO: 7519163 - DNA, 23 bp, Homo sapiens
gctgtccccatgctccatccctg

SEQ ID NO: 7519164 - DNA, 23 bp, Homo sapiens
gctgtccccatgctccatccctg

SEQ ID NO: 7519165 - DNA, 22 bp, Homo sapiens
gctgtcccatggttgcaagatg

SEQ ID NO: 7519166 - DNA, 22 bp, Homo sapiens
ggacaggcccggggagcctgga

SEQ ID NO: 7519167 - DNA, 22 bp, Homo sapiens
ggacaggcccggggagcctgga

SEQ ID NO: 7519168 - DNA, 22 bp, Homo sapiens
ggacaggcccggggagcctgga

SEQ ID NO: 7519169 - DNA, 22 bp, Homo sapiens
ggacaggcccggggagcctgga

SEQ ID NO: 7519170 - DNA, 22 bp, Homo sapiens
ggacaggcccggggagcctgga

SEQ ID NO: 7519171 - DNA, 22 bp, Homo sapiens
ggacaggcccggggagcctgga

SEQ ID NO: 7519172 - DNA, 22 bp, Homo sapiens
ggacaggccatatggaatacat

SEQ ID NO: 7519173 - DNA, 22 bp, Homo sapiens
ggacaggccatatggaatacat

SEQ ID NO: 7519174 - DNA, 22 bp, Homo sapiens
ggacaggcaggtgatttccaga

SEQ ID NO: 7519175 - DNA, 22 bp, Homo sapiens
ggacaggatgctgaagatgaag

SEQ ID NO: 7519176 - DNA, 22 bp, Homo sapiens
ggacaggatgctgaagatgaag

SEQ ID NO: 7519177 - DNA, 22 bp, Homo sapiens
ggacaggccctctggtcagctt

SEQ ID NO: 7519178 - DNA, 22 bp, Homo sapiens
ggacaggccctctggtcagctt

SEQ ID NO: 7519179 - DNA, 22 bp, Homo sapiens
ggacaggccctctggtcagctt

SEQ ID NO: 7519180 - DNA, 22 bp, Homo sapiens
ggacaggccgcctcggtggggg

SEQ ID NO: 7519181 - DNA, 22 bp, Homo sapiens
ggacaggcccggggagcctgga

SEQ ID NO: 7519182 - DNA, 22 bp, Homo sapiens
ggacaggcccggggagcctgga

SEQ ID NO: 7519183 - DNA, 22 bp, Homo sapiens
ggacaggcccggggagcctgga

SEQ ID NO: 7519184 - DNA, 22 bp, Homo sapiens
ggacaggccctctggtcagctt

SEQ ID NO: 7519185 - DNA, 22 bp, Homo sapiens
ggacaggccctctggtcagctt

SEQ ID NO: 7519186 - DNA, 22 bp, Homo sapiens
ggacaggccctctggtcagctt

SEQ ID NO: 7519187 - DNA, 22 bp, Homo sapiens
ggacaggcccggggagcctgga

SEQ ID NO: 7519188 - DNA, 22 bp, Homo sapiens
ggacaggcctggcacagtactg

SEQ ID NO: 7519189 - DNA, 22 bp, Homo sapiens
ggacaggcctggcacagtactg

SEQ ID NO: 7519190 - DNA, 22 bp, Homo sapiens
ggacaggccgcctcggtggggg

SEQ ID NO: 7519191 - DNA, 22 bp, Homo sapiens
ggacaggccgcctcggtggggg

SEQ ID NO: 7519192 - DNA, 22 bp, Homo sapiens
ggacaggccgcctcggtggggg

SEQ ID NO: 7519193 - DNA, 22 bp, Homo sapiens
ggacaggcgcagggccaaggaa

SEQ ID NO: 7519194 - DNA, 22 bp, Homo sapiens
ggacaggcctggcacagtactg

SEQ ID NO: 7519195 - DNA, 22 bp, Homo sapiens
ggacaggcctggcacagtactg

SEQ ID NO: 7519196 - DNA, 22 bp, Homo sapiens
ggacaggctgcatctgagcatg

SEQ ID NO: 7519197 - DNA, 22 bp, Homo sapiens
ggacaggctgcatctgagcatg

SEQ ID NO: 7519198 - DNA, 22 bp, Homo sapiens
ggacaggctgcatctgagcatg

SEQ ID NO: 7519199 - DNA, 22 bp, Homo sapiens
ggacaggctgcatctgagcatg

SEQ ID NO: 7519200 - DNA, 22 bp, Homo sapiens
ggacaggcctggcacagtactg

SEQ ID NO: 7519201 - DNA, 22 bp, Homo sapiens
ggacaggctgcatctgagcatg

SEQ ID NO: 7519202 - DNA, 22 bp, Homo sapiens
ggacaggctgcatctgagcatg

SEQ ID NO: 7519203 - DNA, 22 bp, Homo sapiens
ggacaggctgcatctgagcatg

SEQ ID NO: 7519204 - DNA, 22 bp, Homo sapiens
ggacaggctgcatctgagcatg

SEQ ID NO: 7519205 - DNA, 22 bp, Homo sapiens
ggacaggctgcatctgagcatg

SEQ ID NO: 7519206 - DNA, 22 bp, Homo sapiens
ggacaggctgcatctgagcatg

SEQ ID NO: 7519207 - DNA, 22 bp, Homo sapiens
ggacaggctgcatctgagcatg

SEQ ID NO: 7519208 - DNA, 22 bp, Homo sapiens
ggacaggctgcatctgagcatg

SEQ ID NO: 7519209 - DNA, 22 bp, Homo sapiens
ggacagggctcttggcactcct

SEQ ID NO: 7519210 - DNA, 23 bp, Homo sapiens
ggacagggccctgccctatggcc

SEQ ID NO: 7519211 - DNA, 23 bp, Homo sapiens
ggacagggccctgccctatggcc

SEQ ID NO: 7519212 - DNA, 22 bp, Homo sapiens
ggacagggctcttggcactcct

SEQ ID NO: 7519213 - DNA, 22 bp, Homo sapiens
ggacagggctcttggcactcct

SEQ ID NO: 7519214 - DNA, 22 bp, Homo sapiens
ggacagggctcttggcactcct

SEQ ID NO: 7519215 - DNA, 22 bp, Homo sapiens
ggacagggctcttggcactcct

SEQ ID NO: 7519216 - DNA, 22 bp, Homo sapiens
ggacagggctcttggcactcct

SEQ ID NO: 7519217 - DNA, 23 bp, Homo sapiens
ggacagggccctgccctatggcc

SEQ ID NO: 7519218 - DNA, 23 bp, Homo sapiens
ggacagggccctgccctatggcc

SEQ ID NO: 7519219 - DNA, 23 bp, Homo sapiens
ggacagggccctgccctatggcc

SEQ ID NO: 7519220 - DNA, 23 bp, Homo sapiens
ggacagggccctgccctatggcc

SEQ ID NO: 7519221 - DNA, 23 bp, Homo sapiens
ggacagggccctgccctatggcc

SEQ ID NO: 7519222 - DNA, 23 bp, Homo sapiens
ggacagggccctgccctatggcc

SEQ ID NO: 7519223 - DNA, 22 bp, Homo sapiens
ggacagggatcattatctgagc

SEQ ID NO: 7519224 - DNA, 22 bp, Homo sapiens
ggacagggatcattatctgagc

SEQ ID NO: 7519225 - DNA, 22 bp, Homo sapiens
ggacagggatcattatctgagc

SEQ ID NO: 7519226 - DNA, 22 bp, Homo sapiens
ggacagggatcattatctgagc

SEQ ID NO: 7519227 - DNA, 22 bp, Homo sapiens
ggacagggatcattatctgagc

SEQ ID NO: 7519228 - DNA, 23 bp, Homo sapiens
ggacagggccctgccctatggcc

SEQ ID NO: 7519229 - DNA, 22 bp, Homo sapiens
ggacagggtaagtactagtgtg

SEQ ID NO: 7519230 - DNA, 19 bp, Homo sapiens
ggacagggggagcttttat

SEQ ID NO: 7519231 - DNA, 19 bp, Homo sapiens
ggacagggggagcttttat

SEQ ID NO: 7519232 - DNA, 19 bp, Homo sapiens
ggacagggggagcttttat

SEQ ID NO: 7519233 - DNA, 19 bp, Homo sapiens
ggacagggggagcttttat

SEQ ID NO: 7519234 - DNA, 22 bp, Homo sapiens
ggacaggggcgtggggattgtt

SEQ ID NO: 7519235 - DNA, 22 bp, Homo sapiens
ggacaggggcgtggggattgtt

SEQ ID NO: 7519236 - DNA, 22 bp, Homo sapiens
ggacaggggcgtggggattgtt

SEQ ID NO: 7519237 - DNA, 22 bp, Homo sapiens
ggacaggggcgtggggattgtt

SEQ ID NO: 7519238 - DNA, 22 bp, Homo sapiens
ggacaggggcgtggggattgtt

SEQ ID NO: 7519239 - DNA, 22 bp, Homo sapiens
ggacaggggcgtggggattgtt

SEQ ID NO: 7519240 - DNA, 22 bp, Homo sapiens
ggacaggggcgtggggattgtt

SEQ ID NO: 7519241 - DNA, 22 bp, Homo sapiens
ggacaggggcgtggggattgtt

SEQ ID NO: 7519242 - DNA, 22 bp, Homo sapiens
ggacagggctcttggcactcct

SEQ ID NO: 7519243 - DNA, 22 bp, Homo sapiens
ggacagggctcttggcactcct

SEQ ID NO: 7519244 - DNA, 22 bp, Homo sapiens
ggacagggctcttggcactcct

SEQ ID NO: 7519245 - DNA, 22 bp, Homo sapiens
ggacagggctcttggcactcct

SEQ ID NO: 7519246 - DNA, 22 bp, Homo sapiens
ggacagggctcttggcactcct

SEQ ID NO: 7519247 - DNA, 22 bp, Homo sapiens
ggacagggctcttggcactcct

SEQ ID NO: 7519248 - DNA, 22 bp, Homo sapiens
ggactggtctgagagggattca

SEQ ID NO: 7519249 - DNA, 22 bp, Homo sapiens
ggactgggtcactaagatagta

SEQ ID NO: 7519250 - DNA, 22 bp, Homo sapiens
ggactgggtcactaagatagta

SEQ ID NO: 7519251 - DNA, 22 bp, Homo sapiens
ggactgggtcactaagatagta

SEQ ID NO: 7519252 - DNA, 19 bp, Homo sapiens
ggactgttgccaggcctct

SEQ ID NO: 7519253 - DNA, 22 bp, Homo sapiens
ggactgtgaggtctgggtgagg

SEQ ID NO: 7519254 - DNA, 22 bp, Homo sapiens
ggactgtctactaacaagaagc

SEQ ID NO: 7519255 - DNA, 22 bp, Homo sapiens
ggactgtctccttgctggtagg

SEQ ID NO: 7519256 - DNA, 22 bp, Homo sapiens
ggactgtctccttgctggtagg

SEQ ID NO: 7519257 - DNA, 21 bp, Homo sapiens
ggacttggatggtggcagtag

SEQ ID NO: 7519258 - DNA, 22 bp, Homo sapiens
ggacttggcttctttcagagac

SEQ ID NO: 7519259 - DNA, 21 bp, Homo sapiens
ggacttggatggtggcagtag

SEQ ID NO: 7519260 - DNA, 22 bp, Homo sapiens
ggacttcattattgggagaggc

SEQ ID NO: 7519261 - DNA, 22 bp, Homo sapiens
ggacttcattattgggagaggc

SEQ ID NO: 7519262 - DNA, 22 bp, Homo sapiens
ggacttctggggactgtagatt

SEQ ID NO: 7519263 - DNA, 22 bp, Homo sapiens
ggactgggtcactaagatagta

SEQ ID NO: 7519264 - DNA, 22 bp, Homo sapiens
ggactgggaatcagggagatgc

SEQ ID NO: 7519265 - DNA, 22 bp, Homo sapiens
ggactgggaatcagggagatgc

SEQ ID NO: 7519266 - DNA, 22 bp, Homo sapiens
ggactgggaatcagggagatgc

SEQ ID NO: 7519267 - DNA, 22 bp, Homo sapiens
ggactgggaatcagggagatgc

SEQ ID NO: 7519268 - DNA, 22 bp, Homo sapiens
ggactgggaatcagggagatgc

SEQ ID NO: 7519269 - DNA, 22 bp, Homo sapiens
ggactgggaatcagggagatgc

SEQ ID NO: 7519270 - DNA, 22 bp, Homo sapiens
ggactgggaatcagggagatgc

SEQ ID NO: 7519271 - DNA, 22 bp, Homo sapiens
ggactggccggcgctgaggccc

SEQ ID NO: 7519272 - DNA, 22 bp, Homo sapiens
ggactggccggcgctgaggccc

SEQ ID NO: 7519273 - DNA, 22 bp, Homo sapiens
ggactggactctcaggctcaca

SEQ ID NO: 7519274 - DNA, 22 bp, Homo sapiens
ggacagggtaagtactagtgtg

SEQ ID NO: 7519275 - DNA, 22 bp, Homo sapiens
ggacagggtaagtactagtgtg

SEQ ID NO: 7519276 - DNA, 22 bp, Homo sapiens
ggacagggtaagtactagtgtg

SEQ ID NO: 7519277 - DNA, 22 bp, Homo sapiens
ggactgctacaatatacaatta

SEQ ID NO: 7519278 - DNA, 23 bp, Homo sapiens
ggactgcaatggcgccgtctcag

SEQ ID NO: 7519279 - DNA, 22 bp, Homo sapiens
ggactgctacaatatacaatta

SEQ ID NO: 7519280 - DNA, 22 bp, Homo sapiens
ggactgctccagtgtgatttgt

SEQ ID NO: 7519281 - DNA, 22 bp, Homo sapiens
ggagaaagctatgtgggggagt

SEQ ID NO: 7519282 - DNA, 22 bp, Homo sapiens
ggagaaagctatgtgggggagt

SEQ ID NO: 7519283 - DNA, 22 bp, Homo sapiens
ggagaaagctgtagtggaatgt

SEQ ID NO: 7519284 - DNA, 22 bp, Homo sapiens
ggagaaagctgtagtggaatgt

SEQ ID NO: 7519285 - DNA, 22 bp, Homo sapiens
ggagaaagctatgtgggggagt

SEQ ID NO: 7519286 - DNA, 22 bp, Homo sapiens
ggagaaagctgtagtggaatgt

SEQ ID NO: 7519287 - DNA, 22 bp, Homo sapiens
ggagaaaggataggaatgtgct

SEQ ID NO: 7519288 - DNA, 22 bp, Homo sapiens
ggagaaagctgtagtggaatgt

SEQ ID NO: 7519289 - DNA, 22 bp, Homo sapiens
ggagaaagctgtagtggaatgt

SEQ ID NO: 7519290 - DNA, 22 bp, Homo sapiens
ggagaaagctgtagtggaatgt

SEQ ID NO: 7519291 - DNA, 22 bp, Homo sapiens
ggagaaagctgtagtggaatgt

SEQ ID NO: 7519292 - DNA, 22 bp, Homo sapiens
ggagaaagctgtagtggaatgt

SEQ ID NO: 7519293 - DNA, 22 bp, Homo sapiens
ggagaaaggataggaatgtgct

SEQ ID NO: 7519294 - DNA, 22 bp, Homo sapiens
ggagaaaggcatagcagaacct

SEQ ID NO: 7519295 - DNA, 22 bp, Homo sapiens
ggagaaaggcatagcagaacct

SEQ ID NO: 7519296 - DNA, 22 bp, Homo sapiens
ggagaaaggcatagcagaacct

SEQ ID NO: 7519297 - DNA, 22 bp, Homo sapiens
ggagaaaggcatagcagaacct

SEQ ID NO: 7519298 - DNA, 22 bp, Homo sapiens
ggagaaaggcatagcagaacct

SEQ ID NO: 7519299 - DNA, 22 bp, Homo sapiens
ggagaaaggcatagcagaacct

SEQ ID NO: 7519300 - DNA, 22 bp, Homo sapiens
ggagaaaggcatagcagaacct

SEQ ID NO: 7519301 - DNA, 22 bp, Homo sapiens
ggagaaagaagacgaacattgt

SEQ ID NO: 7519302 - DNA, 22 bp, Homo sapiens
ggagaaagaagacgaacattgt

SEQ ID NO: 7519303 - DNA, 22 bp, Homo sapiens
ggagaaagaagacgaacattgt

SEQ ID NO: 7519304 - DNA, 22 bp, Homo sapiens
ggagaaagaagacgaacattgt

SEQ ID NO: 7519305 - DNA, 22 bp, Homo sapiens
ggagaaagctatgtgggggagt

SEQ ID NO: 7519306 - DNA, 22 bp, Homo sapiens
ggagaaagctatgtgggggagt

SEQ ID NO: 7519307 - DNA, 22 bp, Homo sapiens
ggagaaagaagacgaacattgt

SEQ ID NO: 7519308 - DNA, 22 bp, Homo sapiens
ggagaaagaaatttttgattgg

SEQ ID NO: 7519309 - DNA, 22 bp, Homo sapiens
ggagaaagaaatttttgattgg

SEQ ID NO: 7519310 - DNA, 22 bp, Homo sapiens
ggagaaagaaatttttgattgg

SEQ ID NO: 7519311 - DNA, 22 bp, Homo sapiens
ggagaaaattgatgaagttggc

SEQ ID NO: 7519312 - DNA, 22 bp, Homo sapiens
ggagaaaattgatgaagttggc

SEQ ID NO: 7519313 - DNA, 22 bp, Homo sapiens
ggagaaaattgatgaagttggc

SEQ ID NO: 7519314 - DNA, 22 bp, Homo sapiens
ggacttgggctggtctgtttct

SEQ ID NO: 7519315 - DNA, 22 bp, Homo sapiens
ggacttgggctggtctgtttct

SEQ ID NO: 7519316 - DNA, 22 bp, Homo sapiens
ggacttggggaaggcacagtta

SEQ ID NO: 7519317 - DNA, 19 bp, Homo sapiens
ggacttggtttccaggctc

SEQ ID NO: 7519318 - DNA, 22 bp, Homo sapiens
ggacagagggttgacagagtat

SEQ ID NO: 7519319 - DNA, 22 bp, Homo sapiens
ggacagagggttgacagagtat

SEQ ID NO: 7519320 - DNA, 22 bp, Homo sapiens
ggacagagggttgacagagtat

SEQ ID NO: 7519321 - DNA, 22 bp, Homo sapiens
ggacagagggttgacagagtat

SEQ ID NO: 7519322 - DNA, 22 bp, Homo sapiens
ggacagagggttgacagagtat

SEQ ID NO: 7519323 - DNA, 22 bp, Homo sapiens
ggacagagggttgacagagtat

SEQ ID NO: 7519324 - DNA, 22 bp, Homo sapiens
ggacagagggttgacagagtat

SEQ ID NO: 7519325 - DNA, 22 bp, Homo sapiens
ggacagagggttgacagagtat

SEQ ID NO: 7519326 - DNA, 22 bp, Homo sapiens
ggaagggaatccatctggttag

SEQ ID NO: 7519327 - DNA, 22 bp, Homo sapiens
ggaagggaatccatctggttag

SEQ ID NO: 7519328 - DNA, 22 bp, Homo sapiens
ggaagggaatccatctggttag

SEQ ID NO: 7519329 - DNA, 22 bp, Homo sapiens
ggaagggaatccatctggttag

SEQ ID NO: 7519330 - DNA, 22 bp, Homo sapiens
ggaagggagtagttggaatgca

SEQ ID NO: 7519331 - DNA, 22 bp, Homo sapiens
ggaagggagtagttggaatgca

SEQ ID NO: 7519332 - DNA, 22 bp, Homo sapiens
ggaagggagtagttggaatgca

SEQ ID NO: 7519333 - DNA, 22 bp, Homo sapiens
ggaagggagtagttggaatgca

SEQ ID NO: 7519334 - DNA, 22 bp, Homo sapiens
ggaagggaatccatctggttag

SEQ ID NO: 7519335 - DNA, 22 bp, Homo sapiens
ggaagggaatccatctggttag

SEQ ID NO: 7519336 - DNA, 22 bp, Homo sapiens
ggaagggaaaattcattcggct

SEQ ID NO: 7519337 - DNA, 22 bp, Homo sapiens
ggaaggctttgtagaagtgcca

SEQ ID NO: 7519338 - DNA, 22 bp, Homo sapiens
ggaagggaaaattcattcggct

SEQ ID NO: 7519339 - DNA, 22 bp, Homo sapiens
ggaagggaaaattcattcggct

SEQ ID NO: 7519340 - DNA, 22 bp, Homo sapiens
ggaagggaaaattcattcggct

SEQ ID NO: 7519341 - DNA, 22 bp, Homo sapiens
ggaagggaaaattcattcggct

SEQ ID NO: 7519342 - DNA, 22 bp, Homo sapiens
ggacaggagtgaggcgggttcc

SEQ ID NO: 7519343 - DNA, 22 bp, Homo sapiens
ggacaggagtgaggcgggttcc

SEQ ID NO: 7519344 - DNA, 18 bp, Homo sapiens
ggacaggagacatgggtg

SEQ ID NO: 7519345 - DNA, 18 bp, Homo sapiens
ggacaggagacatgggtg

SEQ ID NO: 7519346 - DNA, 22 bp, Homo sapiens
ggacagagggttgacagagtat

SEQ ID NO: 7519347 - DNA, 22 bp, Homo sapiens
ggacagagggttgacagagtat

SEQ ID NO: 7519348 - DNA, 22 bp, Homo sapiens
ggacagagggttgacagagtat

SEQ ID NO: 7519349 - DNA, 18 bp, Homo sapiens
ggacaggagacatgggtg

SEQ ID NO: 7519350 - DNA, 18 bp, Homo sapiens
ggacaggagacatgggtg

SEQ ID NO: 7519351 - DNA, 22 bp, Homo sapiens
ggacaggatgctgaagatgaag

SEQ ID NO: 7519352 - DNA, 22 bp, Homo sapiens
ggacaggatgctgaagatgaag

SEQ ID NO: 7519353 - DNA, 22 bp, Homo sapiens
ggacaggatgctgaagatgaag

SEQ ID NO: 7519354 - DNA, 22 bp, Homo sapiens
ggacaggatgctgaagatgaag

SEQ ID NO: 7519355 - DNA, 22 bp, Homo sapiens
ggacaggagtgaggcgggttcc

SEQ ID NO: 7519356 - DNA, 22 bp, Homo sapiens
ggacaggataagagacactgcc

SEQ ID NO: 7519357 - DNA, 22 bp, Homo sapiens
ggacaggataagagacactgcc

SEQ ID NO: 7519358 - DNA, 22 bp, Homo sapiens
ggacaggataagagacactgcc

SEQ ID NO: 7519359 - DNA, 22 bp, Homo sapiens
ggacaggataagagacactgcc

SEQ ID NO: 7519360 - DNA, 22 bp, Homo sapiens
ggaaggcagaggtgtcgtgggg

SEQ ID NO: 7519361 - DNA, 22 bp, Homo sapiens
ggaaggcagaggtgtcgtgggg

SEQ ID NO: 7519362 - DNA, 19 bp, Homo sapiens
ggaaggcagaggggctgtg

SEQ ID NO: 7519363 - DNA, 22 bp, Homo sapiens
ggaaggcagtgaaggggctgat

SEQ ID NO: 7519364 - DNA, 22 bp, Homo sapiens
ggaaggcagtgaaggggctgat

SEQ ID NO: 7519365 - DNA, 22 bp, Homo sapiens
ggaaggcagtgaaggggctgat

SEQ ID NO: 7519366 - DNA, 22 bp, Homo sapiens
ggaaggcagaggtgtcgtgggg

SEQ ID NO: 7519367 - DNA, 22 bp, Homo sapiens
ggaaggcagtgaaggggctgat

SEQ ID NO: 7519368 - DNA, 22 bp, Homo sapiens
ggaaggcagtgaaggggctgat

SEQ ID NO: 7519369 - DNA, 22 bp, Homo sapiens
ggaaggcagtgaaggggctgat

SEQ ID NO: 7519370 - DNA, 19 bp, Homo sapiens
ggaaggccacggcaggctt

SEQ ID NO: 7519371 - DNA, 22 bp, Homo sapiens
ggaaggcagtgaaggggctgat

SEQ ID NO: 7519372 - DNA, 22 bp, Homo sapiens
ggaaggcagtgaaggggctgat

SEQ ID NO: 7519373 - DNA, 22 bp, Homo sapiens
ggaaggctaataatgcaagaaa

SEQ ID NO: 7519374 - DNA, 22 bp, Homo sapiens
ggaaggctaataatgcaagaaa

SEQ ID NO: 7519375 - DNA, 19 bp, Homo sapiens
ggaaggccacggcaggctt

SEQ ID NO: 7519376 - DNA, 19 bp, Homo sapiens
ggaaggccacggcaggctt

SEQ ID NO: 7519377 - DNA, 22 bp, Homo sapiens
ggaaggctaataatgcaagaaa

SEQ ID NO: 7519378 - DNA, 22 bp, Homo sapiens
ggaaggctaataatgcaagaaa

SEQ ID NO: 7519379 - DNA, 22 bp, Homo sapiens
ggaaggctacaggaatccagcg

SEQ ID NO: 7519380 - DNA, 22 bp, Homo sapiens
ggaaggctccacccaaggcgag

SEQ ID NO: 7519381 - DNA, 21 bp, Homo sapiens
ggaaggctatggtgtattttt

SEQ ID NO: 7519382 - DNA, 22 bp, Homo sapiens
ggaaggctccatacacaaagca

SEQ ID NO: 7519383 - DNA, 22 bp, Homo sapiens
ggaaggctccacccaaggcgag

SEQ ID NO: 7519384 - DNA, 22 bp, Homo sapiens
ggaaggctctgttccttgactt

SEQ ID NO: 7519385 - DNA, 22 bp, Homo sapiens
ggaaggctgtgcagtgtttgca

SEQ ID NO: 7519386 - DNA, 22 bp, Homo sapiens
ggaaggctgtgccagaagaact

SEQ ID NO: 7519387 - DNA, 22 bp, Homo sapiens
ggaaggctgtgccagaagaact

SEQ ID NO: 7519388 - DNA, 22 bp, Homo sapiens
ggaaggctgttcactaacatgt

SEQ ID NO: 7519389 - DNA, 22 bp, Homo sapiens
ggaaggctgttcactaacatgt

SEQ ID NO: 7519390 - DNA, 22 bp, Homo sapiens
ggaaggctttgtagaagtgcca

SEQ ID NO: 7519391 - DNA, 22 bp, Homo sapiens
ggaaggctttctgttctgtgac

SEQ ID NO: 7519392 - DNA, 22 bp, Homo sapiens
ggaaggctttgaggggtgctgg

SEQ ID NO: 7519393 - DNA, 20 bp, Homo sapiens
ggaaggcttgaagtttacat

SEQ ID NO: 7519394 - DNA, 22 bp, Homo sapiens
ggaaggctttctgttctgtgac

SEQ ID NO: 7519395 - DNA, 19 bp, Homo sapiens
ggaaggagagaaatgcatg

SEQ ID NO: 7519396 - DNA, 22 bp, Homo sapiens
ggaaggaattccaagactaaag

SEQ ID NO: 7519397 - DNA, 19 bp, Homo sapiens
ggaaggagagaaatgcatg

SEQ ID NO: 7519398 - DNA, 22 bp, Homo sapiens
ggaaggaattccaagactaaag

SEQ ID NO: 7519399 - DNA, 22 bp, Homo sapiens
ggaaggaagtgcagactttaaa

SEQ ID NO: 7519400 - DNA, 22 bp, Homo sapiens
ggaaggaattccaagactaaag

SEQ ID NO: 7519401 - DNA, 22 bp, Homo sapiens
ggaaggaattccaagactaaag

SEQ ID NO: 7519402 - DNA, 22 bp, Homo sapiens
ggaaggaattccaagactaaag

SEQ ID NO: 7519403 - DNA, 22 bp, Homo sapiens
ggaaggaattccaagactaaag

SEQ ID NO: 7519404 - DNA, 19 bp, Homo sapiens
ggaaggagagaaatgcatg

SEQ ID NO: 7519405 - DNA, 22 bp, Homo sapiens
ggaaggagcatttgccagttta

SEQ ID NO: 7519406 - DNA, 19 bp, Homo sapiens
ggaaggagagaaatgcatg

SEQ ID NO: 7519407 - DNA, 19 bp, Homo sapiens
ggaaggagagaaatgcatg

SEQ ID NO: 7519408 - DNA, 19 bp, Homo sapiens
ggaaggagagaaatgcatg

SEQ ID NO: 7519409 - DNA, 19 bp, Homo sapiens
ggaaggagagaaatgcatg

SEQ ID NO: 7519410 - DNA, 22 bp, Homo sapiens
ggaaggagcatttgccagttta

SEQ ID NO: 7519411 - DNA, 22 bp, Homo sapiens
ggaaggagcatttgccagttta

SEQ ID NO: 7519412 - DNA, 22 bp, Homo sapiens
ggaaggagcatttgccagttta

SEQ ID NO: 7519413 - DNA, 22 bp, Homo sapiens
ggaaggaagtgcagactttaaa

SEQ ID NO: 7519414 - DNA, 22 bp, Homo sapiens
ggaaggaagtgaccaggatatc

SEQ ID NO: 7519415 - DNA, 22 bp, Homo sapiens
ggaaggaagtgaccaggatatc

SEQ ID NO: 7519416 - DNA, 22 bp, Homo sapiens
ggaaaaatgacacatatctcaa

SEQ ID NO: 7519417 - DNA, 22 bp, Homo sapiens
ggaaaaatgacacatatctcaa

SEQ ID NO: 7519418 - DNA, 22 bp, Homo sapiens
ggaaaaatgacacatatctcaa

SEQ ID NO: 7519419 - DNA, 22 bp, Homo sapiens
ggaaaaatgacacatatctcaa

SEQ ID NO: 7519420 - DNA, 22 bp, Homo sapiens
ggaaaaacagtctttattattt

SEQ ID NO: 7519421 - DNA, 23 bp, Homo sapiens
ggaaaaacactgtgtcttggcag

SEQ ID NO: 7519422 - DNA, 22 bp, Homo sapiens
ggaaaaacagtctttattattt

SEQ ID NO: 7519423 - DNA, 22 bp, Homo sapiens
ggaaaaatagagtatactttaa

SEQ ID NO: 7519424 - DNA, 22 bp, Homo sapiens
ggaaaaatagagtatactttaa

SEQ ID NO: 7519425 - DNA, 22 bp, Homo sapiens
ggaaaaatagagtatactttaa

SEQ ID NO: 7519426 - DNA, 22 bp, Homo sapiens
ggaaaaacagtctttattattt

SEQ ID NO: 7519427 - DNA, 22 bp, Homo sapiens
ggaaaaacagtctttattattt

SEQ ID NO: 7519428 - DNA, 22 bp, Homo sapiens
ggaaggaggggcaaagcagttc

SEQ ID NO: 7519429 - DNA, 22 bp, Homo sapiens
ggaaggaggggcaaagcagttc

SEQ ID NO: 7519430 - DNA, 22 bp, Homo sapiens
ggaaggaggggcaaagcagttc

SEQ ID NO: 7519431 - DNA, 22 bp, Homo sapiens
ggaaggaggggcaaagcagttc

SEQ ID NO: 7519432 - DNA, 22 bp, Homo sapiens
ggaaggaggggcaaagcagttc

SEQ ID NO: 7519433 - DNA, 22 bp, Homo sapiens
ggaaggaggggcaaagcagttc

SEQ ID NO: 7519434 - DNA, 22 bp, Homo sapiens
ggaaggagggcggcaatgatga

SEQ ID NO: 7519435 - DNA, 22 bp, Homo sapiens
ggaaggagggcggcaatgatga

SEQ ID NO: 7519436 - DNA, 22 bp, Homo sapiens
ggaaggaggatgctctggcctt

SEQ ID NO: 7519437 - DNA, 22 bp, Homo sapiens
ggaaggaggatgctctggcctt

SEQ ID NO: 7519438 - DNA, 22 bp, Homo sapiens
ggaaggaggatgctctggcctt

SEQ ID NO: 7519439 - DNA, 22 bp, Homo sapiens
ggaaggaggatgctctggcctt

SEQ ID NO: 7519440 - DNA, 22 bp, Homo sapiens
ggaaggaggatgctctggcctt

SEQ ID NO: 7519441 - DNA, 22 bp, Homo sapiens
ggaaggagccatatcatatcca

SEQ ID NO: 7519442 - DNA, 22 bp, Homo sapiens
ggaaggagccatatcatatcca

SEQ ID NO: 7519443 - DNA, 22 bp, Homo sapiens
ggaaggaggatgctctggcctt

SEQ ID NO: 7519444 - DNA, 22 bp, Homo sapiens
ggaaggaggatgctctggcctt

SEQ ID NO: 7519445 - DNA, 22 bp, Homo sapiens
ggaaggagtctttaacacccat

SEQ ID NO: 7519446 - DNA, 22 bp, Homo sapiens
ggaaggagtctttaacacccat

SEQ ID NO: 7519447 - DNA, 18 bp, Homo sapiens
ggaaggagtggaccccag

SEQ ID NO: 7519448 - DNA, 22 bp, Homo sapiens
ggaaggagtctttaacacccat

SEQ ID NO: 7519449 - DNA, 22 bp, Homo sapiens
ggaaggaggggcaaagcagttc

SEQ ID NO: 7519450 - DNA, 22 bp, Homo sapiens
ggaaggaggggcaaagcagttc

SEQ ID NO: 7519451 - DNA, 22 bp, Homo sapiens
ggaaggaggggcaaagcagttc

SEQ ID NO: 7519452 - DNA, 22 bp, Homo sapiens
ggaaggaggggcaaagcagttc

SEQ ID NO: 7519453 - DNA, 22 bp, Homo sapiens
ggaaggaggggcaaagcagttc

SEQ ID NO: 7519454 - DNA, 18 bp, Homo sapiens
ggaaggagtggaccccag

SEQ ID NO: 7519455 - DNA, 18 bp, Homo sapiens
ggaaggagtggaccccag

SEQ ID NO: 7519456 - DNA, 19 bp, Homo sapiens
ggaaggcagaggggctgtg

SEQ ID NO: 7519457 - DNA, 19 bp, Homo sapiens
ggaaggcagaggggctgtg

SEQ ID NO: 7519458 - DNA, 18 bp, Homo sapiens
ggaaggagtggaccccag

SEQ ID NO: 7519459 - DNA, 19 bp, Homo sapiens
ggaaggcagaggggctgtg

SEQ ID NO: 7519460 - DNA, 19 bp, Homo sapiens
ggaaggcagaggggctgtg

SEQ ID NO: 7519461 - DNA, 19 bp, Homo sapiens
ggaaggcagaggggctgtg

SEQ ID NO: 7519462 - DNA, 19 bp, Homo sapiens
ggaaggcagaggggctgtg

SEQ ID NO: 7519463 - DNA, 19 bp, Homo sapiens
ggaaggcagaggggctgtg

SEQ ID NO: 7519464 - DNA, 22 bp, Homo sapiens
ggagcctggcaatgctgcgtcc

SEQ ID NO: 7519465 - DNA, 22 bp, Homo sapiens
ggagcctggcaatgctgcgtcc

SEQ ID NO: 7519466 - DNA, 22 bp, Homo sapiens
ggagcctggcaatgctgcgtcc

SEQ ID NO: 7519467 - DNA, 22 bp, Homo sapiens
ggagcctggagtttctgatggg

SEQ ID NO: 7519468 - DNA, 22 bp, Homo sapiens
ggagcctggagtttctgatggg

SEQ ID NO: 7519469 - DNA, 22 bp, Homo sapiens
ggagccctcaccggcgagtgcc

SEQ ID NO: 7519470 - DNA, 22 bp, Homo sapiens
ggagccctcaccggcgagtgcc

SEQ ID NO: 7519471 - DNA, 22 bp, Homo sapiens
ggagccctcaccggcgagtgcc

SEQ ID NO: 7519472 - DNA, 22 bp, Homo sapiens
ggagcccagtcggggtgtaggt

SEQ ID NO: 7519473 - DNA, 22 bp, Homo sapiens
ggagcccagtcggggtgtaggt

SEQ ID NO: 7519474 - DNA, 18 bp, Homo sapiens
ggagcccagaggtgagtt

SEQ ID NO: 7519475 - DNA, 18 bp, Homo sapiens
ggagcccagaggtgagtt

SEQ ID NO: 7519476 - DNA, 22 bp, Homo sapiens
ggagccccaattgagcagtacg

SEQ ID NO: 7519477 - DNA, 22 bp, Homo sapiens
ggagccccaattgagcagtacg

SEQ ID NO: 7519478 - DNA, 22 bp, Homo sapiens
ggagccctcaccggcgagtgcc

SEQ ID NO: 7519479 - DNA, 22 bp, Homo sapiens
ggagccctagctgtgcatcaga

SEQ ID NO: 7519480 - DNA, 19 bp, Homo sapiens
ggagcctggcaggggcgtg

SEQ ID NO: 7519481 - DNA, 19 bp, Homo sapiens
ggagcctggcaggggcgtg

SEQ ID NO: 7519482 - DNA, 19 bp, Homo sapiens
ggagcctggcaggggcgtg

SEQ ID NO: 7519483 - DNA, 23 bp, Homo sapiens
ggagcctggcatatgagacgcat

SEQ ID NO: 7519484 - DNA, 19 bp, Homo sapiens
ggagcctggcaggggcgtg

SEQ ID NO: 7519485 - DNA, 22 bp, Homo sapiens
ggagcctggcaatgctgcgtcc

SEQ ID NO: 7519486 - DNA, 22 bp, Homo sapiens
ggagcctggcccggcccttggc

SEQ ID NO: 7519487 - DNA, 22 bp, Homo sapiens
ggagcctggcccggcccttggc

SEQ ID NO: 7519488 - DNA, 22 bp, Homo sapiens
ggagcctggcccggcccttggc

SEQ ID NO: 7519489 - DNA, 22 bp, Homo sapiens
ggagcctggcccggcccttggc

SEQ ID NO: 7519490 - DNA, 23 bp, Homo sapiens
ggagcctggcatatgagacgcat

SEQ ID NO: 7519491 - DNA, 23 bp, Homo sapiens
ggagcctggcatatgagacgcat

SEQ ID NO: 7519492 - DNA, 19 bp, Homo sapiens
ggagcctggcaggggcgtg

SEQ ID NO: 7519493 - DNA, 18 bp, Homo sapiens
ggagccagtctgtctctg

SEQ ID NO: 7519494 - DNA, 18 bp, Homo sapiens
ggagccagtctgtctctg

SEQ ID NO: 7519495 - DNA, 22 bp, Homo sapiens
ggagccagtgccctctggtgga

SEQ ID NO: 7519496 - DNA, 22 bp, Homo sapiens
ggagccagtgccctctggtgga

SEQ ID NO: 7519497 - DNA, 22 bp, Homo sapiens
ggagccagtgccctctggtgga

SEQ ID NO: 7519498 - DNA, 18 bp, Homo sapiens
ggagccagtctgtctctg

SEQ ID NO: 7519499 - DNA, 22 bp, Homo sapiens
ggagccagtatttagtggtctt

SEQ ID NO: 7519500 - DNA, 22 bp, Homo sapiens
ggagccagtatttagtggtctt

SEQ ID NO: 7519501 - DNA, 22 bp, Homo sapiens
ggagccagtatttagtggtctt

SEQ ID NO: 7519502 - DNA, 22 bp, Homo sapiens
ggagccagtatttagtggtctt

SEQ ID NO: 7519503 - DNA, 22 bp, Homo sapiens
ggagccagtgccctctggtgga

SEQ ID NO: 7519504 - DNA, 22 bp, Homo sapiens
ggagccagtgccctctggtgga

SEQ ID NO: 7519505 - DNA, 22 bp, Homo sapiens
ggagccagtgccctctggtgga

SEQ ID NO: 7519506 - DNA, 22 bp, Homo sapiens
ggagccagtgccctctggtgga

SEQ ID NO: 7519507 - DNA, 22 bp, Homo sapiens
ggagccagtttagacctcagtt

SEQ ID NO: 7519508 - DNA, 22 bp, Homo sapiens
ggagccagtttagacctcagtt

SEQ ID NO: 7519509 - DNA, 22 bp, Homo sapiens
ggagccagtgccctctggtgga

SEQ ID NO: 7519510 - DNA, 22 bp, Homo sapiens
ggagccagtttagacctcagtt

SEQ ID NO: 7519511 - DNA, 22 bp, Homo sapiens
ggagccagtttagacctcagtt

SEQ ID NO: 7519512 - DNA, 18 bp, Homo sapiens
ggagcccacggcgtccca

SEQ ID NO: 7519513 - DNA, 18 bp, Homo sapiens
ggagcccacggcgtccca

SEQ ID NO: 7519514 - DNA, 18 bp, Homo sapiens
ggagcccacggcgtccca

SEQ ID NO: 7519515 - DNA, 22 bp, Homo sapiens
ggagccatgttttcagcatgat

SEQ ID NO: 7519516 - DNA, 22 bp, Homo sapiens
ggagccatgttttcagcatgat

SEQ ID NO: 7519517 - DNA, 22 bp, Homo sapiens
ggagcccaagtctgcactcggc

SEQ ID NO: 7519518 - DNA, 22 bp, Homo sapiens
ggagcccaagtctgcactcggc

SEQ ID NO: 7519519 - DNA, 22 bp, Homo sapiens
ggagcccaagtctgcactcggc

SEQ ID NO: 7519520 - DNA, 18 bp, Homo sapiens
ggagcccagaggtgagtt

SEQ ID NO: 7519521 - DNA, 18 bp, Homo sapiens
ggagcccagaggtgagtt

SEQ ID NO: 7519522 - DNA, 18 bp, Homo sapiens
ggagcccagaggacagga

SEQ ID NO: 7519523 - DNA, 18 bp, Homo sapiens
ggagcccagaggtgagtt

SEQ ID NO: 7519524 - DNA, 18 bp, Homo sapiens
ggagcccagaggacagga

SEQ ID NO: 7519525 - DNA, 18 bp, Homo sapiens
ggagcccacggcgtccca

SEQ ID NO: 7519526 - DNA, 18 bp, Homo sapiens
ggagcccagaggacagga

SEQ ID NO: 7519527 - DNA, 22 bp, Homo sapiens
ggagccagggaagctgcttcct

SEQ ID NO: 7519528 - DNA, 22 bp, Homo sapiens
ggagccagggaagctgcttcct

SEQ ID NO: 7519529 - DNA, 22 bp, Homo sapiens
ggagccaggcatatcggggcac

SEQ ID NO: 7519530 - DNA, 22 bp, Homo sapiens
ggagccaggcatatcggggcac

SEQ ID NO: 7519531 - DNA, 22 bp, Homo sapiens
ggagccaggcatatcggggcac

SEQ ID NO: 7519532 - DNA, 22 bp, Homo sapiens
ggagccaggcatatcggggcac

SEQ ID NO: 7519533 - DNA, 22 bp, Homo sapiens
ggagccagggaagctgcttcct

SEQ ID NO: 7519534 - DNA, 22 bp, Homo sapiens
ggagccaggggaccttcacaga

SEQ ID NO: 7519535 - DNA, 22 bp, Homo sapiens
ggagccaggggaccttcacaga

SEQ ID NO: 7519536 - DNA, 22 bp, Homo sapiens
ggagccagtatttagtggtctt

SEQ ID NO: 7519537 - DNA, 22 bp, Homo sapiens
ggagccagtatttagtggtctt

SEQ ID NO: 7519538 - DNA, 22 bp, Homo sapiens
ggagccagtatttagtggtctt

SEQ ID NO: 7519539 - DNA, 22 bp, Homo sapiens
ggagccagtatttagtggtctt

SEQ ID NO: 7519540 - DNA, 22 bp, Homo sapiens
ggagccagtatttagtggtctt

SEQ ID NO: 7519541 - DNA, 22 bp, Homo sapiens
ggagaagattggaattaagcac

SEQ ID NO: 7519542 - DNA, 22 bp, Homo sapiens
ggagaagcaggtgctttgggtc

SEQ ID NO: 7519543 - DNA, 17 bp, Homo sapiens
ggagccaggagcccacc

SEQ ID NO: 7519544 - DNA, 22 bp, Homo sapiens
ggagaagcagcttcttgatgaa

SEQ ID NO: 7519545 - DNA, 22 bp, Homo sapiens
ggagaagcagcttcttgatgaa

SEQ ID NO: 7519546 - DNA, 22 bp, Homo sapiens
ggagaagcagcttcttgatgaa

SEQ ID NO: 7519547 - DNA, 22 bp, Homo sapiens
ggagaagcagcttcttgatgaa

SEQ ID NO: 7519548 - DNA, 22 bp, Homo sapiens
ggagaagattggaattaagcac

SEQ ID NO: 7519549 - DNA, 22 bp, Homo sapiens
ggagaagattggaattaagcac

SEQ ID NO: 7519550 - DNA, 22 bp, Homo sapiens
ggagccaggcaatctgtacttt

SEQ ID NO: 7519551 - DNA, 22 bp, Homo sapiens
ggagccaggcaatctgtacttt

SEQ ID NO: 7519552 - DNA, 22 bp, Homo sapiens
ggagccaggcaatctgtacttt

SEQ ID NO: 7519553 - DNA, 22 bp, Homo sapiens
ggagccaggcaatctgtacttt

SEQ ID NO: 7519554 - DNA, 17 bp, Homo sapiens
ggagccaggagcccacc

SEQ ID NO: 7519555 - DNA, 17 bp, Homo sapiens
ggagccaggagcccacc

SEQ ID NO: 7519556 - DNA, 22 bp, Homo sapiens
ggagaagaggagctggaagcct

SEQ ID NO: 7519557 - DNA, 22 bp, Homo sapiens
ggagaagaggagctggaagcct

SEQ ID NO: 7519558 - DNA, 22 bp, Homo sapiens
ggagaagaggagctggaagcct

SEQ ID NO: 7519559 - DNA, 22 bp, Homo sapiens
ggagaagaggagctggaagcct

SEQ ID NO: 7519560 - DNA, 22 bp, Homo sapiens
ggagaagaggagctggaagcct

SEQ ID NO: 7519561 - DNA, 22 bp, Homo sapiens
ggagaagaggagctggaagcct

SEQ ID NO: 7519562 - DNA, 22 bp, Homo sapiens
ggagaagaggagctggaagcct

SEQ ID NO: 7519563 - DNA, 18 bp, Homo sapiens
ggagaagaacagatgtgg

SEQ ID NO: 7519564 - DNA, 18 bp, Homo sapiens
ggagaagaacagatgtgg

SEQ ID NO: 7519565 - DNA, 18 bp, Homo sapiens
ggagaagaacagatgtgg

SEQ ID NO: 7519566 - DNA, 22 bp, Homo sapiens
ggagaagaggagctggaagcct

SEQ ID NO: 7519567 - DNA, 22 bp, Homo sapiens
ggagaagaggagctggaagcct

SEQ ID NO: 7519568 - DNA, 22 bp, Homo sapiens
ggagaagaggagctggaagcct

SEQ ID NO: 7519569 - DNA, 22 bp, Homo sapiens
ggagaagaggagctggaagcct

SEQ ID NO: 7519570 - DNA, 22 bp, Homo sapiens
ggagaagaggagctggaagcct

SEQ ID NO: 7519571 - DNA, 22 bp, Homo sapiens
ggagaagaggagctggaagcct

SEQ ID NO: 7519572 - DNA, 22 bp, Homo sapiens
ggagaagaggagctggaagcct

SEQ ID NO: 7519573 - DNA, 22 bp, Homo sapiens
ggagaaagtacagcaggcaaca

SEQ ID NO: 7519574 - DNA, 22 bp, Homo sapiens
ggagaaagtacagcaggcaaca

SEQ ID NO: 7519575 - DNA, 22 bp, Homo sapiens
ggagaaagtcagctccaagcag

SEQ ID NO: 7519576 - DNA, 22 bp, Homo sapiens
ggagaaagtacagcaggcaaca

SEQ ID NO: 7519577 - DNA, 22 bp, Homo sapiens
ggagaaagtcagctccaagcag

SEQ ID NO: 7519578 - DNA, 22 bp, Homo sapiens
ggagaacaggcaagcatctggc

SEQ ID NO: 7519579 - DNA, 18 bp, Homo sapiens
ggagaagaacagatgtgg

SEQ ID NO: 7519580 - DNA, 18 bp, Homo sapiens
ggagaagaacagatgtgg

SEQ ID NO: 7519581 - DNA, 22 bp, Homo sapiens
ggagaactccaaatccatattt

SEQ ID NO: 7519582 - DNA, 22 bp, Homo sapiens
ggagaacaaatatctggcttct

SEQ ID NO: 7519583 - DNA, 22 bp, Homo sapiens
ggagaacaggcaagcatctggc

SEQ ID NO: 7519584 - DNA, 22 bp, Homo sapiens
ggagaaaggcatagcagaacct

SEQ ID NO: 7519585 - DNA, 22 bp, Homo sapiens
ggagaaaggcatagcagaacct

SEQ ID NO: 7519586 - DNA, 22 bp, Homo sapiens
ggagaaagggactgatctgctc

SEQ ID NO: 7519587 - DNA, 22 bp, Homo sapiens
ggagaaagggactgatctgctc

SEQ ID NO: 7519588 - DNA, 22 bp, Homo sapiens
ggagaaaggcatagcagaacct

SEQ ID NO: 7519589 - DNA, 22 bp, Homo sapiens
ggagaaaggcatagcagaacct

SEQ ID NO: 7519590 - DNA, 22 bp, Homo sapiens
ggagaaagggactgatctgctc

SEQ ID NO: 7519591 - DNA, 22 bp, Homo sapiens
ggagaaagggactgatctgctc

SEQ ID NO: 7519592 - DNA, 22 bp, Homo sapiens
ggagaaagtacagcaggcaaca

SEQ ID NO: 7519593 - DNA, 22 bp, Homo sapiens
ggagaaagtacagcaggcaaca

SEQ ID NO: 7519594 - DNA, 22 bp, Homo sapiens
ggagaaagggactgatctgctc

SEQ ID NO: 7519595 - DNA, 22 bp, Homo sapiens
ggagaaagtacagcaggcaaca

SEQ ID NO: 7519596 - DNA, 22 bp, Homo sapiens
ggagaaagtacagcaggcaaca

SEQ ID NO: 7519597 - DNA, 22 bp, Homo sapiens
ggagcctggtatagtgttgcat

SEQ ID NO: 7519598 - DNA, 22 bp, Homo sapiens
ggagcctggtatagtgttgcat

SEQ ID NO: 7519599 - DNA, 22 bp, Homo sapiens
ggagcctggtatagtgttgcat

SEQ ID NO: 7519600 - DNA, 22 bp, Homo sapiens
ggagcctggtcaggttggctcc

SEQ ID NO: 7519601 - DNA, 22 bp, Homo sapiens
ggagctgcatttagggagcctt

SEQ ID NO: 7519602 - DNA, 22 bp, Homo sapiens
ggagctgcatttagggagcctt

SEQ ID NO: 7519603 - DNA, 22 bp, Homo sapiens
ggagcctggcctggctctgtgt

SEQ ID NO: 7519604 - DNA, 22 bp, Homo sapiens
ggagcctgggcctcctgccctt

SEQ ID NO: 7519605 - DNA, 22 bp, Homo sapiens
ggagcctggtatagtgttgcat

SEQ ID NO: 7519606 - DNA, 22 bp, Homo sapiens
ggagcctgggcctcctgccctt

SEQ ID NO: 7519607 - DNA, 22 bp, Homo sapiens
ggagctggctacagagaactcc

SEQ ID NO: 7519608 - DNA, 22 bp, Homo sapiens
ggagctggctacagagaactcc

SEQ ID NO: 7519609 - DNA, 22 bp, Homo sapiens
ggagctggctacagagaactcc

SEQ ID NO: 7519610 - DNA, 22 bp, Homo sapiens
ggagctggctacagagaactcc

SEQ ID NO: 7519611 - DNA, 22 bp, Homo sapiens
ggagctggctacagagaactcc

SEQ ID NO: 7519612 - DNA, 20 bp, Homo sapiens
ggagctgccctgggctggag

SEQ ID NO: 7519613 - DNA, 22 bp, Homo sapiens
ggagctgctcagagccagtccc

SEQ ID NO: 7519614 - DNA, 22 bp, Homo sapiens
ggagctgctcagagccagtccc

SEQ ID NO: 7519615 - DNA, 22 bp, Homo sapiens
ggagctgcatttagggagcctt

SEQ ID NO: 7519616 - DNA, 20 bp, Homo sapiens
ggagctgccctgggctggag

SEQ ID NO: 7519617 - DNA, 22 bp, Homo sapiens
ggagctgcatttagggagcctt

SEQ ID NO: 7519618 - DNA, 18 bp, Homo sapiens
ggagctgggccccactcc

SEQ ID NO: 7519619 - DNA, 18 bp, Homo sapiens
ggagctgggccccactcc

SEQ ID NO: 7519620 - DNA, 18 bp, Homo sapiens
ggagctgggccccactcc

SEQ ID NO: 7519621 - DNA, 18 bp, Homo sapiens
ggagctgggccccactcc

SEQ ID NO: 7519622 - DNA, 18 bp, Homo sapiens
ggagctgggccccactcc

SEQ ID NO: 7519623 - DNA, 22 bp, Homo sapiens
ggagctgggaccctgtcatctg

SEQ ID NO: 7519624 - DNA, 22 bp, Homo sapiens
ggagctgggaccctgtcatctg

SEQ ID NO: 7519625 - DNA, 21 bp, Homo sapiens
ggagctggggagctggcccca

SEQ ID NO: 7519626 - DNA, 18 bp, Homo sapiens
ggagctgggcctggttcc

SEQ ID NO: 7519627 - DNA, 18 bp, Homo sapiens
ggagctgggcctggttcc

SEQ ID NO: 7519628 - DNA, 18 bp, Homo sapiens
ggagctgggcctggttcc

SEQ ID NO: 7519629 - DNA, 18 bp, Homo sapiens
ggagctgggcctggttcc

SEQ ID NO: 7519630 - DNA, 21 bp, Homo sapiens
ggagctggggagctggcccca

SEQ ID NO: 7519631 - DNA, 21 bp, Homo sapiens
ggagctggggagctggcccca

SEQ ID NO: 7519632 - DNA, 21 bp, Homo sapiens
ggagctggggagctggcccca

SEQ ID NO: 7519633 - DNA, 21 bp, Homo sapiens
ggagctggggagctggcccca

SEQ ID NO: 7519634 - DNA, 21 bp, Homo sapiens
ggagctggggagctggcccca

SEQ ID NO: 7519635 - DNA, 21 bp, Homo sapiens
ggagctggggagctggcccca

SEQ ID NO: 7519636 - DNA, 21 bp, Homo sapiens
ggagctggggagctggcccca

SEQ ID NO: 7519637 - DNA, 21 bp, Homo sapiens
ggagctggggagctggcccca

SEQ ID NO: 7519638 - DNA, 22 bp, Homo sapiens
ggagctgggaccctgtcatctg

SEQ ID NO: 7519639 - DNA, 22 bp, Homo sapiens
ggagctgggaccctgtcatctg

SEQ ID NO: 7519640 - DNA, 22 bp, Homo sapiens
ggagctgggaccctgtcatctg

SEQ ID NO: 7519641 - DNA, 22 bp, Homo sapiens
ggagctgggaccctgtcatctg

SEQ ID NO: 7519642 - DNA, 22 bp, Homo sapiens
ggagctgggaattggatcatct

SEQ ID NO: 7519643 - DNA, 22 bp, Homo sapiens
ggagctgggaattggatcatct

SEQ ID NO: 7519644 - DNA, 22 bp, Homo sapiens
ggagctgggaattggatcatct

SEQ ID NO: 7519645 - DNA, 22 bp, Homo sapiens
ggagctgggaattggatcatct

SEQ ID NO: 7519646 - DNA, 22 bp, Homo sapiens
ggagctgggaactatgtagtat

SEQ ID NO: 7519647 - DNA, 22 bp, Homo sapiens
ggagctgggaactatgtagtat

SEQ ID NO: 7519648 - DNA, 22 bp, Homo sapiens
ggagctgggaactatgtagtat

SEQ ID NO: 7519649 - DNA, 22 bp, Homo sapiens
ggagctgggaactatgtagtat

SEQ ID NO: 7519650 - DNA, 22 bp, Homo sapiens
ggagctggctacagagaactcc

SEQ ID NO: 7519651 - DNA, 22 bp, Homo sapiens
ggagctgggaattggatcatct

SEQ ID NO: 7519652 - DNA, 22 bp, Homo sapiens
ggagctgggaattggatcatct

SEQ ID NO: 7519653 - DNA, 22 bp, Homo sapiens
ggagctgggaactatgtagtat

SEQ ID NO: 7519654 - DNA, 22 bp, Homo sapiens
ggagctgggaattggatcatct

SEQ ID NO: 7519655 - DNA, 22 bp, Homo sapiens
ggagctgggaattggatcatct

SEQ ID NO: 7519656 - DNA, 22 bp, Homo sapiens
ggagctgggaactatgtagtat

SEQ ID NO: 7519657 - DNA, 22 bp, Homo sapiens
ggagctgggaactatgtagtat

SEQ ID NO: 7519658 - DNA, 22 bp, Homo sapiens
ggagctgtgctgggtgatcagg

SEQ ID NO: 7519659 - DNA, 22 bp, Homo sapiens
ggagctgtgcagtgactacaga

SEQ ID NO: 7519660 - DNA, 22 bp, Homo sapiens
ggagctgtgcagtgactacaga

SEQ ID NO: 7519661 - DNA, 22 bp, Homo sapiens
ggagctgtaacgagccattgct

SEQ ID NO: 7519662 - DNA, 22 bp, Homo sapiens
ggagctgtctgtagggcacagg

SEQ ID NO: 7519663 - DNA, 22 bp, Homo sapiens
ggagctgtgttatccattccca

SEQ ID NO: 7519664 - DNA, 22 bp, Homo sapiens
ggagctgtgttatccattccca

SEQ ID NO: 7519665 - DNA, 22 bp, Homo sapiens
ggagctgttaaatgcagaattt

SEQ ID NO: 7519666 - DNA, 22 bp, Homo sapiens
ggagctgttatggcataagcat

SEQ ID NO: 7519667 - DNA, 22 bp, Homo sapiens
ggagctgttatggcataagcat

SEQ ID NO: 7519668 - DNA, 22 bp, Homo sapiens
ggagctgtgggacgctgtccca

SEQ ID NO: 7519669 - DNA, 22 bp, Homo sapiens
ggagctgtgggacgctgtccca

SEQ ID NO: 7519670 - DNA, 22 bp, Homo sapiens
ggagctgtgggacgctgtccca

SEQ ID NO: 7519671 - DNA, 22 bp, Homo sapiens
ggagctggtcagccttgagcat

SEQ ID NO: 7519672 - DNA, 22 bp, Homo sapiens
ggagctggtcagccttgagcat

SEQ ID NO: 7519673 - DNA, 22 bp, Homo sapiens
ggagctggtcagccttgagcat

SEQ ID NO: 7519674 - DNA, 22 bp, Homo sapiens
ggagctggtcagccttgagcat

SEQ ID NO: 7519675 - DNA, 22 bp, Homo sapiens
ggagctggtcagccttgagcat

SEQ ID NO: 7519676 - DNA, 22 bp, Homo sapiens
ggagctggtcagccttgagcat

SEQ ID NO: 7519677 - DNA, 22 bp, Homo sapiens
ggagctggtcagccttgagcat

SEQ ID NO: 7519678 - DNA, 22 bp, Homo sapiens
ggagctggggttggcatcttcc

SEQ ID NO: 7519679 - DNA, 22 bp, Homo sapiens
ggagctggggttggcatcttcc

SEQ ID NO: 7519680 - DNA, 22 bp, Homo sapiens
ggagctggggttggcatcttcc

SEQ ID NO: 7519681 - DNA, 21 bp, Homo sapiens
ggagctggggagctggcccca

SEQ ID NO: 7519682 - DNA, 22 bp, Homo sapiens
ggagctggggttggcatcttcc

SEQ ID NO: 7519683 - DNA, 22 bp, Homo sapiens
ggagctggggttggcatcttcc

SEQ ID NO: 7519684 - DNA, 22 bp, Homo sapiens
ggagctggggttggcatcttcc

SEQ ID NO: 7519685 - DNA, 22 bp, Homo sapiens
ggaggaggggtgactgaatgct

SEQ ID NO: 7519686 - DNA, 22 bp, Homo sapiens
ggaggaggggtgactgaatgct

SEQ ID NO: 7519687 - DNA, 22 bp, Homo sapiens
ggaggaggggtgactgaatgct

SEQ ID NO: 7519688 - DNA, 22 bp, Homo sapiens
ggaggaggggtgactgaatgct

SEQ ID NO: 7519689 - DNA, 22 bp, Homo sapiens
ggaggaggggtgactgaatgct

SEQ ID NO: 7519690 - DNA, 22 bp, Homo sapiens
ggaggaggggtgactgaatgct

SEQ ID NO: 7519691 - DNA, 22 bp, Homo sapiens
ggaggaggggtgactgaatgct

SEQ ID NO: 7519692 - DNA, 22 bp, Homo sapiens
ggaggaggggtgactgaatgct

SEQ ID NO: 7519693 - DNA, 22 bp, Homo sapiens
ggaggaggggtgactgaatgct

SEQ ID NO: 7519694 - DNA, 22 bp, Homo sapiens
ggaggaggggtgactgaatgct

SEQ ID NO: 7519695 - DNA, 22 bp, Homo sapiens
ggaggaggggcgctttgtctat

SEQ ID NO: 7519696 - DNA, 22 bp, Homo sapiens
ggaggaggggcgctttgtctat

SEQ ID NO: 7519697 - DNA, 22 bp, Homo sapiens
ggaggaggggcgctttgtctat

SEQ ID NO: 7519698 - DNA, 22 bp, Homo sapiens
ggaggaggggcgctttgtctat

SEQ ID NO: 7519699 - DNA, 22 bp, Homo sapiens
ggaggaggcggcagaagttcct

SEQ ID NO: 7519700 - DNA, 22 bp, Homo sapiens
ggagctgttgcgcatgcgctcg

SEQ ID NO: 7519701 - DNA, 22 bp, Homo sapiens
ggagctgttgattgtttgagga

SEQ ID NO: 7519702 - DNA, 19 bp, Homo sapiens
ggagcttggtggctgtggc

SEQ ID NO: 7519703 - DNA, 19 bp, Homo sapiens
ggagcttggtggctgtggc

SEQ ID NO: 7519704 - DNA, 21 bp, Homo sapiens
ggaggaaaaaggaatgacttg

SEQ ID NO: 7519705 - DNA, 21 bp, Homo sapiens
ggaggaaaaaggaatgacttg

SEQ ID NO: 7519706 - DNA, 19 bp, Homo sapiens
ggagcttggtggctgtggc

SEQ ID NO: 7519707 - DNA, 21 bp, Homo sapiens
ggaggaaaaaggaatgacttg

SEQ ID NO: 7519708 - DNA, 22 bp, Homo sapiens
ggaggaggcggcagaagttcct

SEQ ID NO: 7519709 - DNA, 21 bp, Homo sapiens
ggaggaaaaaggaatgacttg

SEQ ID NO: 7519710 - DNA, 21 bp, Homo sapiens
ggaggaaaaaggaatgacttg

SEQ ID NO: 7519711 - DNA, 22 bp, Homo sapiens
gcctccctgtagaggccagcct

SEQ ID NO: 7519712 - DNA, 22 bp, Homo sapiens
gcctccctgtagaggccagcct

SEQ ID NO: 7519713 - DNA, 18 bp, Homo sapiens
gcctccctggctacactt

SEQ ID NO: 7519714 - DNA, 22 bp, Homo sapiens
gcctccctgtagaggccagcct

SEQ ID NO: 7519715 - DNA, 22 bp, Homo sapiens
gcctccctgtagaggccagcct

SEQ ID NO: 7519716 - DNA, 18 bp, Homo sapiens
gcctccctggctacactt

SEQ ID NO: 7519717 - DNA, 18 bp, Homo sapiens
gcctccctggctacactt

SEQ ID NO: 7519718 - DNA, 18 bp, Homo sapiens
gcctccctggctacactt

SEQ ID NO: 7519719 - DNA, 18 bp, Homo sapiens
gcctccctggctacactt

SEQ ID NO: 7519720 - DNA, 18 bp, Homo sapiens
gcctccctggctacactt

SEQ ID NO: 7519721 - DNA, 22 bp, Homo sapiens
gcctccctgttcttccacaata

SEQ ID NO: 7519722 - DNA, 22 bp, Homo sapiens
gcctccctgttcttccacaata

SEQ ID NO: 7519723 - DNA, 22 bp, Homo sapiens
gcctccctgttcttccacaata

SEQ ID NO: 7519724 - DNA, 22 bp, Homo sapiens
gcctccctgttcttccacaata

SEQ ID NO: 7519725 - DNA, 22 bp, Homo sapiens
gcctccctgttcttccacaata

SEQ ID NO: 7519726 - DNA, 22 bp, Homo sapiens
gcctccctgttcttccacaata

SEQ ID NO: 7519727 - DNA, 22 bp, Homo sapiens
gcctccctgttcttccacaata

SEQ ID NO: 7519728 - DNA, 22 bp, Homo sapiens
gcctccctgtttcctgctccaa

SEQ ID NO: 7519729 - DNA, 22 bp, Homo sapiens
gcctccctgtttcctgctccaa

SEQ ID NO: 7519730 - DNA, 22 bp, Homo sapiens
gcctccctgtttcctgctccaa

SEQ ID NO: 7519731 - DNA, 22 bp, Homo sapiens
gcctccctgtttcctgctccaa

SEQ ID NO: 7519732 - DNA, 22 bp, Homo sapiens
gcctccctgtttcctgctccaa

SEQ ID NO: 7519733 - DNA, 22 bp, Homo sapiens
gcctccctgtttcctgctccaa

SEQ ID NO: 7519734 - DNA, 22 bp, Homo sapiens
gcctgagtcaagatgtggcacc

SEQ ID NO: 7519735 - DNA, 22 bp, Homo sapiens
gcctgagtaaatatgcggcagg

SEQ ID NO: 7519736 - DNA, 22 bp, Homo sapiens
gcctgagtcaagatgtggcacc

SEQ ID NO: 7519737 - DNA, 22 bp, Homo sapiens
gcctgagtcaagatgtggcacc

SEQ ID NO: 7519738 - DNA, 22 bp, Homo sapiens
gcctgagtgcatctgcagacat

SEQ ID NO: 7519739 - DNA, 22 bp, Homo sapiens
gcctgagggctcctagcaggct

SEQ ID NO: 7519740 - DNA, 18 bp, Homo sapiens
gcctgagggtcaagtgtg

SEQ ID NO: 7519741 - DNA, 22 bp, Homo sapiens
gcctgagggctcctagcaggct

SEQ ID NO: 7519742 - DNA, 22 bp, Homo sapiens
gcctgagggctcctagcaggct

SEQ ID NO: 7519743 - DNA, 22 bp, Homo sapiens
gcctgagggctcctagcaggct

SEQ ID NO: 7519744 - DNA, 22 bp, Homo sapiens
gcctgagggctcctagcaggct

SEQ ID NO: 7519745 - DNA, 22 bp, Homo sapiens
gcctgagggctcctagcaggct

SEQ ID NO: 7519746 - DNA, 22 bp, Homo sapiens
gcctgagggctcctagcaggct

SEQ ID NO: 7519747 - DNA, 22 bp, Homo sapiens
gcctgaggaatgctcctgactt

SEQ ID NO: 7519748 - DNA, 22 bp, Homo sapiens
gcctgagggctcctagcaggct

SEQ ID NO: 7519749 - DNA, 22 bp, Homo sapiens
gcctgaggaattgagggggtaa

SEQ ID NO: 7519750 - DNA, 22 bp, Homo sapiens
gcctgaggaattgagggggtaa

SEQ ID NO: 7519751 - DNA, 22 bp, Homo sapiens
gcctcccttggtgtctcccggg

SEQ ID NO: 7519752 - DNA, 22 bp, Homo sapiens
gcctcccttggtgtctcccggg

SEQ ID NO: 7519753 - DNA, 22 bp, Homo sapiens
gcctcccttggtgtctcccggg

SEQ ID NO: 7519754 - DNA, 22 bp, Homo sapiens
gcctccccaggggtgtcatgag

SEQ ID NO: 7519755 - DNA, 22 bp, Homo sapiens
gcctcccctgcaattgtccttg

SEQ ID NO: 7519756 - DNA, 22 bp, Homo sapiens
gcctccccaggggtgtcatgag

SEQ ID NO: 7519757 - DNA, 22 bp, Homo sapiens
gcctccccaggggtgtcatgag

SEQ ID NO: 7519758 - DNA, 22 bp, Homo sapiens
gcctccccaggggtgtcatgag

SEQ ID NO: 7519759 - DNA, 22 bp, Homo sapiens
gcctccccaggggtgtcatgag

SEQ ID NO: 7519760 - DNA, 22 bp, Homo sapiens
gcctccacttttgctggcttct

SEQ ID NO: 7519761 - DNA, 22 bp, Homo sapiens
gcctccacttctttagtatgac

SEQ ID NO: 7519762 - DNA, 22 bp, Homo sapiens
gcctccactgatcagacttgac

SEQ ID NO: 7519763 - DNA, 22 bp, Homo sapiens
gcctccaccgaacgctctcttg

SEQ ID NO: 7519764 - DNA, 22 bp, Homo sapiens
gcctccacccctggggagtgga

SEQ ID NO: 7519765 - DNA, 22 bp, Homo sapiens
gcctccacccctggggagtgga

SEQ ID NO: 7519766 - DNA, 22 bp, Homo sapiens
gcctccaccgaacgctctcttg

SEQ ID NO: 7519767 - DNA, 22 bp, Homo sapiens
gcctccacccctggggagtgga

SEQ ID NO: 7519768 - DNA, 22 bp, Homo sapiens
gcctccaccgaacgctctcttg

SEQ ID NO: 7519769 - DNA, 22 bp, Homo sapiens
gcctcccctgcaattgtccttg

SEQ ID NO: 7519770 - DNA, 22 bp, Homo sapiens
gcctcccctgcaattgtccttg

SEQ ID NO: 7519771 - DNA, 22 bp, Homo sapiens
gcctccctccaccactgcaggt

SEQ ID NO: 7519772 - DNA, 22 bp, Homo sapiens
gcctccctccaccactgcaggt

SEQ ID NO: 7519773 - DNA, 22 bp, Homo sapiens
gcctccctccaccactgcaggt

SEQ ID NO: 7519774 - DNA, 22 bp, Homo sapiens
gcctcccctgcaattgtccttg

SEQ ID NO: 7519775 - DNA, 22 bp, Homo sapiens
gcctcccctgcaattgtccttg

SEQ ID NO: 7519776 - DNA, 22 bp, Homo sapiens
gcctcccctgcaattgtccttg

SEQ ID NO: 7519777 - DNA, 22 bp, Homo sapiens
gcctccctccaccactgcaggt

SEQ ID NO: 7519778 - DNA, 22 bp, Homo sapiens
gcctccctccaccactgcaggt

SEQ ID NO: 7519779 - DNA, 22 bp, Homo sapiens
gcctccctccaccactgcaggt

SEQ ID NO: 7519780 - DNA, 22 bp, Homo sapiens
gcctccctccaccactgcaggt

SEQ ID NO: 7519781 - DNA, 22 bp, Homo sapiens
gcctccctgagtcacccaagca

SEQ ID NO: 7519782 - DNA, 22 bp, Homo sapiens
gcctccctgagtcacccaagca

SEQ ID NO: 7519783 - DNA, 22 bp, Homo sapiens
gcctccctgagtcacccaagca

SEQ ID NO: 7519784 - DNA, 22 bp, Homo sapiens
gcctccctggcccacagcagcg

SEQ ID NO: 7519785 - DNA, 22 bp, Homo sapiens
gcctccctggcccacagcagcg

SEQ ID NO: 7519786 - DNA, 22 bp, Homo sapiens
gcctccctggcccacagcagcg

SEQ ID NO: 7519787 - DNA, 22 bp, Homo sapiens
gcctccctgagtcacccaagca

SEQ ID NO: 7519788 - DNA, 22 bp, Homo sapiens
gcctccctgagtcacccaagca

SEQ ID NO: 7519789 - DNA, 22 bp, Homo sapiens
gcctccctggcccacagcagcg

SEQ ID NO: 7519790 - DNA, 22 bp, Homo sapiens
gcctccctggcccacagcagcg

SEQ ID NO: 7519791 - DNA, 22 bp, Homo sapiens
gcctccctggcccacagcagcg

SEQ ID NO: 7519792 - DNA, 22 bp, Homo sapiens
gcctccctggcccacagcagcg

SEQ ID NO: 7519793 - DNA, 22 bp, Homo sapiens
gcctgcagatatataggatggt

SEQ ID NO: 7519794 - DNA, 22 bp, Homo sapiens
gcctgcagatatataggatggt

SEQ ID NO: 7519795 - DNA, 22 bp, Homo sapiens
gcctgcagatatataggatggt

SEQ ID NO: 7519796 - DNA, 22 bp, Homo sapiens
gcctgcagaggtgctgctagct

SEQ ID NO: 7519797 - DNA, 22 bp, Homo sapiens
gcctgcagcatgctaggtcttg

SEQ ID NO: 7519798 - DNA, 22 bp, Homo sapiens
gcctgcagcatgctaggtcttg

SEQ ID NO: 7519799 - DNA, 22 bp, Homo sapiens
gcctgcagccagggagttctct

SEQ ID NO: 7519800 - DNA, 22 bp, Homo sapiens
gcctgcagccagggagttctct

SEQ ID NO: 7519801 - DNA, 22 bp, Homo sapiens
gcctgcagcctcaagggctgag

SEQ ID NO: 7519802 - DNA, 22 bp, Homo sapiens
gcctgcagcctcaagggctgag

SEQ ID NO: 7519803 - DNA, 22 bp, Homo sapiens
gcctgcagcccctctgcagtag

SEQ ID NO: 7519804 - DNA, 22 bp, Homo sapiens
gcctgcagcctcaagggctgag

SEQ ID NO: 7519805 - DNA, 22 bp, Homo sapiens
gcctgcagcctcaagggctgag

SEQ ID NO: 7519806 - DNA, 22 bp, Homo sapiens
gcctgcagcctcaagggctgag

SEQ ID NO: 7519807 - DNA, 22 bp, Homo sapiens
gcctgcagcccctctgcagtag

SEQ ID NO: 7519808 - DNA, 22 bp, Homo sapiens
gcctgcagcccctctgcagtag

SEQ ID NO: 7519809 - DNA, 22 bp, Homo sapiens
gcctgcagcccctctgcagtag

SEQ ID NO: 7519810 - DNA, 22 bp, Homo sapiens
gcctgcagcccctctgcagtag

SEQ ID NO: 7519811 - DNA, 17 bp, Homo sapiens
gcctgcaggcccgcaga

SEQ ID NO: 7519812 - DNA, 22 bp, Homo sapiens
gcctgcaggctgtagtttgtga

SEQ ID NO: 7519813 - DNA, 22 bp, Homo sapiens
gcctgcaggctgtagtttgtga

SEQ ID NO: 7519814 - DNA, 22 bp, Homo sapiens
gcctgcagggcccttgtgggtc

SEQ ID NO: 7519815 - DNA, 22 bp, Homo sapiens
gcctgcagggcccttgtgggtc

SEQ ID NO: 7519816 - DNA, 18 bp, Homo sapiens
gcctgcaggcacgggggt

SEQ ID NO: 7519817 - DNA, 17 bp, Homo sapiens
gcctgcaggcccgcaga

SEQ ID NO: 7519818 - DNA, 17 bp, Homo sapiens
gcctgcaggcccgcaga

SEQ ID NO: 7519819 - DNA, 17 bp, Homo sapiens
gcctgcaggcccgcaga

SEQ ID NO: 7519820 - DNA, 22 bp, Homo sapiens
gcctgcagggcctgggcctacc

SEQ ID NO: 7519821 - DNA, 22 bp, Homo sapiens
gcctgcagggcctgggcctacc

SEQ ID NO: 7519822 - DNA, 22 bp, Homo sapiens
gcctgcagggcctgggcctacc

SEQ ID NO: 7519823 - DNA, 18 bp, Homo sapiens
gcctgcaggcacgggggt

SEQ ID NO: 7519824 - DNA, 18 bp, Homo sapiens
gcctgcaggcacgggggt

SEQ ID NO: 7519825 - DNA, 18 bp, Homo sapiens
gcctgcaggcacgggggt

SEQ ID NO: 7519826 - DNA, 22 bp, Homo sapiens
gcctgcagctgcttccacacac

SEQ ID NO: 7519827 - DNA, 22 bp, Homo sapiens
gcctgcagcctcagagaatttt

SEQ ID NO: 7519828 - DNA, 22 bp, Homo sapiens
gcctgcagcctcagagaatttt

SEQ ID NO: 7519829 - DNA, 22 bp, Homo sapiens
gcctgcagcctcagagaatttt

SEQ ID NO: 7519830 - DNA, 22 bp, Homo sapiens
gcctgcagctgcttccacacac

SEQ ID NO: 7519831 - DNA, 22 bp, Homo sapiens
gcctgcagaggtgctgctagct

SEQ ID NO: 7519832 - DNA, 22 bp, Homo sapiens
gcctgcagaggtgctgctagct

SEQ ID NO: 7519833 - DNA, 22 bp, Homo sapiens
gcctgcagaggtgctgctagct

SEQ ID NO: 7519834 - DNA, 20 bp, Homo sapiens
gcctgcagagaaggtcagag

SEQ ID NO: 7519835 - DNA, 22 bp, Homo sapiens
gcctgcagaggtgctgctagct

SEQ ID NO: 7519836 - DNA, 22 bp, Homo sapiens
gcctgcagacgtgttttcctca

SEQ ID NO: 7519837 - DNA, 20 bp, Homo sapiens
gcctgcagagaaggtcagag

SEQ ID NO: 7519838 - DNA, 20 bp, Homo sapiens
gcctgcagagaaggtcagag

SEQ ID NO: 7519839 - DNA, 20 bp, Homo sapiens
gcctgcagagaaggtcagag

SEQ ID NO: 7519840 - DNA, 20 bp, Homo sapiens
gcctgcagagaaggtcagag

SEQ ID NO: 7519841 - DNA, 21 bp, Homo sapiens
gcctgcagaccccaccaggct

SEQ ID NO: 7519842 - DNA, 21 bp, Homo sapiens
gcctgcagaccccaccaggct

SEQ ID NO: 7519843 - DNA, 21 bp, Homo sapiens
gcctgcagaccccaccaggct

SEQ ID NO: 7519844 - DNA, 20 bp, Homo sapiens
gcctgcagagaaggtcagag

SEQ ID NO: 7519845 - DNA, 22 bp, Homo sapiens
gcctgcagaactgtgaggcaat

SEQ ID NO: 7519846 - DNA, 21 bp, Homo sapiens
gcctgcagaccccaccaggct

SEQ ID NO: 7519847 - DNA, 22 bp, Homo sapiens
gcctgcacccacaggcatggcc

SEQ ID NO: 7519848 - DNA, 21 bp, Homo sapiens
gcctgcacacagtaggtgcac

SEQ ID NO: 7519849 - DNA, 21 bp, Homo sapiens
gcctgcacacagtaggtgcac

SEQ ID NO: 7519850 - DNA, 22 bp, Homo sapiens
gcctgcaagatggctggtcact

SEQ ID NO: 7519851 - DNA, 22 bp, Homo sapiens
gcctgatgagcttccagctgag

SEQ ID NO: 7519852 - DNA, 20 bp, Homo sapiens
gcctgatggacatttcagtt

SEQ ID NO: 7519853 - DNA, 22 bp, Homo sapiens
gcctgcagaactgtgaggcaat

SEQ ID NO: 7519854 - DNA, 22 bp, Homo sapiens
gcctgcagaactgtgaggcaat

SEQ ID NO: 7519855 - DNA, 22 bp, Homo sapiens
gcctgcagaactgtgaggcaat

SEQ ID NO: 7519856 - DNA, 19 bp, Homo sapiens
gcctgcagaaaaggcaggg

SEQ ID NO: 7519857 - DNA, 19 bp, Homo sapiens
gcctgcagaaaaggcaggg

SEQ ID NO: 7519858 - DNA, 19 bp, Homo sapiens
gcctgcagaaaaggcaggg

SEQ ID NO: 7519859 - DNA, 19 bp, Homo sapiens
gcctgcagaaaaggcaggg

SEQ ID NO: 7519860 - DNA, 22 bp, Homo sapiens
gcctgcactcaaacactctctt

SEQ ID NO: 7519861 - DNA, 22 bp, Homo sapiens
gcctgcactcaaacactctctt

SEQ ID NO: 7519862 - DNA, 22 bp, Homo sapiens
gcctgcagttctgtgctaggca

SEQ ID NO: 7519863 - DNA, 21 bp, Homo sapiens
gcctgcagttttgaagccctt

SEQ ID NO: 7519864 - DNA, 22 bp, Homo sapiens
gcctgcagttctgtgctaggca

SEQ ID NO: 7519865 - DNA, 22 bp, Homo sapiens
gcctgcagttctgtgctaggca

SEQ ID NO: 7519866 - DNA, 22 bp, Homo sapiens
gcctgcagtgagtgcagaaggt

SEQ ID NO: 7519867 - DNA, 21 bp, Homo sapiens
gcctgcagttttgaagccctt

SEQ ID NO: 7519868 - DNA, 22 bp, Homo sapiens
gcctgccaaaagaagctgctgg

SEQ ID NO: 7519869 - DNA, 22 bp, Homo sapiens
gcctgccaaaagaagctgctgg

SEQ ID NO: 7519870 - DNA, 23 bp, Homo sapiens
gcctggagaaaagctgcagttca

SEQ ID NO: 7519871 - DNA, 23 bp, Homo sapiens
gcctggagaaaagctgcagttca

SEQ ID NO: 7519872 - DNA, 23 bp, Homo sapiens
gcctggagaaaagctgcagttca

SEQ ID NO: 7519873 - DNA, 23 bp, Homo sapiens
gcctggagaaaagctgcagttca

SEQ ID NO: 7519874 - DNA, 23 bp, Homo sapiens
gcctggagaaaagctgcagttca

SEQ ID NO: 7519875 - DNA, 22 bp, Homo sapiens
gcctgcagggcctgggcctacc

SEQ ID NO: 7519876 - DNA, 22 bp, Homo sapiens
gcctgcagggtgatgggctgcc

SEQ ID NO: 7519877 - DNA, 22 bp, Homo sapiens
gcctgcagggcctgggcctacc

SEQ ID NO: 7519878 - DNA, 22 bp, Homo sapiens
gcctgcagggtgatgggctgcc

SEQ ID NO: 7519879 - DNA, 22 bp, Homo sapiens
gcctgcagggtgatgggctgcc

SEQ ID NO: 7519880 - DNA, 22 bp, Homo sapiens
gcctgcagggtgatgggctgcc

SEQ ID NO: 7519881 - DNA, 20 bp, Homo sapiens
gcctgcaggttggatgggat

SEQ ID NO: 7519882 - DNA, 20 bp, Homo sapiens
gcctgcaggttggatgggat

SEQ ID NO: 7519883 - DNA, 20 bp, Homo sapiens
gcctgcaggttggatgggat

SEQ ID NO: 7519884 - DNA, 20 bp, Homo sapiens
gcctgcaggttggatgggat

SEQ ID NO: 7519885 - DNA, 20 bp, Homo sapiens
gcctgcaggttggatgggat

SEQ ID NO: 7519886 - DNA, 22 bp, Homo sapiens
gcctgcagtgagtgcagaaggt

SEQ ID NO: 7519887 - DNA, 22 bp, Homo sapiens
gcctgcagtgagtgcagaaggt

SEQ ID NO: 7519888 - DNA, 22 bp, Homo sapiens
gcctgcagtgagtgcagaaggt

SEQ ID NO: 7519889 - DNA, 22 bp, Homo sapiens
gcctgcagggcccttgtgggtc

SEQ ID NO: 7519890 - DNA, 22 bp, Homo sapiens
gcctggagacagcagaggcggc

SEQ ID NO: 7519891 - DNA, 22 bp, Homo sapiens
gcctggagacagcagaggcggc

SEQ ID NO: 7519892 - DNA, 22 bp, Homo sapiens
gcctggagacagcagaggcggc

SEQ ID NO: 7519893 - DNA, 22 bp, Homo sapiens
gcctggagacagcagaggcggc

SEQ ID NO: 7519894 - DNA, 22 bp, Homo sapiens
gcctggagacaaggacaaaggg

SEQ ID NO: 7519895 - DNA, 22 bp, Homo sapiens
gcctggagacaaggacaaaggg

SEQ ID NO: 7519896 - DNA, 22 bp, Homo sapiens
gcctggagacaaggacaaaggg

SEQ ID NO: 7519897 - DNA, 22 bp, Homo sapiens
gcctggagaattaaaaggaagg

SEQ ID NO: 7519898 - DNA, 22 bp, Homo sapiens
gcctggagaattaaaaggaagg

SEQ ID NO: 7519899 - DNA, 22 bp, Homo sapiens
gcctggagaattaaaaggaagg

SEQ ID NO: 7519900 - DNA, 22 bp, Homo sapiens
gcctggagacaaggacaaaggg

SEQ ID NO: 7519901 - DNA, 22 bp, Homo sapiens
gcctggagaaaggaaggtggga

SEQ ID NO: 7519902 - DNA, 22 bp, Homo sapiens
gcctggagacaaggacaaaggg

SEQ ID NO: 7519903 - DNA, 22 bp, Homo sapiens
gcctggagacaaggacaaaggg

SEQ ID NO: 7519904 - DNA, 22 bp, Homo sapiens
gcctggagacaaggacaaaggg

SEQ ID NO: 7519905 - DNA, 22 bp, Homo sapiens
gcctggagaagatggaactagc

SEQ ID NO: 7519906 - DNA, 22 bp, Homo sapiens
gcctggagaagatggaactagc

SEQ ID NO: 7519907 - DNA, 22 bp, Homo sapiens
gcctggagaattaaaaggaagg

SEQ ID NO: 7519908 - DNA, 22 bp, Homo sapiens
gcctggagaagatggaactagc

SEQ ID NO: 7519909 - DNA, 22 bp, Homo sapiens
gcctggagaagatggaactagc

SEQ ID NO: 7519910 - DNA, 22 bp, Homo sapiens
gcctggagaaaggaaggtggga

SEQ ID NO: 7519911 - DNA, 22 bp, Homo sapiens
gcctggagaaaggaaggtggga

SEQ ID NO: 7519912 - DNA, 22 bp, Homo sapiens
gcctggagaaaggaaggtggga

SEQ ID NO: 7519913 - DNA, 22 bp, Homo sapiens
gcctggagaaaggaaggtggga

SEQ ID NO: 7519914 - DNA, 22 bp, Homo sapiens
gcctggagaaaggaaggtggga

SEQ ID NO: 7519915 - DNA, 22 bp, Homo sapiens
gcctggagaaaggaaggtggga

SEQ ID NO: 7519916 - DNA, 22 bp, Homo sapiens
gcctggagaaaggaaggtggga

SEQ ID NO: 7519917 - DNA, 16 bp, Homo sapiens
gcctggagtggcaggg

SEQ ID NO: 7519918 - DNA, 16 bp, Homo sapiens
gcctggagtggcaggg

SEQ ID NO: 7519919 - DNA, 16 bp, Homo sapiens
gcctggagtggcaggg

SEQ ID NO: 7519920 - DNA, 16 bp, Homo sapiens
gcctggagtggcaggg

SEQ ID NO: 7519921 - DNA, 22 bp, Homo sapiens
gcctggagtggacttggcccct

SEQ ID NO: 7519922 - DNA, 22 bp, Homo sapiens
gcctggagtgcagtggcgtgat

SEQ ID NO: 7519923 - DNA, 22 bp, Homo sapiens
gcctggagtggacttggcccct

SEQ ID NO: 7519924 - DNA, 22 bp, Homo sapiens
gcctggagtgcagtggcgtgat

SEQ ID NO: 7519925 - DNA, 22 bp, Homo sapiens
gcctggagtgcagtggcgtgat

SEQ ID NO: 7519926 - DNA, 22 bp, Homo sapiens
gcctggagtgcagtggcgtgat

SEQ ID NO: 7519927 - DNA, 22 bp, Homo sapiens
gcctggagtagcatggcaagcc

SEQ ID NO: 7519928 - DNA, 22 bp, Homo sapiens
gcctggagtagcatggcaagcc

SEQ ID NO: 7519929 - DNA, 22 bp, Homo sapiens
gcctggagtagcatggcaagcc

SEQ ID NO: 7519930 - DNA, 22 bp, Homo sapiens
gcctggagtagcatggcaagcc

SEQ ID NO: 7519931 - DNA, 22 bp, Homo sapiens
gcctggagtgcagtggcgtgat

SEQ ID NO: 7519932 - DNA, 22 bp, Homo sapiens
gcctggagtgcagtggcgtgat

SEQ ID NO: 7519933 - DNA, 22 bp, Homo sapiens
gcctggagtgcagtggcgtgat

SEQ ID NO: 7519934 - DNA, 22 bp, Homo sapiens
gcctggagtgcagtggcgtgat

SEQ ID NO: 7519935 - DNA, 22 bp, Homo sapiens
gcctggagtgcagtggcgtgat

SEQ ID NO: 7519936 - DNA, 22 bp, Homo sapiens
gcctggagcccagtgtggggct

SEQ ID NO: 7519937 - DNA, 22 bp, Homo sapiens
gcctggagcccagtgtggggct

SEQ ID NO: 7519938 - DNA, 22 bp, Homo sapiens
gcctggagcccagtgtggggct

SEQ ID NO: 7519939 - DNA, 22 bp, Homo sapiens
gcctggagcccagtgtggggct

SEQ ID NO: 7519940 - DNA, 22 bp, Homo sapiens
gcctggagcccagtgtggggct

SEQ ID NO: 7519941 - DNA, 22 bp, Homo sapiens
gcctggagacctgctcctctac

SEQ ID NO: 7519942 - DNA, 22 bp, Homo sapiens
gcctggagaggaagccggtgga

SEQ ID NO: 7519943 - DNA, 22 bp, Homo sapiens
gcctggagaggaagccggtgga

SEQ ID NO: 7519944 - DNA, 22 bp, Homo sapiens
gcctggagaggaagccggtgga

SEQ ID NO: 7519945 - DNA, 22 bp, Homo sapiens
gcctggagaggaagccggtgga

SEQ ID NO: 7519946 - DNA, 22 bp, Homo sapiens
gcctggagagcactgtgcgctt

SEQ ID NO: 7519947 - DNA, 22 bp, Homo sapiens
gcctggagaggaagccggtgga

SEQ ID NO: 7519948 - DNA, 22 bp, Homo sapiens
gcctggagaggaagccggtgga

SEQ ID NO: 7519949 - DNA, 22 bp, Homo sapiens
gcctggagcagacgtgtcccgg

SEQ ID NO: 7519950 - DNA, 22 bp, Homo sapiens
gcctggagcagacgtgtcccgg

SEQ ID NO: 7519951 - DNA, 22 bp, Homo sapiens
gcctggagcccagtgtggggct

SEQ ID NO: 7519952 - DNA, 22 bp, Homo sapiens
gcctggagcagacgtgtcccgg

SEQ ID NO: 7519953 - DNA, 22 bp, Homo sapiens
gcctggagcagacgtgtcccgg

SEQ ID NO: 7519954 - DNA, 22 bp, Homo sapiens
gcctggagcagacgtgtcccgg

SEQ ID NO: 7519955 - DNA, 22 bp, Homo sapiens
gcctggagacctgctcctctac

SEQ ID NO: 7519956 - DNA, 22 bp, Homo sapiens
gcctggagacctgctcctctac

SEQ ID NO: 7519957 - DNA, 22 bp, Homo sapiens
gcctggagacctgctcctctac

SEQ ID NO: 7519958 - DNA, 22 bp, Homo sapiens
gcctggagacagcagaggcggc

SEQ ID NO: 7519959 - DNA, 22 bp, Homo sapiens
gcctggagacagcagaggcggc

SEQ ID NO: 7519960 - DNA, 22 bp, Homo sapiens
gcctggagacagcagaggcggc

SEQ ID NO: 7519961 - DNA, 22 bp, Homo sapiens
gcctggagagcactgtgcgctt

SEQ ID NO: 7519962 - DNA, 22 bp, Homo sapiens
gcctggagagcactgtgcgctt

SEQ ID NO: 7519963 - DNA, 22 bp, Homo sapiens
gcctggagacctgctcctctac

SEQ ID NO: 7519964 - DNA, 22 bp, Homo sapiens
gcctggagagcactgtgcgctt

SEQ ID NO: 7519965 - DNA, 22 bp, Homo sapiens
gcctggagagcactgtgcgctt

SEQ ID NO: 7519966 - DNA, 22 bp, Homo sapiens
gcccctccgggcgcgtcatagc

SEQ ID NO: 7519967 - DNA, 22 bp, Homo sapiens
gcccctccgggcgcgtcatagc

SEQ ID NO: 7519968 - DNA, 22 bp, Homo sapiens
gcccctcccagtcaggagcact

SEQ ID NO: 7519969 - DNA, 22 bp, Homo sapiens
gcccctcccagtcaggagcact

SEQ ID NO: 7519970 - DNA, 22 bp, Homo sapiens
gcccctcccagtcaggagcact

SEQ ID NO: 7519971 - DNA, 22 bp, Homo sapiens
gcccctcccagtcaggagcact

SEQ ID NO: 7519972 - DNA, 22 bp, Homo sapiens
gcccctccatccatcaccgggg

SEQ ID NO: 7519973 - DNA, 22 bp, Homo sapiens
gcccctccatccatcaccgggg

SEQ ID NO: 7519974 - DNA, 22 bp, Homo sapiens
gcccctcccagtcaggagcact

SEQ ID NO: 7519975 - DNA, 22 bp, Homo sapiens
gcccctcccagtcaggagcact

SEQ ID NO: 7519976 - DNA, 22 bp, Homo sapiens
gcccctcccagtcaggagcact

SEQ ID NO: 7519977 - DNA, 22 bp, Homo sapiens
gccccaggttgcctgtcccagg

SEQ ID NO: 7519978 - DNA, 22 bp, Homo sapiens
gccccaggttgcctgtcccagg

SEQ ID NO: 7519979 - DNA, 22 bp, Homo sapiens
gccccaggttgcctgtcccagg

SEQ ID NO: 7519980 - DNA, 22 bp, Homo sapiens
gcccctccatccatcaccgggg

SEQ ID NO: 7519981 - DNA, 22 bp, Homo sapiens
gcccctccatccatcaccgggg

SEQ ID NO: 7519982 - DNA, 22 bp, Homo sapiens
gccccaggtggtaaacctaaga

SEQ ID NO: 7519983 - DNA, 22 bp, Homo sapiens
gccccaggtggtaaacctaaga

SEQ ID NO: 7519984 - DNA, 22 bp, Homo sapiens
gccccaggtggtaaacctaaga

SEQ ID NO: 7519985 - DNA, 22 bp, Homo sapiens
gcccctccgggcgcgtcatagc

SEQ ID NO: 7519986 - DNA, 22 bp, Homo sapiens
gcccctccgggcgcgtcatagc

SEQ ID NO: 7519987 - DNA, 22 bp, Homo sapiens
gcccctccgggcgcgtcatagc

SEQ ID NO: 7519988 - DNA, 22 bp, Homo sapiens
gcccctctcccttgaggcaggc

SEQ ID NO: 7519989 - DNA, 22 bp, Homo sapiens
gcccctctcccttgaggcaggc

SEQ ID NO: 7519990 - DNA, 22 bp, Homo sapiens
gcccctctccttgtgcacctgc

SEQ ID NO: 7519991 - DNA, 22 bp, Homo sapiens
gcccctctcccttgaggcaggc

SEQ ID NO: 7519992 - DNA, 22 bp, Homo sapiens
gcccctctccttgtgcacctgc

SEQ ID NO: 7519993 - DNA, 22 bp, Homo sapiens
gcccctctccttgtgcacctgc

SEQ ID NO: 7519994 - DNA, 22 bp, Homo sapiens
gcccctctccttgtgcacctgc

SEQ ID NO: 7519995 - DNA, 22 bp, Homo sapiens
gcccctctccttgtgcacctgc

SEQ ID NO: 7519996 - DNA, 22 bp, Homo sapiens
gcccctggctggccagctcctc

SEQ ID NO: 7519997 - DNA, 22 bp, Homo sapiens
gcccctgggagcagagccacca

SEQ ID NO: 7519998 - DNA, 22 bp, Homo sapiens
gcccctgggagcagagccacca

SEQ ID NO: 7519999 - DNA, 22 bp, Homo sapiens
gcccctgggagcagagccacca

SEQ ID NO: 7520000 - DNA, 22 bp, Homo sapiens
gcccctctccttgtgcacctgc

SEQ ID NO: 7520001 - DNA, 22 bp, Homo sapiens
gcccctgcctttgaacctggag

SEQ ID NO: 7520002 - DNA, 22 bp, Homo sapiens
gcccctggctggccagctcctc

SEQ ID NO: 7520003 - DNA, 22 bp, Homo sapiens
gcccctggctggccagctcctc

SEQ ID NO: 7520004 - DNA, 22 bp, Homo sapiens
gcccctggctggccagctcctc

SEQ ID NO: 7520005 - DNA, 21 bp, Homo sapiens
gcccaatgaacctgggcagct

SEQ ID NO: 7520006 - DNA, 22 bp, Homo sapiens
gcccaatagagaaatagtgaaa

SEQ ID NO: 7520007 - DNA, 21 bp, Homo sapiens
gcccaatgaacctgggcagct

SEQ ID NO: 7520008 - DNA, 22 bp, Homo sapiens
gcccaatggctgacccggcgct

SEQ ID NO: 7520009 - DNA, 22 bp, Homo sapiens
gcccacacaccagctcaggagg

SEQ ID NO: 7520010 - DNA, 22 bp, Homo sapiens
gcccacacaccagctcaggagg

SEQ ID NO: 7520011 - DNA, 22 bp, Homo sapiens
gcccacacaccagctcaggagg

SEQ ID NO: 7520012 - DNA, 22 bp, Homo sapiens
gcccacacagcagatcctttgg

SEQ ID NO: 7520013 - DNA, 22 bp, Homo sapiens
gcccaaggtcccatggcagcac

SEQ ID NO: 7520014 - DNA, 22 bp, Homo sapiens
gcccaaggtcccatggcagcac

SEQ ID NO: 7520015 - DNA, 22 bp, Homo sapiens
gcccaagtcagtgcttctggca

SEQ ID NO: 7520016 - DNA, 22 bp, Homo sapiens
gcccaaggtcccatggcagcac

SEQ ID NO: 7520017 - DNA, 22 bp, Homo sapiens
gcccaaggtcccatggcagcac

SEQ ID NO: 7520018 - DNA, 22 bp, Homo sapiens
gcccaaggtcccatggcagcac

SEQ ID NO: 7520019 - DNA, 22 bp, Homo sapiens
gcccaaggtcccatggcagcac

SEQ ID NO: 7520020 - DNA, 20 bp, Homo sapiens
gcccaaggtccagaaggggg

SEQ ID NO: 7520021 - DNA, 20 bp, Homo sapiens
gcccaaggtccagaaggggg

SEQ ID NO: 7520022 - DNA, 22 bp, Homo sapiens
gcccacagctcgttcctctcct

SEQ ID NO: 7520023 - DNA, 22 bp, Homo sapiens
gcccacagaggcaccaccaggc

SEQ ID NO: 7520024 - DNA, 22 bp, Homo sapiens
gcccacagaggcaccaccaggc

SEQ ID NO: 7520025 - DNA, 22 bp, Homo sapiens
gcccacagaggcaccaccaggc

SEQ ID NO: 7520026 - DNA, 22 bp, Homo sapiens
gcccacagaggcaccaccaggc

SEQ ID NO: 7520027 - DNA, 22 bp, Homo sapiens
gcccacaccatttattctttgt

SEQ ID NO: 7520028 - DNA, 22 bp, Homo sapiens
gcccacagaggcaccaccaggc

SEQ ID NO: 7520029 - DNA, 22 bp, Homo sapiens
gcccacagaggcaccaccaggc

SEQ ID NO: 7520030 - DNA, 22 bp, Homo sapiens
gccccaggggaggtgccctgca

SEQ ID NO: 7520031 - DNA, 22 bp, Homo sapiens
gccccaggggaggtgccctgca

SEQ ID NO: 7520032 - DNA, 22 bp, Homo sapiens
gccccaggggaggtgccctgca

SEQ ID NO: 7520033 - DNA, 22 bp, Homo sapiens
gcccacaggggacctggtggct

SEQ ID NO: 7520034 - DNA, 22 bp, Homo sapiens
gcccacaggggacctggtggct

SEQ ID NO: 7520035 - DNA, 22 bp, Homo sapiens
gcccacagctcgttcctctcct

SEQ ID NO: 7520036 - DNA, 22 bp, Homo sapiens
gcccacaggggacctggtggct

SEQ ID NO: 7520037 - DNA, 22 bp, Homo sapiens
gcccacaggggacctggtggct

SEQ ID NO: 7520038 - DNA, 22 bp, Homo sapiens
gcccggccaggaacagagtata

SEQ ID NO: 7520039 - DNA, 17 bp, Homo sapiens
gcccgtgggctacggta

SEQ ID NO: 7520040 - DNA, 17 bp, Homo sapiens
gcccgcggcccggggtg

SEQ ID NO: 7520041 - DNA, 22 bp, Homo sapiens
gcccggcagtcacacacccagg

SEQ ID NO: 7520042 - DNA, 22 bp, Homo sapiens
gcccggcagtcacacacccagg

SEQ ID NO: 7520043 - DNA, 22 bp, Homo sapiens
gcccggcagtcacacacccagg

SEQ ID NO: 7520044 - DNA, 22 bp, Homo sapiens
gcccggccaggaacagagtata

SEQ ID NO: 7520045 - DNA, 22 bp, Homo sapiens
gcccgcgccagcctctccatct

SEQ ID NO: 7520046 - DNA, 22 bp, Homo sapiens
gcccgcgccagcctctccatct

SEQ ID NO: 7520047 - DNA, 22 bp, Homo sapiens
gcccgcgccagcctctccatct

SEQ ID NO: 7520048 - DNA, 22 bp, Homo sapiens
gccctagcgccagctcagcacc

SEQ ID NO: 7520049 - DNA, 22 bp, Homo sapiens
gccctagcgccagctcagcacc

SEQ ID NO: 7520050 - DNA, 22 bp, Homo sapiens
gccctagcgccagctcagcacc

SEQ ID NO: 7520051 - DNA, 22 bp, Homo sapiens
gccctagcgccagctcagcacc

SEQ ID NO: 7520052 - DNA, 22 bp, Homo sapiens
gccctagcccgggccacctgtt

SEQ ID NO: 7520053 - DNA, 22 bp, Homo sapiens
gccctacctcagtccagatctg

SEQ ID NO: 7520054 - DNA, 22 bp, Homo sapiens
gccctagaatcacatttcttgt

SEQ ID NO: 7520055 - DNA, 22 bp, Homo sapiens
gccctagccatcctgtgctctg

SEQ ID NO: 7520056 - DNA, 22 bp, Homo sapiens
gccctagccatcctgtgctctg

SEQ ID NO: 7520057 - DNA, 22 bp, Homo sapiens
gcccgcagagatctttaacaaa

SEQ ID NO: 7520058 - DNA, 22 bp, Homo sapiens
gccccttgtctccaggccccaa

SEQ ID NO: 7520059 - DNA, 22 bp, Homo sapiens
gccccttgtctccaggccccaa

SEQ ID NO: 7520060 - DNA, 22 bp, Homo sapiens
gccccttgggaattcctccact

SEQ ID NO: 7520061 - DNA, 22 bp, Homo sapiens
gccccttgggaattcctccact

SEQ ID NO: 7520062 - DNA, 22 bp, Homo sapiens
gccccttgggaattcctccact

SEQ ID NO: 7520063 - DNA, 22 bp, Homo sapiens
gccccttcttctggagattcaa

SEQ ID NO: 7520064 - DNA, 22 bp, Homo sapiens
gccccttctctgaggaacctgc

SEQ ID NO: 7520065 - DNA, 22 bp, Homo sapiens
gccccttctctgaggaacctgc

SEQ ID NO: 7520066 - DNA, 22 bp, Homo sapiens
gccccttctctgaggaacctgc

SEQ ID NO: 7520067 - DNA, 22 bp, Homo sapiens
gccccttctctgaggaacctgc

SEQ ID NO: 7520068 - DNA, 22 bp, Homo sapiens
gcccctgttgtggctttgtcta

SEQ ID NO: 7520069 - DNA, 22 bp, Homo sapiens
gcccctgttgtggctttgtcta

SEQ ID NO: 7520070 - DNA, 22 bp, Homo sapiens
gcccctgggagcagagccacca

SEQ ID NO: 7520071 - DNA, 22 bp, Homo sapiens
gccccttccatcatgtgaggac

SEQ ID NO: 7520072 - DNA, 22 bp, Homo sapiens
gccccttccatcatgtgaggac

SEQ ID NO: 7520073 - DNA, 22 bp, Homo sapiens
gccccttcgtggaagtgcattc

SEQ ID NO: 7520074 - DNA, 22 bp, Homo sapiens
gccccttcgtggaagtgcattc

SEQ ID NO: 7520075 - DNA, 22 bp, Homo sapiens
gccctcagagttccccacagtg

SEQ ID NO: 7520076 - DNA, 22 bp, Homo sapiens
gccctcagaggacagctgactt

SEQ ID NO: 7520077 - DNA, 22 bp, Homo sapiens
gccctcagaggacagctgactt

SEQ ID NO: 7520078 - DNA, 22 bp, Homo sapiens
gccctcagaggacagctgactt

SEQ ID NO: 7520079 - DNA, 19 bp, Homo sapiens
gccctgagtaagctaggag

SEQ ID NO: 7520080 - DNA, 19 bp, Homo sapiens
gccctgagtaagctaggag

SEQ ID NO: 7520081 - DNA, 22 bp, Homo sapiens
gccctcagagttccccacagtg

SEQ ID NO: 7520082 - DNA, 22 bp, Homo sapiens
gccctcagagttccccacagtg

SEQ ID NO: 7520083 - DNA, 19 bp, Homo sapiens
gccctgagtaagctaggag

SEQ ID NO: 7520084 - DNA, 22 bp, Homo sapiens
gccctgagtggtacctgtgggt

SEQ ID NO: 7520085 - DNA, 22 bp, Homo sapiens
gccctgagttgagccttccaaa

SEQ ID NO: 7520086 - DNA, 22 bp, Homo sapiens
gccctgagtggtacctgtgggt

SEQ ID NO: 7520087 - DNA, 22 bp, Homo sapiens
gccctgagtgcctgtgtaagaa

SEQ ID NO: 7520088 - DNA, 22 bp, Homo sapiens
gccctgagttgagccttccaaa

SEQ ID NO: 7520089 - DNA, 22 bp, Homo sapiens
gccctgagtggtacctgtgggt

SEQ ID NO: 7520090 - DNA, 22 bp, Homo sapiens
gccctgagtggtacctgtgggt

SEQ ID NO: 7520091 - DNA, 22 bp, Homo sapiens
gccctgagtggtacctgtgggt

SEQ ID NO: 7520092 - DNA, 22 bp, Homo sapiens
gccctgagtgcctgtgtaagaa

SEQ ID NO: 7520093 - DNA, 19 bp, Homo sapiens
gccctgagtaagctaggag

SEQ ID NO: 7520094 - DNA, 19 bp, Homo sapiens
gccctgagtaagctaggag

SEQ ID NO: 7520095 - DNA, 22 bp, Homo sapiens
gccctgagtggtacctgtgggt

SEQ ID NO: 7520096 - DNA, 22 bp, Homo sapiens
gccctgagtgcctgtgtaagaa

SEQ ID NO: 7520097 - DNA, 22 bp, Homo sapiens
gccctaggcttttgtgactgcc

SEQ ID NO: 7520098 - DNA, 22 bp, Homo sapiens
gccctaggcttttgtgactgcc

SEQ ID NO: 7520099 - DNA, 22 bp, Homo sapiens
gccctaggcttttgtgactgcc

SEQ ID NO: 7520100 - DNA, 21 bp, Homo sapiens
gccctaggctacctggagcgc

SEQ ID NO: 7520101 - DNA, 21 bp, Homo sapiens
gccctaggctacctggagcgc

SEQ ID NO: 7520102 - DNA, 21 bp, Homo sapiens
gccctaggctacctggagcgc

SEQ ID NO: 7520103 - DNA, 22 bp, Homo sapiens
gccctaggcctgtttgtccata

SEQ ID NO: 7520104 - DNA, 22 bp, Homo sapiens
gccctagggggaaccgaggact

SEQ ID NO: 7520105 - DNA, 22 bp, Homo sapiens
gccctagggggaaccgaggact

SEQ ID NO: 7520106 - DNA, 22 bp, Homo sapiens
gccctagggcttttgggcctgt

SEQ ID NO: 7520107 - DNA, 22 bp, Homo sapiens
gccctagggcttttgggcctgt

SEQ ID NO: 7520108 - DNA, 22 bp, Homo sapiens
gccctagggcttttgggcctgt

SEQ ID NO: 7520109 - DNA, 22 bp, Homo sapiens
gccctagggggaaccgaggact

SEQ ID NO: 7520110 - DNA, 22 bp, Homo sapiens
gccctatcattcattgagtgct

SEQ ID NO: 7520111 - DNA, 22 bp, Homo sapiens
gccctagggggaaccgaggact

SEQ ID NO: 7520112 - DNA, 22 bp, Homo sapiens
gccctcagaatgggctctaatc

SEQ ID NO: 7520113 - DNA, 22 bp, Homo sapiens
gccctcagaggacagctgactt

SEQ ID NO: 7520114 - DNA, 22 bp, Homo sapiens
gccctcagaggacagctgactt

SEQ ID NO: 7520115 - DNA, 22 bp, Homo sapiens
gccctcagaatgggctctaatc

SEQ ID NO: 7520116 - DNA, 22 bp, Homo sapiens
gccctggaatctctccatggga

SEQ ID NO: 7520117 - DNA, 22 bp, Homo sapiens
gccctggaatctctccatggga

SEQ ID NO: 7520118 - DNA, 22 bp, Homo sapiens
gccctggaatctctccatggga

SEQ ID NO: 7520119 - DNA, 22 bp, Homo sapiens
gccctggaatctctccatggga

SEQ ID NO: 7520120 - DNA, 22 bp, Homo sapiens
gccctggacagtgacggtgacc

SEQ ID NO: 7520121 - DNA, 20 bp, Homo sapiens
gccctggacgtggcctcggc

SEQ ID NO: 7520122 - DNA, 22 bp, Homo sapiens
gccctggacagtgacggtgacc

SEQ ID NO: 7520123 - DNA, 22 bp, Homo sapiens
gccctggacagtgacggtgacc

SEQ ID NO: 7520124 - DNA, 22 bp, Homo sapiens
gccctgcttctggcatgcagaa

SEQ ID NO: 7520125 - DNA, 22 bp, Homo sapiens
gccctgcttctggcatgcagaa

SEQ ID NO: 7520126 - DNA, 22 bp, Homo sapiens
gccctgcttggtcatggccttc

SEQ ID NO: 7520127 - DNA, 22 bp, Homo sapiens
gccctgcttggtcatggccttc

SEQ ID NO: 7520128 - DNA, 22 bp, Homo sapiens
gccctggaatctctccatggga

SEQ ID NO: 7520129 - DNA, 22 bp, Homo sapiens
gccctggaaaggaacctgggct

SEQ ID NO: 7520130 - DNA, 22 bp, Homo sapiens
gccctggaaaggaacctgggct

SEQ ID NO: 7520131 - DNA, 22 bp, Homo sapiens
gccctgcttggtcatggccttc

SEQ ID NO: 7520132 - DNA, 22 bp, Homo sapiens
gccctggaaaggaacctgggct

SEQ ID NO: 7520133 - DNA, 22 bp, Homo sapiens
gcctcagggggagaggccagct

SEQ ID NO: 7520134 - DNA, 22 bp, Homo sapiens
gcctcagggggagaggccagct

SEQ ID NO: 7520135 - DNA, 22 bp, Homo sapiens
gccctggagagggatatggcat

SEQ ID NO: 7520136 - DNA, 22 bp, Homo sapiens
gccctggagagggatatggcat

SEQ ID NO: 7520137 - DNA, 22 bp, Homo sapiens
gccctggagagggatatggcat

SEQ ID NO: 7520138 - DNA, 20 bp, Homo sapiens
gccctggacgtggcctcggc

SEQ ID NO: 7520139 - DNA, 22 bp, Homo sapiens
gcctcagggggagaggccagct

SEQ ID NO: 7520140 - DNA, 22 bp, Homo sapiens
gcctcagggggagaggccagct

SEQ ID NO: 7520141 - DNA, 22 bp, Homo sapiens
gcctcagggggagaggccagct

SEQ ID NO: 7520142 - DNA, 22 bp, Homo sapiens
gcctcagggggagaggccagct

SEQ ID NO: 7520143 - DNA, 22 bp, Homo sapiens
gcctcaggtaaaacttgagttt

SEQ ID NO: 7520144 - DNA, 22 bp, Homo sapiens
gcctcaggtaaaacttgagttt

SEQ ID NO: 7520145 - DNA, 22 bp, Homo sapiens
gcctcaggtaaaacttgagttt

SEQ ID NO: 7520146 - DNA, 22 bp, Homo sapiens
gcctcaggtgcatctctcattc

SEQ ID NO: 7520147 - DNA, 22 bp, Homo sapiens
gcctcaggtgcatctctcattc

SEQ ID NO: 7520148 - DNA, 22 bp, Homo sapiens
gcctcaggtgcatctctcattc

SEQ ID NO: 7520149 - DNA, 22 bp, Homo sapiens
gcctcaggtaaaacttgagttt

SEQ ID NO: 7520150 - DNA, 19 bp, Homo sapiens
gcctcatttccacctcccc

SEQ ID NO: 7520151 - DNA, 19 bp, Homo sapiens
gcctcatttccacctcccc

SEQ ID NO: 7520152 - DNA, 19 bp, Homo sapiens
gcctcatttccacctcccc

SEQ ID NO: 7520153 - DNA, 22 bp, Homo sapiens
gcctcattacagccaggaagca

SEQ ID NO: 7520154 - DNA, 19 bp, Homo sapiens
gcctcatttccacctcccc

SEQ ID NO: 7520155 - DNA, 23 bp, Homo sapiens
gcctccaaacctctaggctggtg

SEQ ID NO: 7520156 - DNA, 23 bp, Homo sapiens
gcctccaaacctctaggctggtg

SEQ ID NO: 7520157 - DNA, 20 bp, Homo sapiens
gcctccaccccaggcttcag

SEQ ID NO: 7520158 - DNA, 20 bp, Homo sapiens
gcctccaccccaggcttcag

SEQ ID NO: 7520159 - DNA, 20 bp, Homo sapiens
gcctccaccccaggcttcag

SEQ ID NO: 7520160 - DNA, 18 bp, Homo sapiens
gcctccaccatggagggt

SEQ ID NO: 7520161 - DNA, 18 bp, Homo sapiens
gcctccaccatggagggt

SEQ ID NO: 7520162 - DNA, 18 bp, Homo sapiens
gcctccaccatggagggt

SEQ ID NO: 7520163 - DNA, 18 bp, Homo sapiens
gcctccaccatggagggt

SEQ ID NO: 7520164 - DNA, 20 bp, Homo sapiens
gcctccacactcacccctta

SEQ ID NO: 7520165 - DNA, 22 bp, Homo sapiens
gcctcagtgatatgtgggacaa

SEQ ID NO: 7520166 - DNA, 22 bp, Homo sapiens
gcctcagtgatatgtgggacaa

SEQ ID NO: 7520167 - DNA, 20 bp, Homo sapiens
gcctcagtcacatggcctac

SEQ ID NO: 7520168 - DNA, 20 bp, Homo sapiens
gcctcagtcacatggcctac

SEQ ID NO: 7520169 - DNA, 22 bp, Homo sapiens
gcctcagtctcccgagtagctg

SEQ ID NO: 7520170 - DNA, 22 bp, Homo sapiens
gcctcagtctcccgagtagctg

SEQ ID NO: 7520171 - DNA, 22 bp, Homo sapiens
gcctcaggtgcatctctcattc

SEQ ID NO: 7520172 - DNA, 22 bp, Homo sapiens
gcctcaggtgcatctctcattc

SEQ ID NO: 7520173 - DNA, 22 bp, Homo sapiens
gcctcaggtgcatctctcattc

SEQ ID NO: 7520174 - DNA, 22 bp, Homo sapiens
gcctcagttgatctgtgtgagc

SEQ ID NO: 7520175 - DNA, 22 bp, Homo sapiens
gcctcagtggctttaggagttc

SEQ ID NO: 7520176 - DNA, 22 bp, Homo sapiens
gcctcagtggctttaggagttc

SEQ ID NO: 7520177 - DNA, 22 bp, Homo sapiens
gcctcagtttatacacctgtaa

SEQ ID NO: 7520178 - DNA, 22 bp, Homo sapiens
gcctcagtttatacacctgtaa

SEQ ID NO: 7520179 - DNA, 22 bp, Homo sapiens
gcctcagttgatctgtgtgagc

SEQ ID NO: 7520180 - DNA, 18 bp, Homo sapiens
gcctcagtttcctcacct

SEQ ID NO: 7520181 - DNA, 22 bp, Homo sapiens
gcctcatgagggatctgccctc

SEQ ID NO: 7520182 - DNA, 22 bp, Homo sapiens
gccctgcttctggcatgcagaa

SEQ ID NO: 7520183 - DNA, 22 bp, Homo sapiens
gccctgcttctggcatgcagaa

SEQ ID NO: 7520184 - DNA, 22 bp, Homo sapiens
gccctgcttctggcatgcagaa

SEQ ID NO: 7520185 - DNA, 22 bp, Homo sapiens
gccctgctgtttagagagctac

SEQ ID NO: 7520186 - DNA, 22 bp, Homo sapiens
gccctgcttctggcatgcagaa

SEQ ID NO: 7520187 - DNA, 22 bp, Homo sapiens
gccctgctgtttagagagctac

SEQ ID NO: 7520188 - DNA, 22 bp, Homo sapiens
gccctgctgtttagagagctac

SEQ ID NO: 7520189 - DNA, 22 bp, Homo sapiens
gccctgctgtcttcagagtata

SEQ ID NO: 7520190 - DNA, 22 bp, Homo sapiens
gccctgctgtttagagagctac

SEQ ID NO: 7520191 - DNA, 22 bp, Homo sapiens
gccctgctggggcacagcaaga

SEQ ID NO: 7520192 - DNA, 23 bp, Homo sapiens
gccctgctgggacctcctgctac

SEQ ID NO: 7520193 - DNA, 23 bp, Homo sapiens
gccctgctgggacctcctgctac

SEQ ID NO: 7520194 - DNA, 22 bp, Homo sapiens
gccctgctggggcacagcaaga

SEQ ID NO: 7520195 - DNA, 22 bp, Homo sapiens
gccctgctggggcacagcaaga

SEQ ID NO: 7520196 - DNA, 22 bp, Homo sapiens
gccctgctgtcttcagagtata

SEQ ID NO: 7520197 - DNA, 22 bp, Homo sapiens
gccctgctgtcttcagagtata

SEQ ID NO: 7520198 - DNA, 22 bp, Homo sapiens
gccctgctgagtccggctcaga

SEQ ID NO: 7520199 - DNA, 22 bp, Homo sapiens
gccctgctgagtccggctcaga

SEQ ID NO: 7520200 - DNA, 22 bp, Homo sapiens
gccctgctgagtccggctcaga

SEQ ID NO: 7520201 - DNA, 22 bp, Homo sapiens
gccctgctgcgcagcacgcatg

SEQ ID NO: 7520202 - DNA, 22 bp, Homo sapiens
gccctgctgagtccggctcaga

SEQ ID NO: 7520203 - DNA, 22 bp, Homo sapiens
gccctgctgcgcagcacgcatg

SEQ ID NO: 7520204 - DNA, 22 bp, Homo sapiens
gccctgctgcgcagcacgcatg

SEQ ID NO: 7520205 - DNA, 22 bp, Homo sapiens
gccctgctcttttgcccaccca

SEQ ID NO: 7520206 - DNA, 22 bp, Homo sapiens
gccctgctcttttgcccaccca

SEQ ID NO: 7520207 - DNA, 22 bp, Homo sapiens
gccctgctcttttgcccaccca

SEQ ID NO: 7520208 - DNA, 22 bp, Homo sapiens
gccctgctgcgcagcacgcatg

SEQ ID NO: 7520209 - DNA, 22 bp, Homo sapiens
gccctgctgctggcagaggcgc

SEQ ID NO: 7520210 - DNA, 22 bp, Homo sapiens
gccctgctgctggcagaggcgc

SEQ ID NO: 7520211 - DNA, 22 bp, Homo sapiens
gccctgctgctggcagaggcgc

SEQ ID NO: 7520212 - DNA, 22 bp, Homo sapiens
gccctgctgctggcagaggcgc

SEQ ID NO: 7520213 - DNA, 22 bp, Homo sapiens
gccctgctgctggcagaggcgc

SEQ ID NO: 7520214 - DNA, 23 bp, Homo sapiens
gccctgctgggacctcctgctac

SEQ ID NO: 7520215 - DNA, 23 bp, Homo sapiens
gccctgctgggacctcctgctac

SEQ ID NO: 7520216 - DNA, 22 bp, Homo sapiens
gccctgctcatttcacgtgttt

SEQ ID NO: 7520217 - DNA, 22 bp, Homo sapiens
gccctgctcatttcacgtgttt

SEQ ID NO: 7520218 - DNA, 23 bp, Homo sapiens
gccctgctactcacaagctgtgt

SEQ ID NO: 7520219 - DNA, 22 bp, Homo sapiens
gccctgctcatttcacgtgttt

SEQ ID NO: 7520220 - DNA, 22 bp, Homo sapiens
gccctgcgccgtcccgctggtg

SEQ ID NO: 7520221 - DNA, 22 bp, Homo sapiens
gccctgcgccgtcccgctggtg

SEQ ID NO: 7520222 - DNA, 23 bp, Homo sapiens
gccctgctactcacaagctgtgt

SEQ ID NO: 7520223 - DNA, 22 bp, Homo sapiens
gccctgctaatttcgtactttt

SEQ ID NO: 7520224 - DNA, 17 bp, Homo sapiens
gccctgcctgctgccct

SEQ ID NO: 7520225 - DNA, 17 bp, Homo sapiens
gccctgcctgctgccct

SEQ ID NO: 7520226 - DNA, 22 bp, Homo sapiens
gccctgagttgagccttccaaa

SEQ ID NO: 7520227 - DNA, 17 bp, Homo sapiens
gccctgcctgctgccct

SEQ ID NO: 7520228 - DNA, 22 bp, Homo sapiens
gccctgcctgtctgctgggagg

SEQ ID NO: 7520229 - DNA, 22 bp, Homo sapiens
gccctgcctgtctgctgggagg

SEQ ID NO: 7520230 - DNA, 22 bp, Homo sapiens
gccctgcctgtctgctgggagg

SEQ ID NO: 7520231 - DNA, 22 bp, Homo sapiens
gccctgcctgtctgctgggagg

SEQ ID NO: 7520232 - DNA, 22 bp, Homo sapiens
gccctgctcctccgtcccacga

SEQ ID NO: 7520233 - DNA, 22 bp, Homo sapiens
gccctgctcctccgtcccacga

SEQ ID NO: 7520234 - DNA, 22 bp, Homo sapiens
gccctgctcatttcacgtgttt

SEQ ID NO: 7520235 - DNA, 22 bp, Homo sapiens
gccctgctcctccgtcccacga

SEQ ID NO: 7520236 - DNA, 22 bp, Homo sapiens
gccctgctccaggagaataccc

SEQ ID NO: 7520237 - DNA, 22 bp, Homo sapiens
gccctgctccaggagaataccc

SEQ ID NO: 7520238 - DNA, 23 bp, Homo sapiens
gccctgctcctggctgggaggga

SEQ ID NO: 7520239 - DNA, 23 bp, Homo sapiens
gccctgctcctggctgggaggga

SEQ ID NO: 7520240 - DNA, 23 bp, Homo sapiens
gccctgctcctggctgggaggga

SEQ ID NO: 7520241 - DNA, 22 bp, Homo sapiens
gccctgctctggtctctgcccg

SEQ ID NO: 7520242 - DNA, 22 bp, Homo sapiens
gccctgctctggtctctgcccg

SEQ ID NO: 7520243 - DNA, 22 bp, Homo sapiens
gccctgctctggtctctgcccg

SEQ ID NO: 7520244 - DNA, 22 bp, Homo sapiens
gccctgctctggtctctgcccg

SEQ ID NO: 7520245 - DNA, 22 bp, Homo sapiens
gccctgctctggtctctgcccg

SEQ ID NO: 7520246 - DNA, 22 bp, Homo sapiens
gccctgctctgttggtcacctg

SEQ ID NO: 7520247 - DNA, 22 bp, Homo sapiens
gccctgctctgttggtcacctg

SEQ ID NO: 7520248 - DNA, 22 bp, Homo sapiens
gccctgctctgttggtcacctg

SEQ ID NO: 7520249 - DNA, 22 bp, Homo sapiens
gccctgctctggtctctgcccg

SEQ ID NO: 7520250 - DNA, 22 bp, Homo sapiens
gccctgctctggtctctgcccg

SEQ ID NO: 7520251 - DNA, 22 bp, Homo sapiens
gccagctgagaaatcattgata

SEQ ID NO: 7520252 - DNA, 22 bp, Homo sapiens
gccagctgagaaatcattgata

SEQ ID NO: 7520253 - DNA, 22 bp, Homo sapiens
gccagctgagaaatcattgata

SEQ ID NO: 7520254 - DNA, 22 bp, Homo sapiens
gccagctgagcaaattccagct

SEQ ID NO: 7520255 - DNA, 22 bp, Homo sapiens
gccagctgagcaaattccagct

SEQ ID NO: 7520256 - DNA, 22 bp, Homo sapiens
gccagctgagcaaattccagct

SEQ ID NO: 7520257 - DNA, 22 bp, Homo sapiens
gccagctgagcaaattccagct

SEQ ID NO: 7520258 - DNA, 22 bp, Homo sapiens
gccagctgaggccgtgcaggct

SEQ ID NO: 7520259 - DNA, 22 bp, Homo sapiens
gccagctgaggccgtgcaggct

SEQ ID NO: 7520260 - DNA, 22 bp, Homo sapiens
gccagctgaggccgtgcaggct

SEQ ID NO: 7520261 - DNA, 22 bp, Homo sapiens
gccagctgaggccgtgcaggct

SEQ ID NO: 7520262 - DNA, 22 bp, Homo sapiens
gccagctgacaccttgattttg

SEQ ID NO: 7520263 - DNA, 22 bp, Homo sapiens
gccagctgagaaatcattgata

SEQ ID NO: 7520264 - DNA, 22 bp, Homo sapiens
gccagctgagaaatcattgata

SEQ ID NO: 7520265 - DNA, 22 bp, Homo sapiens
gccagagacacttggaggtaga

SEQ ID NO: 7520266 - DNA, 22 bp, Homo sapiens
gccagagacacttggaggtaga

SEQ ID NO: 7520267 - DNA, 22 bp, Homo sapiens
gccagagaatgaaaatcagatt

SEQ ID NO: 7520268 - DNA, 22 bp, Homo sapiens
gccagagaatgaaaatcagatt

SEQ ID NO: 7520269 - DNA, 22 bp, Homo sapiens
gccagaattttgagactacttg

SEQ ID NO: 7520270 - DNA, 22 bp, Homo sapiens
gccagacactcccctgggcagg

SEQ ID NO: 7520271 - DNA, 22 bp, Homo sapiens
gccacttgtgtaagcgcctgtc

SEQ ID NO: 7520272 - DNA, 22 bp, Homo sapiens
gccacttgtgtaagcgcctgtc

SEQ ID NO: 7520273 - DNA, 22 bp, Homo sapiens
gccactttgatgatataaaaac

SEQ ID NO: 7520274 - DNA, 22 bp, Homo sapiens
gccagaaacatacacatcactt

SEQ ID NO: 7520275 - DNA, 22 bp, Homo sapiens
gccagaaacatacacatcactt

SEQ ID NO: 7520276 - DNA, 22 bp, Homo sapiens
gccagaaacatacacatcactt

SEQ ID NO: 7520277 - DNA, 22 bp, Homo sapiens
gccagaaacatacacatcactt

SEQ ID NO: 7520278 - DNA, 22 bp, Homo sapiens
gccagaaacatacacatcactt

SEQ ID NO: 7520279 - DNA, 22 bp, Homo sapiens
gccagaaagaggaggacctggg

SEQ ID NO: 7520280 - DNA, 22 bp, Homo sapiens
gccagaaagaggaggacctggg

SEQ ID NO: 7520281 - DNA, 22 bp, Homo sapiens
gccagaagactggagtcagctg

SEQ ID NO: 7520282 - DNA, 22 bp, Homo sapiens
gccagaagactggagtcagctg

SEQ ID NO: 7520283 - DNA, 22 bp, Homo sapiens
gccagaaagaggaggacctggg

SEQ ID NO: 7520284 - DNA, 22 bp, Homo sapiens
gccagaagactggagtcagctg

SEQ ID NO: 7520285 - DNA, 22 bp, Homo sapiens
gccagaaagaggaggacctggg

SEQ ID NO: 7520286 - DNA, 22 bp, Homo sapiens
gccagaaagaggaggacctggg

SEQ ID NO: 7520287 - DNA, 22 bp, Homo sapiens
gccagaaggggtggatccaggc

SEQ ID NO: 7520288 - DNA, 22 bp, Homo sapiens
gccagaagactggagtcagctg

SEQ ID NO: 7520289 - DNA, 22 bp, Homo sapiens
gccagaaggggtggatccaggc

SEQ ID NO: 7520290 - DNA, 22 bp, Homo sapiens
gccagaaggggtggatccaggc

SEQ ID NO: 7520291 - DNA, 22 bp, Homo sapiens
gccagaaggggtggatccaggc

SEQ ID NO: 7520292 - DNA, 22 bp, Homo sapiens
gccagctgtaagctggggtgat

SEQ ID NO: 7520293 - DNA, 22 bp, Homo sapiens
gccagctgtaagctggggtgat

SEQ ID NO: 7520294 - DNA, 22 bp, Homo sapiens
gccagctgtaagctggggtgat

SEQ ID NO: 7520295 - DNA, 22 bp, Homo sapiens
gccagctgtaagcagtgattct

SEQ ID NO: 7520296 - DNA, 22 bp, Homo sapiens
gccagctgtaagctggggtgat

SEQ ID NO: 7520297 - DNA, 22 bp, Homo sapiens
gccagctgtaagctggggtgat

SEQ ID NO: 7520298 - DNA, 20 bp, Homo sapiens
gccagctggtcccaattatg

SEQ ID NO: 7520299 - DNA, 20 bp, Homo sapiens
gccagctggtcccaattatg

SEQ ID NO: 7520300 - DNA, 20 bp, Homo sapiens
gccagctggtcccaattatg

SEQ ID NO: 7520301 - DNA, 20 bp, Homo sapiens
gccagctggtcccaattatg

SEQ ID NO: 7520302 - DNA, 22 bp, Homo sapiens
gccagctgtaagcagtgattct

SEQ ID NO: 7520303 - DNA, 22 bp, Homo sapiens
gccagctgtaagcagtgattct

SEQ ID NO: 7520304 - DNA, 20 bp, Homo sapiens
gccagctggtcccaattatg

SEQ ID NO: 7520305 - DNA, 22 bp, Homo sapiens
gccagctgtaagcagtgattct

SEQ ID NO: 7520306 - DNA, 22 bp, Homo sapiens
gccagctgtaggtggtgggttg

SEQ ID NO: 7520307 - DNA, 22 bp, Homo sapiens
gccagctgtatctttggccagc

SEQ ID NO: 7520308 - DNA, 22 bp, Homo sapiens
gccagctgtaggtggtgggttg

SEQ ID NO: 7520309 - DNA, 22 bp, Homo sapiens
gccagctgtaggtggtgggttg

SEQ ID NO: 7520310 - DNA, 22 bp, Homo sapiens
gccagctgtctaagagagtaaa

SEQ ID NO: 7520311 - DNA, 22 bp, Homo sapiens
gccagctgtctaagagagtaaa

SEQ ID NO: 7520312 - DNA, 22 bp, Homo sapiens
gccagctgtctaagagagtaaa

SEQ ID NO: 7520313 - DNA, 22 bp, Homo sapiens
gccagctgtctaagagagtaaa

SEQ ID NO: 7520314 - DNA, 22 bp, Homo sapiens
gccagctgtatctttggccagc

SEQ ID NO: 7520315 - DNA, 22 bp, Homo sapiens
gccagctgtatctttggccagc

SEQ ID NO: 7520316 - DNA, 21 bp, Homo sapiens
gccagctgggtcttgcaggag

SEQ ID NO: 7520317 - DNA, 21 bp, Homo sapiens
gccagctgggtcttgcaggag

SEQ ID NO: 7520318 - DNA, 21 bp, Homo sapiens
gccagctgggtcttgcaggag

SEQ ID NO: 7520319 - DNA, 22 bp, Homo sapiens
gccagctggtaggcacctagcc

SEQ ID NO: 7520320 - DNA, 22 bp, Homo sapiens
gccagctggtaggcacctagcc

SEQ ID NO: 7520321 - DNA, 22 bp, Homo sapiens
gccagctggtaggcacctagcc

SEQ ID NO: 7520322 - DNA, 22 bp, Homo sapiens
gccagctggtaggcacctagcc

SEQ ID NO: 7520323 - DNA, 22 bp, Homo sapiens
gccagctggtaggcacctagcc

SEQ ID NO: 7520324 - DNA, 22 bp, Homo sapiens
gccagctggtaggcacctagcc

SEQ ID NO: 7520325 - DNA, 22 bp, Homo sapiens
gccagctgcaaagtatgttgaa

SEQ ID NO: 7520326 - DNA, 22 bp, Homo sapiens
gccagctgcaaagtatgttgaa

SEQ ID NO: 7520327 - DNA, 18 bp, Homo sapiens
gccagctgcacggccctc

SEQ ID NO: 7520328 - DNA, 18 bp, Homo sapiens
gccagctgcacggccctc

SEQ ID NO: 7520329 - DNA, 18 bp, Homo sapiens
gccagctgcacggccctc

SEQ ID NO: 7520330 - DNA, 22 bp, Homo sapiens
gccagctgcaaagtatgttgaa

SEQ ID NO: 7520331 - DNA, 22 bp, Homo sapiens
gccagctgggccttagggctgg

SEQ ID NO: 7520332 - DNA, 22 bp, Homo sapiens
gccagctgggccttagggctgg

SEQ ID NO: 7520333 - DNA, 22 bp, Homo sapiens
gccagctggctgcaggtcccag

SEQ ID NO: 7520334 - DNA, 22 bp, Homo sapiens
gccagctggctgcaggtcccag

SEQ ID NO: 7520335 - DNA, 22 bp, Homo sapiens
gccaggaaggctgaagccagaa

SEQ ID NO: 7520336 - DNA, 22 bp, Homo sapiens
gccaggaaggctgaagccagaa

SEQ ID NO: 7520337 - DNA, 22 bp, Homo sapiens
gccaggaaggctccctggtcac

SEQ ID NO: 7520338 - DNA, 18 bp, Homo sapiens
gccaggaagcatggggac

SEQ ID NO: 7520339 - DNA, 18 bp, Homo sapiens
gccaggaagcatggggac

SEQ ID NO: 7520340 - DNA, 22 bp, Homo sapiens
gccaggaagtcagccaagccca

SEQ ID NO: 7520341 - DNA, 22 bp, Homo sapiens
gccaggaaggctgaagccagaa

SEQ ID NO: 7520342 - DNA, 22 bp, Homo sapiens
gccaggaaggctgaagccagaa

SEQ ID NO: 7520343 - DNA, 22 bp, Homo sapiens
gccaggaagtgcagccctgcca

SEQ ID NO: 7520344 - DNA, 22 bp, Homo sapiens
gccaggaagtcagccaagccca

SEQ ID NO: 7520345 - DNA, 22 bp, Homo sapiens
gccaggaagtgcagccctgcca

SEQ ID NO: 7520346 - DNA, 22 bp, Homo sapiens
gccaggaagttgggccagtcta

SEQ ID NO: 7520347 - DNA, 22 bp, Homo sapiens
gccaggaatcactgctgagtaa

SEQ ID NO: 7520348 - DNA, 22 bp, Homo sapiens
gccaggaatcactgctgagtaa

SEQ ID NO: 7520349 - DNA, 22 bp, Homo sapiens
gccaggaagttgggccagtcta

SEQ ID NO: 7520350 - DNA, 22 bp, Homo sapiens
gccaggcatgtcctctgcagaa

SEQ ID NO: 7520351 - DNA, 22 bp, Homo sapiens
gccaggcatgtcctctgcagaa

SEQ ID NO: 7520352 - DNA, 22 bp, Homo sapiens
gccaggaatcactgctgagtaa

SEQ ID NO: 7520353 - DNA, 22 bp, Homo sapiens
gccaggcatgtcctctgcagaa

SEQ ID NO: 7520354 - DNA, 22 bp, Homo sapiens
gccaggaagcagttagatgggt

SEQ ID NO: 7520355 - DNA, 22 bp, Homo sapiens
gccaggaagcagttagatgggt

SEQ ID NO: 7520356 - DNA, 18 bp, Homo sapiens
gccaggaagcatggggac

SEQ ID NO: 7520357 - DNA, 18 bp, Homo sapiens
gccaggaagaggaatgtg

SEQ ID NO: 7520358 - DNA, 18 bp, Homo sapiens
gccaggaagaggaatgtg

SEQ ID NO: 7520359 - DNA, 18 bp, Homo sapiens
gccaggaagaggaatgtg

SEQ ID NO: 7520360 - DNA, 22 bp, Homo sapiens
gccaggaagagagagccctcca

SEQ ID NO: 7520361 - DNA, 22 bp, Homo sapiens
gccaggaagagagagccctcca

SEQ ID NO: 7520362 - DNA, 22 bp, Homo sapiens
gccaggaacacaatgccaagct

SEQ ID NO: 7520363 - DNA, 22 bp, Homo sapiens
gccaggaacacaatgccaagct

SEQ ID NO: 7520364 - DNA, 22 bp, Homo sapiens
gccaggaacacaatgccaagct

SEQ ID NO: 7520365 - DNA, 22 bp, Homo sapiens
gccaggaaattcatgccagatc

SEQ ID NO: 7520366 - DNA, 22 bp, Homo sapiens
gccaggaacacaatgccaagct

SEQ ID NO: 7520367 - DNA, 22 bp, Homo sapiens
gccaggaaagggaattccctga

SEQ ID NO: 7520368 - DNA, 22 bp, Homo sapiens
gccaggaaattcatgccagatc

SEQ ID NO: 7520369 - DNA, 22 bp, Homo sapiens
gccaggaaagccactggcatac

SEQ ID NO: 7520370 - DNA, 22 bp, Homo sapiens
gccaggaaattcatgccagatc

SEQ ID NO: 7520371 - DNA, 22 bp, Homo sapiens
gccaggaaattcatgccagatc

SEQ ID NO: 7520372 - DNA, 22 bp, Homo sapiens
gccaggaaaaaccggccctgct

SEQ ID NO: 7520373 - DNA, 22 bp, Homo sapiens
gccaggaaaaaccggccctgct

SEQ ID NO: 7520374 - DNA, 23 bp, Homo sapiens
gccagctttggtctgtctcctag

SEQ ID NO: 7520375 - DNA, 22 bp, Homo sapiens
gccaggaaaaacgtggtgggag

SEQ ID NO: 7520376 - DNA, 22 bp, Homo sapiens
gccaggaaaaagggtggccaat

SEQ ID NO: 7520377 - DNA, 22 bp, Homo sapiens
gccaggaaaaagggtggccaat

SEQ ID NO: 7520378 - DNA, 22 bp, Homo sapiens
gccaggaaaaagggtggccaat

SEQ ID NO: 7520379 - DNA, 22 bp, Homo sapiens
gccaggaaaaagggtggccaat

SEQ ID NO: 7520380 - DNA, 22 bp, Homo sapiens
gccaggaaaagaagctggtgct

SEQ ID NO: 7520381 - DNA, 22 bp, Homo sapiens
gccaggaaaagaagctggtgct

SEQ ID NO: 7520382 - DNA, 22 bp, Homo sapiens
gccaggaaaagaagctggtgct

SEQ ID NO: 7520383 - DNA, 19 bp, Homo sapiens
gccaggaaagaatcaggcg

SEQ ID NO: 7520384 - DNA, 19 bp, Homo sapiens
gccaggaaagaatcaggcg

SEQ ID NO: 7520385 - DNA, 19 bp, Homo sapiens
gccaggaaagaatcaggcg

SEQ ID NO: 7520386 - DNA, 22 bp, Homo sapiens
gccaggaaagccactggcatac

SEQ ID NO: 7520387 - DNA, 22 bp, Homo sapiens
gccaggaaagccactggcatac

SEQ ID NO: 7520388 - DNA, 19 bp, Homo sapiens
gccaggaaagaatcaggcg

SEQ ID NO: 7520389 - DNA, 22 bp, Homo sapiens
gccaggaaagcaaaatcaccca

SEQ ID NO: 7520390 - DNA, 22 bp, Homo sapiens
gccagctgtgcttttcctaaaa

SEQ ID NO: 7520391 - DNA, 22 bp, Homo sapiens
gccagctgtgcttttcctaaaa

SEQ ID NO: 7520392 - DNA, 22 bp, Homo sapiens
gccagctgtgcttttcctaaaa

SEQ ID NO: 7520393 - DNA, 22 bp, Homo sapiens
gccagctgtgcttttcctaaaa

SEQ ID NO: 7520394 - DNA, 22 bp, Homo sapiens
gccagctgttcagacattcttt

SEQ ID NO: 7520395 - DNA, 22 bp, Homo sapiens
gccagctgttcagacattcttt

SEQ ID NO: 7520396 - DNA, 22 bp, Homo sapiens
gccagctgtgcttttcctaaaa

SEQ ID NO: 7520397 - DNA, 22 bp, Homo sapiens
gccagctgtttcagagcccagt

SEQ ID NO: 7520398 - DNA, 22 bp, Homo sapiens
gccagctgtttcagagcccagt

SEQ ID NO: 7520399 - DNA, 22 bp, Homo sapiens
gccagctgtttcagagcccagt

SEQ ID NO: 7520400 - DNA, 22 bp, Homo sapiens
gccagctgtttcagagcccagt

SEQ ID NO: 7520401 - DNA, 22 bp, Homo sapiens
gccagctgttcagacattcttt

SEQ ID NO: 7520402 - DNA, 22 bp, Homo sapiens
gccagctgttcagacattcttt

SEQ ID NO: 7520403 - DNA, 22 bp, Homo sapiens
gccagcttcccatctggcttcc

SEQ ID NO: 7520404 - DNA, 22 bp, Homo sapiens
gccagcttccatggccacgtca

SEQ ID NO: 7520405 - DNA, 22 bp, Homo sapiens
gccagcttggcatgtgaggagt

SEQ ID NO: 7520406 - DNA, 22 bp, Homo sapiens
gccagcttggccagtggccagt

SEQ ID NO: 7520407 - DNA, 23 bp, Homo sapiens
gccagctttggtctgtctcctag

SEQ ID NO: 7520408 - DNA, 22 bp, Homo sapiens
gccagctttggcacagggtggt

SEQ ID NO: 7520409 - DNA, 22 bp, Homo sapiens
gccagctttggcacagggtggt

SEQ ID NO: 7520410 - DNA, 22 bp, Homo sapiens
gccaggcattattccgatccct

SEQ ID NO: 7520411 - DNA, 22 bp, Homo sapiens
gccaggcattattccgatccct

SEQ ID NO: 7520412 - DNA, 22 bp, Homo sapiens
gccaggcattattccgatccct

SEQ ID NO: 7520413 - DNA, 22 bp, Homo sapiens
gccaggcgggtctcaaactcct

SEQ ID NO: 7520414 - DNA, 22 bp, Homo sapiens
gccaggcattattccgatccct

SEQ ID NO: 7520415 - DNA, 22 bp, Homo sapiens
gccaggctaagaaaggtgtgat

SEQ ID NO: 7520416 - DNA, 22 bp, Homo sapiens
gccaggctaagaaaggtgtgat

SEQ ID NO: 7520417 - DNA, 22 bp, Homo sapiens
gccaggctaagaaaggtgtgat

SEQ ID NO: 7520418 - DNA, 22 bp, Homo sapiens
gccaggctaagaaaggtgtgat

SEQ ID NO: 7520419 - DNA, 22 bp, Homo sapiens
gccaggctaagaaaggtgtgat

SEQ ID NO: 7520420 - DNA, 22 bp, Homo sapiens
gccaggcgggtctcaaactcct

SEQ ID NO: 7520421 - DNA, 22 bp, Homo sapiens
gccaggcgggtctcaaactcct

SEQ ID NO: 7520422 - DNA, 22 bp, Homo sapiens
gccaggcgggtctcaaactcct

SEQ ID NO: 7520423 - DNA, 22 bp, Homo sapiens
gccaggctcagcagtcaacctg

SEQ ID NO: 7520424 - DNA, 22 bp, Homo sapiens
gccaggctaagaaaggtgtgat

SEQ ID NO: 7520425 - DNA, 22 bp, Homo sapiens
gccaggctaagaaaggtgtgat

SEQ ID NO: 7520426 - DNA, 22 bp, Homo sapiens
gccaggctaagaaaggtgtgat

SEQ ID NO: 7520427 - DNA, 22 bp, Homo sapiens
gccaggctaagaaaggtgtgat

SEQ ID NO: 7520428 - DNA, 22 bp, Homo sapiens
gccaggctcagcagtcaacctg

SEQ ID NO: 7520429 - DNA, 22 bp, Homo sapiens
gccaggctaagaaaggtgtgat

SEQ ID NO: 7520430 - DNA, 22 bp, Homo sapiens
gccaggctcagcagtcaacctg

SEQ ID NO: 7520431 - DNA, 22 bp, Homo sapiens
gccaggctcagcagtcaacctg

SEQ ID NO: 7520432 - DNA, 22 bp, Homo sapiens
gccaggctcagtagcgattcct

SEQ ID NO: 7520433 - DNA, 22 bp, Homo sapiens
gccaggctcagtagcgattcct

SEQ ID NO: 7520434 - DNA, 22 bp, Homo sapiens
gccaggctcagcagtcaacctg

SEQ ID NO: 7520435 - DNA, 22 bp, Homo sapiens
gccaggctcagtagcgattcct

SEQ ID NO: 7520436 - DNA, 22 bp, Homo sapiens
gccaggctccccggatccctgg

SEQ ID NO: 7520437 - DNA, 22 bp, Homo sapiens
gccaggctccccggatccctgg

SEQ ID NO: 7520438 - DNA, 22 bp, Homo sapiens
gccaggctccccggatccctgg

SEQ ID NO: 7520439 - DNA, 22 bp, Homo sapiens
gccaggctccccggatccctgg

SEQ ID NO: 7520440 - DNA, 22 bp, Homo sapiens
gccaggctccccggatccctgg

SEQ ID NO: 7520441 - DNA, 22 bp, Homo sapiens
gccaggctccccggatccctgg

SEQ ID NO: 7520442 - DNA, 22 bp, Homo sapiens
gccaggctccccggatccctgg

SEQ ID NO: 7520443 - DNA, 22 bp, Homo sapiens
gccaggctccccggatccctgg

SEQ ID NO: 7520444 - DNA, 22 bp, Homo sapiens
gccaggctccccggatccctgg

SEQ ID NO: 7520445 - DNA, 22 bp, Homo sapiens
gccaggctccccggatccctgg

SEQ ID NO: 7520446 - DNA, 23 bp, Homo sapiens
gccaggctccggtctgtggccac

SEQ ID NO: 7520447 - DNA, 23 bp, Homo sapiens
gccaggctccggtctgtggccac

SEQ ID NO: 7520448 - DNA, 23 bp, Homo sapiens
gccaggctccggtctgtggccac

SEQ ID NO: 7520449 - DNA, 23 bp, Homo sapiens
gccaggctccggtctgtggccac

SEQ ID NO: 7520450 - DNA, 23 bp, Homo sapiens
gccaggctccggtctgtggccac

SEQ ID NO: 7520451 - DNA, 23 bp, Homo sapiens
gccaggctccggtctgtggccac

SEQ ID NO: 7520452 - DNA, 23 bp, Homo sapiens
gccaggctccggtctgtggccac

SEQ ID NO: 7520453 - DNA, 22 bp, Homo sapiens
gccaggctccaggccctcctga

SEQ ID NO: 7520454 - DNA, 22 bp, Homo sapiens
gccaggctcagtagcgattcct

SEQ ID NO: 7520455 - DNA, 22 bp, Homo sapiens
gccaggctccaggccctcctga

SEQ ID NO: 7520456 - DNA, 22 bp, Homo sapiens
gccaggctccaggccctcctga

SEQ ID NO: 7520457 - DNA, 22 bp, Homo sapiens
gccaggctccaggccctcctga

SEQ ID NO: 7520458 - DNA, 22 bp, Homo sapiens
gccaggctccaggccctcctga

SEQ ID NO: 7520459 - DNA, 22 bp, Homo sapiens
gccaggctccaggccctcctga

SEQ ID NO: 7520460 - DNA, 22 bp, Homo sapiens
gccaggctccaggccctcctga

SEQ ID NO: 7520461 - DNA, 22 bp, Homo sapiens
gccaggctccaggccctcctga

SEQ ID NO: 7520462 - DNA, 22 bp, Homo sapiens
gccaggctccaggccctcctga

SEQ ID NO: 7520463 - DNA, 22 bp, Homo sapiens
gccaggctccaggccctcctga

SEQ ID NO: 7520464 - DNA, 19 bp, Homo sapiens
gccaggctccatagccggc

SEQ ID NO: 7520465 - DNA, 19 bp, Homo sapiens
gccaggctccatagccggc

SEQ ID NO: 7520466 - DNA, 22 bp, Homo sapiens
gccaggctccaggccctcctga

SEQ ID NO: 7520467 - DNA, 19 bp, Homo sapiens
gccaggctccatagccggc

SEQ ID NO: 7520468 - DNA, 19 bp, Homo sapiens
gccaggctccatagccggc

SEQ ID NO: 7520469 - DNA, 19 bp, Homo sapiens
gccaggctccatagccggc

SEQ ID NO: 7520470 - DNA, 21 bp, Homo sapiens
gccatttcacacagacatttg

SEQ ID NO: 7520471 - DNA, 22 bp, Homo sapiens
gcccaaagccagtgtgctctcc

SEQ ID NO: 7520472 - DNA, 22 bp, Homo sapiens
gcccaaagagctttgatctcag

SEQ ID NO: 7520473 - DNA, 22 bp, Homo sapiens
gcccaaagagctttgatctcag

SEQ ID NO: 7520474 - DNA, 22 bp, Homo sapiens
gcccaaagagctttgatctcag

SEQ ID NO: 7520475 - DNA, 22 bp, Homo sapiens
gccaggctctcagtgactgccc

SEQ ID NO: 7520476 - DNA, 22 bp, Homo sapiens
gccaggctctcagtgactgccc

SEQ ID NO: 7520477 - DNA, 22 bp, Homo sapiens
gccaggctctcagtgactgccc

SEQ ID NO: 7520478 - DNA, 23 bp, Homo sapiens
gccaggctccggtctgtggccac

SEQ ID NO: 7520479 - DNA, 23 bp, Homo sapiens
gccaggctccggtctgtggccac

SEQ ID NO: 7520480 - DNA, 23 bp, Homo sapiens
gccaggctccggtctgtggccac

SEQ ID NO: 7520481 - DNA, 21 bp, Homo sapiens
gccatttcacacagacatttg

SEQ ID NO: 7520482 - DNA, 22 bp, Homo sapiens
gccaggctctcagtgactgccc

SEQ ID NO: 7520483 - DNA, 22 bp, Homo sapiens
gccaggctctcagtgactgccc

SEQ ID NO: 7520484 - DNA, 22 bp, Homo sapiens
gccaggctctcagtgactgccc

SEQ ID NO: 7520485 - DNA, 22 bp, Homo sapiens
gcccaagcagcttcccgagctt

SEQ ID NO: 7520486 - DNA, 22 bp, Homo sapiens
gcccaagccgccttccagagac

SEQ ID NO: 7520487 - DNA, 22 bp, Homo sapiens
gcccaagcaaaatggttcctgt

SEQ ID NO: 7520488 - DNA, 22 bp, Homo sapiens
gcccaagcagcttcccgagctt

SEQ ID NO: 7520489 - DNA, 22 bp, Homo sapiens
gcccaagatctggagctgcagg

SEQ ID NO: 7520490 - DNA, 22 bp, Homo sapiens
gcccaagatctggagctgcagg

SEQ ID NO: 7520491 - DNA, 22 bp, Homo sapiens
gcccaagatctggagctgcagg

SEQ ID NO: 7520492 - DNA, 22 bp, Homo sapiens
gcccaagatcagtggggcagat

SEQ ID NO: 7520493 - DNA, 22 bp, Homo sapiens
gcccaagatcacactggaaatc

SEQ ID NO: 7520494 - DNA, 22 bp, Homo sapiens
gcccaagatcacactggaaatc

SEQ ID NO: 7520495 - DNA, 22 bp, Homo sapiens
gcccaagagagcgaaggttggc

SEQ ID NO: 7520496 - DNA, 22 bp, Homo sapiens
gcccaagagttaagtctctgct

SEQ ID NO: 7520497 - DNA, 22 bp, Homo sapiens
gcccaagagttaagtctctgct

SEQ ID NO: 7520498 - DNA, 22 bp, Homo sapiens
gcccaagagttaagtctctgct

SEQ ID NO: 7520499 - DNA, 22 bp, Homo sapiens
gcccaagacatttagtaaagag

SEQ ID NO: 7520500 - DNA, 22 bp, Homo sapiens
gcccaagagagcgaaggttggc

SEQ ID NO: 7520501 - DNA, 22 bp, Homo sapiens
gcccaagactgtacagttaaag

SEQ ID NO: 7520502 - DNA, 22 bp, Homo sapiens
gcccaagacatttagtaaagag

SEQ ID NO: 7520503 - DNA, 22 bp, Homo sapiens
gccattttctgtcttgtttatt

SEQ ID NO: 7520504 - DNA, 22 bp, Homo sapiens
gcccaaagtcactcagctagga

SEQ ID NO: 7520505 - DNA, 22 bp, Homo sapiens
gcccaagaatatttcccaagtt

SEQ ID NO: 7520506 - DNA, 22 bp, Homo sapiens
gcccaaagtcactcagctagga

SEQ ID NO: 7520507 - DNA, 22 bp, Homo sapiens
gcccaaagtcactcagctagga

SEQ ID NO: 7520508 - DNA, 22 bp, Homo sapiens
gcccaaagccagtgtgctctcc

SEQ ID NO: 7520509 - DNA, 22 bp, Homo sapiens
gcccaaagccagtgtgctctcc

SEQ ID NO: 7520510 - DNA, 22 bp, Homo sapiens
gcccaaagccagtgtgctctcc

SEQ ID NO: 7520511 - DNA, 20 bp, Homo sapiens
gcccaagcgccggccgcaga

SEQ ID NO: 7520512 - DNA, 20 bp, Homo sapiens
gcccaagcgccggccgcaga

SEQ ID NO: 7520513 - DNA, 22 bp, Homo sapiens
gcccaagctccgcctcctgtcg

SEQ ID NO: 7520514 - DNA, 22 bp, Homo sapiens
gcccaagctccgcctcctgtcg

SEQ ID NO: 7520515 - DNA, 22 bp, Homo sapiens
gcccaagctccgcctcctgtcg

SEQ ID NO: 7520516 - DNA, 22 bp, Homo sapiens
gcccaagggcatcaagttctac

SEQ ID NO: 7520517 - DNA, 22 bp, Homo sapiens
gcccaagggcatcaagttctac

SEQ ID NO: 7520518 - DNA, 22 bp, Homo sapiens
gcccaagctggactgcagtggc

SEQ ID NO: 7520519 - DNA, 22 bp, Homo sapiens
gcccaagctggactgcagtggc

SEQ ID NO: 7520520 - DNA, 22 bp, Homo sapiens
gcccaagccgccttccagagac

SEQ ID NO: 7520521 - DNA, 22 bp, Homo sapiens
gcccaagccgccttccagagac

SEQ ID NO: 7520522 - DNA, 22 bp, Homo sapiens
gcccaagccggagctgggagag

SEQ ID NO: 7520523 - DNA, 22 bp, Homo sapiens
gcccaagccggagctgggagag

SEQ ID NO: 7520524 - DNA, 22 bp, Homo sapiens
gcccaagccggagctgggagag

SEQ ID NO: 7520525 - DNA, 20 bp, Homo sapiens
gcccaagcgccggccgcaga

SEQ ID NO: 7520526 - DNA, 20 bp, Homo sapiens
gcccaagcgccggccgcaga

SEQ ID NO: 7520527 - DNA, 22 bp, Homo sapiens
gcccaagccggagctgggagag

SEQ ID NO: 7520528 - DNA, 22 bp, Homo sapiens
gcccaaggtcacacacaggaag

SEQ ID NO: 7520529 - DNA, 22 bp, Homo sapiens
gcccaaggtcacacacaggaag

SEQ ID NO: 7520530 - DNA, 22 bp, Homo sapiens
gcccaaggtcacacacaggaag

SEQ ID NO: 7520531 - DNA, 22 bp, Homo sapiens
gcccaaggtcacacacaggaag

SEQ ID NO: 7520532 - DNA, 22 bp, Homo sapiens
gcccaaggtcacacacaggaag

SEQ ID NO: 7520533 - DNA, 20 bp, Homo sapiens
gcccaaggtccagaaggggg

SEQ ID NO: 7520534 - DNA, 20 bp, Homo sapiens
gcccaaggtccagaaggggg

SEQ ID NO: 7520535 - DNA, 20 bp, Homo sapiens
gcccaaggtccagaaggggg

SEQ ID NO: 7520536 - DNA, 20 bp, Homo sapiens
gcccaaggtccagaaggggg

SEQ ID NO: 7520537 - DNA, 22 bp, Homo sapiens
gcccaaggtatatcagagacag

SEQ ID NO: 7520538 - DNA, 22 bp, Homo sapiens
gcccaaggtatatcagagacag

SEQ ID NO: 7520539 - DNA, 22 bp, Homo sapiens
gcccaaggtatatcagagacag

SEQ ID NO: 7520540 - DNA, 22 bp, Homo sapiens
gcccaagggcatcaagttctac

SEQ ID NO: 7520541 - DNA, 22 bp, Homo sapiens
gcccaaggtcacacacaggaag

SEQ ID NO: 7520542 - DNA, 22 bp, Homo sapiens
gcccaaggtatatcagagacag

SEQ ID NO: 7520543 - DNA, 22 bp, Homo sapiens
gcccaaggtatatcagagacag

SEQ ID NO: 7520544 - DNA, 22 bp, Homo sapiens
gcccaaggtatatcagagacag

SEQ ID NO: 7520545 - DNA, 22 bp, Homo sapiens
gcccaaggtatatcagagacag

SEQ ID NO: 7520546 - DNA, 22 bp, Homo sapiens
gcccaaggtatatcagagacag

SEQ ID NO: 7520547 - DNA, 22 bp, Homo sapiens
gcccaaggtatatcagagacag

SEQ ID NO: 7520548 - DNA, 22 bp, Homo sapiens
gcatttattatctgccaggcac

SEQ ID NO: 7520549 - DNA, 22 bp, Homo sapiens
gcatttattatctgccaggcac

SEQ ID NO: 7520550 - DNA, 18 bp, Homo sapiens
gcatttatgcggggctac

SEQ ID NO: 7520551 - DNA, 22 bp, Homo sapiens
gcatttattatctgccaggcac

SEQ ID NO: 7520552 - DNA, 22 bp, Homo sapiens
gcatttagctttaaaatatttc

SEQ ID NO: 7520553 - DNA, 22 bp, Homo sapiens
gcatttatattctgttcggata

SEQ ID NO: 7520554 - DNA, 18 bp, Homo sapiens
gcatttatgcggggctac

SEQ ID NO: 7520555 - DNA, 22 bp, Homo sapiens
gcatttatttctttactgcatc

SEQ ID NO: 7520556 - DNA, 22 bp, Homo sapiens
gcatttatttctttactgcatc

SEQ ID NO: 7520557 - DNA, 22 bp, Homo sapiens
gcatttatttctttactgcatc

SEQ ID NO: 7520558 - DNA, 22 bp, Homo sapiens
gcatttatttctttactgcatc

SEQ ID NO: 7520559 - DNA, 22 bp, Homo sapiens
gcatttatttctttactgcatc

SEQ ID NO: 7520560 - DNA, 22 bp, Homo sapiens
gcatttatttctttactgcatc

SEQ ID NO: 7520561 - DNA, 22 bp, Homo sapiens
gccaccctgacgccgcagaccc

SEQ ID NO: 7520562 - DNA, 22 bp, Homo sapiens
gccaccctgagctgggccaggg

SEQ ID NO: 7520563 - DNA, 22 bp, Homo sapiens
gccaccctgcaaatgcccagga

SEQ ID NO: 7520564 - DNA, 22 bp, Homo sapiens
gccaccctgcaaatgcccagga

SEQ ID NO: 7520565 - DNA, 22 bp, Homo sapiens
gccaccctgcaaatgcccagga

SEQ ID NO: 7520566 - DNA, 22 bp, Homo sapiens
gccaccctggaccaccctgggc

SEQ ID NO: 7520567 - DNA, 22 bp, Homo sapiens
gccaccctggaccaccctgggc

SEQ ID NO: 7520568 - DNA, 19 bp, Homo sapiens
gcatttcaggcatgtttgc

SEQ ID NO: 7520569 - DNA, 19 bp, Homo sapiens
gcatttcaggcatgtttgc

SEQ ID NO: 7520570 - DNA, 18 bp, Homo sapiens
gccaccctcctcgtctcc

SEQ ID NO: 7520571 - DNA, 18 bp, Homo sapiens
gccaccctcctcgtctcc

SEQ ID NO: 7520572 - DNA, 22 bp, Homo sapiens
gcatttcatgtaagtcagacca

SEQ ID NO: 7520573 - DNA, 22 bp, Homo sapiens
gcattggttaagagctttgggg

SEQ ID NO: 7520574 - DNA, 22 bp, Homo sapiens
gcattggcagggatgcattacg

SEQ ID NO: 7520575 - DNA, 22 bp, Homo sapiens
gcattgcaactgacagatcatt

SEQ ID NO: 7520576 - DNA, 23 bp, Homo sapiens
gcattgtagaatgtttagcagca

SEQ ID NO: 7520577 - DNA, 23 bp, Homo sapiens
gcattgtagaatgtttagcagca

SEQ ID NO: 7520578 - DNA, 22 bp, Homo sapiens
gcattggtttacacagggtgaa

SEQ ID NO: 7520579 - DNA, 22 bp, Homo sapiens
gcattggttcaaggttgtgcag

SEQ ID NO: 7520580 - DNA, 22 bp, Homo sapiens
gcattggtttacacagggtgaa

SEQ ID NO: 7520581 - DNA, 22 bp, Homo sapiens
gcattggttcaaggttgtgcag

SEQ ID NO: 7520582 - DNA, 22 bp, Homo sapiens
gcattggttaagagctttgggg

SEQ ID NO: 7520583 - DNA, 22 bp, Homo sapiens
gcattgcaactgacagatcatt

SEQ ID NO: 7520584 - DNA, 22 bp, Homo sapiens
gcattgcaactgacagatcatt

SEQ ID NO: 7520585 - DNA, 22 bp, Homo sapiens
gcattgcaaaaagcagcttgat

SEQ ID NO: 7520586 - DNA, 22 bp, Homo sapiens
gcattgattctgaagtgaaatg

SEQ ID NO: 7520587 - DNA, 22 bp, Homo sapiens
gcattgattctgaagtgaaatg

SEQ ID NO: 7520588 - DNA, 22 bp, Homo sapiens
gcattgatttaaacatctctct

SEQ ID NO: 7520589 - DNA, 22 bp, Homo sapiens
gcattgatttaaacatctctct

SEQ ID NO: 7520590 - DNA, 22 bp, Homo sapiens
gcatttaaatttgaacttcaga

SEQ ID NO: 7520591 - DNA, 22 bp, Homo sapiens
gcatttaaatttgaacttcaga

SEQ ID NO: 7520592 - DNA, 22 bp, Homo sapiens
gcatttaaatttgaacttcaga

SEQ ID NO: 7520593 - DNA, 22 bp, Homo sapiens
gcatttaaatttgaacttcaga

SEQ ID NO: 7520594 - DNA, 22 bp, Homo sapiens
gcatttaaatttgaacttcaga

SEQ ID NO: 7520595 - DNA, 22 bp, Homo sapiens
gcatttagctttaaaatatttc

SEQ ID NO: 7520596 - DNA, 22 bp, Homo sapiens
gcatttagctttaaaatatttc

SEQ ID NO: 7520597 - DNA, 22 bp, Homo sapiens
gcatttagctttaaaatatttc

SEQ ID NO: 7520598 - DNA, 22 bp, Homo sapiens
gcatttagctttaaaatatttc

SEQ ID NO: 7520599 - DNA, 23 bp, Homo sapiens
gcatttacagactcacttttcta

SEQ ID NO: 7520600 - DNA, 22 bp, Homo sapiens
gcatttacatggagctatctaa

SEQ ID NO: 7520601 - DNA, 22 bp, Homo sapiens
gcatttacatggagctatctaa

SEQ ID NO: 7520602 - DNA, 22 bp, Homo sapiens
gcatttaaatttgaacttcaga

SEQ ID NO: 7520603 - DNA, 22 bp, Homo sapiens
gcatttaaatttgaacttcaga

SEQ ID NO: 7520604 - DNA, 22 bp, Homo sapiens
gcatttaaatttgaacttcaga

SEQ ID NO: 7520605 - DNA, 20 bp, Homo sapiens
gcattgttgtagtagattgt

SEQ ID NO: 7520606 - DNA, 22 bp, Homo sapiens
gccacctgccaacttgctggaa

SEQ ID NO: 7520607 - DNA, 22 bp, Homo sapiens
gccacctgccaacttgctggaa

SEQ ID NO: 7520608 - DNA, 22 bp, Homo sapiens
gccacctgccaacttgctggaa

SEQ ID NO: 7520609 - DNA, 22 bp, Homo sapiens
gccacctgcgggccgtggtgga

SEQ ID NO: 7520610 - DNA, 22 bp, Homo sapiens
gccacctgcgggccgtggtgga

SEQ ID NO: 7520611 - DNA, 22 bp, Homo sapiens
gccacctgcgggccgtggtgga

SEQ ID NO: 7520612 - DNA, 22 bp, Homo sapiens
gccacctgcgggccgtggtgga

SEQ ID NO: 7520613 - DNA, 22 bp, Homo sapiens
gccacctggacagctgtgccct

SEQ ID NO: 7520614 - DNA, 22 bp, Homo sapiens
gccacctggacagctgtgccct

SEQ ID NO: 7520615 - DNA, 22 bp, Homo sapiens
gccacctggacagctgtgccct

SEQ ID NO: 7520616 - DNA, 22 bp, Homo sapiens
gccacctgcgggccgtggtgga

SEQ ID NO: 7520617 - DNA, 22 bp, Homo sapiens
gccacctggacagctgtgccct

SEQ ID NO: 7520618 - DNA, 22 bp, Homo sapiens
gccacctggactcagagccagg

SEQ ID NO: 7520619 - DNA, 22 bp, Homo sapiens
gccacctggactcagagccagg

SEQ ID NO: 7520620 - DNA, 22 bp, Homo sapiens
gccacctggactcagagccagg

SEQ ID NO: 7520621 - DNA, 22 bp, Homo sapiens
gccacctggactcagagccagg

SEQ ID NO: 7520622 - DNA, 22 bp, Homo sapiens
gccacctggactcagagccagg

SEQ ID NO: 7520623 - DNA, 22 bp, Homo sapiens
gccacctggactcagagccagg

SEQ ID NO: 7520624 - DNA, 22 bp, Homo sapiens
gccacctggactcagagccagg

SEQ ID NO: 7520625 - DNA, 22 bp, Homo sapiens
gccacctggtggcatcttctgg

SEQ ID NO: 7520626 - DNA, 22 bp, Homo sapiens
gccacctgtaagccattaggcc

SEQ ID NO: 7520627 - DNA, 22 bp, Homo sapiens
gccacctgtaagccattaggcc

SEQ ID NO: 7520628 - DNA, 22 bp, Homo sapiens
gccacctgtaagccattaggcc

SEQ ID NO: 7520629 - DNA, 22 bp, Homo sapiens
gccacctgtgtgggcctttgtg

SEQ ID NO: 7520630 - DNA, 22 bp, Homo sapiens
gccacctgtgtgggcctttgtg

SEQ ID NO: 7520631 - DNA, 22 bp, Homo sapiens
gccacctgtgtgggcctttgtg

SEQ ID NO: 7520632 - DNA, 22 bp, Homo sapiens
gccactgttgctcctcaggaaa

SEQ ID NO: 7520633 - DNA, 22 bp, Homo sapiens
gccactgttgctcctcaggaaa

SEQ ID NO: 7520634 - DNA, 22 bp, Homo sapiens
gccacttactaacctcctatcc

SEQ ID NO: 7520635 - DNA, 22 bp, Homo sapiens
gccactgtgttgatctagcctg

SEQ ID NO: 7520636 - DNA, 22 bp, Homo sapiens
gccacctgtttcagatgtggtt

SEQ ID NO: 7520637 - DNA, 22 bp, Homo sapiens
gccacctgtttcagatgtggtt

SEQ ID NO: 7520638 - DNA, 22 bp, Homo sapiens
gccacctgtttcagatgtggtt

SEQ ID NO: 7520639 - DNA, 22 bp, Homo sapiens
gccacctgtttcagatgtggtt

SEQ ID NO: 7520640 - DNA, 22 bp, Homo sapiens
gccacctgtttcagatgtggtt

SEQ ID NO: 7520641 - DNA, 22 bp, Homo sapiens
gccacctgtttcgcttgcccag

SEQ ID NO: 7520642 - DNA, 22 bp, Homo sapiens
gccacctgtttcgcttgcccag

SEQ ID NO: 7520643 - DNA, 22 bp, Homo sapiens
gccacctgtttcgcttgcccag

SEQ ID NO: 7520644 - DNA, 22 bp, Homo sapiens
gccacctgtttcgcttgcccag

SEQ ID NO: 7520645 - DNA, 21 bp, Homo sapiens
gccactgtgcacactaaccca

SEQ ID NO: 7520646 - DNA, 22 bp, Homo sapiens
gccaccttccaaaataatcaca

SEQ ID NO: 7520647 - DNA, 22 bp, Homo sapiens
gccacctgtttcgcttgcccag

SEQ ID NO: 7520648 - DNA, 22 bp, Homo sapiens
gccacctgtttcgcttgcccag

SEQ ID NO: 7520649 - DNA, 20 bp, Homo sapiens
gccactgtgcttacactgct

SEQ ID NO: 7520650 - DNA, 22 bp, Homo sapiens
gccacccttgcgtcactgacat

SEQ ID NO: 7520651 - DNA, 22 bp, Homo sapiens
gccacctcccaggacgaggctg

SEQ ID NO: 7520652 - DNA, 21 bp, Homo sapiens
gccacctcaatcttctagcgc

SEQ ID NO: 7520653 - DNA, 21 bp, Homo sapiens
gccacctcaatcttctagcgc

SEQ ID NO: 7520654 - DNA, 22 bp, Homo sapiens
gccaccctggacgcactgttcg

SEQ ID NO: 7520655 - DNA, 22 bp, Homo sapiens
gccaccctggacgcactgttcg

SEQ ID NO: 7520656 - DNA, 22 bp, Homo sapiens
gccacccttatcccatgcttct

SEQ ID NO: 7520657 - DNA, 22 bp, Homo sapiens
gccacccttatcccatgcttct

SEQ ID NO: 7520658 - DNA, 22 bp, Homo sapiens
gccacccttatcccatgcttct

SEQ ID NO: 7520659 - DNA, 22 bp, Homo sapiens
gccacctcccaggacgaggctg

SEQ ID NO: 7520660 - DNA, 22 bp, Homo sapiens
gccacctcccaggacgaggctg

SEQ ID NO: 7520661 - DNA, 22 bp, Homo sapiens
gccacctcccaggacgaggctg

SEQ ID NO: 7520662 - DNA, 23 bp, Homo sapiens
gccacctcctggtcagaaagagg

SEQ ID NO: 7520663 - DNA, 23 bp, Homo sapiens
gccacctcctggtcagaaagagg

SEQ ID NO: 7520664 - DNA, 22 bp, Homo sapiens
gccacctcggctttctctgctc

SEQ ID NO: 7520665 - DNA, 22 bp, Homo sapiens
gccacctcggctttctctgctc

SEQ ID NO: 7520666 - DNA, 22 bp, Homo sapiens
gccacctccttattccacctgt

SEQ ID NO: 7520667 - DNA, 22 bp, Homo sapiens
gccacctccttattccacctgt

SEQ ID NO: 7520668 - DNA, 22 bp, Homo sapiens
gccacctccttattccacctgt

SEQ ID NO: 7520669 - DNA, 22 bp, Homo sapiens
gccacctctctcttgactcgag

SEQ ID NO: 7520670 - DNA, 22 bp, Homo sapiens
gccacctctctcttgactcgag

SEQ ID NO: 7520671 - DNA, 22 bp, Homo sapiens
gccacctctctcttgactcgag

SEQ ID NO: 7520672 - DNA, 20 bp, Homo sapiens
gccacctctctagcagtaga

SEQ ID NO: 7520673 - DNA, 20 bp, Homo sapiens
gccacctctctagcagtaga

SEQ ID NO: 7520674 - DNA, 20 bp, Homo sapiens
gccacctctctagcagtaga

SEQ ID NO: 7520675 - DNA, 22 bp, Homo sapiens
gccacctctctcttgactcgag

SEQ ID NO: 7520676 - DNA, 22 bp, Homo sapiens
gccacctctttgtctctgccgc

SEQ ID NO: 7520677 - DNA, 22 bp, Homo sapiens
gccacctctttgtctctgccgc

SEQ ID NO: 7520678 - DNA, 21 bp, Homo sapiens
gccacctcgtctcggagcagc

SEQ ID NO: 7520679 - DNA, 21 bp, Homo sapiens
gccacctcgtctcggagcagc

SEQ ID NO: 7520680 - DNA, 21 bp, Homo sapiens
gccacctcgtctcggagcagc

SEQ ID NO: 7520681 - DNA, 22 bp, Homo sapiens
gccacctcggctttctctgctc

SEQ ID NO: 7520682 - DNA, 23 bp, Homo sapiens
gccacctcctggtcagaaagagg

SEQ ID NO: 7520683 - DNA, 22 bp, Homo sapiens
gccacctctagcaaagctcagc

SEQ ID NO: 7520684 - DNA, 22 bp, Homo sapiens
gccacctctagcaaagctcagc

SEQ ID NO: 7520685 - DNA, 22 bp, Homo sapiens
gccacctctagcaaagctcagc

SEQ ID NO: 7520686 - DNA, 22 bp, Homo sapiens
gccacctctagcaaagctcagc

SEQ ID NO: 7520687 - DNA, 21 bp, Homo sapiens
gccacctcgtctcggagcagc

SEQ ID NO: 7520688 - DNA, 22 bp, Homo sapiens
gcagttctacttatccatagac

SEQ ID NO: 7520689 - DNA, 22 bp, Homo sapiens
gcagttcacccaagtgcagaga

SEQ ID NO: 7520690 - DNA, 22 bp, Homo sapiens
gcagttcacccaagtgcagaga

SEQ ID NO: 7520691 - DNA, 22 bp, Homo sapiens
gcagttcctacagtggaaagcg

SEQ ID NO: 7520692 - DNA, 22 bp, Homo sapiens
gcagttcctacagtggaaagcg

SEQ ID NO: 7520693 - DNA, 22 bp, Homo sapiens
gcagttctccagaataaagggt

SEQ ID NO: 7520694 - DNA, 22 bp, Homo sapiens
gcagttacttctgagaagtgaa

SEQ ID NO: 7520695 - DNA, 22 bp, Homo sapiens
gcagttggcagggagcccagat

SEQ ID NO: 7520696 - DNA, 22 bp, Homo sapiens
gcagttggcagggagcccagat

SEQ ID NO: 7520697 - DNA, 22 bp, Homo sapiens
gcagttgcaggatttgtgttgt

SEQ ID NO: 7520698 - DNA, 22 bp, Homo sapiens
gcagttggcagggagcccagat

SEQ ID NO: 7520699 - DNA, 22 bp, Homo sapiens
gcagtttactgtcaataactct

SEQ ID NO: 7520700 - DNA, 22 bp, Homo sapiens
gcagtttactgtcaataactct

SEQ ID NO: 7520701 - DNA, 16 bp, Homo sapiens
gcagttggggagagct

SEQ ID NO: 7520702 - DNA, 22 bp, Homo sapiens
gcagtttactgtcaataactct

SEQ ID NO: 7520703 - DNA, 22 bp, Homo sapiens
gcagtttagtagatgacattat

SEQ ID NO: 7520704 - DNA, 22 bp, Homo sapiens
gcagtttagtagatgacattat

SEQ ID NO: 7520705 - DNA, 17 bp, Homo sapiens
gcagttaaattaagatg

SEQ ID NO: 7520706 - DNA, 22 bp, Homo sapiens
gcagttaaaaataaaccttcat

SEQ ID NO: 7520707 - DNA, 21 bp, Homo sapiens
gcagttaatagcagagcacac

SEQ ID NO: 7520708 - DNA, 22 bp, Homo sapiens
gcagtgtttgtgttctcacatg

SEQ ID NO: 7520709 - DNA, 22 bp, Homo sapiens
gcagtgtttacatattagaaac

SEQ ID NO: 7520710 - DNA, 22 bp, Homo sapiens
gcagtgtttcccagagatggaa

SEQ ID NO: 7520711 - DNA, 23 bp, Homo sapiens
gcagtgtttgcttcatcttatcc

SEQ ID NO: 7520712 - DNA, 22 bp, Homo sapiens
gcagtgttggcaggatggggct

SEQ ID NO: 7520713 - DNA, 18 bp, Homo sapiens
gcaggtgccactgctgtt

SEQ ID NO: 7520714 - DNA, 22 bp, Homo sapiens
gcaggtggaagcagcagactca

SEQ ID NO: 7520715 - DNA, 22 bp, Homo sapiens
gcaggtggaagcagcagactca

SEQ ID NO: 7520716 - DNA, 18 bp, Homo sapiens
gcaggtgccactgctgtt

SEQ ID NO: 7520717 - DNA, 18 bp, Homo sapiens
gcaggtgccactgctgtt

SEQ ID NO: 7520718 - DNA, 18 bp, Homo sapiens
gcaggtgccactgctgtt

SEQ ID NO: 7520719 - DNA, 18 bp, Homo sapiens
gcaggtgccactgctgtt

SEQ ID NO: 7520720 - DNA, 18 bp, Homo sapiens
gcaggtgccactgctgtt

SEQ ID NO: 7520721 - DNA, 22 bp, Homo sapiens
gcaggtgattcaccctgggcct

SEQ ID NO: 7520722 - DNA, 22 bp, Homo sapiens
gcaggtgattcaccctgggcct

SEQ ID NO: 7520723 - DNA, 22 bp, Homo sapiens
gcaggtgattcaccctgggcct

SEQ ID NO: 7520724 - DNA, 18 bp, Homo sapiens
gcaggtgccactgctgtt

SEQ ID NO: 7520725 - DNA, 22 bp, Homo sapiens
gcattgaaatggcaaaaagaga

SEQ ID NO: 7520726 - DNA, 23 bp, Homo sapiens
gcattgaacaaaagaggggagta

SEQ ID NO: 7520727 - DNA, 22 bp, Homo sapiens
gcattgaaccatctagatttct

SEQ ID NO: 7520728 - DNA, 22 bp, Homo sapiens
gcattctttgaatgcttctaat

SEQ ID NO: 7520729 - DNA, 22 bp, Homo sapiens
gcattgaagatcttagactagg

SEQ ID NO: 7520730 - DNA, 22 bp, Homo sapiens
gcattgaaggacttccattata

SEQ ID NO: 7520731 - DNA, 22 bp, Homo sapiens
gcattgaaggacttccattata

SEQ ID NO: 7520732 - DNA, 22 bp, Homo sapiens
gcattgaaggcattttatctac

SEQ ID NO: 7520733 - DNA, 22 bp, Homo sapiens
gcattgaaggcattttatctac

SEQ ID NO: 7520734 - DNA, 22 bp, Homo sapiens
gcattgaatcctatcaggcaaa

SEQ ID NO: 7520735 - DNA, 22 bp, Homo sapiens
gcattgaaggacttccattata

SEQ ID NO: 7520736 - DNA, 22 bp, Homo sapiens
gcattgatctgtatgcattaag

SEQ ID NO: 7520737 - DNA, 22 bp, Homo sapiens
gcattcttcgaagtaagtagtg

SEQ ID NO: 7520738 - DNA, 22 bp, Homo sapiens
gcattcttgaggtgtggactca

SEQ ID NO: 7520739 - DNA, 22 bp, Homo sapiens
gcattctttagactgagagata

SEQ ID NO: 7520740 - DNA, 22 bp, Homo sapiens
gcattcttgtttttcctaccct

SEQ ID NO: 7520741 - DNA, 22 bp, Homo sapiens
gcattcttcacagtattcctcc

SEQ ID NO: 7520742 - DNA, 18 bp, Homo sapiens
gcattctgttaatgtgga

SEQ ID NO: 7520743 - DNA, 18 bp, Homo sapiens
gcattctgttaatgtgga

SEQ ID NO: 7520744 - DNA, 22 bp, Homo sapiens
gcattcttcacagtattcctcc

SEQ ID NO: 7520745 - DNA, 22 bp, Homo sapiens
gcattcttcacagtattcctcc

SEQ ID NO: 7520746 - DNA, 21 bp, Homo sapiens
gcattcttcatgtgattcaga

SEQ ID NO: 7520747 - DNA, 21 bp, Homo sapiens
gcattcttcatgtgattcaga

SEQ ID NO: 7520748 - DNA, 21 bp, Homo sapiens
gcagtttatgtaatatgcact

SEQ ID NO: 7520749 - DNA, 22 bp, Homo sapiens
gcagtttactgtcaataactct

SEQ ID NO: 7520750 - DNA, 21 bp, Homo sapiens
gcagtttatgtaatatgcact

SEQ ID NO: 7520751 - DNA, 21 bp, Homo sapiens
gcagtttatgtaatatgcact

SEQ ID NO: 7520752 - DNA, 21 bp, Homo sapiens
gcagtttatgtaatatgcact

SEQ ID NO: 7520753 - DNA, 22 bp, Homo sapiens
gcagtttcagacatatctccat

SEQ ID NO: 7520754 - DNA, 22 bp, Homo sapiens
gcagtttgaaagtatgagtcca

SEQ ID NO: 7520755 - DNA, 22 bp, Homo sapiens
gcagtttctgaatttatccaag

SEQ ID NO: 7520756 - DNA, 22 bp, Homo sapiens
gcagttttagtggatctggggc

SEQ ID NO: 7520757 - DNA, 22 bp, Homo sapiens
gcagttttagtggatctggggc

SEQ ID NO: 7520758 - DNA, 22 bp, Homo sapiens
gcagttttagagctttaagatg

SEQ ID NO: 7520759 - DNA, 19 bp, Homo sapiens
gcataaaatgtcaatgtgt

SEQ ID NO: 7520760 - DNA, 22 bp, Homo sapiens
gcagttttattatgatggaaat

SEQ ID NO: 7520761 - DNA, 22 bp, Homo sapiens
gcagttttagagctttaagatg

SEQ ID NO: 7520762 - DNA, 22 bp, Homo sapiens
gcagttttattatgatggaaat

SEQ ID NO: 7520763 - DNA, 22 bp, Homo sapiens
gcagttttagtggatctggggc

SEQ ID NO: 7520764 - DNA, 22 bp, Homo sapiens
gcagttttattatgatggaaat

SEQ ID NO: 7520765 - DNA, 22 bp, Homo sapiens
gcataaactccaaaaggcaggg

SEQ ID NO: 7520766 - DNA, 19 bp, Homo sapiens
gcataaaatgtcaatgtgt

SEQ ID NO: 7520767 - DNA, 19 bp, Homo sapiens
gcataaaatgtcaatgtgt

SEQ ID NO: 7520768 - DNA, 19 bp, Homo sapiens
gcataaaatgtcaatgtgt

SEQ ID NO: 7520769 - DNA, 19 bp, Homo sapiens
gcataaaatgtcaatgtgt

SEQ ID NO: 7520770 - DNA, 22 bp, Homo sapiens
gcattaatgtaagacccactcc

SEQ ID NO: 7520771 - DNA, 22 bp, Homo sapiens
gcattaaatgctagggacctaa

SEQ ID NO: 7520772 - DNA, 22 bp, Homo sapiens
gcattaatgtaagacccactcc

SEQ ID NO: 7520773 - DNA, 21 bp, Homo sapiens
gcattaaaagcagttgttggt

SEQ ID NO: 7520774 - DNA, 22 bp, Homo sapiens
gcattaaatgctagggacctaa

SEQ ID NO: 7520775 - DNA, 22 bp, Homo sapiens
gcattaaatgctagggacctaa

SEQ ID NO: 7520776 - DNA, 22 bp, Homo sapiens
gcattacaggctgtaagatgca

SEQ ID NO: 7520777 - DNA, 22 bp, Homo sapiens
gcattacagcagttcaacttgg

SEQ ID NO: 7520778 - DNA, 22 bp, Homo sapiens
gcattacaggaatttgttactg

SEQ ID NO: 7520779 - DNA, 22 bp, Homo sapiens
gcattacacatagacattcgtt

SEQ ID NO: 7520780 - DNA, 22 bp, Homo sapiens
gcattacagcagttcaacttgg

SEQ ID NO: 7520781 - DNA, 22 bp, Homo sapiens
gcattacagcagttcaacttgg

SEQ ID NO: 7520782 - DNA, 22 bp, Homo sapiens
gcattagacccaaggtattttg

SEQ ID NO: 7520783 - DNA, 22 bp, Homo sapiens
gcattacttctttcataggtca

SEQ ID NO: 7520784 - DNA, 22 bp, Homo sapiens
gcattagaaactattgctgcaa

SEQ ID NO: 7520785 - DNA, 22 bp, Homo sapiens
gcagatttctaataagcaatgt

SEQ ID NO: 7520786 - DNA, 22 bp, Homo sapiens
gcagattattattaggctgagt

SEQ ID NO: 7520787 - DNA, 22 bp, Homo sapiens
gcagcaaaaaagtaatatttat

SEQ ID NO: 7520788 - DNA, 22 bp, Homo sapiens
gcagcaaaaaagtaatatttat

SEQ ID NO: 7520789 - DNA, 22 bp, Homo sapiens
gcagcaaaaaagtaatatttat

SEQ ID NO: 7520790 - DNA, 22 bp, Homo sapiens
gcagatgttgttgctgggagtt

SEQ ID NO: 7520791 - DNA, 22 bp, Homo sapiens
gcagattactggactgattcca

SEQ ID NO: 7520792 - DNA, 22 bp, Homo sapiens
gcagattatatgcatatgtggt

SEQ ID NO: 7520793 - DNA, 22 bp, Homo sapiens
gcagatgttgatgcaagaagag

SEQ ID NO: 7520794 - DNA, 22 bp, Homo sapiens
gcagatgttgtgaggctggtaa

SEQ ID NO: 7520795 - DNA, 22 bp, Homo sapiens
gcagatgttgtgaggctggtaa

SEQ ID NO: 7520796 - DNA, 22 bp, Homo sapiens
gcagatgttgttgctgggagtt

SEQ ID NO: 7520797 - DNA, 22 bp, Homo sapiens
gcagatgttgttgctgggagtt

SEQ ID NO: 7520798 - DNA, 19 bp, Homo sapiens
gcagagtggggtggagggt

SEQ ID NO: 7520799 - DNA, 19 bp, Homo sapiens
gcagagtggggtggagggt

SEQ ID NO: 7520800 - DNA, 19 bp, Homo sapiens
gcagagtggggtggagggt

SEQ ID NO: 7520801 - DNA, 19 bp, Homo sapiens
gcagagtggggtggagggt

SEQ ID NO: 7520802 - DNA, 19 bp, Homo sapiens
gcagagtggggtggagggt

SEQ ID NO: 7520803 - DNA, 19 bp, Homo sapiens
gcagagtggggtggagggt

SEQ ID NO: 7520804 - DNA, 19 bp, Homo sapiens
gcagcaaacaaaacaggta

SEQ ID NO: 7520805 - DNA, 19 bp, Homo sapiens
gcagcaaacaaaacaggta

SEQ ID NO: 7520806 - DNA, 22 bp, Homo sapiens
gcagcaaacttccacaagtaga

SEQ ID NO: 7520807 - DNA, 22 bp, Homo sapiens
gcagcaaacttccacaagtaga

SEQ ID NO: 7520808 - DNA, 19 bp, Homo sapiens
gcagcaaacaaaacaggta

SEQ ID NO: 7520809 - DNA, 22 bp, Homo sapiens
gcagcaaaaaagtaatatttat

SEQ ID NO: 7520810 - DNA, 22 bp, Homo sapiens
gcagcaaaaaagtaatatttat

SEQ ID NO: 7520811 - DNA, 22 bp, Homo sapiens
gcagcaaacttccacaagtaga

SEQ ID NO: 7520812 - DNA, 22 bp, Homo sapiens
gcagcaaagctcttcatgtgat

SEQ ID NO: 7520813 - DNA, 22 bp, Homo sapiens
gcagcaaagctcttcatgtgat

SEQ ID NO: 7520814 - DNA, 22 bp, Homo sapiens
gcagcaaacttccacaagtaga

SEQ ID NO: 7520815 - DNA, 22 bp, Homo sapiens
gcagcaaacttccacaagtaga

SEQ ID NO: 7520816 - DNA, 22 bp, Homo sapiens
gcagcaaacttccacaagtaga

SEQ ID NO: 7520817 - DNA, 22 bp, Homo sapiens
gcagcaagaataatttgggtag

SEQ ID NO: 7520818 - DNA, 21 bp, Homo sapiens
gcagcaaatgacaacagtgag

SEQ ID NO: 7520819 - DNA, 22 bp, Homo sapiens
gcagcaacgcggccctactgct

SEQ ID NO: 7520820 - DNA, 21 bp, Homo sapiens
gcagcaaatgacaacagtgag

SEQ ID NO: 7520821 - DNA, 22 bp, Homo sapiens
gcagcaacgcggccctactgct

SEQ ID NO: 7520822 - DNA, 21 bp, Homo sapiens
gcagcaaatgacaacagtgag

SEQ ID NO: 7520823 - DNA, 18 bp, Homo sapiens
gcagcaaagggcccgggg

SEQ ID NO: 7520824 - DNA, 18 bp, Homo sapiens
gcagcaaagggcccgggg

SEQ ID NO: 7520825 - DNA, 18 bp, Homo sapiens
gcagcaaagggcccgggg

SEQ ID NO: 7520826 - DNA, 22 bp, Homo sapiens
gcagcaagaggtgccatcttga

SEQ ID NO: 7520827 - DNA, 21 bp, Homo sapiens
gcagcaaatgacaacagtgag

SEQ ID NO: 7520828 - DNA, 22 bp, Homo sapiens
gcagcaagaataatttgggtag

SEQ ID NO: 7520829 - DNA, 22 bp, Homo sapiens
gcagcaagaataatttgggtag

SEQ ID NO: 7520830 - DNA, 22 bp, Homo sapiens
gcagagtgaagcatttctttct

SEQ ID NO: 7520831 - DNA, 22 bp, Homo sapiens
gcagagtgaagggagaggtgtg

SEQ ID NO: 7520832 - DNA, 22 bp, Homo sapiens
gcagagtgaagggagaggtgtg

SEQ ID NO: 7520833 - DNA, 22 bp, Homo sapiens
gcagagtgaagggagaggtgtg

SEQ ID NO: 7520834 - DNA, 22 bp, Homo sapiens
gcagagtgaagggagaggtgtg

SEQ ID NO: 7520835 - DNA, 22 bp, Homo sapiens
gcagagtgaagggagaggtgtg

SEQ ID NO: 7520836 - DNA, 22 bp, Homo sapiens
gcagagtgagatatgaacccag

SEQ ID NO: 7520837 - DNA, 22 bp, Homo sapiens
gcagagtgagccgaggctgctc

SEQ ID NO: 7520838 - DNA, 22 bp, Homo sapiens
gcagagtgagatatgaacccag

SEQ ID NO: 7520839 - DNA, 22 bp, Homo sapiens
gcagagtgaagggagaggtgtg

SEQ ID NO: 7520840 - DNA, 22 bp, Homo sapiens
gcagagtgagccgaggctgctc

SEQ ID NO: 7520841 - DNA, 22 bp, Homo sapiens
gcagagtgagccgaggctgctc

SEQ ID NO: 7520842 - DNA, 22 bp, Homo sapiens
gcagagtgagccgaggctgctc

SEQ ID NO: 7520843 - DNA, 22 bp, Homo sapiens
gcagagtgagccgaggctgctc

SEQ ID NO: 7520844 - DNA, 22 bp, Homo sapiens
gcagagtgagccgaggctgctc

SEQ ID NO: 7520845 - DNA, 22 bp, Homo sapiens
gcagagtgaggaagagcttcca

SEQ ID NO: 7520846 - DNA, 22 bp, Homo sapiens
gcagagtgagccgaggctgctc

SEQ ID NO: 7520847 - DNA, 22 bp, Homo sapiens
gcagagtgagccgaggctgctc

SEQ ID NO: 7520848 - DNA, 22 bp, Homo sapiens
gcagagtgaagggagaggtgtg

SEQ ID NO: 7520849 - DNA, 22 bp, Homo sapiens
gcagagtgagccgaggctgctc

SEQ ID NO: 7520850 - DNA, 22 bp, Homo sapiens
gcagagtgagccgaggctgctc

SEQ ID NO: 7520851 - DNA, 22 bp, Homo sapiens
gcagagtgccagtatttgttgt

SEQ ID NO: 7520852 - DNA, 22 bp, Homo sapiens
gcagagtgatggaatgtgggtg

SEQ ID NO: 7520853 - DNA, 22 bp, Homo sapiens
gcagagtgatggaatgtgggtg

SEQ ID NO: 7520854 - DNA, 22 bp, Homo sapiens
gcagagtgccgagatggaagcg

SEQ ID NO: 7520855 - DNA, 22 bp, Homo sapiens
gcagagtgccgagatggaagcg

SEQ ID NO: 7520856 - DNA, 22 bp, Homo sapiens
gcagagtgccgagatggaagcg

SEQ ID NO: 7520857 - DNA, 22 bp, Homo sapiens
gcagagtgccagtatttgttgt

SEQ ID NO: 7520858 - DNA, 22 bp, Homo sapiens
gcagagtgccgagatggaagcg

SEQ ID NO: 7520859 - DNA, 22 bp, Homo sapiens
gcagagtgaggaagagcttcca

SEQ ID NO: 7520860 - DNA, 22 bp, Homo sapiens
gcagagtgatggaatgtgggtg

SEQ ID NO: 7520861 - DNA, 22 bp, Homo sapiens
gcagagtgaggaagagcttcca

SEQ ID NO: 7520862 - DNA, 22 bp, Homo sapiens
gcagagtgggagcccagggctg

SEQ ID NO: 7520863 - DNA, 22 bp, Homo sapiens
gcagagtgggagcccagggctg

SEQ ID NO: 7520864 - DNA, 22 bp, Homo sapiens
gcagagtgggagcccagggctg

SEQ ID NO: 7520865 - DNA, 22 bp, Homo sapiens
gcagagtgctgtcgtacgcccc

SEQ ID NO: 7520866 - DNA, 22 bp, Homo sapiens
gcagagtgccgagatggaagcg

SEQ ID NO: 7520867 - DNA, 22 bp, Homo sapiens
gcagagtgccgagatggaagcg

SEQ ID NO: 7520868 - DNA, 18 bp, Homo sapiens
gcagagtgcgtctctgtg

SEQ ID NO: 7520869 - DNA, 18 bp, Homo sapiens
gcagagtgcgtctctgtg

SEQ ID NO: 7520870 - DNA, 18 bp, Homo sapiens
gcagagtgcgtctctgtg

SEQ ID NO: 7520871 - DNA, 22 bp, Homo sapiens
gcagaggtggatgcaattgggg

SEQ ID NO: 7520872 - DNA, 22 bp, Homo sapiens
gcagaggtggatgcaattgggg

SEQ ID NO: 7520873 - DNA, 22 bp, Homo sapiens
gcagaggtggatgcaattgggg

SEQ ID NO: 7520874 - DNA, 22 bp, Homo sapiens
gcagaggtgctcagtggcagaa

SEQ ID NO: 7520875 - DNA, 22 bp, Homo sapiens
gcagaggtgctcagtggcagaa

SEQ ID NO: 7520876 - DNA, 22 bp, Homo sapiens
gcagaggtgctcagtggcagaa

SEQ ID NO: 7520877 - DNA, 22 bp, Homo sapiens
gcagaggtggcatctgggctct

SEQ ID NO: 7520878 - DNA, 22 bp, Homo sapiens
gcagaggtggcatctgggctct

SEQ ID NO: 7520879 - DNA, 22 bp, Homo sapiens
gcagaggtggcatctgggctct

SEQ ID NO: 7520880 - DNA, 22 bp, Homo sapiens
gcagaggtggcatctgggctct

SEQ ID NO: 7520881 - DNA, 22 bp, Homo sapiens
gcagaggtggcatctgggctct

SEQ ID NO: 7520882 - DNA, 22 bp, Homo sapiens
gcagaggtgtagccccctccat

SEQ ID NO: 7520883 - DNA, 22 bp, Homo sapiens
gcagaggtgtcaccttccagga

SEQ ID NO: 7520884 - DNA, 22 bp, Homo sapiens
gcagaggtgtgggaggggccac

SEQ ID NO: 7520885 - DNA, 22 bp, Homo sapiens
gcagaggtgtgggaggggccac

SEQ ID NO: 7520886 - DNA, 22 bp, Homo sapiens
gcagaggtgtgggaggggccac

SEQ ID NO: 7520887 - DNA, 22 bp, Homo sapiens
gcagaggtgtcaccttccagga

SEQ ID NO: 7520888 - DNA, 22 bp, Homo sapiens
gcagacagggctacagaggtac

SEQ ID NO: 7520889 - DNA, 22 bp, Homo sapiens
gcagacagggctacagaggtac

SEQ ID NO: 7520890 - DNA, 22 bp, Homo sapiens
gcagacagggctacagaggtac

SEQ ID NO: 7520891 - DNA, 22 bp, Homo sapiens
gcagacagggctacagaggtac

SEQ ID NO: 7520892 - DNA, 22 bp, Homo sapiens
gcagacaggcccagtggaggga

SEQ ID NO: 7520893 - DNA, 22 bp, Homo sapiens
gcagacaggcccagtggaggga

SEQ ID NO: 7520894 - DNA, 22 bp, Homo sapiens
gcagacagggctacagaggtac

SEQ ID NO: 7520895 - DNA, 22 bp, Homo sapiens
gcagacagggctacagaggtac

SEQ ID NO: 7520896 - DNA, 22 bp, Homo sapiens
gcagacagggctacagaggtac

SEQ ID NO: 7520897 - DNA, 22 bp, Homo sapiens
gcagacagggctacagaggtac

SEQ ID NO: 7520898 - DNA, 22 bp, Homo sapiens
gcagaggtgctcagtggcagaa

SEQ ID NO: 7520899 - DNA, 22 bp, Homo sapiens
gcagaggtgctcagtggcagaa

SEQ ID NO: 7520900 - DNA, 22 bp, Homo sapiens
gcagaggtgctcagtggcagaa

SEQ ID NO: 7520901 - DNA, 22 bp, Homo sapiens
gcagacaggggcttaggaaagg

SEQ ID NO: 7520902 - DNA, 22 bp, Homo sapiens
gcagaggtgagtttctcagctg

SEQ ID NO: 7520903 - DNA, 22 bp, Homo sapiens
gcagagtgaaagaatatattaa

SEQ ID NO: 7520904 - DNA, 22 bp, Homo sapiens
gcagagtgaaagaatatattaa

SEQ ID NO: 7520905 - DNA, 22 bp, Homo sapiens
gcagagtgaagcagtatggaaa

SEQ ID NO: 7520906 - DNA, 22 bp, Homo sapiens
gcagagtctggtaggtgctggt

SEQ ID NO: 7520907 - DNA, 22 bp, Homo sapiens
gcagagtctggtaggtgctggt

SEQ ID NO: 7520908 - DNA, 22 bp, Homo sapiens
gcagagtgaagcagtatggaaa

SEQ ID NO: 7520909 - DNA, 22 bp, Homo sapiens
gcagagtgaagcagtatggaaa

SEQ ID NO: 7520910 - DNA, 22 bp, Homo sapiens
gcagagtgaagcagtatggaaa

SEQ ID NO: 7520911 - DNA, 22 bp, Homo sapiens
gcagagtctgggctacctcttg

SEQ ID NO: 7520912 - DNA, 22 bp, Homo sapiens
gcagagtctgggctacctcttg

SEQ ID NO: 7520913 - DNA, 22 bp, Homo sapiens
gcagagtctgggcagcctccat

SEQ ID NO: 7520914 - DNA, 22 bp, Homo sapiens
gcagagtctggtaggtgctggt

SEQ ID NO: 7520915 - DNA, 22 bp, Homo sapiens
gcagagtctggtaggtgctggt

SEQ ID NO: 7520916 - DNA, 22 bp, Homo sapiens
gcagagtctgggcagcctccat

SEQ ID NO: 7520917 - DNA, 22 bp, Homo sapiens
gcagagtctgggctacctcttg

SEQ ID NO: 7520918 - DNA, 22 bp, Homo sapiens
gcagagtctggtaggtgctggt

SEQ ID NO: 7520919 - DNA, 22 bp, Homo sapiens
gcagagtctgggcagcctccat

SEQ ID NO: 7520920 - DNA, 22 bp, Homo sapiens
gcagagtctgggcagcctccat

SEQ ID NO: 7520921 - DNA, 22 bp, Homo sapiens
gcagagtcccagcaggtggtgg

SEQ ID NO: 7520922 - DNA, 22 bp, Homo sapiens
gcagagtctgggcagcctccat

SEQ ID NO: 7520923 - DNA, 22 bp, Homo sapiens
gcagagtcccagcaggtggtgg

SEQ ID NO: 7520924 - DNA, 22 bp, Homo sapiens
gcagagtcccagcaggtggtgg

SEQ ID NO: 7520925 - DNA, 22 bp, Homo sapiens
gcagagtcccagcaggtggtgg

SEQ ID NO: 7520926 - DNA, 22 bp, Homo sapiens
gcagagtcccagcaggtggtgg

SEQ ID NO: 7520927 - DNA, 22 bp, Homo sapiens
gcagagtcaggattccatccca

SEQ ID NO: 7520928 - DNA, 22 bp, Homo sapiens
gcagagtcaggattccatccca

SEQ ID NO: 7520929 - DNA, 22 bp, Homo sapiens
gcagagtcaggtccaaggactg

SEQ ID NO: 7520930 - DNA, 22 bp, Homo sapiens
gcagagtcaggtccaaggactg

SEQ ID NO: 7520931 - DNA, 22 bp, Homo sapiens
gcagagtcaggtccaaggactg

SEQ ID NO: 7520932 - DNA, 22 bp, Homo sapiens
gcagagtcattatttatgcaat

SEQ ID NO: 7520933 - DNA, 22 bp, Homo sapiens
gcagagtcattatttatgcaat

SEQ ID NO: 7520934 - DNA, 23 bp, Homo sapiens
gcagaggttatgttttttaggct

SEQ ID NO: 7520935 - DNA, 23 bp, Homo sapiens
gcagaggttatgttttttaggct

SEQ ID NO: 7520936 - DNA, 22 bp, Homo sapiens
gcagaggttggattggtgactt

SEQ ID NO: 7520937 - DNA, 22 bp, Homo sapiens
gcagaggttggattggtgactt

SEQ ID NO: 7520938 - DNA, 23 bp, Homo sapiens
gcagaggtttttcagtatggttt

SEQ ID NO: 7520939 - DNA, 23 bp, Homo sapiens
gcagaggtttttcagtatggttt

SEQ ID NO: 7520940 - DNA, 23 bp, Homo sapiens
gcagaggtttttcagtatggttt

SEQ ID NO: 7520941 - DNA, 19 bp, Homo sapiens
gcagagtcaagagctgctg

SEQ ID NO: 7520942 - DNA, 19 bp, Homo sapiens
gcagagtcaagagctgctg

SEQ ID NO: 7520943 - DNA, 19 bp, Homo sapiens
gcagagtcaagagctgctg

SEQ ID NO: 7520944 - DNA, 19 bp, Homo sapiens
gcagagtcaagagctgctg

SEQ ID NO: 7520945 - DNA, 19 bp, Homo sapiens
gcagagtcaagagctgctg

SEQ ID NO: 7520946 - DNA, 22 bp, Homo sapiens
gcagagtcagcctccgagacag

SEQ ID NO: 7520947 - DNA, 23 bp, Homo sapiens
gcagagtcaagtagtcatgagtg

SEQ ID NO: 7520948 - DNA, 23 bp, Homo sapiens
gcagagtcaagtagtcatgagtg

SEQ ID NO: 7520949 - DNA, 23 bp, Homo sapiens
gcagagtcaagtagtcatgagtg

SEQ ID NO: 7520950 - DNA, 22 bp, Homo sapiens
gcagagtcagcctccgagacag

SEQ ID NO: 7520951 - DNA, 22 bp, Homo sapiens
gcagagtcagcctccgagacag

SEQ ID NO: 7520952 - DNA, 22 bp, Homo sapiens
gcagagtcagcctccgagacag

SEQ ID NO: 7520953 - DNA, 22 bp, Homo sapiens
gcacccagatagcaaggattag

SEQ ID NO: 7520954 - DNA, 22 bp, Homo sapiens
gcacccagatattgccttgacc

SEQ ID NO: 7520955 - DNA, 22 bp, Homo sapiens
gcacccagatattgccttgacc

SEQ ID NO: 7520956 - DNA, 22 bp, Homo sapiens
gcacccagatagcaaggattag

SEQ ID NO: 7520957 - DNA, 22 bp, Homo sapiens
gcacccagaggtcagcagtgct

SEQ ID NO: 7520958 - DNA, 22 bp, Homo sapiens
gcacccagaggtcagcagtgct

SEQ ID NO: 7520959 - DNA, 22 bp, Homo sapiens
gcacccagccagcatctcagag

SEQ ID NO: 7520960 - DNA, 22 bp, Homo sapiens
gcacccagccagcatctcagag

SEQ ID NO: 7520961 - DNA, 22 bp, Homo sapiens
gcacccagccagcatctcagag

SEQ ID NO: 7520962 - DNA, 22 bp, Homo sapiens
gcacccagccagcatctcagag

SEQ ID NO: 7520963 - DNA, 22 bp, Homo sapiens
gcacccagccagcatctcagag

SEQ ID NO: 7520964 - DNA, 22 bp, Homo sapiens
gcacccagccagcatctcagag

SEQ ID NO: 7520965 - DNA, 22 bp, Homo sapiens
gcacccagccagcatctcagag

SEQ ID NO: 7520966 - DNA, 22 bp, Homo sapiens
gcacccagatattgccttgacc

SEQ ID NO: 7520967 - DNA, 22 bp, Homo sapiens
gcacccagatattgccttgacc

SEQ ID NO: 7520968 - DNA, 22 bp, Homo sapiens
gcacccagatattgccttgacc

SEQ ID NO: 7520969 - DNA, 21 bp, Homo sapiens
gcacccagccggttctcccag

SEQ ID NO: 7520970 - DNA, 21 bp, Homo sapiens
gcacccagccggttctcccag

SEQ ID NO: 7520971 - DNA, 21 bp, Homo sapiens
gcacccagccggttctcccag

SEQ ID NO: 7520972 - DNA, 21 bp, Homo sapiens
gcacccagccggttctcccag

SEQ ID NO: 7520973 - DNA, 20 bp, Homo sapiens
gcacccagcttcttgttcta

SEQ ID NO: 7520974 - DNA, 21 bp, Homo sapiens
gcacccagccggttctcccag

SEQ ID NO: 7520975 - DNA, 22 bp, Homo sapiens
gcacccagcccagggcgtgatg

SEQ ID NO: 7520976 - DNA, 22 bp, Homo sapiens
gcacccagcccagggcgtgatg

SEQ ID NO: 7520977 - DNA, 22 bp, Homo sapiens
gcacccagcccagggcgtgatg

SEQ ID NO: 7520978 - DNA, 22 bp, Homo sapiens
gcagaaggatccgcaggtgcaa

SEQ ID NO: 7520979 - DNA, 22 bp, Homo sapiens
gcacccagcccagggcgtgatg

SEQ ID NO: 7520980 - DNA, 20 bp, Homo sapiens
gcacccagcttcttgttcta

SEQ ID NO: 7520981 - DNA, 22 bp, Homo sapiens
gcagaaggatccgcaggtgcaa

SEQ ID NO: 7520982 - DNA, 22 bp, Homo sapiens
gcagaaggatccgcaggtgcaa

SEQ ID NO: 7520983 - DNA, 22 bp, Homo sapiens
gcacccagaggtcagcagtgct

SEQ ID NO: 7520984 - DNA, 22 bp, Homo sapiens
gcacccagaggtcagcagtgct

SEQ ID NO: 7520985 - DNA, 22 bp, Homo sapiens
gcacccagaggtcagcagtgct

SEQ ID NO: 7520986 - DNA, 22 bp, Homo sapiens
gcacccagaggtcagcagtgct

SEQ ID NO: 7520987 - DNA, 22 bp, Homo sapiens
gcacccagaggtcagcagtgct

SEQ ID NO: 7520988 - DNA, 22 bp, Homo sapiens
gcaccaggaggcccttctcatc

SEQ ID NO: 7520989 - DNA, 22 bp, Homo sapiens
gcaccaggagaatcacgttaga

SEQ ID NO: 7520990 - DNA, 22 bp, Homo sapiens
gcacccagagggcagggtctcc

SEQ ID NO: 7520991 - DNA, 22 bp, Homo sapiens
gcaccagctgctgggttctaga

SEQ ID NO: 7520992 - DNA, 22 bp, Homo sapiens
gcaccaggaagctgttatagca

SEQ ID NO: 7520993 - DNA, 22 bp, Homo sapiens
gcaccagctgccttctgtgccc

SEQ ID NO: 7520994 - DNA, 22 bp, Homo sapiens
gcaccagctgccttctgtgccc

SEQ ID NO: 7520995 - DNA, 22 bp, Homo sapiens
gcaccagctgctgggttctaga

SEQ ID NO: 7520996 - DNA, 22 bp, Homo sapiens
gcaccagctgccttctgtgccc

SEQ ID NO: 7520997 - DNA, 22 bp, Homo sapiens
gcaccagctgccttctgtgccc

SEQ ID NO: 7520998 - DNA, 22 bp, Homo sapiens
gcaccagctgccttctgtgccc

SEQ ID NO: 7520999 - DNA, 22 bp, Homo sapiens
gcaccagctgccttctgtgccc

SEQ ID NO: 7521000 - DNA, 22 bp, Homo sapiens
gcaccagctgcagggtggctga

SEQ ID NO: 7521001 - DNA, 22 bp, Homo sapiens
gcaccagctgcagggtggctga

SEQ ID NO: 7521002 - DNA, 19 bp, Homo sapiens
gcaccagattgagtgacac

SEQ ID NO: 7521003 - DNA, 19 bp, Homo sapiens
gcaccagattgagtgacac

SEQ ID NO: 7521004 - DNA, 22 bp, Homo sapiens
gcaccagagggggctctgcagg

SEQ ID NO: 7521005 - DNA, 22 bp, Homo sapiens
gcaccactacactccagcctgg

SEQ ID NO: 7521006 - DNA, 22 bp, Homo sapiens
gcaccagagggggctctgcagg

SEQ ID NO: 7521007 - DNA, 19 bp, Homo sapiens
gcaccagattgagtgacac

SEQ ID NO: 7521008 - DNA, 22 bp, Homo sapiens
gcaccagctgcagggtggctga

SEQ ID NO: 7521009 - DNA, 22 bp, Homo sapiens
gcaccagctgcagggtggctga

SEQ ID NO: 7521010 - DNA, 22 bp, Homo sapiens
gcaccagcctgagcctcttgca

SEQ ID NO: 7521011 - DNA, 22 bp, Homo sapiens
gcaccagcctgagcctcttgca

SEQ ID NO: 7521012 - DNA, 22 bp, Homo sapiens
gcaccactacactccagcctgg

SEQ ID NO: 7521013 - DNA, 22 bp, Homo sapiens
gcaccactaagagcagggaccg

SEQ ID NO: 7521014 - DNA, 22 bp, Homo sapiens
gcacatttgccactgagctcct

SEQ ID NO: 7521015 - DNA, 22 bp, Homo sapiens
gcaccaccaccatcggcacctc

SEQ ID NO: 7521016 - DNA, 22 bp, Homo sapiens
gcacatttgagacatccaggca

SEQ ID NO: 7521017 - DNA, 22 bp, Homo sapiens
gcacatttctcaaagaattgtc

SEQ ID NO: 7521018 - DNA, 22 bp, Homo sapiens
gcacatttaactgagctcagga

SEQ ID NO: 7521019 - DNA, 22 bp, Homo sapiens
gcacatttctcaaagaattgtc

SEQ ID NO: 7521020 - DNA, 22 bp, Homo sapiens
gcacatttaactgagctcagga

SEQ ID NO: 7521021 - DNA, 22 bp, Homo sapiens
gcacattgcttgcccattgtaa

SEQ ID NO: 7521022 - DNA, 22 bp, Homo sapiens
gcacatttaactgagctcagga

SEQ ID NO: 7521023 - DNA, 22 bp, Homo sapiens
gcacatttaactgagctcagga

SEQ ID NO: 7521024 - DNA, 22 bp, Homo sapiens
gcagacagatgagggtgctggg

SEQ ID NO: 7521025 - DNA, 22 bp, Homo sapiens
gcagacagatgagggtgctggg

SEQ ID NO: 7521026 - DNA, 22 bp, Homo sapiens
gcagacagatgagggtgctggg

SEQ ID NO: 7521027 - DNA, 22 bp, Homo sapiens
gcagacagatgagggtgctggg

SEQ ID NO: 7521028 - DNA, 22 bp, Homo sapiens
gcagacagcatgttgggctatt

SEQ ID NO: 7521029 - DNA, 22 bp, Homo sapiens
gcagacagcatgttgggctatt

SEQ ID NO: 7521030 - DNA, 22 bp, Homo sapiens
gcagacagatgagggtgctggg

SEQ ID NO: 7521031 - DNA, 22 bp, Homo sapiens
gcagacagcatgttgggctatt

SEQ ID NO: 7521032 - DNA, 22 bp, Homo sapiens
gcagacagcatgttgggctatt

SEQ ID NO: 7521033 - DNA, 22 bp, Homo sapiens
gcagacaggcccagtggaggga

SEQ ID NO: 7521034 - DNA, 22 bp, Homo sapiens
gcagacaggcccagtggaggga

SEQ ID NO: 7521035 - DNA, 22 bp, Homo sapiens
gcagacaggcccagtggaggga

SEQ ID NO: 7521036 - DNA, 22 bp, Homo sapiens
gcagacaggcccagtggaggga

SEQ ID NO: 7521037 - DNA, 22 bp, Homo sapiens
gcagacaggcccagtggaggga

SEQ ID NO: 7521038 - DNA, 22 bp, Homo sapiens
gcagacaggattgggttaatag

SEQ ID NO: 7521039 - DNA, 22 bp, Homo sapiens
gcagacaggattgggttaatag

SEQ ID NO: 7521040 - DNA, 22 bp, Homo sapiens
gcagacagccagactgcactgg

SEQ ID NO: 7521041 - DNA, 22 bp, Homo sapiens
gcagacagccagactgcactgg

SEQ ID NO: 7521042 - DNA, 22 bp, Homo sapiens
gcagacagccagactgcactgg

SEQ ID NO: 7521043 - DNA, 22 bp, Homo sapiens
gcagacagcatgttgggctatt

SEQ ID NO: 7521044 - DNA, 22 bp, Homo sapiens
gcagacagcatgttgggctatt

SEQ ID NO: 7521045 - DNA, 22 bp, Homo sapiens
gcagacagccagactgcactgg

SEQ ID NO: 7521046 - DNA, 22 bp, Homo sapiens
gcagacagccagactgcactgg

SEQ ID NO: 7521047 - DNA, 22 bp, Homo sapiens
gcagacacttcccactgcagcg

SEQ ID NO: 7521048 - DNA, 22 bp, Homo sapiens
gcagacacttcccactgcagcg

SEQ ID NO: 7521049 - DNA, 17 bp, Homo sapiens
gcagacacttctattga

SEQ ID NO: 7521050 - DNA, 22 bp, Homo sapiens
gcagacacttttattctgcata

SEQ ID NO: 7521051 - DNA, 22 bp, Homo sapiens
gcagacacttttattctgcata

SEQ ID NO: 7521052 - DNA, 22 bp, Homo sapiens
gcagacacttttattctgcata

SEQ ID NO: 7521053 - DNA, 22 bp, Homo sapiens
gcagacacttgaggtgggcttt

SEQ ID NO: 7521054 - DNA, 22 bp, Homo sapiens
gcagacacttgaggtgggcttt

SEQ ID NO: 7521055 - DNA, 22 bp, Homo sapiens
gcagacagaagctaagtagaca

SEQ ID NO: 7521056 - DNA, 22 bp, Homo sapiens
gcagacagaagctaagtagaca

SEQ ID NO: 7521057 - DNA, 22 bp, Homo sapiens
gcagacagaagctaagtagaca

SEQ ID NO: 7521058 - DNA, 22 bp, Homo sapiens
gcagacacttttattctgcata

SEQ ID NO: 7521059 - DNA, 22 bp, Homo sapiens
gcagacagactgcagtgatttt

SEQ ID NO: 7521060 - DNA, 22 bp, Homo sapiens
gcagacagactgcagtgatttt

SEQ ID NO: 7521061 - DNA, 23 bp, Homo sapiens
gcagacagagcagactaagacaa

SEQ ID NO: 7521062 - DNA, 23 bp, Homo sapiens
gcagacagagcagactaagacaa

SEQ ID NO: 7521063 - DNA, 23 bp, Homo sapiens
gcagacagagcagactaagacaa

SEQ ID NO: 7521064 - DNA, 22 bp, Homo sapiens
gcagacacagggaaggcaagga

SEQ ID NO: 7521065 - DNA, 22 bp, Homo sapiens
gcagacacagggaaggcaagga

SEQ ID NO: 7521066 - DNA, 22 bp, Homo sapiens
gcagacacatccactcctacag

SEQ ID NO: 7521067 - DNA, 22 bp, Homo sapiens
gcagacacatccactcctacag

SEQ ID NO: 7521068 - DNA, 22 bp, Homo sapiens
gcagacacatccactcctacag

SEQ ID NO: 7521069 - DNA, 22 bp, Homo sapiens
gcagacaccttgtaggtgtgta

SEQ ID NO: 7521070 - DNA, 22 bp, Homo sapiens
gcagacacagggaaggcaagga

SEQ ID NO: 7521071 - DNA, 22 bp, Homo sapiens
gcagacaccttgtaggtgtgta

SEQ ID NO: 7521072 - DNA, 22 bp, Homo sapiens
gcagacaccttgtaggtgtgta

SEQ ID NO: 7521073 - DNA, 22 bp, Homo sapiens
gcagacacttcccactgcagcg

SEQ ID NO: 7521074 - DNA, 18 bp, Homo sapiens
gcagacactcgtggaggg

SEQ ID NO: 7521075 - DNA, 22 bp, Homo sapiens
gcagacacttcccactgcagcg

SEQ ID NO: 7521076 - DNA, 22 bp, Homo sapiens
gcagacacttcccactgcagcg

SEQ ID NO: 7521077 - DNA, 18 bp, Homo sapiens
gcagacactcgtggaggg

SEQ ID NO: 7521078 - DNA, 22 bp, Homo sapiens
gcagacaccttgtaggtgtgta

SEQ ID NO: 7521079 - DNA, 18 bp, Homo sapiens
gcagacactcgtggaggg

SEQ ID NO: 7521080 - DNA, 18 bp, Homo sapiens
gcagacactcgtggaggg

SEQ ID NO: 7521081 - DNA, 22 bp, Homo sapiens
gcagaaggcctcttggttaata

SEQ ID NO: 7521082 - DNA, 22 bp, Homo sapiens
gcagaaggcctcttggttaata

SEQ ID NO: 7521083 - DNA, 22 bp, Homo sapiens
gcagaagggaataaggagcttt

SEQ ID NO: 7521084 - DNA, 22 bp, Homo sapiens
gcagaagggaataaggagcttt

SEQ ID NO: 7521085 - DNA, 22 bp, Homo sapiens
gcagaagggaataaggagcttt

SEQ ID NO: 7521086 - DNA, 22 bp, Homo sapiens
gcagaaggcctcttggttaata

SEQ ID NO: 7521087 - DNA, 22 bp, Homo sapiens
gcagaagggaataaggagcttt

SEQ ID NO: 7521088 - DNA, 22 bp, Homo sapiens
gcagacaatttattagcagatt

SEQ ID NO: 7521089 - DNA, 22 bp, Homo sapiens
gcagaagggaataaggagcttt

SEQ ID NO: 7521090 - DNA, 22 bp, Homo sapiens
gcagacaatttattagcagatt

SEQ ID NO: 7521091 - DNA, 22 bp, Homo sapiens
gcagacaatttattagcagatt

SEQ ID NO: 7521092 - DNA, 22 bp, Homo sapiens
gcagacacagggaaggcaagga

SEQ ID NO: 7521093 - DNA, 22 bp, Homo sapiens
gcagacaatttattagcagatt

SEQ ID NO: 7521094 - DNA, 22 bp, Homo sapiens
gcacagcagctgggggccctgg

SEQ ID NO: 7521095 - DNA, 22 bp, Homo sapiens
gcacagcagctgggggccctgg

SEQ ID NO: 7521096 - DNA, 22 bp, Homo sapiens
gcacagcagctgggggccctgg

SEQ ID NO: 7521097 - DNA, 22 bp, Homo sapiens
gcacagcagctgctcagttgct

SEQ ID NO: 7521098 - DNA, 22 bp, Homo sapiens
gcacagcagctgctcagttgct

SEQ ID NO: 7521099 - DNA, 22 bp, Homo sapiens
gcacagcagctgctcagttgct

SEQ ID NO: 7521100 - DNA, 22 bp, Homo sapiens
gcacatgcactgtgggggcaat

SEQ ID NO: 7521101 - DNA, 20 bp, Homo sapiens
gcacatgcaacttttattta

SEQ ID NO: 7521102 - DNA, 22 bp, Homo sapiens
gcacagcagctgggggccctgg

SEQ ID NO: 7521103 - DNA, 22 bp, Homo sapiens
gcacagcagctgggggccctgg

SEQ ID NO: 7521104 - DNA, 22 bp, Homo sapiens
gcacagcacagcaacatgtttt

SEQ ID NO: 7521105 - DNA, 22 bp, Homo sapiens
gcacagcaatttctataagctc

SEQ ID NO: 7521106 - DNA, 22 bp, Homo sapiens
gcacagcaatttctataagctc

SEQ ID NO: 7521107 - DNA, 22 bp, Homo sapiens
gcacagcacagcaacatgtttt

SEQ ID NO: 7521108 - DNA, 22 bp, Homo sapiens
gcacagcacagcaacatgtttt

SEQ ID NO: 7521109 - DNA, 22 bp, Homo sapiens
gcacagcacagcaacatgtttt

SEQ ID NO: 7521110 - DNA, 22 bp, Homo sapiens
gcacagcagacttggtggggct

SEQ ID NO: 7521111 - DNA, 22 bp, Homo sapiens
gcacagcagacttggtggggct

SEQ ID NO: 7521112 - DNA, 22 bp, Homo sapiens
gcacagcagacttggtggggct

SEQ ID NO: 7521113 - DNA, 22 bp, Homo sapiens
gcacagcagacttggtggggct

SEQ ID NO: 7521114 - DNA, 22 bp, Homo sapiens
gcacagcagctgctcagttgct

SEQ ID NO: 7521115 - DNA, 22 bp, Homo sapiens
gcacagcagctgctcagttgct

SEQ ID NO: 7521116 - DNA, 22 bp, Homo sapiens
gcacagcagacttggtggggct

SEQ ID NO: 7521117 - DNA, 22 bp, Homo sapiens
gcacagagtcactagctaagca

SEQ ID NO: 7521118 - DNA, 22 bp, Homo sapiens
gcacagagtcactagctaagca

SEQ ID NO: 7521119 - DNA, 22 bp, Homo sapiens
gcacagagtcactagctaagca

SEQ ID NO: 7521120 - DNA, 22 bp, Homo sapiens
gcacagagtgggtgagatgtgg

SEQ ID NO: 7521121 - DNA, 22 bp, Homo sapiens
gcacagatggtactagcttggt

SEQ ID NO: 7521122 - DNA, 22 bp, Homo sapiens
gcacagagtgggtgagatgtgg

SEQ ID NO: 7521123 - DNA, 22 bp, Homo sapiens
gcacagaggtggaggacaaata

SEQ ID NO: 7521124 - DNA, 22 bp, Homo sapiens
gcacagaggtggaggacaaata

SEQ ID NO: 7521125 - DNA, 22 bp, Homo sapiens
gcacagaggtggaggacaaata

SEQ ID NO: 7521126 - DNA, 22 bp, Homo sapiens
gcacagagtcactagctaagca

SEQ ID NO: 7521127 - DNA, 22 bp, Homo sapiens
gcacagagtcactagctaagca

SEQ ID NO: 7521128 - DNA, 22 bp, Homo sapiens
gcacagagtcactagctaagca

SEQ ID NO: 7521129 - DNA, 22 bp, Homo sapiens
gcacagagtcactagctaagca

SEQ ID NO: 7521130 - DNA, 22 bp, Homo sapiens
gcacatgtgagagtagaggcct

SEQ ID NO: 7521131 - DNA, 22 bp, Homo sapiens
gcacatgtgggaatggtgctga

SEQ ID NO: 7521132 - DNA, 22 bp, Homo sapiens
gcacatgtgagagtagaggcct

SEQ ID NO: 7521133 - DNA, 22 bp, Homo sapiens
gcacatgtgagagtagaggcct

SEQ ID NO: 7521134 - DNA, 22 bp, Homo sapiens
gcacatgtcttattcactgtta

SEQ ID NO: 7521135 - DNA, 22 bp, Homo sapiens
gcacatgtcttattcactgtta

SEQ ID NO: 7521136 - DNA, 22 bp, Homo sapiens
gcacatgtcttattcactgtta

SEQ ID NO: 7521137 - DNA, 18 bp, Homo sapiens
gcacatgtaagagtaaag

SEQ ID NO: 7521138 - DNA, 18 bp, Homo sapiens
gcacatgtaagagtaaag

SEQ ID NO: 7521139 - DNA, 22 bp, Homo sapiens
gcacatgtgggtaagcacatgg

SEQ ID NO: 7521140 - DNA, 22 bp, Homo sapiens
gcacatgtgggaatggtgctga

SEQ ID NO: 7521141 - DNA, 22 bp, Homo sapiens
gcacatgtgggtaagcacatgg

SEQ ID NO: 7521142 - DNA, 22 bp, Homo sapiens
gcacatgtgggtaagcacatgg

SEQ ID NO: 7521143 - DNA, 18 bp, Homo sapiens
gcacatgtgtaaggcgac

SEQ ID NO: 7521144 - DNA, 22 bp, Homo sapiens
gcacattgttactcttactgtg

SEQ ID NO: 7521145 - DNA, 22 bp, Homo sapiens
gcacatgttgctagttacttgc

SEQ ID NO: 7521146 - DNA, 17 bp, Homo sapiens
gcacatgtgttctttta

SEQ ID NO: 7521147 - DNA, 22 bp, Homo sapiens
gcacatggacaatggaggtgca

SEQ ID NO: 7521148 - DNA, 22 bp, Homo sapiens
gcacatgcttgagtgtgatgtg

SEQ ID NO: 7521149 - DNA, 22 bp, Homo sapiens
gcacatggacaatggaggtgca

SEQ ID NO: 7521150 - DNA, 22 bp, Homo sapiens
gcacatggcggccagcaggtga

SEQ ID NO: 7521151 - DNA, 22 bp, Homo sapiens
gcacatggcggccagcaggtga

SEQ ID NO: 7521152 - DNA, 22 bp, Homo sapiens
gcacatggcggccagcaggtga

SEQ ID NO: 7521153 - DNA, 22 bp, Homo sapiens
gcacatggtaggcatttgatgt

SEQ ID NO: 7521154 - DNA, 18 bp, Homo sapiens
gcacatgtaagagtaaag

SEQ ID NO: 7521155 - DNA, 22 bp, Homo sapiens
gcacatggtaggcatttgatgt

SEQ ID NO: 7521156 - DNA, 21 bp, Homo sapiens
gcacatgctgtgtgtttctct

SEQ ID NO: 7521157 - DNA, 21 bp, Homo sapiens
gcacatgctgtgtgtttctct

SEQ ID NO: 7521158 - DNA, 21 bp, Homo sapiens
gcacatgctgtgtgtttctct

SEQ ID NO: 7521159 - DNA, 22 bp, Homo sapiens
gcacatgctcaatgtgtatgta

SEQ ID NO: 7521160 - DNA, 22 bp, Homo sapiens
gcacatgcgtgcttagaaagaa

SEQ ID NO: 7521161 - DNA, 22 bp, Homo sapiens
gcacatgcgtgcttagaaagaa

SEQ ID NO: 7521162 - DNA, 22 bp, Homo sapiens
gcacagcagctgggggccctgg

SEQ ID NO: 7521163 - DNA, 22 bp, Homo sapiens
gcacatgccccattcttgtcac

SEQ ID NO: 7521164 - DNA, 22 bp, Homo sapiens
gcacatgcatgcatattcctgg

SEQ ID NO: 7521165 - DNA, 22 bp, Homo sapiens
gcacatgcagactcattatcta

SEQ ID NO: 7521166 - DNA, 22 bp, Homo sapiens
gcacagagagcagtgggggaca

SEQ ID NO: 7521167 - DNA, 22 bp, Homo sapiens
gcacagagaggctgtgagcgcc

SEQ ID NO: 7521168 - DNA, 22 bp, Homo sapiens
gcacagagaggctgtgagcgcc

SEQ ID NO: 7521169 - DNA, 22 bp, Homo sapiens
gcacagagaggctgtgagcgcc

SEQ ID NO: 7521170 - DNA, 22 bp, Homo sapiens
gcacagagagcagtgggggaca

SEQ ID NO: 7521171 - DNA, 22 bp, Homo sapiens
gcacagagagcagtgggggaca

SEQ ID NO: 7521172 - DNA, 22 bp, Homo sapiens
gcacagagagcagtgggggaca

SEQ ID NO: 7521173 - DNA, 22 bp, Homo sapiens
gcacagagagcagtgggggaca

SEQ ID NO: 7521174 - DNA, 22 bp, Homo sapiens
gcacagagacagtcctgagatc

SEQ ID NO: 7521175 - DNA, 22 bp, Homo sapiens
gcacagagacagtcctgagatc

SEQ ID NO: 7521176 - DNA, 22 bp, Homo sapiens
gcacagagagcagtgggggaca

SEQ ID NO: 7521177 - DNA, 22 bp, Homo sapiens
gcacagagacagtcctgagatc

SEQ ID NO: 7521178 - DNA, 22 bp, Homo sapiens
gcacagagacagtcctgagatc

SEQ ID NO: 7521179 - DNA, 22 bp, Homo sapiens
gcacagagacagtcctgagatc

SEQ ID NO: 7521180 - DNA, 22 bp, Homo sapiens
gcacagagagggaaggtaactt

SEQ ID NO: 7521181 - DNA, 22 bp, Homo sapiens
gcacagagagggaaggtaactt

SEQ ID NO: 7521182 - DNA, 22 bp, Homo sapiens
gcacagagagggaaggtaactt

SEQ ID NO: 7521183 - DNA, 22 bp, Homo sapiens
gcacagagaggctgtgagcgcc

SEQ ID NO: 7521184 - DNA, 22 bp, Homo sapiens
gcacagagagtcccgggtgccc

SEQ ID NO: 7521185 - DNA, 22 bp, Homo sapiens
gcacagagagggaaggtaactt

SEQ ID NO: 7521186 - DNA, 22 bp, Homo sapiens
gcacagagagtcccgggtgccc

SEQ ID NO: 7521187 - DNA, 20 bp, Homo sapiens
gcacagagatgagcaaagta

SEQ ID NO: 7521188 - DNA, 20 bp, Homo sapiens
gcacagagatgagcaaagta

SEQ ID NO: 7521189 - DNA, 22 bp, Homo sapiens
gcacagagagtcccgggtgccc

SEQ ID NO: 7521190 - DNA, 22 bp, Homo sapiens
gcacagagggcagtgagcctct

SEQ ID NO: 7521191 - DNA, 22 bp, Homo sapiens
gcacagaggtggaggacaaata

SEQ ID NO: 7521192 - DNA, 22 bp, Homo sapiens
gcacagagggcagtgagcctct

SEQ ID NO: 7521193 - DNA, 20 bp, Homo sapiens
gcacagagatgagcaaagta

SEQ ID NO: 7521194 - DNA, 20 bp, Homo sapiens
gcacagagatgagcaaagta

SEQ ID NO: 7521195 - DNA, 20 bp, Homo sapiens
gcacagagatgagcaaagta

SEQ ID NO: 7521196 - DNA, 22 bp, Homo sapiens
gcacagagggcagtgagcctct

SEQ ID NO: 7521197 - DNA, 20 bp, Homo sapiens
gcacagagatgagcaaagta

SEQ ID NO: 7521198 - DNA, 17 bp, Homo sapiens
gcacagaggccaaagga

SEQ ID NO: 7521199 - DNA, 22 bp, Homo sapiens
gcacagaagtaaaatacaagtc

SEQ ID NO: 7521200 - DNA, 22 bp, Homo sapiens
gcacagaagtaaaatacaagtc

SEQ ID NO: 7521201 - DNA, 22 bp, Homo sapiens
gcacagaagtaaaatacaagtc

SEQ ID NO: 7521202 - DNA, 22 bp, Homo sapiens
gcacagaagtaaaatacaagtc

SEQ ID NO: 7521203 - DNA, 22 bp, Homo sapiens
gcacagaagtaaaatacaagtc

SEQ ID NO: 7521204 - DNA, 22 bp, Homo sapiens
gcacagaagagctttggaatga

SEQ ID NO: 7521205 - DNA, 22 bp, Homo sapiens
gcacagaataacactctgggct

SEQ ID NO: 7521206 - DNA, 22 bp, Homo sapiens
gcacagaataacactctgggct

SEQ ID NO: 7521207 - DNA, 22 bp, Homo sapiens
gcacagaataacactctgggct

SEQ ID NO: 7521208 - DNA, 22 bp, Homo sapiens
gcacagaataacactctgggct

SEQ ID NO: 7521209 - DNA, 22 bp, Homo sapiens
gcacagacatatccatatttac

SEQ ID NO: 7521210 - DNA, 22 bp, Homo sapiens
gcacagacagaatccctactcc

SEQ ID NO: 7521211 - DNA, 22 bp, Homo sapiens
gcacagactcaccttaatttga

SEQ ID NO: 7521212 - DNA, 22 bp, Homo sapiens
gcacagactttgattgcagtca

SEQ ID NO: 7521213 - DNA, 22 bp, Homo sapiens
gcacagactttgattgcagtca

SEQ ID NO: 7521214 - DNA, 22 bp, Homo sapiens
gcaatactaagtgacttttggg

SEQ ID NO: 7521215 - DNA, 22 bp, Homo sapiens
gcaatactaagtgacttttggg

SEQ ID NO: 7521216 - DNA, 22 bp, Homo sapiens
gcaatactcaacacttttgctt

SEQ ID NO: 7521217 - DNA, 22 bp, Homo sapiens
gcaatactaagtgacttttggg

SEQ ID NO: 7521218 - DNA, 22 bp, Homo sapiens
gcaatactgagattattgtact

SEQ ID NO: 7521219 - DNA, 22 bp, Homo sapiens
gcaatactgagattattgtact

SEQ ID NO: 7521220 - DNA, 22 bp, Homo sapiens
gcaatactcaacacttttgctt

SEQ ID NO: 7521221 - DNA, 22 bp, Homo sapiens
gcaatagactgtttttattgtt

SEQ ID NO: 7521222 - DNA, 22 bp, Homo sapiens
gcaatagacttggttcttctgt

SEQ ID NO: 7521223 - DNA, 22 bp, Homo sapiens
gcaatagattatgatctacagt

SEQ ID NO: 7521224 - DNA, 22 bp, Homo sapiens
gcaatagagcagctaatggaaa

SEQ ID NO: 7521225 - DNA, 22 bp, Homo sapiens
gcacagaaccagacatgaggca

SEQ ID NO: 7521226 - DNA, 22 bp, Homo sapiens
gcacagaaccctatctttcgga

SEQ ID NO: 7521227 - DNA, 22 bp, Homo sapiens
gcaatagattatgatctacagt

SEQ ID NO: 7521228 - DNA, 22 bp, Homo sapiens
gcacagaaccagacatgaggca

SEQ ID NO: 7521229 - DNA, 22 bp, Homo sapiens
gcacagaaccctatctttcgga

SEQ ID NO: 7521230 - DNA, 22 bp, Homo sapiens
gcacagaacttctcttagtagg

SEQ ID NO: 7521231 - DNA, 22 bp, Homo sapiens
gcacagaacttctcttagtagg

SEQ ID NO: 7521232 - DNA, 22 bp, Homo sapiens
gcacagaacttctcttagtagg

SEQ ID NO: 7521233 - DNA, 22 bp, Homo sapiens
gcacagaacttctcttagtagg

SEQ ID NO: 7521234 - DNA, 22 bp, Homo sapiens
gcacagaagagctttggaatga

SEQ ID NO: 7521235 - DNA, 22 bp, Homo sapiens
gcacagaagagctttggaatga

SEQ ID NO: 7521236 - DNA, 22 bp, Homo sapiens
gcaaggagcctggaggtgagtg

SEQ ID NO: 7521237 - DNA, 22 bp, Homo sapiens
gcaaggaggctggtggaggaag

SEQ ID NO: 7521238 - DNA, 22 bp, Homo sapiens
gcaaggagcctggaggtgagtg

SEQ ID NO: 7521239 - DNA, 22 bp, Homo sapiens
gcaaggatctgttgtggggcca

SEQ ID NO: 7521240 - DNA, 22 bp, Homo sapiens
gcaaggatctgttgtggggcca

SEQ ID NO: 7521241 - DNA, 22 bp, Homo sapiens
gcaaggaggctggtggaggaag

SEQ ID NO: 7521242 - DNA, 22 bp, Homo sapiens
gcaaggatgtactgcaatagga

SEQ ID NO: 7521243 - DNA, 21 bp, Homo sapiens
gcaaggcaatgccatgatttc

SEQ ID NO: 7521244 - DNA, 21 bp, Homo sapiens
gcaaggcaatgccatgatttc

SEQ ID NO: 7521245 - DNA, 21 bp, Homo sapiens
gcaaggcaatgccatgatttc

SEQ ID NO: 7521246 - DNA, 22 bp, Homo sapiens
gcaaggagcctggaggtgagtg

SEQ ID NO: 7521247 - DNA, 22 bp, Homo sapiens
gcaaggagcacctttctggaac

SEQ ID NO: 7521248 - DNA, 22 bp, Homo sapiens
gcaaggagactgtagggccaag

SEQ ID NO: 7521249 - DNA, 22 bp, Homo sapiens
gcaaggagactgtagggccaag

SEQ ID NO: 7521250 - DNA, 22 bp, Homo sapiens
gagtattttcaaattcagcaga

SEQ ID NO: 7521251 - DNA, 22 bp, Homo sapiens
gagtcaacaagtcagatctcac

SEQ ID NO: 7521252 - DNA, 22 bp, Homo sapiens
gcaaggaagcagagttgctatc

SEQ ID NO: 7521253 - DNA, 22 bp, Homo sapiens
gagtcaagtccagtgaggctga

SEQ ID NO: 7521254 - DNA, 22 bp, Homo sapiens
gagtcacaaaagatgcccaggg

SEQ ID NO: 7521255 - DNA, 22 bp, Homo sapiens
gagtcacaaaagatgcccaggg

SEQ ID NO: 7521256 - DNA, 22 bp, Homo sapiens
gagtcacaaaagatgcccaggg

SEQ ID NO: 7521257 - DNA, 22 bp, Homo sapiens
gcaaggagactgtagggccaag

SEQ ID NO: 7521258 - DNA, 22 bp, Homo sapiens
gcaaggagactgtagggccaag

SEQ ID NO: 7521259 - DNA, 22 bp, Homo sapiens
gcaaggagactgtagggccaag

SEQ ID NO: 7521260 - DNA, 22 bp, Homo sapiens
gcaaggagactgtagggccaag

SEQ ID NO: 7521261 - DNA, 22 bp, Homo sapiens
gcaaggaagcagagttgctatc

SEQ ID NO: 7521262 - DNA, 17 bp, Homo sapiens
gcaaggaagttctttgc

SEQ ID NO: 7521263 - DNA, 22 bp, Homo sapiens
gcaaggacctttgagcgtgcca

SEQ ID NO: 7521264 - DNA, 22 bp, Homo sapiens
gagtagacaaggtacatgttct

SEQ ID NO: 7521265 - DNA, 22 bp, Homo sapiens
gagtagaaggaagttatctacc

SEQ ID NO: 7521266 - DNA, 22 bp, Homo sapiens
gagtagaaggaagttatctacc

SEQ ID NO: 7521267 - DNA, 22 bp, Homo sapiens
gagtagacattaaattacactg

SEQ ID NO: 7521268 - DNA, 22 bp, Homo sapiens
gagtagaactggttatctaata

SEQ ID NO: 7521269 - DNA, 22 bp, Homo sapiens
gagtagaactggttatctaata

SEQ ID NO: 7521270 - DNA, 22 bp, Homo sapiens
gagtagaactggttatctaata

SEQ ID NO: 7521271 - DNA, 22 bp, Homo sapiens
gagtagaaggaagttatctacc

SEQ ID NO: 7521272 - DNA, 22 bp, Homo sapiens
gagtagaaagtaaagtacgaat

SEQ ID NO: 7521273 - DNA, 22 bp, Homo sapiens
gagtagaactggttatctaata

SEQ ID NO: 7521274 - DNA, 22 bp, Homo sapiens
gagtagaactagaattcttcaa

SEQ ID NO: 7521275 - DNA, 22 bp, Homo sapiens
gagtagaactagaattcttcaa

SEQ ID NO: 7521276 - DNA, 22 bp, Homo sapiens
gagtagcattctagagtatgct

SEQ ID NO: 7521277 - DNA, 22 bp, Homo sapiens
gagtaggaatgttctgccatct

SEQ ID NO: 7521278 - DNA, 22 bp, Homo sapiens
gagtagggatgctggtgactcc

SEQ ID NO: 7521279 - DNA, 22 bp, Homo sapiens
gagtaggcaaggtagctctgtt

SEQ ID NO: 7521280 - DNA, 22 bp, Homo sapiens
gagtagcattctagagtatgct

SEQ ID NO: 7521281 - DNA, 22 bp, Homo sapiens
gagtagcattctagagtatgct

SEQ ID NO: 7521282 - DNA, 22 bp, Homo sapiens
gagtagcagccacagaggaccc

SEQ ID NO: 7521283 - DNA, 22 bp, Homo sapiens
gagtagggtttccaggttagag

SEQ ID NO: 7521284 - DNA, 22 bp, Homo sapiens
gagtagttgctgcagagaatac

SEQ ID NO: 7521285 - DNA, 22 bp, Homo sapiens
gagtagggtttccaggttagag

SEQ ID NO: 7521286 - DNA, 22 bp, Homo sapiens
gagtagggatgctggtgactcc

SEQ ID NO: 7521287 - DNA, 22 bp, Homo sapiens
gagtagggatgctggtgactcc

SEQ ID NO: 7521288 - DNA, 22 bp, Homo sapiens
gagtataatgattttcattcac

SEQ ID NO: 7521289 - DNA, 22 bp, Homo sapiens
gagtataagtaatttcaagcaa

SEQ ID NO: 7521290 - DNA, 22 bp, Homo sapiens
gagtataagctttttcacttca

SEQ ID NO: 7521291 - DNA, 22 bp, Homo sapiens
gagtataagctttttcacttca

SEQ ID NO: 7521292 - DNA, 17 bp, Homo sapiens
gagtagttacaacagac

SEQ ID NO: 7521293 - DNA, 22 bp, Homo sapiens
gagtataagctttttcacttca

SEQ ID NO: 7521294 - DNA, 22 bp, Homo sapiens
gagtattcctcagtcattttgt

SEQ ID NO: 7521295 - DNA, 22 bp, Homo sapiens
gagtatttatatgtaagtacct

SEQ ID NO: 7521296 - DNA, 22 bp, Homo sapiens
gagtatttatatgtaagtacct

SEQ ID NO: 7521297 - DNA, 22 bp, Homo sapiens
gagtatttatatgtaagtacct

SEQ ID NO: 7521298 - DNA, 22 bp, Homo sapiens
gagtattttcaaattcagcaga

SEQ ID NO: 7521299 - DNA, 20 bp, Homo sapiens
gagtatgtaggatggtatca

SEQ ID NO: 7521300 - DNA, 22 bp, Homo sapiens
gagtattcaatatatacaaatg

SEQ ID NO: 7521301 - DNA, 22 bp, Homo sapiens
gagtattcaatatatacaaatg

SEQ ID NO: 7521302 - DNA, 22 bp, Homo sapiens
gagtatataattaattggtctg

SEQ ID NO: 7521303 - DNA, 22 bp, Homo sapiens
gagtataatgattttcattcac

SEQ ID NO: 7521304 - DNA, 22 bp, Homo sapiens
gcaaggcagcatccttttgagg

SEQ ID NO: 7521305 - DNA, 22 bp, Homo sapiens
gcaaggcagcgcggagtagcta

SEQ ID NO: 7521306 - DNA, 22 bp, Homo sapiens
gcaaggcagcgcggagtagcta

SEQ ID NO: 7521307 - DNA, 22 bp, Homo sapiens
gcaaggcagcgcggagtagcta

SEQ ID NO: 7521308 - DNA, 22 bp, Homo sapiens
gcaaggcagcgcggagtagcta

SEQ ID NO: 7521309 - DNA, 22 bp, Homo sapiens
gcaaggcagcgcggagtagcta

SEQ ID NO: 7521310 - DNA, 22 bp, Homo sapiens
gcaaggcagcgcggagtagcta

SEQ ID NO: 7521311 - DNA, 22 bp, Homo sapiens
gcaaggcagcgcggagtagcta

SEQ ID NO: 7521312 - DNA, 22 bp, Homo sapiens
gcaaggcagcgcggagtagcta

SEQ ID NO: 7521313 - DNA, 18 bp, Homo sapiens
gcaaggcagctctctggg

SEQ ID NO: 7521314 - DNA, 18 bp, Homo sapiens
gcaaggcagctctctggg

SEQ ID NO: 7521315 - DNA, 20 bp, Homo sapiens
gcaaggcaggttgaccaaga

SEQ ID NO: 7521316 - DNA, 21 bp, Homo sapiens
gcaaggcaatgccatgatttc

SEQ ID NO: 7521317 - DNA, 20 bp, Homo sapiens
gcaaggcacagtgaggaggg

SEQ ID NO: 7521318 - DNA, 20 bp, Homo sapiens
gcaaggcacagtgaggaggg

SEQ ID NO: 7521319 - DNA, 20 bp, Homo sapiens
gcaaggcacagtgaggaggg

SEQ ID NO: 7521320 - DNA, 20 bp, Homo sapiens
gcaaggcacagtgaggaggg

SEQ ID NO: 7521321 - DNA, 20 bp, Homo sapiens
gcaaggcacagtgaggaggg

SEQ ID NO: 7521322 - DNA, 20 bp, Homo sapiens
gcaaggcacagtgaggaggg

SEQ ID NO: 7521323 - DNA, 20 bp, Homo sapiens
gcaaggcacagtgaggaggg

SEQ ID NO: 7521324 - DNA, 18 bp, Homo sapiens
gcaaggctcaggccaggc

SEQ ID NO: 7521325 - DNA, 18 bp, Homo sapiens
gcaaggctcaggccaggc

SEQ ID NO: 7521326 - DNA, 20 bp, Homo sapiens
gcaaggctccaaggggtgtg

SEQ ID NO: 7521327 - DNA, 21 bp, Homo sapiens
gcaaggctcattcttgttgta

SEQ ID NO: 7521328 - DNA, 18 bp, Homo sapiens
gcaaggctcaggccaggc

SEQ ID NO: 7521329 - DNA, 22 bp, Homo sapiens
gcaaggctcacattgaactgaa

SEQ ID NO: 7521330 - DNA, 22 bp, Homo sapiens
gcaaggctcacattgaactgaa

SEQ ID NO: 7521331 - DNA, 17 bp, Homo sapiens
gcaaggcctgtttgttc

SEQ ID NO: 7521332 - DNA, 22 bp, Homo sapiens
gcaaggcctgaggtgggtgctc

SEQ ID NO: 7521333 - DNA, 22 bp, Homo sapiens
gcaaggcctgaggtgggtgctc

SEQ ID NO: 7521334 - DNA, 17 bp, Homo sapiens
gcaaggcctgtttgttc

SEQ ID NO: 7521335 - DNA, 18 bp, Homo sapiens
gcaaggcagctctctggg

SEQ ID NO: 7521336 - DNA, 20 bp, Homo sapiens
gcaaggcaggttgaccaaga

SEQ ID NO: 7521337 - DNA, 22 bp, Homo sapiens
gcaaggcagtcctggggccctg

SEQ ID NO: 7521338 - DNA, 21 bp, Homo sapiens
gcaaggcctatcatggcagct

SEQ ID NO: 7521339 - DNA, 19 bp, Homo sapiens
gcaaggccagcttgatgtg

SEQ ID NO: 7521340 - DNA, 22 bp, Homo sapiens
gcaaggcagtcctggggccctg

SEQ ID NO: 7521341 - DNA, 22 bp, Homo sapiens
gcaaggcagtcctggggccctg

SEQ ID NO: 7521342 - DNA, 22 bp, Homo sapiens
gcaaggcctgaggtgggtgctc

SEQ ID NO: 7521343 - DNA, 22 bp, Homo sapiens
gcaaggcctgaggtgggtgctc

SEQ ID NO: 7521344 - DNA, 21 bp, Homo sapiens
gcaaggcctatcatggcagct

SEQ ID NO: 7521345 - DNA, 19 bp, Homo sapiens
gcaaggccagcttgatgtg

SEQ ID NO: 7521346 - DNA, 19 bp, Homo sapiens
gcaaggccagcttgatgtg

SEQ ID NO: 7521347 - DNA, 21 bp, Homo sapiens
gcaaggcctatcatggcagct

SEQ ID NO: 7521348 - DNA, 21 bp, Homo sapiens
gcaaggcctatcatggcagct

SEQ ID NO: 7521349 - DNA, 21 bp, Homo sapiens
gcaaggcctatcatggcagct

SEQ ID NO: 7521350 - DNA, 22 bp, Homo sapiens
gcaaggctgacctctctagact

SEQ ID NO: 7521351 - DNA, 22 bp, Homo sapiens
gcaaggctcccgcagcccaggg

SEQ ID NO: 7521352 - DNA, 20 bp, Homo sapiens
gcaaggctccaaggggtgtg

SEQ ID NO: 7521353 - DNA, 20 bp, Homo sapiens
gcaaggctccaaggggtgtg

SEQ ID NO: 7521354 - DNA, 22 bp, Homo sapiens
gcaaggctcccgcagcccaggg

SEQ ID NO: 7521355 - DNA, 22 bp, Homo sapiens
gcaataaaatgtaatgattggg

SEQ ID NO: 7521356 - DNA, 22 bp, Homo sapiens
gcaataaacatgtttgatgcgc

SEQ ID NO: 7521357 - DNA, 22 bp, Homo sapiens
gcaataaacatgtttgatgcgc

SEQ ID NO: 7521358 - DNA, 22 bp, Homo sapiens
gcaataaacatgtttgatgcgc

SEQ ID NO: 7521359 - DNA, 22 bp, Homo sapiens
gcaataaagattttactgtcag

SEQ ID NO: 7521360 - DNA, 22 bp, Homo sapiens
gcaataaagattttactgtcag

SEQ ID NO: 7521361 - DNA, 22 bp, Homo sapiens
gcaataaactctctcaagccac

SEQ ID NO: 7521362 - DNA, 22 bp, Homo sapiens
gcaataaataacatggaagaca

SEQ ID NO: 7521363 - DNA, 22 bp, Homo sapiens
gcaataaagtagcagctcatca

SEQ ID NO: 7521364 - DNA, 23 bp, Homo sapiens
gcaatacaagactggtcatgagc

SEQ ID NO: 7521365 - DNA, 20 bp, Homo sapiens
gcaataagtaagtacaacag

SEQ ID NO: 7521366 - DNA, 22 bp, Homo sapiens
gcaataaataacatggaagaca

SEQ ID NO: 7521367 - DNA, 22 bp, Homo sapiens
gcaataaataacatggaagaca

SEQ ID NO: 7521368 - DNA, 22 bp, Homo sapiens
gcaatacagaagagtggcaagg

SEQ ID NO: 7521369 - DNA, 22 bp, Homo sapiens
gcaatacagtaggtttattggt

SEQ ID NO: 7521370 - DNA, 22 bp, Homo sapiens
gcaatacagttgaagagattga

SEQ ID NO: 7521371 - DNA, 22 bp, Homo sapiens
gcaatacagtaggtttattggt

SEQ ID NO: 7521372 - DNA, 23 bp, Homo sapiens
gcagctggttagaagggaaggag

SEQ ID NO: 7521373 - DNA, 23 bp, Homo sapiens
gcagctggttagaagggaaggag

SEQ ID NO: 7521374 - DNA, 23 bp, Homo sapiens
gcagctggttagaagggaaggag

SEQ ID NO: 7521375 - DNA, 23 bp, Homo sapiens
gcagctggttagaagggaaggag

SEQ ID NO: 7521376 - DNA, 23 bp, Homo sapiens
gcagctggttagaagggaaggag

SEQ ID NO: 7521377 - DNA, 23 bp, Homo sapiens
gcagctggttagaagggaaggag

SEQ ID NO: 7521378 - DNA, 23 bp, Homo sapiens
gcagctggttagaagggaaggag

SEQ ID NO: 7521379 - DNA, 23 bp, Homo sapiens
gcagctggttagaagggaaggag

SEQ ID NO: 7521380 - DNA, 23 bp, Homo sapiens
gcagctggttagaagggaaggag

SEQ ID NO: 7521381 - DNA, 23 bp, Homo sapiens
gcagctggttagaagggaaggag

SEQ ID NO: 7521382 - DNA, 22 bp, Homo sapiens
gcagctggttaatgggagaatt

SEQ ID NO: 7521383 - DNA, 22 bp, Homo sapiens
gcagctggttaatgggagaatt

SEQ ID NO: 7521384 - DNA, 22 bp, Homo sapiens
gcagctggttaatgggagaatt

SEQ ID NO: 7521385 - DNA, 22 bp, Homo sapiens
gcagctggtgcaaatgtcactc

SEQ ID NO: 7521386 - DNA, 22 bp, Homo sapiens
gcagctggttaatgggagaatt

SEQ ID NO: 7521387 - DNA, 22 bp, Homo sapiens
gcagctggttaatgggagaatt

SEQ ID NO: 7521388 - DNA, 22 bp, Homo sapiens
gcagctggtgcaaatgtcactc

SEQ ID NO: 7521389 - DNA, 22 bp, Homo sapiens
gcagctggtgcaaatgtcactc

SEQ ID NO: 7521390 - DNA, 22 bp, Homo sapiens
gcagctggtgcaaatgtcactc

SEQ ID NO: 7521391 - DNA, 22 bp, Homo sapiens
gcagctggtgcaaatgtcactc

SEQ ID NO: 7521392 - DNA, 22 bp, Homo sapiens
gcagctggtgcaaatgtcactc

SEQ ID NO: 7521393 - DNA, 22 bp, Homo sapiens
gcagctggtgcaaatgtcactc

SEQ ID NO: 7521394 - DNA, 22 bp, Homo sapiens
gcagctggtctggcctagagta

SEQ ID NO: 7521395 - DNA, 22 bp, Homo sapiens
gcagctggtctggcctagagta

SEQ ID NO: 7521396 - DNA, 22 bp, Homo sapiens
gcagctggtctggcctagagta

SEQ ID NO: 7521397 - DNA, 22 bp, Homo sapiens
gcagctggtctggcctagagta

SEQ ID NO: 7521398 - DNA, 22 bp, Homo sapiens
gcagctggtctggcctagagta

SEQ ID NO: 7521399 - DNA, 22 bp, Homo sapiens
gcagctggtctggcctagagta

SEQ ID NO: 7521400 - DNA, 22 bp, Homo sapiens
gcagctggtctggcctagagta

SEQ ID NO: 7521401 - DNA, 21 bp, Homo sapiens
gcagctggtctcagagcttgc

SEQ ID NO: 7521402 - DNA, 21 bp, Homo sapiens
gcagctggtctcagagcttgc

SEQ ID NO: 7521403 - DNA, 21 bp, Homo sapiens
gcagctggtctcagagcttgc

SEQ ID NO: 7521404 - DNA, 21 bp, Homo sapiens
gcagctggtctcagagcttgc

SEQ ID NO: 7521405 - DNA, 22 bp, Homo sapiens
gcagctggggaggtcgtgggga

SEQ ID NO: 7521406 - DNA, 22 bp, Homo sapiens
gcagctggggaggtcgtgggga

SEQ ID NO: 7521407 - DNA, 22 bp, Homo sapiens
gcagctggggccacacttaggc

SEQ ID NO: 7521408 - DNA, 22 bp, Homo sapiens
gcagctggggccacacttaggc

SEQ ID NO: 7521409 - DNA, 22 bp, Homo sapiens
gcagctggggccacacttaggc

SEQ ID NO: 7521410 - DNA, 22 bp, Homo sapiens
gcagctggggccacacttaggc

SEQ ID NO: 7521411 - DNA, 22 bp, Homo sapiens
gcagctggggccacacttaggc

SEQ ID NO: 7521412 - DNA, 22 bp, Homo sapiens
gcagctgggtctgtgtgggctg

SEQ ID NO: 7521413 - DNA, 22 bp, Homo sapiens
gcagctgggtctgtgtgggctg

SEQ ID NO: 7521414 - DNA, 22 bp, Homo sapiens
gcagctgggtctgtgtgggctg

SEQ ID NO: 7521415 - DNA, 22 bp, Homo sapiens
gcagctgggtctgtgtgggctg

SEQ ID NO: 7521416 - DNA, 22 bp, Homo sapiens
gcagctgggtctgtgtgggctg

SEQ ID NO: 7521417 - DNA, 22 bp, Homo sapiens
gcagctgggtctgtgtgggctg

SEQ ID NO: 7521418 - DNA, 22 bp, Homo sapiens
gcagctgggtctgtgtgggctg

SEQ ID NO: 7521419 - DNA, 22 bp, Homo sapiens
gcagctgggtctgtgtgggctg

SEQ ID NO: 7521420 - DNA, 22 bp, Homo sapiens
gcagctgggacactgaggccag

SEQ ID NO: 7521421 - DNA, 22 bp, Homo sapiens
gcagctgggacactgaggccag

SEQ ID NO: 7521422 - DNA, 22 bp, Homo sapiens
gcagctgggacactgaggccag

SEQ ID NO: 7521423 - DNA, 22 bp, Homo sapiens
gcagctgggacactgaggccag

SEQ ID NO: 7521424 - DNA, 22 bp, Homo sapiens
gcagctgggccccagcctctcc

SEQ ID NO: 7521425 - DNA, 22 bp, Homo sapiens
gcagctgggccccagcctctcc

SEQ ID NO: 7521426 - DNA, 22 bp, Homo sapiens
gcagctgggccccagcctctcc

SEQ ID NO: 7521427 - DNA, 22 bp, Homo sapiens
gcagctgggccccagcctctcc

SEQ ID NO: 7521428 - DNA, 22 bp, Homo sapiens
gcagctgggccccagcctctcc

SEQ ID NO: 7521429 - DNA, 22 bp, Homo sapiens
gcagctggggaggtcgtgggga

SEQ ID NO: 7521430 - DNA, 22 bp, Homo sapiens
gcagctggggaggtcgtgggga

SEQ ID NO: 7521431 - DNA, 22 bp, Homo sapiens
gcagctggggaggtcgtgggga

SEQ ID NO: 7521432 - DNA, 22 bp, Homo sapiens
gcagctggggaggtcgtgggga

SEQ ID NO: 7521433 - DNA, 22 bp, Homo sapiens
gcagctggggaggtcgtgggga

SEQ ID NO: 7521434 - DNA, 22 bp, Homo sapiens
gcagctggggaggtcgtgggga

SEQ ID NO: 7521435 - DNA, 22 bp, Homo sapiens
gcagctggggaggtcgtgggga

SEQ ID NO: 7521436 - DNA, 22 bp, Homo sapiens
gcagctggggaggtcgtgggga

SEQ ID NO: 7521437 - DNA, 22 bp, Homo sapiens
gcagctggccctgacacgcaga

SEQ ID NO: 7521438 - DNA, 22 bp, Homo sapiens
gcagctggctcagagaggtggg

SEQ ID NO: 7521439 - DNA, 22 bp, Homo sapiens
gcagcccacagctggaggccta

SEQ ID NO: 7521440 - DNA, 22 bp, Homo sapiens
gcagcccacaccactctgctca

SEQ ID NO: 7521441 - DNA, 22 bp, Homo sapiens
gcagcccacagctggaggccta

SEQ ID NO: 7521442 - DNA, 22 bp, Homo sapiens
gcagcccacagctggaggccta

SEQ ID NO: 7521443 - DNA, 22 bp, Homo sapiens
gcagcccacagctggaggccta

SEQ ID NO: 7521444 - DNA, 22 bp, Homo sapiens
gcagcccacaccactctgctca

SEQ ID NO: 7521445 - DNA, 22 bp, Homo sapiens
gcagcccacaccactctgctca

SEQ ID NO: 7521446 - DNA, 22 bp, Homo sapiens
gcagcccaatggactgagacag

SEQ ID NO: 7521447 - DNA, 22 bp, Homo sapiens
gcagcccaatggactgagacag

SEQ ID NO: 7521448 - DNA, 22 bp, Homo sapiens
gcagcccaagcctgagcatcct

SEQ ID NO: 7521449 - DNA, 22 bp, Homo sapiens
gcagcccaagcctgagcatcct

SEQ ID NO: 7521450 - DNA, 22 bp, Homo sapiens
gcagcccaagcctgagcatcct

SEQ ID NO: 7521451 - DNA, 22 bp, Homo sapiens
gcagcccaatggactgagacag

SEQ ID NO: 7521452 - DNA, 22 bp, Homo sapiens
gcagcccaatggactgagacag

SEQ ID NO: 7521453 - DNA, 22 bp, Homo sapiens
gcagcccaatggactgagacag

SEQ ID NO: 7521454 - DNA, 22 bp, Homo sapiens
gcagcccacaccactctgctca

SEQ ID NO: 7521455 - DNA, 22 bp, Homo sapiens
gcagcccacaccactctgctca

SEQ ID NO: 7521456 - DNA, 22 bp, Homo sapiens
gcagctggctctgggaaaaact

SEQ ID NO: 7521457 - DNA, 22 bp, Homo sapiens
gcagctggctctgggaaaaact

SEQ ID NO: 7521458 - DNA, 22 bp, Homo sapiens
gcagctggctcagagaggtggg

SEQ ID NO: 7521459 - DNA, 22 bp, Homo sapiens
gcagctggctcagagaggtggg

SEQ ID NO: 7521460 - DNA, 22 bp, Homo sapiens
gcagctggctcagagaggtggg

SEQ ID NO: 7521461 - DNA, 22 bp, Homo sapiens
gcagctggctcagagaggtggg

SEQ ID NO: 7521462 - DNA, 22 bp, Homo sapiens
gcagctggctcagagaggtggg

SEQ ID NO: 7521463 - DNA, 22 bp, Homo sapiens
gcagctggctcagagaggtggg

SEQ ID NO: 7521464 - DNA, 22 bp, Homo sapiens
gcagctggctcagagaggtggg

SEQ ID NO: 7521465 - DNA, 22 bp, Homo sapiens
gcagctgggacactgaggccag

SEQ ID NO: 7521466 - DNA, 22 bp, Homo sapiens
gcagctgggacactgaggccag

SEQ ID NO: 7521467 - DNA, 22 bp, Homo sapiens
gcagctgggacactgaggccag

SEQ ID NO: 7521468 - DNA, 22 bp, Homo sapiens
gcagctgggacactgaggccag

SEQ ID NO: 7521469 - DNA, 22 bp, Homo sapiens
gcagctgggacactgaggccag

SEQ ID NO: 7521470 - DNA, 22 bp, Homo sapiens
gcagctgggacactgaggccag

SEQ ID NO: 7521471 - DNA, 22 bp, Homo sapiens
gcagctgggacactgaggccag

SEQ ID NO: 7521472 - DNA, 22 bp, Homo sapiens
gcagctgggacactgaggccag

SEQ ID NO: 7521473 - DNA, 22 bp, Homo sapiens
gcagctgggacactgaggccag

SEQ ID NO: 7521474 - DNA, 22 bp, Homo sapiens
gcagctggctctgggaaaaact

SEQ ID NO: 7521475 - DNA, 22 bp, Homo sapiens
gcagccagtgggatgagaaaga

SEQ ID NO: 7521476 - DNA, 17 bp, Homo sapiens
gcagccagtgcagcagg

SEQ ID NO: 7521477 - DNA, 22 bp, Homo sapiens
gcagccagtgggatgagaaaga

SEQ ID NO: 7521478 - DNA, 22 bp, Homo sapiens
gcagccagtgggatgagaaaga

SEQ ID NO: 7521479 - DNA, 23 bp, Homo sapiens
gcagccatgttcccgtctcagct

SEQ ID NO: 7521480 - DNA, 22 bp, Homo sapiens
gcagcccaaaaaagaggtagat

SEQ ID NO: 7521481 - DNA, 22 bp, Homo sapiens
gcagcccaaaaaagaggtagat

SEQ ID NO: 7521482 - DNA, 22 bp, Homo sapiens
gcagccattgagcgaaaaaatc

SEQ ID NO: 7521483 - DNA, 22 bp, Homo sapiens
gcagcccaagcctgagcatcct

SEQ ID NO: 7521484 - DNA, 22 bp, Homo sapiens
gcagcccaagagactctgttga

SEQ ID NO: 7521485 - DNA, 22 bp, Homo sapiens
gcagcccaagagactctgttga

SEQ ID NO: 7521486 - DNA, 22 bp, Homo sapiens
gcagcccaagagactctgttga

SEQ ID NO: 7521487 - DNA, 22 bp, Homo sapiens
gcagcccaagcctgagcatcct

SEQ ID NO: 7521488 - DNA, 22 bp, Homo sapiens
gcagcccaagcctgagcatcct

SEQ ID NO: 7521489 - DNA, 22 bp, Homo sapiens
gcagcccaaaaaagaggtagat

SEQ ID NO: 7521490 - DNA, 22 bp, Homo sapiens
gcagcccaaaaaagaggtagat

SEQ ID NO: 7521491 - DNA, 22 bp, Homo sapiens
gcagcccaaaaaagaggtagat

SEQ ID NO: 7521492 - DNA, 22 bp, Homo sapiens
gcagcccaaaaaagaggtagat

SEQ ID NO: 7521493 - DNA, 22 bp, Homo sapiens
gcagcccaaaaaagaggtagat

SEQ ID NO: 7521494 - DNA, 22 bp, Homo sapiens
gcagcccaagagactctgttga

SEQ ID NO: 7521495 - DNA, 22 bp, Homo sapiens
gcagccaggaagcccaggacac

SEQ ID NO: 7521496 - DNA, 22 bp, Homo sapiens
gcagccaggaagcccaggacac

SEQ ID NO: 7521497 - DNA, 22 bp, Homo sapiens
gcagccaggaagcccaggacac

SEQ ID NO: 7521498 - DNA, 22 bp, Homo sapiens
gcagccaggaagcccaggacac

SEQ ID NO: 7521499 - DNA, 22 bp, Homo sapiens
gcagccaggaagcccaggacac

SEQ ID NO: 7521500 - DNA, 22 bp, Homo sapiens
gcagccagtatcctctgagatt

SEQ ID NO: 7521501 - DNA, 22 bp, Homo sapiens
gcagccagtatcctctgagatt

SEQ ID NO: 7521502 - DNA, 22 bp, Homo sapiens
gcagccagtatcctctgagatt

SEQ ID NO: 7521503 - DNA, 22 bp, Homo sapiens
gcagccaggtttgaggaccact

SEQ ID NO: 7521504 - DNA, 22 bp, Homo sapiens
gcagccaggaagcccaggacac

SEQ ID NO: 7521505 - DNA, 22 bp, Homo sapiens
gcagccaggaagcccaggacac

SEQ ID NO: 7521506 - DNA, 17 bp, Homo sapiens
gcagccagtgcagcagg

SEQ ID NO: 7521507 - DNA, 17 bp, Homo sapiens
gcagccagtgcagcagg

SEQ ID NO: 7521508 - DNA, 17 bp, Homo sapiens
gcagccagtgcagcagg

SEQ ID NO: 7521509 - DNA, 17 bp, Homo sapiens
gcagccagtgcagcagg

SEQ ID NO: 7521510 - DNA, 17 bp, Homo sapiens
gcagccagtgcagcagg

SEQ ID NO: 7521511 - DNA, 22 bp, Homo sapiens
gcagccagtatcctctgagatt

SEQ ID NO: 7521512 - DNA, 17 bp, Homo sapiens
gcagccagtgcagcagg

SEQ ID NO: 7521513 - DNA, 17 bp, Homo sapiens
gcagccagtgcagcagg

SEQ ID NO: 7521514 - DNA, 22 bp, Homo sapiens
gcagccagcccctctgacctct

SEQ ID NO: 7521515 - DNA, 22 bp, Homo sapiens
gcagccagcccctctgacctct

SEQ ID NO: 7521516 - DNA, 22 bp, Homo sapiens
gcagccagcccctctgacctct

SEQ ID NO: 7521517 - DNA, 22 bp, Homo sapiens
gcagccagcaggaagcgggaga

SEQ ID NO: 7521518 - DNA, 22 bp, Homo sapiens
gcagccagcaggaagcgggaga

SEQ ID NO: 7521519 - DNA, 22 bp, Homo sapiens
gcagccagcaggaagcgggaga

SEQ ID NO: 7521520 - DNA, 22 bp, Homo sapiens
gcagccagcccctctgacctct

SEQ ID NO: 7521521 - DNA, 22 bp, Homo sapiens
gcagccagcccctctgacctct

SEQ ID NO: 7521522 - DNA, 21 bp, Homo sapiens
gcagccagacgggattcagtt

SEQ ID NO: 7521523 - DNA, 21 bp, Homo sapiens
gcagccagacgggattcagtt

SEQ ID NO: 7521524 - DNA, 21 bp, Homo sapiens
gcagccagacgggattcagtt

SEQ ID NO: 7521525 - DNA, 22 bp, Homo sapiens
gcagccagagggggtgtgatca

SEQ ID NO: 7521526 - DNA, 22 bp, Homo sapiens
gcagccagagggggtgtgatca

SEQ ID NO: 7521527 - DNA, 21 bp, Homo sapiens
gcagccagacgggattcagtt

SEQ ID NO: 7521528 - DNA, 21 bp, Homo sapiens
gcagccagacgggattcagtt

SEQ ID NO: 7521529 - DNA, 22 bp, Homo sapiens
gcagccagaagactcagaacaa

SEQ ID NO: 7521530 - DNA, 21 bp, Homo sapiens
gcagccagccgagaccatgcc

SEQ ID NO: 7521531 - DNA, 21 bp, Homo sapiens
gcagccagccgagaccatgcc

SEQ ID NO: 7521532 - DNA, 21 bp, Homo sapiens
gcagccagccgagaccatgcc

SEQ ID NO: 7521533 - DNA, 22 bp, Homo sapiens
gcagccagccctagtcccactt

SEQ ID NO: 7521534 - DNA, 22 bp, Homo sapiens
gcagccagccctagtcccactt

SEQ ID NO: 7521535 - DNA, 22 bp, Homo sapiens
gcagccagcccctctgacctct

SEQ ID NO: 7521536 - DNA, 21 bp, Homo sapiens
gcagccagccgagaccatgcc

SEQ ID NO: 7521537 - DNA, 22 bp, Homo sapiens
gcagccagccctagtcccactt

SEQ ID NO: 7521538 - DNA, 22 bp, Homo sapiens
gcagccagccctagtcccactt

SEQ ID NO: 7521539 - DNA, 22 bp, Homo sapiens
gcagccagccctagtcccactt

SEQ ID NO: 7521540 - DNA, 22 bp, Homo sapiens
gcagccaggaaagctggaccct

SEQ ID NO: 7521541 - DNA, 22 bp, Homo sapiens
gcagccaggaaagctggaccct

SEQ ID NO: 7521542 - DNA, 22 bp, Homo sapiens
gcagccaggaaagctggaccct

SEQ ID NO: 7521543 - DNA, 22 bp, Homo sapiens
gcagccaggaaagctggaccct

SEQ ID NO: 7521544 - DNA, 22 bp, Homo sapiens
gcagccaggaaagctggaccct

SEQ ID NO: 7521545 - DNA, 21 bp, Homo sapiens
gcagccagccgagaccatgcc

SEQ ID NO: 7521546 - DNA, 22 bp, Homo sapiens
gcagccacagaggagggatgca

SEQ ID NO: 7521547 - DNA, 22 bp, Homo sapiens
gcagccacagaggagggatgca

SEQ ID NO: 7521548 - DNA, 22 bp, Homo sapiens
gcagccacagaggagggatgca

SEQ ID NO: 7521549 - DNA, 22 bp, Homo sapiens
gcagcagcccagggctctcaga

SEQ ID NO: 7521550 - DNA, 22 bp, Homo sapiens
gcagcagcccagggctctcaga

SEQ ID NO: 7521551 - DNA, 22 bp, Homo sapiens
gcagccaccctcaaggctgaat

SEQ ID NO: 7521552 - DNA, 21 bp, Homo sapiens
gcagccacagccaccaagcta

SEQ ID NO: 7521553 - DNA, 22 bp, Homo sapiens
gcagcagcccagggctctcaga

SEQ ID NO: 7521554 - DNA, 22 bp, Homo sapiens
gcagcagcccagggctctcaga

SEQ ID NO: 7521555 - DNA, 22 bp, Homo sapiens
gcagcagcccagggctctcaga

SEQ ID NO: 7521556 - DNA, 22 bp, Homo sapiens
gcagcagcccagggctctcaga

SEQ ID NO: 7521557 - DNA, 22 bp, Homo sapiens
gcagcagccactattctggcat

SEQ ID NO: 7521558 - DNA, 22 bp, Homo sapiens
gcagcagcccagggctctcaga

SEQ ID NO: 7521559 - DNA, 22 bp, Homo sapiens
gcagcagcccagggctctcaga

SEQ ID NO: 7521560 - DNA, 22 bp, Homo sapiens
gcagccaccctcaaggctgaat

SEQ ID NO: 7521561 - DNA, 19 bp, Homo sapiens
gcagccaccgcggcggccg

SEQ ID NO: 7521562 - DNA, 19 bp, Homo sapiens
gcagccaccgcggcggccg

SEQ ID NO: 7521563 - DNA, 22 bp, Homo sapiens
gcagccaccctcaaggctgaat

SEQ ID NO: 7521564 - DNA, 22 bp, Homo sapiens
gcagccaccctcaaggctgaat

SEQ ID NO: 7521565 - DNA, 22 bp, Homo sapiens
gcagccaccctcaaggctgaat

SEQ ID NO: 7521566 - DNA, 19 bp, Homo sapiens
gcagccaccgcggcggccg

SEQ ID NO: 7521567 - DNA, 22 bp, Homo sapiens
gcagccacctcccatggcgggg

SEQ ID NO: 7521568 - DNA, 22 bp, Homo sapiens
gcagccacctcccatggcgggg

SEQ ID NO: 7521569 - DNA, 22 bp, Homo sapiens
gcagccacctcccatggcgggg

SEQ ID NO: 7521570 - DNA, 22 bp, Homo sapiens
gcagccactgggagtgcttata

SEQ ID NO: 7521571 - DNA, 22 bp, Homo sapiens
gcagccagaagactcagaacaa

SEQ ID NO: 7521572 - DNA, 22 bp, Homo sapiens
gcagccactttgcaaccaagag

SEQ ID NO: 7521573 - DNA, 22 bp, Homo sapiens
gcagccagaagactcagaacaa

SEQ ID NO: 7521574 - DNA, 22 bp, Homo sapiens
gcagccagaagactcagaacaa

SEQ ID NO: 7521575 - DNA, 22 bp, Homo sapiens
gcagccactgggagtgcttata

SEQ ID NO: 7521576 - DNA, 21 bp, Homo sapiens
gcagccactgccttcaacaat

SEQ ID NO: 7521577 - DNA, 22 bp, Homo sapiens
gcagccactctcattccacgtg

SEQ ID NO: 7521578 - DNA, 21 bp, Homo sapiens
gcagccactgccttcaacaat

SEQ ID NO: 7521579 - DNA, 22 bp, Homo sapiens
gcagccactctcattccacgtg

SEQ ID NO: 7521580 - DNA, 22 bp, Homo sapiens
gcagccactagttttcctgttt

SEQ ID NO: 7521581 - DNA, 22 bp, Homo sapiens
gcagcaatcttcacagtgtcat

SEQ ID NO: 7521582 - DNA, 22 bp, Homo sapiens
gcagcaatcttcacagtgtcat

SEQ ID NO: 7521583 - DNA, 22 bp, Homo sapiens
gcagcaatatccatgtcttcac

SEQ ID NO: 7521584 - DNA, 22 bp, Homo sapiens
gcagcaatcttcacagtgtcat

SEQ ID NO: 7521585 - DNA, 22 bp, Homo sapiens
gcagcaatcccaagtctgagtg

SEQ ID NO: 7521586 - DNA, 22 bp, Homo sapiens
gcagcaatcccaagtctgagtg

SEQ ID NO: 7521587 - DNA, 22 bp, Homo sapiens
gcagcaatcccaagtctgagtg

SEQ ID NO: 7521588 - DNA, 22 bp, Homo sapiens
gcagcaataatgttttggagga

SEQ ID NO: 7521589 - DNA, 22 bp, Homo sapiens
gcagcaataatgttttggagga

SEQ ID NO: 7521590 - DNA, 19 bp, Homo sapiens
gcagcaatagaagacaaat

SEQ ID NO: 7521591 - DNA, 19 bp, Homo sapiens
gcagcaatagaagacaaat

SEQ ID NO: 7521592 - DNA, 22 bp, Homo sapiens
gcagcaaggatgaagcacttgg

SEQ ID NO: 7521593 - DNA, 22 bp, Homo sapiens
gcagcaagaggtgccatcttga

SEQ ID NO: 7521594 - DNA, 22 bp, Homo sapiens
gcagcaagaggtttctgttgac

SEQ ID NO: 7521595 - DNA, 22 bp, Homo sapiens
gcagcaagaggtgccatcttga

SEQ ID NO: 7521596 - DNA, 22 bp, Homo sapiens
gcagcaagaggtttctgttgac

SEQ ID NO: 7521597 - DNA, 22 bp, Homo sapiens
gcagcaagtctagtttgtaggc

SEQ ID NO: 7521598 - DNA, 22 bp, Homo sapiens
gcagcaaggatgaagcacttgg

SEQ ID NO: 7521599 - DNA, 22 bp, Homo sapiens
gcagcaaggatgaagcacttgg

SEQ ID NO: 7521600 - DNA, 22 bp, Homo sapiens
gcagcaagtctagtttgtaggc

SEQ ID NO: 7521601 - DNA, 22 bp, Homo sapiens
gcagcagaaggccaaggggagc

SEQ ID NO: 7521602 - DNA, 22 bp, Homo sapiens
gcagcactgtcttgtcttagga

SEQ ID NO: 7521603 - DNA, 22 bp, Homo sapiens
gcagcagaaggccaaggggagc

SEQ ID NO: 7521604 - DNA, 22 bp, Homo sapiens
gcagcagaaggccaaggggagc

SEQ ID NO: 7521605 - DNA, 22 bp, Homo sapiens
gcagcactgtcttgtcttagga

SEQ ID NO: 7521606 - DNA, 22 bp, Homo sapiens
gcagcactgatcctaaacttag

SEQ ID NO: 7521607 - DNA, 22 bp, Homo sapiens
gcagcactaatgggccccagaa

SEQ ID NO: 7521608 - DNA, 22 bp, Homo sapiens
gcagcaccaaccagggcctgtt

SEQ ID NO: 7521609 - DNA, 22 bp, Homo sapiens
gcagcacaaagtccccagggac

SEQ ID NO: 7521610 - DNA, 22 bp, Homo sapiens
gcagcacaaagtccccagggac

SEQ ID NO: 7521611 - DNA, 22 bp, Homo sapiens
gcagcacaaagtccccagggac

SEQ ID NO: 7521612 - DNA, 22 bp, Homo sapiens
gcagcaattatcaatctcatta

SEQ ID NO: 7521613 - DNA, 22 bp, Homo sapiens
gcagcacatataaacaaagaga

SEQ ID NO: 7521614 - DNA, 22 bp, Homo sapiens
gcagcacatataaacaaagaga

SEQ ID NO: 7521615 - DNA, 22 bp, Homo sapiens
gcagcacatataaacaaagaga

SEQ ID NO: 7521616 - DNA, 22 bp, Homo sapiens
gcagcaccaaccagggcctgtt

SEQ ID NO: 7521617 - DNA, 22 bp, Homo sapiens
gcagcaccaaccagggcctgtt

SEQ ID NO: 7521618 - DNA, 22 bp, Homo sapiens
gcagcagaagtagaagtacagg

SEQ ID NO: 7521619 - DNA, 22 bp, Homo sapiens
gcagcagatgtgggcccagagc

SEQ ID NO: 7521620 - DNA, 22 bp, Homo sapiens
gcagcagaagtagaagtacagg

SEQ ID NO: 7521621 - DNA, 22 bp, Homo sapiens
gcagcagaaggccaaggggagc

SEQ ID NO: 7521622 - DNA, 22 bp, Homo sapiens
gcagcagaaggccaaggggagc

SEQ ID NO: 7521623 - DNA, 22 bp, Homo sapiens
gcagcagaaggccaaggggagc

SEQ ID NO: 7521624 - DNA, 22 bp, Homo sapiens
gcagcagaaggccaaggggagc

SEQ ID NO: 7521625 - DNA, 22 bp, Homo sapiens
gcagcagaagtagaagtacagg

SEQ ID NO: 7521626 - DNA, 22 bp, Homo sapiens
gcagcagaagtagaagtacagg

SEQ ID NO: 7521627 - DNA, 22 bp, Homo sapiens
gcagcagaagtagaagtacagg

SEQ ID NO: 7521628 - DNA, 22 bp, Homo sapiens
gcagcagcagcaattttctgtc

SEQ ID NO: 7521629 - DNA, 22 bp, Homo sapiens
gcagcagcagcaattttctgtc

SEQ ID NO: 7521630 - DNA, 22 bp, Homo sapiens
gcagcagcagcaattttctgtc

SEQ ID NO: 7521631 - DNA, 22 bp, Homo sapiens
gcagcagcaagaaggttggact

SEQ ID NO: 7521632 - DNA, 22 bp, Homo sapiens
gcagcagcaagaaggttggact

SEQ ID NO: 7521633 - DNA, 22 bp, Homo sapiens
gcagcagcaagaaggttggact

SEQ ID NO: 7521634 - DNA, 22 bp, Homo sapiens
gcagcagatgtgggcccagagc

SEQ ID NO: 7521635 - DNA, 22 bp, Homo sapiens
gcagcagattgttttttcacct

SEQ ID NO: 7521636 - DNA, 22 bp, Homo sapiens
gcagcagattgttttttcacct

SEQ ID NO: 7521637 - DNA, 22 bp, Homo sapiens
gcagcagcaagaaggttggact

SEQ ID NO: 7521638 - DNA, 22 bp, Homo sapiens
gcagcagcaagaaggttggact

SEQ ID NO: 7521639 - DNA, 22 bp, Homo sapiens
gcagcagcagggagtctgactt

SEQ ID NO: 7521640 - DNA, 22 bp, Homo sapiens
gcagcagcagggagtctgactt

SEQ ID NO: 7521641 - DNA, 22 bp, Homo sapiens
gcagcagcaggcgctcggccgt

SEQ ID NO: 7521642 - DNA, 22 bp, Homo sapiens
gcagcagcaggcgctcggccgt

SEQ ID NO: 7521643 - DNA, 22 bp, Homo sapiens
gcagcagcaggcgctcggccgt

SEQ ID NO: 7521644 - DNA, 22 bp, Homo sapiens
gcagcagcaggcgctcggccgt

SEQ ID NO: 7521645 - DNA, 22 bp, Homo sapiens
gcagcagcaggcgctcggccgt

SEQ ID NO: 7521646 - DNA, 22 bp, Homo sapiens
gcagcagcagcaattttctgtc

SEQ ID NO: 7521647 - DNA, 22 bp, Homo sapiens
gcagcagcaggcgctcggccgt

SEQ ID NO: 7521648 - DNA, 22 bp, Homo sapiens
gcagcagcaggcgctcggccgt

SEQ ID NO: 7521649 - DNA, 22 bp, Homo sapiens
gcagcagcaggcgctcggccgt

SEQ ID NO: 7521650 - DNA, 22 bp, Homo sapiens
gcagcagcagggagtctgactt

SEQ ID NO: 7521651 - DNA, 22 bp, Homo sapiens
gcagcagcagggagtctgactt

SEQ ID NO: 7521652 - DNA, 22 bp, Homo sapiens
gcagcagcagggagtctgactt

SEQ ID NO: 7521653 - DNA, 22 bp, Homo sapiens
gcagcagcagggagtctgactt

SEQ ID NO: 7521654 - DNA, 19 bp, Homo sapiens
gcagcagcatttggtaata

SEQ ID NO: 7521655 - DNA, 22 bp, Homo sapiens
gcagcagcagggagtctgactt

SEQ ID NO: 7521656 - DNA, 22 bp, Homo sapiens
gcagcagcagggagtctgactt

SEQ ID NO: 7521657 - DNA, 22 bp, Homo sapiens
gcagcagccactattctggcat

SEQ ID NO: 7521658 - DNA, 22 bp, Homo sapiens
gcagcagccactattctggcat

SEQ ID NO: 7521659 - DNA, 22 bp, Homo sapiens
gcagcagccactattctggcat

SEQ ID NO: 7521660 - DNA, 22 bp, Homo sapiens
gcagcagccactattctggcat

SEQ ID NO: 7521661 - DNA, 19 bp, Homo sapiens
gcagcagcatttggtaata

SEQ ID NO: 7521662 - DNA, 19 bp, Homo sapiens
gcagcagcatttggtaata

SEQ ID NO: 7521663 - DNA, 22 bp, Homo sapiens
gcaggtagtgatcgagggtgac

SEQ ID NO: 7521664 - DNA, 22 bp, Homo sapiens
gcaggtagtgatcgagggtgac

SEQ ID NO: 7521665 - DNA, 22 bp, Homo sapiens
gcaggtagtgatcgagggtgac

SEQ ID NO: 7521666 - DNA, 19 bp, Homo sapiens
gcaggtagagacagcagcc

SEQ ID NO: 7521667 - DNA, 19 bp, Homo sapiens
gcaggtagagacagcagcc

SEQ ID NO: 7521668 - DNA, 19 bp, Homo sapiens
gcaggtagagacagcagcc

SEQ ID NO: 7521669 - DNA, 22 bp, Homo sapiens
gcaggtaagagaggctggcttc

SEQ ID NO: 7521670 - DNA, 21 bp, Homo sapiens
gcagggtttgtgctgtgagtt

SEQ ID NO: 7521671 - DNA, 21 bp, Homo sapiens
gcagggtttgtgctgtgagtt

SEQ ID NO: 7521672 - DNA, 22 bp, Homo sapiens
gcagggttttatagatctcttc

SEQ ID NO: 7521673 - DNA, 22 bp, Homo sapiens
gcagggttttccttagaatttc

SEQ ID NO: 7521674 - DNA, 22 bp, Homo sapiens
gcagggttttccttagaatttc

SEQ ID NO: 7521675 - DNA, 21 bp, Homo sapiens
gcagggtttgtgctgtgagtt

SEQ ID NO: 7521676 - DNA, 22 bp, Homo sapiens
gcaggtaagagaggctggcttc

SEQ ID NO: 7521677 - DNA, 19 bp, Homo sapiens
gcagggtgttgactgtccc

SEQ ID NO: 7521678 - DNA, 19 bp, Homo sapiens
gcagggtgttgactgtccc

SEQ ID NO: 7521679 - DNA, 22 bp, Homo sapiens
gcagggttcctctctagcattt

SEQ ID NO: 7521680 - DNA, 22 bp, Homo sapiens
gcagggttcctctctagcattt

SEQ ID NO: 7521681 - DNA, 22 bp, Homo sapiens
gcagggttctcagcagtgatgg

SEQ ID NO: 7521682 - DNA, 22 bp, Homo sapiens
gcagggttctcagcagtgatgg

SEQ ID NO: 7521683 - DNA, 22 bp, Homo sapiens
gcagggttggtgtcctctgcgg

SEQ ID NO: 7521684 - DNA, 22 bp, Homo sapiens
gcagggttggtgtcctctgcgg

SEQ ID NO: 7521685 - DNA, 22 bp, Homo sapiens
gcagggttggtgtcctctgcgg

SEQ ID NO: 7521686 - DNA, 22 bp, Homo sapiens
gcagggtttagcacctgtagct

SEQ ID NO: 7521687 - DNA, 22 bp, Homo sapiens
gcagggtttagcacctgtagct

SEQ ID NO: 7521688 - DNA, 21 bp, Homo sapiens
gcagggtttgtgctgtgagtt

SEQ ID NO: 7521689 - DNA, 22 bp, Homo sapiens
gcaggtcccagaaagttaattc

SEQ ID NO: 7521690 - DNA, 22 bp, Homo sapiens
gcaggtctagaagctgcctctg

SEQ ID NO: 7521691 - DNA, 22 bp, Homo sapiens
gcaggtctagaagctgcctctg

SEQ ID NO: 7521692 - DNA, 20 bp, Homo sapiens
gcaggtccctggcatgcaga

SEQ ID NO: 7521693 - DNA, 22 bp, Homo sapiens
gcaggtctatcaggctgcaggt

SEQ ID NO: 7521694 - DNA, 22 bp, Homo sapiens
gcaggtctatcaggctgcaggt

SEQ ID NO: 7521695 - DNA, 19 bp, Homo sapiens
gcaggtcattaggctaggt

SEQ ID NO: 7521696 - DNA, 19 bp, Homo sapiens
gcaggtcattaggctaggt

SEQ ID NO: 7521697 - DNA, 22 bp, Homo sapiens
gcaggtccagtcaccagagaga

SEQ ID NO: 7521698 - DNA, 22 bp, Homo sapiens
gcaggtagtgctaaagacttac

SEQ ID NO: 7521699 - DNA, 19 bp, Homo sapiens
gcaggtcattaggctaggt

SEQ ID NO: 7521700 - DNA, 19 bp, Homo sapiens
gcaggtcattaggctaggt

SEQ ID NO: 7521701 - DNA, 22 bp, Homo sapiens
gcaggtagtgatcgagggtgac

SEQ ID NO: 7521702 - DNA, 22 bp, Homo sapiens
gcaggtgaatgatggactagga

SEQ ID NO: 7521703 - DNA, 22 bp, Homo sapiens
gcaggtgaatgatggactagga

SEQ ID NO: 7521704 - DNA, 22 bp, Homo sapiens
gcaggtgaatgatggactagga

SEQ ID NO: 7521705 - DNA, 22 bp, Homo sapiens
gcaggtgaatgatggactagga

SEQ ID NO: 7521706 - DNA, 22 bp, Homo sapiens
gcaggtgaatgatggactagga

SEQ ID NO: 7521707 - DNA, 22 bp, Homo sapiens
gcaggtgaatgatggactagga

SEQ ID NO: 7521708 - DNA, 22 bp, Homo sapiens
gcaggtgaatgatggactagga

SEQ ID NO: 7521709 - DNA, 22 bp, Homo sapiens
gcaggtgatgtgatgtgagcat

SEQ ID NO: 7521710 - DNA, 19 bp, Homo sapiens
gcaggtgagccgtggctcc

SEQ ID NO: 7521711 - DNA, 22 bp, Homo sapiens
gcaggtgatgtgatgtgagcat

SEQ ID NO: 7521712 - DNA, 22 bp, Homo sapiens
gcaggtgatgtgatgtgagcat

SEQ ID NO: 7521713 - DNA, 22 bp, Homo sapiens
gcaggtctggcatagagcctgc

SEQ ID NO: 7521714 - DNA, 22 bp, Homo sapiens
gcaggtgaaagtgagtagtgag

SEQ ID NO: 7521715 - DNA, 22 bp, Homo sapiens
gcaggtgaaagtgagtagtgag

SEQ ID NO: 7521716 - DNA, 22 bp, Homo sapiens
gcaggtgaaagtgagtagtgag

SEQ ID NO: 7521717 - DNA, 22 bp, Homo sapiens
gcaggtgaaagtgagtagtgag

SEQ ID NO: 7521718 - DNA, 22 bp, Homo sapiens
gcaggtctgttgattacagtca

SEQ ID NO: 7521719 - DNA, 22 bp, Homo sapiens
gcaggtcttgaaggtgtgattt

SEQ ID NO: 7521720 - DNA, 22 bp, Homo sapiens
gcaggtctcaatctgagcaggc

SEQ ID NO: 7521721 - DNA, 22 bp, Homo sapiens
gcaggtctcaatctgagcaggc

SEQ ID NO: 7521722 - DNA, 22 bp, Homo sapiens
gcaggtctcaatctgagcaggc

SEQ ID NO: 7521723 - DNA, 22 bp, Homo sapiens
gcaggtctggagggcactgggg

SEQ ID NO: 7521724 - DNA, 22 bp, Homo sapiens
gcagggcagggcaagaactggg

SEQ ID NO: 7521725 - DNA, 22 bp, Homo sapiens
gcagggcagggcaagaactggg

SEQ ID NO: 7521726 - DNA, 22 bp, Homo sapiens
gcagggcagggcaagaactggg

SEQ ID NO: 7521727 - DNA, 22 bp, Homo sapiens
gcagggcagggcaagaactggg

SEQ ID NO: 7521728 - DNA, 22 bp, Homo sapiens
gcagggcagggcaagaactggg

SEQ ID NO: 7521729 - DNA, 22 bp, Homo sapiens
gcagggcagtaagagctagagt

SEQ ID NO: 7521730 - DNA, 22 bp, Homo sapiens
gcagggcagtaagagctagagt

SEQ ID NO: 7521731 - DNA, 22 bp, Homo sapiens
gcagggcagtaagagctagagt

SEQ ID NO: 7521732 - DNA, 22 bp, Homo sapiens
gcagggcagtaagagctagagt

SEQ ID NO: 7521733 - DNA, 22 bp, Homo sapiens
gcagggcagtaagagctagagt

SEQ ID NO: 7521734 - DNA, 22 bp, Homo sapiens
gcagggcagggcaagaactggg

SEQ ID NO: 7521735 - DNA, 22 bp, Homo sapiens
gcagggcagggcaagaactggg

SEQ ID NO: 7521736 - DNA, 22 bp, Homo sapiens
gcagggcaggatttgaacccag

SEQ ID NO: 7521737 - DNA, 22 bp, Homo sapiens
gcagggcagcttagtccctgtc

SEQ ID NO: 7521738 - DNA, 22 bp, Homo sapiens
gcagggcaggatttgaacccag

SEQ ID NO: 7521739 - DNA, 22 bp, Homo sapiens
gcagggcaggatttgaacccag

SEQ ID NO: 7521740 - DNA, 22 bp, Homo sapiens
gcagggcaggatttgaacccag

SEQ ID NO: 7521741 - DNA, 22 bp, Homo sapiens
gcagggcatgggccctgtctgc

SEQ ID NO: 7521742 - DNA, 22 bp, Homo sapiens
gcagggcatgggccctgtctgc

SEQ ID NO: 7521743 - DNA, 22 bp, Homo sapiens
gcagggcatgggccctgtctgc

SEQ ID NO: 7521744 - DNA, 22 bp, Homo sapiens
gcagggcatgggccctgtctgc

SEQ ID NO: 7521745 - DNA, 22 bp, Homo sapiens
gcagggcagtaagagctagagt

SEQ ID NO: 7521746 - DNA, 22 bp, Homo sapiens
gcagggcatgggccctgtctgc

SEQ ID NO: 7521747 - DNA, 22 bp, Homo sapiens
gcagggcatgggccctgtctgc

SEQ ID NO: 7521748 - DNA, 22 bp, Homo sapiens
gcagggcatgggccctgtctgc

SEQ ID NO: 7521749 - DNA, 22 bp, Homo sapiens
gcagggcatgggccctgtctgc

SEQ ID NO: 7521750 - DNA, 22 bp, Homo sapiens
gcagggccagggctcaggctgt

SEQ ID NO: 7521751 - DNA, 22 bp, Homo sapiens
gcagggccagggctcaggctgt

SEQ ID NO: 7521752 - DNA, 22 bp, Homo sapiens
gcagggccagggctcaggctgt

SEQ ID NO: 7521753 - DNA, 22 bp, Homo sapiens
gcagggccagggctcaggctgt

SEQ ID NO: 7521754 - DNA, 22 bp, Homo sapiens
gcagggccagggctcaggctgt

SEQ ID NO: 7521755 - DNA, 22 bp, Homo sapiens
gcagggccagggctcaggctgt

SEQ ID NO: 7521756 - DNA, 22 bp, Homo sapiens
gcagggccagtgcagagaggaa

SEQ ID NO: 7521757 - DNA, 22 bp, Homo sapiens
gcagggccaggtacaagaagca

SEQ ID NO: 7521758 - DNA, 22 bp, Homo sapiens
gcagggccaggtacaagaagca

SEQ ID NO: 7521759 - DNA, 22 bp, Homo sapiens
gcagggccaggtacaagaagca

SEQ ID NO: 7521760 - DNA, 22 bp, Homo sapiens
gcagggccaggtacaagaagca

SEQ ID NO: 7521761 - DNA, 22 bp, Homo sapiens
gcagggccaggtacaagaagca

SEQ ID NO: 7521762 - DNA, 22 bp, Homo sapiens
gcagggccagtgcagagaggaa

SEQ ID NO: 7521763 - DNA, 22 bp, Homo sapiens
gcagggccagtgcagagaggaa

SEQ ID NO: 7521764 - DNA, 22 bp, Homo sapiens
gcagggccagtgcagagaggaa

SEQ ID NO: 7521765 - DNA, 22 bp, Homo sapiens
gcagggccagtgcagagaggaa

SEQ ID NO: 7521766 - DNA, 22 bp, Homo sapiens
gcagggccagtgcagagaggaa

SEQ ID NO: 7521767 - DNA, 22 bp, Homo sapiens
gcagggccagtgcagagaggaa

SEQ ID NO: 7521768 - DNA, 22 bp, Homo sapiens
gcagggccagtgcagagaggaa

SEQ ID NO: 7521769 - DNA, 22 bp, Homo sapiens
gcagggccagtgcagagaggaa

SEQ ID NO: 7521770 - DNA, 22 bp, Homo sapiens
gcagggtgtgtctcatacagtt

SEQ ID NO: 7521771 - DNA, 19 bp, Homo sapiens
gcagggtggcagagctctt

SEQ ID NO: 7521772 - DNA, 19 bp, Homo sapiens
gcagggtggcagagctctt

SEQ ID NO: 7521773 - DNA, 22 bp, Homo sapiens
gcagggccttagcagcggctgc

SEQ ID NO: 7521774 - DNA, 22 bp, Homo sapiens
gcagggccttagcagcggctgc

SEQ ID NO: 7521775 - DNA, 22 bp, Homo sapiens
gcagggccttagcagcggctgc

SEQ ID NO: 7521776 - DNA, 22 bp, Homo sapiens
gcagggtgtgtctcatacagtt

SEQ ID NO: 7521777 - DNA, 22 bp, Homo sapiens
gcagggtgtgtctcatacagtt

SEQ ID NO: 7521778 - DNA, 22 bp, Homo sapiens
gcagggtgtgtctcatacagtt

SEQ ID NO: 7521779 - DNA, 22 bp, Homo sapiens
gcagggtgtgtctcatacagtt

SEQ ID NO: 7521780 - DNA, 19 bp, Homo sapiens
gcagggtgttgactgtccc

SEQ ID NO: 7521781 - DNA, 19 bp, Homo sapiens
gcagggtgttgactgtccc

SEQ ID NO: 7521782 - DNA, 19 bp, Homo sapiens
gcagggtgttgactgtccc

SEQ ID NO: 7521783 - DNA, 22 bp, Homo sapiens
gcagggcagctgaagctaggtg

SEQ ID NO: 7521784 - DNA, 22 bp, Homo sapiens
gcagggcagctgaagctaggtg

SEQ ID NO: 7521785 - DNA, 22 bp, Homo sapiens
gcagggcagcttagtccctgtc

SEQ ID NO: 7521786 - DNA, 22 bp, Homo sapiens
gcagggcagcttagtccctgtc

SEQ ID NO: 7521787 - DNA, 22 bp, Homo sapiens
gcagggcagctgaagctaggtg

SEQ ID NO: 7521788 - DNA, 22 bp, Homo sapiens
gcagggcagcttagtccctgtc

SEQ ID NO: 7521789 - DNA, 22 bp, Homo sapiens
gcagggcagcttagtccctgtc

SEQ ID NO: 7521790 - DNA, 22 bp, Homo sapiens
gcagggcagcttagtccctgtc

SEQ ID NO: 7521791 - DNA, 22 bp, Homo sapiens
gcagggcagcttagtccctgtc

SEQ ID NO: 7521792 - DNA, 22 bp, Homo sapiens
gcagggcagcttagtccctgtc

SEQ ID NO: 7521793 - DNA, 22 bp, Homo sapiens
gcagggcagcttagtccctgtc

SEQ ID NO: 7521794 - DNA, 22 bp, Homo sapiens
gcagggcagcttagtccctgtc

SEQ ID NO: 7521795 - DNA, 22 bp, Homo sapiens
gcagggcagctcactgtggttc

SEQ ID NO: 7521796 - DNA, 22 bp, Homo sapiens
gcagggcagctcactgtggttc

SEQ ID NO: 7521797 - DNA, 22 bp, Homo sapiens
gcagggcagctcactgtggttc

SEQ ID NO: 7521798 - DNA, 22 bp, Homo sapiens
gcagggcagctcactgtggttc

SEQ ID NO: 7521799 - DNA, 22 bp, Homo sapiens
gcagggcagctgaagctaggtg

SEQ ID NO: 7521800 - DNA, 22 bp, Homo sapiens
gcagggcagctgaagctaggtg

SEQ ID NO: 7521801 - DNA, 22 bp, Homo sapiens
gcagggcagctgaagctaggtg

SEQ ID NO: 7521802 - DNA, 22 bp, Homo sapiens
gcagggcagctgaagctaggtg

SEQ ID NO: 7521803 - DNA, 22 bp, Homo sapiens
gcagggcagctcactgtggttc

SEQ ID NO: 7521804 - DNA, 22 bp, Homo sapiens
gcagggcagctcactgtggttc

SEQ ID NO: 7521805 - DNA, 22 bp, Homo sapiens
gcagggcagctcactgtggttc

SEQ ID NO: 7521806 - DNA, 22 bp, Homo sapiens
gcagggcagctcactgtggttc

SEQ ID NO: 7521807 - DNA, 22 bp, Homo sapiens
gcagggcagctcactgtggttc

SEQ ID NO: 7521808 - DNA, 22 bp, Homo sapiens
gcagggcagccacaggccccct

SEQ ID NO: 7521809 - DNA, 22 bp, Homo sapiens
gcagggcagccacaggccccct

SEQ ID NO: 7521810 - DNA, 20 bp, Homo sapiens
gcaggccctctctctagtct

SEQ ID NO: 7521811 - DNA, 20 bp, Homo sapiens
gcaggccctctctctagtct

SEQ ID NO: 7521812 - DNA, 18 bp, Homo sapiens
gcaggccctgtttctggg

SEQ ID NO: 7521813 - DNA, 20 bp, Homo sapiens
gcaggccctctctctagtct

SEQ ID NO: 7521814 - DNA, 22 bp, Homo sapiens
gcaggcccttagccttggtggg

SEQ ID NO: 7521815 - DNA, 22 bp, Homo sapiens
gcaggcccttagccttggtggg

SEQ ID NO: 7521816 - DNA, 22 bp, Homo sapiens
gcaggcccttagccttggtggg

SEQ ID NO: 7521817 - DNA, 18 bp, Homo sapiens
gcaggccctgtttctggg

SEQ ID NO: 7521818 - DNA, 18 bp, Homo sapiens
gcaggccctgtttctggg

SEQ ID NO: 7521819 - DNA, 20 bp, Homo sapiens
gcaggccctctctctagtct

SEQ ID NO: 7521820 - DNA, 18 bp, Homo sapiens
gcaggccctgtttctggg

SEQ ID NO: 7521821 - DNA, 19 bp, Homo sapiens
gcaggcccagtcgggctgg

SEQ ID NO: 7521822 - DNA, 19 bp, Homo sapiens
gcaggcccagtcgggctgg

SEQ ID NO: 7521823 - DNA, 19 bp, Homo sapiens
gcaggcccagtcgggctgg

SEQ ID NO: 7521824 - DNA, 19 bp, Homo sapiens
gcaggcccagtcgggctgg

SEQ ID NO: 7521825 - DNA, 19 bp, Homo sapiens
gcaggcccagtcgggctgg

SEQ ID NO: 7521826 - DNA, 22 bp, Homo sapiens
gcaggccctcctctagcaaggc

SEQ ID NO: 7521827 - DNA, 19 bp, Homo sapiens
gcaggcccagtcgggctgg

SEQ ID NO: 7521828 - DNA, 22 bp, Homo sapiens
gcaggccctcctctagcaaggc

SEQ ID NO: 7521829 - DNA, 22 bp, Homo sapiens
gcaggccctcctctagcaaggc

SEQ ID NO: 7521830 - DNA, 20 bp, Homo sapiens
gcaggccctctctctagtct

SEQ ID NO: 7521831 - DNA, 22 bp, Homo sapiens
gcaggccctcctctagcaaggc

SEQ ID NO: 7521832 - DNA, 20 bp, Homo sapiens
gcaggccctctctctagtct

SEQ ID NO: 7521833 - DNA, 22 bp, Homo sapiens
gcaggcctctaattcaccgcag

SEQ ID NO: 7521834 - DNA, 22 bp, Homo sapiens
gcaggcctcccctgctggagct

SEQ ID NO: 7521835 - DNA, 22 bp, Homo sapiens
gcaggcctcccctgctggagct

SEQ ID NO: 7521836 - DNA, 22 bp, Homo sapiens
gcaggcctcccctgctggagct

SEQ ID NO: 7521837 - DNA, 22 bp, Homo sapiens
gcaggcctcccctgctggagct

SEQ ID NO: 7521838 - DNA, 22 bp, Homo sapiens
gcaggcctcccctgctggagct

SEQ ID NO: 7521839 - DNA, 18 bp, Homo sapiens
gcaggcctagaacttggt

SEQ ID NO: 7521840 - DNA, 18 bp, Homo sapiens
gcaggcctagaacttggt

SEQ ID NO: 7521841 - DNA, 22 bp, Homo sapiens
gcaggcctaagagaaggcattg

SEQ ID NO: 7521842 - DNA, 22 bp, Homo sapiens
gcaggcctaagagaaggcattg

SEQ ID NO: 7521843 - DNA, 22 bp, Homo sapiens
gcaggcctaagagaaggcattg

SEQ ID NO: 7521844 - DNA, 22 bp, Homo sapiens
gcaggcccttagccttggtggg

SEQ ID NO: 7521845 - DNA, 22 bp, Homo sapiens
gcaggcccttagccttggtggg

SEQ ID NO: 7521846 - DNA, 22 bp, Homo sapiens
gcaggcccttagccttggtggg

SEQ ID NO: 7521847 - DNA, 22 bp, Homo sapiens
gcaggcctaagagaaggcattg

SEQ ID NO: 7521848 - DNA, 22 bp, Homo sapiens
gcaggcctaagagaaggcattg

SEQ ID NO: 7521849 - DNA, 22 bp, Homo sapiens
gcaggcccttagccttggtggg

SEQ ID NO: 7521850 - DNA, 22 bp, Homo sapiens
gcaggcccttagccttggtggg

SEQ ID NO: 7521851 - DNA, 22 bp, Homo sapiens
gcagctgtcagaagttggaatc

SEQ ID NO: 7521852 - DNA, 22 bp, Homo sapiens
gcaggcagtttgcttttccctc

SEQ ID NO: 7521853 - DNA, 22 bp, Homo sapiens
gcaggcagtttgcttttccctc

SEQ ID NO: 7521854 - DNA, 22 bp, Homo sapiens
gcaggcagtttgcttttccctc

SEQ ID NO: 7521855 - DNA, 22 bp, Homo sapiens
gcaggcatggtcgctgccaggt

SEQ ID NO: 7521856 - DNA, 22 bp, Homo sapiens
gcaggcatctctgtagccaggg

SEQ ID NO: 7521857 - DNA, 22 bp, Homo sapiens
gcaggcatctctgtagccaggg

SEQ ID NO: 7521858 - DNA, 22 bp, Homo sapiens
gcaggcatggtcgctgccaggt

SEQ ID NO: 7521859 - DNA, 22 bp, Homo sapiens
gcaggcatggtcgctgccaggt

SEQ ID NO: 7521860 - DNA, 21 bp, Homo sapiens
gcaggcatgtctactgcatgt

SEQ ID NO: 7521861 - DNA, 22 bp, Homo sapiens
gcaggcatggtcgctgccaggt

SEQ ID NO: 7521862 - DNA, 22 bp, Homo sapiens
gcaggccaagccctcgcagaga

SEQ ID NO: 7521863 - DNA, 22 bp, Homo sapiens
gcaggccaagccctcgcagaga

SEQ ID NO: 7521864 - DNA, 22 bp, Homo sapiens
gcaggccaagccctcgcagaga

SEQ ID NO: 7521865 - DNA, 22 bp, Homo sapiens
gcaggccaagccctcgcagaga

SEQ ID NO: 7521866 - DNA, 22 bp, Homo sapiens
gcaggccacagtggagtctctg

SEQ ID NO: 7521867 - DNA, 22 bp, Homo sapiens
gcaggccaagccctcgcagaga

SEQ ID NO: 7521868 - DNA, 22 bp, Homo sapiens
gcaggccaagccctcgcagaga

SEQ ID NO: 7521869 - DNA, 22 bp, Homo sapiens
gcaggccaagccctcgcagaga

SEQ ID NO: 7521870 - DNA, 22 bp, Homo sapiens
gcagctgtcagaagttggaatc

SEQ ID NO: 7521871 - DNA, 22 bp, Homo sapiens
gcagctgtatcacttttaaaca

SEQ ID NO: 7521872 - DNA, 22 bp, Homo sapiens
gcagctgtcactttcacaatgc

SEQ ID NO: 7521873 - DNA, 22 bp, Homo sapiens
gcagctgtcactttcacaatgc

SEQ ID NO: 7521874 - DNA, 22 bp, Homo sapiens
gcagctgtcactttcacaatgc

SEQ ID NO: 7521875 - DNA, 22 bp, Homo sapiens
gcagctgtatcacttttaaaca

SEQ ID NO: 7521876 - DNA, 22 bp, Homo sapiens
gcagctgtagaggggagaaaga

SEQ ID NO: 7521877 - DNA, 22 bp, Homo sapiens
gcagctgtactggcagcattgt

SEQ ID NO: 7521878 - DNA, 22 bp, Homo sapiens
gcagctgtaaagcagaaatagt

SEQ ID NO: 7521879 - DNA, 22 bp, Homo sapiens
gcagctgtaaagcagaaatagt

SEQ ID NO: 7521880 - DNA, 22 bp, Homo sapiens
gcagctgtaaagcagaaatagt

SEQ ID NO: 7521881 - DNA, 22 bp, Homo sapiens
gcagctgtactggcagcattgt

SEQ ID NO: 7521882 - DNA, 22 bp, Homo sapiens
gcaggcccagagtcgctggcct

SEQ ID NO: 7521883 - DNA, 22 bp, Homo sapiens
gcaggcccagagtcgctggcct

SEQ ID NO: 7521884 - DNA, 22 bp, Homo sapiens
gcaggcccagagtcgctggcct

SEQ ID NO: 7521885 - DNA, 22 bp, Homo sapiens
gcaggcccagagtcgctggcct

SEQ ID NO: 7521886 - DNA, 22 bp, Homo sapiens
gcaggcccagagtcgctggcct

SEQ ID NO: 7521887 - DNA, 22 bp, Homo sapiens
gcaggcccagagtcgctggcct

SEQ ID NO: 7521888 - DNA, 22 bp, Homo sapiens
gcaggccattcaggagatgtgc

SEQ ID NO: 7521889 - DNA, 22 bp, Homo sapiens
gcaggccattcaggagatgtgc

SEQ ID NO: 7521890 - DNA, 22 bp, Homo sapiens
gcaggccattcaggagatgtgc

SEQ ID NO: 7521891 - DNA, 22 bp, Homo sapiens
gcaggccaggctaggggctgtc

SEQ ID NO: 7521892 - DNA, 22 bp, Homo sapiens
gcaggccaggctaggggctgtc

SEQ ID NO: 7521893 - DNA, 22 bp, Homo sapiens
gcaggccaggctaggggctgtc

SEQ ID NO: 7521894 - DNA, 22 bp, Homo sapiens
gcaggccaggctaggggctgtc

SEQ ID NO: 7521895 - DNA, 19 bp, Homo sapiens
gcaggccaggaggcggagg

SEQ ID NO: 7521896 - DNA, 19 bp, Homo sapiens
gcaggccaggaggcggagg

SEQ ID NO: 7521897 - DNA, 19 bp, Homo sapiens
gcaggccaggaggcggagg

SEQ ID NO: 7521898 - DNA, 19 bp, Homo sapiens
gcaggccaggaggcggagg

SEQ ID NO: 7521899 - DNA, 22 bp, Homo sapiens
gcaggccacagtggagtctctg

SEQ ID NO: 7521900 - DNA, 22 bp, Homo sapiens
gcaggccacagtggagtctctg

SEQ ID NO: 7521901 - DNA, 22 bp, Homo sapiens
gcaggccacagtggagtctctg

SEQ ID NO: 7521902 - DNA, 22 bp, Homo sapiens
gcaggccacagtggagtctctg

SEQ ID NO: 7521903 - DNA, 22 bp, Homo sapiens
gcaggccacagtggagtctctg

SEQ ID NO: 7521904 - DNA, 22 bp, Homo sapiens
gcaggccactgtctcctctggg

SEQ ID NO: 7521905 - DNA, 22 bp, Homo sapiens
gcaggccactgtctcctctggg

SEQ ID NO: 7521906 - DNA, 22 bp, Homo sapiens
gcaggccactgtctcctctggg

SEQ ID NO: 7521907 - DNA, 22 bp, Homo sapiens
gcaggccacagtggagtctctg

SEQ ID NO: 7521908 - DNA, 22 bp, Homo sapiens
gcaggccacagtggagtctctg

SEQ ID NO: 7521909 - DNA, 22 bp, Homo sapiens
gcaggccagctgtgcagatggg

SEQ ID NO: 7521910 - DNA, 22 bp, Homo sapiens
gcaggccagctgtgcagatggg

SEQ ID NO: 7521911 - DNA, 22 bp, Homo sapiens
gcaggccactgtctcctctggg

SEQ ID NO: 7521912 - DNA, 22 bp, Homo sapiens
gcaggccagctgtgcagatggg

SEQ ID NO: 7521913 - DNA, 22 bp, Homo sapiens
gcaggccactgtctcctctggg

SEQ ID NO: 7521914 - DNA, 22 bp, Homo sapiens
gcaggccagctgtgcagatggg

SEQ ID NO: 7521915 - DNA, 22 bp, Homo sapiens
gcaggccagctgtgcagatggg

SEQ ID NO: 7521916 - DNA, 22 bp, Homo sapiens
gcaggccagctgtgcagatggg

SEQ ID NO: 7521917 - DNA, 22 bp, Homo sapiens
ctgggggtcttgaaagggagag

SEQ ID NO: 7521918 - DNA, 22 bp, Homo sapiens
ctgggggtcttgaaagggagag

SEQ ID NO: 7521919 - DNA, 22 bp, Homo sapiens
ctgggggtgagcagcagcgacg

SEQ ID NO: 7521920 - DNA, 22 bp, Homo sapiens
ctgggggtgagcagcagcgacg

SEQ ID NO: 7521921 - DNA, 22 bp, Homo sapiens
ctgggggtcgcgcctctgggca

SEQ ID NO: 7521922 - DNA, 22 bp, Homo sapiens
ctgggggtcgcgcctctgggca

SEQ ID NO: 7521923 - DNA, 22 bp, Homo sapiens
ctgggggtcgcgcctctgggca

SEQ ID NO: 7521924 - DNA, 22 bp, Homo sapiens
ctgggggtcgcgcctctgggca

SEQ ID NO: 7521925 - DNA, 22 bp, Homo sapiens
ctgggggtcgcgcctctgggca

SEQ ID NO: 7521926 - DNA, 22 bp, Homo sapiens
ctgggggtcgcgcctctgggca

SEQ ID NO: 7521927 - DNA, 22 bp, Homo sapiens
ctggggggctactgacagagga

SEQ ID NO: 7521928 - DNA, 22 bp, Homo sapiens
ctggggggctactgacagagga

SEQ ID NO: 7521929 - DNA, 22 bp, Homo sapiens
ctggggggctactgacagagga

SEQ ID NO: 7521930 - DNA, 22 bp, Homo sapiens
ctggggggctactgacagagga

SEQ ID NO: 7521931 - DNA, 22 bp, Homo sapiens
ctggggggctactgacagagga

SEQ ID NO: 7521932 - DNA, 22 bp, Homo sapiens
ctggggggctactgacagagga

SEQ ID NO: 7521933 - DNA, 22 bp, Homo sapiens
ctggggggctactgacagagga

SEQ ID NO: 7521934 - DNA, 22 bp, Homo sapiens
ctggggggctactgacagagga

SEQ ID NO: 7521935 - DNA, 22 bp, Homo sapiens
ctggggggctactgacagagga

SEQ ID NO: 7521936 - DNA, 22 bp, Homo sapiens
ctggggggctactgacagagga

SEQ ID NO: 7521937 - DNA, 22 bp, Homo sapiens
ctgggggtgagcagcagcgacg

SEQ ID NO: 7521938 - DNA, 19 bp, Homo sapiens
ctgggggtgctcacgctct

SEQ ID NO: 7521939 - DNA, 22 bp, Homo sapiens
ctgggggtgagcagcagcgacg

SEQ ID NO: 7521940 - DNA, 19 bp, Homo sapiens
ctgggggtgctcacgctct

SEQ ID NO: 7521941 - DNA, 22 bp, Homo sapiens
ctggggtaggaggcagctgtgc

SEQ ID NO: 7521942 - DNA, 22 bp, Homo sapiens
ctggggtatctgccacaactct

SEQ ID NO: 7521943 - DNA, 22 bp, Homo sapiens
ctggggtcagggatcagagagc

SEQ ID NO: 7521944 - DNA, 22 bp, Homo sapiens
ctggggtcagggatcagagagc

SEQ ID NO: 7521945 - DNA, 22 bp, Homo sapiens
ctggggtccttgccatgtgtca

SEQ ID NO: 7521946 - DNA, 22 bp, Homo sapiens
ctggggtctcaattctagcggg

SEQ ID NO: 7521947 - DNA, 22 bp, Homo sapiens
ctggggtctcaattctagcggg

SEQ ID NO: 7521948 - DNA, 22 bp, Homo sapiens
ctggggtctcaattctagcggg

SEQ ID NO: 7521949 - DNA, 22 bp, Homo sapiens
ctggggtgaaggattacctgag

SEQ ID NO: 7521950 - DNA, 22 bp, Homo sapiens
ctggggtgaaggattacctgag

SEQ ID NO: 7521951 - DNA, 22 bp, Homo sapiens
ctggggtgaaggattacctgag

SEQ ID NO: 7521952 - DNA, 22 bp, Homo sapiens
ctggggtgaaggattacctgag

SEQ ID NO: 7521953 - DNA, 22 bp, Homo sapiens
ctggggtgagcagaaacagggg

SEQ ID NO: 7521954 - DNA, 22 bp, Homo sapiens
ctggggtgagcagaaacagggg

SEQ ID NO: 7521955 - DNA, 22 bp, Homo sapiens
ctggggtgtctcgtctgccatt

SEQ ID NO: 7521956 - DNA, 22 bp, Homo sapiens
ctggggtgtctcgtctgccatt

SEQ ID NO: 7521957 - DNA, 22 bp, Homo sapiens
ctggggtgtctcgtctgccatt

SEQ ID NO: 7521958 - DNA, 22 bp, Homo sapiens
ctggggtggtgcaggcctcatg

SEQ ID NO: 7521959 - DNA, 22 bp, Homo sapiens
ctggggtggtgcaggcctcatg

SEQ ID NO: 7521960 - DNA, 22 bp, Homo sapiens
ctggggtggtgcaggcctcatg

SEQ ID NO: 7521961 - DNA, 22 bp, Homo sapiens
ctggggtggtgcaggcctcatg

SEQ ID NO: 7521962 - DNA, 22 bp, Homo sapiens
ctggggtggtgcaggcctcatg

SEQ ID NO: 7521963 - DNA, 22 bp, Homo sapiens
ctggggtggtgcaggcctcatg

SEQ ID NO: 7521964 - DNA, 22 bp, Homo sapiens
ctgggtgcttactttgtgctag

SEQ ID NO: 7521965 - DNA, 22 bp, Homo sapiens
ctggggtgtgctcagagcaggg

SEQ ID NO: 7521966 - DNA, 22 bp, Homo sapiens
ctgggtggaaagtgctgagaat

SEQ ID NO: 7521967 - DNA, 22 bp, Homo sapiens
ctgggtggaaagtgctgagaat

SEQ ID NO: 7521968 - DNA, 22 bp, Homo sapiens
ctgggtggaaagtgctgagaat

SEQ ID NO: 7521969 - DNA, 22 bp, Homo sapiens
ctggggtgtctcgtctgccatt

SEQ ID NO: 7521970 - DNA, 22 bp, Homo sapiens
ctggggtgtctcgtctgccatt

SEQ ID NO: 7521971 - DNA, 22 bp, Homo sapiens
ctggggtgtctcgtctgccatt

SEQ ID NO: 7521972 - DNA, 22 bp, Homo sapiens
ctggggtgtctcgtctgccatt

SEQ ID NO: 7521973 - DNA, 22 bp, Homo sapiens
ctggggtgtctcgtctgccatt

SEQ ID NO: 7521974 - DNA, 22 bp, Homo sapiens
ctggggtggatgggtccaagtt

SEQ ID NO: 7521975 - DNA, 22 bp, Homo sapiens
ctggggtggatgggtccaagtt

SEQ ID NO: 7521976 - DNA, 22 bp, Homo sapiens
ctggggtggatgggtccaagtt

SEQ ID NO: 7521977 - DNA, 22 bp, Homo sapiens
ctggggtggatgggtccaagtt

SEQ ID NO: 7521978 - DNA, 22 bp, Homo sapiens
ctggggtggaggagctcccctg

SEQ ID NO: 7521979 - DNA, 22 bp, Homo sapiens
ctggggtggatgggtccaagtt

SEQ ID NO: 7521980 - DNA, 22 bp, Homo sapiens
ctggggtggtgcaggcctcatg

SEQ ID NO: 7521981 - DNA, 22 bp, Homo sapiens
ctggggtggatgggtccaagtt

SEQ ID NO: 7521982 - DNA, 22 bp, Homo sapiens
ctggggtggatgggtccaagtt

SEQ ID NO: 7521983 - DNA, 22 bp, Homo sapiens
ctggggtggaggagctcccctg

SEQ ID NO: 7521984 - DNA, 22 bp, Homo sapiens
ctggggtggaggagctcccctg

SEQ ID NO: 7521985 - DNA, 22 bp, Homo sapiens
ctggggtggagattggcaatct

SEQ ID NO: 7521986 - DNA, 22 bp, Homo sapiens
ctggggtggagattggcaatct

SEQ ID NO: 7521987 - DNA, 22 bp, Homo sapiens
ctggggtggagattggcaatct

SEQ ID NO: 7521988 - DNA, 22 bp, Homo sapiens
ctggggtgagcagaaacagggg

SEQ ID NO: 7521989 - DNA, 22 bp, Homo sapiens
ctggggtggagattggcaatct

SEQ ID NO: 7521990 - DNA, 18 bp, Homo sapiens
ctgggctcgagagatcct

SEQ ID NO: 7521991 - DNA, 18 bp, Homo sapiens
ctgggctcgagagatcct

SEQ ID NO: 7521992 - DNA, 22 bp, Homo sapiens
ctgggctcctaaccatccaggt

SEQ ID NO: 7521993 - DNA, 22 bp, Homo sapiens
ctgggctcctaaccatccaggt

SEQ ID NO: 7521994 - DNA, 22 bp, Homo sapiens
ctgggctcctaaccatccaggt

SEQ ID NO: 7521995 - DNA, 22 bp, Homo sapiens
ctgggctccctcatgtgtctgc

SEQ ID NO: 7521996 - DNA, 22 bp, Homo sapiens
ctgggctccactcccacagtgt

SEQ ID NO: 7521997 - DNA, 22 bp, Homo sapiens
ctgggctccctcatgtgtctgc

SEQ ID NO: 7521998 - DNA, 22 bp, Homo sapiens
ctgggctccctcatgtgtctgc

SEQ ID NO: 7521999 - DNA, 22 bp, Homo sapiens
ctgggctccctcatgtgtctgc

SEQ ID NO: 7522000 - DNA, 22 bp, Homo sapiens
ctgggctcctaaccatccaggt

SEQ ID NO: 7522001 - DNA, 22 bp, Homo sapiens
ctgggctcctaaccatccaggt

SEQ ID NO: 7522002 - DNA, 22 bp, Homo sapiens
ctgggctcctaaccatccaggt

SEQ ID NO: 7522003 - DNA, 22 bp, Homo sapiens
ctgggctcctaaccatccaggt

SEQ ID NO: 7522004 - DNA, 22 bp, Homo sapiens
ctgggctcctaaccatccaggt

SEQ ID NO: 7522005 - DNA, 22 bp, Homo sapiens
ctgggctcctaaccatccaggt

SEQ ID NO: 7522006 - DNA, 20 bp, Homo sapiens
ctgggctcggtggccctggc

SEQ ID NO: 7522007 - DNA, 20 bp, Homo sapiens
ctgggctcggtggccctggc

SEQ ID NO: 7522008 - DNA, 20 bp, Homo sapiens
ctgggctcggtggccctggc

SEQ ID NO: 7522009 - DNA, 20 bp, Homo sapiens
ctgggctcggtggccctggc

SEQ ID NO: 7522010 - DNA, 20 bp, Homo sapiens
ctgggctcggtggccctggc

SEQ ID NO: 7522011 - DNA, 20 bp, Homo sapiens
ctgggctcggtggccctggc

SEQ ID NO: 7522012 - DNA, 20 bp, Homo sapiens
ctgggctcggtggccctggc

SEQ ID NO: 7522013 - DNA, 18 bp, Homo sapiens
ctgggctcgagagatcct

SEQ ID NO: 7522014 - DNA, 18 bp, Homo sapiens
ctgggctcgagagatcct

SEQ ID NO: 7522015 - DNA, 18 bp, Homo sapiens
ctgggctcgagagatcct

SEQ ID NO: 7522016 - DNA, 18 bp, Homo sapiens
ctgggctcgagagatcct

SEQ ID NO: 7522017 - DNA, 22 bp, Homo sapiens
ctgggctctaagggagcaccgt

SEQ ID NO: 7522018 - DNA, 20 bp, Homo sapiens
ctgggctcggtggccctggc

SEQ ID NO: 7522019 - DNA, 22 bp, Homo sapiens
ctgggctctaagggagcaccgt

SEQ ID NO: 7522020 - DNA, 22 bp, Homo sapiens
ctgggctctaagggagcaccgt

SEQ ID NO: 7522021 - DNA, 22 bp, Homo sapiens
ctgggctctaagggagcaccgt

SEQ ID NO: 7522022 - DNA, 22 bp, Homo sapiens
ctgggctctaagggagcaccgt

SEQ ID NO: 7522023 - DNA, 22 bp, Homo sapiens
ctgggggcagcaagaagccatg

SEQ ID NO: 7522024 - DNA, 22 bp, Homo sapiens
ctgggggcagcaagaagccatg

SEQ ID NO: 7522025 - DNA, 22 bp, Homo sapiens
ctgggggcagcaagaagccatg

SEQ ID NO: 7522026 - DNA, 22 bp, Homo sapiens
ctgggggcagcaagaagccatg

SEQ ID NO: 7522027 - DNA, 22 bp, Homo sapiens
ctgggggcagcaagaagccatg

SEQ ID NO: 7522028 - DNA, 22 bp, Homo sapiens
ctgggggcagcaagaagccatg

SEQ ID NO: 7522029 - DNA, 22 bp, Homo sapiens
ctgggggcagcaagaagccatg

SEQ ID NO: 7522030 - DNA, 22 bp, Homo sapiens
ctgggggccttacggaactcca

SEQ ID NO: 7522031 - DNA, 22 bp, Homo sapiens
ctgggggccttacggaactcca

SEQ ID NO: 7522032 - DNA, 22 bp, Homo sapiens
ctgggggccttacggaactcca

SEQ ID NO: 7522033 - DNA, 22 bp, Homo sapiens
ctgggggccttacggaactcca

SEQ ID NO: 7522034 - DNA, 22 bp, Homo sapiens
ctgggggccttacggaactcca

SEQ ID NO: 7522035 - DNA, 22 bp, Homo sapiens
ctggggggagctgcgtccagca

SEQ ID NO: 7522036 - DNA, 22 bp, Homo sapiens
ctggggggagctgcgtccagca

SEQ ID NO: 7522037 - DNA, 22 bp, Homo sapiens
ctggggggagctgcgtccagca

SEQ ID NO: 7522038 - DNA, 22 bp, Homo sapiens
ctggggggagctgcgtccagca

SEQ ID NO: 7522039 - DNA, 22 bp, Homo sapiens
ctggggctggtgaggcaggctc

SEQ ID NO: 7522040 - DNA, 22 bp, Homo sapiens
ctggggctgtaggaggacttat

SEQ ID NO: 7522041 - DNA, 22 bp, Homo sapiens
ctggggctgtaggaggacttat

SEQ ID NO: 7522042 - DNA, 22 bp, Homo sapiens
ctggggctggtgaggcaggctc

SEQ ID NO: 7522043 - DNA, 22 bp, Homo sapiens
ctggggctggtgaggcaggctc

SEQ ID NO: 7522044 - DNA, 22 bp, Homo sapiens
ctgggctctagaaaggaaagaa

SEQ ID NO: 7522045 - DNA, 22 bp, Homo sapiens
ctgggctctaagggagcaccgt

SEQ ID NO: 7522046 - DNA, 22 bp, Homo sapiens
ctgggctctagaaaggaaagaa

SEQ ID NO: 7522047 - DNA, 22 bp, Homo sapiens
ctgggctctagaaaggaaagaa

SEQ ID NO: 7522048 - DNA, 22 bp, Homo sapiens
ctgggctctagaaaggaaagaa

SEQ ID NO: 7522049 - DNA, 22 bp, Homo sapiens
ctgggctctagaaaggaaagaa

SEQ ID NO: 7522050 - DNA, 22 bp, Homo sapiens
ctggggctggtgaggcaggctc

SEQ ID NO: 7522051 - DNA, 22 bp, Homo sapiens
ctggggctggtgaggcaggctc

SEQ ID NO: 7522052 - DNA, 22 bp, Homo sapiens
ctggggctggtgaggcaggctc

SEQ ID NO: 7522053 - DNA, 22 bp, Homo sapiens
ctggtcacctccttcccagcta

SEQ ID NO: 7522054 - DNA, 22 bp, Homo sapiens
ctggtcacctccttcccagcta

SEQ ID NO: 7522055 - DNA, 22 bp, Homo sapiens
ctggtcacctccttcccagcta

SEQ ID NO: 7522056 - DNA, 22 bp, Homo sapiens
ctggtcacctccttcccagcta

SEQ ID NO: 7522057 - DNA, 22 bp, Homo sapiens
ctggtcacctccttcccagcta

SEQ ID NO: 7522058 - DNA, 22 bp, Homo sapiens
ctggtcaataatcatgtagtac

SEQ ID NO: 7522059 - DNA, 22 bp, Homo sapiens
ctggtcaccaggtagcattgta

SEQ ID NO: 7522060 - DNA, 22 bp, Homo sapiens
ctggtcaccaggtagcattgta

SEQ ID NO: 7522061 - DNA, 22 bp, Homo sapiens
ctggtcacatctctactaccca

SEQ ID NO: 7522062 - DNA, 22 bp, Homo sapiens
ctggtcaagagctagcagagct

SEQ ID NO: 7522063 - DNA, 22 bp, Homo sapiens
ctggtcaaggagagtctctgca

SEQ ID NO: 7522064 - DNA, 22 bp, Homo sapiens
ctggtcaataatcatgtagtac

SEQ ID NO: 7522065 - DNA, 22 bp, Homo sapiens
ctggtcaagagctagcagagct

SEQ ID NO: 7522066 - DNA, 22 bp, Homo sapiens
ctggtcaaaaattatgcttact

SEQ ID NO: 7522067 - DNA, 22 bp, Homo sapiens
ctggtcaagagctagcagagct

SEQ ID NO: 7522068 - DNA, 22 bp, Homo sapiens
ctggtcaaaaattatgcttact

SEQ ID NO: 7522069 - DNA, 22 bp, Homo sapiens
ctggtagtttgcaaaatggtgt

SEQ ID NO: 7522070 - DNA, 22 bp, Homo sapiens
ctggtagtttgcaaaatggtgt

SEQ ID NO: 7522071 - DNA, 22 bp, Homo sapiens
ctggtagtgtctgccgaggtcc

SEQ ID NO: 7522072 - DNA, 22 bp, Homo sapiens
ctggtagtttgcaaaatggtgt

SEQ ID NO: 7522073 - DNA, 22 bp, Homo sapiens
ctggtattgagttgttgcttcc

SEQ ID NO: 7522074 - DNA, 22 bp, Homo sapiens
ctggtagcagtgaagctgttga

SEQ ID NO: 7522075 - DNA, 22 bp, Homo sapiens
ctggtagctcctgaatatccct

SEQ ID NO: 7522076 - DNA, 22 bp, Homo sapiens
ctggtagggccccacatcctta

SEQ ID NO: 7522077 - DNA, 22 bp, Homo sapiens
ctggtagggccccacatcctta

SEQ ID NO: 7522078 - DNA, 22 bp, Homo sapiens
ctggtaggggtgactgttatcg

SEQ ID NO: 7522079 - DNA, 22 bp, Homo sapiens
ctggtaggggtgactgttatcg

SEQ ID NO: 7522080 - DNA, 22 bp, Homo sapiens
ctggtaggggtgactgttatcg

SEQ ID NO: 7522081 - DNA, 22 bp, Homo sapiens
ctggtgcctcctctcccaggtc

SEQ ID NO: 7522082 - DNA, 22 bp, Homo sapiens
ctggtgcctcctctcccaggtc

SEQ ID NO: 7522083 - DNA, 22 bp, Homo sapiens
ctggtgcctcctctcccaggtc

SEQ ID NO: 7522084 - DNA, 22 bp, Homo sapiens
ctggtgctggagcctagtccct

SEQ ID NO: 7522085 - DNA, 22 bp, Homo sapiens
ctggtgggtagagggcatcagg

SEQ ID NO: 7522086 - DNA, 22 bp, Homo sapiens
ctggtggggagtcctggtctcc

SEQ ID NO: 7522087 - DNA, 22 bp, Homo sapiens
ctggtgggtagagggcatcagg

SEQ ID NO: 7522088 - DNA, 22 bp, Homo sapiens
ctggtggggagtcctggtctcc

SEQ ID NO: 7522089 - DNA, 22 bp, Homo sapiens
ctggtgggtagagggcatcagg

SEQ ID NO: 7522090 - DNA, 22 bp, Homo sapiens
ctggtgcctcctccctgtgctt

SEQ ID NO: 7522091 - DNA, 22 bp, Homo sapiens
ctggtgcctcctccctgtgctt

SEQ ID NO: 7522092 - DNA, 22 bp, Homo sapiens
ctggtgcctcctccctgtgctt

SEQ ID NO: 7522093 - DNA, 22 bp, Homo sapiens
ctggtgcctcctccctgtgctt

SEQ ID NO: 7522094 - DNA, 22 bp, Homo sapiens
ctggtgcctcctccctgtgctt

SEQ ID NO: 7522095 - DNA, 22 bp, Homo sapiens
ctggtgccctgtgtggcaggag

SEQ ID NO: 7522096 - DNA, 22 bp, Homo sapiens
ctggtgccctgtgtggcaggag

SEQ ID NO: 7522097 - DNA, 22 bp, Homo sapiens
ctggtcacctccttcccagcta

SEQ ID NO: 7522098 - DNA, 22 bp, Homo sapiens
ctggtcacctccttcccagcta

SEQ ID NO: 7522099 - DNA, 22 bp, Homo sapiens
ctggtgtggcggcgccctgtag

SEQ ID NO: 7522100 - DNA, 22 bp, Homo sapiens
ctggtgtggcggcgccctgtag

SEQ ID NO: 7522101 - DNA, 22 bp, Homo sapiens
ctggtgtggcggcgccctgtag

SEQ ID NO: 7522102 - DNA, 22 bp, Homo sapiens
ctggtgtggactccgcgcggag

SEQ ID NO: 7522103 - DNA, 22 bp, Homo sapiens
ctggtgtggactccgcgcggag

SEQ ID NO: 7522104 - DNA, 22 bp, Homo sapiens
ctggtgtggactccgcgcggag

SEQ ID NO: 7522105 - DNA, 22 bp, Homo sapiens
ctggttattattcttggaatgc

SEQ ID NO: 7522106 - DNA, 22 bp, Homo sapiens
ctggttcaagtcctggctctgt

SEQ ID NO: 7522107 - DNA, 22 bp, Homo sapiens
ctggttatcctgcctattttgt

SEQ ID NO: 7522108 - DNA, 22 bp, Homo sapiens
ctggtgtttattacaggtgctc

SEQ ID NO: 7522109 - DNA, 22 bp, Homo sapiens
ctggttaaatgaaaaagtatta

SEQ ID NO: 7522110 - DNA, 22 bp, Homo sapiens
ctggttaaatgaaaaagtatta

SEQ ID NO: 7522111 - DNA, 22 bp, Homo sapiens
ctggtgtggactccgcgcggag

SEQ ID NO: 7522112 - DNA, 22 bp, Homo sapiens
ctggtgtggactccgcgcggag

SEQ ID NO: 7522113 - DNA, 22 bp, Homo sapiens
ctggtgtggactccgcgcggag

SEQ ID NO: 7522114 - DNA, 22 bp, Homo sapiens
ctggtgtctgctccctcacagc

SEQ ID NO: 7522115 - DNA, 22 bp, Homo sapiens
ctggtgtgattgagcccaggtg

SEQ ID NO: 7522116 - DNA, 22 bp, Homo sapiens
ctggtgtctgctccctcacagc

SEQ ID NO: 7522117 - DNA, 22 bp, Homo sapiens
ctggtgtctgctccctcacagc

SEQ ID NO: 7522118 - DNA, 22 bp, Homo sapiens
ctggtgtctgattctcccctga

SEQ ID NO: 7522119 - DNA, 22 bp, Homo sapiens
ctggtgtctgattctcccctga

SEQ ID NO: 7522120 - DNA, 22 bp, Homo sapiens
ctggtgtctgattctcccctga

SEQ ID NO: 7522121 - DNA, 22 bp, Homo sapiens
ctggtgtctactacatggttga

SEQ ID NO: 7522122 - DNA, 22 bp, Homo sapiens
ctggtgtctactacatggttga

SEQ ID NO: 7522123 - DNA, 21 bp, Homo sapiens
ctggtgtagcactcaggtgct

SEQ ID NO: 7522124 - DNA, 22 bp, Homo sapiens
ctggtgtcattttagcctcagg

SEQ ID NO: 7522125 - DNA, 22 bp, Homo sapiens
ctggtggttcaggagaatggct

SEQ ID NO: 7522126 - DNA, 22 bp, Homo sapiens
ctggtggttcaggagaatggct

SEQ ID NO: 7522127 - DNA, 22 bp, Homo sapiens
ctggtgtaccttggctcaggca

SEQ ID NO: 7522128 - DNA, 21 bp, Homo sapiens
ctggtgtagcactcaggtgct

SEQ ID NO: 7522129 - DNA, 22 bp, Homo sapiens
ctgggttttattacagtgagct

SEQ ID NO: 7522130 - DNA, 22 bp, Homo sapiens
ctgggttttattacagtgagct

SEQ ID NO: 7522131 - DNA, 22 bp, Homo sapiens
ctgggttttattacagtgagct

SEQ ID NO: 7522132 - DNA, 22 bp, Homo sapiens
ctgggttttattacagtgagct

SEQ ID NO: 7522133 - DNA, 22 bp, Homo sapiens
ctggtaaatgatgagaagcacc

SEQ ID NO: 7522134 - DNA, 22 bp, Homo sapiens
ctggtaaatgatgagaagcacc

SEQ ID NO: 7522135 - DNA, 22 bp, Homo sapiens
ctggtaaagaagacaaacaggg

SEQ ID NO: 7522136 - DNA, 22 bp, Homo sapiens
ctggtaaagaagacaaacaggg

SEQ ID NO: 7522137 - DNA, 23 bp, Homo sapiens
ctggtaaatcactaaaattacaa

SEQ ID NO: 7522138 - DNA, 23 bp, Homo sapiens
ctggtaaatcactaaaattacaa

SEQ ID NO: 7522139 - DNA, 22 bp, Homo sapiens
ctggtacatagtaagaacacaa

SEQ ID NO: 7522140 - DNA, 22 bp, Homo sapiens
ctggtacagggaaataaaggaa

SEQ ID NO: 7522141 - DNA, 22 bp, Homo sapiens
ctggtacaaaatgctgatatca

SEQ ID NO: 7522142 - DNA, 22 bp, Homo sapiens
ctggtacagggaaataaaggaa

SEQ ID NO: 7522143 - DNA, 22 bp, Homo sapiens
ctggtacagtgttacaaaatgg

SEQ ID NO: 7522144 - DNA, 22 bp, Homo sapiens
ctgggttgccctgggcctgtga

SEQ ID NO: 7522145 - DNA, 22 bp, Homo sapiens
ctgggttgccctgggcctgtga

SEQ ID NO: 7522146 - DNA, 22 bp, Homo sapiens
ctgggttgcaaagcgctggctg

SEQ ID NO: 7522147 - DNA, 22 bp, Homo sapiens
ctgggttgcaaagcgctggctg

SEQ ID NO: 7522148 - DNA, 22 bp, Homo sapiens
ctgggttgccctgggcctgtga

SEQ ID NO: 7522149 - DNA, 22 bp, Homo sapiens
ctgggtttagggtctccccttg

SEQ ID NO: 7522150 - DNA, 22 bp, Homo sapiens
ctgggtttagggtctccccttg

SEQ ID NO: 7522151 - DNA, 22 bp, Homo sapiens
ctgggtttagggtctccccttg

SEQ ID NO: 7522152 - DNA, 22 bp, Homo sapiens
ctgggtttagggtctccccttg

SEQ ID NO: 7522153 - DNA, 22 bp, Homo sapiens
ctgggttgcaaagcgctggctg

SEQ ID NO: 7522154 - DNA, 22 bp, Homo sapiens
ctgggttcttggcacagcagga

SEQ ID NO: 7522155 - DNA, 22 bp, Homo sapiens
ctgggttcttggcacagcagga

SEQ ID NO: 7522156 - DNA, 22 bp, Homo sapiens
ctgggtggaaagtgctgagaat

SEQ ID NO: 7522157 - DNA, 22 bp, Homo sapiens
ctgggtggaaagtgctgagaat

SEQ ID NO: 7522158 - DNA, 22 bp, Homo sapiens
ctgggtggaaagtgctgagaat

SEQ ID NO: 7522159 - DNA, 22 bp, Homo sapiens
ctgggtggaaagtgctgagaat

SEQ ID NO: 7522160 - DNA, 22 bp, Homo sapiens
ctgggtggaaagtgctgagaat

SEQ ID NO: 7522161 - DNA, 22 bp, Homo sapiens
ctgggtggaaagtgctgagaat

SEQ ID NO: 7522162 - DNA, 22 bp, Homo sapiens
ctgggtggaaagtgctgagaat

SEQ ID NO: 7522163 - DNA, 22 bp, Homo sapiens
ctgggtggaaagtgctgagaat

SEQ ID NO: 7522164 - DNA, 22 bp, Homo sapiens
ctgggtggttttgatgtgaatt

SEQ ID NO: 7522165 - DNA, 22 bp, Homo sapiens
ctgggtggttttgatgtgaatt

SEQ ID NO: 7522166 - DNA, 22 bp, Homo sapiens
ctgggtggttttgatgtgaatt

SEQ ID NO: 7522167 - DNA, 22 bp, Homo sapiens
ctgggtggttttgatgtgaatt

SEQ ID NO: 7522168 - DNA, 22 bp, Homo sapiens
ctgggtggttttgatgtgaatt

SEQ ID NO: 7522169 - DNA, 22 bp, Homo sapiens
ctgggtggttctaactgttgat

SEQ ID NO: 7522170 - DNA, 22 bp, Homo sapiens
ctgggtggttctaactgttgat

SEQ ID NO: 7522171 - DNA, 22 bp, Homo sapiens
ctgggtggttctaactgttgat

SEQ ID NO: 7522172 - DNA, 22 bp, Homo sapiens
ctgggtggttctaactgttgat

SEQ ID NO: 7522173 - DNA, 22 bp, Homo sapiens
ctgggtgtcaggagacatgatg

SEQ ID NO: 7522174 - DNA, 22 bp, Homo sapiens
ctgggtgtagatggaagtttgg

SEQ ID NO: 7522175 - DNA, 22 bp, Homo sapiens
ctgggtgtagcccagtatgagg

SEQ ID NO: 7522176 - DNA, 22 bp, Homo sapiens
ctgggtgtagcccagtatgagg

SEQ ID NO: 7522177 - DNA, 22 bp, Homo sapiens
ctgggtgttcacccgaggcgct

SEQ ID NO: 7522178 - DNA, 22 bp, Homo sapiens
ctgggtgtcaggagacatgatg

SEQ ID NO: 7522179 - DNA, 22 bp, Homo sapiens
ctgggtgtcaggagacatgatg

SEQ ID NO: 7522180 - DNA, 22 bp, Homo sapiens
ctgggtgtgggtcaagcaacca

SEQ ID NO: 7522181 - DNA, 22 bp, Homo sapiens
ctgggtgtgggtcaagcaacca

SEQ ID NO: 7522182 - DNA, 22 bp, Homo sapiens
ctgggttaccatgaggaaatga

SEQ ID NO: 7522183 - DNA, 22 bp, Homo sapiens
ctgggttccatgtagccaagag

SEQ ID NO: 7522184 - DNA, 22 bp, Homo sapiens
ctgggtgttgggtactgaccgt

SEQ ID NO: 7522185 - DNA, 22 bp, Homo sapiens
ctgggtgttcaggagctgggct

SEQ ID NO: 7522186 - DNA, 22 bp, Homo sapiens
ctgggtgttcacccgaggcgct

SEQ ID NO: 7522187 - DNA, 22 bp, Homo sapiens
ctgggctcagtgtctcactcct

SEQ ID NO: 7522188 - DNA, 22 bp, Homo sapiens
ctgggctcagtgtctcactcct

SEQ ID NO: 7522189 - DNA, 22 bp, Homo sapiens
ctgggctcagtgtctcactcct

SEQ ID NO: 7522190 - DNA, 22 bp, Homo sapiens
ctgggctcagtgtctcactcct

SEQ ID NO: 7522191 - DNA, 22 bp, Homo sapiens
ctgggctcagtggctcatggct

SEQ ID NO: 7522192 - DNA, 22 bp, Homo sapiens
ctgggctcagtggctcatggct

SEQ ID NO: 7522193 - DNA, 22 bp, Homo sapiens
ctgggctcagtggctcatggct

SEQ ID NO: 7522194 - DNA, 22 bp, Homo sapiens
ctgggctcagtggctcatggct

SEQ ID NO: 7522195 - DNA, 22 bp, Homo sapiens
ctgggctcagtggctcatggct

SEQ ID NO: 7522196 - DNA, 22 bp, Homo sapiens
ctgggctcagtggctcatggct

SEQ ID NO: 7522197 - DNA, 22 bp, Homo sapiens
ctgggctcagtggctcatggct

SEQ ID NO: 7522198 - DNA, 22 bp, Homo sapiens
ctgggctcagtggctcatggct

SEQ ID NO: 7522199 - DNA, 22 bp, Homo sapiens
ctgggctcagtggctcatggct

SEQ ID NO: 7522200 - DNA, 22 bp, Homo sapiens
ctgggctcagtggctcatggct

SEQ ID NO: 7522201 - DNA, 22 bp, Homo sapiens
ctgggctcagtggctcatggct

SEQ ID NO: 7522202 - DNA, 22 bp, Homo sapiens
ctgggctcagtggctcatggct

SEQ ID NO: 7522203 - DNA, 22 bp, Homo sapiens
ctgggctcagtggctcatggct

SEQ ID NO: 7522204 - DNA, 22 bp, Homo sapiens
ctgggctcagtgtctcactcct

SEQ ID NO: 7522205 - DNA, 22 bp, Homo sapiens
ctgggctcagtgtctcactcct

SEQ ID NO: 7522206 - DNA, 21 bp, Homo sapiens
ctgggctcatggtgttacaga

SEQ ID NO: 7522207 - DNA, 21 bp, Homo sapiens
ctgggctcatggtgttacaga

SEQ ID NO: 7522208 - DNA, 21 bp, Homo sapiens
ctgggctcatggtgttacaga

SEQ ID NO: 7522209 - DNA, 21 bp, Homo sapiens
ctgggctcatggtgttacaga

SEQ ID NO: 7522210 - DNA, 22 bp, Homo sapiens
ctgggctccactacttgctaac

SEQ ID NO: 7522211 - DNA, 22 bp, Homo sapiens
ctgggctccactacttgctaac

SEQ ID NO: 7522212 - DNA, 22 bp, Homo sapiens
ctgggctccactacttgctaac

SEQ ID NO: 7522213 - DNA, 22 bp, Homo sapiens
ctgggctccactacttgctaac

SEQ ID NO: 7522214 - DNA, 22 bp, Homo sapiens
ctgggctccactacttgctaac

SEQ ID NO: 7522215 - DNA, 22 bp, Homo sapiens
ctgggctccactacttgctaac

SEQ ID NO: 7522216 - DNA, 22 bp, Homo sapiens
ctgggctccctcatgtgtctgc

SEQ ID NO: 7522217 - DNA, 22 bp, Homo sapiens
ctgggctccactcccacagtgt

SEQ ID NO: 7522218 - DNA, 22 bp, Homo sapiens
ctgggctccactcccacagtgt

SEQ ID NO: 7522219 - DNA, 22 bp, Homo sapiens
ctgggctccactcccacagtgt

SEQ ID NO: 7522220 - DNA, 22 bp, Homo sapiens
ctgggctccactcccacagtgt

SEQ ID NO: 7522221 - DNA, 22 bp, Homo sapiens
ctgggctccactcccacagtgt

SEQ ID NO: 7522222 - DNA, 22 bp, Homo sapiens
ctgggctccactcccacagtgt

SEQ ID NO: 7522223 - DNA, 22 bp, Homo sapiens
ctgggctccactcccacagtgt

SEQ ID NO: 7522224 - DNA, 22 bp, Homo sapiens
ctgggctcaagaagtcttccct

SEQ ID NO: 7522225 - DNA, 22 bp, Homo sapiens
ctgggctcaagaagtcttccct

SEQ ID NO: 7522226 - DNA, 22 bp, Homo sapiens
ctgggctcaagaagtcttccct

SEQ ID NO: 7522227 - DNA, 22 bp, Homo sapiens
ctgggctcaaatcctggccctg

SEQ ID NO: 7522228 - DNA, 22 bp, Homo sapiens
ctgggctcaaatcctggccctg

SEQ ID NO: 7522229 - DNA, 22 bp, Homo sapiens
ctgggctcaaatcctggccctg

SEQ ID NO: 7522230 - DNA, 22 bp, Homo sapiens
ctgggctcaaatcctggccctg

SEQ ID NO: 7522231 - DNA, 22 bp, Homo sapiens
ctgggctcaaatcctggccctg

SEQ ID NO: 7522232 - DNA, 22 bp, Homo sapiens
ctgggctcaaatcctggccctg

SEQ ID NO: 7522233 - DNA, 22 bp, Homo sapiens
ctgggctcaaatcctggccctg

SEQ ID NO: 7522234 - DNA, 22 bp, Homo sapiens
ctgggctcaaatcctggccctg

SEQ ID NO: 7522235 - DNA, 22 bp, Homo sapiens
ctgggctcagcaggccaaggcc

SEQ ID NO: 7522236 - DNA, 22 bp, Homo sapiens
ctgggctcagcaggccaaggcc

SEQ ID NO: 7522237 - DNA, 22 bp, Homo sapiens
ctgggctcagcccatgctgtcc

SEQ ID NO: 7522238 - DNA, 22 bp, Homo sapiens
ctgggctcagcccatgctgtcc

SEQ ID NO: 7522239 - DNA, 22 bp, Homo sapiens
ctgggctcagcccatgctgtcc

SEQ ID NO: 7522240 - DNA, 22 bp, Homo sapiens
ctgggctcaagaagtcttccct

SEQ ID NO: 7522241 - DNA, 22 bp, Homo sapiens
ctgggctcaagaagtcttccct

SEQ ID NO: 7522242 - DNA, 22 bp, Homo sapiens
ctgggctcaagaagtcttccct

SEQ ID NO: 7522243 - DNA, 22 bp, Homo sapiens
ctgggctcagcaggccaaggcc

SEQ ID NO: 7522244 - DNA, 22 bp, Homo sapiens
ctgggctcagcaggccaaggcc

SEQ ID NO: 7522245 - DNA, 22 bp, Homo sapiens
ctgggcctccacgggccatcac

SEQ ID NO: 7522246 - DNA, 22 bp, Homo sapiens
ctgggcctccagctctgccagc

SEQ ID NO: 7522247 - DNA, 22 bp, Homo sapiens
ctgggcctccacgggccatcac

SEQ ID NO: 7522248 - DNA, 22 bp, Homo sapiens
ctgggcctccacgggccatcac

SEQ ID NO: 7522249 - DNA, 22 bp, Homo sapiens
ctgggcctccagctctgccagc

SEQ ID NO: 7522250 - DNA, 22 bp, Homo sapiens
ctgggcctccagctctgccagc

SEQ ID NO: 7522251 - DNA, 22 bp, Homo sapiens
ctgggcctccagctctgccagc

SEQ ID NO: 7522252 - DNA, 22 bp, Homo sapiens
ctgggcctccagctctgccagc

SEQ ID NO: 7522253 - DNA, 22 bp, Homo sapiens
ctgggcctccagctctgccagc

SEQ ID NO: 7522254 - DNA, 22 bp, Homo sapiens
ctgggcctccagctctgccagc

SEQ ID NO: 7522255 - DNA, 22 bp, Homo sapiens
ctgggcctccagctctgccagc

SEQ ID NO: 7522256 - DNA, 22 bp, Homo sapiens
ctgggcctccacgggccatcac

SEQ ID NO: 7522257 - DNA, 22 bp, Homo sapiens
ctgggcctcatgcacagagatg

SEQ ID NO: 7522258 - DNA, 22 bp, Homo sapiens
ctgggcctcatgcacagagatg

SEQ ID NO: 7522259 - DNA, 22 bp, Homo sapiens
ctgggcctcatgcacagagatg

SEQ ID NO: 7522260 - DNA, 22 bp, Homo sapiens
ctgggcctcatgcacagagatg

SEQ ID NO: 7522261 - DNA, 22 bp, Homo sapiens
ctgggcctcatgcacagagatg

SEQ ID NO: 7522262 - DNA, 22 bp, Homo sapiens
ctgggcctccacgggccatcac

SEQ ID NO: 7522263 - DNA, 22 bp, Homo sapiens
ctgggcctccacgggccatcac

SEQ ID NO: 7522264 - DNA, 22 bp, Homo sapiens
ctgggcctccacgggccatcac

SEQ ID NO: 7522265 - DNA, 22 bp, Homo sapiens
ctgggcctccacgggccatcac

SEQ ID NO: 7522266 - DNA, 22 bp, Homo sapiens
ctgggcctccacgggccatcac

SEQ ID NO: 7522267 - DNA, 22 bp, Homo sapiens
ctgggcctccacgggccatcac

SEQ ID NO: 7522268 - DNA, 22 bp, Homo sapiens
ctgggcctccacgggccatcac

SEQ ID NO: 7522269 - DNA, 22 bp, Homo sapiens
ctgggcccaggcggctctcgga

SEQ ID NO: 7522270 - DNA, 22 bp, Homo sapiens
ctgggccctatggaagaaaggg

SEQ ID NO: 7522271 - DNA, 22 bp, Homo sapiens
ctgggccctatggaagaaaggg

SEQ ID NO: 7522272 - DNA, 22 bp, Homo sapiens
ctgggccctgaagacagtcagg

SEQ ID NO: 7522273 - DNA, 22 bp, Homo sapiens
ctgggccctgaagacagtcagg

SEQ ID NO: 7522274 - DNA, 22 bp, Homo sapiens
ctgggccctgaagacagtcagg

SEQ ID NO: 7522275 - DNA, 22 bp, Homo sapiens
ctgggccctgaagacagtcagg

SEQ ID NO: 7522276 - DNA, 22 bp, Homo sapiens
ctgggccctatggaagaaaggg

SEQ ID NO: 7522277 - DNA, 22 bp, Homo sapiens
ctgggccctgaagacagtcagg

SEQ ID NO: 7522278 - DNA, 22 bp, Homo sapiens
ctgggcctaacccacagcgttt

SEQ ID NO: 7522279 - DNA, 22 bp, Homo sapiens
ctgggcctaacccacagcgttt

SEQ ID NO: 7522280 - DNA, 22 bp, Homo sapiens
ctgggcctaacccacagcgttt

SEQ ID NO: 7522281 - DNA, 22 bp, Homo sapiens
ctgggcctaacccacagcgttt

SEQ ID NO: 7522282 - DNA, 22 bp, Homo sapiens
ctgggcctaacccacagcgttt

SEQ ID NO: 7522283 - DNA, 22 bp, Homo sapiens
ctgggcctaacccacagcgttt

SEQ ID NO: 7522284 - DNA, 22 bp, Homo sapiens
ctgggcctaacccacagcgttt

SEQ ID NO: 7522285 - DNA, 22 bp, Homo sapiens
ctgggcctagaggaagctgaca

SEQ ID NO: 7522286 - DNA, 22 bp, Homo sapiens
ctgggcctagaggaagctgaca

SEQ ID NO: 7522287 - DNA, 22 bp, Homo sapiens
ctgggcctagaggaagctgaca

SEQ ID NO: 7522288 - DNA, 22 bp, Homo sapiens
ctgggcctaggatggaagggcc

SEQ ID NO: 7522289 - DNA, 22 bp, Homo sapiens
ctgggcctaggatggaagggcc

SEQ ID NO: 7522290 - DNA, 22 bp, Homo sapiens
ctgggcctaggatggaagggcc

SEQ ID NO: 7522291 - DNA, 22 bp, Homo sapiens
ctgggcctaggatggaagggcc

SEQ ID NO: 7522292 - DNA, 22 bp, Homo sapiens
ctgggcctaggatggaagggcc

SEQ ID NO: 7522293 - DNA, 22 bp, Homo sapiens
ctgggcctagcaacagaggagt

SEQ ID NO: 7522294 - DNA, 22 bp, Homo sapiens
ctgggcctagcaacagaggagt

SEQ ID NO: 7522295 - DNA, 22 bp, Homo sapiens
ctgggcctagcaacagaggagt

SEQ ID NO: 7522296 - DNA, 22 bp, Homo sapiens
ctgggcctagcaacagaggagt

SEQ ID NO: 7522297 - DNA, 22 bp, Homo sapiens
ctgggcctagcaacagaggagt

SEQ ID NO: 7522298 - DNA, 22 bp, Homo sapiens
ctgggcctagcaacagaggagt

SEQ ID NO: 7522299 - DNA, 22 bp, Homo sapiens
ctgggcctagcaacagaggagt

SEQ ID NO: 7522300 - DNA, 22 bp, Homo sapiens
ctgggcctagaggaagctgaca

SEQ ID NO: 7522301 - DNA, 22 bp, Homo sapiens
ctgggcctagcaacagaggagt

SEQ ID NO: 7522302 - DNA, 22 bp, Homo sapiens
ctgggcctcatccagccacaac

SEQ ID NO: 7522303 - DNA, 22 bp, Homo sapiens
ctgggcctcatccagccacaac

SEQ ID NO: 7522304 - DNA, 22 bp, Homo sapiens
ctgggcctcatccagccacaac

SEQ ID NO: 7522305 - DNA, 22 bp, Homo sapiens
ctgggcctcatccagccacaac

SEQ ID NO: 7522306 - DNA, 22 bp, Homo sapiens
ctgggcctcatccagccacaac

SEQ ID NO: 7522307 - DNA, 22 bp, Homo sapiens
ctgggcctcatccccagagttt

SEQ ID NO: 7522308 - DNA, 22 bp, Homo sapiens
ctgggcctcatccccagagttt

SEQ ID NO: 7522309 - DNA, 22 bp, Homo sapiens
ctgggcctcatccccagagttt

SEQ ID NO: 7522310 - DNA, 22 bp, Homo sapiens
ctgggcctcatccccagagttt

SEQ ID NO: 7522311 - DNA, 22 bp, Homo sapiens
ctgggcctcatccccagagttt

SEQ ID NO: 7522312 - DNA, 22 bp, Homo sapiens
ctgggcctcatcctcagagttt

SEQ ID NO: 7522313 - DNA, 22 bp, Homo sapiens
ctgggcctcatcctcagagttt

SEQ ID NO: 7522314 - DNA, 22 bp, Homo sapiens
ctgggcctcatcctcagagttt

SEQ ID NO: 7522315 - DNA, 22 bp, Homo sapiens
ctgggcctcatcctcagagttt

SEQ ID NO: 7522316 - DNA, 22 bp, Homo sapiens
ctgggcctcatcctcagagttt

SEQ ID NO: 7522317 - DNA, 22 bp, Homo sapiens
ctgggcctcatccccagagttt

SEQ ID NO: 7522318 - DNA, 22 bp, Homo sapiens
ctgggcctcatgcacagagatg

SEQ ID NO: 7522319 - DNA, 22 bp, Homo sapiens
ctgggcctcatcctcagagttt

SEQ ID NO: 7522320 - DNA, 22 bp, Homo sapiens
ctgggcctcatcctcagagttt

SEQ ID NO: 7522321 - DNA, 22 bp, Homo sapiens
ctgggcctcaccctagaccaat

SEQ ID NO: 7522322 - DNA, 22 bp, Homo sapiens
ctgggcctcaccctagaccaat

SEQ ID NO: 7522323 - DNA, 22 bp, Homo sapiens
ctgggcctcaccctagaccaat

SEQ ID NO: 7522324 - DNA, 22 bp, Homo sapiens
ctgggcctcaccctagaccaat

SEQ ID NO: 7522325 - DNA, 22 bp, Homo sapiens
ctgggcctcacacccaccaaat

SEQ ID NO: 7522326 - DNA, 22 bp, Homo sapiens
ctgggcctcaatctcagagttt

SEQ ID NO: 7522327 - DNA, 22 bp, Homo sapiens
ctgggcctcacacccaccaaat

SEQ ID NO: 7522328 - DNA, 22 bp, Homo sapiens
ctgggcctcacacccaccaaat

SEQ ID NO: 7522329 - DNA, 22 bp, Homo sapiens
ctgggcctcacacccaccaaat

SEQ ID NO: 7522330 - DNA, 22 bp, Homo sapiens
ctgggcctcacacccaccaaat

SEQ ID NO: 7522331 - DNA, 22 bp, Homo sapiens
ctgggcctcacacccaccaaat

SEQ ID NO: 7522332 - DNA, 22 bp, Homo sapiens
ctgggcctcaagctcagatttc

SEQ ID NO: 7522333 - DNA, 22 bp, Homo sapiens
ctgggcctcaagctcagatttc

SEQ ID NO: 7522334 - DNA, 22 bp, Homo sapiens
ctgggcctcaagctcagatttc

SEQ ID NO: 7522335 - DNA, 22 bp, Homo sapiens
ctgggcctcaagctcagatttc

SEQ ID NO: 7522336 - DNA, 22 bp, Homo sapiens
ctgggcctcaagctcagatttc

SEQ ID NO: 7522337 - DNA, 23 bp, Homo sapiens
ctgggcctatggtctgaatccaa

SEQ ID NO: 7522338 - DNA, 23 bp, Homo sapiens
ctgggcctatggtctgaatccaa

SEQ ID NO: 7522339 - DNA, 23 bp, Homo sapiens
ctgggcctatggtctgaatccaa

SEQ ID NO: 7522340 - DNA, 23 bp, Homo sapiens
ctgggcctatggtctgaatccaa

SEQ ID NO: 7522341 - DNA, 22 bp, Homo sapiens
ctgggcctcaatctcagagttt

SEQ ID NO: 7522342 - DNA, 22 bp, Homo sapiens
ctgggcctcaatctcagagttt

SEQ ID NO: 7522343 - DNA, 22 bp, Homo sapiens
ctgggcctcaatctcagagttt

SEQ ID NO: 7522344 - DNA, 22 bp, Homo sapiens
ctgggcctcaatctcagagttt

SEQ ID NO: 7522345 - DNA, 22 bp, Homo sapiens
ctgggcctcaagctcagatttc

SEQ ID NO: 7522346 - DNA, 22 bp, Homo sapiens
ctgggcctcaatctcagagttt

SEQ ID NO: 7522347 - DNA, 22 bp, Homo sapiens
ctgggcctcaatctcagagttt

SEQ ID NO: 7522348 - DNA, 22 bp, Homo sapiens
ctggagctccagggtctcctct

SEQ ID NO: 7522349 - DNA, 22 bp, Homo sapiens
ctggagctccagggtctcctct

SEQ ID NO: 7522350 - DNA, 22 bp, Homo sapiens
ctggagctccagggtctcctct

SEQ ID NO: 7522351 - DNA, 22 bp, Homo sapiens
ctggagctccagggtctcctct

SEQ ID NO: 7522352 - DNA, 22 bp, Homo sapiens
ctggagctctccagagccccgt

SEQ ID NO: 7522353 - DNA, 22 bp, Homo sapiens
ctgggaggcggaggttgcagtg

SEQ ID NO: 7522354 - DNA, 22 bp, Homo sapiens
ctgggaggcggaggttgcagtg

SEQ ID NO: 7522355 - DNA, 22 bp, Homo sapiens
ctgggaggcggaggttgcagtg

SEQ ID NO: 7522356 - DNA, 22 bp, Homo sapiens
ctgggaggcggaggttgcagtg

SEQ ID NO: 7522357 - DNA, 22 bp, Homo sapiens
ctgggaggcggagcttgcagtg

SEQ ID NO: 7522358 - DNA, 22 bp, Homo sapiens
ctggagctccagggtctcctct

SEQ ID NO: 7522359 - DNA, 22 bp, Homo sapiens
ctggagctctccagagccccgt

SEQ ID NO: 7522360 - DNA, 22 bp, Homo sapiens
ctgggaggcggagcttgcagtg

SEQ ID NO: 7522361 - DNA, 22 bp, Homo sapiens
ctggagcctgcagttttcactt

SEQ ID NO: 7522362 - DNA, 22 bp, Homo sapiens
ctggagccttcaccaggggaaa

SEQ ID NO: 7522363 - DNA, 22 bp, Homo sapiens
ctggagccttcaccaggggaaa

SEQ ID NO: 7522364 - DNA, 22 bp, Homo sapiens
ctggagccttcaccaggggaaa

SEQ ID NO: 7522365 - DNA, 22 bp, Homo sapiens
ctggagccttcaccaggggaaa

SEQ ID NO: 7522366 - DNA, 22 bp, Homo sapiens
ctggagccttcaccaggggaaa

SEQ ID NO: 7522367 - DNA, 22 bp, Homo sapiens
ctggagccttcaccaggggaaa

SEQ ID NO: 7522368 - DNA, 22 bp, Homo sapiens
ctggagccttcaccaggggaaa

SEQ ID NO: 7522369 - DNA, 22 bp, Homo sapiens
ctggagccttcaccaggggaaa

SEQ ID NO: 7522370 - DNA, 22 bp, Homo sapiens
ctggagctaataatccatctga

SEQ ID NO: 7522371 - DNA, 22 bp, Homo sapiens
ctggagctcagcccaggttcca

SEQ ID NO: 7522372 - DNA, 22 bp, Homo sapiens
ctggagctcagcccaggttcca

SEQ ID NO: 7522373 - DNA, 22 bp, Homo sapiens
ctggagctaggaagtccaagat

SEQ ID NO: 7522374 - DNA, 22 bp, Homo sapiens
ctggagctaataatccatctga

SEQ ID NO: 7522375 - DNA, 22 bp, Homo sapiens
ctgggagtctggaattttggta

SEQ ID NO: 7522376 - DNA, 22 bp, Homo sapiens
ctgggagtctggcctctggtcc

SEQ ID NO: 7522377 - DNA, 22 bp, Homo sapiens
ctgggagtctggcctctggtcc

SEQ ID NO: 7522378 - DNA, 22 bp, Homo sapiens
ctgggagtctaagctagcaccg

SEQ ID NO: 7522379 - DNA, 22 bp, Homo sapiens
ctgggagtctaagctagcaccg

SEQ ID NO: 7522380 - DNA, 22 bp, Homo sapiens
ctgggagtggtgacagctctcg

SEQ ID NO: 7522381 - DNA, 22 bp, Homo sapiens
ctgggagtggtgacagctctcg

SEQ ID NO: 7522382 - DNA, 22 bp, Homo sapiens
ctgggagtggtgacagctctcg

SEQ ID NO: 7522383 - DNA, 22 bp, Homo sapiens
ctgggagtgaaaggagggctgc

SEQ ID NO: 7522384 - DNA, 22 bp, Homo sapiens
ctgggagtgaaaggagggctgc

SEQ ID NO: 7522385 - DNA, 22 bp, Homo sapiens
ctgggagtcaccaggagcaagg

SEQ ID NO: 7522386 - DNA, 22 bp, Homo sapiens
ctgggagtcaccaggagcaagg

SEQ ID NO: 7522387 - DNA, 22 bp, Homo sapiens
ctgggagtcagtataagaagca

SEQ ID NO: 7522388 - DNA, 22 bp, Homo sapiens
ctgggagtcagtataagaagca

SEQ ID NO: 7522389 - DNA, 22 bp, Homo sapiens
ctgggagtcagtataagaagca

SEQ ID NO: 7522390 - DNA, 22 bp, Homo sapiens
ctgggagtccctggaatagctc

SEQ ID NO: 7522391 - DNA, 22 bp, Homo sapiens
ctgggagtcaccaggagcaagg

SEQ ID NO: 7522392 - DNA, 22 bp, Homo sapiens
ctgggagtcaccaggagcaagg

SEQ ID NO: 7522393 - DNA, 22 bp, Homo sapiens
ctgggagtactgggggatgtca

SEQ ID NO: 7522394 - DNA, 22 bp, Homo sapiens
ctgggaggcggaggttgcagtg

SEQ ID NO: 7522395 - DNA, 22 bp, Homo sapiens
ctgggaggcggaggttgcagtg

SEQ ID NO: 7522396 - DNA, 22 bp, Homo sapiens
ctgggccagcaactgcaatgga

SEQ ID NO: 7522397 - DNA, 22 bp, Homo sapiens
ctgggccaggaccagggttgaa

SEQ ID NO: 7522398 - DNA, 22 bp, Homo sapiens
ctgggccaggaccagggttgaa

SEQ ID NO: 7522399 - DNA, 22 bp, Homo sapiens
ctgggccaggaccagggttgaa

SEQ ID NO: 7522400 - DNA, 22 bp, Homo sapiens
ctgggccaggaccagggttgaa

SEQ ID NO: 7522401 - DNA, 22 bp, Homo sapiens
ctgggccaggaccagggttgaa

SEQ ID NO: 7522402 - DNA, 22 bp, Homo sapiens
ctgggccaggaccagggttgaa

SEQ ID NO: 7522403 - DNA, 22 bp, Homo sapiens
ctgggccaggaccagggttgaa

SEQ ID NO: 7522404 - DNA, 22 bp, Homo sapiens
ctgggcccacgagggctctggg

SEQ ID NO: 7522405 - DNA, 22 bp, Homo sapiens
ctgggcccacgagggctctggg

SEQ ID NO: 7522406 - DNA, 22 bp, Homo sapiens
ctgggcccaggcggctctcgga

SEQ ID NO: 7522407 - DNA, 22 bp, Homo sapiens
ctgggcccaggcggctctcgga

SEQ ID NO: 7522408 - DNA, 22 bp, Homo sapiens
ctgggcccacgagggctctggg

SEQ ID NO: 7522409 - DNA, 22 bp, Homo sapiens
ctgggcccacgagggctctggg

SEQ ID NO: 7522410 - DNA, 22 bp, Homo sapiens
ctgggcccacgagggctctggg

SEQ ID NO: 7522411 - DNA, 22 bp, Homo sapiens
ctgggcccacgagggctctggg

SEQ ID NO: 7522412 - DNA, 22 bp, Homo sapiens
ctgggcccacgagggctctggg

SEQ ID NO: 7522413 - DNA, 22 bp, Homo sapiens
ctgggcccacgagggctctggg

SEQ ID NO: 7522414 - DNA, 22 bp, Homo sapiens
ctgggccagcaactgcaatgga

SEQ ID NO: 7522415 - DNA, 22 bp, Homo sapiens
ctgggccagcaactgcaatgga

SEQ ID NO: 7522416 - DNA, 22 bp, Homo sapiens
ctgggccagcaactgcaatgga

SEQ ID NO: 7522417 - DNA, 22 bp, Homo sapiens
ctgggccagcaactgcaatgga

SEQ ID NO: 7522418 - DNA, 22 bp, Homo sapiens
ctgggatgtctatagaacactt

SEQ ID NO: 7522419 - DNA, 22 bp, Homo sapiens
ctgggatgtgaggagcgcctct

SEQ ID NO: 7522420 - DNA, 22 bp, Homo sapiens
ctgggccagatccagcctcaca

SEQ ID NO: 7522421 - DNA, 22 bp, Homo sapiens
ctgggatggctccgctgctgct

SEQ ID NO: 7522422 - DNA, 22 bp, Homo sapiens
ctgggatggctttcctgcatta

SEQ ID NO: 7522423 - DNA, 22 bp, Homo sapiens
ctgggatgtctatagaacactt

SEQ ID NO: 7522424 - DNA, 22 bp, Homo sapiens
ctgggatgtctatagaacactt

SEQ ID NO: 7522425 - DNA, 22 bp, Homo sapiens
ctgggatgggaactgagaatca

SEQ ID NO: 7522426 - DNA, 22 bp, Homo sapiens
ctgggatggctttcctgcatta

SEQ ID NO: 7522427 - DNA, 22 bp, Homo sapiens
ctgggatgggaactgagaatca

SEQ ID NO: 7522428 - DNA, 22 bp, Homo sapiens
ctgggatgggaactgagaatca

SEQ ID NO: 7522429 - DNA, 22 bp, Homo sapiens
ctgggatgctccggcctggatg

SEQ ID NO: 7522430 - DNA, 22 bp, Homo sapiens
ctgggatggctccgctgctgct

SEQ ID NO: 7522431 - DNA, 22 bp, Homo sapiens
ctgggatgctccggcctggatg

SEQ ID NO: 7522432 - DNA, 22 bp, Homo sapiens
ctgggatgctccggcctggatg

SEQ ID NO: 7522433 - DNA, 22 bp, Homo sapiens
ctgggatgatagtgctagtatt

SEQ ID NO: 7522434 - DNA, 22 bp, Homo sapiens
ctgggatgatagtgctagtatt

SEQ ID NO: 7522435 - DNA, 22 bp, Homo sapiens
ctgggatgcggaggttgcggtg

SEQ ID NO: 7522436 - DNA, 22 bp, Homo sapiens
ctgggagtttctagagaaagac

SEQ ID NO: 7522437 - DNA, 22 bp, Homo sapiens
ctgggagtttgttagtaatgca

SEQ ID NO: 7522438 - DNA, 22 bp, Homo sapiens
ctgggatccacgggctcccaag

SEQ ID NO: 7522439 - DNA, 22 bp, Homo sapiens
ctgggatcagcagtagtgatga

SEQ ID NO: 7522440 - DNA, 22 bp, Homo sapiens
ctgggataggaaggtttccagc

SEQ ID NO: 7522441 - DNA, 22 bp, Homo sapiens
ctgggatcagcagtagtgatga

SEQ ID NO: 7522442 - DNA, 22 bp, Homo sapiens
ctgggatccacgggctcccaag

SEQ ID NO: 7522443 - DNA, 22 bp, Homo sapiens
ctgggatccacgggctcccaag

SEQ ID NO: 7522444 - DNA, 22 bp, Homo sapiens
ctgggagtgttctaggtcacat

SEQ ID NO: 7522445 - DNA, 22 bp, Homo sapiens
ctgggagtgttctaggtcacat

SEQ ID NO: 7522446 - DNA, 22 bp, Homo sapiens
ctgggagtgttctaggtcacat

SEQ ID NO: 7522447 - DNA, 22 bp, Homo sapiens
ctgggagtgttctaggtcacat

SEQ ID NO: 7522448 - DNA, 22 bp, Homo sapiens
ctgggagtgtccctctggtaat

SEQ ID NO: 7522449 - DNA, 22 bp, Homo sapiens
ctgggagtgtccctctggtaat

SEQ ID NO: 7522450 - DNA, 22 bp, Homo sapiens
ctgggagtttctagagaaagac

SEQ ID NO: 7522451 - DNA, 22 bp, Homo sapiens
ctgggagtttctagagaaagac

SEQ ID NO: 7522452 - DNA, 22 bp, Homo sapiens
ctgggagttgacgaggcttgta

SEQ ID NO: 7522453 - DNA, 22 bp, Homo sapiens
ctgggagttgacgaggcttgta

SEQ ID NO: 7522454 - DNA, 22 bp, Homo sapiens
ctgggagttgacgaggcttgta

SEQ ID NO: 7522455 - DNA, 19 bp, Homo sapiens
ctgggagttcactgctgcc

SEQ ID NO: 7522456 - DNA, 19 bp, Homo sapiens
ctgggagttcactgctgcc

SEQ ID NO: 7522457 - DNA, 19 bp, Homo sapiens
ctgggagttcactgctgcc

SEQ ID NO: 7522458 - DNA, 22 bp, Homo sapiens
ctgtgtcttctgttttgaagtt

SEQ ID NO: 7522459 - DNA, 22 bp, Homo sapiens
ctgtgtcttctgttttgaagtt

SEQ ID NO: 7522460 - DNA, 22 bp, Homo sapiens
ctgtgtcttctgttttgaagtt

SEQ ID NO: 7522461 - DNA, 22 bp, Homo sapiens
ctgtgtcttctgttttgaagtt

SEQ ID NO: 7522462 - DNA, 22 bp, Homo sapiens
ctgtggtggcacagcgggctgg

SEQ ID NO: 7522463 - DNA, 22 bp, Homo sapiens
ctgtggtggcacagcgggctgg

SEQ ID NO: 7522464 - DNA, 22 bp, Homo sapiens
ctgtggtggcacagcgggctgg

SEQ ID NO: 7522465 - DNA, 22 bp, Homo sapiens
ctgtgtctttcctactttgtgg

SEQ ID NO: 7522466 - DNA, 22 bp, Homo sapiens
ctgtgtctttcctactttgtgg

SEQ ID NO: 7522467 - DNA, 22 bp, Homo sapiens
ctgtgtctttcctactttgtgg

SEQ ID NO: 7522468 - DNA, 22 bp, Homo sapiens
ctgtgtcttgagtaattcggtg

SEQ ID NO: 7522469 - DNA, 22 bp, Homo sapiens
ctgtgtcttgagtaattcggtg

SEQ ID NO: 7522470 - DNA, 22 bp, Homo sapiens
ctgtgtcttgagtaattcggtg

SEQ ID NO: 7522471 - DNA, 22 bp, Homo sapiens
ctgtgtctttcctactttgtgg

SEQ ID NO: 7522472 - DNA, 22 bp, Homo sapiens
ctgtgtgatgggaagaatgttt

SEQ ID NO: 7522473 - DNA, 22 bp, Homo sapiens
ctgtgtgatgggaagaatgttt

SEQ ID NO: 7522474 - DNA, 22 bp, Homo sapiens
ctgtgtgagcatcacttcagat

SEQ ID NO: 7522475 - DNA, 22 bp, Homo sapiens
ctgtggtcactgttggggaatg

SEQ ID NO: 7522476 - DNA, 22 bp, Homo sapiens
ctgtggtcatctcagagtggcc

SEQ ID NO: 7522477 - DNA, 22 bp, Homo sapiens
ctgtggtcatctcagagtggcc

SEQ ID NO: 7522478 - DNA, 22 bp, Homo sapiens
ctgtggtctgtaggagtgatgg

SEQ ID NO: 7522479 - DNA, 22 bp, Homo sapiens
ctgtggtctgtaggagtgatgg

SEQ ID NO: 7522480 - DNA, 22 bp, Homo sapiens
ctgtggtgagcaactgactgaa

SEQ ID NO: 7522481 - DNA, 22 bp, Homo sapiens
ctgtggtgagcaactgactgaa

SEQ ID NO: 7522482 - DNA, 22 bp, Homo sapiens
ctgtggtgagcaactgactgaa

SEQ ID NO: 7522483 - DNA, 20 bp, Homo sapiens
ctgtggtgagcaggagagta

SEQ ID NO: 7522484 - DNA, 20 bp, Homo sapiens
ctgtggtgagcaggagagta

SEQ ID NO: 7522485 - DNA, 20 bp, Homo sapiens
ctgtggtgagcaggagagta

SEQ ID NO: 7522486 - DNA, 22 bp, Homo sapiens
ctgtggtgagcaactgactgaa

SEQ ID NO: 7522487 - DNA, 22 bp, Homo sapiens
ctgtggtgagcaactgactgaa

SEQ ID NO: 7522488 - DNA, 22 bp, Homo sapiens
ctgtggtggcacagcgggctgg

SEQ ID NO: 7522489 - DNA, 22 bp, Homo sapiens
ctgtggtggcacagcgggctgg

SEQ ID NO: 7522490 - DNA, 20 bp, Homo sapiens
ctgtggtgagcaggagagta

SEQ ID NO: 7522491 - DNA, 20 bp, Homo sapiens
ctgtggtgagcaggagagta

SEQ ID NO: 7522492 - DNA, 23 bp, Homo sapiens
ctgtggtgaggccctagaatctg

SEQ ID NO: 7522493 - DNA, 22 bp, Homo sapiens
ctgtgggctgaaagtgctcccg

SEQ ID NO: 7522494 - DNA, 22 bp, Homo sapiens
ctgtgggctgaaagtgctcccg

SEQ ID NO: 7522495 - DNA, 22 bp, Homo sapiens
ctgtgggctgaaagtgctcccg

SEQ ID NO: 7522496 - DNA, 18 bp, Homo sapiens
ctgtgggctggtgcatga

SEQ ID NO: 7522497 - DNA, 18 bp, Homo sapiens
ctgtgggctggtgcatga

SEQ ID NO: 7522498 - DNA, 22 bp, Homo sapiens
ctgtgggctgaaagtgctcccg

SEQ ID NO: 7522499 - DNA, 22 bp, Homo sapiens
ctgtgggctgaaagtgctcccg

SEQ ID NO: 7522500 - DNA, 22 bp, Homo sapiens
ctgtggggaaagggtcctgctc

SEQ ID NO: 7522501 - DNA, 22 bp, Homo sapiens
ctgtgggcttgaggttagacag

SEQ ID NO: 7522502 - DNA, 22 bp, Homo sapiens
ctgtggggaaagggtcctgctc

SEQ ID NO: 7522503 - DNA, 18 bp, Homo sapiens
ctgtgggctggtgcatga

SEQ ID NO: 7522504 - DNA, 18 bp, Homo sapiens
ctgtgggctggtgcatga

SEQ ID NO: 7522505 - DNA, 22 bp, Homo sapiens
ctgtgggcttgaggttagacag

SEQ ID NO: 7522506 - DNA, 22 bp, Homo sapiens
ctgtgggcttgaggttagacag

SEQ ID NO: 7522507 - DNA, 22 bp, Homo sapiens
ctgtggggagctgatcagatca

SEQ ID NO: 7522508 - DNA, 22 bp, Homo sapiens
ctgtgggtgaagacaagggaga

SEQ ID NO: 7522509 - DNA, 22 bp, Homo sapiens
ctgtggggagctgatcagatca

SEQ ID NO: 7522510 - DNA, 22 bp, Homo sapiens
ctgtggggaagatagaaccgac

SEQ ID NO: 7522511 - DNA, 19 bp, Homo sapiens
ctgtgggtgtgcaagggtg

SEQ ID NO: 7522512 - DNA, 19 bp, Homo sapiens
ctgtgggtgtgcaagggtg

SEQ ID NO: 7522513 - DNA, 22 bp, Homo sapiens
ctgtgggtggctgtgccccagg

SEQ ID NO: 7522514 - DNA, 22 bp, Homo sapiens
ctgtgggtgaagacaagggaga

SEQ ID NO: 7522515 - DNA, 21 bp, Homo sapiens
ctgtggtacagctgggacgga

SEQ ID NO: 7522516 - DNA, 21 bp, Homo sapiens
ctgtggtacagctgggacgga

SEQ ID NO: 7522517 - DNA, 22 bp, Homo sapiens
ctgtggtcaccaggctggggcc

SEQ ID NO: 7522518 - DNA, 22 bp, Homo sapiens
ctgtggtcaccaggctggggcc

SEQ ID NO: 7522519 - DNA, 22 bp, Homo sapiens
ctgtgtgtgagaagcaggttga

SEQ ID NO: 7522520 - DNA, 22 bp, Homo sapiens
ctgtgtgtgagaagcaggttga

SEQ ID NO: 7522521 - DNA, 22 bp, Homo sapiens
ctgtgtgtgagaagcaggttga

SEQ ID NO: 7522522 - DNA, 22 bp, Homo sapiens
ctgtgtgtgagaagcaggttga

SEQ ID NO: 7522523 - DNA, 22 bp, Homo sapiens
ctgtgtgtgaacacagcccagc

SEQ ID NO: 7522524 - DNA, 22 bp, Homo sapiens
ctgtgtgtgaacacagcccagc

SEQ ID NO: 7522525 - DNA, 23 bp, Homo sapiens
ctgtgtgtgccgagggtggccac

SEQ ID NO: 7522526 - DNA, 23 bp, Homo sapiens
ctgtgtgtgccgagggtggccac

SEQ ID NO: 7522527 - DNA, 23 bp, Homo sapiens
ctgtgtgtgccgagggtggccac

SEQ ID NO: 7522528 - DNA, 23 bp, Homo sapiens
ctgtgtgtgccgagggtggccac

SEQ ID NO: 7522529 - DNA, 23 bp, Homo sapiens
ctgtgtgtgccgagggtggccac

SEQ ID NO: 7522530 - DNA, 22 bp, Homo sapiens
ctgtgtgtgagaagcaggttga

SEQ ID NO: 7522531 - DNA, 22 bp, Homo sapiens
ctgtgtgtgagaagcaggttga

SEQ ID NO: 7522532 - DNA, 23 bp, Homo sapiens
ctgtgtgtgccgagggtggccac

SEQ ID NO: 7522533 - DNA, 22 bp, Homo sapiens
ctgtgtgtgctacaggcttcca

SEQ ID NO: 7522534 - DNA, 22 bp, Homo sapiens
ctgtgtgtgctacaggcttcca

SEQ ID NO: 7522535 - DNA, 22 bp, Homo sapiens
ctgtgtgtgctacaggcttcca

SEQ ID NO: 7522536 - DNA, 22 bp, Homo sapiens
ctgtgtgtgctacaggcttcca

SEQ ID NO: 7522537 - DNA, 22 bp, Homo sapiens
ctgtgtgtgctacaggcttcca

SEQ ID NO: 7522538 - DNA, 22 bp, Homo sapiens
ctgtgtgtgctacaggcttcca

SEQ ID NO: 7522539 - DNA, 22 bp, Homo sapiens
ctgtgtgtgtctgcagcatact

SEQ ID NO: 7522540 - DNA, 22 bp, Homo sapiens
ctgtgtgtgtctgcagcatact

SEQ ID NO: 7522541 - DNA, 22 bp, Homo sapiens
ctgtgtgtgtctgcagcatact

SEQ ID NO: 7522542 - DNA, 22 bp, Homo sapiens
ctgtgtgtgtctgcagcatact

SEQ ID NO: 7522543 - DNA, 22 bp, Homo sapiens
ctgtgtgtgtctgcagcatact

SEQ ID NO: 7522544 - DNA, 22 bp, Homo sapiens
ctgtgtgtttatatcatttcct

SEQ ID NO: 7522545 - DNA, 22 bp, Homo sapiens
ctgtgttcagtgctactgagtt

SEQ ID NO: 7522546 - DNA, 22 bp, Homo sapiens
ctgtgtgtttatatcatttcct

SEQ ID NO: 7522547 - DNA, 22 bp, Homo sapiens
ctgtgtgtttatatcatttcct

SEQ ID NO: 7522548 - DNA, 22 bp, Homo sapiens
ctgtgtgtttatatcatttcct

SEQ ID NO: 7522549 - DNA, 22 bp, Homo sapiens
ctgtgtgtgtctgcagcatact

SEQ ID NO: 7522550 - DNA, 22 bp, Homo sapiens
ctgtgtttctcttgacccaagt

SEQ ID NO: 7522551 - DNA, 22 bp, Homo sapiens
ctgtgtttctgagaagtgggga

SEQ ID NO: 7522552 - DNA, 22 bp, Homo sapiens
ctgtgtttctcttgacccaagt

SEQ ID NO: 7522553 - DNA, 22 bp, Homo sapiens
ctgtgtttctaagtaaaggagc

SEQ ID NO: 7522554 - DNA, 22 bp, Homo sapiens
ctgtgtttctaagtaaaggagc

SEQ ID NO: 7522555 - DNA, 22 bp, Homo sapiens
ctgtgttctccaggggcagctg

SEQ ID NO: 7522556 - DNA, 22 bp, Homo sapiens
ctgtgttggcttttctcttgta

SEQ ID NO: 7522557 - DNA, 22 bp, Homo sapiens
ctgtgttcccctgctgctgagg

SEQ ID NO: 7522558 - DNA, 22 bp, Homo sapiens
ctgtgttcccctgctgctgagg

SEQ ID NO: 7522559 - DNA, 22 bp, Homo sapiens
ctgtgttcccctgctgctgagg

SEQ ID NO: 7522560 - DNA, 22 bp, Homo sapiens
ctgtgttcccctgctgctgagg

SEQ ID NO: 7522561 - DNA, 22 bp, Homo sapiens
ctgtgtttttggtctgatctat

SEQ ID NO: 7522562 - DNA, 22 bp, Homo sapiens
ctgtgttttgattaaaaagcaa

SEQ ID NO: 7522563 - DNA, 22 bp, Homo sapiens
ctgtgtttggacaacttttcag

SEQ ID NO: 7522564 - DNA, 22 bp, Homo sapiens
ctgtgttttgagatattattaa

SEQ ID NO: 7522565 - DNA, 22 bp, Homo sapiens
ctgtgtttggacaacttttcag

SEQ ID NO: 7522566 - DNA, 22 bp, Homo sapiens
ctgtgttttgattaaaaagcaa

SEQ ID NO: 7522567 - DNA, 22 bp, Homo sapiens
ctgtgttttgagatattattaa

SEQ ID NO: 7522568 - DNA, 22 bp, Homo sapiens
ctgtgtttggacaacttttcag

SEQ ID NO: 7522569 - DNA, 22 bp, Homo sapiens
ctgtgtttgctatgcaaagaca

SEQ ID NO: 7522570 - DNA, 22 bp, Homo sapiens
ctgtgtttgctatgcaaagaca

SEQ ID NO: 7522571 - DNA, 22 bp, Homo sapiens
ctgtgtttgctatgcaaagaca

SEQ ID NO: 7522572 - DNA, 22 bp, Homo sapiens
ctgtgtttgctatgcaaagaca

SEQ ID NO: 7522573 - DNA, 22 bp, Homo sapiens
ctgtgtttgatgagaagccacc

SEQ ID NO: 7522574 - DNA, 22 bp, Homo sapiens
ctgtgtttgatgagaagccacc

SEQ ID NO: 7522575 - DNA, 22 bp, Homo sapiens
ctgtgtttgacaggcggtctcc

SEQ ID NO: 7522576 - DNA, 22 bp, Homo sapiens
ctgtgtttgatgagaagccacc

SEQ ID NO: 7522577 - DNA, 22 bp, Homo sapiens
ctgtggatttaggcagagctga

SEQ ID NO: 7522578 - DNA, 22 bp, Homo sapiens
ctgtggagtttgtggcgctgac

SEQ ID NO: 7522579 - DNA, 22 bp, Homo sapiens
ctgtggagtttgtggcgctgac

SEQ ID NO: 7522580 - DNA, 22 bp, Homo sapiens
ctgtggagtttgtggcgctgac

SEQ ID NO: 7522581 - DNA, 22 bp, Homo sapiens
ctgtggagtttgtggcgctgac

SEQ ID NO: 7522582 - DNA, 22 bp, Homo sapiens
ctgtggagtttgtggcgctgac

SEQ ID NO: 7522583 - DNA, 22 bp, Homo sapiens
ctgtggagtttgtggcgctgac

SEQ ID NO: 7522584 - DNA, 22 bp, Homo sapiens
ctgtggagtttgtggcgctgac

SEQ ID NO: 7522585 - DNA, 22 bp, Homo sapiens
ctgtggagtttgtggcgctgac

SEQ ID NO: 7522586 - DNA, 23 bp, Homo sapiens
ctgtggcaagtcctgcacctgcc

SEQ ID NO: 7522587 - DNA, 23 bp, Homo sapiens
ctgtggcaagtcctgcacctgcc

SEQ ID NO: 7522588 - DNA, 22 bp, Homo sapiens
ctgtggatcagtttggaaactt

SEQ ID NO: 7522589 - DNA, 22 bp, Homo sapiens
ctgtggatttaggcagagctga

SEQ ID NO: 7522590 - DNA, 22 bp, Homo sapiens
ctgtggcaaatgatacctccca

SEQ ID NO: 7522591 - DNA, 23 bp, Homo sapiens
ctgtggcaagtcctgcacctgcc

SEQ ID NO: 7522592 - DNA, 23 bp, Homo sapiens
ctgtggcaagtcctgcacctgcc

SEQ ID NO: 7522593 - DNA, 22 bp, Homo sapiens
ctgtggcaaatgatacctccca

SEQ ID NO: 7522594 - DNA, 22 bp, Homo sapiens
ctgtggcacatgtggcaaggcc

SEQ ID NO: 7522595 - DNA, 22 bp, Homo sapiens
ctgtggcacatgtggcaaggcc

SEQ ID NO: 7522596 - DNA, 22 bp, Homo sapiens
ctgtggcaagtctgcctgtcac

SEQ ID NO: 7522597 - DNA, 22 bp, Homo sapiens
ctgtggcaagtctgcctgtcac

SEQ ID NO: 7522598 - DNA, 22 bp, Homo sapiens
ctgtggcaagtctgcctgtcac

SEQ ID NO: 7522599 - DNA, 22 bp, Homo sapiens
ctgtggcaagtctgcctgtcac

SEQ ID NO: 7522600 - DNA, 22 bp, Homo sapiens
ctgtggcaccaatacatttttc

SEQ ID NO: 7522601 - DNA, 22 bp, Homo sapiens
ctgtggcactcaagaagcctcc

SEQ ID NO: 7522602 - DNA, 22 bp, Homo sapiens
ctgtggcacatgtggcaaggcc

SEQ ID NO: 7522603 - DNA, 22 bp, Homo sapiens
ctgtggcacatgtggcaaggcc

SEQ ID NO: 7522604 - DNA, 22 bp, Homo sapiens
ctgtggcagaggtgacacctct

SEQ ID NO: 7522605 - DNA, 22 bp, Homo sapiens
ctgtggcagaggtgacacctct

SEQ ID NO: 7522606 - DNA, 22 bp, Homo sapiens
ctgtggcagaggtgacacctct

SEQ ID NO: 7522607 - DNA, 22 bp, Homo sapiens
ctgtggcactcaagaagcctcc

SEQ ID NO: 7522608 - DNA, 22 bp, Homo sapiens
ctgtggcaggaagggactagca

SEQ ID NO: 7522609 - DNA, 22 bp, Homo sapiens
ctgtggcagaggtgacacctct

SEQ ID NO: 7522610 - DNA, 22 bp, Homo sapiens
ctgtggcaggaagggactagca

SEQ ID NO: 7522611 - DNA, 22 bp, Homo sapiens
ctgtggcaggaagggactagca

SEQ ID NO: 7522612 - DNA, 20 bp, Homo sapiens
ctgtggcatctgtcatggtg

SEQ ID NO: 7522613 - DNA, 20 bp, Homo sapiens
ctgtggcatctgtcatggtg

SEQ ID NO: 7522614 - DNA, 22 bp, Homo sapiens
ctgtggcattgccgaggctggc

SEQ ID NO: 7522615 - DNA, 22 bp, Homo sapiens
ctgtggcattgccgaggctggc

SEQ ID NO: 7522616 - DNA, 22 bp, Homo sapiens
ctgtggcattgccgaggctggc

SEQ ID NO: 7522617 - DNA, 22 bp, Homo sapiens
ctgtggcattgccgaggctggc

SEQ ID NO: 7522618 - DNA, 22 bp, Homo sapiens
ctgtggcattgccgaggctggc

SEQ ID NO: 7522619 - DNA, 22 bp, Homo sapiens
ctgtggcattgccgaggctggc

SEQ ID NO: 7522620 - DNA, 22 bp, Homo sapiens
ctgtggcattgccgaggctggc

SEQ ID NO: 7522621 - DNA, 22 bp, Homo sapiens
ctgtggcattaataaaagtgca

SEQ ID NO: 7522622 - DNA, 22 bp, Homo sapiens
ctgtggcattgtgaggactgca

SEQ ID NO: 7522623 - DNA, 22 bp, Homo sapiens
ctgtggcattgtgaggactgca

SEQ ID NO: 7522624 - DNA, 22 bp, Homo sapiens
ctgtggcattgtgaggactgca

SEQ ID NO: 7522625 - DNA, 22 bp, Homo sapiens
ctgtggcattgtgaggactgca

SEQ ID NO: 7522626 - DNA, 22 bp, Homo sapiens
ctgtggcattgtgaggactgca

SEQ ID NO: 7522627 - DNA, 22 bp, Homo sapiens
ctgtggcattgccgaggctggc

SEQ ID NO: 7522628 - DNA, 22 bp, Homo sapiens
ctgtggcattgccgaggctggc

SEQ ID NO: 7522629 - DNA, 22 bp, Homo sapiens
ctgtggcattgccgaggctggc

SEQ ID NO: 7522630 - DNA, 22 bp, Homo sapiens
ctgtggcattgccgaggctggc

SEQ ID NO: 7522631 - DNA, 22 bp, Homo sapiens
ctgtggcaggaagggactagca

SEQ ID NO: 7522632 - DNA, 22 bp, Homo sapiens
ctgtggcagggaagaggccatg

SEQ ID NO: 7522633 - DNA, 22 bp, Homo sapiens
ctgtggcagggaagaggccatg

SEQ ID NO: 7522634 - DNA, 22 bp, Homo sapiens
ctgtggcagggaagaggccatg

SEQ ID NO: 7522635 - DNA, 22 bp, Homo sapiens
ctgtggcagggaagaggccatg

SEQ ID NO: 7522636 - DNA, 22 bp, Homo sapiens
ctgtggcaggtgtctggggcag

SEQ ID NO: 7522637 - DNA, 22 bp, Homo sapiens
ctgtggcaggtgtctggggcag

SEQ ID NO: 7522638 - DNA, 22 bp, Homo sapiens
ctgtggcaggtgtctggggcag

SEQ ID NO: 7522639 - DNA, 22 bp, Homo sapiens
ctgtggcagggaagaggccatg

SEQ ID NO: 7522640 - DNA, 22 bp, Homo sapiens
ctgtggcagggaagaggccatg

SEQ ID NO: 7522641 - DNA, 22 bp, Homo sapiens
ctgtggcaggtgtctggggcag

SEQ ID NO: 7522642 - DNA, 20 bp, Homo sapiens
ctgtggcatctgtcatggtg

SEQ ID NO: 7522643 - DNA, 20 bp, Homo sapiens
ctgtggcatctgtcatggtg

SEQ ID NO: 7522644 - DNA, 22 bp, Homo sapiens
ctgtggcaggtgtctggggcag

SEQ ID NO: 7522645 - DNA, 22 bp, Homo sapiens
ctgtggcaggtgtctggggcag

SEQ ID NO: 7522646 - DNA, 22 bp, Homo sapiens
ctgtggcaggtgtctggggcag

SEQ ID NO: 7522647 - DNA, 20 bp, Homo sapiens
ctgtggcatctgtcatggtg

SEQ ID NO: 7522648 - DNA, 20 bp, Homo sapiens
ctgtggcatctgtcatggtg

SEQ ID NO: 7522649 - DNA, 20 bp, Homo sapiens
ctgtggcatctgtcatggtg

SEQ ID NO: 7522650 - DNA, 19 bp, Homo sapiens
ctgtgggcggaggaggggc

SEQ ID NO: 7522651 - DNA, 22 bp, Homo sapiens
ctgtgggctcccagcttctctc

SEQ ID NO: 7522652 - DNA, 22 bp, Homo sapiens
ctgtgggctcctgcagctcagg

SEQ ID NO: 7522653 - DNA, 22 bp, Homo sapiens
ctgtgggctcccagcttctctc

SEQ ID NO: 7522654 - DNA, 22 bp, Homo sapiens
ctgtgggctcccagcttctctc

SEQ ID NO: 7522655 - DNA, 22 bp, Homo sapiens
ctgtgggctcccagcttctctc

SEQ ID NO: 7522656 - DNA, 22 bp, Homo sapiens
ctgtgggcgcctgtcagcctca

SEQ ID NO: 7522657 - DNA, 22 bp, Homo sapiens
ctgtgggcgcctgtcagcctca

SEQ ID NO: 7522658 - DNA, 22 bp, Homo sapiens
ctgtgggcgcctgtcagcctca

SEQ ID NO: 7522659 - DNA, 22 bp, Homo sapiens
ctgtgggcgcctgtcagcctca

SEQ ID NO: 7522660 - DNA, 22 bp, Homo sapiens
ctgtgggcgcctgtcagcctca

SEQ ID NO: 7522661 - DNA, 20 bp, Homo sapiens
ctgtgggcctcacttggggt

SEQ ID NO: 7522662 - DNA, 20 bp, Homo sapiens
ctgtgggcctcacttggggt

SEQ ID NO: 7522663 - DNA, 22 bp, Homo sapiens
ctgtgggcctgatgttcttctc

SEQ ID NO: 7522664 - DNA, 22 bp, Homo sapiens
ctgtgggcctgatgttcttctc

SEQ ID NO: 7522665 - DNA, 22 bp, Homo sapiens
ctgtgggcctagtctggcctag

SEQ ID NO: 7522666 - DNA, 22 bp, Homo sapiens
ctgtgggcctagtctggcctag

SEQ ID NO: 7522667 - DNA, 22 bp, Homo sapiens
ctgtgggcctagtctggcctag

SEQ ID NO: 7522668 - DNA, 22 bp, Homo sapiens
ctgtgggcatttgagtgtgggt

SEQ ID NO: 7522669 - DNA, 22 bp, Homo sapiens
ctgtgggcatttgagtgtgggt

SEQ ID NO: 7522670 - DNA, 22 bp, Homo sapiens
ctgtgggcctagtctggcctag

SEQ ID NO: 7522671 - DNA, 22 bp, Homo sapiens
ctgtgggatgggacctcagctg

SEQ ID NO: 7522672 - DNA, 22 bp, Homo sapiens
ctgtgggcatttgagtgtgggt

SEQ ID NO: 7522673 - DNA, 22 bp, Homo sapiens
ctgtgggcagctcctcctgtca

SEQ ID NO: 7522674 - DNA, 22 bp, Homo sapiens
ctgtgggcagctcctcctgtca

SEQ ID NO: 7522675 - DNA, 22 bp, Homo sapiens
ctgtgggcagctcctcctgtca

SEQ ID NO: 7522676 - DNA, 22 bp, Homo sapiens
ctgtggctttctctgcctcctt

SEQ ID NO: 7522677 - DNA, 22 bp, Homo sapiens
ctgtgggagcactggggaccga

SEQ ID NO: 7522678 - DNA, 22 bp, Homo sapiens
ctgtgggagcactggggaccga

SEQ ID NO: 7522679 - DNA, 22 bp, Homo sapiens
ctgtgggagcactggggaccga

SEQ ID NO: 7522680 - DNA, 22 bp, Homo sapiens
ctgtgggagggtgagagaacca

SEQ ID NO: 7522681 - DNA, 22 bp, Homo sapiens
ctgtgggagggaaggcgcggcc

SEQ ID NO: 7522682 - DNA, 22 bp, Homo sapiens
ctgtgggagggaaggcgcggcc

SEQ ID NO: 7522683 - DNA, 22 bp, Homo sapiens
ctgtgggagggaaggcgcggcc

SEQ ID NO: 7522684 - DNA, 22 bp, Homo sapiens
ctgtgggagggaaggcgcggcc

SEQ ID NO: 7522685 - DNA, 22 bp, Homo sapiens
ctgtgggagggaaggcgcggcc

SEQ ID NO: 7522686 - DNA, 22 bp, Homo sapiens
ctgtgggagcagcaccaaggac

SEQ ID NO: 7522687 - DNA, 23 bp, Homo sapiens
ctgtggccacccctagctggagg

SEQ ID NO: 7522688 - DNA, 23 bp, Homo sapiens
ctgtggccacccctagctggagg

SEQ ID NO: 7522689 - DNA, 23 bp, Homo sapiens
ctgtggccacccctagctggagg

SEQ ID NO: 7522690 - DNA, 22 bp, Homo sapiens
ctgtggcttcagcattcagagc

SEQ ID NO: 7522691 - DNA, 17 bp, Homo sapiens
ctgtggccacctggatg

SEQ ID NO: 7522692 - DNA, 17 bp, Homo sapiens
ctgtggccacctggatg

SEQ ID NO: 7522693 - DNA, 22 bp, Homo sapiens
ctgtggcatttagaggttgcgt

SEQ ID NO: 7522694 - DNA, 22 bp, Homo sapiens
ctgtggcattgtgaggactgca

SEQ ID NO: 7522695 - DNA, 22 bp, Homo sapiens
ctgtggcatttagaggttgcgt

SEQ ID NO: 7522696 - DNA, 23 bp, Homo sapiens
ctgtggccacccctagctggagg

SEQ ID NO: 7522697 - DNA, 22 bp, Homo sapiens
ctgtggcttctgggtcagttca

SEQ ID NO: 7522698 - DNA, 22 bp, Homo sapiens
ctgtggctttctctgcctcctt

SEQ ID NO: 7522699 - DNA, 22 bp, Homo sapiens
ctgtggcttctgggtcagttca

SEQ ID NO: 7522700 - DNA, 22 bp, Homo sapiens
ctgtggcttctgggtcagttca

SEQ ID NO: 7522701 - DNA, 22 bp, Homo sapiens
ctgtggcttctgcttgggcctc

SEQ ID NO: 7522702 - DNA, 22 bp, Homo sapiens
ctgtggcttctaggtccccgat

SEQ ID NO: 7522703 - DNA, 22 bp, Homo sapiens
ctgtcccatccttactctaccc

SEQ ID NO: 7522704 - DNA, 22 bp, Homo sapiens
ctgtccccacccaaatctcatc

SEQ ID NO: 7522705 - DNA, 22 bp, Homo sapiens
ctgtccccacccaaatctcatc

SEQ ID NO: 7522706 - DNA, 21 bp, Homo sapiens
ctgtccccagtgagcaccccc

SEQ ID NO: 7522707 - DNA, 22 bp, Homo sapiens
ctgtccccattgtttgagggtt

SEQ ID NO: 7522708 - DNA, 21 bp, Homo sapiens
ctgtccccagtgagcaccccc

SEQ ID NO: 7522709 - DNA, 21 bp, Homo sapiens
ctgtccccagtgagcaccccc

SEQ ID NO: 7522710 - DNA, 21 bp, Homo sapiens
ctgtccccagtgagcaccccc

SEQ ID NO: 7522711 - DNA, 22 bp, Homo sapiens
ctgtcccagtgatcctgagtgc

SEQ ID NO: 7522712 - DNA, 22 bp, Homo sapiens
ctgtcccaggatcctgactcca

SEQ ID NO: 7522713 - DNA, 22 bp, Homo sapiens
ctgtcccaggatcctgactcca

SEQ ID NO: 7522714 - DNA, 18 bp, Homo sapiens
ctgtcccatcctcaggtt

SEQ ID NO: 7522715 - DNA, 22 bp, Homo sapiens
ctgtcccatactatctgggtga

SEQ ID NO: 7522716 - DNA, 22 bp, Homo sapiens
ctgtcccatccttactctaccc

SEQ ID NO: 7522717 - DNA, 18 bp, Homo sapiens
ctgtcccatcctcaggtt

SEQ ID NO: 7522718 - DNA, 22 bp, Homo sapiens
ctgtccctcagttctgggcaaa

SEQ ID NO: 7522719 - DNA, 22 bp, Homo sapiens
ctgtccctcagttctgggcaaa

SEQ ID NO: 7522720 - DNA, 22 bp, Homo sapiens
ctgtccctcagttctgggcaaa

SEQ ID NO: 7522721 - DNA, 22 bp, Homo sapiens
ctgtcccctgtgctttcacttg

SEQ ID NO: 7522722 - DNA, 22 bp, Homo sapiens
ctgtcccctgtgctttcacttg

SEQ ID NO: 7522723 - DNA, 22 bp, Homo sapiens
ctgtcccctgtgctttcacttg

SEQ ID NO: 7522724 - DNA, 22 bp, Homo sapiens
ctgtccccgcgagtccagagct

SEQ ID NO: 7522725 - DNA, 22 bp, Homo sapiens
ctgtccccgcgagtccagagct

SEQ ID NO: 7522726 - DNA, 22 bp, Homo sapiens
ctgtccccgcgagtccagagct

SEQ ID NO: 7522727 - DNA, 22 bp, Homo sapiens
ctgtccccgcgagtccagagct

SEQ ID NO: 7522728 - DNA, 22 bp, Homo sapiens
ctgtccccgcgagtccagagct

SEQ ID NO: 7522729 - DNA, 20 bp, Homo sapiens
ctgtccccgaggtcaccagg

SEQ ID NO: 7522730 - DNA, 20 bp, Homo sapiens
ctgtccccgaggtcaccagg

SEQ ID NO: 7522731 - DNA, 22 bp, Homo sapiens
ctgtcccaggagctgtaagaca

SEQ ID NO: 7522732 - DNA, 22 bp, Homo sapiens
ctgtcccagccccgtactctaa

SEQ ID NO: 7522733 - DNA, 22 bp, Homo sapiens
ctgtcccagatgttctcagcac

SEQ ID NO: 7522734 - DNA, 22 bp, Homo sapiens
ctgtcccaggatcctgactcca

SEQ ID NO: 7522735 - DNA, 22 bp, Homo sapiens
ctgtcccaggatcctgactcca

SEQ ID NO: 7522736 - DNA, 22 bp, Homo sapiens
ctgtcccaggatcctgactcca

SEQ ID NO: 7522737 - DNA, 22 bp, Homo sapiens
ctgtcccaggagctgtaagaca

SEQ ID NO: 7522738 - DNA, 22 bp, Homo sapiens
ctgtcccaggagctgtaagaca

SEQ ID NO: 7522739 - DNA, 22 bp, Homo sapiens
ctgtcccaggatcctgactcca

SEQ ID NO: 7522740 - DNA, 19 bp, Homo sapiens
ctgtcccagactctgctct

SEQ ID NO: 7522741 - DNA, 19 bp, Homo sapiens
ctgtcccagactctgctct

SEQ ID NO: 7522742 - DNA, 19 bp, Homo sapiens
ctgtcccagactctgctct

SEQ ID NO: 7522743 - DNA, 19 bp, Homo sapiens
ctgtcccagactctgctct

SEQ ID NO: 7522744 - DNA, 22 bp, Homo sapiens
ctgtcccagatgttctcagcac

SEQ ID NO: 7522745 - DNA, 22 bp, Homo sapiens
ctgtcccagatgttctcagcac

SEQ ID NO: 7522746 - DNA, 22 bp, Homo sapiens
ctgtcccagatgttctcagcac

SEQ ID NO: 7522747 - DNA, 22 bp, Homo sapiens
ctgtcccagatgttctcagcac

SEQ ID NO: 7522748 - DNA, 22 bp, Homo sapiens
ctgtccatggtgctggacggtc

SEQ ID NO: 7522749 - DNA, 22 bp, Homo sapiens
ctgtccatggtgctggacggtc

SEQ ID NO: 7522750 - DNA, 22 bp, Homo sapiens
ctgtccatggcaatgatgcaga

SEQ ID NO: 7522751 - DNA, 22 bp, Homo sapiens
ctgtccatggcaatgatgcaga

SEQ ID NO: 7522752 - DNA, 22 bp, Homo sapiens
ctgtccatggtccttattacca

SEQ ID NO: 7522753 - DNA, 22 bp, Homo sapiens
ctgtccatggtccttattacca

SEQ ID NO: 7522754 - DNA, 22 bp, Homo sapiens
ctgtccatgcatgttgtctgct

SEQ ID NO: 7522755 - DNA, 22 bp, Homo sapiens
ctgtccatcagaaaggggctta

SEQ ID NO: 7522756 - DNA, 22 bp, Homo sapiens
ctgtccatgacttgcactataa

SEQ ID NO: 7522757 - DNA, 22 bp, Homo sapiens
ctgtccatgacttgcactataa

SEQ ID NO: 7522758 - DNA, 22 bp, Homo sapiens
ctgtccatgcatgttgtctgct

SEQ ID NO: 7522759 - DNA, 22 bp, Homo sapiens
ctgtccatattcaaggggtagg

SEQ ID NO: 7522760 - DNA, 22 bp, Homo sapiens
ctgtccagtgcagagaacagag

SEQ ID NO: 7522761 - DNA, 22 bp, Homo sapiens
ctgtccagtgcagagaacagag

SEQ ID NO: 7522762 - DNA, 22 bp, Homo sapiens
ctgtccatattcaaggggtagg

SEQ ID NO: 7522763 - DNA, 20 bp, Homo sapiens
ctgtccatatttgaaaatgc

SEQ ID NO: 7522764 - DNA, 22 bp, Homo sapiens
ctgtccatattcaaggggtagg

SEQ ID NO: 7522765 - DNA, 20 bp, Homo sapiens
ctgtccatatttgaaaatgc

SEQ ID NO: 7522766 - DNA, 22 bp, Homo sapiens
ctgtccatcagaaaggggctta

SEQ ID NO: 7522767 - DNA, 22 bp, Homo sapiens
ctgtccattttgaattttcagt

SEQ ID NO: 7522768 - DNA, 22 bp, Homo sapiens
ctgtccattttcgtgcctcctt

SEQ ID NO: 7522769 - DNA, 22 bp, Homo sapiens
ctgtccattttcgtgcctcctt

SEQ ID NO: 7522770 - DNA, 22 bp, Homo sapiens
ctgtccattggtatattagggt

SEQ ID NO: 7522771 - DNA, 22 bp, Homo sapiens
ctgtccattggtatattagggt

SEQ ID NO: 7522772 - DNA, 22 bp, Homo sapiens
ctgtccattttcgtgcctcctt

SEQ ID NO: 7522773 - DNA, 22 bp, Homo sapiens
ctgtccatggtgctggacggtc

SEQ ID NO: 7522774 - DNA, 22 bp, Homo sapiens
ctgtccatgttaagccccttgc

SEQ ID NO: 7522775 - DNA, 22 bp, Homo sapiens
ctgtccatggtgctggacggtc

SEQ ID NO: 7522776 - DNA, 22 bp, Homo sapiens
ctgtccatgttaagccccttgc

SEQ ID NO: 7522777 - DNA, 19 bp, Homo sapiens
ctgtcccagactctgctct

SEQ ID NO: 7522778 - DNA, 19 bp, Homo sapiens
ctgtcccagactctgctct

SEQ ID NO: 7522779 - DNA, 22 bp, Homo sapiens
ctgtcccacaagcagtgtgcac

SEQ ID NO: 7522780 - DNA, 22 bp, Homo sapiens
ctgtccattttgaattttcagt

SEQ ID NO: 7522781 - DNA, 22 bp, Homo sapiens
ctgtcccacaagcagtgtgcac

SEQ ID NO: 7522782 - DNA, 22 bp, Homo sapiens
ctgtcccacaagcagtgtgcac

SEQ ID NO: 7522783 - DNA, 22 bp, Homo sapiens
ctggttctgatgttcttggctt

SEQ ID NO: 7522784 - DNA, 22 bp, Homo sapiens
ctggttctgatgttcttggctt

SEQ ID NO: 7522785 - DNA, 22 bp, Homo sapiens
ctggttcctccatcagcaggaa

SEQ ID NO: 7522786 - DNA, 22 bp, Homo sapiens
ctggttcctccatcagcaggaa

SEQ ID NO: 7522787 - DNA, 22 bp, Homo sapiens
ctggttctgattttgctgcatt

SEQ ID NO: 7522788 - DNA, 22 bp, Homo sapiens
ctggttggaagtgcagactctc

SEQ ID NO: 7522789 - DNA, 22 bp, Homo sapiens
ctggttctgattttgctgcatt

SEQ ID NO: 7522790 - DNA, 22 bp, Homo sapiens
ctggttggaagtgcagactctc

SEQ ID NO: 7522791 - DNA, 22 bp, Homo sapiens
ctggttcaatactaaacttctt

SEQ ID NO: 7522792 - DNA, 22 bp, Homo sapiens
ctggttcagtgaaaggcatggg

SEQ ID NO: 7522793 - DNA, 22 bp, Homo sapiens
ctggttcaatggggctgagccc

SEQ ID NO: 7522794 - DNA, 22 bp, Homo sapiens
ctggttcagtgaaaggcatggg

SEQ ID NO: 7522795 - DNA, 23 bp, Homo sapiens
ctggttcatagtcaagagattga

SEQ ID NO: 7522796 - DNA, 22 bp, Homo sapiens
ctggttcatataggcaagttta

SEQ ID NO: 7522797 - DNA, 22 bp, Homo sapiens
ctggttcccagcaggagtgtag

SEQ ID NO: 7522798 - DNA, 22 bp, Homo sapiens
ctggttcatggtggaatgacat

SEQ ID NO: 7522799 - DNA, 22 bp, Homo sapiens
ctggttcatccccttccaggaa

SEQ ID NO: 7522800 - DNA, 22 bp, Homo sapiens
ctggttcatccccttccaggaa

SEQ ID NO: 7522801 - DNA, 22 bp, Homo sapiens
ctggtttagctgtaaggttccc

SEQ ID NO: 7522802 - DNA, 22 bp, Homo sapiens
ctggttgggaggttggctttca

SEQ ID NO: 7522803 - DNA, 22 bp, Homo sapiens
ctggttggaagtgcagactctc

SEQ ID NO: 7522804 - DNA, 22 bp, Homo sapiens
ctggtttacccaagatttgctg

SEQ ID NO: 7522805 - DNA, 22 bp, Homo sapiens
ctggtttacccaagatttgctg

SEQ ID NO: 7522806 - DNA, 22 bp, Homo sapiens
ctggtttagctgtaaggttccc

SEQ ID NO: 7522807 - DNA, 22 bp, Homo sapiens
ctgtcattgagcctgtcagggc

SEQ ID NO: 7522808 - DNA, 22 bp, Homo sapiens
ctgtccagtgcagagaacagag

SEQ ID NO: 7522809 - DNA, 22 bp, Homo sapiens
ctgtccagtgcagagaacagag

SEQ ID NO: 7522810 - DNA, 22 bp, Homo sapiens
ctgtcattcttacataatgtga

SEQ ID NO: 7522811 - DNA, 22 bp, Homo sapiens
ctgtcatggtcagattgtcatc

SEQ ID NO: 7522812 - DNA, 22 bp, Homo sapiens
ctgtcattcttacataatgtga

SEQ ID NO: 7522813 - DNA, 22 bp, Homo sapiens
ctgtcagttcttccagatagag

SEQ ID NO: 7522814 - DNA, 22 bp, Homo sapiens
ctgtcatcacagttgagcagcc

SEQ ID NO: 7522815 - DNA, 22 bp, Homo sapiens
ctggttttgtcagaagctttat

SEQ ID NO: 7522816 - DNA, 22 bp, Homo sapiens
ctggttttgtcagaagctttat

SEQ ID NO: 7522817 - DNA, 22 bp, Homo sapiens
ctggttttgtcagaagctttat

SEQ ID NO: 7522818 - DNA, 22 bp, Homo sapiens
ctggtttttagtgcttaggagt

SEQ ID NO: 7522819 - DNA, 22 bp, Homo sapiens
ctgtcagttctatctttgtgct

SEQ ID NO: 7522820 - DNA, 22 bp, Homo sapiens
ctggttttccaatgttttgact

SEQ ID NO: 7522821 - DNA, 22 bp, Homo sapiens
ctggttttgaaaacgcaagctg

SEQ ID NO: 7522822 - DNA, 22 bp, Homo sapiens
ctggttttctagtccactggct

SEQ ID NO: 7522823 - DNA, 22 bp, Homo sapiens
ctggttttggctggcaaggttg

SEQ ID NO: 7522824 - DNA, 22 bp, Homo sapiens
ctggttttggctggcaaggttg

SEQ ID NO: 7522825 - DNA, 22 bp, Homo sapiens
ctggttttggctggcaaggttg

SEQ ID NO: 7522826 - DNA, 22 bp, Homo sapiens
ctggttttgaaaacgcaagctg

SEQ ID NO: 7522827 - DNA, 22 bp, Homo sapiens
ctggttttgaatatgtctgctt

SEQ ID NO: 7522828 - DNA, 22 bp, Homo sapiens
ctggtttgtcttgggaggatgt

SEQ ID NO: 7522829 - DNA, 22 bp, Homo sapiens
ctggtttgcccacaccagccac

SEQ ID NO: 7522830 - DNA, 22 bp, Homo sapiens
ctggtttgcccacaccagccac

SEQ ID NO: 7522831 - DNA, 22 bp, Homo sapiens
ctggttttaatgttatgtttat

SEQ ID NO: 7522832 - DNA, 22 bp, Homo sapiens
ctggttttatgttatagatgga

SEQ ID NO: 7522833 - DNA, 22 bp, Homo sapiens
ctggttttaatgttatgtttat

SEQ ID NO: 7522834 - DNA, 22 bp, Homo sapiens
ctggttttatgttatagatgga

SEQ ID NO: 7522835 - DNA, 22 bp, Homo sapiens
ctggttttatgttatagatgga

SEQ ID NO: 7522836 - DNA, 22 bp, Homo sapiens
ctggttttaatgttatgtttat

SEQ ID NO: 7522837 - DNA, 22 bp, Homo sapiens
ctgtgacagtttctcagacttt

SEQ ID NO: 7522838 - DNA, 22 bp, Homo sapiens
ctgtgacagtttctcagacttt

SEQ ID NO: 7522839 - DNA, 22 bp, Homo sapiens
ctgtgacagtttctcagaattt

SEQ ID NO: 7522840 - DNA, 20 bp, Homo sapiens
ctgtgaccagagacccagga

SEQ ID NO: 7522841 - DNA, 22 bp, Homo sapiens
ctgtgacctccaggaaggggtg

SEQ ID NO: 7522842 - DNA, 22 bp, Homo sapiens
ctgtgacccagttcctggcacc

SEQ ID NO: 7522843 - DNA, 22 bp, Homo sapiens
ctgtgacccagttcctggcacc

SEQ ID NO: 7522844 - DNA, 22 bp, Homo sapiens
ctgtgacagtttctcagaattt

SEQ ID NO: 7522845 - DNA, 22 bp, Homo sapiens
ctgtgacagtttctcagaattt

SEQ ID NO: 7522846 - DNA, 22 bp, Homo sapiens
ctgtgacagggatcagaatgca

SEQ ID NO: 7522847 - DNA, 22 bp, Homo sapiens
ctgtgacagagcttgagtgaga

SEQ ID NO: 7522848 - DNA, 22 bp, Homo sapiens
ctgtgacagagcttgagtgaga

SEQ ID NO: 7522849 - DNA, 22 bp, Homo sapiens
ctgtgaatttaaagcacacatc

SEQ ID NO: 7522850 - DNA, 22 bp, Homo sapiens
ctgtgaattttccaatattccg

SEQ ID NO: 7522851 - DNA, 22 bp, Homo sapiens
ctgtgacagagcttgagtgaga

SEQ ID NO: 7522852 - DNA, 22 bp, Homo sapiens
ctgtgacagagcttgagtgaga

SEQ ID NO: 7522853 - DNA, 22 bp, Homo sapiens
ctgtgaatgttatatctcaatg

SEQ ID NO: 7522854 - DNA, 22 bp, Homo sapiens
ctgtgaatgttatatctcaatg

SEQ ID NO: 7522855 - DNA, 22 bp, Homo sapiens
ctgtgaatgttgaataaatcct

SEQ ID NO: 7522856 - DNA, 22 bp, Homo sapiens
ctgtgaattaagtattgttatc

SEQ ID NO: 7522857 - DNA, 22 bp, Homo sapiens
ctgtgaatttaaagcacacatc

SEQ ID NO: 7522858 - DNA, 22 bp, Homo sapiens
ctgtgaattgaatatgactatg

SEQ ID NO: 7522859 - DNA, 22 bp, Homo sapiens
ctgtgaattgcaacaattgcaa

SEQ ID NO: 7522860 - DNA, 22 bp, Homo sapiens
ctgtgaattaagtattgttatc

SEQ ID NO: 7522861 - DNA, 22 bp, Homo sapiens
ctgtgaattgaatatgactatg

SEQ ID NO: 7522862 - DNA, 22 bp, Homo sapiens
ctgtgaattgaatatgactatg

SEQ ID NO: 7522863 - DNA, 22 bp, Homo sapiens
ctgtgaatctgggtcagttgta

SEQ ID NO: 7522864 - DNA, 22 bp, Homo sapiens
ctgtgaatcttgatgttatttc

SEQ ID NO: 7522865 - DNA, 22 bp, Homo sapiens
ctgtgaatgctagtaagagtgc

SEQ ID NO: 7522866 - DNA, 22 bp, Homo sapiens
ctgtgaatcttgatgttatttc

SEQ ID NO: 7522867 - DNA, 22 bp, Homo sapiens
ctgtgaatgctagtaagagtgc

SEQ ID NO: 7522868 - DNA, 22 bp, Homo sapiens
ctgtgaaatgctttgcgatggt

SEQ ID NO: 7522869 - DNA, 22 bp, Homo sapiens
ctgtgaaatgctttgcgatggt

SEQ ID NO: 7522870 - DNA, 22 bp, Homo sapiens
ctgtgaacaatagcagcatctt

SEQ ID NO: 7522871 - DNA, 22 bp, Homo sapiens
ctgtgaacaatagcagcatctt

SEQ ID NO: 7522872 - DNA, 22 bp, Homo sapiens
ctgtgaagggacggatgctgct

SEQ ID NO: 7522873 - DNA, 22 bp, Homo sapiens
ctgtctgttatctcaccagtcc

SEQ ID NO: 7522874 - DNA, 22 bp, Homo sapiens
ctgtctgtgtggacacggctgc

SEQ ID NO: 7522875 - DNA, 22 bp, Homo sapiens
ctgtctgttatctcaccagtcc

SEQ ID NO: 7522876 - DNA, 22 bp, Homo sapiens
ctgtctgttatctcaccagtcc

SEQ ID NO: 7522877 - DNA, 22 bp, Homo sapiens
ctgtctgttatctcaccagtcc

SEQ ID NO: 7522878 - DNA, 22 bp, Homo sapiens
ctgtctgttatctcaccagtcc

SEQ ID NO: 7522879 - DNA, 22 bp, Homo sapiens
ctgtctgttatctcaccagtcc

SEQ ID NO: 7522880 - DNA, 21 bp, Homo sapiens
ctgtccctctttgcttccctc

SEQ ID NO: 7522881 - DNA, 22 bp, Homo sapiens
ctgtctgtggtctcagtaggcc

SEQ ID NO: 7522882 - DNA, 22 bp, Homo sapiens
ctgtccctgagcaactcctgtt

SEQ ID NO: 7522883 - DNA, 22 bp, Homo sapiens
ctgtctgtggtctcagtaggcc

SEQ ID NO: 7522884 - DNA, 22 bp, Homo sapiens
ctgtctgtgtggacacggctgc

SEQ ID NO: 7522885 - DNA, 22 bp, Homo sapiens
ctgtctgtttcaaaagtggtta

SEQ ID NO: 7522886 - DNA, 22 bp, Homo sapiens
ctgtgaaactggacagcacttg

SEQ ID NO: 7522887 - DNA, 22 bp, Homo sapiens
ctgtgaaatcaaccttgagccc

SEQ ID NO: 7522888 - DNA, 22 bp, Homo sapiens
ctgtgaaactggacagcacttg

SEQ ID NO: 7522889 - DNA, 22 bp, Homo sapiens
ctgtctgttcagattcattact

SEQ ID NO: 7522890 - DNA, 22 bp, Homo sapiens
ctgtctgttcagattcattact

SEQ ID NO: 7522891 - DNA, 22 bp, Homo sapiens
ctgtctgttgaccatagtttgc

SEQ ID NO: 7522892 - DNA, 22 bp, Homo sapiens
ctgtctgttgaccatagtttgc

SEQ ID NO: 7522893 - DNA, 22 bp, Homo sapiens
ctgtccctcatcacctctgggt

SEQ ID NO: 7522894 - DNA, 22 bp, Homo sapiens
ctgtccctcatcacctctgggt

SEQ ID NO: 7522895 - DNA, 22 bp, Homo sapiens
ctgtcccctgtgctttcacttg

SEQ ID NO: 7522896 - DNA, 22 bp, Homo sapiens
ctgtccctcatcacctctgggt

SEQ ID NO: 7522897 - DNA, 22 bp, Homo sapiens
ctgtccctcatcacctctgggt

SEQ ID NO: 7522898 - DNA, 21 bp, Homo sapiens
ctgtccctctttgcttccctc

SEQ ID NO: 7522899 - DNA, 21 bp, Homo sapiens
ctgtccctctttgcttccctc

SEQ ID NO: 7522900 - DNA, 21 bp, Homo sapiens
ctgtccctctttgcttccctc

SEQ ID NO: 7522901 - DNA, 22 bp, Homo sapiens
ctgtccctcatcacctctgggt

SEQ ID NO: 7522902 - DNA, 22 bp, Homo sapiens
ctgtccctctcacacctcacca

SEQ ID NO: 7522903 - DNA, 22 bp, Homo sapiens
ctgtccctctcacacctcacca

SEQ ID NO: 7522904 - DNA, 22 bp, Homo sapiens
ctgtccctctcacacctcacca

SEQ ID NO: 7522905 - DNA, 19 bp, Homo sapiens
ctgtccctcccaggtatga

SEQ ID NO: 7522906 - DNA, 19 bp, Homo sapiens
ctgtccctcccaggtatga

SEQ ID NO: 7522907 - DNA, 19 bp, Homo sapiens
ctgtccctcccaggtatga

SEQ ID NO: 7522908 - DNA, 22 bp, Homo sapiens
ctgtccctctcacacctcacca

SEQ ID NO: 7522909 - DNA, 22 bp, Homo sapiens
ctgtggaatcgggaaaagacag

SEQ ID NO: 7522910 - DNA, 22 bp, Homo sapiens
ctgtggaatcgggaaaagacag

SEQ ID NO: 7522911 - DNA, 22 bp, Homo sapiens
ctgtggaatcgggaaaagacag

SEQ ID NO: 7522912 - DNA, 22 bp, Homo sapiens
ctgtggaattgatgcttagtgt

SEQ ID NO: 7522913 - DNA, 22 bp, Homo sapiens
ctgtggaaggtttagataggta

SEQ ID NO: 7522914 - DNA, 20 bp, Homo sapiens
ctgtggaattttaccatgcg

SEQ ID NO: 7522915 - DNA, 21 bp, Homo sapiens
ctgtggacaggctggggcatg

SEQ ID NO: 7522916 - DNA, 22 bp, Homo sapiens
ctgtggacaggggcgcagaggt

SEQ ID NO: 7522917 - DNA, 22 bp, Homo sapiens
ctgtggacctgctcttagagac

SEQ ID NO: 7522918 - DNA, 19 bp, Homo sapiens
ctgtggactctagatcatg

SEQ ID NO: 7522919 - DNA, 22 bp, Homo sapiens
ctgtggacaggggcgcagaggt

SEQ ID NO: 7522920 - DNA, 22 bp, Homo sapiens
ctgtggacaggggcgcagaggt

SEQ ID NO: 7522921 - DNA, 22 bp, Homo sapiens
ctgtggacaggggcgcagaggt

SEQ ID NO: 7522922 - DNA, 21 bp, Homo sapiens
ctgtggacaggctggggcatg

SEQ ID NO: 7522923 - DNA, 22 bp, Homo sapiens
ctgtgagctgggtggccaggac

SEQ ID NO: 7522924 - DNA, 22 bp, Homo sapiens
ctgtgaggcctttggccagata

SEQ ID NO: 7522925 - DNA, 22 bp, Homo sapiens
ctgtgaggccctgggtgctgga

SEQ ID NO: 7522926 - DNA, 22 bp, Homo sapiens
ctgtgagggcagggaccagagg

SEQ ID NO: 7522927 - DNA, 22 bp, Homo sapiens
ctgtgagggcagggaccagagg

SEQ ID NO: 7522928 - DNA, 22 bp, Homo sapiens
ctgtgagggcagggaccagagg

SEQ ID NO: 7522929 - DNA, 22 bp, Homo sapiens
ctgtgaggcgggtggagtggag

SEQ ID NO: 7522930 - DNA, 22 bp, Homo sapiens
ctgtgaggcgggtggagtggag

SEQ ID NO: 7522931 - DNA, 22 bp, Homo sapiens
ctgtgaggcgggtggagtggag

SEQ ID NO: 7522932 - DNA, 22 bp, Homo sapiens
ctgtgactttgaataagaggga

SEQ ID NO: 7522933 - DNA, 22 bp, Homo sapiens
ctgtgactttgaataagaggga

SEQ ID NO: 7522934 - DNA, 22 bp, Homo sapiens
ctgtgacttgccaaaggtcatt

SEQ ID NO: 7522935 - DNA, 22 bp, Homo sapiens
ctgtgagaaaggtgatggaggt

SEQ ID NO: 7522936 - DNA, 22 bp, Homo sapiens
ctgtgagaaaggtgatggaggt

SEQ ID NO: 7522937 - DNA, 22 bp, Homo sapiens
ctgtgagaaataaatgtttgct

SEQ ID NO: 7522938 - DNA, 22 bp, Homo sapiens
ctgtgagactgatagggaagag

SEQ ID NO: 7522939 - DNA, 22 bp, Homo sapiens
ctgtgagacctgatttcttcat

SEQ ID NO: 7522940 - DNA, 22 bp, Homo sapiens
ctgtgagaagaatcccacctga

SEQ ID NO: 7522941 - DNA, 22 bp, Homo sapiens
ctgtgagaaataaatgtttgct

SEQ ID NO: 7522942 - DNA, 22 bp, Homo sapiens
ctgtgagaagaatcccacctga

SEQ ID NO: 7522943 - DNA, 22 bp, Homo sapiens
ctgtgagatttttaaataactt

SEQ ID NO: 7522944 - DNA, 22 bp, Homo sapiens
ctgtgagatttttaaataactt

SEQ ID NO: 7522945 - DNA, 22 bp, Homo sapiens
ctgtgagatgaccaactgactg

SEQ ID NO: 7522946 - DNA, 22 bp, Homo sapiens
ctgtgagatgtttctggttaga

SEQ ID NO: 7522947 - DNA, 22 bp, Homo sapiens
ctgtgagatgtttctggttaga

SEQ ID NO: 7522948 - DNA, 22 bp, Homo sapiens
ctgtgagatgaccaactgactg

SEQ ID NO: 7522949 - DNA, 22 bp, Homo sapiens
ctgtgagatatgcatatgctct

SEQ ID NO: 7522950 - DNA, 22 bp, Homo sapiens
ctgtgagatatgcatatgctct

SEQ ID NO: 7522951 - DNA, 22 bp, Homo sapiens
ctgtgagatatgcatatgctct

SEQ ID NO: 7522952 - DNA, 22 bp, Homo sapiens
ctgtgagagtggtggcctaggc

SEQ ID NO: 7522953 - DNA, 22 bp, Homo sapiens
ctgtgagactgatagggaagag

SEQ ID NO: 7522954 - DNA, 22 bp, Homo sapiens
ctgtgagagtggtggcctaggc

SEQ ID NO: 7522955 - DNA, 22 bp, Homo sapiens
ctgtgacttagagtgagtagag

SEQ ID NO: 7522956 - DNA, 22 bp, Homo sapiens
ctgtgacttccggatgacatga

SEQ ID NO: 7522957 - DNA, 22 bp, Homo sapiens
ctgtgactgtgttggatgcaca

SEQ ID NO: 7522958 - DNA, 22 bp, Homo sapiens
ctgtgactgtgttggatgcaca

SEQ ID NO: 7522959 - DNA, 22 bp, Homo sapiens
ctgtgactgggtgacagtcctc

SEQ ID NO: 7522960 - DNA, 22 bp, Homo sapiens
ctgtgactgtgttggatgcaca

SEQ ID NO: 7522961 - DNA, 22 bp, Homo sapiens
ctgtgactgggtgacagtcctc

SEQ ID NO: 7522962 - DNA, 22 bp, Homo sapiens
ctgtgactggaatctggctctt

SEQ ID NO: 7522963 - DNA, 22 bp, Homo sapiens
ctgtgactggaatctggctctt

SEQ ID NO: 7522964 - DNA, 22 bp, Homo sapiens
ctgtgaccttagcaagggaaat

SEQ ID NO: 7522965 - DNA, 22 bp, Homo sapiens
ctgtgaccttagcaagggaaat

SEQ ID NO: 7522966 - DNA, 21 bp, Homo sapiens
ctgtgacctttctttcctcct

SEQ ID NO: 7522967 - DNA, 22 bp, Homo sapiens
ctgtgactagacctgcaggaga

SEQ ID NO: 7522968 - DNA, 18 bp, Homo sapiens
ctgtgactcctagatctc

SEQ ID NO: 7522969 - DNA, 21 bp, Homo sapiens
ctgtgactccctgggcaatcc

SEQ ID NO: 7522970 - DNA, 22 bp, Homo sapiens
ctgtgactagacctgcaggaga

SEQ ID NO: 7522971 - DNA, 22 bp, Homo sapiens
ctgtgactccttctacctgtct

SEQ ID NO: 7522972 - DNA, 22 bp, Homo sapiens
ctgtgactgcagcaccaagtaa

SEQ ID NO: 7522973 - DNA, 22 bp, Homo sapiens
cttctgtagccagtaacatata

SEQ ID NO: 7522974 - DNA, 22 bp, Homo sapiens
cttctgtagccagtaacatata

SEQ ID NO: 7522975 - DNA, 22 bp, Homo sapiens
cttccctttctggtgacttctc

SEQ ID NO: 7522976 - DNA, 22 bp, Homo sapiens
cttccctttctggtgacttctc

SEQ ID NO: 7522977 - DNA, 22 bp, Homo sapiens
cttccctttctggtgacttctc

SEQ ID NO: 7522978 - DNA, 22 bp, Homo sapiens
cttccctttagcatatagtagt

SEQ ID NO: 7522979 - DNA, 22 bp, Homo sapiens
cttcccttctgtgcagggcaga

SEQ ID NO: 7522980 - DNA, 22 bp, Homo sapiens
cttcccttggtgaacagagcat

SEQ ID NO: 7522981 - DNA, 22 bp, Homo sapiens
cttccctttagcatatagtagt

SEQ ID NO: 7522982 - DNA, 22 bp, Homo sapiens
cttccctttagcatatagtagt

SEQ ID NO: 7522983 - DNA, 22 bp, Homo sapiens
cttcccttctgtgcagggcaga

SEQ ID NO: 7522984 - DNA, 22 bp, Homo sapiens
cttcccttctgtgcagggcaga

SEQ ID NO: 7522985 - DNA, 22 bp, Homo sapiens
cttcccttctgcagatctttgg

SEQ ID NO: 7522986 - DNA, 22 bp, Homo sapiens
cttcccttcccctcacggagac

SEQ ID NO: 7522987 - DNA, 22 bp, Homo sapiens
cttcccttctgcagatctttgg

SEQ ID NO: 7522988 - DNA, 22 bp, Homo sapiens
cttcccttctgcagatctttgg

SEQ ID NO: 7522989 - DNA, 22 bp, Homo sapiens
cttcccttggtgaacagagcat

SEQ ID NO: 7522990 - DNA, 22 bp, Homo sapiens
cttcccttctgtgcagggcaga

SEQ ID NO: 7522991 - DNA, 22 bp, Homo sapiens
cttcccttctgtgcagggcaga

SEQ ID NO: 7522992 - DNA, 22 bp, Homo sapiens
cttcccttggtgaacagagcat

SEQ ID NO: 7522993 - DNA, 22 bp, Homo sapiens
cttcccttggtgaacagagcat

SEQ ID NO: 7522994 - DNA, 22 bp, Homo sapiens
cttctgtgaagagcagaaccat

SEQ ID NO: 7522995 - DNA, 22 bp, Homo sapiens
cttctgtgaagagcagaaccat

SEQ ID NO: 7522996 - DNA, 22 bp, Homo sapiens
cttctgtgaccaccagcagccc

SEQ ID NO: 7522997 - DNA, 22 bp, Homo sapiens
cttctgtgaccaccagcagccc

SEQ ID NO: 7522998 - DNA, 22 bp, Homo sapiens
cttctgtgaagagcagaaccat

SEQ ID NO: 7522999 - DNA, 22 bp, Homo sapiens
cttctgtgaatgaagtgtggga

SEQ ID NO: 7523000 - DNA, 22 bp, Homo sapiens
cttctgtgacgtatgtgaggac

SEQ ID NO: 7523001 - DNA, 22 bp, Homo sapiens
cttctgtgagtcagtgtttctg

SEQ ID NO: 7523002 - DNA, 22 bp, Homo sapiens
cttctgtgaccaccagcagccc

SEQ ID NO: 7523003 - DNA, 22 bp, Homo sapiens
cttctgtgacgtatgtgaggac

SEQ ID NO: 7523004 - DNA, 22 bp, Homo sapiens
cttcttcaagagaatgggagac

SEQ ID NO: 7523005 - DNA, 22 bp, Homo sapiens
cttcttcaagagaatgggagac

SEQ ID NO: 7523006 - DNA, 19 bp, Homo sapiens
cttctgtgatacatcagtc

SEQ ID NO: 7523007 - DNA, 22 bp, Homo sapiens
cttcttcaacctgaaagtttca

SEQ ID NO: 7523008 - DNA, 22 bp, Homo sapiens
cttcttcaacctgaaagtttca

SEQ ID NO: 7523009 - DNA, 22 bp, Homo sapiens
cttcttcagaggccagcctctg

SEQ ID NO: 7523010 - DNA, 22 bp, Homo sapiens
cttcttcagaggccagcctctg

SEQ ID NO: 7523011 - DNA, 22 bp, Homo sapiens
cttcttcagaggccagcctctg

SEQ ID NO: 7523012 - DNA, 22 bp, Homo sapiens
cttcttcaatagcaagcgcata

SEQ ID NO: 7523013 - DNA, 22 bp, Homo sapiens
cttcttcaagaggaccatccag

SEQ ID NO: 7523014 - DNA, 22 bp, Homo sapiens
cttcttcaatagcaagcgcata

SEQ ID NO: 7523015 - DNA, 22 bp, Homo sapiens
cttcttcaatagcaagcgcata

SEQ ID NO: 7523016 - DNA, 22 bp, Homo sapiens
cttcttcacactggtctgaagc

SEQ ID NO: 7523017 - DNA, 22 bp, Homo sapiens
cttcttcacactggtctgaagc

SEQ ID NO: 7523018 - DNA, 20 bp, Homo sapiens
cttcttcagcctatgcttca

SEQ ID NO: 7523019 - DNA, 20 bp, Homo sapiens
cttcttcagcctatgcttca

SEQ ID NO: 7523020 - DNA, 22 bp, Homo sapiens
cttcttcagcacaatattgatg

SEQ ID NO: 7523021 - DNA, 22 bp, Homo sapiens
cttcttcagcacaatattgatg

SEQ ID NO: 7523022 - DNA, 22 bp, Homo sapiens
cttcttcagcacaatattgatg

SEQ ID NO: 7523023 - DNA, 22 bp, Homo sapiens
cttcttcagcacaatattgatg

SEQ ID NO: 7523024 - DNA, 22 bp, Homo sapiens
cttcttcagcacaatattgatg

SEQ ID NO: 7523025 - DNA, 22 bp, Homo sapiens
cttcttcataggcagtcctgtt

SEQ ID NO: 7523026 - DNA, 22 bp, Homo sapiens
cttcttcatctgtaaaacttgg

SEQ ID NO: 7523027 - DNA, 22 bp, Homo sapiens
cttcttcatctgtaaaacttgg

SEQ ID NO: 7523028 - DNA, 22 bp, Homo sapiens
cttcttcatctgtaaaacttgg

SEQ ID NO: 7523029 - DNA, 22 bp, Homo sapiens
cttcttcatctgtaaaacttgg

SEQ ID NO: 7523030 - DNA, 22 bp, Homo sapiens
cttcttcagttgcatgtattgg

SEQ ID NO: 7523031 - DNA, 22 bp, Homo sapiens
cttcttcataggcagtcctgtt

SEQ ID NO: 7523032 - DNA, 22 bp, Homo sapiens
cttcttcataggcagtcctgtt

SEQ ID NO: 7523033 - DNA, 20 bp, Homo sapiens
cttcttcagtagtttgttct

SEQ ID NO: 7523034 - DNA, 20 bp, Homo sapiens
cttcttcagcctatgcttca

SEQ ID NO: 7523035 - DNA, 21 bp, Homo sapiens
cttccccaggctggtctgtat

SEQ ID NO: 7523036 - DNA, 19 bp, Homo sapiens
cttcccctgttacctcact

SEQ ID NO: 7523037 - DNA, 22 bp, Homo sapiens
cttcccccaaatcaagagacct

SEQ ID NO: 7523038 - DNA, 19 bp, Homo sapiens
cttcccctgttacctcact

SEQ ID NO: 7523039 - DNA, 19 bp, Homo sapiens
cttcccctgttacctcact

SEQ ID NO: 7523040 - DNA, 19 bp, Homo sapiens
cttcccctgttacctcact

SEQ ID NO: 7523041 - DNA, 19 bp, Homo sapiens
cttcccctgttacctcact

SEQ ID NO: 7523042 - DNA, 19 bp, Homo sapiens
cttcccctgttacctcact

SEQ ID NO: 7523043 - DNA, 22 bp, Homo sapiens
cttccctcctggattccagact

SEQ ID NO: 7523044 - DNA, 19 bp, Homo sapiens
cttcccctgttacctcact

SEQ ID NO: 7523045 - DNA, 22 bp, Homo sapiens
cttcccgcagccctagcgctct

SEQ ID NO: 7523046 - DNA, 22 bp, Homo sapiens
cttcccgttattgcccttgggt

SEQ ID NO: 7523047 - DNA, 22 bp, Homo sapiens
cttcccgttattgcccttgggt

SEQ ID NO: 7523048 - DNA, 22 bp, Homo sapiens
cttccctcctggattccagact

SEQ ID NO: 7523049 - DNA, 22 bp, Homo sapiens
cttccctcctggattccagact

SEQ ID NO: 7523050 - DNA, 18 bp, Homo sapiens
cttccctcttcctttgtc

SEQ ID NO: 7523051 - DNA, 18 bp, Homo sapiens
cttccctcttcctttgtc

SEQ ID NO: 7523052 - DNA, 22 bp, Homo sapiens
cttccctctgctccttggtcca

SEQ ID NO: 7523053 - DNA, 22 bp, Homo sapiens
cttccctctgctccttggtcca

SEQ ID NO: 7523054 - DNA, 22 bp, Homo sapiens
cttccctctgctccttggtcca

SEQ ID NO: 7523055 - DNA, 22 bp, Homo sapiens
cttccctgagctttctcaggct

SEQ ID NO: 7523056 - DNA, 22 bp, Homo sapiens
cttccctgagctttctcaggct

SEQ ID NO: 7523057 - DNA, 18 bp, Homo sapiens
cttccctcttcctttgtc

SEQ ID NO: 7523058 - DNA, 22 bp, Homo sapiens
cttccctggtgttagcccaatg

SEQ ID NO: 7523059 - DNA, 22 bp, Homo sapiens
cttccctgataagagcctcaga

SEQ ID NO: 7523060 - DNA, 22 bp, Homo sapiens
cttccctgataagagcctcaga

SEQ ID NO: 7523061 - DNA, 22 bp, Homo sapiens
cttcccttcccctcacggagac

SEQ ID NO: 7523062 - DNA, 22 bp, Homo sapiens
cttcccttcccctcacggagac

SEQ ID NO: 7523063 - DNA, 22 bp, Homo sapiens
cttcccttcctggggcaattta

SEQ ID NO: 7523064 - DNA, 22 bp, Homo sapiens
cttcccttcctggggcaattta

SEQ ID NO: 7523065 - DNA, 22 bp, Homo sapiens
cttccctgataagagcctcaga

SEQ ID NO: 7523066 - DNA, 22 bp, Homo sapiens
cttccctgataagagcctcaga

SEQ ID NO: 7523067 - DNA, 22 bp, Homo sapiens
cttccctgagctttctcaggct

SEQ ID NO: 7523068 - DNA, 22 bp, Homo sapiens
cttccctgagctttctcaggct

SEQ ID NO: 7523069 - DNA, 22 bp, Homo sapiens
cttccctgataagagcctcaga

SEQ ID NO: 7523070 - DNA, 22 bp, Homo sapiens
cttccctgataagagcctcaga

SEQ ID NO: 7523071 - DNA, 22 bp, Homo sapiens
cttccctgataagagcctcaga

SEQ ID NO: 7523072 - DNA, 21 bp, Homo sapiens
cttccccaggctggtctgtat

SEQ ID NO: 7523073 - DNA, 22 bp, Homo sapiens
cttccccaggacctctgctaaa

SEQ ID NO: 7523074 - DNA, 22 bp, Homo sapiens
cttccccaagtagagaggggag

SEQ ID NO: 7523075 - DNA, 22 bp, Homo sapiens
cttccccaagtagagaggggag

SEQ ID NO: 7523076 - DNA, 22 bp, Homo sapiens
cttcccatataactaatttctg

SEQ ID NO: 7523077 - DNA, 22 bp, Homo sapiens
cttcccatataactaatttctg

SEQ ID NO: 7523078 - DNA, 22 bp, Homo sapiens
cttccccaaccccgactgtgtg

SEQ ID NO: 7523079 - DNA, 22 bp, Homo sapiens
cttcccaggtgctcttagcatg

SEQ ID NO: 7523080 - DNA, 22 bp, Homo sapiens
cttcccaggtgctcttagcatg

SEQ ID NO: 7523081 - DNA, 22 bp, Homo sapiens
cttcccaggtgctcttagcatg

SEQ ID NO: 7523082 - DNA, 22 bp, Homo sapiens
cttcccagcacctcagtctggc

SEQ ID NO: 7523083 - DNA, 22 bp, Homo sapiens
cttcccagttctgcttgagggg

SEQ ID NO: 7523084 - DNA, 22 bp, Homo sapiens
cttcccaggtgctcttagcatg

SEQ ID NO: 7523085 - DNA, 22 bp, Homo sapiens
cttcccagttctgcttgagggg

SEQ ID NO: 7523086 - DNA, 22 bp, Homo sapiens
cttcccagttctgcttgagggg

SEQ ID NO: 7523087 - DNA, 22 bp, Homo sapiens
cttcccagttctgcttgagggg

SEQ ID NO: 7523088 - DNA, 22 bp, Homo sapiens
cttcccagttctgcttgagggg

SEQ ID NO: 7523089 - DNA, 22 bp, Homo sapiens
cttcccagttctgcttgagggg

SEQ ID NO: 7523090 - DNA, 22 bp, Homo sapiens
cttcccagacggggtggcagcc

SEQ ID NO: 7523091 - DNA, 22 bp, Homo sapiens
cttcccagacggggtggcagcc

SEQ ID NO: 7523092 - DNA, 22 bp, Homo sapiens
cttcccagcacctcagtctggc

SEQ ID NO: 7523093 - DNA, 22 bp, Homo sapiens
cttcccagcacctcagtctggc

SEQ ID NO: 7523094 - DNA, 22 bp, Homo sapiens
cttcccagaccttagagtgcag

SEQ ID NO: 7523095 - DNA, 22 bp, Homo sapiens
cttcccagaccttagagtgcag

SEQ ID NO: 7523096 - DNA, 22 bp, Homo sapiens
cttcccagaccttagagtgcag

SEQ ID NO: 7523097 - DNA, 22 bp, Homo sapiens
cttcccagaccttagagtgcag

SEQ ID NO: 7523098 - DNA, 22 bp, Homo sapiens
cttcccagaccttagagtgcag

SEQ ID NO: 7523099 - DNA, 22 bp, Homo sapiens
cttcccagaacaatgtaggctt

SEQ ID NO: 7523100 - DNA, 22 bp, Homo sapiens
cttcccagaacaatgtaggctt

SEQ ID NO: 7523101 - DNA, 22 bp, Homo sapiens
cttccaggtccttcttgagaag

SEQ ID NO: 7523102 - DNA, 22 bp, Homo sapiens
cttcagaaactagtaacagcta

SEQ ID NO: 7523103 - DNA, 22 bp, Homo sapiens
cttcactttaagccaatcatga

SEQ ID NO: 7523104 - DNA, 22 bp, Homo sapiens
cttcactttaagccaatcatga

SEQ ID NO: 7523105 - DNA, 22 bp, Homo sapiens
cttcactttaagccaatcatga

SEQ ID NO: 7523106 - DNA, 22 bp, Homo sapiens
cttcagaaactagtaacagcta

SEQ ID NO: 7523107 - DNA, 22 bp, Homo sapiens
cttcagaaactagtaacagcta

SEQ ID NO: 7523108 - DNA, 22 bp, Homo sapiens
cttcagaaactagtaacagcta

SEQ ID NO: 7523109 - DNA, 22 bp, Homo sapiens
cttcacttgctcatcatgctat

SEQ ID NO: 7523110 - DNA, 22 bp, Homo sapiens
cttcacttcacagatgccaaga

SEQ ID NO: 7523111 - DNA, 22 bp, Homo sapiens
cttcactgtttggttcacagca

SEQ ID NO: 7523112 - DNA, 22 bp, Homo sapiens
cttcacttcacagatgccaaga

SEQ ID NO: 7523113 - DNA, 22 bp, Homo sapiens
cttcactgtttggttcacagca

SEQ ID NO: 7523114 - DNA, 22 bp, Homo sapiens
cttcactgtttggttcacagca

SEQ ID NO: 7523115 - DNA, 22 bp, Homo sapiens
cttcactgtttggttcacagca

SEQ ID NO: 7523116 - DNA, 22 bp, Homo sapiens
cttcactgtttggttcacagca

SEQ ID NO: 7523117 - DNA, 22 bp, Homo sapiens
cttcactgtgcttcaagcagct

SEQ ID NO: 7523118 - DNA, 22 bp, Homo sapiens
cttcactgggctcctgagaggg

SEQ ID NO: 7523119 - DNA, 22 bp, Homo sapiens
cttcactggatctttgatttca

SEQ ID NO: 7523120 - DNA, 22 bp, Homo sapiens
cttcactggaatctgtaatagt

SEQ ID NO: 7523121 - DNA, 22 bp, Homo sapiens
cttcactgcagtcatggctctg

SEQ ID NO: 7523122 - DNA, 22 bp, Homo sapiens
cttcactgtgcttcaagcagct

SEQ ID NO: 7523123 - DNA, 22 bp, Homo sapiens
cttcactgtgcttcaagcagct

SEQ ID NO: 7523124 - DNA, 22 bp, Homo sapiens
cttcactgggctcctgagaggg

SEQ ID NO: 7523125 - DNA, 22 bp, Homo sapiens
cttcagaaataacaacaattac

SEQ ID NO: 7523126 - DNA, 22 bp, Homo sapiens
cttcagaaataacaacaattac

SEQ ID NO: 7523127 - DNA, 22 bp, Homo sapiens
cttcagaaataacaacaattac

SEQ ID NO: 7523128 - DNA, 22 bp, Homo sapiens
cttcagaaataacaacaattac

SEQ ID NO: 7523129 - DNA, 22 bp, Homo sapiens
cttcagaaataacaacaattac

SEQ ID NO: 7523130 - DNA, 22 bp, Homo sapiens
cttcagaaataacaacaattac

SEQ ID NO: 7523131 - DNA, 22 bp, Homo sapiens
cttcagaaataacaacaattac

SEQ ID NO: 7523132 - DNA, 22 bp, Homo sapiens
cttcagaaccagccagaagagg

SEQ ID NO: 7523133 - DNA, 22 bp, Homo sapiens
cttcagaaccagccagaagagg

SEQ ID NO: 7523134 - DNA, 22 bp, Homo sapiens
cttccagggtccaggaagagcc

SEQ ID NO: 7523135 - DNA, 22 bp, Homo sapiens
cttccaggacaccagggtagta

SEQ ID NO: 7523136 - DNA, 22 bp, Homo sapiens
cttccaggacaccagggtagta

SEQ ID NO: 7523137 - DNA, 22 bp, Homo sapiens
cttccaggtaggcctaaggcag

SEQ ID NO: 7523138 - DNA, 22 bp, Homo sapiens
cttccaggtaggcctaaggcag

SEQ ID NO: 7523139 - DNA, 22 bp, Homo sapiens
cttccaggtaggcctaaggcag

SEQ ID NO: 7523140 - DNA, 22 bp, Homo sapiens
cttccaggtaggcctaaggcag

SEQ ID NO: 7523141 - DNA, 22 bp, Homo sapiens
cttccaggtccttcttgagaag

SEQ ID NO: 7523142 - DNA, 22 bp, Homo sapiens
cttcacattgggcttgatatga

SEQ ID NO: 7523143 - DNA, 22 bp, Homo sapiens
cttcacattgggcttgatatga

SEQ ID NO: 7523144 - DNA, 22 bp, Homo sapiens
cttcacattgggcttgatatga

SEQ ID NO: 7523145 - DNA, 22 bp, Homo sapiens
cttcacattagtttggatcaaa

SEQ ID NO: 7523146 - DNA, 22 bp, Homo sapiens
cttcacattagtttggatcaaa

SEQ ID NO: 7523147 - DNA, 22 bp, Homo sapiens
cttcacattgggcttgatatga

SEQ ID NO: 7523148 - DNA, 22 bp, Homo sapiens
cttcacatttgcgaaggccaaa

SEQ ID NO: 7523149 - DNA, 22 bp, Homo sapiens
cttcacatttgcgaaggccaaa

SEQ ID NO: 7523150 - DNA, 22 bp, Homo sapiens
cttcacatttgcgaaggccaaa

SEQ ID NO: 7523151 - DNA, 22 bp, Homo sapiens
cttcacatttgcgaaggccaaa

SEQ ID NO: 7523152 - DNA, 22 bp, Homo sapiens
cttcacctcctcctctgtgggc

SEQ ID NO: 7523153 - DNA, 22 bp, Homo sapiens
cttcacctgtacgctggagcta

SEQ ID NO: 7523154 - DNA, 22 bp, Homo sapiens
cttcactgagtagtctagactc

SEQ ID NO: 7523155 - DNA, 22 bp, Homo sapiens
cttcactgagtagtctagactc

SEQ ID NO: 7523156 - DNA, 22 bp, Homo sapiens
cttcactgcagtcatggctctg

SEQ ID NO: 7523157 - DNA, 22 bp, Homo sapiens
cttcactggaatctgtaatagt

SEQ ID NO: 7523158 - DNA, 22 bp, Homo sapiens
cttcactgatgggacagctcaa

SEQ ID NO: 7523159 - DNA, 22 bp, Homo sapiens
cttcactgagtagtctagactc

SEQ ID NO: 7523160 - DNA, 22 bp, Homo sapiens
cttcactgagtagtctagactc

SEQ ID NO: 7523161 - DNA, 22 bp, Homo sapiens
cttcactgatgggacagctcaa

SEQ ID NO: 7523162 - DNA, 22 bp, Homo sapiens
cttcactgatgggacagctcaa

SEQ ID NO: 7523163 - DNA, 22 bp, Homo sapiens
cttcacatgttggagtcctttg

SEQ ID NO: 7523164 - DNA, 22 bp, Homo sapiens
cttcacatgttggagtcctttg

SEQ ID NO: 7523165 - DNA, 22 bp, Homo sapiens
cttcacattagtttggatcaaa

SEQ ID NO: 7523166 - DNA, 22 bp, Homo sapiens
cttcacatgttggagtcctttg

SEQ ID NO: 7523167 - DNA, 22 bp, Homo sapiens
cttcacatgttggagtcctttg

SEQ ID NO: 7523168 - DNA, 22 bp, Homo sapiens
cttcacatgggtactgctgatc

SEQ ID NO: 7523169 - DNA, 19 bp, Homo sapiens
cttcacatctgtgagggga

SEQ ID NO: 7523170 - DNA, 19 bp, Homo sapiens
cttcacatctgtgagggga

SEQ ID NO: 7523171 - DNA, 22 bp, Homo sapiens
cttcacatgatgtccgtgctgt

SEQ ID NO: 7523172 - DNA, 22 bp, Homo sapiens
cttcacatgatgtccgtgctgt

SEQ ID NO: 7523173 - DNA, 22 bp, Homo sapiens
cttcacatgggtactgctgatc

SEQ ID NO: 7523174 - DNA, 22 bp, Homo sapiens
cttcacatgggtactgctgatc

SEQ ID NO: 7523175 - DNA, 22 bp, Homo sapiens
cttcacatctccctaaaacagc

SEQ ID NO: 7523176 - DNA, 22 bp, Homo sapiens
cttcacatctccctaaaacagc

SEQ ID NO: 7523177 - DNA, 22 bp, Homo sapiens
cttcacataaacaaagggccat

SEQ ID NO: 7523178 - DNA, 22 bp, Homo sapiens
cttcacataaacaaagggccat

SEQ ID NO: 7523179 - DNA, 22 bp, Homo sapiens
cttcacataaacaaagggccat

SEQ ID NO: 7523180 - DNA, 22 bp, Homo sapiens
cttcacatctccctaaaacagc

SEQ ID NO: 7523181 - DNA, 22 bp, Homo sapiens
cttcacagtcaccctgctgtgt

SEQ ID NO: 7523182 - DNA, 22 bp, Homo sapiens
cttcacagtctttatttcctcc

SEQ ID NO: 7523183 - DNA, 22 bp, Homo sapiens
cttcacagtctttatttcctcc

SEQ ID NO: 7523184 - DNA, 23 bp, Homo sapiens
ctgttaaattccttaagagcagg

SEQ ID NO: 7523185 - DNA, 23 bp, Homo sapiens
ctgttaaattccttaagagcagg

SEQ ID NO: 7523186 - DNA, 23 bp, Homo sapiens
ctgttaaattccttaagagcagg

SEQ ID NO: 7523187 - DNA, 23 bp, Homo sapiens
ctgttaaattccttaagagcagg

SEQ ID NO: 7523188 - DNA, 23 bp, Homo sapiens
ctgttaaattccttaagagcagg

SEQ ID NO: 7523189 - DNA, 22 bp, Homo sapiens
ctgttaaatagactgcagtgca

SEQ ID NO: 7523190 - DNA, 22 bp, Homo sapiens
ctgttaaatgagaaagcagact

SEQ ID NO: 7523191 - DNA, 22 bp, Homo sapiens
ctgttaaatgagaaagcagact

SEQ ID NO: 7523192 - DNA, 22 bp, Homo sapiens
ctgttaaatgagaaagcagact

SEQ ID NO: 7523193 - DNA, 22 bp, Homo sapiens
ctgttaaatgagaaagcagact

SEQ ID NO: 7523194 - DNA, 22 bp, Homo sapiens
ctgttaaatgagaaagcagact

SEQ ID NO: 7523195 - DNA, 22 bp, Homo sapiens
cttcaaatacaagtagattatg

SEQ ID NO: 7523196 - DNA, 22 bp, Homo sapiens
cttcaaatacaagtagattatg

SEQ ID NO: 7523197 - DNA, 22 bp, Homo sapiens
cttcaaatacaagtagattatg

SEQ ID NO: 7523198 - DNA, 22 bp, Homo sapiens
cttcaaatacaagtagattatg

SEQ ID NO: 7523199 - DNA, 22 bp, Homo sapiens
cttcaaatacaagtagattatg

SEQ ID NO: 7523200 - DNA, 22 bp, Homo sapiens
cttcaaatacaagtagattatg

SEQ ID NO: 7523201 - DNA, 22 bp, Homo sapiens
cttcaaatacaagtagattatg

SEQ ID NO: 7523202 - DNA, 22 bp, Homo sapiens
cttcaaatccccctgagtttga

SEQ ID NO: 7523203 - DNA, 22 bp, Homo sapiens
cttcaaatccccctgagtttga

SEQ ID NO: 7523204 - DNA, 22 bp, Homo sapiens
cttcaaatcctgtgtagggcta

SEQ ID NO: 7523205 - DNA, 22 bp, Homo sapiens
cttcaaatcctgtgtagggcta

SEQ ID NO: 7523206 - DNA, 22 bp, Homo sapiens
ctgttaaaatgtggtcttaaaa

SEQ ID NO: 7523207 - DNA, 22 bp, Homo sapiens
ctgttaaagatagttaagcttc

SEQ ID NO: 7523208 - DNA, 22 bp, Homo sapiens
ctgttaaaatgtggtcttaaaa

SEQ ID NO: 7523209 - DNA, 22 bp, Homo sapiens
ctgttaaagtgatcctttgtta

SEQ ID NO: 7523210 - DNA, 22 bp, Homo sapiens
ctgttaaagatagttaagcttc

SEQ ID NO: 7523211 - DNA, 22 bp, Homo sapiens
ctgttaaaaagaccaatggatt

SEQ ID NO: 7523212 - DNA, 22 bp, Homo sapiens
ctgttaaaaagaccaatggatt

SEQ ID NO: 7523213 - DNA, 22 bp, Homo sapiens
ctgttaaaagcactgccatcct

SEQ ID NO: 7523214 - DNA, 20 bp, Homo sapiens
ctgttaaaaggtatgaattc

SEQ ID NO: 7523215 - DNA, 20 bp, Homo sapiens
ctgttaaaaggtatgaattc

SEQ ID NO: 7523216 - DNA, 20 bp, Homo sapiens
ctgttaaaaggtatgaattc

SEQ ID NO: 7523217 - DNA, 20 bp, Homo sapiens
ctgttaaaaggtatgaattc

SEQ ID NO: 7523218 - DNA, 20 bp, Homo sapiens
ctgttaaaaggtatgaattc

SEQ ID NO: 7523219 - DNA, 20 bp, Homo sapiens
ctgttaaaaggtatgaattc

SEQ ID NO: 7523220 - DNA, 20 bp, Homo sapiens
ctgttaaaaggtatgaattc

SEQ ID NO: 7523221 - DNA, 22 bp, Homo sapiens
cttcaaatgtgattttaataac

SEQ ID NO: 7523222 - DNA, 22 bp, Homo sapiens
cttcaaatgtgattttaataac

SEQ ID NO: 7523223 - DNA, 22 bp, Homo sapiens
cttcaaatgtgattttaataac

SEQ ID NO: 7523224 - DNA, 22 bp, Homo sapiens
cttcaaatgtgattttaataac

SEQ ID NO: 7523225 - DNA, 22 bp, Homo sapiens
cttcaaatgtgattttaataac

SEQ ID NO: 7523226 - DNA, 22 bp, Homo sapiens
cttcaaatgtgattttaataac

SEQ ID NO: 7523227 - DNA, 22 bp, Homo sapiens
cttcacagagtccctgattgtt

SEQ ID NO: 7523228 - DNA, 22 bp, Homo sapiens
cttcacagagtccctgattgtt

SEQ ID NO: 7523229 - DNA, 22 bp, Homo sapiens
cttcacagatgctgagagggct

SEQ ID NO: 7523230 - DNA, 22 bp, Homo sapiens
cttcacagatgctgagagggct

SEQ ID NO: 7523231 - DNA, 16 bp, Homo sapiens
cttcacagaggagagt

SEQ ID NO: 7523232 - DNA, 16 bp, Homo sapiens
cttcacagaggagagt

SEQ ID NO: 7523233 - DNA, 16 bp, Homo sapiens
cttcacagaggagagt

SEQ ID NO: 7523234 - DNA, 16 bp, Homo sapiens
cttcacagaggagagt

SEQ ID NO: 7523235 - DNA, 22 bp, Homo sapiens
cttcacagccaacatgggcaca

SEQ ID NO: 7523236 - DNA, 22 bp, Homo sapiens
cttcacagccaacatgggcaca

SEQ ID NO: 7523237 - DNA, 22 bp, Homo sapiens
cttcacagccaacatgggcaca

SEQ ID NO: 7523238 - DNA, 22 bp, Homo sapiens
cttcacagcatgagctttggag

SEQ ID NO: 7523239 - DNA, 22 bp, Homo sapiens
cttcacagcatgagctttggag

SEQ ID NO: 7523240 - DNA, 22 bp, Homo sapiens
cttcacagatgctgagagggct

SEQ ID NO: 7523241 - DNA, 22 bp, Homo sapiens
cttcacagatgctgagagggct

SEQ ID NO: 7523242 - DNA, 22 bp, Homo sapiens
cttcacagcatgagctttggag

SEQ ID NO: 7523243 - DNA, 22 bp, Homo sapiens
cttcacagcatgagctttggag

SEQ ID NO: 7523244 - DNA, 22 bp, Homo sapiens
cttcacagcatgagctttggag

SEQ ID NO: 7523245 - DNA, 22 bp, Homo sapiens
cttcacagtaaatccagaagaa

SEQ ID NO: 7523246 - DNA, 22 bp, Homo sapiens
cttcacagtataggtccctgag

SEQ ID NO: 7523247 - DNA, 22 bp, Homo sapiens
cttcacagtcaccctgctgtgt

SEQ ID NO: 7523248 - DNA, 22 bp, Homo sapiens
cttcacagtataggtccctgag

SEQ ID NO: 7523249 - DNA, 22 bp, Homo sapiens
cttcacagtcaccctgctgtgt

SEQ ID NO: 7523250 - DNA, 22 bp, Homo sapiens
cttcacagtcaccctgctgtgt

SEQ ID NO: 7523251 - DNA, 22 bp, Homo sapiens
cttcacagtcaccctgctgtgt

SEQ ID NO: 7523252 - DNA, 22 bp, Homo sapiens
cttcacagtcaccctgctgtgt

SEQ ID NO: 7523253 - DNA, 22 bp, Homo sapiens
cttcacagtcaccctgctgtgt

SEQ ID NO: 7523254 - DNA, 22 bp, Homo sapiens
cttcacagtcaccctgctgtgt

SEQ ID NO: 7523255 - DNA, 22 bp, Homo sapiens
cttcacagtaaatccagaagaa

SEQ ID NO: 7523256 - DNA, 22 bp, Homo sapiens
cttcacagtaaatccagaagaa

SEQ ID NO: 7523257 - DNA, 22 bp, Homo sapiens
cttcacagtaaatccagaagaa

SEQ ID NO: 7523258 - DNA, 23 bp, Homo sapiens
cttcacaggttcaggggattaag

SEQ ID NO: 7523259 - DNA, 22 bp, Homo sapiens
cttcacagtaaatccagaagaa

SEQ ID NO: 7523260 - DNA, 23 bp, Homo sapiens
cttcacaggttcaggggattaag

SEQ ID NO: 7523261 - DNA, 23 bp, Homo sapiens
cttcacaggttcaggggattaag

SEQ ID NO: 7523262 - DNA, 23 bp, Homo sapiens
cttcacaggttcaggggattaag

SEQ ID NO: 7523263 - DNA, 22 bp, Homo sapiens
cttcacaggcaagtctgttttt

SEQ ID NO: 7523264 - DNA, 22 bp, Homo sapiens
cttcacagccaacatgggcaca

SEQ ID NO: 7523265 - DNA, 22 bp, Homo sapiens
cttcacaggcaagtctgttttt

SEQ ID NO: 7523266 - DNA, 22 bp, Homo sapiens
ctttctcttcactgtcatgatc

SEQ ID NO: 7523267 - DNA, 22 bp, Homo sapiens
ctttctcttcactgtcatgatc

SEQ ID NO: 7523268 - DNA, 22 bp, Homo sapiens
ctttgcataatgaatgatcata

SEQ ID NO: 7523269 - DNA, 22 bp, Homo sapiens
ctttctcttcactgtcatgatc

SEQ ID NO: 7523270 - DNA, 22 bp, Homo sapiens
ctttctcttacccaaggatctg

SEQ ID NO: 7523271 - DNA, 22 bp, Homo sapiens
ctttctcttcactgtcatgatc

SEQ ID NO: 7523272 - DNA, 22 bp, Homo sapiens
ctttctcttacccaaggatctg

SEQ ID NO: 7523273 - DNA, 22 bp, Homo sapiens
ctttctcttacccaaggatctg

SEQ ID NO: 7523274 - DNA, 22 bp, Homo sapiens
ctttctctgtgtttcacatgct

SEQ ID NO: 7523275 - DNA, 22 bp, Homo sapiens
ctttctcttacccaaggatctg

SEQ ID NO: 7523276 - DNA, 22 bp, Homo sapiens
ctttctcttacccaaggatctg

SEQ ID NO: 7523277 - DNA, 22 bp, Homo sapiens
ctttctcttacccaaggatctg

SEQ ID NO: 7523278 - DNA, 22 bp, Homo sapiens
ctttctctgtgtttcacatgct

SEQ ID NO: 7523279 - DNA, 22 bp, Homo sapiens
ctttctctgtgtttcacatgct

SEQ ID NO: 7523280 - DNA, 22 bp, Homo sapiens
ctttggaacaagaagaaatggc

SEQ ID NO: 7523281 - DNA, 22 bp, Homo sapiens
ctttggaacacatgggcatggt

SEQ ID NO: 7523282 - DNA, 22 bp, Homo sapiens
ctttggaacacatgggcatggt

SEQ ID NO: 7523283 - DNA, 22 bp, Homo sapiens
ctttggaacacatgggcatggt

SEQ ID NO: 7523284 - DNA, 22 bp, Homo sapiens
ctttggaacacccagctctgtg

SEQ ID NO: 7523285 - DNA, 22 bp, Homo sapiens
ctttggaacacccagctctgtg

SEQ ID NO: 7523286 - DNA, 22 bp, Homo sapiens
ctttggaacacatgggcatggt

SEQ ID NO: 7523287 - DNA, 22 bp, Homo sapiens
ctttggaacacccagctctgtg

SEQ ID NO: 7523288 - DNA, 22 bp, Homo sapiens
ctttggaacacatgggcatggt

SEQ ID NO: 7523289 - DNA, 22 bp, Homo sapiens
ctttggaacacccagctctgtg

SEQ ID NO: 7523290 - DNA, 22 bp, Homo sapiens
ctttgcattttgcccaactgtg

SEQ ID NO: 7523291 - DNA, 22 bp, Homo sapiens
ctttggaacaagaagaaatggc

SEQ ID NO: 7523292 - DNA, 22 bp, Homo sapiens
ctttggaacaagaagaaatggc

SEQ ID NO: 7523293 - DNA, 22 bp, Homo sapiens
ctttgcattctcagcacagagc

SEQ ID NO: 7523294 - DNA, 22 bp, Homo sapiens
ctttgcatgtggtagaaggttc

SEQ ID NO: 7523295 - DNA, 22 bp, Homo sapiens
ctttgcatgggtctgaaggctt

SEQ ID NO: 7523296 - DNA, 22 bp, Homo sapiens
ctttgcatgtggtagaaggttc

SEQ ID NO: 7523297 - DNA, 21 bp, Homo sapiens
ctttgcatctatatgttctca

SEQ ID NO: 7523298 - DNA, 22 bp, Homo sapiens
ctttgcatacaatttttagaaa

SEQ ID NO: 7523299 - DNA, 21 bp, Homo sapiens
ctttgcatacagatgccaatt

SEQ ID NO: 7523300 - DNA, 21 bp, Homo sapiens
ctttgcatctatatgttctca

SEQ ID NO: 7523301 - DNA, 21 bp, Homo sapiens
ctttgcatctatatgttctca

SEQ ID NO: 7523302 - DNA, 22 bp, Homo sapiens
ctttgcatgggtctgaaggctt

SEQ ID NO: 7523303 - DNA, 21 bp, Homo sapiens
ctttgcatacagatgccaatt

SEQ ID NO: 7523304 - DNA, 22 bp, Homo sapiens
ctttgcatacaatttttagaaa

SEQ ID NO: 7523305 - DNA, 22 bp, Homo sapiens
ctttgcatacaatttttagaaa

SEQ ID NO: 7523306 - DNA, 22 bp, Homo sapiens
ctttgcatacaatttttagaaa

SEQ ID NO: 7523307 - DNA, 22 bp, Homo sapiens
ctttgcataatgaatgatcata

SEQ ID NO: 7523308 - DNA, 22 bp, Homo sapiens
ctttctctgtgtttcacatgct

SEQ ID NO: 7523309 - DNA, 22 bp, Homo sapiens
ctttctctgtgtggtaaagggc

SEQ ID NO: 7523310 - DNA, 22 bp, Homo sapiens
ctttctctgtgtttcacatgct

SEQ ID NO: 7523311 - DNA, 22 bp, Homo sapiens
ctttctctgtgtttcacatgct

SEQ ID NO: 7523312 - DNA, 22 bp, Homo sapiens
ctttctctgtggtgaggagggt

SEQ ID NO: 7523313 - DNA, 22 bp, Homo sapiens
ctttctctgtggtgaggagggt

SEQ ID NO: 7523314 - DNA, 22 bp, Homo sapiens
ctttctctgtgtggtaaagggc

SEQ ID NO: 7523315 - DNA, 22 bp, Homo sapiens
ctttctctggaggggagtggtt

SEQ ID NO: 7523316 - DNA, 22 bp, Homo sapiens
ctttctctggaggggagtggtt

SEQ ID NO: 7523317 - DNA, 20 bp, Homo sapiens
ctttctctaatttataagta

SEQ ID NO: 7523318 - DNA, 20 bp, Homo sapiens
ctttctctaatttataagta

SEQ ID NO: 7523319 - DNA, 20 bp, Homo sapiens
ctttctctaatttataagta

SEQ ID NO: 7523320 - DNA, 20 bp, Homo sapiens
ctttctctaatttataagta

SEQ ID NO: 7523321 - DNA, 20 bp, Homo sapiens
ctttctctaatttataagta

SEQ ID NO: 7523322 - DNA, 22 bp, Homo sapiens
ctttctcctactgggcgcggga

SEQ ID NO: 7523323 - DNA, 20 bp, Homo sapiens
ctttctctaatttataagta

SEQ ID NO: 7523324 - DNA, 22 bp, Homo sapiens
ctttctccctgtcccaaactgg

SEQ ID NO: 7523325 - DNA, 22 bp, Homo sapiens
ctttctccctgtcccaaactgg

SEQ ID NO: 7523326 - DNA, 22 bp, Homo sapiens
ctttctccagagctgcttattt

SEQ ID NO: 7523327 - DNA, 22 bp, Homo sapiens
ctttctccagagctgcttattt

SEQ ID NO: 7523328 - DNA, 22 bp, Homo sapiens
ctttctccagagctgcttattt

SEQ ID NO: 7523329 - DNA, 22 bp, Homo sapiens
ctttctcagtgttaattacttt

SEQ ID NO: 7523330 - DNA, 22 bp, Homo sapiens
ctttctagttgacagcatgcca

SEQ ID NO: 7523331 - DNA, 22 bp, Homo sapiens
ctttctcaatgccggaaggcac

SEQ ID NO: 7523332 - DNA, 22 bp, Homo sapiens
ctttctcaatgccggaaggcac

SEQ ID NO: 7523333 - DNA, 22 bp, Homo sapiens
ctttctcagtgttaattacttt

SEQ ID NO: 7523334 - DNA, 22 bp, Homo sapiens
ctttctcagtgttaattacttt

SEQ ID NO: 7523335 - DNA, 22 bp, Homo sapiens
ctttctagagtatggagtctgt

SEQ ID NO: 7523336 - DNA, 22 bp, Homo sapiens
ctttctagagtatggagtctgt

SEQ ID NO: 7523337 - DNA, 22 bp, Homo sapiens
ctttctagttgacagcatgcca

SEQ ID NO: 7523338 - DNA, 22 bp, Homo sapiens
ctttctaattctcccatagtct

SEQ ID NO: 7523339 - DNA, 22 bp, Homo sapiens
ctttcctccactccctaggctt

SEQ ID NO: 7523340 - DNA, 22 bp, Homo sapiens
ctttcctccactccctaggctt

SEQ ID NO: 7523341 - DNA, 22 bp, Homo sapiens
ctttcctccactccctaggctt

SEQ ID NO: 7523342 - DNA, 22 bp, Homo sapiens
ctttcctctggcactgtctggt

SEQ ID NO: 7523343 - DNA, 22 bp, Homo sapiens
ctttcctccactccctaggctt

SEQ ID NO: 7523344 - DNA, 22 bp, Homo sapiens
ctttcctctggcactgtctggt

SEQ ID NO: 7523345 - DNA, 22 bp, Homo sapiens
ctttcctctggcactgtctggt

SEQ ID NO: 7523346 - DNA, 22 bp, Homo sapiens
ctttcctctggcactgtctggt

SEQ ID NO: 7523347 - DNA, 22 bp, Homo sapiens
ctttcctgaaatctcttctgca

SEQ ID NO: 7523348 - DNA, 22 bp, Homo sapiens
ctttcctgaaatctcttctgca

SEQ ID NO: 7523349 - DNA, 22 bp, Homo sapiens
ctttcctctggcactgtctggt

SEQ ID NO: 7523350 - DNA, 22 bp, Homo sapiens
ctttcctgagaaaggagaagga

SEQ ID NO: 7523351 - DNA, 22 bp, Homo sapiens
ctttcctgagaaaggagaagga

SEQ ID NO: 7523352 - DNA, 22 bp, Homo sapiens
ctttcctgagaaaggagaagga

SEQ ID NO: 7523353 - DNA, 22 bp, Homo sapiens
ctttcctgaggagtatggctgt

SEQ ID NO: 7523354 - DNA, 22 bp, Homo sapiens
ctttcctgagaaaggagaagga

SEQ ID NO: 7523355 - DNA, 22 bp, Homo sapiens
ctttcctgccttattcattcat

SEQ ID NO: 7523356 - DNA, 22 bp, Homo sapiens
ctttcctgccttattcattcat

SEQ ID NO: 7523357 - DNA, 22 bp, Homo sapiens
ctttcctgaggagtatggctgt

SEQ ID NO: 7523358 - DNA, 22 bp, Homo sapiens
ctttcctgaggagtatggctgt

SEQ ID NO: 7523359 - DNA, 22 bp, Homo sapiens
ctttcctgaggagtatggctgt

SEQ ID NO: 7523360 - DNA, 22 bp, Homo sapiens
ctttcctgccttattcattcat

SEQ ID NO: 7523361 - DNA, 22 bp, Homo sapiens
ctttcctggctggcagttgtgg

SEQ ID NO: 7523362 - DNA, 22 bp, Homo sapiens
ctttcctggctggcagttgtgg

SEQ ID NO: 7523363 - DNA, 22 bp, Homo sapiens
ctttccttaataagcaggtata

SEQ ID NO: 7523364 - DNA, 22 bp, Homo sapiens
ctttccttaataagcaggtata

SEQ ID NO: 7523365 - DNA, 22 bp, Homo sapiens
ctttccttaataagcaggtata

SEQ ID NO: 7523366 - DNA, 22 bp, Homo sapiens
ctttccttctcgtggttctcac

SEQ ID NO: 7523367 - DNA, 22 bp, Homo sapiens
ctttccttctcgtggttctcac

SEQ ID NO: 7523368 - DNA, 22 bp, Homo sapiens
ctttccttctcgtggttctcac

SEQ ID NO: 7523369 - DNA, 22 bp, Homo sapiens
ctttccttaataagcaggtata

SEQ ID NO: 7523370 - DNA, 22 bp, Homo sapiens
ctttccttctcgtggttctcac

SEQ ID NO: 7523371 - DNA, 22 bp, Homo sapiens
ctttccttctcgtggttctcac

SEQ ID NO: 7523372 - DNA, 23 bp, Homo sapiens
ctttcctttctttgacacccagc

SEQ ID NO: 7523373 - DNA, 22 bp, Homo sapiens
ctttccttctcgtggttctcac

SEQ ID NO: 7523374 - DNA, 22 bp, Homo sapiens
ctttccttctcgtggttctcac

SEQ ID NO: 7523375 - DNA, 23 bp, Homo sapiens
ctttcctttctttgacacccagc

SEQ ID NO: 7523376 - DNA, 23 bp, Homo sapiens
ctttcctttctttgacacccagc

SEQ ID NO: 7523377 - DNA, 22 bp, Homo sapiens
ctttctaattctcccatagtct

SEQ ID NO: 7523378 - DNA, 22 bp, Homo sapiens
ctttctaaatgttccttgatta

SEQ ID NO: 7523379 - DNA, 22 bp, Homo sapiens
ctttctaaatgttccttgatta

SEQ ID NO: 7523380 - DNA, 22 bp, Homo sapiens
ctttcgatcaagggtcccttca

SEQ ID NO: 7523381 - DNA, 23 bp, Homo sapiens
ctttcctttctttgacacccagc

SEQ ID NO: 7523382 - DNA, 22 bp, Homo sapiens
cttggaggaaggggctcttctg

SEQ ID NO: 7523383 - DNA, 22 bp, Homo sapiens
cttggaggaaggggctcttctg

SEQ ID NO: 7523384 - DNA, 22 bp, Homo sapiens
cttggaggaaggggctcttctg

SEQ ID NO: 7523385 - DNA, 22 bp, Homo sapiens
cttggaggaggtggtgcttgat

SEQ ID NO: 7523386 - DNA, 22 bp, Homo sapiens
cttggaggatgtgcggctgccc

SEQ ID NO: 7523387 - DNA, 22 bp, Homo sapiens
cttggaggatgtgcggctgccc

SEQ ID NO: 7523388 - DNA, 22 bp, Homo sapiens
cttggaggtggaagttgcagtg

SEQ ID NO: 7523389 - DNA, 22 bp, Homo sapiens
cttggaggtggaagttgcagtg

SEQ ID NO: 7523390 - DNA, 22 bp, Homo sapiens
cttggaggaaaggcagggagac

SEQ ID NO: 7523391 - DNA, 22 bp, Homo sapiens
cttggaggaaaggcagggagac

SEQ ID NO: 7523392 - DNA, 22 bp, Homo sapiens
cttggagctcccgcactgatta

SEQ ID NO: 7523393 - DNA, 22 bp, Homo sapiens
cttggaggaaaggcagggagac

SEQ ID NO: 7523394 - DNA, 22 bp, Homo sapiens
cttggagcccagcaggcctgga

SEQ ID NO: 7523395 - DNA, 22 bp, Homo sapiens
cttggaggaaaggcagggagac

SEQ ID NO: 7523396 - DNA, 22 bp, Homo sapiens
cttggagattcattgcctgaaa

SEQ ID NO: 7523397 - DNA, 22 bp, Homo sapiens
cttggagattcattgcctgaaa

SEQ ID NO: 7523398 - DNA, 22 bp, Homo sapiens
cttggagatacagaggacattt

SEQ ID NO: 7523399 - DNA, 22 bp, Homo sapiens
cttggagcaacacatgacatct

SEQ ID NO: 7523400 - DNA, 22 bp, Homo sapiens
cttggagcccagcaggcctgga

SEQ ID NO: 7523401 - DNA, 22 bp, Homo sapiens
ctttccaccaactcacttccct

SEQ ID NO: 7523402 - DNA, 22 bp, Homo sapiens
ctttccaatgtcactatgaatc

SEQ ID NO: 7523403 - DNA, 22 bp, Homo sapiens
ctttccaatgcatttccaatgt

SEQ ID NO: 7523404 - DNA, 22 bp, Homo sapiens
ctttccaagaatgcagatacct

SEQ ID NO: 7523405 - DNA, 22 bp, Homo sapiens
ctttccaagaatgcagatacct

SEQ ID NO: 7523406 - DNA, 22 bp, Homo sapiens
cttggagtgaatgggggcaggt

SEQ ID NO: 7523407 - DNA, 22 bp, Homo sapiens
cttggagtatgagcttcctgga

SEQ ID NO: 7523408 - DNA, 22 bp, Homo sapiens
cttggagtatgagcttcctgga

SEQ ID NO: 7523409 - DNA, 22 bp, Homo sapiens
cttggagtgaatgggggcaggt

SEQ ID NO: 7523410 - DNA, 22 bp, Homo sapiens
ctttcctagtagttacagaatg

SEQ ID NO: 7523411 - DNA, 22 bp, Homo sapiens
ctttcctagttggtcccagcac

SEQ ID NO: 7523412 - DNA, 22 bp, Homo sapiens
ctttccagatttgtccagttat

SEQ ID NO: 7523413 - DNA, 22 bp, Homo sapiens
ctttccagatttgtccagttat

SEQ ID NO: 7523414 - DNA, 22 bp, Homo sapiens
ctttccagacctccttgtagct

SEQ ID NO: 7523415 - DNA, 22 bp, Homo sapiens
ctttccagacctccttgtagct

SEQ ID NO: 7523416 - DNA, 22 bp, Homo sapiens
ctttccagacctccttgtagct

SEQ ID NO: 7523417 - DNA, 22 bp, Homo sapiens
ctttccagatttgtccagttat

SEQ ID NO: 7523418 - DNA, 22 bp, Homo sapiens
cttcttccagttataagagctt

SEQ ID NO: 7523419 - DNA, 22 bp, Homo sapiens
cttcttcccagcttccctcacc

SEQ ID NO: 7523420 - DNA, 22 bp, Homo sapiens
cttcttcccagcttccctcacc

SEQ ID NO: 7523421 - DNA, 22 bp, Homo sapiens
cttcttcccagcttccctcacc

SEQ ID NO: 7523422 - DNA, 22 bp, Homo sapiens
cttcttccagttataagagctt

SEQ ID NO: 7523423 - DNA, 22 bp, Homo sapiens
cttcttcccagcttccctcacc

SEQ ID NO: 7523424 - DNA, 22 bp, Homo sapiens
cttcttcccagcttccctcacc

SEQ ID NO: 7523425 - DNA, 22 bp, Homo sapiens
cttcttcctgaaagctggctct

SEQ ID NO: 7523426 - DNA, 22 bp, Homo sapiens
cttcttccaagcttatgctcaa

SEQ ID NO: 7523427 - DNA, 20 bp, Homo sapiens
cttcttcattaaccctactg

SEQ ID NO: 7523428 - DNA, 22 bp, Homo sapiens
cttcttccaagcttatgctcaa

SEQ ID NO: 7523429 - DNA, 22 bp, Homo sapiens
cttcttccaagcttatgctcaa

SEQ ID NO: 7523430 - DNA, 22 bp, Homo sapiens
cttcttcatgtattgatagtct

SEQ ID NO: 7523431 - DNA, 22 bp, Homo sapiens
cttcttcatgtattgatagtct

SEQ ID NO: 7523432 - DNA, 22 bp, Homo sapiens
cttcttcatgtattgatagtct

SEQ ID NO: 7523433 - DNA, 22 bp, Homo sapiens
cttcttctctacatcctttgat

SEQ ID NO: 7523434 - DNA, 22 bp, Homo sapiens
cttcttctcaaggggcaggtgg

SEQ ID NO: 7523435 - DNA, 22 bp, Homo sapiens
cttcttctcaaggggcaggtgg

SEQ ID NO: 7523436 - DNA, 22 bp, Homo sapiens
cttcttctggacaggcagctcc

SEQ ID NO: 7523437 - DNA, 22 bp, Homo sapiens
cttcttctggacaggcagctcc

SEQ ID NO: 7523438 - DNA, 22 bp, Homo sapiens
cttcttctctacatcctttgat

SEQ ID NO: 7523439 - DNA, 22 bp, Homo sapiens
cttcttctctacatcctttgat

SEQ ID NO: 7523440 - DNA, 22 bp, Homo sapiens
cttcttctctacatcctttgat

SEQ ID NO: 7523441 - DNA, 22 bp, Homo sapiens
cttcttcctgctgcagcctcca

SEQ ID NO: 7523442 - DNA, 22 bp, Homo sapiens
cttcttcctgctgcagcctcca

SEQ ID NO: 7523443 - DNA, 22 bp, Homo sapiens
cttcttcctgaaagctggctct

SEQ ID NO: 7523444 - DNA, 22 bp, Homo sapiens
cttcttcctgctgcagcctcca

SEQ ID NO: 7523445 - DNA, 22 bp, Homo sapiens
cttcttcctgctgcagcctcca

SEQ ID NO: 7523446 - DNA, 22 bp, Homo sapiens
cttcttcctgctgcagcctcca

SEQ ID NO: 7523447 - DNA, 22 bp, Homo sapiens
cttcttcttcccccttcagggg

SEQ ID NO: 7523448 - DNA, 22 bp, Homo sapiens
cttcttcttcccccttcagggg

SEQ ID NO: 7523449 - DNA, 19 bp, Homo sapiens
cttcttcttggcagccaag

SEQ ID NO: 7523450 - DNA, 22 bp, Homo sapiens
cttcttctggacaggcagctcc

SEQ ID NO: 7523451 - DNA, 22 bp, Homo sapiens
cttcttcttcccccttcagggg

SEQ ID NO: 7523452 - DNA, 22 bp, Homo sapiens
cttcttctggtttatgtggcaa

SEQ ID NO: 7523453 - DNA, 22 bp, Homo sapiens
cttcttctggtttatgtggcaa

SEQ ID NO: 7523454 - DNA, 22 bp, Homo sapiens
cttgcctacttgtcaaccagca

SEQ ID NO: 7523455 - DNA, 19 bp, Homo sapiens
cttcttcttggcagccaag

SEQ ID NO: 7523456 - DNA, 22 bp, Homo sapiens
cttgcctacttgtcaaccagca

SEQ ID NO: 7523457 - DNA, 22 bp, Homo sapiens
cttgcctccctcagctcacagc

SEQ ID NO: 7523458 - DNA, 22 bp, Homo sapiens
cttgcctccctcagctcacagc

SEQ ID NO: 7523459 - DNA, 22 bp, Homo sapiens
cttgcctccctcagctcacagc

SEQ ID NO: 7523460 - DNA, 22 bp, Homo sapiens
cttgcctccctcagctcacagc

SEQ ID NO: 7523461 - DNA, 22 bp, Homo sapiens
cttgcctgaggaacagagggta

SEQ ID NO: 7523462 - DNA, 22 bp, Homo sapiens
cttgcctgccactacagctgaa

SEQ ID NO: 7523463 - DNA, 22 bp, Homo sapiens
cttgcctgccactacagctgaa

SEQ ID NO: 7523464 - DNA, 22 bp, Homo sapiens
cttgctggggtaagtctgtgct

SEQ ID NO: 7523465 - DNA, 22 bp, Homo sapiens
cttgcctgctggagcagggctc

SEQ ID NO: 7523466 - DNA, 22 bp, Homo sapiens
cttgcctgctggagcagggctc

SEQ ID NO: 7523467 - DNA, 19 bp, Homo sapiens
cttgctgggtggtttctgc

SEQ ID NO: 7523468 - DNA, 22 bp, Homo sapiens
cttgctggggtaagtctgtgct

SEQ ID NO: 7523469 - DNA, 22 bp, Homo sapiens
cttgctggtattttctctctca

SEQ ID NO: 7523470 - DNA, 19 bp, Homo sapiens
cttgctgggtggtttctgc

SEQ ID NO: 7523471 - DNA, 22 bp, Homo sapiens
cttgctggtggtgttttctatg

SEQ ID NO: 7523472 - DNA, 22 bp, Homo sapiens
cttgctggtattttctctctca

SEQ ID NO: 7523473 - DNA, 22 bp, Homo sapiens
cttgctggtgtcgtgccttcac

SEQ ID NO: 7523474 - DNA, 22 bp, Homo sapiens
cttgctggtggtgttttctatg

SEQ ID NO: 7523475 - DNA, 22 bp, Homo sapiens
cttgctggtgtcgtgccttcac

SEQ ID NO: 7523476 - DNA, 22 bp, Homo sapiens
cttgctggtgtcgtgccttcac

SEQ ID NO: 7523477 - DNA, 22 bp, Homo sapiens
cttgctgtcttgcatttagagc

SEQ ID NO: 7523478 - DNA, 22 bp, Homo sapiens
cttgctggtgtcgtgccttcac

SEQ ID NO: 7523479 - DNA, 22 bp, Homo sapiens
cttggacccactcccagaattg

SEQ ID NO: 7523480 - DNA, 22 bp, Homo sapiens
cttggacaacttttctctggtt

SEQ ID NO: 7523481 - DNA, 22 bp, Homo sapiens
cttggacttccaggaagtattt

SEQ ID NO: 7523482 - DNA, 22 bp, Homo sapiens
cttggactttagtctctctcca

SEQ ID NO: 7523483 - DNA, 22 bp, Homo sapiens
cttggactttagtctctctcca

SEQ ID NO: 7523484 - DNA, 18 bp, Homo sapiens
cttggagaactaatgata

SEQ ID NO: 7523485 - DNA, 22 bp, Homo sapiens
cttggagaaaggaaagggcttg

SEQ ID NO: 7523486 - DNA, 22 bp, Homo sapiens
cttggactttccagcttctaaa

SEQ ID NO: 7523487 - DNA, 22 bp, Homo sapiens
cttggagaaaggaaagggcttg

SEQ ID NO: 7523488 - DNA, 21 bp, Homo sapiens
cttggaacgggtagaactcac

SEQ ID NO: 7523489 - DNA, 22 bp, Homo sapiens
cttggaacaaattaaacaatac

SEQ ID NO: 7523490 - DNA, 21 bp, Homo sapiens
cttggaacgggtagaactcac

SEQ ID NO: 7523491 - DNA, 22 bp, Homo sapiens
cttggaacttagtaatatgaca

SEQ ID NO: 7523492 - DNA, 22 bp, Homo sapiens
cttggaaggacgggctgtatct

SEQ ID NO: 7523493 - DNA, 22 bp, Homo sapiens
cttggaaggacgggctgtatct

SEQ ID NO: 7523494 - DNA, 22 bp, Homo sapiens
cttggaaggctggttctccctc

SEQ ID NO: 7523495 - DNA, 22 bp, Homo sapiens
cttggaaggctggttctccctc

SEQ ID NO: 7523496 - DNA, 22 bp, Homo sapiens
cttggaatggggcagaaaatgg

SEQ ID NO: 7523497 - DNA, 22 bp, Homo sapiens
cttggaatcaagtttttggaga

SEQ ID NO: 7523498 - DNA, 22 bp, Homo sapiens
cttggaatggggcagaaaatgg

SEQ ID NO: 7523499 - DNA, 22 bp, Homo sapiens
cttggagatacagaggacattt

SEQ ID NO: 7523500 - DNA, 22 bp, Homo sapiens
cttggagatacagaggacattt

SEQ ID NO: 7523501 - DNA, 22 bp, Homo sapiens
cttggagatacagaggacattt

SEQ ID NO: 7523502 - DNA, 22 bp, Homo sapiens
cttggagagtggttatccctgt

SEQ ID NO: 7523503 - DNA, 22 bp, Homo sapiens
cttggagatacaagtggtacct

SEQ ID NO: 7523504 - DNA, 22 bp, Homo sapiens
cttggagagggagaaaaataac

SEQ ID NO: 7523505 - DNA, 22 bp, Homo sapiens
cttggagagggagaaaaataac

SEQ ID NO: 7523506 - DNA, 22 bp, Homo sapiens
cttggagagagcctcagctgtt

SEQ ID NO: 7523507 - DNA, 22 bp, Homo sapiens
cttggagagagcctcagctgtt

SEQ ID NO: 7523508 - DNA, 22 bp, Homo sapiens
cttggagagagcctcagctgtt

SEQ ID NO: 7523509 - DNA, 22 bp, Homo sapiens
cttggagagagcctcagctgtt

SEQ ID NO: 7523510 - DNA, 22 bp, Homo sapiens
cttggagaccagtgacattgct

SEQ ID NO: 7523511 - DNA, 22 bp, Homo sapiens
cttggagaccagtgacattgct

SEQ ID NO: 7523512 - DNA, 22 bp, Homo sapiens
cttggagaccagtgacattgct

SEQ ID NO: 7523513 - DNA, 19 bp, Homo sapiens
cttggagaaggctatgacc

SEQ ID NO: 7523514 - DNA, 22 bp, Homo sapiens
cttggagaaaggaaagggcttg

SEQ ID NO: 7523515 - DNA, 22 bp, Homo sapiens
cttggagaatcctggttattca

SEQ ID NO: 7523516 - DNA, 22 bp, Homo sapiens
cttggagaatgacagtggatta

SEQ ID NO: 7523517 - DNA, 22 bp, Homo sapiens
cttggagacaggacaggcagaa

SEQ ID NO: 7523518 - DNA, 22 bp, Homo sapiens
cttggagaatgacagtggatta

SEQ ID NO: 7523519 - DNA, 22 bp, Homo sapiens
cttggagaatgacagtggatta

SEQ ID NO: 7523520 - DNA, 22 bp, Homo sapiens
cttggagacattgatcttttgc

SEQ ID NO: 7523521 - DNA, 22 bp, Homo sapiens
cttggagacattgatcttttgc

SEQ ID NO: 7523522 - DNA, 22 bp, Homo sapiens
cttggagacaggacaggcagaa

SEQ ID NO: 7523523 - DNA, 22 bp, Homo sapiens
cttggagacaggacaggcagaa

SEQ ID NO: 7523524 - DNA, 22 bp, Homo sapiens
cttggagacaggacaggcagaa

SEQ ID NO: 7523525 - DNA, 22 bp, Homo sapiens
cttgcttgccatgggcttgggc

SEQ ID NO: 7523526 - DNA, 22 bp, Homo sapiens
cttgcttgttttgaagaaagat

SEQ ID NO: 7523527 - DNA, 22 bp, Homo sapiens
cttgcttgtttagttcacagat

SEQ ID NO: 7523528 - DNA, 22 bp, Homo sapiens
cttgcttgttttgaagaaagat

SEQ ID NO: 7523529 - DNA, 22 bp, Homo sapiens
cttgctttatctggtttctcat

SEQ ID NO: 7523530 - DNA, 22 bp, Homo sapiens
cttgctttatctggtttctcat

SEQ ID NO: 7523531 - DNA, 22 bp, Homo sapiens
cttgctttcagtctcggcctca

SEQ ID NO: 7523532 - DNA, 22 bp, Homo sapiens
cttgctttcagtctcggcctca

SEQ ID NO: 7523533 - DNA, 22 bp, Homo sapiens
cttgctttatctggtttctcat

SEQ ID NO: 7523534 - DNA, 22 bp, Homo sapiens
cttgctgttttctaccctcaag

SEQ ID NO: 7523535 - DNA, 22 bp, Homo sapiens
cttgcttacctagttagctcca

SEQ ID NO: 7523536 - DNA, 22 bp, Homo sapiens
cttgcttctgctgcactatcct

SEQ ID NO: 7523537 - DNA, 22 bp, Homo sapiens
cttgctgttgtgggagactggg

SEQ ID NO: 7523538 - DNA, 22 bp, Homo sapiens
cttgctgtgtggtgttctcaga

SEQ ID NO: 7523539 - DNA, 22 bp, Homo sapiens
cttggaaagaatatatgatgct

SEQ ID NO: 7523540 - DNA, 22 bp, Homo sapiens
cttggaaactttccctgggcac

SEQ ID NO: 7523541 - DNA, 22 bp, Homo sapiens
cttgcttttgctgatgattaag

SEQ ID NO: 7523542 - DNA, 22 bp, Homo sapiens
cttgcttttgctgatgattaag

SEQ ID NO: 7523543 - DNA, 22 bp, Homo sapiens
cttgcttttgctgatgattaag

SEQ ID NO: 7523544 - DNA, 22 bp, Homo sapiens
cttgctttccaaatgactcact

SEQ ID NO: 7523545 - DNA, 22 bp, Homo sapiens
cttgctttccaaatgactcact

SEQ ID NO: 7523546 - DNA, 22 bp, Homo sapiens
cttgctttgtccagaaattcag

SEQ ID NO: 7523547 - DNA, 22 bp, Homo sapiens
cttgctttgtccagaaattcag

SEQ ID NO: 7523548 - DNA, 22 bp, Homo sapiens
cttggaaagttatcattttcct

SEQ ID NO: 7523549 - DNA, 22 bp, Homo sapiens
cttggaaagttatcattttcct

SEQ ID NO: 7523550 - DNA, 22 bp, Homo sapiens
cttggaaaggttttacaaagcg

SEQ ID NO: 7523551 - DNA, 22 bp, Homo sapiens
cttggaacaaattaaacaatac

SEQ ID NO: 7523552 - DNA, 22 bp, Homo sapiens
cttggaaagttatcattttcct

SEQ ID NO: 7523553 - DNA, 22 bp, Homo sapiens
cttggaaagttatcattttcct

SEQ ID NO: 7523554 - DNA, 22 bp, Homo sapiens
cttggaaagttatcattttcct

SEQ ID NO: 7523555 - DNA, 22 bp, Homo sapiens
cttggaaaggaatcttttacca

SEQ ID NO: 7523556 - DNA, 22 bp, Homo sapiens
cttggaaagaatatatgatgct

SEQ ID NO: 7523557 - DNA, 22 bp, Homo sapiens
cttggaaaggttttacaaagcg

SEQ ID NO: 7523558 - DNA, 22 bp, Homo sapiens
cttggaaagaatatatgatgct

SEQ ID NO: 7523559 - DNA, 22 bp, Homo sapiens
cttggaaaggttttacaaagcg

SEQ ID NO: 7523560 - DNA, 22 bp, Homo sapiens
gaaactctcgcatcctgggaac

SEQ ID NO: 7523561 - DNA, 22 bp, Homo sapiens
gaaactctcgcatcctgggaac

SEQ ID NO: 7523562 - DNA, 22 bp, Homo sapiens
gaaactgaatataagaaaggta

SEQ ID NO: 7523563 - DNA, 22 bp, Homo sapiens
gaaacgttaaaccatatgtaat

SEQ ID NO: 7523564 - DNA, 22 bp, Homo sapiens
gaaactagatgtattagagatt

SEQ ID NO: 7523565 - DNA, 22 bp, Homo sapiens
gaaactctcgcatcctgggaac

SEQ ID NO: 7523566 - DNA, 22 bp, Homo sapiens
gaaactctcgcatcctgggaac

SEQ ID NO: 7523567 - DNA, 22 bp, Homo sapiens
gaaactctcgcatcctgggaac

SEQ ID NO: 7523568 - DNA, 22 bp, Homo sapiens
gaaactctcgcatcctgggaac

SEQ ID NO: 7523569 - DNA, 22 bp, Homo sapiens
gaaactgagtaggctagagcac

SEQ ID NO: 7523570 - DNA, 22 bp, Homo sapiens
gaaactggatgcagggatgcag

SEQ ID NO: 7523571 - DNA, 22 bp, Homo sapiens
gaaactggatgcagggatgcag

SEQ ID NO: 7523572 - DNA, 22 bp, Homo sapiens
gaaactgatattaactcagtgt

SEQ ID NO: 7523573 - DNA, 22 bp, Homo sapiens
gaaactgatattaactcagtgt

SEQ ID NO: 7523574 - DNA, 22 bp, Homo sapiens
gaaactggatgcagggatgcag

SEQ ID NO: 7523575 - DNA, 22 bp, Homo sapiens
gaaactgtatgtagtttttggg

SEQ ID NO: 7523576 - DNA, 22 bp, Homo sapiens
gaaactgtgaggatcttaactt

SEQ ID NO: 7523577 - DNA, 22 bp, Homo sapiens
gaaactgtatgtagtttttggg

SEQ ID NO: 7523578 - DNA, 22 bp, Homo sapiens
gaaacgaagctctagattagaa

SEQ ID NO: 7523579 - DNA, 22 bp, Homo sapiens
gaaacgaagctctagattagaa

SEQ ID NO: 7523580 - DNA, 22 bp, Homo sapiens
gaaacctgtgctgatttgttag

SEQ ID NO: 7523581 - DNA, 22 bp, Homo sapiens
gaaacctggttctgcgtgaggg

SEQ ID NO: 7523582 - DNA, 22 bp, Homo sapiens
gaaacctgtcccctcttcctca

SEQ ID NO: 7523583 - DNA, 22 bp, Homo sapiens
gaaacctcttagcctctctttg

SEQ ID NO: 7523584 - DNA, 22 bp, Homo sapiens
gaaacctgagccagagtgggga

SEQ ID NO: 7523585 - DNA, 18 bp, Homo sapiens
gaaacctgaggaagaaag

SEQ ID NO: 7523586 - DNA, 22 bp, Homo sapiens
gaaacctgagtgcagatcagga

SEQ ID NO: 7523587 - DNA, 22 bp, Homo sapiens
gaaacctgagtgcagatcagga

SEQ ID NO: 7523588 - DNA, 22 bp, Homo sapiens
gaaacctgggatatataagttt

SEQ ID NO: 7523589 - DNA, 22 bp, Homo sapiens
gaaacccttcctagagggcaag

SEQ ID NO: 7523590 - DNA, 22 bp, Homo sapiens
gaaacctacctgaaatgaattg

SEQ ID NO: 7523591 - DNA, 22 bp, Homo sapiens
gaaacctatttataacttctag

SEQ ID NO: 7523592 - DNA, 22 bp, Homo sapiens
gaaacctatttataacttctag

SEQ ID NO: 7523593 - DNA, 22 bp, Homo sapiens
gaaacccaaactaagacagtag

SEQ ID NO: 7523594 - DNA, 22 bp, Homo sapiens
gaaacccaaactaagacagtag

SEQ ID NO: 7523595 - DNA, 22 bp, Homo sapiens
gaaaccagtttgtaccaagatc

SEQ ID NO: 7523596 - DNA, 21 bp, Homo sapiens
gaaaccaggttatcaatcaca

SEQ ID NO: 7523597 - DNA, 22 bp, Homo sapiens
gaaaccatgcaagctgctagag

SEQ ID NO: 7523598 - DNA, 22 bp, Homo sapiens
gaaaccatgcaagctgctagag

SEQ ID NO: 7523599 - DNA, 22 bp, Homo sapiens
gaaaccatgcaagctgctagag

SEQ ID NO: 7523600 - DNA, 22 bp, Homo sapiens
gaaacccaaactaagacagtag

SEQ ID NO: 7523601 - DNA, 22 bp, Homo sapiens
gaaacccaaactaagacagtag

SEQ ID NO: 7523602 - DNA, 21 bp, Homo sapiens
gaaaccaggttatcaatcaca

SEQ ID NO: 7523603 - DNA, 22 bp, Homo sapiens
gaaaccagtttgtaccaagatc

SEQ ID NO: 7523604 - DNA, 22 bp, Homo sapiens
gaaacttgataattgaaacaga

SEQ ID NO: 7523605 - DNA, 22 bp, Homo sapiens
gaaacttgcctgaagtcaacca

SEQ ID NO: 7523606 - DNA, 22 bp, Homo sapiens
gaaactttcatgaatataagat

SEQ ID NO: 7523607 - DNA, 22 bp, Homo sapiens
gaaactttggctaaaagccaga

SEQ ID NO: 7523608 - DNA, 22 bp, Homo sapiens
gaaactttggctaaaagccaga

SEQ ID NO: 7523609 - DNA, 22 bp, Homo sapiens
gaaactgtgatcgtgttctggg

SEQ ID NO: 7523610 - DNA, 22 bp, Homo sapiens
gaaactgtgatcgtgttctggg

SEQ ID NO: 7523611 - DNA, 22 bp, Homo sapiens
gaaactgtttctggctttggtg

SEQ ID NO: 7523612 - DNA, 22 bp, Homo sapiens
gaaactgtttctggctttggtg

SEQ ID NO: 7523613 - DNA, 22 bp, Homo sapiens
gaaactgtgaggatcttaactt

SEQ ID NO: 7523614 - DNA, 22 bp, Homo sapiens
gaaacttcttgtctcacagttc

SEQ ID NO: 7523615 - DNA, 22 bp, Homo sapiens
gaaactgtatgtagtttttggg

SEQ ID NO: 7523616 - DNA, 22 bp, Homo sapiens
gaaacttacttactcacatttc

SEQ ID NO: 7523617 - DNA, 22 bp, Homo sapiens
gaaagaatgctgggagccatct

SEQ ID NO: 7523618 - DNA, 22 bp, Homo sapiens
gaaagaatgctatagtgacttc

SEQ ID NO: 7523619 - DNA, 22 bp, Homo sapiens
gaaagaatgctatagtgacttc

SEQ ID NO: 7523620 - DNA, 22 bp, Homo sapiens
gaaagaatgctatagtgacttc

SEQ ID NO: 7523621 - DNA, 22 bp, Homo sapiens
gaaagaatgagcatcatgactt

SEQ ID NO: 7523622 - DNA, 22 bp, Homo sapiens
gaaagaatgagcatcatgactt

SEQ ID NO: 7523623 - DNA, 22 bp, Homo sapiens
gaaagaatcaactatgtctctg

SEQ ID NO: 7523624 - DNA, 22 bp, Homo sapiens
gaaagaatcaactatgtctctg

SEQ ID NO: 7523625 - DNA, 22 bp, Homo sapiens
gaaagaagctttagatggctat

SEQ ID NO: 7523626 - DNA, 22 bp, Homo sapiens
gaaagaagctttagatggctat

SEQ ID NO: 7523627 - DNA, 22 bp, Homo sapiens
gaaagaagctttagatggctat

SEQ ID NO: 7523628 - DNA, 22 bp, Homo sapiens
gaaagaagctttagatggctat

SEQ ID NO: 7523629 - DNA, 22 bp, Homo sapiens
gaaagaagctttagatggctat

SEQ ID NO: 7523630 - DNA, 22 bp, Homo sapiens
gaaaaatgagctgatgtcaggg

SEQ ID NO: 7523631 - DNA, 22 bp, Homo sapiens
gaaaaatgagctgatgtcaggg

SEQ ID NO: 7523632 - DNA, 22 bp, Homo sapiens
gaaaaatgagctgatgtcaggg

SEQ ID NO: 7523633 - DNA, 22 bp, Homo sapiens
gaaaaatgagctgatgtcaggg

SEQ ID NO: 7523634 - DNA, 22 bp, Homo sapiens
gaaaaatgagctgatgtcaggg

SEQ ID NO: 7523635 - DNA, 22 bp, Homo sapiens
gaaaaatgctccaaatctgtgg

SEQ ID NO: 7523636 - DNA, 22 bp, Homo sapiens
gaaaaatgctccaaatctgtgg

SEQ ID NO: 7523637 - DNA, 22 bp, Homo sapiens
gaaaaatgctccaaatctgtgg

SEQ ID NO: 7523638 - DNA, 22 bp, Homo sapiens
gaaaaatgctccaaatctgtgg

SEQ ID NO: 7523639 - DNA, 22 bp, Homo sapiens
gaaaaatgctccaaatctgtgg

SEQ ID NO: 7523640 - DNA, 22 bp, Homo sapiens
gaaaaatgagctgatgtcaggg

SEQ ID NO: 7523641 - DNA, 22 bp, Homo sapiens
gaaaaatgctccaaatctgtgg

SEQ ID NO: 7523642 - DNA, 22 bp, Homo sapiens
gaaaaatgctccaaatctgtgg

SEQ ID NO: 7523643 - DNA, 22 bp, Homo sapiens
gaaaaatgctccaaatctgtgg

SEQ ID NO: 7523644 - DNA, 22 bp, Homo sapiens
gaaaaatgctccaaatctgtgg

SEQ ID NO: 7523645 - DNA, 22 bp, Homo sapiens
gaaaaatgctccaaatctgtgg

SEQ ID NO: 7523646 - DNA, 22 bp, Homo sapiens
gaaaacactttgatctgaaagt

SEQ ID NO: 7523647 - DNA, 22 bp, Homo sapiens
gaaaacactttgatctgaaagt

SEQ ID NO: 7523648 - DNA, 22 bp, Homo sapiens
gaaacagctagaaagccattgg

SEQ ID NO: 7523649 - DNA, 22 bp, Homo sapiens
gaaacagctagaaagccattgg

SEQ ID NO: 7523650 - DNA, 22 bp, Homo sapiens
gaaacagcccctgtgtgaagca

SEQ ID NO: 7523651 - DNA, 22 bp, Homo sapiens
gaaacagctagaaagccattgg

SEQ ID NO: 7523652 - DNA, 22 bp, Homo sapiens
gaaacagcacgtttggagagat

SEQ ID NO: 7523653 - DNA, 22 bp, Homo sapiens
gaaacagcccctgtgtgaagca

SEQ ID NO: 7523654 - DNA, 22 bp, Homo sapiens
gaaacagctagaaagccattgg

SEQ ID NO: 7523655 - DNA, 22 bp, Homo sapiens
gaaacagctttaagtgatactg

SEQ ID NO: 7523656 - DNA, 22 bp, Homo sapiens
gaaacagctttaagtgatactg

SEQ ID NO: 7523657 - DNA, 22 bp, Homo sapiens
gaaacagctttaagtgatactg

SEQ ID NO: 7523658 - DNA, 22 bp, Homo sapiens
gaaaccagcatttaaaccagga

SEQ ID NO: 7523659 - DNA, 22 bp, Homo sapiens
gaaaccagcatttaaaccagga

SEQ ID NO: 7523660 - DNA, 22 bp, Homo sapiens
gaaaccagcatttaaaccagga

SEQ ID NO: 7523661 - DNA, 22 bp, Homo sapiens
gaaaccagctagaggcagaggg

SEQ ID NO: 7523662 - DNA, 22 bp, Homo sapiens
gaaaccagctagaggcagaggg

SEQ ID NO: 7523663 - DNA, 22 bp, Homo sapiens
gaaaccagctagaggcagaggg

SEQ ID NO: 7523664 - DNA, 22 bp, Homo sapiens
gaaaaagtgaccttggtagcta

SEQ ID NO: 7523665 - DNA, 22 bp, Homo sapiens
gaaaaagtgaccttggtagcta

SEQ ID NO: 7523666 - DNA, 22 bp, Homo sapiens
gaaaaagtgaccttggtagcta

SEQ ID NO: 7523667 - DNA, 22 bp, Homo sapiens
gaaaaatgagctgatgtcaggg

SEQ ID NO: 7523668 - DNA, 22 bp, Homo sapiens
gaaaaatgagctgatgtcaggg

SEQ ID NO: 7523669 - DNA, 22 bp, Homo sapiens
gaaaaatgagctgatgtcaggg

SEQ ID NO: 7523670 - DNA, 22 bp, Homo sapiens
gaaaaagtgaccttggtagcta

SEQ ID NO: 7523671 - DNA, 22 bp, Homo sapiens
gaaaaagtgaccttggtagcta

SEQ ID NO: 7523672 - DNA, 22 bp, Homo sapiens
gaaaaaggataaatacagtgtt

SEQ ID NO: 7523673 - DNA, 22 bp, Homo sapiens
gaaaaaggataaatacagtgtt

SEQ ID NO: 7523674 - DNA, 22 bp, Homo sapiens
gaaaaaggataaatacagtgtt

SEQ ID NO: 7523675 - DNA, 22 bp, Homo sapiens
gaaaaagtgaccttggtagcta

SEQ ID NO: 7523676 - DNA, 22 bp, Homo sapiens
gaaaaagtgaccttggtagcta

SEQ ID NO: 7523677 - DNA, 22 bp, Homo sapiens
gaaaaaggataaatacagtgtt

SEQ ID NO: 7523678 - DNA, 22 bp, Homo sapiens
gaaaaaggataaatacagtgtt

SEQ ID NO: 7523679 - DNA, 22 bp, Homo sapiens
gaaaaaggataaatacagtgtt

SEQ ID NO: 7523680 - DNA, 22 bp, Homo sapiens
gaaaaaggataaatacagtgtt

SEQ ID NO: 7523681 - DNA, 22 bp, Homo sapiens
gaaaaaggataaatacagtgtt

SEQ ID NO: 7523682 - DNA, 22 bp, Homo sapiens
gaaaaaggataaatacagtgtt

SEQ ID NO: 7523683 - DNA, 22 bp, Homo sapiens
gaaaaaggataaatacagtgtt

SEQ ID NO: 7523684 - DNA, 22 bp, Homo sapiens
gaaaaaggataaatacagtgtt

SEQ ID NO: 7523685 - DNA, 22 bp, Homo sapiens
cttttttcctaaggcaacatga

SEQ ID NO: 7523686 - DNA, 22 bp, Homo sapiens
cttttttcctaaggcaacatga

SEQ ID NO: 7523687 - DNA, 22 bp, Homo sapiens
cttttttcctaaggcaacatga

SEQ ID NO: 7523688 - DNA, 22 bp, Homo sapiens
cttttttcctaaggcaacatga

SEQ ID NO: 7523689 - DNA, 22 bp, Homo sapiens
cttttttcctaaggcaacatga

SEQ ID NO: 7523690 - DNA, 22 bp, Homo sapiens
cttttttcctaaggcaacatga

SEQ ID NO: 7523691 - DNA, 22 bp, Homo sapiens
ctttttgttgtataagcccttt

SEQ ID NO: 7523692 - DNA, 22 bp, Homo sapiens
ctttttgttgtataagcccttt

SEQ ID NO: 7523693 - DNA, 22 bp, Homo sapiens
ctttttgttgtataagcccttt

SEQ ID NO: 7523694 - DNA, 22 bp, Homo sapiens
ctttttgttgtataagcccttt

SEQ ID NO: 7523695 - DNA, 22 bp, Homo sapiens
ctttttgttgtccacactagga

SEQ ID NO: 7523696 - DNA, 22 bp, Homo sapiens
ctttttgttgtccacactagga

SEQ ID NO: 7523697 - DNA, 22 bp, Homo sapiens
ctttttgttgtataagcccttt

SEQ ID NO: 7523698 - DNA, 22 bp, Homo sapiens
ctttttgtgtatgctacagttg

SEQ ID NO: 7523699 - DNA, 22 bp, Homo sapiens
ctttttgtgtatgctacagttg

SEQ ID NO: 7523700 - DNA, 22 bp, Homo sapiens
ctttttgtgtatgctacagttg

SEQ ID NO: 7523701 - DNA, 22 bp, Homo sapiens
ctttttgtgtatgctacagttg

SEQ ID NO: 7523702 - DNA, 22 bp, Homo sapiens
ctttttgtctctgtcctgatga

SEQ ID NO: 7523703 - DNA, 22 bp, Homo sapiens
ctttttgtctctgtcctgatga

SEQ ID NO: 7523704 - DNA, 22 bp, Homo sapiens
ctttttgtctctgtcctgatga

SEQ ID NO: 7523705 - DNA, 22 bp, Homo sapiens
ctttttgtctctgtcctgatga

SEQ ID NO: 7523706 - DNA, 22 bp, Homo sapiens
cttttttaaggtagctcctcct

SEQ ID NO: 7523707 - DNA, 22 bp, Homo sapiens
cttttttcctaaggcaacatga

SEQ ID NO: 7523708 - DNA, 22 bp, Homo sapiens
cttttttcctaaggcaacatga

SEQ ID NO: 7523709 - DNA, 22 bp, Homo sapiens
cttttttaaggtagctcctcct

SEQ ID NO: 7523710 - DNA, 22 bp, Homo sapiens
cttttttcctaaggcaacatga

SEQ ID NO: 7523711 - DNA, 22 bp, Homo sapiens
ctttttgttgtccacactagga

SEQ ID NO: 7523712 - DNA, 22 bp, Homo sapiens
ctttttgttgtccacactagga

SEQ ID NO: 7523713 - DNA, 22 bp, Homo sapiens
ctttttgttgtccacactagga

SEQ ID NO: 7523714 - DNA, 22 bp, Homo sapiens
cttttttaaggtagctcctcct

SEQ ID NO: 7523715 - DNA, 22 bp, Homo sapiens
cttttttaaggtagctcctcct

SEQ ID NO: 7523716 - DNA, 22 bp, Homo sapiens
cttttttaaggtagctcctcct

SEQ ID NO: 7523717 - DNA, 22 bp, Homo sapiens
cttttttaaggtagctcctcct

SEQ ID NO: 7523718 - DNA, 22 bp, Homo sapiens
cttttttaaggtagctcctcct

SEQ ID NO: 7523719 - DNA, 22 bp, Homo sapiens
ctttggaggtcatagccaagag

SEQ ID NO: 7523720 - DNA, 22 bp, Homo sapiens
ctttggaggtcatagccaagag

SEQ ID NO: 7523721 - DNA, 22 bp, Homo sapiens
ctttggatgactggtgcaggtt

SEQ ID NO: 7523722 - DNA, 22 bp, Homo sapiens
ctttggagttccctaatttccc

SEQ ID NO: 7523723 - DNA, 22 bp, Homo sapiens
ctttggatggctgtgtgtttat

SEQ ID NO: 7523724 - DNA, 22 bp, Homo sapiens
ctttggatggctgtgtgtttat

SEQ ID NO: 7523725 - DNA, 22 bp, Homo sapiens
ctttggatttttatcaggcaat

SEQ ID NO: 7523726 - DNA, 22 bp, Homo sapiens
ctttggcaatgaaacacaagaa

SEQ ID NO: 7523727 - DNA, 22 bp, Homo sapiens
ctttggcaatgaaacacaagaa

SEQ ID NO: 7523728 - DNA, 22 bp, Homo sapiens
ctttggcaacacatgtgggaca

SEQ ID NO: 7523729 - DNA, 21 bp, Homo sapiens
ctttggcaagggagaagtcac

SEQ ID NO: 7523730 - DNA, 22 bp, Homo sapiens
ctttggcaagggttttaattgt

SEQ ID NO: 7523731 - DNA, 22 bp, Homo sapiens
ctttggaggtcatagccaagag

SEQ ID NO: 7523732 - DNA, 22 bp, Homo sapiens
ctttggaggtcatagccaagag

SEQ ID NO: 7523733 - DNA, 19 bp, Homo sapiens
ctttggaggatgaggctgg

SEQ ID NO: 7523734 - DNA, 19 bp, Homo sapiens
ctttggaggatgaggctgg

SEQ ID NO: 7523735 - DNA, 22 bp, Homo sapiens
ctttggaggaaaattgaggtca

SEQ ID NO: 7523736 - DNA, 22 bp, Homo sapiens
ctttggaggaaaattgaggtca

SEQ ID NO: 7523737 - DNA, 22 bp, Homo sapiens
ctttggaggacctatgtgcaat

SEQ ID NO: 7523738 - DNA, 22 bp, Homo sapiens
ctttggaggacctatgtgcaat

SEQ ID NO: 7523739 - DNA, 22 bp, Homo sapiens
ctttggaggacctatgtgcaat

SEQ ID NO: 7523740 - DNA, 22 bp, Homo sapiens
ctttggaggacctatgtgcaat

SEQ ID NO: 7523741 - DNA, 20 bp, Homo sapiens
ctttggagaaagatgcaata

SEQ ID NO: 7523742 - DNA, 22 bp, Homo sapiens
ctttggaatgcacagaggtgta

SEQ ID NO: 7523743 - DNA, 22 bp, Homo sapiens
ctttggagaaaagttcttgggc

SEQ ID NO: 7523744 - DNA, 22 bp, Homo sapiens
ctttggaatgcacagaggtgta

SEQ ID NO: 7523745 - DNA, 22 bp, Homo sapiens
ctttggaatgcacagaggtgta

SEQ ID NO: 7523746 - DNA, 22 bp, Homo sapiens
ctttggaatcattgcttattca

SEQ ID NO: 7523747 - DNA, 22 bp, Homo sapiens
ctttggaatgcacagaggtgta

SEQ ID NO: 7523748 - DNA, 22 bp, Homo sapiens
ctttggaatgcacagaggtgta

SEQ ID NO: 7523749 - DNA, 22 bp, Homo sapiens
ctttggaatgcacagaggtgta

SEQ ID NO: 7523750 - DNA, 22 bp, Homo sapiens
ctttggagaagaatgcatcctt

SEQ ID NO: 7523751 - DNA, 22 bp, Homo sapiens
ctttggagaagaatgcatcctt

SEQ ID NO: 7523752 - DNA, 20 bp, Homo sapiens
ctttggagaaagatgcaata

SEQ ID NO: 7523753 - DNA, 20 bp, Homo sapiens
ctttggagaaagatgcaata

SEQ ID NO: 7523754 - DNA, 20 bp, Homo sapiens
ctttggagaaagctaacaga

SEQ ID NO: 7523755 - DNA, 20 bp, Homo sapiens
ctttggagaaagctaacaga

SEQ ID NO: 7523756 - DNA, 22 bp, Homo sapiens
ctttggaagtgaccacaatcct

SEQ ID NO: 7523757 - DNA, 22 bp, Homo sapiens
ctttggaagtgaccacaatcct

SEQ ID NO: 7523758 - DNA, 22 bp, Homo sapiens
ctttggaagtgaccacaatcct

SEQ ID NO: 7523759 - DNA, 22 bp, Homo sapiens
ctttggaagtgaccacaatcct

SEQ ID NO: 7523760 - DNA, 22 bp, Homo sapiens
ctttggaagtgaccacaatcct

SEQ ID NO: 7523761 - DNA, 22 bp, Homo sapiens
ctttggaagtgaccacaatcct

SEQ ID NO: 7523762 - DNA, 22 bp, Homo sapiens
ctttggaagtaaagtcagcagg

SEQ ID NO: 7523763 - DNA, 22 bp, Homo sapiens
ctttggaagtaaagtcagcagg

SEQ ID NO: 7523764 - DNA, 22 bp, Homo sapiens
ctttggaagtaaagtcagcagg

SEQ ID NO: 7523765 - DNA, 22 bp, Homo sapiens
ctttggaagtgatagatatgat

SEQ ID NO: 7523766 - DNA, 22 bp, Homo sapiens
ctttggaagtgatagatatgat

SEQ ID NO: 7523767 - DNA, 22 bp, Homo sapiens
ctttggaagtgatagatatgat

SEQ ID NO: 7523768 - DNA, 22 bp, Homo sapiens
ctttggaagtgatagatatgat

SEQ ID NO: 7523769 - DNA, 22 bp, Homo sapiens
ctttggaataaaattagttgtt

SEQ ID NO: 7523770 - DNA, 22 bp, Homo sapiens
ctttggaataaaattagttgtt

SEQ ID NO: 7523771 - DNA, 22 bp, Homo sapiens
ctttggaataaaattagttgtt

SEQ ID NO: 7523772 - DNA, 22 bp, Homo sapiens
ctttggaataatcaagctctga

SEQ ID NO: 7523773 - DNA, 22 bp, Homo sapiens
ctttggaataatcaagctctga

SEQ ID NO: 7523774 - DNA, 22 bp, Homo sapiens
ctttggaataatcaagctctga

SEQ ID NO: 7523775 - DNA, 22 bp, Homo sapiens
ctttggaataatcaagctctga

SEQ ID NO: 7523776 - DNA, 22 bp, Homo sapiens
ctttggaataatttcctggagt

SEQ ID NO: 7523777 - DNA, 22 bp, Homo sapiens
ctttggaataatttcctggagt

SEQ ID NO: 7523778 - DNA, 22 bp, Homo sapiens
ctttggaataatcaagctctga

SEQ ID NO: 7523779 - DNA, 22 bp, Homo sapiens
ctttggaataatttcctggagt

SEQ ID NO: 7523780 - DNA, 22 bp, Homo sapiens
ctttggaataatttcctggagt

SEQ ID NO: 7523781 - DNA, 22 bp, Homo sapiens
ctttggaatattttattgagaa

SEQ ID NO: 7523782 - DNA, 22 bp, Homo sapiens
ctttggaatattttattgagaa

SEQ ID NO: 7523783 - DNA, 22 bp, Homo sapiens
ctttggaatattttattgagaa

SEQ ID NO: 7523784 - DNA, 22 bp, Homo sapiens
ctttggaatcattgcttattca

SEQ ID NO: 7523785 - DNA, 22 bp, Homo sapiens
ctttggaatcattgcttattca

SEQ ID NO: 7523786 - DNA, 22 bp, Homo sapiens
ctttggaatcattgcttattca

SEQ ID NO: 7523787 - DNA, 22 bp, Homo sapiens
ctttggaactgtaaggagatgg

SEQ ID NO: 7523788 - DNA, 22 bp, Homo sapiens
ctttggaacatactgctgagct

SEQ ID NO: 7523789 - DNA, 22 bp, Homo sapiens
ctttggaacatactgctgagct

SEQ ID NO: 7523790 - DNA, 22 bp, Homo sapiens
ctttggaacatactgctgagct

SEQ ID NO: 7523791 - DNA, 22 bp, Homo sapiens
ctttggaacatactgctgagct

SEQ ID NO: 7523792 - DNA, 22 bp, Homo sapiens
ctttggaacatactgctgagct

SEQ ID NO: 7523793 - DNA, 22 bp, Homo sapiens
ctttggaacatactgctgagct

SEQ ID NO: 7523794 - DNA, 22 bp, Homo sapiens
ctttggaacacccagctctgtg

SEQ ID NO: 7523795 - DNA, 22 bp, Homo sapiens
ctttggaaggaacaggattctc

SEQ ID NO: 7523796 - DNA, 22 bp, Homo sapiens
ctttggaaggaacaggattctc

SEQ ID NO: 7523797 - DNA, 22 bp, Homo sapiens
ctttggaagccaggcagttcac

SEQ ID NO: 7523798 - DNA, 22 bp, Homo sapiens
ctttggaaggaacaggattctc

SEQ ID NO: 7523799 - DNA, 22 bp, Homo sapiens
ctttggaagccaggcagttcac

SEQ ID NO: 7523800 - DNA, 22 bp, Homo sapiens
ctttggaagccaggcagttcac

SEQ ID NO: 7523801 - DNA, 22 bp, Homo sapiens
ctttggaagccaggcagttcac

SEQ ID NO: 7523802 - DNA, 22 bp, Homo sapiens
ctttggaactgtaaggagatgg

SEQ ID NO: 7523803 - DNA, 22 bp, Homo sapiens
ctttggaactgtaaggagatgg

SEQ ID NO: 7523804 - DNA, 22 bp, Homo sapiens
ctttggaactgtaaggagatgg

SEQ ID NO: 7523805 - DNA, 22 bp, Homo sapiens
ctttggaactgtaaggagatgg

SEQ ID NO: 7523806 - DNA, 22 bp, Homo sapiens
ctttggaaggcagagctctgtg

SEQ ID NO: 7523807 - DNA, 22 bp, Homo sapiens
ctttggaaggcagagctctgtg

SEQ ID NO: 7523808 - DNA, 22 bp, Homo sapiens
ctttggaaggaagacctttcag

SEQ ID NO: 7523809 - DNA, 22 bp, Homo sapiens
ctttggaaggaagacctttcag

SEQ ID NO: 7523810 - DNA, 22 bp, Homo sapiens
ctttggaaggaacaggattctc

SEQ ID NO: 7523811 - DNA, 22 bp, Homo sapiens
ctttggaaggaacaggattctc

SEQ ID NO: 7523812 - DNA, 22 bp, Homo sapiens
ctttggaaggaacaggattctc

SEQ ID NO: 7523813 - DNA, 22 bp, Homo sapiens
ctttggaaggtcgtccgtgtgg

SEQ ID NO: 7523814 - DNA, 22 bp, Homo sapiens
ctttggaaggtcgtccgtgtgg

SEQ ID NO: 7523815 - DNA, 22 bp, Homo sapiens
ctttggaagtaaagtcagcagg

SEQ ID NO: 7523816 - DNA, 22 bp, Homo sapiens
ctttggaaggtcgtccgtgtgg

SEQ ID NO: 7523817 - DNA, 22 bp, Homo sapiens
ctttggaaggcagagctctgtg

SEQ ID NO: 7523818 - DNA, 22 bp, Homo sapiens
ctttggaaggcagagctctgtg

SEQ ID NO: 7523819 - DNA, 22 bp, Homo sapiens
ctttggaaggcagagctctgtg

SEQ ID NO: 7523820 - DNA, 20 bp, Homo sapiens
ctttggcaatgagaacaggg

SEQ ID NO: 7523821 - DNA, 20 bp, Homo sapiens
ctttggcaatgagaacaggg

SEQ ID NO: 7523822 - DNA, 20 bp, Homo sapiens
ctttggcaatgagaacaggg

SEQ ID NO: 7523823 - DNA, 20 bp, Homo sapiens
ctttggcaatgagaacaggg

SEQ ID NO: 7523824 - DNA, 20 bp, Homo sapiens
ctttggcaatgagaacaggg

SEQ ID NO: 7523825 - DNA, 22 bp, Homo sapiens
ctttggcacagtctcatttgat

SEQ ID NO: 7523826 - DNA, 22 bp, Homo sapiens
ctttggcaatgtcattttcaat

SEQ ID NO: 7523827 - DNA, 23 bp, Homo sapiens
ctttggcactttacaataaactc

SEQ ID NO: 7523828 - DNA, 22 bp, Homo sapiens
ctttggcactgcgcagccattt

SEQ ID NO: 7523829 - DNA, 22 bp, Homo sapiens
ctttggcacagtgtttactagc

SEQ ID NO: 7523830 - DNA, 22 bp, Homo sapiens
ctttggcacagtctcatttgat

SEQ ID NO: 7523831 - DNA, 22 bp, Homo sapiens
cttttgttctacagctggggaa

SEQ ID NO: 7523832 - DNA, 22 bp, Homo sapiens
cttttgttgcccttgtcgcagg

SEQ ID NO: 7523833 - DNA, 22 bp, Homo sapiens
cttttgttgcccttgtcgcagg

SEQ ID NO: 7523834 - DNA, 22 bp, Homo sapiens
cttttgttgcccttgtcgcagg

SEQ ID NO: 7523835 - DNA, 22 bp, Homo sapiens
ctttttcccaggtggagagagg

SEQ ID NO: 7523836 - DNA, 22 bp, Homo sapiens
ctttttcccaggtggagagagg

SEQ ID NO: 7523837 - DNA, 22 bp, Homo sapiens
cttttgttctacagctggggaa

SEQ ID NO: 7523838 - DNA, 22 bp, Homo sapiens
cttttgttctacagctggggaa

SEQ ID NO: 7523839 - DNA, 22 bp, Homo sapiens
cttttgttctacagctggggaa

SEQ ID NO: 7523840 - DNA, 22 bp, Homo sapiens
cttttgttctacagctggggaa

SEQ ID NO: 7523841 - DNA, 22 bp, Homo sapiens
cttttgttaggagaaaacatca

SEQ ID NO: 7523842 - DNA, 22 bp, Homo sapiens
ctttggcagacattaggggtga

SEQ ID NO: 7523843 - DNA, 22 bp, Homo sapiens
cttttgcagccattattgctgc

SEQ ID NO: 7523844 - DNA, 22 bp, Homo sapiens
cttttggcctcaaaggaaagaa

SEQ ID NO: 7523845 - DNA, 22 bp, Homo sapiens
cttttggcctcaaaggaaagaa

SEQ ID NO: 7523846 - DNA, 22 bp, Homo sapiens
cttttgtctaccctgattccag

SEQ ID NO: 7523847 - DNA, 22 bp, Homo sapiens
cttttgtctaccctgattccag

SEQ ID NO: 7523848 - DNA, 22 bp, Homo sapiens
cttttgtgattcctcagttact

SEQ ID NO: 7523849 - DNA, 22 bp, Homo sapiens
cttttgtgattcctcagttact

SEQ ID NO: 7523850 - DNA, 22 bp, Homo sapiens
cttttgtggcaatggttaagag

SEQ ID NO: 7523851 - DNA, 22 bp, Homo sapiens
cttttgttaggagaaaacatca

SEQ ID NO: 7523852 - DNA, 22 bp, Homo sapiens
cttttgttaggagaaaacatca

SEQ ID NO: 7523853 - DNA, 22 bp, Homo sapiens
cttttgttaggagaaaacatca

SEQ ID NO: 7523854 - DNA, 22 bp, Homo sapiens
cttttgttaggagaaaacatca

SEQ ID NO: 7523855 - DNA, 22 bp, Homo sapiens
ctttttgtctctgtcctgatga

SEQ ID NO: 7523856 - DNA, 22 bp, Homo sapiens
ctttttgcaagagtttctcatc

SEQ ID NO: 7523857 - DNA, 22 bp, Homo sapiens
ctttttgcaagagtttctcatc

SEQ ID NO: 7523858 - DNA, 22 bp, Homo sapiens
ctttttgcaagagtttctcatc

SEQ ID NO: 7523859 - DNA, 22 bp, Homo sapiens
ctttttcttctaggtgtgcctg

SEQ ID NO: 7523860 - DNA, 22 bp, Homo sapiens
ctttttgcaagagtttctcatc

SEQ ID NO: 7523861 - DNA, 22 bp, Homo sapiens
ctttttctgatgttccatgatt

SEQ ID NO: 7523862 - DNA, 22 bp, Homo sapiens
ctttttctgatgttccatgatt

SEQ ID NO: 7523863 - DNA, 22 bp, Homo sapiens
ctttttcttctaggtgtgcctg

SEQ ID NO: 7523864 - DNA, 22 bp, Homo sapiens
ctttttcttctaggtgtgcctg

SEQ ID NO: 7523865 - DNA, 22 bp, Homo sapiens
ctttttcttctaggtgtgcctg

SEQ ID NO: 7523866 - DNA, 22 bp, Homo sapiens
ctttttctgatgttccatgatt

SEQ ID NO: 7523867 - DNA, 22 bp, Homo sapiens
ctttttctgatgttccatgatt

SEQ ID NO: 7523868 - DNA, 22 bp, Homo sapiens
ctttttctgatgttccatgatt

SEQ ID NO: 7523869 - DNA, 22 bp, Homo sapiens
ctttttctgatgttccatgatt

SEQ ID NO: 7523870 - DNA, 22 bp, Homo sapiens
ctttttctgatgttccatgatt

SEQ ID NO: 7523871 - DNA, 20 bp, Homo sapiens
ctttttctccagctctgagc

SEQ ID NO: 7523872 - DNA, 16 bp, Homo sapiens
ctttttctcccctctt

SEQ ID NO: 7523873 - DNA, 22 bp, Homo sapiens
ctttttctgatgttccatgatt

SEQ ID NO: 7523874 - DNA, 22 bp, Homo sapiens
ctttttctgatgttccatgatt

SEQ ID NO: 7523875 - DNA, 16 bp, Homo sapiens
ctttttctcccctctt

SEQ ID NO: 7523876 - DNA, 20 bp, Homo sapiens
ctttttctccagctctgagc

SEQ ID NO: 7523877 - DNA, 20 bp, Homo sapiens
ctttttctccagctctgagc

SEQ ID NO: 7523878 - DNA, 20 bp, Homo sapiens
ctttttctccagctctgagc

SEQ ID NO: 7523879 - DNA, 20 bp, Homo sapiens
ctttttctccagctctgagc

SEQ ID NO: 7523880 - DNA, 20 bp, Homo sapiens
ctttttctccagctctgagc

SEQ ID NO: 7523881 - DNA, 20 bp, Homo sapiens
ctttttctccagctctgagc

SEQ ID NO: 7523882 - DNA, 20 bp, Homo sapiens
ctttttctccagctctgagc

SEQ ID NO: 7523883 - DNA, 16 bp, Homo sapiens
ctttttctcccctctt

SEQ ID NO: 7523884 - DNA, 16 bp, Homo sapiens
ctttttctcccctctt

SEQ ID NO: 7523885 - DNA, 22 bp, Homo sapiens
ctttttctaatcataattgtct

SEQ ID NO: 7523886 - DNA, 22 bp, Homo sapiens
ctttttctaatcataattgtct

SEQ ID NO: 7523887 - DNA, 22 bp, Homo sapiens
ctttttctaatcataattgtct

SEQ ID NO: 7523888 - DNA, 22 bp, Homo sapiens
ctttttctaatcataattgtct

SEQ ID NO: 7523889 - DNA, 22 bp, Homo sapiens
ctttttctaatcataattgtct

SEQ ID NO: 7523890 - DNA, 22 bp, Homo sapiens
ctttttcctcgtagagcctaat

SEQ ID NO: 7523891 - DNA, 22 bp, Homo sapiens
ctttttctaatcataattgtct

SEQ ID NO: 7523892 - DNA, 22 bp, Homo sapiens
ctttttcctcgtagagcctaat

SEQ ID NO: 7523893 - DNA, 22 bp, Homo sapiens
ctttttcctcgtagagcctaat

SEQ ID NO: 7523894 - DNA, 22 bp, Homo sapiens
ctttttcctcgtagagcctaat

SEQ ID NO: 7523895 - DNA, 22 bp, Homo sapiens
gaaatattcttgtcttgttttc

SEQ ID NO: 7523896 - DNA, 22 bp, Homo sapiens
gaaatattcttgtcttgttttc

SEQ ID NO: 7523897 - DNA, 22 bp, Homo sapiens
gaaatattcttgtcttgttttc

SEQ ID NO: 7523898 - DNA, 22 bp, Homo sapiens
gaaatattcttgtcttgttttc

SEQ ID NO: 7523899 - DNA, 22 bp, Homo sapiens
gaaatattcttgtcttgttttc

SEQ ID NO: 7523900 - DNA, 22 bp, Homo sapiens
gaaatattcttgtcttgttttc

SEQ ID NO: 7523901 - DNA, 22 bp, Homo sapiens
gaaatattacagtggaggggat

SEQ ID NO: 7523902 - DNA, 22 bp, Homo sapiens
gaaatattacagtggaggggat

SEQ ID NO: 7523903 - DNA, 22 bp, Homo sapiens
gaaatattcttgtcttgttttc

SEQ ID NO: 7523904 - DNA, 22 bp, Homo sapiens
gaaatattcttgtcttgttttc

SEQ ID NO: 7523905 - DNA, 22 bp, Homo sapiens
gaaatattcttgtcttgttttc

SEQ ID NO: 7523906 - DNA, 22 bp, Homo sapiens
gaaatattcttgtcttgttttc

SEQ ID NO: 7523907 - DNA, 22 bp, Homo sapiens
gaaatattcttgtcttgttttc

SEQ ID NO: 7523908 - DNA, 22 bp, Homo sapiens
gaaatattcttgtcttgttttc

SEQ ID NO: 7523909 - DNA, 22 bp, Homo sapiens
gaaatattcttgtcttgttttc

SEQ ID NO: 7523910 - DNA, 22 bp, Homo sapiens
gaaatattcttgtcttgttttc

SEQ ID NO: 7523911 - DNA, 22 bp, Homo sapiens
gaaatattacagtggaggggat

SEQ ID NO: 7523912 - DNA, 22 bp, Homo sapiens
gaaatattacagtggaggggat

SEQ ID NO: 7523913 - DNA, 22 bp, Homo sapiens
gaaatattacagtggaggggat

SEQ ID NO: 7523914 - DNA, 22 bp, Homo sapiens
gaaatattacagtggaggggat

SEQ ID NO: 7523915 - DNA, 22 bp, Homo sapiens
gaaatattacagtggaggggat

SEQ ID NO: 7523916 - DNA, 22 bp, Homo sapiens
gaaatatacattgcaggaagag

SEQ ID NO: 7523917 - DNA, 22 bp, Homo sapiens
gaaatatacattgcaggaagag

SEQ ID NO: 7523918 - DNA, 22 bp, Homo sapiens
gaaatatacattgcaggaagag

SEQ ID NO: 7523919 - DNA, 22 bp, Homo sapiens
gaaatatacattgcaggaagag

SEQ ID NO: 7523920 - DNA, 22 bp, Homo sapiens
gaaatatacattgcaggaagag

SEQ ID NO: 7523921 - DNA, 22 bp, Homo sapiens
gaaatatacattgcaggaagag

SEQ ID NO: 7523922 - DNA, 22 bp, Homo sapiens
gaaatatacattgcaggaagag

SEQ ID NO: 7523923 - DNA, 22 bp, Homo sapiens
gaaatacagaaagggctgaatg

SEQ ID NO: 7523924 - DNA, 22 bp, Homo sapiens
gaaatacagaaagggctgaatg

SEQ ID NO: 7523925 - DNA, 22 bp, Homo sapiens
gaaatacagaaagggctgaatg

SEQ ID NO: 7523926 - DNA, 22 bp, Homo sapiens
gaaatacagaaagggctgaatg

SEQ ID NO: 7523927 - DNA, 22 bp, Homo sapiens
gaaagagaacctgggcctagat

SEQ ID NO: 7523928 - DNA, 22 bp, Homo sapiens
gaaagagaacctgggcctagat

SEQ ID NO: 7523929 - DNA, 22 bp, Homo sapiens
gaaagagaacctgggcctagat

SEQ ID NO: 7523930 - DNA, 22 bp, Homo sapiens
gaaagagaacctgggcctagat

SEQ ID NO: 7523931 - DNA, 22 bp, Homo sapiens
gaaatatacattgcaggaagag

SEQ ID NO: 7523932 - DNA, 22 bp, Homo sapiens
gaaatatacattgcaggaagag

SEQ ID NO: 7523933 - DNA, 22 bp, Homo sapiens
gaaatatacattgcaggaagag

SEQ ID NO: 7523934 - DNA, 22 bp, Homo sapiens
gaaatatacattgcaggaagag

SEQ ID NO: 7523935 - DNA, 22 bp, Homo sapiens
gaaatatacattgcaggaagag

SEQ ID NO: 7523936 - DNA, 22 bp, Homo sapiens
gaaatacaggaatgccacacag

SEQ ID NO: 7523937 - DNA, 22 bp, Homo sapiens
gaaatacaggaatgccacacag

SEQ ID NO: 7523938 - DNA, 22 bp, Homo sapiens
gaaatacaggaatgccacacag

SEQ ID NO: 7523939 - DNA, 22 bp, Homo sapiens
gaaatacaggaatgccacacag

SEQ ID NO: 7523940 - DNA, 22 bp, Homo sapiens
gaaagagaacctgggcctagat

SEQ ID NO: 7523941 - DNA, 22 bp, Homo sapiens
gaaagactcttgatgtctttgg

SEQ ID NO: 7523942 - DNA, 22 bp, Homo sapiens
gaaagactgtaggattttgaat

SEQ ID NO: 7523943 - DNA, 22 bp, Homo sapiens
gaaagactgtaggattttgaat

SEQ ID NO: 7523944 - DNA, 22 bp, Homo sapiens
gaaagactaactagaaagtgca

SEQ ID NO: 7523945 - DNA, 22 bp, Homo sapiens
gaaagacatagttgcaagatgg

SEQ ID NO: 7523946 - DNA, 22 bp, Homo sapiens
gaaagacatagttgcaagatgg

SEQ ID NO: 7523947 - DNA, 22 bp, Homo sapiens
gaaagacatagttgcaagatgg

SEQ ID NO: 7523948 - DNA, 22 bp, Homo sapiens
gaaagacatagttgcaagatgg

SEQ ID NO: 7523949 - DNA, 22 bp, Homo sapiens
gaaagacatagttgcaagatgg

SEQ ID NO: 7523950 - DNA, 22 bp, Homo sapiens
gaaagacatagttgcaagatgg

SEQ ID NO: 7523951 - DNA, 22 bp, Homo sapiens
gaaagacatagttgcaagatgg

SEQ ID NO: 7523952 - DNA, 22 bp, Homo sapiens
gaaagacatagttgcaagatgg

SEQ ID NO: 7523953 - DNA, 22 bp, Homo sapiens
gaaagacatagttgcaagatgg

SEQ ID NO: 7523954 - DNA, 22 bp, Homo sapiens
gaaagacatagttgcaagatgg

SEQ ID NO: 7523955 - DNA, 22 bp, Homo sapiens
gaaagacatagttgcaagatgg

SEQ ID NO: 7523956 - DNA, 22 bp, Homo sapiens
gaaatgtcattgccttcagccc

SEQ ID NO: 7523957 - DNA, 22 bp, Homo sapiens
gaaatgtcctcatgaaggaagt

SEQ ID NO: 7523958 - DNA, 22 bp, Homo sapiens
gaaatgtcctcatgaaggaagt

SEQ ID NO: 7523959 - DNA, 20 bp, Homo sapiens
gaaatgtctatgataatgat

SEQ ID NO: 7523960 - DNA, 22 bp, Homo sapiens
gaaatgtctctggatttgcttt

SEQ ID NO: 7523961 - DNA, 22 bp, Homo sapiens
gaaatgtctctggatttgcttt

SEQ ID NO: 7523962 - DNA, 22 bp, Homo sapiens
gaaatgtctgccaggcacatag

SEQ ID NO: 7523963 - DNA, 22 bp, Homo sapiens
gaaatgtctcttgatttttgga

SEQ ID NO: 7523964 - DNA, 22 bp, Homo sapiens
gaaatgtctttgacaagagagg

SEQ ID NO: 7523965 - DNA, 20 bp, Homo sapiens
gaaatgtctatgataatgat

SEQ ID NO: 7523966 - DNA, 22 bp, Homo sapiens
gaaatgtctgccaggcacatag

SEQ ID NO: 7523967 - DNA, 22 bp, Homo sapiens
gaaatgtgacctacttccttgt

SEQ ID NO: 7523968 - DNA, 20 bp, Homo sapiens
gaaatgtgacctcttctgtg

SEQ ID NO: 7523969 - DNA, 18 bp, Homo sapiens
gaaatgtgattctagggc

SEQ ID NO: 7523970 - DNA, 18 bp, Homo sapiens
gaaatgtgattctagggc

SEQ ID NO: 7523971 - DNA, 22 bp, Homo sapiens
gaaatgtgcagaatgtgttaga

SEQ ID NO: 7523972 - DNA, 22 bp, Homo sapiens
gaaatgtgcagaatgtgttaga

SEQ ID NO: 7523973 - DNA, 22 bp, Homo sapiens
gaaatgtgggtcatgacccatt

SEQ ID NO: 7523974 - DNA, 22 bp, Homo sapiens
gaaatgtgggtcatgacccatt

SEQ ID NO: 7523975 - DNA, 22 bp, Homo sapiens
gaaatgtgtgacaagtttcaat

SEQ ID NO: 7523976 - DNA, 22 bp, Homo sapiens
gaaatgtcatagtcttcaagcc

SEQ ID NO: 7523977 - DNA, 22 bp, Homo sapiens
gaaatgtcaagatatgtttgga

SEQ ID NO: 7523978 - DNA, 22 bp, Homo sapiens
gaaatgtatttgacagtccttg

SEQ ID NO: 7523979 - DNA, 22 bp, Homo sapiens
gaaatgtatttgacagtccttg

SEQ ID NO: 7523980 - DNA, 22 bp, Homo sapiens
gaaatgtatttgacagtccttg

SEQ ID NO: 7523981 - DNA, 22 bp, Homo sapiens
gaaatgtatgtcttcccccatt

SEQ ID NO: 7523982 - DNA, 20 bp, Homo sapiens
gaaatgtatctcttgattct

SEQ ID NO: 7523983 - DNA, 20 bp, Homo sapiens
gaaatgtatctcttgattct

SEQ ID NO: 7523984 - DNA, 20 bp, Homo sapiens
gaaatgtatctcttgattct

SEQ ID NO: 7523985 - DNA, 22 bp, Homo sapiens
gaaatgtataagctggtctttt

SEQ ID NO: 7523986 - DNA, 22 bp, Homo sapiens
gaaatgtaggcataattatttt

SEQ ID NO: 7523987 - DNA, 22 bp, Homo sapiens
gaaatattgggactcagagctt

SEQ ID NO: 7523988 - DNA, 22 bp, Homo sapiens
gaaatattgggactcagagctt

SEQ ID NO: 7523989 - DNA, 22 bp, Homo sapiens
gaaatattgggactcagagctt

SEQ ID NO: 7523990 - DNA, 22 bp, Homo sapiens
gaaatattgtactggagatgtt

SEQ ID NO: 7523991 - DNA, 22 bp, Homo sapiens
gaaatattgtactggagatgtt

SEQ ID NO: 7523992 - DNA, 22 bp, Homo sapiens
gaaatattgtactggagatgtt

SEQ ID NO: 7523993 - DNA, 22 bp, Homo sapiens
gaaatattgtactggagatgtt

SEQ ID NO: 7523994 - DNA, 22 bp, Homo sapiens
gaaatattgtactggagatgtt

SEQ ID NO: 7523995 - DNA, 22 bp, Homo sapiens
gaaatattgggactcagagctt

SEQ ID NO: 7523996 - DNA, 22 bp, Homo sapiens
gaaatattgggactcagagctt

SEQ ID NO: 7523997 - DNA, 22 bp, Homo sapiens
gaaatattgggactcagagctt

SEQ ID NO: 7523998 - DNA, 22 bp, Homo sapiens
gaaatattgggactcagagctt

SEQ ID NO: 7523999 - DNA, 22 bp, Homo sapiens
gaaatattgggactcagagctt

SEQ ID NO: 7524000 - DNA, 22 bp, Homo sapiens
gaaatattgtactggagatgtt

SEQ ID NO: 7524001 - DNA, 22 bp, Homo sapiens
gaaatattgtactggagatgtt

SEQ ID NO: 7524002 - DNA, 22 bp, Homo sapiens
gaaatgtagagtatctgaggat

SEQ ID NO: 7524003 - DNA, 22 bp, Homo sapiens
gaaatgtagagtatctgaggat

SEQ ID NO: 7524004 - DNA, 22 bp, Homo sapiens
gaaatgtagaattgcttaactg

SEQ ID NO: 7524005 - DNA, 22 bp, Homo sapiens
gaaatgtaggcataattatttt

SEQ ID NO: 7524006 - DNA, 22 bp, Homo sapiens
gaaatgtagagtatctgaggat

SEQ ID NO: 7524007 - DNA, 22 bp, Homo sapiens
gaaatgtaggcataattatttt

SEQ ID NO: 7524008 - DNA, 22 bp, Homo sapiens
gaaatgtaggcataattatttt

SEQ ID NO: 7524009 - DNA, 22 bp, Homo sapiens
gaaatgtaggcataattatttt

SEQ ID NO: 7524010 - DNA, 22 bp, Homo sapiens
gaaatgtaggcataattatttt

SEQ ID NO: 7524011 - DNA, 22 bp, Homo sapiens
gaaatattgtactggagatgtt

SEQ ID NO: 7524012 - DNA, 22 bp, Homo sapiens
gaaatattgtactggagatgtt

SEQ ID NO: 7524013 - DNA, 22 bp, Homo sapiens
gaaatattgtactggagatgtt

SEQ ID NO: 7524014 - DNA, 22 bp, Homo sapiens
gaaatattgtactggagatgtt

SEQ ID NO: 7524015 - DNA, 22 bp, Homo sapiens
gaaatattgtactggagatgtt

SEQ ID NO: 7524016 - DNA, 22 bp, Homo sapiens
gaaatattgtactggagatgtt

SEQ ID NO: 7524017 - DNA, 22 bp, Homo sapiens
gaaatattgtactggagatgtt

SEQ ID NO: 7524018 - DNA, 22 bp, Homo sapiens
gaaatattgtactggagatgtt

SEQ ID NO: 7524019 - DNA, 17 bp, Homo sapiens
gaagaaggaatctagaa

SEQ ID NO: 7524020 - DNA, 22 bp, Homo sapiens
gaagaaggaagatcatgcttga

SEQ ID NO: 7524021 - DNA, 22 bp, Homo sapiens
gaagaaggaagatcatgcttga

SEQ ID NO: 7524022 - DNA, 17 bp, Homo sapiens
gaagaaggaatctagaa

SEQ ID NO: 7524023 - DNA, 22 bp, Homo sapiens
gaagaaggaagatcatgcttga

SEQ ID NO: 7524024 - DNA, 22 bp, Homo sapiens
gaagaagggagtgacaaatgca

SEQ ID NO: 7524025 - DNA, 22 bp, Homo sapiens
gaagaagggagtgacaaatgca

SEQ ID NO: 7524026 - DNA, 22 bp, Homo sapiens
gaagaagggagtgacaaatgca

SEQ ID NO: 7524027 - DNA, 22 bp, Homo sapiens
gaagaagggagtgacaaatgca

SEQ ID NO: 7524028 - DNA, 17 bp, Homo sapiens
gaagaaggaatctagaa

SEQ ID NO: 7524029 - DNA, 22 bp, Homo sapiens
gaagaagggagtgacaaatgca

SEQ ID NO: 7524030 - DNA, 22 bp, Homo sapiens
gaagaagggagtgacaaatgca

SEQ ID NO: 7524031 - DNA, 16 bp, Homo sapiens
gaagaaggaaaactac

SEQ ID NO: 7524032 - DNA, 19 bp, Homo sapiens
gaagaagcttgagaagtag

SEQ ID NO: 7524033 - DNA, 19 bp, Homo sapiens
gaagaagcttgagaagtag

SEQ ID NO: 7524034 - DNA, 19 bp, Homo sapiens
gaagaagcttgagaagtag

SEQ ID NO: 7524035 - DNA, 22 bp, Homo sapiens
gaagaagagataatggggagca

SEQ ID NO: 7524036 - DNA, 22 bp, Homo sapiens
gaagaagcaggagtgtgtagca

SEQ ID NO: 7524037 - DNA, 22 bp, Homo sapiens
gaagaagcaggagtgtgtagca

SEQ ID NO: 7524038 - DNA, 22 bp, Homo sapiens
gaagaagcctctgtggatctga

SEQ ID NO: 7524039 - DNA, 22 bp, Homo sapiens
gaagaagcattctgctgttttg

SEQ ID NO: 7524040 - DNA, 22 bp, Homo sapiens
gaagaagcattctgctgttttg

SEQ ID NO: 7524041 - DNA, 22 bp, Homo sapiens
gaagaagcattctgctgttttg

SEQ ID NO: 7524042 - DNA, 19 bp, Homo sapiens
gaagaagcttgagaagtag

SEQ ID NO: 7524043 - DNA, 22 bp, Homo sapiens
gaagaagcaggagtgtgtagca

SEQ ID NO: 7524044 - DNA, 22 bp, Homo sapiens
gaagaagagataatggggagca

SEQ ID NO: 7524045 - DNA, 22 bp, Homo sapiens
gaagaagagataatggggagca

SEQ ID NO: 7524046 - DNA, 22 bp, Homo sapiens
gaagaagagataatggggagca

SEQ ID NO: 7524047 - DNA, 22 bp, Homo sapiens
gaagaagacatggaacaatagt

SEQ ID NO: 7524048 - DNA, 22 bp, Homo sapiens
gaagaagacatggaacaatagt

SEQ ID NO: 7524049 - DNA, 22 bp, Homo sapiens
gaagaagacatggaacaatagt

SEQ ID NO: 7524050 - DNA, 22 bp, Homo sapiens
gaagaagacatggaacaatagt

SEQ ID NO: 7524051 - DNA, 22 bp, Homo sapiens
gaagaacttaacataataagga

SEQ ID NO: 7524052 - DNA, 22 bp, Homo sapiens
gaagaacttaacataataagga

SEQ ID NO: 7524053 - DNA, 22 bp, Homo sapiens
gaagaactgaaagttgatgcac

SEQ ID NO: 7524054 - DNA, 22 bp, Homo sapiens
gaagaacttaacataataagga

SEQ ID NO: 7524055 - DNA, 22 bp, Homo sapiens
gaagaactttagggcagaattt

SEQ ID NO: 7524056 - DNA, 22 bp, Homo sapiens
gaagaactttagggcagaattt

SEQ ID NO: 7524057 - DNA, 22 bp, Homo sapiens
gaagaacttataggaatgtcat

SEQ ID NO: 7524058 - DNA, 22 bp, Homo sapiens
gaagaactttagggcagaattt

SEQ ID NO: 7524059 - DNA, 22 bp, Homo sapiens
gaagaactgtgacagaagcagt

SEQ ID NO: 7524060 - DNA, 22 bp, Homo sapiens
gaagaactgtgacagaagcagt

SEQ ID NO: 7524061 - DNA, 22 bp, Homo sapiens
gaagaactgtgacagaagcagt

SEQ ID NO: 7524062 - DNA, 22 bp, Homo sapiens
gaagaactgacaaactagatca

SEQ ID NO: 7524063 - DNA, 22 bp, Homo sapiens
gaagaactgacaaactagatca

SEQ ID NO: 7524064 - DNA, 22 bp, Homo sapiens
gaagaactgtgacagaagcagt

SEQ ID NO: 7524065 - DNA, 22 bp, Homo sapiens
gaacttgtgcactgctggtgat

SEQ ID NO: 7524066 - DNA, 22 bp, Homo sapiens
gaactttaaaacaaagtacagt

SEQ ID NO: 7524067 - DNA, 22 bp, Homo sapiens
gaactttaaaacaaagtacagt

SEQ ID NO: 7524068 - DNA, 22 bp, Homo sapiens
gaagaaatgtgttcaaggtagg

SEQ ID NO: 7524069 - DNA, 20 bp, Homo sapiens
gaacttgggcaagtggctta

SEQ ID NO: 7524070 - DNA, 22 bp, Homo sapiens
gaacttgggagaagggagtgtg

SEQ ID NO: 7524071 - DNA, 22 bp, Homo sapiens
gaacttataattattaagattg

SEQ ID NO: 7524072 - DNA, 22 bp, Homo sapiens
gaaattgtcagtgatatgatac

SEQ ID NO: 7524073 - DNA, 22 bp, Homo sapiens
gaacttataattattaagattg

SEQ ID NO: 7524074 - DNA, 22 bp, Homo sapiens
gaagaaattgaattcatgagct

SEQ ID NO: 7524075 - DNA, 22 bp, Homo sapiens
gaagaaattgaattcatgagct

SEQ ID NO: 7524076 - DNA, 22 bp, Homo sapiens
gaagaaattgaattcatgagct

SEQ ID NO: 7524077 - DNA, 22 bp, Homo sapiens
gaagaaattgaattcatgagct

SEQ ID NO: 7524078 - DNA, 22 bp, Homo sapiens
gaagaaattgaattcatgagct

SEQ ID NO: 7524079 - DNA, 22 bp, Homo sapiens
gaagaaattgaattcatgagct

SEQ ID NO: 7524080 - DNA, 22 bp, Homo sapiens
gaagaaattgaattcatgagct

SEQ ID NO: 7524081 - DNA, 22 bp, Homo sapiens
gaagaaatgtgttcaaggtagg

SEQ ID NO: 7524082 - DNA, 22 bp, Homo sapiens
gaagaacaagcagtgctttcct

SEQ ID NO: 7524083 - DNA, 22 bp, Homo sapiens
gaagaacaagcagtgctttcct

SEQ ID NO: 7524084 - DNA, 22 bp, Homo sapiens
gaagaacaagcagtgctttcct

SEQ ID NO: 7524085 - DNA, 22 bp, Homo sapiens
gaagaacacttcatgattcatt

SEQ ID NO: 7524086 - DNA, 22 bp, Homo sapiens
gaagaacacctgctgcccagtg

SEQ ID NO: 7524087 - DNA, 22 bp, Homo sapiens
gaagaacacttcatgattcatt

SEQ ID NO: 7524088 - DNA, 22 bp, Homo sapiens
gaagaacacttcatgattcatt

SEQ ID NO: 7524089 - DNA, 22 bp, Homo sapiens
gaagaactgaaagttgatgcac

SEQ ID NO: 7524090 - DNA, 22 bp, Homo sapiens
gaagaactaactgaccatgaat

SEQ ID NO: 7524091 - DNA, 22 bp, Homo sapiens
gaagaactaactgaccatgaat

SEQ ID NO: 7524092 - DNA, 22 bp, Homo sapiens
gaagaactaactgaccatgaat

SEQ ID NO: 7524093 - DNA, 22 bp, Homo sapiens
gaagaacgtcttataaattcac

SEQ ID NO: 7524094 - DNA, 22 bp, Homo sapiens
gaagaactgacaaactagatca

SEQ ID NO: 7524095 - DNA, 22 bp, Homo sapiens
gaaattaagcaggggtctgtgg

SEQ ID NO: 7524096 - DNA, 22 bp, Homo sapiens
gaaattaagcaggggtctgtgg

SEQ ID NO: 7524097 - DNA, 22 bp, Homo sapiens
gaaattaagcaggggtctgtgg

SEQ ID NO: 7524098 - DNA, 22 bp, Homo sapiens
gaaattattgctagagactgca

SEQ ID NO: 7524099 - DNA, 22 bp, Homo sapiens
gaaattattgctagagactgca

SEQ ID NO: 7524100 - DNA, 22 bp, Homo sapiens
gaaattattgctagagactgca

SEQ ID NO: 7524101 - DNA, 22 bp, Homo sapiens
gaaattattgctagagactgca

SEQ ID NO: 7524102 - DNA, 22 bp, Homo sapiens
gaaattcaaaatgtcagtatag

SEQ ID NO: 7524103 - DNA, 22 bp, Homo sapiens
gaaattcaaaatgtcagtatag

SEQ ID NO: 7524104 - DNA, 22 bp, Homo sapiens
gaaattcaaaatgtcagtatag

SEQ ID NO: 7524105 - DNA, 22 bp, Homo sapiens
gaaattcaaaatgtcagtatag

SEQ ID NO: 7524106 - DNA, 22 bp, Homo sapiens
gaaattcaaataagatatgtag

SEQ ID NO: 7524107 - DNA, 22 bp, Homo sapiens
gaaattcaaataagatatgtag

SEQ ID NO: 7524108 - DNA, 22 bp, Homo sapiens
gaaattcaaataagatatgtag

SEQ ID NO: 7524109 - DNA, 22 bp, Homo sapiens
gaaattcaaaatgtcagtatag

SEQ ID NO: 7524110 - DNA, 22 bp, Homo sapiens
gaaattcaaaatgtcagtatag

SEQ ID NO: 7524111 - DNA, 22 bp, Homo sapiens
gaaattcactgtatttcttggg

SEQ ID NO: 7524112 - DNA, 22 bp, Homo sapiens
gaaattcaccttttacgtggcc

SEQ ID NO: 7524113 - DNA, 22 bp, Homo sapiens
gaaattcactgtatttcttggg

SEQ ID NO: 7524114 - DNA, 22 bp, Homo sapiens
gaaattcactgtatttcttggg

SEQ ID NO: 7524115 - DNA, 22 bp, Homo sapiens
gaaattcaccttttacgtggcc

SEQ ID NO: 7524116 - DNA, 22 bp, Homo sapiens
gaaattcaccttttacgtggcc

SEQ ID NO: 7524117 - DNA, 22 bp, Homo sapiens
gaaattcaaataagatatgtag

SEQ ID NO: 7524118 - DNA, 22 bp, Homo sapiens
gaaattcaaataagatatgtag

SEQ ID NO: 7524119 - DNA, 22 bp, Homo sapiens
gaaattgaaagaccaactgcat

SEQ ID NO: 7524120 - DNA, 22 bp, Homo sapiens
gaaattgaaaccgatctgtgtt

SEQ ID NO: 7524121 - DNA, 22 bp, Homo sapiens
gaaattctgtgtcccagagtgc

SEQ ID NO: 7524122 - DNA, 22 bp, Homo sapiens
gaaattgtcagcttctttcagt

SEQ ID NO: 7524123 - DNA, 22 bp, Homo sapiens
gaaattcaggacaaagactctt

SEQ ID NO: 7524124 - DNA, 22 bp, Homo sapiens
gaaattcaggacaaagactctt

SEQ ID NO: 7524125 - DNA, 22 bp, Homo sapiens
gaaattcactgtatttcttggg

SEQ ID NO: 7524126 - DNA, 22 bp, Homo sapiens
gaaattcactgtatttcttggg

SEQ ID NO: 7524127 - DNA, 22 bp, Homo sapiens
gaaattcactgtatttcttggg

SEQ ID NO: 7524128 - DNA, 22 bp, Homo sapiens
gaaattcactgtatttcttggg

SEQ ID NO: 7524129 - DNA, 22 bp, Homo sapiens
gaaattcaggacaaagactctt

SEQ ID NO: 7524130 - DNA, 22 bp, Homo sapiens
gaaattcaggacaaagactctt

SEQ ID NO: 7524131 - DNA, 22 bp, Homo sapiens
gaaattcaggacaaagactctt

SEQ ID NO: 7524132 - DNA, 23 bp, Homo sapiens
gaaatgtttcttgattaatccta

SEQ ID NO: 7524133 - DNA, 22 bp, Homo sapiens
gaaatgtttgggaggagtcaac

SEQ ID NO: 7524134 - DNA, 22 bp, Homo sapiens
gaaattaaccacctttggcttt

SEQ ID NO: 7524135 - DNA, 22 bp, Homo sapiens
gaaattaaccacctttggcttt

SEQ ID NO: 7524136 - DNA, 22 bp, Homo sapiens
gaaattaaccacctttggcttt

SEQ ID NO: 7524137 - DNA, 22 bp, Homo sapiens
gaaattaaccacctttggcttt

SEQ ID NO: 7524138 - DNA, 22 bp, Homo sapiens
gaaattaaccacctttggcttt

SEQ ID NO: 7524139 - DNA, 22 bp, Homo sapiens
gaaattaaccacctttggcttt

SEQ ID NO: 7524140 - DNA, 22 bp, Homo sapiens
gaaattaaccacctttggcttt

SEQ ID NO: 7524141 - DNA, 22 bp, Homo sapiens
gaaattaaccacctttggcttt

SEQ ID NO: 7524142 - DNA, 22 bp, Homo sapiens
gaaattaagcaggggtctgtgg

SEQ ID NO: 7524143 - DNA, 22 bp, Homo sapiens
gaaattaagcaggggtctgtgg

SEQ ID NO: 7524144 - DNA, 22 bp, Homo sapiens
gaaattaagcaggggtctgtgg

SEQ ID NO: 7524145 - DNA, 22 bp, Homo sapiens
gaaattaagcaggggtctgtgg

SEQ ID NO: 7524146 - DNA, 22 bp, Homo sapiens
gaaatgtttccttttgtatgct

SEQ ID NO: 7524147 - DNA, 22 bp, Homo sapiens
gaaatgttgtctctgcagcaat

SEQ ID NO: 7524148 - DNA, 22 bp, Homo sapiens
gaaatgttgtctctgcagcaat

SEQ ID NO: 7524149 - DNA, 22 bp, Homo sapiens
gaaatgttggacacttgaaatt

SEQ ID NO: 7524150 - DNA, 22 bp, Homo sapiens
gaaatgttggacacttgaaatt

SEQ ID NO: 7524151 - DNA, 22 bp, Homo sapiens
gaaatgttggacacttgaaatt

SEQ ID NO: 7524152 - DNA, 22 bp, Homo sapiens
gaaatgttcctgatccctgatt

SEQ ID NO: 7524153 - DNA, 22 bp, Homo sapiens
gaaatgttcctgatccctgatt

SEQ ID NO: 7524154 - DNA, 22 bp, Homo sapiens
gaaatgttcctgatccctgatt

SEQ ID NO: 7524155 - DNA, 22 bp, Homo sapiens
gaaatgttatgagatatgtact

SEQ ID NO: 7524156 - DNA, 22 bp, Homo sapiens
gaaatgttatgagatatgtact

SEQ ID NO: 7524157 - DNA, 22 bp, Homo sapiens
gaaatgttatgagatatgtact

SEQ ID NO: 7524158 - DNA, 22 bp, Homo sapiens
gaaatgttatgagatatgtact

SEQ ID NO: 7524159 - DNA, 22 bp, Homo sapiens
gaaatgtgttgttcatttctaa

SEQ ID NO: 7524160 - DNA, 22 bp, Homo sapiens
gaaatgtgttgttcatttctaa

SEQ ID NO: 7524161 - DNA, 22 bp, Homo sapiens
gaaatgttatgagatatgtact

SEQ ID NO: 7524162 - DNA, 20 bp, Homo sapiens
gaattttatgaacactacca

SEQ ID NO: 7524163 - DNA, 22 bp, Homo sapiens
gaattttattactagtcaactg

SEQ ID NO: 7524164 - DNA, 22 bp, Homo sapiens
gaattttattactagtcaactg

SEQ ID NO: 7524165 - DNA, 22 bp, Homo sapiens
gaatttatctacgttaagtatg

SEQ ID NO: 7524166 - DNA, 20 bp, Homo sapiens
gaattttatgaacactacca

SEQ ID NO: 7524167 - DNA, 20 bp, Homo sapiens
gaattttatgaacactacca

SEQ ID NO: 7524168 - DNA, 20 bp, Homo sapiens
gaattttatgaacactacca

SEQ ID NO: 7524169 - DNA, 20 bp, Homo sapiens
gaattttatgaacactacca

SEQ ID NO: 7524170 - DNA, 22 bp, Homo sapiens
gaatttatctacgttaagtatg

SEQ ID NO: 7524171 - DNA, 22 bp, Homo sapiens
gaatttatctacgttaagtatg

SEQ ID NO: 7524172 - DNA, 22 bp, Homo sapiens
gaatttatctacgttaagtatg

SEQ ID NO: 7524173 - DNA, 22 bp, Homo sapiens
gaatttacagggtgagcttcag

SEQ ID NO: 7524174 - DNA, 22 bp, Homo sapiens
gaatttacaagttgaataacaa

SEQ ID NO: 7524175 - DNA, 22 bp, Homo sapiens
gaatttaaggaccaagcatttt

SEQ ID NO: 7524176 - DNA, 22 bp, Homo sapiens
gaatttaaggaccaagcatttt

SEQ ID NO: 7524177 - DNA, 22 bp, Homo sapiens
gaatttaaggaccaagcatttt

SEQ ID NO: 7524178 - DNA, 22 bp, Homo sapiens
gaatttacaagttgaataacaa

SEQ ID NO: 7524179 - DNA, 22 bp, Homo sapiens
gaatttacaagttgaataacaa

SEQ ID NO: 7524180 - DNA, 22 bp, Homo sapiens
gaatttttctggaagcaattat

SEQ ID NO: 7524181 - DNA, 22 bp, Homo sapiens
gaattttgcttttatgtcaagt

SEQ ID NO: 7524182 - DNA, 22 bp, Homo sapiens
gaatttttctggaagcaattat

SEQ ID NO: 7524183 - DNA, 22 bp, Homo sapiens
gaatttttctggaagcaattat

SEQ ID NO: 7524184 - DNA, 22 bp, Homo sapiens
gaattttgcttttatgtcaagt

SEQ ID NO: 7524185 - DNA, 22 bp, Homo sapiens
gaattttcaggtagcaatttca

SEQ ID NO: 7524186 - DNA, 22 bp, Homo sapiens
gaattttcaggtagcaatttca

SEQ ID NO: 7524187 - DNA, 22 bp, Homo sapiens
gaattttcaggtagcaatttca

SEQ ID NO: 7524188 - DNA, 22 bp, Homo sapiens
gaattttattactagtcaactg

SEQ ID NO: 7524189 - DNA, 22 bp, Homo sapiens
gaattttattactagtcaactg

SEQ ID NO: 7524190 - DNA, 22 bp, Homo sapiens
gaattttattactagtcaactg

SEQ ID NO: 7524191 - DNA, 22 bp, Homo sapiens
gaatttttctggaagcaattat

SEQ ID NO: 7524192 - DNA, 22 bp, Homo sapiens
gaatttttctggaagcaattat

SEQ ID NO: 7524193 - DNA, 22 bp, Homo sapiens
gaatttttctggaagcaattat

SEQ ID NO: 7524194 - DNA, 22 bp, Homo sapiens
gacaaaacacattagtttaaaa

SEQ ID NO: 7524195 - DNA, 22 bp, Homo sapiens
gacaaaacacattagtttaaaa

SEQ ID NO: 7524196 - DNA, 22 bp, Homo sapiens
gaatttttctggaagcaattat

SEQ ID NO: 7524197 - DNA, 22 bp, Homo sapiens
gacaaaacacattagtttaaaa

SEQ ID NO: 7524198 - DNA, 22 bp, Homo sapiens
gacaaaacacattagtttaaaa

SEQ ID NO: 7524199 - DNA, 22 bp, Homo sapiens
gacaaaacacattagtttaaaa

SEQ ID NO: 7524200 - DNA, 22 bp, Homo sapiens
gacaaaacacattagtttaaaa

SEQ ID NO: 7524201 - DNA, 21 bp, Homo sapiens
gacaaacatttcatagcttta

SEQ ID NO: 7524202 - DNA, 21 bp, Homo sapiens
gacaaacatttcatagcttta

SEQ ID NO: 7524203 - DNA, 22 bp, Homo sapiens
gacaaactgaagtatatttaga

SEQ ID NO: 7524204 - DNA, 22 bp, Homo sapiens
gacaaagagaagtaacagtacc

SEQ ID NO: 7524205 - DNA, 22 bp, Homo sapiens
gacaaagagaagtaacagtacc

SEQ ID NO: 7524206 - DNA, 22 bp, Homo sapiens
gacaaactgaagtatatttaga

SEQ ID NO: 7524207 - DNA, 22 bp, Homo sapiens
gacaaagagaagtaacagtacc

SEQ ID NO: 7524208 - DNA, 22 bp, Homo sapiens
gacaaaagtgttttgaacaagg

SEQ ID NO: 7524209 - DNA, 22 bp, Homo sapiens
gacaaaagtgttttgaacaagg

SEQ ID NO: 7524210 - DNA, 21 bp, Homo sapiens
gacaaacatttcatagcttta

SEQ ID NO: 7524211 - DNA, 21 bp, Homo sapiens
gacaaacatttcatagcttta

SEQ ID NO: 7524212 - DNA, 21 bp, Homo sapiens
gacaaacatttcatagcttta

SEQ ID NO: 7524213 - DNA, 22 bp, Homo sapiens
gacaaaagtgttttgaacaagg

SEQ ID NO: 7524214 - DNA, 18 bp, Homo sapiens
gacaaaagtacagacaga

SEQ ID NO: 7524215 - DNA, 18 bp, Homo sapiens
gacaaaagtacagacaga

SEQ ID NO: 7524216 - DNA, 18 bp, Homo sapiens
gacaaaagtacagacaga

SEQ ID NO: 7524217 - DNA, 18 bp, Homo sapiens
gacaaaagtacagacaga

SEQ ID NO: 7524218 - DNA, 18 bp, Homo sapiens
gacaaaagtacagacaga

SEQ ID NO: 7524219 - DNA, 18 bp, Homo sapiens
gacaaaagtacagacaga

SEQ ID NO: 7524220 - DNA, 18 bp, Homo sapiens
gacaaaagtacagacaga

SEQ ID NO: 7524221 - DNA, 18 bp, Homo sapiens
gacaaaagtacagacaga

SEQ ID NO: 7524222 - DNA, 22 bp, Homo sapiens
gacaaaagtgttttgaacaagg

SEQ ID NO: 7524223 - DNA, 18 bp, Homo sapiens
gacaaaagtacagacaga

SEQ ID NO: 7524224 - DNA, 22 bp, Homo sapiens
gacaaaagtgttttgaacaagg

SEQ ID NO: 7524225 - DNA, 22 bp, Homo sapiens
gacaaaagtgttttgaacaagg

SEQ ID NO: 7524226 - DNA, 22 bp, Homo sapiens
gacaaaagtgttttgaacaagg

SEQ ID NO: 7524227 - DNA, 18 bp, Homo sapiens
gacaaaagtacagacaga

SEQ ID NO: 7524228 - DNA, 18 bp, Homo sapiens
gacaaaagtacagacaga

SEQ ID NO: 7524229 - DNA, 22 bp, Homo sapiens
gacaaaactgagatcacactgt

SEQ ID NO: 7524230 - DNA, 22 bp, Homo sapiens
gacaaaactgagatcacactgt

SEQ ID NO: 7524231 - DNA, 22 bp, Homo sapiens
gacaaaactgagatcacactgt

SEQ ID NO: 7524232 - DNA, 22 bp, Homo sapiens
gacaaaactgagatcacactgt

SEQ ID NO: 7524233 - DNA, 22 bp, Homo sapiens
gacaaaactgagatcacactgt

SEQ ID NO: 7524234 - DNA, 22 bp, Homo sapiens
gacaaaactgagatcacactgt

SEQ ID NO: 7524235 - DNA, 22 bp, Homo sapiens
gacaaaactgagatcacactgt

SEQ ID NO: 7524236 - DNA, 22 bp, Homo sapiens
gacagcagccacagggagaggg

SEQ ID NO: 7524237 - DNA, 22 bp, Homo sapiens
gacagcagccacagggagaggg

SEQ ID NO: 7524238 - DNA, 22 bp, Homo sapiens
gacagcagccacagggagaggg

SEQ ID NO: 7524239 - DNA, 22 bp, Homo sapiens
gacagcagccacagggagaggg

SEQ ID NO: 7524240 - DNA, 22 bp, Homo sapiens
gacagcagccacagggagaggg

SEQ ID NO: 7524241 - DNA, 22 bp, Homo sapiens
gacagcagccacagggagaggg

SEQ ID NO: 7524242 - DNA, 22 bp, Homo sapiens
gacagcagccacagggagaggg

SEQ ID NO: 7524243 - DNA, 22 bp, Homo sapiens
gacagcaggagatcatgataga

SEQ ID NO: 7524244 - DNA, 22 bp, Homo sapiens
gacagcaggagatcatgataga

SEQ ID NO: 7524245 - DNA, 18 bp, Homo sapiens
gacagcagcttttgttct

SEQ ID NO: 7524246 - DNA, 18 bp, Homo sapiens
gacagcagcttttgttct

SEQ ID NO: 7524247 - DNA, 22 bp, Homo sapiens
gacagcagccacagggagaggg

SEQ ID NO: 7524248 - DNA, 22 bp, Homo sapiens
gacagcagccacagggagaggg

SEQ ID NO: 7524249 - DNA, 20 bp, Homo sapiens
gacaacagagtaccaggaag

SEQ ID NO: 7524250 - DNA, 20 bp, Homo sapiens
gacaacagagtaccaggaag

SEQ ID NO: 7524251 - DNA, 20 bp, Homo sapiens
gacaacagagtaccaggaag

SEQ ID NO: 7524252 - DNA, 22 bp, Homo sapiens
gacagcagccacagggagaggg

SEQ ID NO: 7524253 - DNA, 22 bp, Homo sapiens
gacaacaggcagacgtcagaaa

SEQ ID NO: 7524254 - DNA, 20 bp, Homo sapiens
gacaacagagtaccaggaag

SEQ ID NO: 7524255 - DNA, 22 bp, Homo sapiens
gacagcagggacatgtaggaag

SEQ ID NO: 7524256 - DNA, 22 bp, Homo sapiens
gacagcagggacatgtaggaag

SEQ ID NO: 7524257 - DNA, 22 bp, Homo sapiens
gacagcagggacatgtaggaag

SEQ ID NO: 7524258 - DNA, 22 bp, Homo sapiens
gacagcagggaaagtccagacc

SEQ ID NO: 7524259 - DNA, 22 bp, Homo sapiens
gacagcagggaaagtccagacc

SEQ ID NO: 7524260 - DNA, 22 bp, Homo sapiens
gacagcagggaaagtccagacc

SEQ ID NO: 7524261 - DNA, 22 bp, Homo sapiens
gacagcagggaaagtccagacc

SEQ ID NO: 7524262 - DNA, 22 bp, Homo sapiens
gacagcagggaaagtccagacc

SEQ ID NO: 7524263 - DNA, 22 bp, Homo sapiens
gacagcagggaaagtccagacc

SEQ ID NO: 7524264 - DNA, 22 bp, Homo sapiens
gacagcagggaaagtccagacc

SEQ ID NO: 7524265 - DNA, 22 bp, Homo sapiens
gacagcaggatgtgaggggatg

SEQ ID NO: 7524266 - DNA, 22 bp, Homo sapiens
gacagcaggatgtgaggggatg

SEQ ID NO: 7524267 - DNA, 22 bp, Homo sapiens
gacagcaggagatcatgataga

SEQ ID NO: 7524268 - DNA, 22 bp, Homo sapiens
gacagcaggagatcatgataga

SEQ ID NO: 7524269 - DNA, 22 bp, Homo sapiens
gacagcaggagatcatgataga

SEQ ID NO: 7524270 - DNA, 22 bp, Homo sapiens
gacagcaggatgtgaggggatg

SEQ ID NO: 7524271 - DNA, 22 bp, Homo sapiens
gacagcaggatgtgaggggatg

SEQ ID NO: 7524272 - DNA, 22 bp, Homo sapiens
gacagcaggatgtgaggggatg

SEQ ID NO: 7524273 - DNA, 22 bp, Homo sapiens
gacagcaggatgtgaggggatg

SEQ ID NO: 7524274 - DNA, 22 bp, Homo sapiens
gacagcaggatgtgaggggatg

SEQ ID NO: 7524275 - DNA, 22 bp, Homo sapiens
gacaacaataatgtggagctga

SEQ ID NO: 7524276 - DNA, 22 bp, Homo sapiens
gacaacaataatgtggagctga

SEQ ID NO: 7524277 - DNA, 22 bp, Homo sapiens
gacaacaataatgtggagctga

SEQ ID NO: 7524278 - DNA, 22 bp, Homo sapiens
gacaacaataatgtggagctga

SEQ ID NO: 7524279 - DNA, 18 bp, Homo sapiens
gacaaatgcaatttaaag

SEQ ID NO: 7524280 - DNA, 22 bp, Homo sapiens
gacaaatgtacccctagagtct

SEQ ID NO: 7524281 - DNA, 22 bp, Homo sapiens
gacaaatgtacccctagagtct

SEQ ID NO: 7524282 - DNA, 22 bp, Homo sapiens
gacaaatgaatgatgaacacca

SEQ ID NO: 7524283 - DNA, 22 bp, Homo sapiens
gacaaatgaatgatgaacacca

SEQ ID NO: 7524284 - DNA, 22 bp, Homo sapiens
gacaaatgaatgatgaacacca

SEQ ID NO: 7524285 - DNA, 22 bp, Homo sapiens
gacaaatgaagtcactgacctt

SEQ ID NO: 7524286 - DNA, 22 bp, Homo sapiens
gacaaatgagtctcatacccgg

SEQ ID NO: 7524287 - DNA, 22 bp, Homo sapiens
gacaaatgaatgatgaacacca

SEQ ID NO: 7524288 - DNA, 22 bp, Homo sapiens
gacaaatgagacatcaattccc

SEQ ID NO: 7524289 - DNA, 22 bp, Homo sapiens
gacaaatgagacatcaattccc

SEQ ID NO: 7524290 - DNA, 22 bp, Homo sapiens
gacaaatgagacatcaattccc

SEQ ID NO: 7524291 - DNA, 22 bp, Homo sapiens
gacaaagcagacaagataattc

SEQ ID NO: 7524292 - DNA, 22 bp, Homo sapiens
gacaaagagaagtaacagtacc

SEQ ID NO: 7524293 - DNA, 23 bp, Homo sapiens
gacaaagcacttgaaatgtgtac

SEQ ID NO: 7524294 - DNA, 22 bp, Homo sapiens
gacaaagcagacaagataattc

SEQ ID NO: 7524295 - DNA, 22 bp, Homo sapiens
gacaaaggatcagaggttggga

SEQ ID NO: 7524296 - DNA, 22 bp, Homo sapiens
gacaaagctttggcatccttac

SEQ ID NO: 7524297 - DNA, 22 bp, Homo sapiens
gacaaagcgcctgctcgcgggc

SEQ ID NO: 7524298 - DNA, 22 bp, Homo sapiens
gacaaagcctaagaagtattta

SEQ ID NO: 7524299 - DNA, 22 bp, Homo sapiens
gacaaagtcaacagtactctca

SEQ ID NO: 7524300 - DNA, 22 bp, Homo sapiens
gacaaagtcaacagtactctca

SEQ ID NO: 7524301 - DNA, 21 bp, Homo sapiens
gacaaagtgaagcaggcagga

SEQ ID NO: 7524302 - DNA, 22 bp, Homo sapiens
gacaaatgaagtcactgacctt

SEQ ID NO: 7524303 - DNA, 22 bp, Homo sapiens
gacaaatcattctctgtgtctg

SEQ ID NO: 7524304 - DNA, 22 bp, Homo sapiens
gacaaatcattctctgtgtctg

SEQ ID NO: 7524305 - DNA, 22 bp, Homo sapiens
gacaaataggtcaacaggaggg

SEQ ID NO: 7524306 - DNA, 22 bp, Homo sapiens
gacaaataggtcaacaggaggg

SEQ ID NO: 7524307 - DNA, 22 bp, Homo sapiens
gacaaataggtcaacaggaggg

SEQ ID NO: 7524308 - DNA, 22 bp, Homo sapiens
gacaaataggtcaacaggaggg

SEQ ID NO: 7524309 - DNA, 22 bp, Homo sapiens
gaagaatattcttgatcttaga

SEQ ID NO: 7524310 - DNA, 22 bp, Homo sapiens
gaagaatctgaggacagtcatt

SEQ ID NO: 7524311 - DNA, 22 bp, Homo sapiens
gaagaatctgaggacagtcatt

SEQ ID NO: 7524312 - DNA, 22 bp, Homo sapiens
gaagaattgaggatgtttacct

SEQ ID NO: 7524313 - DNA, 22 bp, Homo sapiens
gaagaatatataatgattttgt

SEQ ID NO: 7524314 - DNA, 22 bp, Homo sapiens
gaagaatatataatgattttgt

SEQ ID NO: 7524315 - DNA, 22 bp, Homo sapiens
gaagaatatataatgattttgt

SEQ ID NO: 7524316 - DNA, 22 bp, Homo sapiens
gaagaatatataatgattttgt

SEQ ID NO: 7524317 - DNA, 22 bp, Homo sapiens
gaagaagtgtaagtctgtttca

SEQ ID NO: 7524318 - DNA, 22 bp, Homo sapiens
gaagaagtgtaagtctgtttca

SEQ ID NO: 7524319 - DNA, 19 bp, Homo sapiens
gaagaagttggaggatctc

SEQ ID NO: 7524320 - DNA, 19 bp, Homo sapiens
gaagaagttggaggatctc

SEQ ID NO: 7524321 - DNA, 22 bp, Homo sapiens
gaagaatatataatgattttgt

SEQ ID NO: 7524322 - DNA, 22 bp, Homo sapiens
gaagaatatggctctcagcaat

SEQ ID NO: 7524323 - DNA, 22 bp, Homo sapiens
gaagaatatggctctcagcaat

SEQ ID NO: 7524324 - DNA, 22 bp, Homo sapiens
gaagaatatggctctcagcaat

SEQ ID NO: 7524325 - DNA, 22 bp, Homo sapiens
gaagaatattcttgatcttaga

SEQ ID NO: 7524326 - DNA, 22 bp, Homo sapiens
gaagaatattcttgatcttaga

SEQ ID NO: 7524327 - DNA, 22 bp, Homo sapiens
gaagaatattcttgatcttaga

SEQ ID NO: 7524328 - DNA, 22 bp, Homo sapiens
gaagaatattcttgatcttaga

SEQ ID NO: 7524329 - DNA, 22 bp, Homo sapiens
gaagaagtatttttgtcctgtt

SEQ ID NO: 7524330 - DNA, 22 bp, Homo sapiens
gaagaaggtggcccaggggtag

SEQ ID NO: 7524331 - DNA, 22 bp, Homo sapiens
gaagaagtatttttgtcctgtt

SEQ ID NO: 7524332 - DNA, 22 bp, Homo sapiens
gaagaagtcattctgtctttca

SEQ ID NO: 7524333 - DNA, 22 bp, Homo sapiens
gaagaagtgtaagtctgtttca

SEQ ID NO: 7524334 - DNA, 22 bp, Homo sapiens
gaagaagtgtaagtctgtttca

SEQ ID NO: 7524335 - DNA, 22 bp, Homo sapiens
gaagaagtcattctgtctttca

SEQ ID NO: 7524336 - DNA, 22 bp, Homo sapiens
gaagaagtcattctgtctttca

SEQ ID NO: 7524337 - DNA, 22 bp, Homo sapiens
gaagaaggtggcccaggggtag

SEQ ID NO: 7524338 - DNA, 22 bp, Homo sapiens
gaagaaggtggcccaggggtag

SEQ ID NO: 7524339 - DNA, 22 bp, Homo sapiens
gaagaaggtgctacacagggca

SEQ ID NO: 7524340 - DNA, 22 bp, Homo sapiens
gaagaaggtgctacacagggca

SEQ ID NO: 7524341 - DNA, 22 bp, Homo sapiens
gaagaaggtggcccaggggtag

SEQ ID NO: 7524342 - DNA, 22 bp, Homo sapiens
gaagaagggtaaggagtgttga

SEQ ID NO: 7524343 - DNA, 22 bp, Homo sapiens
gaagaagggagtgcgtgtaata

SEQ ID NO: 7524344 - DNA, 22 bp, Homo sapiens
gaagaagggtaaggagtgttga

SEQ ID NO: 7524345 - DNA, 22 bp, Homo sapiens
gaagaaggtgccagaggcttac

SEQ ID NO: 7524346 - DNA, 22 bp, Homo sapiens
gaagaaggtgccagaggcttac

SEQ ID NO: 7524347 - DNA, 22 bp, Homo sapiens
gaagaaggtgccagaggcttac

SEQ ID NO: 7524348 - DNA, 22 bp, Homo sapiens
gaagaaggtgccagaggcttac

SEQ ID NO: 7524349 - DNA, 22 bp, Homo sapiens
gaagaaggtgctacacagggca

SEQ ID NO: 7524350 - DNA, 22 bp, Homo sapiens
gaagaaggtgccagaggcttac

SEQ ID NO: 7524351 - DNA, 22 bp, Homo sapiens
gaagaaggtgctacacagggca

SEQ ID NO: 7524352 - DNA, 22 bp, Homo sapiens
gaagaaggtgccagaggcttac

SEQ ID NO: 7524353 - DNA, 22 bp, Homo sapiens
gaagaaggtgctacacagggca

SEQ ID NO: 7524354 - DNA, 22 bp, Homo sapiens
gaagaaggtgctacacagggca

SEQ ID NO: 7524355 - DNA, 22 bp, Homo sapiens
gaagaaggtgctacacagggca

SEQ ID NO: 7524356 - DNA, 22 bp, Homo sapiens
gaatgcatgtgaagcaaagaat

SEQ ID NO: 7524357 - DNA, 22 bp, Homo sapiens
gaatgcatgtgaagcaaagaat

SEQ ID NO: 7524358 - DNA, 22 bp, Homo sapiens
gaatgcagttcatttctctatg

SEQ ID NO: 7524359 - DNA, 22 bp, Homo sapiens
gaatgcattccacggtagtgat

SEQ ID NO: 7524360 - DNA, 22 bp, Homo sapiens
gaatgcattccacggtagtgat

SEQ ID NO: 7524361 - DNA, 22 bp, Homo sapiens
gaatgcatgtgaagcaaagaat

SEQ ID NO: 7524362 - DNA, 22 bp, Homo sapiens
gaatgcagtgacggaggcttac

SEQ ID NO: 7524363 - DNA, 22 bp, Homo sapiens
gaatgcagtgacggaggcttac

SEQ ID NO: 7524364 - DNA, 22 bp, Homo sapiens
gaatgcagtggtgagatcttgg

SEQ ID NO: 7524365 - DNA, 22 bp, Homo sapiens
gaatgcagtggtgagatcttgg

SEQ ID NO: 7524366 - DNA, 22 bp, Homo sapiens
gaatgcagttcatttctctatg

SEQ ID NO: 7524367 - DNA, 22 bp, Homo sapiens
gaatgcattctcttagcatcta

SEQ ID NO: 7524368 - DNA, 22 bp, Homo sapiens
gaatgcattctcttagcatcta

SEQ ID NO: 7524369 - DNA, 22 bp, Homo sapiens
gaatgcattctcttagcatcta

SEQ ID NO: 7524370 - DNA, 22 bp, Homo sapiens
gaatgctaagcatgtgggagtt

SEQ ID NO: 7524371 - DNA, 22 bp, Homo sapiens
gaatgctaagcatgtgggagtt

SEQ ID NO: 7524372 - DNA, 22 bp, Homo sapiens
gaatgctaagcatgtgggagtt

SEQ ID NO: 7524373 - DNA, 22 bp, Homo sapiens
gaatgctaagcatgtgggagtt

SEQ ID NO: 7524374 - DNA, 22 bp, Homo sapiens
gaatgctacttgactcagctca

SEQ ID NO: 7524375 - DNA, 22 bp, Homo sapiens
gaatgctaagcatgtgggagtt

SEQ ID NO: 7524376 - DNA, 22 bp, Homo sapiens
gaatgcagatggctggtgtatg

SEQ ID NO: 7524377 - DNA, 22 bp, Homo sapiens
gaatgcacacgtgtgtgcatgc

SEQ ID NO: 7524378 - DNA, 22 bp, Homo sapiens
gaatgcacacgtgtgtgcatgc

SEQ ID NO: 7524379 - DNA, 22 bp, Homo sapiens
gaatgcactcacccatcactca

SEQ ID NO: 7524380 - DNA, 22 bp, Homo sapiens
gaatgcacttccaacatctatt

SEQ ID NO: 7524381 - DNA, 22 bp, Homo sapiens
gaatgcagggctcctaagattc

SEQ ID NO: 7524382 - DNA, 22 bp, Homo sapiens
gaatgcagctgacagtcgtttt

SEQ ID NO: 7524383 - DNA, 22 bp, Homo sapiens
gaatgcagatggctggtgtatg

SEQ ID NO: 7524384 - DNA, 22 bp, Homo sapiens
gaatgcagatggctggtgtatg

SEQ ID NO: 7524385 - DNA, 19 bp, Homo sapiens
gaatgcagaagagagtgga

SEQ ID NO: 7524386 - DNA, 21 bp, Homo sapiens
gaagacaaatgggaatagctg

SEQ ID NO: 7524387 - DNA, 21 bp, Homo sapiens
gaagacaaatgggaatagctg

SEQ ID NO: 7524388 - DNA, 22 bp, Homo sapiens
gaagacaagctgagtgttgtcc

SEQ ID NO: 7524389 - DNA, 22 bp, Homo sapiens
gaagacaagctgagtgttgtcc

SEQ ID NO: 7524390 - DNA, 21 bp, Homo sapiens
gaagacaaatgggaatagctg

SEQ ID NO: 7524391 - DNA, 21 bp, Homo sapiens
gaagacaaatgggaatagctg

SEQ ID NO: 7524392 - DNA, 21 bp, Homo sapiens
gaagacaaatgggaatagctg

SEQ ID NO: 7524393 - DNA, 21 bp, Homo sapiens
gaagacaaatgggaatagctg

SEQ ID NO: 7524394 - DNA, 22 bp, Homo sapiens
gaatgcaaagctctctatgtta

SEQ ID NO: 7524395 - DNA, 22 bp, Homo sapiens
gaattaaaatagttttggtcga

SEQ ID NO: 7524396 - DNA, 22 bp, Homo sapiens
gaattaactggcagttagtgct

SEQ ID NO: 7524397 - DNA, 22 bp, Homo sapiens
gaattacaaagtgagacaagct

SEQ ID NO: 7524398 - DNA, 22 bp, Homo sapiens
gaattaattgtgtggtttgaat

SEQ ID NO: 7524399 - DNA, 22 bp, Homo sapiens
gaatgtttttcattggtgactc

SEQ ID NO: 7524400 - DNA, 22 bp, Homo sapiens
gaattaaaatagttttggtcga

SEQ ID NO: 7524401 - DNA, 22 bp, Homo sapiens
gaattaaaatagttttggtcga

SEQ ID NO: 7524402 - DNA, 22 bp, Homo sapiens
gaatgtttttataagtgttaca

SEQ ID NO: 7524403 - DNA, 22 bp, Homo sapiens
gaatgtttttataagtgttaca

SEQ ID NO: 7524404 - DNA, 22 bp, Homo sapiens
gaatgtttttaggaatgttatg

SEQ ID NO: 7524405 - DNA, 22 bp, Homo sapiens
gaatgtttttaggaatgttatg

SEQ ID NO: 7524406 - DNA, 22 bp, Homo sapiens
gaattacaaagtgagacaagct

SEQ ID NO: 7524407 - DNA, 22 bp, Homo sapiens
gaattacagagttgttaagtca

SEQ ID NO: 7524408 - DNA, 22 bp, Homo sapiens
gaattacagagttgttaagtca

SEQ ID NO: 7524409 - DNA, 22 bp, Homo sapiens
gaattacaaagtgagacaagct

SEQ ID NO: 7524410 - DNA, 22 bp, Homo sapiens
gaattacagccagaagaatgaa

SEQ ID NO: 7524411 - DNA, 22 bp, Homo sapiens
gaattacagccagaagaatgaa

SEQ ID NO: 7524412 - DNA, 22 bp, Homo sapiens
gaattacagccagaagaatgaa

SEQ ID NO: 7524413 - DNA, 22 bp, Homo sapiens
gaattacagccagaagaatgaa

SEQ ID NO: 7524414 - DNA, 22 bp, Homo sapiens
gaattacagccagaagaatgaa

SEQ ID NO: 7524415 - DNA, 22 bp, Homo sapiens
gaattacataataaaatgagag

SEQ ID NO: 7524416 - DNA, 22 bp, Homo sapiens
gaattacataataaaatgagag

SEQ ID NO: 7524417 - DNA, 22 bp, Homo sapiens
gaattacataataaaatgagag

SEQ ID NO: 7524418 - DNA, 22 bp, Homo sapiens
gaattacataataaaatgagag

SEQ ID NO: 7524419 - DNA, 22 bp, Homo sapiens
gaattacataataaaatgagag

SEQ ID NO: 7524420 - DNA, 22 bp, Homo sapiens
gaattacatagtttctaggttc

SEQ ID NO: 7524421 - DNA, 22 bp, Homo sapiens
gaatttaaggaccaagcatttt

SEQ ID NO: 7524422 - DNA, 22 bp, Homo sapiens
gaattacataataaaatgagag

SEQ ID NO: 7524423 - DNA, 22 bp, Homo sapiens
gaattacatagtttctaggttc

SEQ ID NO: 7524424 - DNA, 22 bp, Homo sapiens
gaatgctggcttacaggcagtt

SEQ ID NO: 7524425 - DNA, 22 bp, Homo sapiens
gaatgctggcttacaggcagtt

SEQ ID NO: 7524426 - DNA, 22 bp, Homo sapiens
gaatgctggcttacaggcagtt

SEQ ID NO: 7524427 - DNA, 22 bp, Homo sapiens
gaatgctggcttacaggcagtt

SEQ ID NO: 7524428 - DNA, 22 bp, Homo sapiens
gaatgctggtgttcagaatttt

SEQ ID NO: 7524429 - DNA, 22 bp, Homo sapiens
gaatgcttggaacctgaagttc

SEQ ID NO: 7524430 - DNA, 22 bp, Homo sapiens
gaatgctttgggaattcagaat

SEQ ID NO: 7524431 - DNA, 22 bp, Homo sapiens
gaatgctttgggaattcagaat

SEQ ID NO: 7524432 - DNA, 22 bp, Homo sapiens
gaatgcttggaacctgaagttc

SEQ ID NO: 7524433 - DNA, 22 bp, Homo sapiens
gaatgctgtagacagactctat

SEQ ID NO: 7524434 - DNA, 22 bp, Homo sapiens
gaatgcttggaacctgaagttc

SEQ ID NO: 7524435 - DNA, 22 bp, Homo sapiens
gaatggaaactgggagatggcc

SEQ ID NO: 7524436 - DNA, 22 bp, Homo sapiens
gaatggaaactgggagatggcc

SEQ ID NO: 7524437 - DNA, 22 bp, Homo sapiens
gaatggcatagctttctttaca

SEQ ID NO: 7524438 - DNA, 22 bp, Homo sapiens
gaatggcatagctttctttaca

SEQ ID NO: 7524439 - DNA, 22 bp, Homo sapiens
gaatgtttgtgcagagtcatct

SEQ ID NO: 7524440 - DNA, 19 bp, Homo sapiens
gaatgtttgtattcagcgc

SEQ ID NO: 7524441 - DNA, 19 bp, Homo sapiens
gaatgtttgtattcagcgc

SEQ ID NO: 7524442 - DNA, 22 bp, Homo sapiens
gaatggtaagagacaaaagtat

SEQ ID NO: 7524443 - DNA, 22 bp, Homo sapiens
gaatgtaaaattgcctacaaga

SEQ ID NO: 7524444 - DNA, 22 bp, Homo sapiens
gaatgtaaaattgcctacaaga

SEQ ID NO: 7524445 - DNA, 22 bp, Homo sapiens
gaatgtaagtgggcagaagaca

SEQ ID NO: 7524446 - DNA, 22 bp, Homo sapiens
gaatgtaagtgggcagaagaca

SEQ ID NO: 7524447 - DNA, 22 bp, Homo sapiens
gaatgtaagtgggcagaagaca

SEQ ID NO: 7524448 - DNA, 22 bp, Homo sapiens
gaatgtaagtgggcagaagaca

SEQ ID NO: 7524449 - DNA, 22 bp, Homo sapiens
gaatgtaagtgggcagaagaca

SEQ ID NO: 7524450 - DNA, 19 bp, Homo sapiens
gaatgggaatgggaaagct

SEQ ID NO: 7524451 - DNA, 19 bp, Homo sapiens
gaatgggaatgggaaagct

SEQ ID NO: 7524452 - DNA, 19 bp, Homo sapiens
gaatgggaatgggaaagct

SEQ ID NO: 7524453 - DNA, 19 bp, Homo sapiens
gaatgggaatgggaaagct

SEQ ID NO: 7524454 - DNA, 19 bp, Homo sapiens
gaatgggaatgggaaagct

SEQ ID NO: 7524455 - DNA, 21 bp, Homo sapiens
gaatggctcgcgcgccacact

SEQ ID NO: 7524456 - DNA, 22 bp, Homo sapiens
gaatggctatcggattattagg

SEQ ID NO: 7524457 - DNA, 22 bp, Homo sapiens
gaatggctatcggattattagg

SEQ ID NO: 7524458 - DNA, 23 bp, Homo sapiens
gaatggctaagcacatagacttg

SEQ ID NO: 7524459 - DNA, 22 bp, Homo sapiens
gaatggctgaatgtcttaaatt

SEQ ID NO: 7524460 - DNA, 22 bp, Homo sapiens
gaatggctcaagattattgtct

SEQ ID NO: 7524461 - DNA, 22 bp, Homo sapiens
gaatggctcaagattattgtct

SEQ ID NO: 7524462 - DNA, 22 bp, Homo sapiens
gacctggggtggaaggaaggca

SEQ ID NO: 7524463 - DNA, 22 bp, Homo sapiens
gacctggggtggaaggaaggca

SEQ ID NO: 7524464 - DNA, 22 bp, Homo sapiens
gacctggggtggaaggaaggca

SEQ ID NO: 7524465 - DNA, 22 bp, Homo sapiens
gacctggggtaagcttggcaac

SEQ ID NO: 7524466 - DNA, 22 bp, Homo sapiens
gacctggtccttgtactttgaa

SEQ ID NO: 7524467 - DNA, 22 bp, Homo sapiens
gacctggggtggaaggaaggca

SEQ ID NO: 7524468 - DNA, 22 bp, Homo sapiens
gacctggggtggaaggaaggca

SEQ ID NO: 7524469 - DNA, 22 bp, Homo sapiens
gacctgggtaaggggctgacaa

SEQ ID NO: 7524470 - DNA, 22 bp, Homo sapiens
gacctgggtaaggggctgacaa

SEQ ID NO: 7524471 - DNA, 22 bp, Homo sapiens
gacctgggtaaggggctgacaa

SEQ ID NO: 7524472 - DNA, 22 bp, Homo sapiens
gacctggcctgcacagccctta

SEQ ID NO: 7524473 - DNA, 22 bp, Homo sapiens
gacctggcctgcacagccctta

SEQ ID NO: 7524474 - DNA, 23 bp, Homo sapiens
gacctggctttgaatcttgactc

SEQ ID NO: 7524475 - DNA, 22 bp, Homo sapiens
gacctggcctgcacagccctta

SEQ ID NO: 7524476 - DNA, 22 bp, Homo sapiens
gacctggcctgcacagccctta

SEQ ID NO: 7524477 - DNA, 22 bp, Homo sapiens
gacctggctttgggccccggca

SEQ ID NO: 7524478 - DNA, 22 bp, Homo sapiens
gacctggggtaagcttggcaac

SEQ ID NO: 7524479 - DNA, 22 bp, Homo sapiens
gacctggctttgggccccggca

SEQ ID NO: 7524480 - DNA, 22 bp, Homo sapiens
gacctggggtaagcttggcaac

SEQ ID NO: 7524481 - DNA, 22 bp, Homo sapiens
gacctggggtaagcttggcaac

SEQ ID NO: 7524482 - DNA, 22 bp, Homo sapiens
gacctggggtaagcttggcaac

SEQ ID NO: 7524483 - DNA, 22 bp, Homo sapiens
gacctggtgcaggtggacagag

SEQ ID NO: 7524484 - DNA, 22 bp, Homo sapiens
gacctggtgctagctggtgtgt

SEQ ID NO: 7524485 - DNA, 22 bp, Homo sapiens
gacctgtgttcaggtcgtggtg

SEQ ID NO: 7524486 - DNA, 22 bp, Homo sapiens
gaccttcaagcaccatatttat

SEQ ID NO: 7524487 - DNA, 22 bp, Homo sapiens
gaccttagaacgtgacacaaga

SEQ ID NO: 7524488 - DNA, 22 bp, Homo sapiens
gacctgtgaccattctgggtag

SEQ ID NO: 7524489 - DNA, 20 bp, Homo sapiens
gacctgtgtctgggatgcgg

SEQ ID NO: 7524490 - DNA, 22 bp, Homo sapiens
gaccttccatgccttcttccaa

SEQ ID NO: 7524491 - DNA, 22 bp, Homo sapiens
gaccttcagtgtgtttctcaca

SEQ ID NO: 7524492 - DNA, 22 bp, Homo sapiens
gaccttcaagcaccatatttat

SEQ ID NO: 7524493 - DNA, 22 bp, Homo sapiens
gaccttccttctttgctccggg

SEQ ID NO: 7524494 - DNA, 22 bp, Homo sapiens
gaccttccaggctgaatggctg

SEQ ID NO: 7524495 - DNA, 22 bp, Homo sapiens
gaccttctgttggaggcattta

SEQ ID NO: 7524496 - DNA, 22 bp, Homo sapiens
gaccttcttgctgtgtcctaac

SEQ ID NO: 7524497 - DNA, 22 bp, Homo sapiens
gaccttgtgatccacccgcctt

SEQ ID NO: 7524498 - DNA, 22 bp, Homo sapiens
gaccttgtgatccacccgcctt

SEQ ID NO: 7524499 - DNA, 22 bp, Homo sapiens
gaccttgggcacagcacagctt

SEQ ID NO: 7524500 - DNA, 22 bp, Homo sapiens
gaccttgtgatccacccgcctt

SEQ ID NO: 7524501 - DNA, 22 bp, Homo sapiens
gaccttgtgatccacccgcctt

SEQ ID NO: 7524502 - DNA, 22 bp, Homo sapiens
gaccttgtgatccacccgcctt

SEQ ID NO: 7524503 - DNA, 22 bp, Homo sapiens
gaccttgtgatccacccgcctt

SEQ ID NO: 7524504 - DNA, 19 bp, Homo sapiens
gactacagggggaagaagt

SEQ ID NO: 7524505 - DNA, 19 bp, Homo sapiens
gactacagggggaagaagt

SEQ ID NO: 7524506 - DNA, 19 bp, Homo sapiens
gactacagggggaagaagt

SEQ ID NO: 7524507 - DNA, 22 bp, Homo sapiens
gactacaggtgtgtgccaccat

SEQ ID NO: 7524508 - DNA, 22 bp, Homo sapiens
gactactcaaactttctctata

SEQ ID NO: 7524509 - DNA, 22 bp, Homo sapiens
gactactcaaactttctctata

SEQ ID NO: 7524510 - DNA, 22 bp, Homo sapiens
gactacaggtgtgtgccaccat

SEQ ID NO: 7524511 - DNA, 22 bp, Homo sapiens
gaccttggttgagcttcctaat

SEQ ID NO: 7524512 - DNA, 22 bp, Homo sapiens
gaccttcttgctgtgtcctaac

SEQ ID NO: 7524513 - DNA, 22 bp, Homo sapiens
gaccttcttgctgtgtcctaac

SEQ ID NO: 7524514 - DNA, 22 bp, Homo sapiens
gaccttcttgctgtgtcctaac

SEQ ID NO: 7524515 - DNA, 22 bp, Homo sapiens
gaccttcttgctgtgtcctaac

SEQ ID NO: 7524516 - DNA, 22 bp, Homo sapiens
gaccttcttgctgtgtcctaac

SEQ ID NO: 7524517 - DNA, 22 bp, Homo sapiens
gaccttcttgctgtgtcctaac

SEQ ID NO: 7524518 - DNA, 22 bp, Homo sapiens
gaccttcttgctgtgtcctaac

SEQ ID NO: 7524519 - DNA, 22 bp, Homo sapiens
gaccttcttgctgtgtcctaac

SEQ ID NO: 7524520 - DNA, 22 bp, Homo sapiens
gactatgtgggagggacaagga

SEQ ID NO: 7524521 - DNA, 19 bp, Homo sapiens
gactatctctggagaccat

SEQ ID NO: 7524522 - DNA, 22 bp, Homo sapiens
gactagaagggcaagagtccct

SEQ ID NO: 7524523 - DNA, 22 bp, Homo sapiens
gactagaatagggggtaggaag

SEQ ID NO: 7524524 - DNA, 22 bp, Homo sapiens
gactaggctctcatagaggtag

SEQ ID NO: 7524525 - DNA, 22 bp, Homo sapiens
gactaggggcagcgtgggagct

SEQ ID NO: 7524526 - DNA, 22 bp, Homo sapiens
gactaggggcagcgtgggagct

SEQ ID NO: 7524527 - DNA, 22 bp, Homo sapiens
gactagggaatcattcttggat

SEQ ID NO: 7524528 - DNA, 22 bp, Homo sapiens
gactatttaaaaagaactactg

SEQ ID NO: 7524529 - DNA, 22 bp, Homo sapiens
gactatttagtttcagattagt

SEQ ID NO: 7524530 - DNA, 22 bp, Homo sapiens
gactatttataatgctgcagaa

SEQ ID NO: 7524531 - DNA, 22 bp, Homo sapiens
gactatgtgtattttactcacc

SEQ ID NO: 7524532 - DNA, 22 bp, Homo sapiens
gactattacatgctttcaagac

SEQ ID NO: 7524533 - DNA, 22 bp, Homo sapiens
gactattacatgctttcaagac

SEQ ID NO: 7524534 - DNA, 22 bp, Homo sapiens
gactattttataaactagtgaa

SEQ ID NO: 7524535 - DNA, 22 bp, Homo sapiens
gactattttataaactagtgaa

SEQ ID NO: 7524536 - DNA, 22 bp, Homo sapiens
gactatttccctcatcatcttc

SEQ ID NO: 7524537 - DNA, 22 bp, Homo sapiens
gactatttagtttcagattagt

SEQ ID NO: 7524538 - DNA, 22 bp, Homo sapiens
gactatttccctcatcatcttc

SEQ ID NO: 7524539 - DNA, 22 bp, Homo sapiens
gactatttatttacagaaagct

SEQ ID NO: 7524540 - DNA, 22 bp, Homo sapiens
gactatttatttacagaaagct

SEQ ID NO: 7524541 - DNA, 22 bp, Homo sapiens
gacatgcatgaatgcaggtctc

SEQ ID NO: 7524542 - DNA, 22 bp, Homo sapiens
gacatgcatattcactcttctt

SEQ ID NO: 7524543 - DNA, 22 bp, Homo sapiens
gacatgcatattcactcttctt

SEQ ID NO: 7524544 - DNA, 22 bp, Homo sapiens
gacatgcatgaatgcaggtctc

SEQ ID NO: 7524545 - DNA, 22 bp, Homo sapiens
gacatgcagttctcaagggtag

SEQ ID NO: 7524546 - DNA, 22 bp, Homo sapiens
gacatgcaatgcagtggtaagt

SEQ ID NO: 7524547 - DNA, 22 bp, Homo sapiens
gacatgcataacaagattggaa

SEQ ID NO: 7524548 - DNA, 22 bp, Homo sapiens
gacatgcagttctcaagggtag

SEQ ID NO: 7524549 - DNA, 22 bp, Homo sapiens
gacatgaacctaccataatgat

SEQ ID NO: 7524550 - DNA, 22 bp, Homo sapiens
gacatgaacctaccataatgat

SEQ ID NO: 7524551 - DNA, 22 bp, Homo sapiens
gacatgaacctaccataatgat

SEQ ID NO: 7524552 - DNA, 23 bp, Homo sapiens
gacatctgttttgtccctgtgct

SEQ ID NO: 7524553 - DNA, 22 bp, Homo sapiens
gacatcttccggatcgccaccc

SEQ ID NO: 7524554 - DNA, 23 bp, Homo sapiens
gacatctgttttgtccctgtgct

SEQ ID NO: 7524555 - DNA, 23 bp, Homo sapiens
gacatctgttttgtccctgtgct

SEQ ID NO: 7524556 - DNA, 22 bp, Homo sapiens
gacatgcaacaatttggcattt

SEQ ID NO: 7524557 - DNA, 22 bp, Homo sapiens
gacatgcaacaatttggcattt

SEQ ID NO: 7524558 - DNA, 22 bp, Homo sapiens
gacatgatgcttggaactacat

SEQ ID NO: 7524559 - DNA, 22 bp, Homo sapiens
gacatgaatgttatactttatt

SEQ ID NO: 7524560 - DNA, 22 bp, Homo sapiens
gacatgaatgttatactttatt

SEQ ID NO: 7524561 - DNA, 22 bp, Homo sapiens
gacatgcattaagacacactga

SEQ ID NO: 7524562 - DNA, 22 bp, Homo sapiens
gacatgcattaagacacactga

SEQ ID NO: 7524563 - DNA, 22 bp, Homo sapiens
gacatgcattaagacacactga

SEQ ID NO: 7524564 - DNA, 22 bp, Homo sapiens
gacatgcattaagacacactga

SEQ ID NO: 7524565 - DNA, 22 bp, Homo sapiens
gacatgcattaagacacactga

SEQ ID NO: 7524566 - DNA, 22 bp, Homo sapiens
gacatggatacttgataagggg

SEQ ID NO: 7524567 - DNA, 22 bp, Homo sapiens
gacatggatacttgataagggg

SEQ ID NO: 7524568 - DNA, 22 bp, Homo sapiens
gacatgcatgaatgcaggtctc

SEQ ID NO: 7524569 - DNA, 22 bp, Homo sapiens
gacatggcttctaggaagcttt

SEQ ID NO: 7524570 - DNA, 22 bp, Homo sapiens
gacatgtattagtcatgcacag

SEQ ID NO: 7524571 - DNA, 22 bp, Homo sapiens
gacatgtattagtcatgcacag

SEQ ID NO: 7524572 - DNA, 22 bp, Homo sapiens
gacatgtcggatagaatgagtt

SEQ ID NO: 7524573 - DNA, 22 bp, Homo sapiens
gacatgtattagtcatgcacag

SEQ ID NO: 7524574 - DNA, 20 bp, Homo sapiens
gacatgtctttctcacacaa

SEQ ID NO: 7524575 - DNA, 22 bp, Homo sapiens
gacatgtattagtacatatggt

SEQ ID NO: 7524576 - DNA, 22 bp, Homo sapiens
gacatgtattagtacatatggt

SEQ ID NO: 7524577 - DNA, 22 bp, Homo sapiens
gacatgtacttcaatttctctt

SEQ ID NO: 7524578 - DNA, 22 bp, Homo sapiens
gacatgtaaatggcaattatgg

SEQ ID NO: 7524579 - DNA, 22 bp, Homo sapiens
gacatgggatgagatgaagcat

SEQ ID NO: 7524580 - DNA, 22 bp, Homo sapiens
gacatgggatgagatgaagcat

SEQ ID NO: 7524581 - DNA, 22 bp, Homo sapiens
gacctggaagaactgaggcctt

SEQ ID NO: 7524582 - DNA, 22 bp, Homo sapiens
gacctgctccacgacaagtggt

SEQ ID NO: 7524583 - DNA, 22 bp, Homo sapiens
gacctgcccactctgaggacat

SEQ ID NO: 7524584 - DNA, 22 bp, Homo sapiens
gacctgcctgagctgcctctgc

SEQ ID NO: 7524585 - DNA, 22 bp, Homo sapiens
gacctgcccactctgaggacat

SEQ ID NO: 7524586 - DNA, 22 bp, Homo sapiens
gacctggcatattcattggcac

SEQ ID NO: 7524587 - DNA, 19 bp, Homo sapiens
gacctggccaagttactta

SEQ ID NO: 7524588 - DNA, 22 bp, Homo sapiens
gacctggcatattcattggcac

SEQ ID NO: 7524589 - DNA, 22 bp, Homo sapiens
gacctggaggcttttcccaaga

SEQ ID NO: 7524590 - DNA, 22 bp, Homo sapiens
gacctggactgagttagatggc

SEQ ID NO: 7524591 - DNA, 22 bp, Homo sapiens
gacctggaatttgtgtgtgttc

SEQ ID NO: 7524592 - DNA, 22 bp, Homo sapiens
gacattcaactttgatgattat

SEQ ID NO: 7524593 - DNA, 22 bp, Homo sapiens
gacctgaccgcgtccctgccga

SEQ ID NO: 7524594 - DNA, 22 bp, Homo sapiens
gacctgagattttgaggctcat

SEQ ID NO: 7524595 - DNA, 22 bp, Homo sapiens
gacctgagattttgaggctcat

SEQ ID NO: 7524596 - DNA, 22 bp, Homo sapiens
gacattagactaatgtagcatt

SEQ ID NO: 7524597 - DNA, 22 bp, Homo sapiens
gacattcaactttgatgattat

SEQ ID NO: 7524598 - DNA, 22 bp, Homo sapiens
gacattcaactttgatgattat

SEQ ID NO: 7524599 - DNA, 22 bp, Homo sapiens
gacctgcccactctgaggacat

SEQ ID NO: 7524600 - DNA, 22 bp, Homo sapiens
gacctgcccactctgaggacat

SEQ ID NO: 7524601 - DNA, 22 bp, Homo sapiens
gacctgagattttgaggctcat

SEQ ID NO: 7524602 - DNA, 22 bp, Homo sapiens
gacattaatttctttggtaatt

SEQ ID NO: 7524603 - DNA, 22 bp, Homo sapiens
gacattaatttctttggtaatt

SEQ ID NO: 7524604 - DNA, 22 bp, Homo sapiens
gacattaatttctttggtaatt

SEQ ID NO: 7524605 - DNA, 22 bp, Homo sapiens
gacattaatggcaaattaatta

SEQ ID NO: 7524606 - DNA, 22 bp, Homo sapiens
gacattaatggcaaattaatta

SEQ ID NO: 7524607 - DNA, 22 bp, Homo sapiens
gacattaatggcaaattaatta

SEQ ID NO: 7524608 - DNA, 22 bp, Homo sapiens
gacatgttatctctggcttcaa

SEQ ID NO: 7524609 - DNA, 22 bp, Homo sapiens
gacatgttgaagaatatttgga

SEQ ID NO: 7524610 - DNA, 22 bp, Homo sapiens
gacatgttatctctggcttcaa

SEQ ID NO: 7524611 - DNA, 22 bp, Homo sapiens
gacatgtttgctatagggattt

SEQ ID NO: 7524612 - DNA, 22 bp, Homo sapiens
gacattaaatgtcttagttgcc

SEQ ID NO: 7524613 - DNA, 22 bp, Homo sapiens
gacagcctcatgtgcatgaact

SEQ ID NO: 7524614 - DNA, 22 bp, Homo sapiens
gacagcctcatgtgcatgaact

SEQ ID NO: 7524615 - DNA, 22 bp, Homo sapiens
gacagcctcatgaggagcaaaa

SEQ ID NO: 7524616 - DNA, 22 bp, Homo sapiens
gacagccatgcacttctgctgt

SEQ ID NO: 7524617 - DNA, 22 bp, Homo sapiens
gacagccatgcacttctgctgt

SEQ ID NO: 7524618 - DNA, 22 bp, Homo sapiens
gacagccatgcacttctgctgt

SEQ ID NO: 7524619 - DNA, 22 bp, Homo sapiens
gacagccatcagcacacgctgc

SEQ ID NO: 7524620 - DNA, 22 bp, Homo sapiens
gacagccatcagcacacgctgc

SEQ ID NO: 7524621 - DNA, 22 bp, Homo sapiens
gacagccagtgcgatggattca

SEQ ID NO: 7524622 - DNA, 22 bp, Homo sapiens
gacagctacagggagagcattg

SEQ ID NO: 7524623 - DNA, 22 bp, Homo sapiens
gacagctacagggagagcattg

SEQ ID NO: 7524624 - DNA, 22 bp, Homo sapiens
gacagctatgtcccaaaaactg

SEQ ID NO: 7524625 - DNA, 22 bp, Homo sapiens
gacagctgaaaaatgtaaggta

SEQ ID NO: 7524626 - DNA, 22 bp, Homo sapiens
gacagcctggcttaatctgtct

SEQ ID NO: 7524627 - DNA, 22 bp, Homo sapiens
gacagctgaaaaatgtaaggta

SEQ ID NO: 7524628 - DNA, 22 bp, Homo sapiens
gacagctgcctctgtgtagatc

SEQ ID NO: 7524629 - DNA, 22 bp, Homo sapiens
gacagctgcctctgtgtagatc

SEQ ID NO: 7524630 - DNA, 22 bp, Homo sapiens
gacagctgcatcctcagacaca

SEQ ID NO: 7524631 - DNA, 22 bp, Homo sapiens
gacagctgcatcctcagacaca

SEQ ID NO: 7524632 - DNA, 22 bp, Homo sapiens
gacagctgaaggatgattcagg

SEQ ID NO: 7524633 - DNA, 22 bp, Homo sapiens
gacagctgcttatgaaccaacg

SEQ ID NO: 7524634 - DNA, 22 bp, Homo sapiens
gacagctgctcccgtttctgct

SEQ ID NO: 7524635 - DNA, 22 bp, Homo sapiens
gacagctggacagacactgatg

SEQ ID NO: 7524636 - DNA, 22 bp, Homo sapiens
gacagctggacagacactgatg

SEQ ID NO: 7524637 - DNA, 22 bp, Homo sapiens
gacagctggacagacactgatg

SEQ ID NO: 7524638 - DNA, 22 bp, Homo sapiens
gacagctggcagtggaaaggtg

SEQ ID NO: 7524639 - DNA, 22 bp, Homo sapiens
gacagctggcagtggaaaggtg

SEQ ID NO: 7524640 - DNA, 22 bp, Homo sapiens
gacagctggcagtggaaaggtg

SEQ ID NO: 7524641 - DNA, 22 bp, Homo sapiens
gacagctggacagacactgatg

SEQ ID NO: 7524642 - DNA, 22 bp, Homo sapiens
gacagcaggtgcttgggaaagg

SEQ ID NO: 7524643 - DNA, 22 bp, Homo sapiens
gacagcaggtgcttgggaaagg

SEQ ID NO: 7524644 - DNA, 22 bp, Homo sapiens
gacagcaggtgcttgggaaagg

SEQ ID NO: 7524645 - DNA, 22 bp, Homo sapiens
gacagcaggtaattagttaaca

SEQ ID NO: 7524646 - DNA, 22 bp, Homo sapiens
gacagcaggtaattagttaaca

SEQ ID NO: 7524647 - DNA, 22 bp, Homo sapiens
gacagcagggacatgtaggaag

SEQ ID NO: 7524648 - DNA, 22 bp, Homo sapiens
gacagcagggacatgtaggaag

SEQ ID NO: 7524649 - DNA, 22 bp, Homo sapiens
gacagcagggacatgtaggaag

SEQ ID NO: 7524650 - DNA, 22 bp, Homo sapiens
gacagcagggacatgtaggaag

SEQ ID NO: 7524651 - DNA, 22 bp, Homo sapiens
gacagcagtttttctctagggt

SEQ ID NO: 7524652 - DNA, 22 bp, Homo sapiens
gacagcagtcctggagttccca

SEQ ID NO: 7524653 - DNA, 22 bp, Homo sapiens
gacagcagtcctggagttccca

SEQ ID NO: 7524654 - DNA, 22 bp, Homo sapiens
gacagcagtcctggagttccca

SEQ ID NO: 7524655 - DNA, 22 bp, Homo sapiens
gacagcagtcctggagttccca

SEQ ID NO: 7524656 - DNA, 22 bp, Homo sapiens
gacagcagtcctggagttccca

SEQ ID NO: 7524657 - DNA, 22 bp, Homo sapiens
gacagcagtcctggagttccca

SEQ ID NO: 7524658 - DNA, 22 bp, Homo sapiens
gacagcaggtgcttgggaaagg

SEQ ID NO: 7524659 - DNA, 22 bp, Homo sapiens
gacagcaggtgcttgggaaagg

SEQ ID NO: 7524660 - DNA, 22 bp, Homo sapiens
gacagcagtttttctctagggt

SEQ ID NO: 7524661 - DNA, 22 bp, Homo sapiens
gacagcagtttttctctagggt

SEQ ID NO: 7524662 - DNA, 22 bp, Homo sapiens
gacagcagtttttctctagggt

SEQ ID NO: 7524663 - DNA, 22 bp, Homo sapiens
gacagcatctgtgtggcaggag

SEQ ID NO: 7524664 - DNA, 22 bp, Homo sapiens
gacagcatctgtgtggcaggag

SEQ ID NO: 7524665 - DNA, 22 bp, Homo sapiens
gacagcatgagagatgccagtg

SEQ ID NO: 7524666 - DNA, 22 bp, Homo sapiens
gacagcatgatcaaggagccca

SEQ ID NO: 7524667 - DNA, 22 bp, Homo sapiens
gacagcatgatcaaggagccca

SEQ ID NO: 7524668 - DNA, 22 bp, Homo sapiens
gacagccatcagcacacgctgc

SEQ ID NO: 7524669 - DNA, 22 bp, Homo sapiens
gacagccatcagcacacgctgc

SEQ ID NO: 7524670 - DNA, 22 bp, Homo sapiens
gacagccagtgcgatggattca

SEQ ID NO: 7524671 - DNA, 22 bp, Homo sapiens
gacagccaactggggagggcat

SEQ ID NO: 7524672 - DNA, 22 bp, Homo sapiens
gacagccaggcatagggagtat

SEQ ID NO: 7524673 - DNA, 22 bp, Homo sapiens
gacagccaggcatagggagtat

SEQ ID NO: 7524674 - DNA, 22 bp, Homo sapiens
gacagccaggcatagggagtat

SEQ ID NO: 7524675 - DNA, 22 bp, Homo sapiens
gacagccaggtctgatgaccca

SEQ ID NO: 7524676 - DNA, 22 bp, Homo sapiens
gacagcattccatctgcaggtt

SEQ ID NO: 7524677 - DNA, 22 bp, Homo sapiens
gacagccaactggggagggcat

SEQ ID NO: 7524678 - DNA, 22 bp, Homo sapiens
gacagcatggtgtctgttcagg

SEQ ID NO: 7524679 - DNA, 22 bp, Homo sapiens
gacagcatggtgtctgttcagg

SEQ ID NO: 7524680 - DNA, 17 bp, Homo sapiens
gacagctgggcgcacgc

SEQ ID NO: 7524681 - DNA, 22 bp, Homo sapiens
gacagctgggaggatgacataa

SEQ ID NO: 7524682 - DNA, 17 bp, Homo sapiens
gacagctgggcgcacgc

SEQ ID NO: 7524683 - DNA, 17 bp, Homo sapiens
gacagctgggcgcacgc

SEQ ID NO: 7524684 - DNA, 17 bp, Homo sapiens
gacagctgggcgcacgc

SEQ ID NO: 7524685 - DNA, 17 bp, Homo sapiens
gacagctgggcgcacgc

SEQ ID NO: 7524686 - DNA, 22 bp, Homo sapiens
gacagctgtacactcctggtta

SEQ ID NO: 7524687 - DNA, 17 bp, Homo sapiens
gacagctggttcctggc

SEQ ID NO: 7524688 - DNA, 17 bp, Homo sapiens
gacagctggttcctggc

SEQ ID NO: 7524689 - DNA, 22 bp, Homo sapiens
gacagctgtacactcctggtta

SEQ ID NO: 7524690 - DNA, 22 bp, Homo sapiens
gacagtcctgcaggttgaactc

SEQ ID NO: 7524691 - DNA, 18 bp, Homo sapiens
gacagctgtcctgagccc

SEQ ID NO: 7524692 - DNA, 22 bp, Homo sapiens
gacatacagaatctgcagactt

SEQ ID NO: 7524693 - DNA, 22 bp, Homo sapiens
gacatacagaatctgcagactt

SEQ ID NO: 7524694 - DNA, 22 bp, Homo sapiens
gacagtgattagttactataaa

SEQ ID NO: 7524695 - DNA, 19 bp, Homo sapiens
gacagtgcagttgtagtac

SEQ ID NO: 7524696 - DNA, 19 bp, Homo sapiens
gacagtgcagttgtagtac

SEQ ID NO: 7524697 - DNA, 22 bp, Homo sapiens
gacagtgcatttcctggcatgg

SEQ ID NO: 7524698 - DNA, 22 bp, Homo sapiens
gacagtgcatttcctggcatgg

SEQ ID NO: 7524699 - DNA, 22 bp, Homo sapiens
gacatacagccctctccctggt

SEQ ID NO: 7524700 - DNA, 22 bp, Homo sapiens
gacatacagccctctccctggt

SEQ ID NO: 7524701 - DNA, 22 bp, Homo sapiens
gacatacagaatctgcagactt

SEQ ID NO: 7524702 - DNA, 22 bp, Homo sapiens
gacatacagcatggtctatgaa

SEQ ID NO: 7524703 - DNA, 22 bp, Homo sapiens
gacagtgattagttactataaa

SEQ ID NO: 7524704 - DNA, 22 bp, Homo sapiens
gacagtgagtacctcaaaggcc

SEQ ID NO: 7524705 - DNA, 22 bp, Homo sapiens
gacagtgagtacctcaaaggcc

SEQ ID NO: 7524706 - DNA, 22 bp, Homo sapiens
gacagtgacagcttggaaagca

SEQ ID NO: 7524707 - DNA, 22 bp, Homo sapiens
gacagtgagagtctacaccctc

SEQ ID NO: 7524708 - DNA, 22 bp, Homo sapiens
gacagtgagtacctcaaaggcc

SEQ ID NO: 7524709 - DNA, 22 bp, Homo sapiens
gacagtctgggcacacatgaaa

SEQ ID NO: 7524710 - DNA, 22 bp, Homo sapiens
gacagtctgggcacacatgaaa

SEQ ID NO: 7524711 - DNA, 22 bp, Homo sapiens
gacagtctggcctaaagggtta

SEQ ID NO: 7524712 - DNA, 22 bp, Homo sapiens
gacagtgaacaggttcccactg

SEQ ID NO: 7524713 - DNA, 22 bp, Homo sapiens
gacagtgacagcttggaaagca

SEQ ID NO: 7524714 - DNA, 22 bp, Homo sapiens
gacagtctgggcacacatgaaa

SEQ ID NO: 7524715 - DNA, 22 bp, Homo sapiens
gacatagctcagagctcagcac

SEQ ID NO: 7524716 - DNA, 18 bp, Homo sapiens
gacatagctcagagctca

SEQ ID NO: 7524717 - DNA, 22 bp, Homo sapiens
gacatagactgagtttagctga

SEQ ID NO: 7524718 - DNA, 22 bp, Homo sapiens
gacatatactatggatggttct

SEQ ID NO: 7524719 - DNA, 22 bp, Homo sapiens
gacatacatctctggaaaaaaa

SEQ ID NO: 7524720 - DNA, 22 bp, Homo sapiens
gacatacatctctggaaaaaaa

SEQ ID NO: 7524721 - DNA, 22 bp, Homo sapiens
gacatagacaaagtcattgtca

SEQ ID NO: 7524722 - DNA, 22 bp, Homo sapiens
gacatagacaaagtcattgtca

SEQ ID NO: 7524723 - DNA, 22 bp, Homo sapiens
gacatcaattcagcattttaag

SEQ ID NO: 7524724 - DNA, 22 bp, Homo sapiens
gacatcaggaagacatgagagg

SEQ ID NO: 7524725 - DNA, 22 bp, Homo sapiens
gacatatactatggatggttct

SEQ ID NO: 7524726 - DNA, 22 bp, Homo sapiens
gacatatttgaaaccaagagaa

SEQ ID NO: 7524727 - DNA, 22 bp, Homo sapiens
gacatatgtgtacatggagatt

SEQ ID NO: 7524728 - DNA, 22 bp, Homo sapiens
gacatcaatattctgcagggat

SEQ ID NO: 7524729 - DNA, 22 bp, Homo sapiens
gacatcatagggtgggaggaaa

SEQ ID NO: 7524730 - DNA, 22 bp, Homo sapiens
gacatcaggcctgcagtctggg

SEQ ID NO: 7524731 - DNA, 22 bp, Homo sapiens
gacatcatggagaggacaaaca

SEQ ID NO: 7524732 - DNA, 22 bp, Homo sapiens
gacatcatggagaggacaaaca

SEQ ID NO: 7524733 - DNA, 22 bp, Homo sapiens
gacatcatatcaggaggcatgt

SEQ ID NO: 7524734 - DNA, 22 bp, Homo sapiens
gacatcatggagaggataaata

SEQ ID NO: 7524735 - DNA, 22 bp, Homo sapiens
gacatcatgttctgctaatagt

SEQ ID NO: 7524736 - DNA, 22 bp, Homo sapiens
gacatcatgttctgctaatagt

SEQ ID NO: 7524737 - DNA, 22 bp, Homo sapiens
gacatcatgtcactaactgcta

SEQ ID NO: 7524738 - DNA, 22 bp, Homo sapiens
gacatcatggagaggataaata

SEQ ID NO: 7524739 - DNA, 21 bp, Homo sapiens
gacatccatgtgagtggcagt

SEQ ID NO: 7524740 - DNA, 22 bp, Homo sapiens
gacatccatcatttcctgttga

SEQ ID NO: 7524741 - DNA, 22 bp, Homo sapiens
gacatctgaatttagcagtttt

SEQ ID NO: 7524742 - DNA, 22 bp, Homo sapiens
gacatctgaatattagagagaa

SEQ ID NO: 7524743 - DNA, 20 bp, Homo sapiens
gacatcatgtacacattgcc

SEQ ID NO: 7524744 - DNA, 22 bp, Homo sapiens
gacatctgaatattagagagaa

SEQ ID NO: 7524745 - DNA, 22 bp, Homo sapiens
gacatctgaatattagagagaa

SEQ ID NO: 7524746 - DNA, 22 bp, Homo sapiens
gacatctggaggagatgaatgg

SEQ ID NO: 7524747 - DNA, 22 bp, Homo sapiens
gacatctggaggagatgaatgg

SEQ ID NO: 7524748 - DNA, 22 bp, Homo sapiens
gacatctgaggccctcagagcc

SEQ ID NO: 7524749 - DNA, 22 bp, Homo sapiens
gacatctgaggccctcagagcc

SEQ ID NO: 7524750 - DNA, 22 bp, Homo sapiens
gacatctgaatttagcagtttt

SEQ ID NO: 7524751 - DNA, 22 bp, Homo sapiens
gacatctgaggccctcagagcc

SEQ ID NO: 7524752 - DNA, 22 bp, Homo sapiens
gagagaagggggatatgagcct

SEQ ID NO: 7524753 - DNA, 22 bp, Homo sapiens
gagagaatgtacatgctagggg

SEQ ID NO: 7524754 - DNA, 22 bp, Homo sapiens
gagagaagggggatatgagcct

SEQ ID NO: 7524755 - DNA, 22 bp, Homo sapiens
gagagaagggggatatgagcct

SEQ ID NO: 7524756 - DNA, 22 bp, Homo sapiens
gagagaagggggatatgagcct

SEQ ID NO: 7524757 - DNA, 22 bp, Homo sapiens
gagagaagggggatatgagcct

SEQ ID NO: 7524758 - DNA, 22 bp, Homo sapiens
gagagaagggggatatgagcct

SEQ ID NO: 7524759 - DNA, 22 bp, Homo sapiens
gagagaagggggatatgagcct

SEQ ID NO: 7524760 - DNA, 22 bp, Homo sapiens
gagagaagggacttctacactt

SEQ ID NO: 7524761 - DNA, 22 bp, Homo sapiens
gagagaagggacttctacactt

SEQ ID NO: 7524762 - DNA, 22 bp, Homo sapiens
gagagaagaatgttccgaggcc

SEQ ID NO: 7524763 - DNA, 22 bp, Homo sapiens
gagagaagggacttctacactt

SEQ ID NO: 7524764 - DNA, 22 bp, Homo sapiens
gagagaagaatgttccgaggcc

SEQ ID NO: 7524765 - DNA, 22 bp, Homo sapiens
gagagaagaatgttccgaggcc

SEQ ID NO: 7524766 - DNA, 22 bp, Homo sapiens
gagagaagaatgttccgaggcc

SEQ ID NO: 7524767 - DNA, 22 bp, Homo sapiens
gagagaagaatgttccgaggcc

SEQ ID NO: 7524768 - DNA, 22 bp, Homo sapiens
gagagaagaatgttccgaggcc

SEQ ID NO: 7524769 - DNA, 22 bp, Homo sapiens
gagagaagaatgttccgaggcc

SEQ ID NO: 7524770 - DNA, 22 bp, Homo sapiens
gagaaggaagttgagccagcat

SEQ ID NO: 7524771 - DNA, 22 bp, Homo sapiens
gagaaggaagttgagccagcat

SEQ ID NO: 7524772 - DNA, 22 bp, Homo sapiens
gagaaggactacacatctggcc

SEQ ID NO: 7524773 - DNA, 22 bp, Homo sapiens
gagaaggaagttgagccagcat

SEQ ID NO: 7524774 - DNA, 22 bp, Homo sapiens
gagaaggaagttgagccagcat

SEQ ID NO: 7524775 - DNA, 18 bp, Homo sapiens
gagaagctgattgaatgc

SEQ ID NO: 7524776 - DNA, 22 bp, Homo sapiens
gagaagctggactttccaaact

SEQ ID NO: 7524777 - DNA, 22 bp, Homo sapiens
gagaagccgagtcagctgagcc

SEQ ID NO: 7524778 - DNA, 22 bp, Homo sapiens
gagaagccgagtcagctgagcc

SEQ ID NO: 7524779 - DNA, 22 bp, Homo sapiens
gagagaagaacaatgtcattca

SEQ ID NO: 7524780 - DNA, 22 bp, Homo sapiens
gagagaagaacaatgtcattca

SEQ ID NO: 7524781 - DNA, 22 bp, Homo sapiens
gagagaagaacaatgtcattca

SEQ ID NO: 7524782 - DNA, 22 bp, Homo sapiens
gagagaagaaagccatggtcct

SEQ ID NO: 7524783 - DNA, 22 bp, Homo sapiens
gagagaagaaagccatggtcct

SEQ ID NO: 7524784 - DNA, 22 bp, Homo sapiens
gagaagcaatcagtggccaccc

SEQ ID NO: 7524785 - DNA, 22 bp, Homo sapiens
gagaagcaatcagtggccaccc

SEQ ID NO: 7524786 - DNA, 22 bp, Homo sapiens
gagaagcaatcagtggccaccc

SEQ ID NO: 7524787 - DNA, 22 bp, Homo sapiens
gagaagcaatcagtggccaccc

SEQ ID NO: 7524788 - DNA, 22 bp, Homo sapiens
gagaagcaatcagcagccaccc

SEQ ID NO: 7524789 - DNA, 22 bp, Homo sapiens
gagaagcaatcagtggccaccc

SEQ ID NO: 7524790 - DNA, 22 bp, Homo sapiens
gagaagcaatcagtggccaccc

SEQ ID NO: 7524791 - DNA, 22 bp, Homo sapiens
gagaagcaatcagtggccaccc

SEQ ID NO: 7524792 - DNA, 22 bp, Homo sapiens
gagaagcaatcagtggccaccc

SEQ ID NO: 7524793 - DNA, 22 bp, Homo sapiens
gagaagcaatcgtgacatctcc

SEQ ID NO: 7524794 - DNA, 22 bp, Homo sapiens
gagaagcaatcgtgacatctcc

SEQ ID NO: 7524795 - DNA, 22 bp, Homo sapiens
gagaagcaatcgtgacatctcc

SEQ ID NO: 7524796 - DNA, 22 bp, Homo sapiens
gagaagcaatcgtgacatctcc

SEQ ID NO: 7524797 - DNA, 22 bp, Homo sapiens
gagaagcaatcgtgacatctcc

SEQ ID NO: 7524798 - DNA, 22 bp, Homo sapiens
gagaagcaatcgtgacatctcc

SEQ ID NO: 7524799 - DNA, 22 bp, Homo sapiens
gagaagcaatcgtgacatctcc

SEQ ID NO: 7524800 - DNA, 22 bp, Homo sapiens
gagaagcaatttccaactgtgc

SEQ ID NO: 7524801 - DNA, 22 bp, Homo sapiens
gagaagcaatttccaactgtgc

SEQ ID NO: 7524802 - DNA, 22 bp, Homo sapiens
gagaagcaatttccaactgtgc

SEQ ID NO: 7524803 - DNA, 22 bp, Homo sapiens
gagaagcaatttccaactgtgc

SEQ ID NO: 7524804 - DNA, 22 bp, Homo sapiens
gagaagcaggtttagcagacaa

SEQ ID NO: 7524805 - DNA, 22 bp, Homo sapiens
gagaagcaggtttagcagacaa

SEQ ID NO: 7524806 - DNA, 22 bp, Homo sapiens
gagaagcaggtttagcagacaa

SEQ ID NO: 7524807 - DNA, 22 bp, Homo sapiens
gagaagcaggtttagcagacaa

SEQ ID NO: 7524808 - DNA, 22 bp, Homo sapiens
gagaagcaggtttagcagacaa

SEQ ID NO: 7524809 - DNA, 22 bp, Homo sapiens
gagaagcaggtttagcagacaa

SEQ ID NO: 7524810 - DNA, 22 bp, Homo sapiens
gagaagcaggtttagcagacaa

SEQ ID NO: 7524811 - DNA, 22 bp, Homo sapiens
gagaagcaggtttagcagacaa

SEQ ID NO: 7524812 - DNA, 22 bp, Homo sapiens
gagaagcaggtttagcagacaa

SEQ ID NO: 7524813 - DNA, 22 bp, Homo sapiens
gagaagcaggtttagcagacaa

SEQ ID NO: 7524814 - DNA, 22 bp, Homo sapiens
gagaagccgagtcagctgagcc

SEQ ID NO: 7524815 - DNA, 22 bp, Homo sapiens
gagaagccgagtcagctgagcc

SEQ ID NO: 7524816 - DNA, 22 bp, Homo sapiens
gagaagccgagtcagctgagcc

SEQ ID NO: 7524817 - DNA, 22 bp, Homo sapiens
gagaagccgagtcagctgagcc

SEQ ID NO: 7524818 - DNA, 22 bp, Homo sapiens
gagaagccgagtcagctgagcc

SEQ ID NO: 7524819 - DNA, 22 bp, Homo sapiens
gactatttttatctaactgggt

SEQ ID NO: 7524820 - DNA, 19 bp, Homo sapiens
gactcacaccttccgctgt

SEQ ID NO: 7524821 - DNA, 19 bp, Homo sapiens
gactcacaccttccgctgt

SEQ ID NO: 7524822 - DNA, 19 bp, Homo sapiens
gactcacaccttccgctgt

SEQ ID NO: 7524823 - DNA, 22 bp, Homo sapiens
gactatttttatctaactgggt

SEQ ID NO: 7524824 - DNA, 22 bp, Homo sapiens
gactattttataaactagtgaa

SEQ ID NO: 7524825 - DNA, 22 bp, Homo sapiens
gactattttgcacaaaacaatt

SEQ ID NO: 7524826 - DNA, 19 bp, Homo sapiens
gactcacaccttccgctgt

SEQ ID NO: 7524827 - DNA, 19 bp, Homo sapiens
gactcacaccttccgctgt

SEQ ID NO: 7524828 - DNA, 22 bp, Homo sapiens
gactcagagatccctggaggtc

SEQ ID NO: 7524829 - DNA, 19 bp, Homo sapiens
gactcacaccttccgctgt

SEQ ID NO: 7524830 - DNA, 19 bp, Homo sapiens
gactccaactttaagcatg

SEQ ID NO: 7524831 - DNA, 22 bp, Homo sapiens
gactccagaatctggacggtcc

SEQ ID NO: 7524832 - DNA, 22 bp, Homo sapiens
gactccagagtgactatttgtc

SEQ ID NO: 7524833 - DNA, 22 bp, Homo sapiens
gactcagtgatttgacatgcct

SEQ ID NO: 7524834 - DNA, 22 bp, Homo sapiens
gactcagatttagagggtaaga

SEQ ID NO: 7524835 - DNA, 19 bp, Homo sapiens
gactccaactttaagcatg

SEQ ID NO: 7524836 - DNA, 19 bp, Homo sapiens
gactccaactttaagcatg

SEQ ID NO: 7524837 - DNA, 19 bp, Homo sapiens
gactccaactttaagcatg

SEQ ID NO: 7524838 - DNA, 19 bp, Homo sapiens
gactccaactttaagcatg

SEQ ID NO: 7524839 - DNA, 22 bp, Homo sapiens
gagaaagggaacttacagagtg

SEQ ID NO: 7524840 - DNA, 22 bp, Homo sapiens
gagaaagggaacttacagagtg

SEQ ID NO: 7524841 - DNA, 22 bp, Homo sapiens
gagaaagggaacttacagagtg

SEQ ID NO: 7524842 - DNA, 22 bp, Homo sapiens
gagaaagggaacttacagagtg

SEQ ID NO: 7524843 - DNA, 22 bp, Homo sapiens
gagaaagggaacttacagagtg

SEQ ID NO: 7524844 - DNA, 22 bp, Homo sapiens
gagaaagggaacttacagagtg

SEQ ID NO: 7524845 - DNA, 22 bp, Homo sapiens
gagaaagggaacttacagagtg

SEQ ID NO: 7524846 - DNA, 22 bp, Homo sapiens
gagaaagggaacttacagagtg

SEQ ID NO: 7524847 - DNA, 22 bp, Homo sapiens
gagaacaggctctggagtcaga

SEQ ID NO: 7524848 - DNA, 22 bp, Homo sapiens
gagaacaggctctggagtcaga

SEQ ID NO: 7524849 - DNA, 22 bp, Homo sapiens
gagaaagggataatttgaagag

SEQ ID NO: 7524850 - DNA, 22 bp, Homo sapiens
gagaacagtgtcatcctataat

SEQ ID NO: 7524851 - DNA, 22 bp, Homo sapiens
gagaacaggctctggagtcaga

SEQ ID NO: 7524852 - DNA, 22 bp, Homo sapiens
gagaacaggctctggagtcaga

SEQ ID NO: 7524853 - DNA, 22 bp, Homo sapiens
gagaagacgtgatggccaagaa

SEQ ID NO: 7524854 - DNA, 16 bp, Homo sapiens
gagaagagcccggcag

SEQ ID NO: 7524855 - DNA, 16 bp, Homo sapiens
gagaagagcccggcag

SEQ ID NO: 7524856 - DNA, 22 bp, Homo sapiens
gagaagcaatcagcagccaccc

SEQ ID NO: 7524857 - DNA, 22 bp, Homo sapiens
gagaagcaatcagcagccaccc

SEQ ID NO: 7524858 - DNA, 22 bp, Homo sapiens
gagaagcaatcagcagccaccc

SEQ ID NO: 7524859 - DNA, 22 bp, Homo sapiens
gagaagcaatcagcagccaccc

SEQ ID NO: 7524860 - DNA, 22 bp, Homo sapiens
gagaagcaatcagcagccaccc

SEQ ID NO: 7524861 - DNA, 22 bp, Homo sapiens
gagaagcaatcagcagccaccc

SEQ ID NO: 7524862 - DNA, 22 bp, Homo sapiens
gagaagaacttgggcaaagtca

SEQ ID NO: 7524863 - DNA, 22 bp, Homo sapiens
gagaagaacttgggcaaagtca

SEQ ID NO: 7524864 - DNA, 16 bp, Homo sapiens
gagaagagcccggcag

SEQ ID NO: 7524865 - DNA, 22 bp, Homo sapiens
gagaagaacttgggcaaagtca

SEQ ID NO: 7524866 - DNA, 22 bp, Homo sapiens
gagaagacgtgatggccaagaa

SEQ ID NO: 7524867 - DNA, 22 bp, Homo sapiens
gagaagacgtgatggccaagaa

SEQ ID NO: 7524868 - DNA, 22 bp, Homo sapiens
gagaagaacttgggcaaagtca

SEQ ID NO: 7524869 - DNA, 22 bp, Homo sapiens
gagaagaacttgggcaaagtca

SEQ ID NO: 7524870 - DNA, 22 bp, Homo sapiens
gagaagaacttgggcaaagtca

SEQ ID NO: 7524871 - DNA, 22 bp, Homo sapiens
gagaagaacttgggcaaagtca

SEQ ID NO: 7524872 - DNA, 22 bp, Homo sapiens
gagaagaaatagaatcacattt

SEQ ID NO: 7524873 - DNA, 22 bp, Homo sapiens
gagaagaaatagaatcacattt

SEQ ID NO: 7524874 - DNA, 22 bp, Homo sapiens
gagaagaaatagaatcacattt

SEQ ID NO: 7524875 - DNA, 22 bp, Homo sapiens
gagaagaaatagaatcacattt

SEQ ID NO: 7524876 - DNA, 22 bp, Homo sapiens
gagaagaaatagaatcacattt

SEQ ID NO: 7524877 - DNA, 22 bp, Homo sapiens
gagaagaaatagaatcacattt

SEQ ID NO: 7524878 - DNA, 22 bp, Homo sapiens
gagaagaaatagaatcacattt

SEQ ID NO: 7524879 - DNA, 22 bp, Homo sapiens
gagaagaaaattccgtgaacac

SEQ ID NO: 7524880 - DNA, 22 bp, Homo sapiens
gagaagaaaattccgtgaacac

SEQ ID NO: 7524881 - DNA, 22 bp, Homo sapiens
gagaagaaaattccgtgaacac

SEQ ID NO: 7524882 - DNA, 22 bp, Homo sapiens
gagaagaaaattccgtgaacac

SEQ ID NO: 7524883 - DNA, 22 bp, Homo sapiens
gagaactgattagcatttgcca

SEQ ID NO: 7524884 - DNA, 22 bp, Homo sapiens
gagaactttctgtgtttttatc

SEQ ID NO: 7524885 - DNA, 22 bp, Homo sapiens
gagaacttcaggattattcaag

SEQ ID NO: 7524886 - DNA, 22 bp, Homo sapiens
gagaacttcaggattattcaag

SEQ ID NO: 7524887 - DNA, 22 bp, Homo sapiens
gagaactcagacgcaggtcatg

SEQ ID NO: 7524888 - DNA, 21 bp, Homo sapiens
gagaactgaaccagagcagct

SEQ ID NO: 7524889 - DNA, 21 bp, Homo sapiens
gagaactgaaccagagcagct

SEQ ID NO: 7524890 - DNA, 21 bp, Homo sapiens
gagaactgaaccagagcagct

SEQ ID NO: 7524891 - DNA, 22 bp, Homo sapiens
gagaactcagacgcaggtcatg

SEQ ID NO: 7524892 - DNA, 22 bp, Homo sapiens
gagaacctctccacaagtctgg

SEQ ID NO: 7524893 - DNA, 22 bp, Homo sapiens
gagaactaatcatgcatggagt

SEQ ID NO: 7524894 - DNA, 22 bp, Homo sapiens
gagaacctctccacaagtctgg

SEQ ID NO: 7524895 - DNA, 22 bp, Homo sapiens
gagaacagtgttgtattttttc

SEQ ID NO: 7524896 - DNA, 22 bp, Homo sapiens
gagaggagacttatccagattg

SEQ ID NO: 7524897 - DNA, 22 bp, Homo sapiens
gagaggagacttatccagattg

SEQ ID NO: 7524898 - DNA, 22 bp, Homo sapiens
gagaggagaagcctgcgcttca

SEQ ID NO: 7524899 - DNA, 22 bp, Homo sapiens
gagaggagaagcctgcgcttca

SEQ ID NO: 7524900 - DNA, 22 bp, Homo sapiens
gagaggagaagcctgcgcttca

SEQ ID NO: 7524901 - DNA, 22 bp, Homo sapiens
gagaggagaagcctgcgcttca

SEQ ID NO: 7524902 - DNA, 22 bp, Homo sapiens
gagaggagaagcctgcgcttca

SEQ ID NO: 7524903 - DNA, 22 bp, Homo sapiens
gagaggagacttatccagattg

SEQ ID NO: 7524904 - DNA, 22 bp, Homo sapiens
gagaggagacttatccagattg

SEQ ID NO: 7524905 - DNA, 18 bp, Homo sapiens
gagaggagccagaatttt

SEQ ID NO: 7524906 - DNA, 18 bp, Homo sapiens
gagaggagccagaatttt

SEQ ID NO: 7524907 - DNA, 18 bp, Homo sapiens
gagaggagccagaatttt

SEQ ID NO: 7524908 - DNA, 22 bp, Homo sapiens
gagaggagacttatccagattg

SEQ ID NO: 7524909 - DNA, 22 bp, Homo sapiens
gagaggagacttatccagattg

SEQ ID NO: 7524910 - DNA, 22 bp, Homo sapiens
gagaggagacttatccagattg

SEQ ID NO: 7524911 - DNA, 22 bp, Homo sapiens
gagaggagacttatccagattg

SEQ ID NO: 7524912 - DNA, 22 bp, Homo sapiens
gagaggagacttatccagattg

SEQ ID NO: 7524913 - DNA, 22 bp, Homo sapiens
gagagctgtcagcgtagcaccg

SEQ ID NO: 7524914 - DNA, 22 bp, Homo sapiens
gagagccctacaaggcgttttg

SEQ ID NO: 7524915 - DNA, 22 bp, Homo sapiens
gagagctgtcagcgtagcaccg

SEQ ID NO: 7524916 - DNA, 22 bp, Homo sapiens
gagagctgtcagcgtagcaccg

SEQ ID NO: 7524917 - DNA, 22 bp, Homo sapiens
gagagctgtcagcgtagcaccg

SEQ ID NO: 7524918 - DNA, 22 bp, Homo sapiens
gagagctgtccggctgagcagc

SEQ ID NO: 7524919 - DNA, 22 bp, Homo sapiens
gagagctgtccggctgagcagc

SEQ ID NO: 7524920 - DNA, 22 bp, Homo sapiens
gagagctgtccggctgagcagc

SEQ ID NO: 7524921 - DNA, 22 bp, Homo sapiens
gagaggagaagcctgcgcttca

SEQ ID NO: 7524922 - DNA, 22 bp, Homo sapiens
gagagctgtccggctgagcagc

SEQ ID NO: 7524923 - DNA, 22 bp, Homo sapiens
gagagctgtccggctgagcagc

SEQ ID NO: 7524924 - DNA, 22 bp, Homo sapiens
gagagctgtccggctgagcagc

SEQ ID NO: 7524925 - DNA, 22 bp, Homo sapiens
gagagctgtaatagtcatgtct

SEQ ID NO: 7524926 - DNA, 22 bp, Homo sapiens
gagagccctgctcctatcccag

SEQ ID NO: 7524927 - DNA, 22 bp, Homo sapiens
gagagccctgcatggctgatga

SEQ ID NO: 7524928 - DNA, 22 bp, Homo sapiens
gagagccctgcatggctgatga

SEQ ID NO: 7524929 - DNA, 17 bp, Homo sapiens
gagagccctcagatgtc

SEQ ID NO: 7524930 - DNA, 22 bp, Homo sapiens
gagagccctcactccttccctg

SEQ ID NO: 7524931 - DNA, 22 bp, Homo sapiens
gagagccctcactccttccctg

SEQ ID NO: 7524932 - DNA, 22 bp, Homo sapiens
gagaggaggtggctatgacagc

SEQ ID NO: 7524933 - DNA, 22 bp, Homo sapiens
gagaggaggtggctatgacagc

SEQ ID NO: 7524934 - DNA, 22 bp, Homo sapiens
gagaggagtagacactttggtt

SEQ ID NO: 7524935 - DNA, 22 bp, Homo sapiens
gagaggagtagacactttggtt

SEQ ID NO: 7524936 - DNA, 22 bp, Homo sapiens
gagaggagtagacactttggtt

SEQ ID NO: 7524937 - DNA, 18 bp, Homo sapiens
gagaggagccagaatttt

SEQ ID NO: 7524938 - DNA, 18 bp, Homo sapiens
gagaggagccagaatttt

SEQ ID NO: 7524939 - DNA, 18 bp, Homo sapiens
gagaggagccagaatttt

SEQ ID NO: 7524940 - DNA, 18 bp, Homo sapiens
gagaggagccagaatttt

SEQ ID NO: 7524941 - DNA, 18 bp, Homo sapiens
gagaggagccagaatttt

SEQ ID NO: 7524942 - DNA, 22 bp, Homo sapiens
gagaggaggtggctatgacagc

SEQ ID NO: 7524943 - DNA, 22 bp, Homo sapiens
gagaggaggtggctatgacagc

SEQ ID NO: 7524944 - DNA, 22 bp, Homo sapiens
gagaggaggtggctatgacagc

SEQ ID NO: 7524945 - DNA, 22 bp, Homo sapiens
gagaggaggtggctatgacagc

SEQ ID NO: 7524946 - DNA, 22 bp, Homo sapiens
gagaggagtaggctgatggtgc

SEQ ID NO: 7524947 - DNA, 22 bp, Homo sapiens
gagaggagtaggctgatggtgc

SEQ ID NO: 7524948 - DNA, 22 bp, Homo sapiens
gagaggagtaggctgatggtgc

SEQ ID NO: 7524949 - DNA, 22 bp, Homo sapiens
gagaggagtaggctgatggtgc

SEQ ID NO: 7524950 - DNA, 22 bp, Homo sapiens
gagaggagtagacactttggtt

SEQ ID NO: 7524951 - DNA, 22 bp, Homo sapiens
gagaggagtaggctgatggtgc

SEQ ID NO: 7524952 - DNA, 22 bp, Homo sapiens
gagaggagtaggctgatggtgc

SEQ ID NO: 7524953 - DNA, 22 bp, Homo sapiens
gagaggagtccctatcacagtt

SEQ ID NO: 7524954 - DNA, 22 bp, Homo sapiens
gagaggagtccctatcacagtt

SEQ ID NO: 7524955 - DNA, 22 bp, Homo sapiens
gagaggagtccctatcacagtt

SEQ ID NO: 7524956 - DNA, 22 bp, Homo sapiens
gagaggagtaggctgatggtgc

SEQ ID NO: 7524957 - DNA, 22 bp, Homo sapiens
gagagcaggaggcagcgggacg

SEQ ID NO: 7524958 - DNA, 22 bp, Homo sapiens
gagagcaggaggcagcgggacg

SEQ ID NO: 7524959 - DNA, 22 bp, Homo sapiens
gagagcaggaggcagcgggacg

SEQ ID NO: 7524960 - DNA, 22 bp, Homo sapiens
gagagcaggaggcagcgggacg

SEQ ID NO: 7524961 - DNA, 22 bp, Homo sapiens
gagagcaggaggcagcgggacg

SEQ ID NO: 7524962 - DNA, 22 bp, Homo sapiens
gagagcaggaggcagcgggacg

SEQ ID NO: 7524963 - DNA, 22 bp, Homo sapiens
gagagcaggaggcagcgggacg

SEQ ID NO: 7524964 - DNA, 22 bp, Homo sapiens
gagagcaggaggcagcgggacg

SEQ ID NO: 7524965 - DNA, 22 bp, Homo sapiens
gagagcaggaggcagcgggacg

SEQ ID NO: 7524966 - DNA, 22 bp, Homo sapiens
gagagcaggaggcagcgggacg

SEQ ID NO: 7524967 - DNA, 22 bp, Homo sapiens
gagagcaggctctcgggggcca

SEQ ID NO: 7524968 - DNA, 22 bp, Homo sapiens
gagagcaggctctcgggggcca

SEQ ID NO: 7524969 - DNA, 22 bp, Homo sapiens
gagagccagcagtaaagacatt

SEQ ID NO: 7524970 - DNA, 22 bp, Homo sapiens
gagagccagcagtaaagacatt

SEQ ID NO: 7524971 - DNA, 22 bp, Homo sapiens
gagagcaggctctcgggggcca

SEQ ID NO: 7524972 - DNA, 22 bp, Homo sapiens
gagagcaggctctcgggggcca

SEQ ID NO: 7524973 - DNA, 22 bp, Homo sapiens
gagagcaggctctcgggggcca

SEQ ID NO: 7524974 - DNA, 22 bp, Homo sapiens
gagagcatactataatggaggt

SEQ ID NO: 7524975 - DNA, 22 bp, Homo sapiens
gagagccatggtggagatgggg

SEQ ID NO: 7524976 - DNA, 22 bp, Homo sapiens
gagagccatggtggagatgggg

SEQ ID NO: 7524977 - DNA, 22 bp, Homo sapiens
gagagccatggtggagatgggg

SEQ ID NO: 7524978 - DNA, 22 bp, Homo sapiens
gagagccagcagtaaagacatt

SEQ ID NO: 7524979 - DNA, 22 bp, Homo sapiens
gagagccagctcactccagggc

SEQ ID NO: 7524980 - DNA, 22 bp, Homo sapiens
gagagccagctcactccagggc

SEQ ID NO: 7524981 - DNA, 22 bp, Homo sapiens
gagagccagctcactccagggc

SEQ ID NO: 7524982 - DNA, 22 bp, Homo sapiens
gagagccatggtggagatgggg

SEQ ID NO: 7524983 - DNA, 22 bp, Homo sapiens
gagagcccaaaatttagcaaga

SEQ ID NO: 7524984 - DNA, 22 bp, Homo sapiens
gagagccatggtggagatgggg

SEQ ID NO: 7524985 - DNA, 22 bp, Homo sapiens
gagagccatggtggagatgggg

SEQ ID NO: 7524986 - DNA, 23 bp, Homo sapiens
gagagcccattggcaggggtacc

SEQ ID NO: 7524987 - DNA, 22 bp, Homo sapiens
gagagccctacaaggcgttttg

SEQ ID NO: 7524988 - DNA, 18 bp, Homo sapiens
gagagcccagcaggtggt

SEQ ID NO: 7524989 - DNA, 23 bp, Homo sapiens
gagagcccattggcaggggtacc

SEQ ID NO: 7524990 - DNA, 18 bp, Homo sapiens
gagagcccagcaggtggt

SEQ ID NO: 7524991 - DNA, 18 bp, Homo sapiens
gagagcccagcaggtggt

SEQ ID NO: 7524992 - DNA, 18 bp, Homo sapiens
gagagcccagcaggtggt

SEQ ID NO: 7524993 - DNA, 18 bp, Homo sapiens
gagagcccagcaggtggt

SEQ ID NO: 7524994 - DNA, 22 bp, Homo sapiens
gagagagaaggcctgtgggtgt

SEQ ID NO: 7524995 - DNA, 22 bp, Homo sapiens
gagagagaaggcctgtgggtgt

SEQ ID NO: 7524996 - DNA, 22 bp, Homo sapiens
gagagagaaggcctgtgggtgt

SEQ ID NO: 7524997 - DNA, 22 bp, Homo sapiens
gagagagaaccccgtgcccttc

SEQ ID NO: 7524998 - DNA, 22 bp, Homo sapiens
gagagagaaccccgtgcccttc

SEQ ID NO: 7524999 - DNA, 22 bp, Homo sapiens
gagagagaaggcctgtgggtgt

SEQ ID NO: 7525000 - DNA, 22 bp, Homo sapiens
gagagagaaaatgactccggac

SEQ ID NO: 7525001 - DNA, 22 bp, Homo sapiens
gagagagaaccccgtgcccttc

SEQ ID NO: 7525002 - DNA, 22 bp, Homo sapiens
gagagagaaccccgtgcccttc

SEQ ID NO: 7525003 - DNA, 22 bp, Homo sapiens
gagagagaaccccgtgcccttc

SEQ ID NO: 7525004 - DNA, 22 bp, Homo sapiens
gagagagaaaatgactccggac

SEQ ID NO: 7525005 - DNA, 22 bp, Homo sapiens
gagagagaaaatgactccggac

SEQ ID NO: 7525006 - DNA, 22 bp, Homo sapiens
gagagactgggcagggccggca

SEQ ID NO: 7525007 - DNA, 22 bp, Homo sapiens
gagagactggaatgggctgtgg

SEQ ID NO: 7525008 - DNA, 22 bp, Homo sapiens
gagagactgatgtggctatgta

SEQ ID NO: 7525009 - DNA, 22 bp, Homo sapiens
gagagacagcagaacgtgcagc

SEQ ID NO: 7525010 - DNA, 22 bp, Homo sapiens
gagagacccagacaccatgcat

SEQ ID NO: 7525011 - DNA, 22 bp, Homo sapiens
gagagacctcagaaacaatcta

SEQ ID NO: 7525012 - DNA, 22 bp, Homo sapiens
gagagactgatgtggctatgta

SEQ ID NO: 7525013 - DNA, 22 bp, Homo sapiens
gagagacagcagaacgtgcagc

SEQ ID NO: 7525014 - DNA, 22 bp, Homo sapiens
gagagacagcagaacgtgcagc

SEQ ID NO: 7525015 - DNA, 22 bp, Homo sapiens
gagagacagcagaacgtgcagc

SEQ ID NO: 7525016 - DNA, 22 bp, Homo sapiens
gagagacagcagaacgtgcagc

SEQ ID NO: 7525017 - DNA, 22 bp, Homo sapiens
gagagacagcacacagtgtggg

SEQ ID NO: 7525018 - DNA, 22 bp, Homo sapiens
gagagacagcagaacgtgcagc

SEQ ID NO: 7525019 - DNA, 22 bp, Homo sapiens
gagagacagcacacagtgtggg

SEQ ID NO: 7525020 - DNA, 22 bp, Homo sapiens
gagagacagcacacagtgtggg

SEQ ID NO: 7525021 - DNA, 22 bp, Homo sapiens
gagagacagcacacagtgtggg

SEQ ID NO: 7525022 - DNA, 22 bp, Homo sapiens
gagagacagcacacagtgtggg

SEQ ID NO: 7525023 - DNA, 22 bp, Homo sapiens
gagagacagcacacagtgtggg

SEQ ID NO: 7525024 - DNA, 22 bp, Homo sapiens
gagagaatgtacatgctagggg

SEQ ID NO: 7525025 - DNA, 22 bp, Homo sapiens
gagcagaacaggccgggtggga

SEQ ID NO: 7525026 - DNA, 22 bp, Homo sapiens
gagcagaaagttatgtcttgca

SEQ ID NO: 7525027 - DNA, 22 bp, Homo sapiens
gagcagaaagttatgtcttgca

SEQ ID NO: 7525028 - DNA, 22 bp, Homo sapiens
gagcagaaagttatgtcttgca

SEQ ID NO: 7525029 - DNA, 22 bp, Homo sapiens
gagcagaaagttatgtcttgca

SEQ ID NO: 7525030 - DNA, 22 bp, Homo sapiens
gagcacttagatgctatgaatg

SEQ ID NO: 7525031 - DNA, 22 bp, Homo sapiens
gagcacttcagaattgggcaat

SEQ ID NO: 7525032 - DNA, 22 bp, Homo sapiens
gagcactgtactcatttgcact

SEQ ID NO: 7525033 - DNA, 22 bp, Homo sapiens
gagcagacgctgcagtcttggg

SEQ ID NO: 7525034 - DNA, 22 bp, Homo sapiens
gagcagacgctgcagtcttggg

SEQ ID NO: 7525035 - DNA, 22 bp, Homo sapiens
gagcagacgctgcagtcttggg

SEQ ID NO: 7525036 - DNA, 22 bp, Homo sapiens
gagcagagaatccagctaagtg

SEQ ID NO: 7525037 - DNA, 22 bp, Homo sapiens
gagcagagaatccagctaagtg

SEQ ID NO: 7525038 - DNA, 22 bp, Homo sapiens
gagcagagaatccagctaagtg

SEQ ID NO: 7525039 - DNA, 22 bp, Homo sapiens
gagcagaaagttatgtcttgca

SEQ ID NO: 7525040 - DNA, 22 bp, Homo sapiens
gagcagaacaggccgggtggga

SEQ ID NO: 7525041 - DNA, 22 bp, Homo sapiens
gagcagaactactcacatatcg

SEQ ID NO: 7525042 - DNA, 22 bp, Homo sapiens
gagcagaactactcacatatcg

SEQ ID NO: 7525043 - DNA, 22 bp, Homo sapiens
gagcagaactactcacatatcg

SEQ ID NO: 7525044 - DNA, 22 bp, Homo sapiens
gagcacgttgaagcgcactgtc

SEQ ID NO: 7525045 - DNA, 22 bp, Homo sapiens
gagcacgttgaagcgcactgtc

SEQ ID NO: 7525046 - DNA, 22 bp, Homo sapiens
gagcacgttgaagcgcactgtc

SEQ ID NO: 7525047 - DNA, 22 bp, Homo sapiens
gagcacctgctaaatgacagtt

SEQ ID NO: 7525048 - DNA, 22 bp, Homo sapiens
gagcactgagctggaattggag

SEQ ID NO: 7525049 - DNA, 22 bp, Homo sapiens
gagcacctgctaaatgacagtt

SEQ ID NO: 7525050 - DNA, 22 bp, Homo sapiens
gagcacctgctaaatgacagtt

SEQ ID NO: 7525051 - DNA, 22 bp, Homo sapiens
gagcacctgcctcctcatttga

SEQ ID NO: 7525052 - DNA, 22 bp, Homo sapiens
gagcacctcaatttgctatttg

SEQ ID NO: 7525053 - DNA, 22 bp, Homo sapiens
gagcactgatttatttttgtct

SEQ ID NO: 7525054 - DNA, 22 bp, Homo sapiens
gagcactgatttatttttgtct

SEQ ID NO: 7525055 - DNA, 22 bp, Homo sapiens
gagcactgaggaaagctggtta

SEQ ID NO: 7525056 - DNA, 22 bp, Homo sapiens
gagcactgatttatttttgtct

SEQ ID NO: 7525057 - DNA, 22 bp, Homo sapiens
gagcactgagctggaattggag

SEQ ID NO: 7525058 - DNA, 22 bp, Homo sapiens
gagcactgaggaaagctggtta

SEQ ID NO: 7525059 - DNA, 18 bp, Homo sapiens
gagcactggtgttgaggt

SEQ ID NO: 7525060 - DNA, 22 bp, Homo sapiens
gagcactgatttatttttgtct

SEQ ID NO: 7525061 - DNA, 22 bp, Homo sapiens
gagcactgatttatttttgtct

SEQ ID NO: 7525062 - DNA, 22 bp, Homo sapiens
gagcacagtaaagcagtgtcac

SEQ ID NO: 7525063 - DNA, 22 bp, Homo sapiens
gagcacagtaaagcagtgtcac

SEQ ID NO: 7525064 - DNA, 22 bp, Homo sapiens
gagcacagtaaagcagtgtcac

SEQ ID NO: 7525065 - DNA, 22 bp, Homo sapiens
gagcacagatcctggagccaca

SEQ ID NO: 7525066 - DNA, 22 bp, Homo sapiens
gagcacagatcctggagccaca

SEQ ID NO: 7525067 - DNA, 20 bp, Homo sapiens
gagcacagtaatgactgcta

SEQ ID NO: 7525068 - DNA, 20 bp, Homo sapiens
gagcacagtaatgactgcta

SEQ ID NO: 7525069 - DNA, 20 bp, Homo sapiens
gagcacagtaatgactgcta

SEQ ID NO: 7525070 - DNA, 22 bp, Homo sapiens
gagcacagtaaagcagtgtcac

SEQ ID NO: 7525071 - DNA, 22 bp, Homo sapiens
gagcacagtccttttgttaaaa

SEQ ID NO: 7525072 - DNA, 22 bp, Homo sapiens
gagcacagtccttttgttaaaa

SEQ ID NO: 7525073 - DNA, 22 bp, Homo sapiens
gagcacagtccttttgttaaaa

SEQ ID NO: 7525074 - DNA, 20 bp, Homo sapiens
gagcacagtaatgactgcta

SEQ ID NO: 7525075 - DNA, 20 bp, Homo sapiens
gagcacagtaatgactgcta

SEQ ID NO: 7525076 - DNA, 22 bp, Homo sapiens
gagcacagtgcagtttctgcta

SEQ ID NO: 7525077 - DNA, 22 bp, Homo sapiens
gagcacagtccttttgttaaaa

SEQ ID NO: 7525078 - DNA, 22 bp, Homo sapiens
gagcacagtgtgttgtgatttc

SEQ ID NO: 7525079 - DNA, 22 bp, Homo sapiens
gagcacagtgtgttgtgatttc

SEQ ID NO: 7525080 - DNA, 22 bp, Homo sapiens
gagcacagtgcagtttctgcta

SEQ ID NO: 7525081 - DNA, 22 bp, Homo sapiens
gagcacagtgtgttgtgatttc

SEQ ID NO: 7525082 - DNA, 22 bp, Homo sapiens
gagcacagtgtgttgtgatttc

SEQ ID NO: 7525083 - DNA, 22 bp, Homo sapiens
gagcacagtgtgttgtgatttc

SEQ ID NO: 7525084 - DNA, 22 bp, Homo sapiens
gagcacagtgtgttgtgatttc

SEQ ID NO: 7525085 - DNA, 22 bp, Homo sapiens
gagcacatgagaggaaatcaaa

SEQ ID NO: 7525086 - DNA, 22 bp, Homo sapiens
gagcacccttgagagactctcg

SEQ ID NO: 7525087 - DNA, 22 bp, Homo sapiens
gagcaccctacctgccactgag

SEQ ID NO: 7525088 - DNA, 22 bp, Homo sapiens
gagcaccctttgcacatcagtc

SEQ ID NO: 7525089 - DNA, 22 bp, Homo sapiens
gagcaccctttgcacatcagtc

SEQ ID NO: 7525090 - DNA, 22 bp, Homo sapiens
gagcacccgtcggtggtaggaa

SEQ ID NO: 7525091 - DNA, 22 bp, Homo sapiens
gagcacccgtcggtggtaggaa

SEQ ID NO: 7525092 - DNA, 22 bp, Homo sapiens
gagcaccctacctgccactgag

SEQ ID NO: 7525093 - DNA, 22 bp, Homo sapiens
gagcacccatgcagagggaaca

SEQ ID NO: 7525094 - DNA, 22 bp, Homo sapiens
gagcacccgtcggtggtaggaa

SEQ ID NO: 7525095 - DNA, 22 bp, Homo sapiens
gagcacccgtcggtggtaggaa

SEQ ID NO: 7525096 - DNA, 22 bp, Homo sapiens
gagcaccagcagtcccctggca

SEQ ID NO: 7525097 - DNA, 22 bp, Homo sapiens
gagcacccatgcagagggaaca

SEQ ID NO: 7525098 - DNA, 22 bp, Homo sapiens
gagcacccatgcagagggaaca

SEQ ID NO: 7525099 - DNA, 22 bp, Homo sapiens
gagcagagaatccagctaagtg

SEQ ID NO: 7525100 - DNA, 22 bp, Homo sapiens
gagcagagaatccagctaagtg

SEQ ID NO: 7525101 - DNA, 22 bp, Homo sapiens
gagcagagaatccagctaagtg

SEQ ID NO: 7525102 - DNA, 22 bp, Homo sapiens
gagcagagacagtacaactggc

SEQ ID NO: 7525103 - DNA, 22 bp, Homo sapiens
gagcagagacagtacaactggc

SEQ ID NO: 7525104 - DNA, 22 bp, Homo sapiens
gagcagagaatccagctaagtg

SEQ ID NO: 7525105 - DNA, 22 bp, Homo sapiens
gagcagagaatccagctaagtg

SEQ ID NO: 7525106 - DNA, 22 bp, Homo sapiens
gagcagagacagtacaactggc

SEQ ID NO: 7525107 - DNA, 22 bp, Homo sapiens
gagcagagacagtacaactggc

SEQ ID NO: 7525108 - DNA, 22 bp, Homo sapiens
gagcagagacagtacaactggc

SEQ ID NO: 7525109 - DNA, 22 bp, Homo sapiens
gagcagagacagtacaactggc

SEQ ID NO: 7525110 - DNA, 22 bp, Homo sapiens
gagcagagacagtacaactggc

SEQ ID NO: 7525111 - DNA, 22 bp, Homo sapiens
gagcagagacagtacaactggc

SEQ ID NO: 7525112 - DNA, 22 bp, Homo sapiens
gagcagagacagtacaactggc

SEQ ID NO: 7525113 - DNA, 23 bp, Homo sapiens
gagcagagcgggcgggggtcctg

SEQ ID NO: 7525114 - DNA, 23 bp, Homo sapiens
gagcagagcgggcgggggtcctg

SEQ ID NO: 7525115 - DNA, 22 bp, Homo sapiens
gagcagagacagtacaactggc

SEQ ID NO: 7525116 - DNA, 22 bp, Homo sapiens
gagcagagacagtacaactggc

SEQ ID NO: 7525117 - DNA, 23 bp, Homo sapiens
gagcagagcgggcgggggtcctg

SEQ ID NO: 7525118 - DNA, 23 bp, Homo sapiens
gagcagagcgggcgggggtcctg

SEQ ID NO: 7525119 - DNA, 23 bp, Homo sapiens
gagcagagcgggcgggggtcctg

SEQ ID NO: 7525120 - DNA, 22 bp, Homo sapiens
gagcagcttgcgctgtcttcac

SEQ ID NO: 7525121 - DNA, 19 bp, Homo sapiens
gagcagcttcctatctggt

SEQ ID NO: 7525122 - DNA, 19 bp, Homo sapiens
gagcagcttcctatctggt

SEQ ID NO: 7525123 - DNA, 19 bp, Homo sapiens
gagcagcttcctatctggt

SEQ ID NO: 7525124 - DNA, 19 bp, Homo sapiens
gagcagcttcctatctggt

SEQ ID NO: 7525125 - DNA, 19 bp, Homo sapiens
gagcagcttcctatctggt

SEQ ID NO: 7525126 - DNA, 19 bp, Homo sapiens
gagcagcttcctatctggt

SEQ ID NO: 7525127 - DNA, 18 bp, Homo sapiens
gagcagaggctcaactgg

SEQ ID NO: 7525128 - DNA, 18 bp, Homo sapiens
gagcagaggctcaactgg

SEQ ID NO: 7525129 - DNA, 18 bp, Homo sapiens
gagcagaggctcaactgg

SEQ ID NO: 7525130 - DNA, 18 bp, Homo sapiens
gagcagaggagggttttt

SEQ ID NO: 7525131 - DNA, 18 bp, Homo sapiens
gagcagaggagggttttt

SEQ ID NO: 7525132 - DNA, 16 bp, Homo sapiens
gagcagagcggttcca

SEQ ID NO: 7525133 - DNA, 16 bp, Homo sapiens
gagcagagcggttcca

SEQ ID NO: 7525134 - DNA, 22 bp, Homo sapiens
gagcagagcttctcaaagtaaa

SEQ ID NO: 7525135 - DNA, 22 bp, Homo sapiens
gagcagagcttctcaaagtaaa

SEQ ID NO: 7525136 - DNA, 22 bp, Homo sapiens
gagcagagcttctcaaagtaaa

SEQ ID NO: 7525137 - DNA, 22 bp, Homo sapiens
gagcagagcttctcaaagtaaa

SEQ ID NO: 7525138 - DNA, 22 bp, Homo sapiens
gagcagagcttctcaaagtaaa

SEQ ID NO: 7525139 - DNA, 22 bp, Homo sapiens
gagcagagcttctcaaagtaaa

SEQ ID NO: 7525140 - DNA, 18 bp, Homo sapiens
gagcagaggagggttttt

SEQ ID NO: 7525141 - DNA, 22 bp, Homo sapiens
gagcagagcttctcaaagtaaa

SEQ ID NO: 7525142 - DNA, 22 bp, Homo sapiens
gagcaggacagcagcttcctgg

SEQ ID NO: 7525143 - DNA, 22 bp, Homo sapiens
gagcaggacagcagcttcctgg

SEQ ID NO: 7525144 - DNA, 22 bp, Homo sapiens
gagcaggacagcagcttcctgg

SEQ ID NO: 7525145 - DNA, 22 bp, Homo sapiens
gagcaggacagcagcttcctgg

SEQ ID NO: 7525146 - DNA, 22 bp, Homo sapiens
gagcaggacgtgggaatgggaa

SEQ ID NO: 7525147 - DNA, 22 bp, Homo sapiens
gagcaggacgtgggaatgggaa

SEQ ID NO: 7525148 - DNA, 22 bp, Homo sapiens
gagcaggacgtgggaatgggaa

SEQ ID NO: 7525149 - DNA, 22 bp, Homo sapiens
gagcaggacgtgggaatgggaa

SEQ ID NO: 7525150 - DNA, 22 bp, Homo sapiens
gagcaggacgtgggaatgggaa

SEQ ID NO: 7525151 - DNA, 22 bp, Homo sapiens
gagcaggacgtgggaatgggaa

SEQ ID NO: 7525152 - DNA, 22 bp, Homo sapiens
gagcaggacgtgggaatgggaa

SEQ ID NO: 7525153 - DNA, 22 bp, Homo sapiens
gagcaggacgtgggaatgggaa

SEQ ID NO: 7525154 - DNA, 22 bp, Homo sapiens
gagcaggaaggccagaagggtc

SEQ ID NO: 7525155 - DNA, 22 bp, Homo sapiens
gagcaggaaggccagaagggtc

SEQ ID NO: 7525156 - DNA, 22 bp, Homo sapiens
gagcaggaaggccagaagggtc

SEQ ID NO: 7525157 - DNA, 22 bp, Homo sapiens
gagcaggacagcagcttcctgg

SEQ ID NO: 7525158 - DNA, 22 bp, Homo sapiens
gagcaggaaggccagaagggtc

SEQ ID NO: 7525159 - DNA, 22 bp, Homo sapiens
gagcaggaaggccagaagggtc

SEQ ID NO: 7525160 - DNA, 22 bp, Homo sapiens
gagcaggaaggccagaagggtc

SEQ ID NO: 7525161 - DNA, 22 bp, Homo sapiens
gagcaggaaggccagaagggtc

SEQ ID NO: 7525162 - DNA, 22 bp, Homo sapiens
gagcaggaaggccagaagggtc

SEQ ID NO: 7525163 - DNA, 22 bp, Homo sapiens
gagcaggaaggccagaagggtc

SEQ ID NO: 7525164 - DNA, 22 bp, Homo sapiens
gagcaggaacagatcccttgga

SEQ ID NO: 7525165 - DNA, 22 bp, Homo sapiens
gagcaggaacagatcccttgga

SEQ ID NO: 7525166 - DNA, 22 bp, Homo sapiens
gagcaggaacagatcccttgga

SEQ ID NO: 7525167 - DNA, 22 bp, Homo sapiens
gagcaggaactgaaaatgagac

SEQ ID NO: 7525168 - DNA, 22 bp, Homo sapiens
gagcaggaactgaaaatgagac

SEQ ID NO: 7525169 - DNA, 22 bp, Homo sapiens
gagcaggaacagatcccttgga

SEQ ID NO: 7525170 - DNA, 22 bp, Homo sapiens
gagcaggaactgaaaatgagac

SEQ ID NO: 7525171 - DNA, 15 bp, Homo sapiens
gagcaggaaacttgg

SEQ ID NO: 7525172 - DNA, 22 bp, Homo sapiens
gagcagcttgcgctgtcttcac

SEQ ID NO: 7525173 - DNA, 22 bp, Homo sapiens
gagcagcttgcgctgtcttcac

SEQ ID NO: 7525174 - DNA, 22 bp, Homo sapiens
gagcagcttgcgctgtcttcac

SEQ ID NO: 7525175 - DNA, 22 bp, Homo sapiens
gagcaggaaggccagaagggtc

SEQ ID NO: 7525176 - DNA, 22 bp, Homo sapiens
gagcaggaaggccagaagggtc

SEQ ID NO: 7525177 - DNA, 22 bp, Homo sapiens
gagcaggaaggccagaagggtc

SEQ ID NO: 7525178 - DNA, 22 bp, Homo sapiens
gagcaggaaggccagaagggtc

SEQ ID NO: 7525179 - DNA, 22 bp, Homo sapiens
gagcaggaaggccagaagggtc

SEQ ID NO: 7525180 - DNA, 22 bp, Homo sapiens
gagcaggaaggccagaagggtc

SEQ ID NO: 7525181 - DNA, 22 bp, Homo sapiens
gagcaggaactgaaaatgagac

SEQ ID NO: 7525182 - DNA, 22 bp, Homo sapiens
gagcaggaactgaaaatgagac

SEQ ID NO: 7525183 - DNA, 22 bp, Homo sapiens
gagcaggaactgaaaatgagac

SEQ ID NO: 7525184 - DNA, 22 bp, Homo sapiens
gagcaggaactgaaaatgagac

SEQ ID NO: 7525185 - DNA, 22 bp, Homo sapiens
gagcaggaactgaaaatgagac

SEQ ID NO: 7525186 - DNA, 22 bp, Homo sapiens
gagcaggaactgaaaatgagac

SEQ ID NO: 7525187 - DNA, 22 bp, Homo sapiens
gagcaaggatggccggggccgt

SEQ ID NO: 7525188 - DNA, 22 bp, Homo sapiens
gagcaaggatggccggggccgt

SEQ ID NO: 7525189 - DNA, 22 bp, Homo sapiens
gagcaaggatgggtctatagta

SEQ ID NO: 7525190 - DNA, 22 bp, Homo sapiens
gagcaaggagggtggggccttt

SEQ ID NO: 7525191 - DNA, 22 bp, Homo sapiens
gagcaagattttataagttgtg

SEQ ID NO: 7525192 - DNA, 22 bp, Homo sapiens
gagcaaggagggtggggccttt

SEQ ID NO: 7525193 - DNA, 22 bp, Homo sapiens
gagcaaggagggtggggccttt

SEQ ID NO: 7525194 - DNA, 22 bp, Homo sapiens
gagcaaggtagctctctggggc

SEQ ID NO: 7525195 - DNA, 22 bp, Homo sapiens
gagcaaggcggcatctctctga

SEQ ID NO: 7525196 - DNA, 22 bp, Homo sapiens
gagcaaggtagctctctggggc

SEQ ID NO: 7525197 - DNA, 22 bp, Homo sapiens
gagcaaggtagctctctggggc

SEQ ID NO: 7525198 - DNA, 22 bp, Homo sapiens
gagcaaggtagctctctggggc

SEQ ID NO: 7525199 - DNA, 22 bp, Homo sapiens
gagcaaggtagctctctggggc

SEQ ID NO: 7525200 - DNA, 22 bp, Homo sapiens
gagcaaggcggcatctctctga

SEQ ID NO: 7525201 - DNA, 22 bp, Homo sapiens
gagcaaggatgggtctatagta

SEQ ID NO: 7525202 - DNA, 22 bp, Homo sapiens
gagcaaggatgggtctatagta

SEQ ID NO: 7525203 - DNA, 22 bp, Homo sapiens
gagcaaggcggcatctctctga

SEQ ID NO: 7525204 - DNA, 22 bp, Homo sapiens
gagcaaggcggcatctctctga

SEQ ID NO: 7525205 - DNA, 22 bp, Homo sapiens
gagcaaggcggcatctctctga

SEQ ID NO: 7525206 - DNA, 22 bp, Homo sapiens
gagcaagattaaaaggctgggt

SEQ ID NO: 7525207 - DNA, 22 bp, Homo sapiens
gagcaagattaaaaggctgggt

SEQ ID NO: 7525208 - DNA, 22 bp, Homo sapiens
gagcaagattaaaaggctgggt

SEQ ID NO: 7525209 - DNA, 22 bp, Homo sapiens
gagcaagattaaaaggctgggt

SEQ ID NO: 7525210 - DNA, 22 bp, Homo sapiens
gagcaagagtgttggactttga

SEQ ID NO: 7525211 - DNA, 22 bp, Homo sapiens
gagcaagattaaaaggctgggt

SEQ ID NO: 7525212 - DNA, 22 bp, Homo sapiens
gagcaagagtgttggactttga

SEQ ID NO: 7525213 - DNA, 22 bp, Homo sapiens
gagcaagatcctgtttttctat

SEQ ID NO: 7525214 - DNA, 22 bp, Homo sapiens
gagcaagactcactgcatcttg

SEQ ID NO: 7525215 - DNA, 22 bp, Homo sapiens
gagcaagactcactgcatcttg

SEQ ID NO: 7525216 - DNA, 22 bp, Homo sapiens
gagcaagagtgttggactttga

SEQ ID NO: 7525217 - DNA, 22 bp, Homo sapiens
gagcaagactacaggcagatga

SEQ ID NO: 7525218 - DNA, 22 bp, Homo sapiens
gagcaagactacaggcagatga

SEQ ID NO: 7525219 - DNA, 22 bp, Homo sapiens
gagcaagactacaggcagatga

SEQ ID NO: 7525220 - DNA, 22 bp, Homo sapiens
gagcaagactacaggcagatga

SEQ ID NO: 7525221 - DNA, 22 bp, Homo sapiens
gagcacagaactaaatgctggt

SEQ ID NO: 7525222 - DNA, 22 bp, Homo sapiens
gagcacagaactaaatgctggt

SEQ ID NO: 7525223 - DNA, 22 bp, Homo sapiens
gagcacagaactaaatgctggt

SEQ ID NO: 7525224 - DNA, 22 bp, Homo sapiens
gagcacagaaggagaaatatgg

SEQ ID NO: 7525225 - DNA, 22 bp, Homo sapiens
gagcacagaaggagaaatatgg

SEQ ID NO: 7525226 - DNA, 22 bp, Homo sapiens
gagcacagaaggagaaatatgg

SEQ ID NO: 7525227 - DNA, 22 bp, Homo sapiens
gagcacagaatcttcccatgca

SEQ ID NO: 7525228 - DNA, 22 bp, Homo sapiens
gagcacagaatcttcccatgca

SEQ ID NO: 7525229 - DNA, 22 bp, Homo sapiens
gagcacagaatcttcccatgca

SEQ ID NO: 7525230 - DNA, 22 bp, Homo sapiens
gagcacagaatcttcccatgca

SEQ ID NO: 7525231 - DNA, 22 bp, Homo sapiens
gagcacagaatcttcccatgca

SEQ ID NO: 7525232 - DNA, 22 bp, Homo sapiens
gagcacagatcctggagccaca

SEQ ID NO: 7525233 - DNA, 22 bp, Homo sapiens
gagcacagatcctggagccaca

SEQ ID NO: 7525234 - DNA, 22 bp, Homo sapiens
gagcacagaatcttcccatgca

SEQ ID NO: 7525235 - DNA, 22 bp, Homo sapiens
gagcacagatcctggagccaca

SEQ ID NO: 7525236 - DNA, 22 bp, Homo sapiens
gagcacagatcctggagccaca

SEQ ID NO: 7525237 - DNA, 22 bp, Homo sapiens
gagcacagatcctggagccaca

SEQ ID NO: 7525238 - DNA, 22 bp, Homo sapiens
gagcacagatcctggagccaca

SEQ ID NO: 7525239 - DNA, 22 bp, Homo sapiens
gagcacagatcctggagccaca

SEQ ID NO: 7525240 - DNA, 22 bp, Homo sapiens
gagcacagatcctggagccaca

SEQ ID NO: 7525241 - DNA, 22 bp, Homo sapiens
gagcaatgcccttcaccagccc

SEQ ID NO: 7525242 - DNA, 22 bp, Homo sapiens
gagcaatgcccttcaccagccc

SEQ ID NO: 7525243 - DNA, 22 bp, Homo sapiens
gagcaatggaagatagataaca

SEQ ID NO: 7525244 - DNA, 22 bp, Homo sapiens
gagcaatacatggcatgaaatt

SEQ ID NO: 7525245 - DNA, 22 bp, Homo sapiens
gagcaaggtagctctctggggc

SEQ ID NO: 7525246 - DNA, 22 bp, Homo sapiens
gagcaatagaaagaatactgct

SEQ ID NO: 7525247 - DNA, 22 bp, Homo sapiens
gagcaatagcaccaattaactc

SEQ ID NO: 7525248 - DNA, 22 bp, Homo sapiens
gagcacagaactaaatgctggt

SEQ ID NO: 7525249 - DNA, 22 bp, Homo sapiens
gagcacagaactaaatgctggt

SEQ ID NO: 7525250 - DNA, 22 bp, Homo sapiens
gagcacagaactaaatgctggt

SEQ ID NO: 7525251 - DNA, 22 bp, Homo sapiens
gagcacagaactaaatgctggt

SEQ ID NO: 7525252 - DNA, 22 bp, Homo sapiens
gagcacagaactaaatgctggt

SEQ ID NO: 7525253 - DNA, 22 bp, Homo sapiens
gagcacagaactaaatgctggt

SEQ ID NO: 7525254 - DNA, 22 bp, Homo sapiens
gagcacagaactaaatgctggt

SEQ ID NO: 7525255 - DNA, 22 bp, Homo sapiens
gagcaatggaagatagataaca

SEQ ID NO: 7525256 - DNA, 22 bp, Homo sapiens
gagcaatgcccttcaccagccc

SEQ ID NO: 7525257 - DNA, 22 bp, Homo sapiens
gagcaatggaagatagataaca

SEQ ID NO: 7525258 - DNA, 22 bp, Homo sapiens
gagcacacagtgtgcctgtgta

SEQ ID NO: 7525259 - DNA, 22 bp, Homo sapiens
gagcacacagtgtgcctgtgta

SEQ ID NO: 7525260 - DNA, 22 bp, Homo sapiens
gagcacacagtgtgcctgtgta

SEQ ID NO: 7525261 - DNA, 22 bp, Homo sapiens
gagaggcagaggcctgaaaccg

SEQ ID NO: 7525262 - DNA, 22 bp, Homo sapiens
gagaggcagaggcctgaaaccg

SEQ ID NO: 7525263 - DNA, 22 bp, Homo sapiens
gagaggcaggaatcctgggtga

SEQ ID NO: 7525264 - DNA, 22 bp, Homo sapiens
gagaggcaggaatcctgggtga

SEQ ID NO: 7525265 - DNA, 22 bp, Homo sapiens
gagaggcagaggcctgaaaccg

SEQ ID NO: 7525266 - DNA, 22 bp, Homo sapiens
gagaggcaggaatcctgggtga

SEQ ID NO: 7525267 - DNA, 22 bp, Homo sapiens
gagaggcaggaatcctgggtga

SEQ ID NO: 7525268 - DNA, 22 bp, Homo sapiens
gagaggcaggaatcctgggtga

SEQ ID NO: 7525269 - DNA, 22 bp, Homo sapiens
gagaggcaggaatcctgggtga

SEQ ID NO: 7525270 - DNA, 22 bp, Homo sapiens
gagaggagtccctatcacagtt

SEQ ID NO: 7525271 - DNA, 22 bp, Homo sapiens
gagaggagtccctatcacagtt

SEQ ID NO: 7525272 - DNA, 22 bp, Homo sapiens
gagaggagttactatttccgag

SEQ ID NO: 7525273 - DNA, 22 bp, Homo sapiens
gagaggagttactatttccgag

SEQ ID NO: 7525274 - DNA, 22 bp, Homo sapiens
gagaggcagaggcctgaaaccg

SEQ ID NO: 7525275 - DNA, 22 bp, Homo sapiens
gagaggcagaggcctgaaaccg

SEQ ID NO: 7525276 - DNA, 22 bp, Homo sapiens
gagaggcaggcgctgcaatggt

SEQ ID NO: 7525277 - DNA, 22 bp, Homo sapiens
gagaggcaggcgctgcaatggt

SEQ ID NO: 7525278 - DNA, 22 bp, Homo sapiens
gagaggcaggaatcctgggtga

SEQ ID NO: 7525279 - DNA, 22 bp, Homo sapiens
gagaggcaggcgctgcaatggt

SEQ ID NO: 7525280 - DNA, 22 bp, Homo sapiens
gagaggcaggcgctgcaatggt

SEQ ID NO: 7525281 - DNA, 22 bp, Homo sapiens
gagaggcaggcgctgcaatggt

SEQ ID NO: 7525282 - DNA, 22 bp, Homo sapiens
gagatttattgacttaacagta

SEQ ID NO: 7525283 - DNA, 22 bp, Homo sapiens
gagatttattgacttaacagta

SEQ ID NO: 7525284 - DNA, 22 bp, Homo sapiens
gagatttaggggggaagatacg

SEQ ID NO: 7525285 - DNA, 22 bp, Homo sapiens
gagatttattgacttaacagta

SEQ ID NO: 7525286 - DNA, 22 bp, Homo sapiens
gagatttcttttgatgcctgtc

SEQ ID NO: 7525287 - DNA, 22 bp, Homo sapiens
gagatttccatattttgtaaca

SEQ ID NO: 7525288 - DNA, 22 bp, Homo sapiens
gagatttcacccctcttaacct

SEQ ID NO: 7525289 - DNA, 17 bp, Homo sapiens
gagattttcgtcctgaa

SEQ ID NO: 7525290 - DNA, 22 bp, Homo sapiens
gagattttcagcttgactggga

SEQ ID NO: 7525291 - DNA, 22 bp, Homo sapiens
gagattttcagcttgactggga

SEQ ID NO: 7525292 - DNA, 22 bp, Homo sapiens
gagatttcttttgatgcctgtc

SEQ ID NO: 7525293 - DNA, 22 bp, Homo sapiens
gagattttcagcttgactggga

SEQ ID NO: 7525294 - DNA, 22 bp, Homo sapiens
gagattttcagcttgactggga

SEQ ID NO: 7525295 - DNA, 22 bp, Homo sapiens
gagcaaaggtgcagtttgaaat

SEQ ID NO: 7525296 - DNA, 22 bp, Homo sapiens
gagcaaatggagcttgtctact

SEQ ID NO: 7525297 - DNA, 22 bp, Homo sapiens
gagcaaaggtgcagtttgaaat

SEQ ID NO: 7525298 - DNA, 22 bp, Homo sapiens
gagcaaagcttttagggccttt

SEQ ID NO: 7525299 - DNA, 22 bp, Homo sapiens
gagcaaagcttttagggccttt

SEQ ID NO: 7525300 - DNA, 22 bp, Homo sapiens
gagcaaagcttttagggccttt

SEQ ID NO: 7525301 - DNA, 15 bp, Homo sapiens
gagcaaacattaatc

SEQ ID NO: 7525302 - DNA, 22 bp, Homo sapiens
gagcaaagcttttagggccttt

SEQ ID NO: 7525303 - DNA, 23 bp, Homo sapiens
gagcaaacccgtctatgccctcc

SEQ ID NO: 7525304 - DNA, 22 bp, Homo sapiens
gagcaaagcttttagggccttt

SEQ ID NO: 7525305 - DNA, 22 bp, Homo sapiens
gagatttttcaacaagaatagg

SEQ ID NO: 7525306 - DNA, 22 bp, Homo sapiens
gagcaaaataaattctgacaaa

SEQ ID NO: 7525307 - DNA, 22 bp, Homo sapiens
gagcaaaataaattctgacaaa

SEQ ID NO: 7525308 - DNA, 22 bp, Homo sapiens
gagcaaaataaattctgacaaa

SEQ ID NO: 7525309 - DNA, 22 bp, Homo sapiens
gagcaaaataaattctgacaaa

SEQ ID NO: 7525310 - DNA, 22 bp, Homo sapiens
gagatttttcaacaagaatagg

SEQ ID NO: 7525311 - DNA, 22 bp, Homo sapiens
gagcaaacaaaactgatgtgac

SEQ ID NO: 7525312 - DNA, 22 bp, Homo sapiens
gagcaaaataaattctgacaaa

SEQ ID NO: 7525313 - DNA, 22 bp, Homo sapiens
gagcaaagcttttagggccttt

SEQ ID NO: 7525314 - DNA, 22 bp, Homo sapiens
gagcaaacatcagtgatgtctg

SEQ ID NO: 7525315 - DNA, 22 bp, Homo sapiens
gagcaaacatcagtgatgtctg

SEQ ID NO: 7525316 - DNA, 22 bp, Homo sapiens
gagcaagactacaggcagatga

SEQ ID NO: 7525317 - DNA, 22 bp, Homo sapiens
gagcaagaccctgggttctctc

SEQ ID NO: 7525318 - DNA, 22 bp, Homo sapiens
gagcaagaccctgggttctctc

SEQ ID NO: 7525319 - DNA, 22 bp, Homo sapiens
gagcaacagtttatggtttttc

SEQ ID NO: 7525320 - DNA, 19 bp, Homo sapiens
gagcaacatatgtaaactc

SEQ ID NO: 7525321 - DNA, 22 bp, Homo sapiens
gagcaacttcaatagtactatt

SEQ ID NO: 7525322 - DNA, 22 bp, Homo sapiens
gagcaacttcaatagtactatt

SEQ ID NO: 7525323 - DNA, 22 bp, Homo sapiens
gagcaacagggcgaggagaact

SEQ ID NO: 7525324 - DNA, 22 bp, Homo sapiens
gagcaacactccacattgctag

SEQ ID NO: 7525325 - DNA, 22 bp, Homo sapiens
gagcaacagtggcagtggtggg

SEQ ID NO: 7525326 - DNA, 22 bp, Homo sapiens
gagcaacaggtgatggggctgt

SEQ ID NO: 7525327 - DNA, 22 bp, Homo sapiens
gagcaacagggcgaggagaact

SEQ ID NO: 7525328 - DNA, 22 bp, Homo sapiens
gagcaacagggcgaggagaact

SEQ ID NO: 7525329 - DNA, 22 bp, Homo sapiens
gagcaacactccacattgctag

SEQ ID NO: 7525330 - DNA, 22 bp, Homo sapiens
gagcaacactccacattgctag

SEQ ID NO: 7525331 - DNA, 22 bp, Homo sapiens
gagcaacacgcagtagtatacg

SEQ ID NO: 7525332 - DNA, 22 bp, Homo sapiens
gagcaacactccacattgctag

SEQ ID NO: 7525333 - DNA, 22 bp, Homo sapiens
gagcaacacattgaatgaggat

SEQ ID NO: 7525334 - DNA, 22 bp, Homo sapiens
gagcaacacattgaatgaggat

SEQ ID NO: 7525335 - DNA, 22 bp, Homo sapiens
gagggagaaggactatcaggct

SEQ ID NO: 7525336 - DNA, 22 bp, Homo sapiens
gagggagaaggactatcaggct

SEQ ID NO: 7525337 - DNA, 22 bp, Homo sapiens
gagggagaaggactatcaggct

SEQ ID NO: 7525338 - DNA, 22 bp, Homo sapiens
gagggagaaggactatcaggct

SEQ ID NO: 7525339 - DNA, 22 bp, Homo sapiens
gagggacctttacacagacatt

SEQ ID NO: 7525340 - DNA, 22 bp, Homo sapiens
gagggacctttacacagacatt

SEQ ID NO: 7525341 - DNA, 22 bp, Homo sapiens
gagggagaaggactatcaggct

SEQ ID NO: 7525342 - DNA, 22 bp, Homo sapiens
gagggacagctaaagagaaatt

SEQ ID NO: 7525343 - DNA, 22 bp, Homo sapiens
gagggacagctaaagagaaatt

SEQ ID NO: 7525344 - DNA, 22 bp, Homo sapiens
gagggaccccaggctggccctt

SEQ ID NO: 7525345 - DNA, 22 bp, Homo sapiens
gagggaagtcataatgttctag

SEQ ID NO: 7525346 - DNA, 22 bp, Homo sapiens
gagggaagtcataatgttctag

SEQ ID NO: 7525347 - DNA, 22 bp, Homo sapiens
gagggaagtcataatgttctag

SEQ ID NO: 7525348 - DNA, 22 bp, Homo sapiens
gagggaatggtgtgcaagaggt

SEQ ID NO: 7525349 - DNA, 22 bp, Homo sapiens
gagggacagctaaagagaaatt

SEQ ID NO: 7525350 - DNA, 22 bp, Homo sapiens
gagggaatggtgtgcaagaggt

SEQ ID NO: 7525351 - DNA, 22 bp, Homo sapiens
gagggacagctaaagagaaatt

SEQ ID NO: 7525352 - DNA, 22 bp, Homo sapiens
gagggacagctaaagagaaatt

SEQ ID NO: 7525353 - DNA, 22 bp, Homo sapiens
gagggagaattgcagccagcgt

SEQ ID NO: 7525354 - DNA, 22 bp, Homo sapiens
gagggagaattgcagccagcgt

SEQ ID NO: 7525355 - DNA, 22 bp, Homo sapiens
gagggagaaggactatcaggct

SEQ ID NO: 7525356 - DNA, 22 bp, Homo sapiens
gagggagaattgcagccagcgt

SEQ ID NO: 7525357 - DNA, 22 bp, Homo sapiens
gagggccacgttcagggctctc

SEQ ID NO: 7525358 - DNA, 22 bp, Homo sapiens
gagggccacgttcagggctctc

SEQ ID NO: 7525359 - DNA, 22 bp, Homo sapiens
gagggccacgttcagggctctc

SEQ ID NO: 7525360 - DNA, 22 bp, Homo sapiens
gagggagaattgcagccagcgt

SEQ ID NO: 7525361 - DNA, 22 bp, Homo sapiens
gagggccacgttcagggctctc

SEQ ID NO: 7525362 - DNA, 22 bp, Homo sapiens
gagggccacttgaatgttttca

SEQ ID NO: 7525363 - DNA, 22 bp, Homo sapiens
gagggccacttgaatgttttca

SEQ ID NO: 7525364 - DNA, 22 bp, Homo sapiens
gagggccacgttcagggctctc

SEQ ID NO: 7525365 - DNA, 22 bp, Homo sapiens
gagggccagaaagttattgaga

SEQ ID NO: 7525366 - DNA, 22 bp, Homo sapiens
gagggccagaaagttattgaga

SEQ ID NO: 7525367 - DNA, 22 bp, Homo sapiens
gagggccagaaagttattgaga

SEQ ID NO: 7525368 - DNA, 22 bp, Homo sapiens
gagggccagagtcctggggtca

SEQ ID NO: 7525369 - DNA, 22 bp, Homo sapiens
gagggccagagtcctggggtca

SEQ ID NO: 7525370 - DNA, 22 bp, Homo sapiens
gagggaagaggcctgacatttt

SEQ ID NO: 7525371 - DNA, 22 bp, Homo sapiens
gaggctgtctgttagcctggga

SEQ ID NO: 7525372 - DNA, 21 bp, Homo sapiens
gaggctgtctgctgctggcct

SEQ ID NO: 7525373 - DNA, 21 bp, Homo sapiens
gaggctgtctgctgctggcct

SEQ ID NO: 7525374 - DNA, 22 bp, Homo sapiens
gaggctgtaacttgggcactgg

SEQ ID NO: 7525375 - DNA, 22 bp, Homo sapiens
gaggctgtaacttgggcactgg

SEQ ID NO: 7525376 - DNA, 22 bp, Homo sapiens
gaggctggtttgccttttggca

SEQ ID NO: 7525377 - DNA, 22 bp, Homo sapiens
gaggctgtaagtgtggagccta

SEQ ID NO: 7525378 - DNA, 22 bp, Homo sapiens
gaggctggtttgccttttggca

SEQ ID NO: 7525379 - DNA, 22 bp, Homo sapiens
gaggctggtttgccttttggca

SEQ ID NO: 7525380 - DNA, 22 bp, Homo sapiens
gaggctggtttgccttttggca

SEQ ID NO: 7525381 - DNA, 22 bp, Homo sapiens
gaggctggtttgccttttggca

SEQ ID NO: 7525382 - DNA, 22 bp, Homo sapiens
gaggctggtttgccttttggca

SEQ ID NO: 7525383 - DNA, 22 bp, Homo sapiens
gagggaaggacccattttaagt

SEQ ID NO: 7525384 - DNA, 22 bp, Homo sapiens
gagggaaggagagttgtagctg

SEQ ID NO: 7525385 - DNA, 22 bp, Homo sapiens
gagggaaggagagttgtagctg

SEQ ID NO: 7525386 - DNA, 22 bp, Homo sapiens
gagggaagattccccatatggg

SEQ ID NO: 7525387 - DNA, 22 bp, Homo sapiens
gagggaaggacccattttaagt

SEQ ID NO: 7525388 - DNA, 22 bp, Homo sapiens
gagggaagtcataatgttctag

SEQ ID NO: 7525389 - DNA, 22 bp, Homo sapiens
gagggaaggtcacccttgtagc

SEQ ID NO: 7525390 - DNA, 22 bp, Homo sapiens
gagggaaggtcacccttgtagc

SEQ ID NO: 7525391 - DNA, 22 bp, Homo sapiens
gagggaaggtcacccttgtagc

SEQ ID NO: 7525392 - DNA, 22 bp, Homo sapiens
gagggaaggtcacccttgtagc

SEQ ID NO: 7525393 - DNA, 22 bp, Homo sapiens
gagggaaggtcacccttgtagc

SEQ ID NO: 7525394 - DNA, 22 bp, Homo sapiens
gagggaagattccccatatggg

SEQ ID NO: 7525395 - DNA, 22 bp, Homo sapiens
gagggaagattccccatatggg

SEQ ID NO: 7525396 - DNA, 22 bp, Homo sapiens
gagggaagattccccatatggg

SEQ ID NO: 7525397 - DNA, 22 bp, Homo sapiens
gagggaagattccccatatggg

SEQ ID NO: 7525398 - DNA, 22 bp, Homo sapiens
gagggaagattccccatatggg

SEQ ID NO: 7525399 - DNA, 22 bp, Homo sapiens
gagggaagattccccatatggg

SEQ ID NO: 7525400 - DNA, 22 bp, Homo sapiens
gagggaagaggcctgacatttt

SEQ ID NO: 7525401 - DNA, 22 bp, Homo sapiens
gagggaagaggcctgacatttt

SEQ ID NO: 7525402 - DNA, 22 bp, Homo sapiens
gagggaagagggtttgaattca

SEQ ID NO: 7525403 - DNA, 22 bp, Homo sapiens
gagggaagaggcctgacatttt

SEQ ID NO: 7525404 - DNA, 22 bp, Homo sapiens
gagggaagagggtttgaattca

SEQ ID NO: 7525405 - DNA, 22 bp, Homo sapiens
gagggaagagggtttgaattca

SEQ ID NO: 7525406 - DNA, 22 bp, Homo sapiens
gagggccagagtcctggggtca

SEQ ID NO: 7525407 - DNA, 22 bp, Homo sapiens
gagggccagagtcctggggtca

SEQ ID NO: 7525408 - DNA, 22 bp, Homo sapiens
gagggccagagtcctggggtca

SEQ ID NO: 7525409 - DNA, 22 bp, Homo sapiens
gagggccagatcccaggaggaa

SEQ ID NO: 7525410 - DNA, 22 bp, Homo sapiens
gagggccagatcccaggaggaa

SEQ ID NO: 7525411 - DNA, 22 bp, Homo sapiens
gagggccagatcccaggaggaa

SEQ ID NO: 7525412 - DNA, 22 bp, Homo sapiens
gagggccagatcccaggaggaa

SEQ ID NO: 7525413 - DNA, 22 bp, Homo sapiens
gagggccagatcccaggaggaa

SEQ ID NO: 7525414 - DNA, 22 bp, Homo sapiens
gagggccagatcccaggaggaa

SEQ ID NO: 7525415 - DNA, 22 bp, Homo sapiens
gagggccagatcccaggaggaa

SEQ ID NO: 7525416 - DNA, 22 bp, Homo sapiens
gagggccagatcccaggaggaa

SEQ ID NO: 7525417 - DNA, 22 bp, Homo sapiens
gagggccagcagcctcagcatg

SEQ ID NO: 7525418 - DNA, 22 bp, Homo sapiens
gagggccagcagcctcagcatg

SEQ ID NO: 7525419 - DNA, 22 bp, Homo sapiens
gagggccagcagcctcagcatg

SEQ ID NO: 7525420 - DNA, 22 bp, Homo sapiens
gagggccagcagcctcagcatg

SEQ ID NO: 7525421 - DNA, 22 bp, Homo sapiens
gagggccagcagcctcagcatg

SEQ ID NO: 7525422 - DNA, 22 bp, Homo sapiens
gagggccagcagcctcagcatg

SEQ ID NO: 7525423 - DNA, 22 bp, Homo sapiens
gagggccagcagcctcagcatg

SEQ ID NO: 7525424 - DNA, 22 bp, Homo sapiens
gagggccaggcagcaagaaggc

SEQ ID NO: 7525425 - DNA, 22 bp, Homo sapiens
gagggccaggcagcaagaaggc

SEQ ID NO: 7525426 - DNA, 22 bp, Homo sapiens
gagggccaggcagcaagaaggc

SEQ ID NO: 7525427 - DNA, 22 bp, Homo sapiens
gagggccaggcagcaagaaggc

SEQ ID NO: 7525428 - DNA, 22 bp, Homo sapiens
gagggccaggcagcaagaaggc

SEQ ID NO: 7525429 - DNA, 22 bp, Homo sapiens
gagggccaggcagcaagaaggc

SEQ ID NO: 7525430 - DNA, 22 bp, Homo sapiens
gagggccagcctgccaagggcc

SEQ ID NO: 7525431 - DNA, 22 bp, Homo sapiens
gagggccagcctgccaagggcc

SEQ ID NO: 7525432 - DNA, 22 bp, Homo sapiens
gagggccagcctgccaagggcc

SEQ ID NO: 7525433 - DNA, 22 bp, Homo sapiens
gagggccagcctgccaagggcc

SEQ ID NO: 7525434 - DNA, 22 bp, Homo sapiens
gagggccagcctgccaagggcc

SEQ ID NO: 7525435 - DNA, 22 bp, Homo sapiens
gagggccattctgagggggtga

SEQ ID NO: 7525436 - DNA, 22 bp, Homo sapiens
gagggccaggtagatatcagga

SEQ ID NO: 7525437 - DNA, 22 bp, Homo sapiens
gagggccaggtagatatcagga

SEQ ID NO: 7525438 - DNA, 22 bp, Homo sapiens
gagggccaggcggagacaggcg

SEQ ID NO: 7525439 - DNA, 22 bp, Homo sapiens
gagggccaggcggagacaggcg

SEQ ID NO: 7525440 - DNA, 22 bp, Homo sapiens
gagggccaggcggagacaggcg

SEQ ID NO: 7525441 - DNA, 22 bp, Homo sapiens
gagggccaggcggagacaggcg

SEQ ID NO: 7525442 - DNA, 22 bp, Homo sapiens
gagggccaggcggagacaggcg

SEQ ID NO: 7525443 - DNA, 22 bp, Homo sapiens
gagggccaggcggagacaggcg

SEQ ID NO: 7525444 - DNA, 22 bp, Homo sapiens
gagggctgataacaggaataca

SEQ ID NO: 7525445 - DNA, 22 bp, Homo sapiens
gagggctgataacaggaataca

SEQ ID NO: 7525446 - DNA, 22 bp, Homo sapiens
gagggctgataacaggaataca

SEQ ID NO: 7525447 - DNA, 22 bp, Homo sapiens
gagggctgataacaggaataca

SEQ ID NO: 7525448 - DNA, 22 bp, Homo sapiens
gagggctgataaatgcgcatgg

SEQ ID NO: 7525449 - DNA, 22 bp, Homo sapiens
gagggctgataaatgcgcatgg

SEQ ID NO: 7525450 - DNA, 22 bp, Homo sapiens
gagggctgataaatgcgcatgg

SEQ ID NO: 7525451 - DNA, 22 bp, Homo sapiens
gagggctgataaatgcgcatgg

SEQ ID NO: 7525452 - DNA, 22 bp, Homo sapiens
gagggctgataaatgcgcatgg

SEQ ID NO: 7525453 - DNA, 22 bp, Homo sapiens
gagggctgataaatgcgcatgg

SEQ ID NO: 7525454 - DNA, 22 bp, Homo sapiens
gagggctgataaatgcgcatgg

SEQ ID NO: 7525455 - DNA, 22 bp, Homo sapiens
gagggctgataaatgcgcatgg

SEQ ID NO: 7525456 - DNA, 22 bp, Homo sapiens
gagggctgaagtgttttatgag

SEQ ID NO: 7525457 - DNA, 22 bp, Homo sapiens
gagggcctggcacagggaggct

SEQ ID NO: 7525458 - DNA, 22 bp, Homo sapiens
gagggctgaagtgttttatgag

SEQ ID NO: 7525459 - DNA, 22 bp, Homo sapiens
gagggcctagaagctccatatg

SEQ ID NO: 7525460 - DNA, 22 bp, Homo sapiens
gagggcctagaagctccatatg

SEQ ID NO: 7525461 - DNA, 22 bp, Homo sapiens
gagggcctagaagctccatatg

SEQ ID NO: 7525462 - DNA, 22 bp, Homo sapiens
gagggcctctgctgctccacat

SEQ ID NO: 7525463 - DNA, 22 bp, Homo sapiens
gagggcctctgctgctccacat

SEQ ID NO: 7525464 - DNA, 22 bp, Homo sapiens
gagggcctctgctgctccacat

SEQ ID NO: 7525465 - DNA, 22 bp, Homo sapiens
gagggcctctgtgggtgctcac

SEQ ID NO: 7525466 - DNA, 22 bp, Homo sapiens
gagggcctctgctgctccacat

SEQ ID NO: 7525467 - DNA, 22 bp, Homo sapiens
gagggcctggcacagggaggct

SEQ ID NO: 7525468 - DNA, 22 bp, Homo sapiens
gagggcctctgtgggtgctcac

SEQ ID NO: 7525469 - DNA, 22 bp, Homo sapiens
gagggcctggcacagggaggct

SEQ ID NO: 7525470 - DNA, 22 bp, Homo sapiens
gagggccctggcttcttgctgg

SEQ ID NO: 7525471 - DNA, 22 bp, Homo sapiens
gagggcctactggacatgtcag

SEQ ID NO: 7525472 - DNA, 22 bp, Homo sapiens
gagggcctactggacatgtcag

SEQ ID NO: 7525473 - DNA, 22 bp, Homo sapiens
gagggcccgcacctcgaaactc

SEQ ID NO: 7525474 - DNA, 22 bp, Homo sapiens
gagggccattctgagggggtga

SEQ ID NO: 7525475 - DNA, 22 bp, Homo sapiens
gagggccctggctggctccagc

SEQ ID NO: 7525476 - DNA, 22 bp, Homo sapiens
gagggccctggctggctccagc

SEQ ID NO: 7525477 - DNA, 22 bp, Homo sapiens
gagggccctggctggctccagc

SEQ ID NO: 7525478 - DNA, 22 bp, Homo sapiens
gaggctagagcaggggctcaat

SEQ ID NO: 7525479 - DNA, 22 bp, Homo sapiens
gaggctagagcaggggctcaat

SEQ ID NO: 7525480 - DNA, 22 bp, Homo sapiens
gaggctaagtaactgtccatgg

SEQ ID NO: 7525481 - DNA, 22 bp, Homo sapiens
gaggctaagtaactgtccatgg

SEQ ID NO: 7525482 - DNA, 22 bp, Homo sapiens
gaggctagatgtttgctgggag

SEQ ID NO: 7525483 - DNA, 22 bp, Homo sapiens
gaggctcaaacctggacagagc

SEQ ID NO: 7525484 - DNA, 22 bp, Homo sapiens
gaggcggcggccgagcctggct

SEQ ID NO: 7525485 - DNA, 22 bp, Homo sapiens
gaggcggccagcgaggccgcaa

SEQ ID NO: 7525486 - DNA, 22 bp, Homo sapiens
gaggcggcggccgagcctggct

SEQ ID NO: 7525487 - DNA, 22 bp, Homo sapiens
gaggcggaggttgcagtgagcc

SEQ ID NO: 7525488 - DNA, 22 bp, Homo sapiens
gaggcggaggttgcagtgagct

SEQ ID NO: 7525489 - DNA, 22 bp, Homo sapiens
gaggcggaggttgcagtgagcc

SEQ ID NO: 7525490 - DNA, 22 bp, Homo sapiens
gaggcggcggccgagcctggct

SEQ ID NO: 7525491 - DNA, 22 bp, Homo sapiens
gaggcggcggccgagcctggct

SEQ ID NO: 7525492 - DNA, 22 bp, Homo sapiens
gaggcggccagcgaggccgcaa

SEQ ID NO: 7525493 - DNA, 22 bp, Homo sapiens
gaggcggaggttgcagtgagct

SEQ ID NO: 7525494 - DNA, 22 bp, Homo sapiens
gaggctcaaacctggacagagc

SEQ ID NO: 7525495 - DNA, 22 bp, Homo sapiens
gaggctcaaacctggacagagc

SEQ ID NO: 7525496 - DNA, 22 bp, Homo sapiens
gaggctcaacccacaggggttg

SEQ ID NO: 7525497 - DNA, 22 bp, Homo sapiens
gaggctcaacccacaggggttg

SEQ ID NO: 7525498 - DNA, 22 bp, Homo sapiens
gaggctcaaacctggacagagc

SEQ ID NO: 7525499 - DNA, 22 bp, Homo sapiens
gaggctcaaacctggacagagc

SEQ ID NO: 7525500 - DNA, 22 bp, Homo sapiens
gaggctggggtctgcctttctg

SEQ ID NO: 7525501 - DNA, 22 bp, Homo sapiens
gaggctggggtctgcctttctg

SEQ ID NO: 7525502 - DNA, 22 bp, Homo sapiens
gaggctggggtctgcctttctg

SEQ ID NO: 7525503 - DNA, 22 bp, Homo sapiens
gaggctggggtctgcctttctg

SEQ ID NO: 7525504 - DNA, 22 bp, Homo sapiens
gaggctggggtctgcctttctg

SEQ ID NO: 7525505 - DNA, 22 bp, Homo sapiens
gaggctggggtctgcctttctg

SEQ ID NO: 7525506 - DNA, 22 bp, Homo sapiens
gaggctggggtctgcctttctg

SEQ ID NO: 7525507 - DNA, 22 bp, Homo sapiens
gaggctggggtctgcctttctg

SEQ ID NO: 7525508 - DNA, 22 bp, Homo sapiens
gaggctggggtctgcctttctg

SEQ ID NO: 7525509 - DNA, 22 bp, Homo sapiens
gaggctggtaggaaaggaaaca

SEQ ID NO: 7525510 - DNA, 22 bp, Homo sapiens
gaggctggtaggaaaggaaaca

SEQ ID NO: 7525511 - DNA, 22 bp, Homo sapiens
gaggctggtaggaaaggaaaca

SEQ ID NO: 7525512 - DNA, 22 bp, Homo sapiens
gaggctggtaggaaaggaaaca

SEQ ID NO: 7525513 - DNA, 22 bp, Homo sapiens
gaggctggtaggaaaggaaaca

SEQ ID NO: 7525514 - DNA, 22 bp, Homo sapiens
gaggctggtaggaaaggaaaca

SEQ ID NO: 7525515 - DNA, 22 bp, Homo sapiens
gaggctggtaggaaaggaaaca

SEQ ID NO: 7525516 - DNA, 22 bp, Homo sapiens
gaggctggggtctgcctttctg

SEQ ID NO: 7525517 - DNA, 22 bp, Homo sapiens
gaggctggtaggaaaggaaaca

SEQ ID NO: 7525518 - DNA, 22 bp, Homo sapiens
gaggctggtaggaaaggaaaca

SEQ ID NO: 7525519 - DNA, 22 bp, Homo sapiens
gaggctggtaggaaaggaaaca

SEQ ID NO: 7525520 - DNA, 22 bp, Homo sapiens
gaggctggtcagccctaagatc

SEQ ID NO: 7525521 - DNA, 22 bp, Homo sapiens
gaggctggtcagccctaagatc

SEQ ID NO: 7525522 - DNA, 22 bp, Homo sapiens
gaggctggtcagccctaagatc

SEQ ID NO: 7525523 - DNA, 22 bp, Homo sapiens
gaggctggtcagccctaagatc

SEQ ID NO: 7525524 - DNA, 22 bp, Homo sapiens
gaggctggtcagccctaagatc

SEQ ID NO: 7525525 - DNA, 22 bp, Homo sapiens
gaggctggtcagccctaagatc

SEQ ID NO: 7525526 - DNA, 22 bp, Homo sapiens
gaggctggtcagccctaagatc

SEQ ID NO: 7525527 - DNA, 22 bp, Homo sapiens
gaggctggtggttagttccatt

SEQ ID NO: 7525528 - DNA, 22 bp, Homo sapiens
gaggctggtggttagttccatt

SEQ ID NO: 7525529 - DNA, 22 bp, Homo sapiens
gaggctggtggttagttccatt

SEQ ID NO: 7525530 - DNA, 22 bp, Homo sapiens
gaggctggtggttagttccatt

SEQ ID NO: 7525531 - DNA, 22 bp, Homo sapiens
gaggctggtggttagttccatt

SEQ ID NO: 7525532 - DNA, 22 bp, Homo sapiens
gaggctggtcagccctaagatc

SEQ ID NO: 7525533 - DNA, 22 bp, Homo sapiens
gaggctggttcccttgatcttt

SEQ ID NO: 7525534 - DNA, 22 bp, Homo sapiens
gaggctggttcccttgatcttt

SEQ ID NO: 7525535 - DNA, 22 bp, Homo sapiens
gaggctggttcccttgatcttt

SEQ ID NO: 7525536 - DNA, 22 bp, Homo sapiens
gaggctggttcccttgatcttt

SEQ ID NO: 7525537 - DNA, 22 bp, Homo sapiens
gaggctggttcccttgatcttt

SEQ ID NO: 7525538 - DNA, 22 bp, Homo sapiens
gaggctggttctgaagtactgt

SEQ ID NO: 7525539 - DNA, 22 bp, Homo sapiens
gaggctggttcccttgatcttt

SEQ ID NO: 7525540 - DNA, 22 bp, Homo sapiens
gaggctggttcccttgatcttt

SEQ ID NO: 7525541 - DNA, 22 bp, Homo sapiens
gaggctggtttgccttttggca

SEQ ID NO: 7525542 - DNA, 22 bp, Homo sapiens
gaggctggttctgaagtactgt

SEQ ID NO: 7525543 - DNA, 22 bp, Homo sapiens
gaggctggttctgaagtactgt

SEQ ID NO: 7525544 - DNA, 22 bp, Homo sapiens
gaggctggttctgaagtactgt

SEQ ID NO: 7525545 - DNA, 22 bp, Homo sapiens
gaggctggttctgaagtactgt

SEQ ID NO: 7525546 - DNA, 22 bp, Homo sapiens
gaggctggttctgaagtactgt

SEQ ID NO: 7525547 - DNA, 22 bp, Homo sapiens
gaggctggttctgaagtactgt

SEQ ID NO: 7525548 - DNA, 22 bp, Homo sapiens
gaggctggttctgaagtactgt

SEQ ID NO: 7525549 - DNA, 22 bp, Homo sapiens
gaggctggttctgaagtactgt

SEQ ID NO: 7525550 - DNA, 19 bp, Homo sapiens
gaggcgaggcgtgcaggag

SEQ ID NO: 7525551 - DNA, 22 bp, Homo sapiens
gaggcgcagcccggaggagaca

SEQ ID NO: 7525552 - DNA, 19 bp, Homo sapiens
gaggcgaggcgtgcaggag

SEQ ID NO: 7525553 - DNA, 19 bp, Homo sapiens
gaggcgaggcgtgcaggag

SEQ ID NO: 7525554 - DNA, 19 bp, Homo sapiens
gaggcgaggcgtgcaggag

SEQ ID NO: 7525555 - DNA, 19 bp, Homo sapiens
gaggcgaggcgtgcaggag

SEQ ID NO: 7525556 - DNA, 19 bp, Homo sapiens
gaggcgaggcgtgcaggag

SEQ ID NO: 7525557 - DNA, 22 bp, Homo sapiens
gaggcgagaagctggagatggt

SEQ ID NO: 7525558 - DNA, 19 bp, Homo sapiens
gaggcgaggcgtgcaggag

SEQ ID NO: 7525559 - DNA, 19 bp, Homo sapiens
gaggcgaggcgtgcaggag

SEQ ID NO: 7525560 - DNA, 22 bp, Homo sapiens
gaggcgagaagctggagatggt

SEQ ID NO: 7525561 - DNA, 22 bp, Homo sapiens
gaggccttgggatgtgccacgg

SEQ ID NO: 7525562 - DNA, 22 bp, Homo sapiens
gaggcctttatgtacatctagt

SEQ ID NO: 7525563 - DNA, 22 bp, Homo sapiens
gaggccttgggatgtgccacgg

SEQ ID NO: 7525564 - DNA, 22 bp, Homo sapiens
gaggccttcctctcaagcacat

SEQ ID NO: 7525565 - DNA, 22 bp, Homo sapiens
gaggccttgggatgtgccacgg

SEQ ID NO: 7525566 - DNA, 22 bp, Homo sapiens
gaggcgagaagctggagatggt

SEQ ID NO: 7525567 - DNA, 22 bp, Homo sapiens
gaggcgagaagctggagatggt

SEQ ID NO: 7525568 - DNA, 22 bp, Homo sapiens
gaggcgagaagctggagatggt

SEQ ID NO: 7525569 - DNA, 22 bp, Homo sapiens
gaggcctgtcgctaggcctctg

SEQ ID NO: 7525570 - DNA, 22 bp, Homo sapiens
gaggcctgtagtcatggatgta

SEQ ID NO: 7525571 - DNA, 22 bp, Homo sapiens
gaggcctgtagtcatggatgta

SEQ ID NO: 7525572 - DNA, 22 bp, Homo sapiens
gaggcctgtcgctaggcctctg

SEQ ID NO: 7525573 - DNA, 22 bp, Homo sapiens
gaggcctgtcgctaggcctctg

SEQ ID NO: 7525574 - DNA, 22 bp, Homo sapiens
gaggcctgtcgctaggcctctg

SEQ ID NO: 7525575 - DNA, 22 bp, Homo sapiens
gaggcctgtcgctaggcctctg

SEQ ID NO: 7525576 - DNA, 22 bp, Homo sapiens
gaggcctgtcgctaggcctctg

SEQ ID NO: 7525577 - DNA, 22 bp, Homo sapiens
gaggccttcagaaggcattagt

SEQ ID NO: 7525578 - DNA, 22 bp, Homo sapiens
gaggccttcagaaggcattagt

SEQ ID NO: 7525579 - DNA, 22 bp, Homo sapiens
gaggccttcctctcaagcacat

SEQ ID NO: 7525580 - DNA, 22 bp, Homo sapiens
gaggccttagagcttttctaga

SEQ ID NO: 7525581 - DNA, 22 bp, Homo sapiens
gaggccttagagcttttctaga

SEQ ID NO: 7525582 - DNA, 22 bp, Homo sapiens
gaggccttcacttatttaaggg

SEQ ID NO: 7525583 - DNA, 22 bp, Homo sapiens
gaggccttcacttatttaaggg

SEQ ID NO: 7525584 - DNA, 22 bp, Homo sapiens
gaggcctgtagtcatggatgta

SEQ ID NO: 7525585 - DNA, 22 bp, Homo sapiens
gaggcctgtagtcatggatgta

SEQ ID NO: 7525586 - DNA, 22 bp, Homo sapiens
gaggcctggtttgcatgagaat

SEQ ID NO: 7525587 - DNA, 22 bp, Homo sapiens
gaggcctggtttgcatgagaat

SEQ ID NO: 7525588 - DNA, 22 bp, Homo sapiens
gaggcctggtttgcatgagaat

SEQ ID NO: 7525589 - DNA, 22 bp, Homo sapiens
gaggcctggtttgcatgagaat

SEQ ID NO: 7525590 - DNA, 22 bp, Homo sapiens
gaggcctggtttgcatgagaat

SEQ ID NO: 7525591 - DNA, 22 bp, Homo sapiens
gaggcctggtttgcatgagaat

SEQ ID NO: 7525592 - DNA, 22 bp, Homo sapiens
gaggcctggtttccagcatcct

SEQ ID NO: 7525593 - DNA, 22 bp, Homo sapiens
gaggcctggtttccagcatcct

SEQ ID NO: 7525594 - DNA, 22 bp, Homo sapiens
gaggcctggtttccagcatcct

SEQ ID NO: 7525595 - DNA, 22 bp, Homo sapiens
gaggcctggtttccagcatcct

SEQ ID NO: 7525596 - DNA, 22 bp, Homo sapiens
gaggcctggtagccgagcccca

SEQ ID NO: 7525597 - DNA, 22 bp, Homo sapiens
gaggcctggtagccgagcccca

SEQ ID NO: 7525598 - DNA, 22 bp, Homo sapiens
gaggcctggtagccgagcccca

SEQ ID NO: 7525599 - DNA, 22 bp, Homo sapiens
gaggcctggtctatgagatgtt

SEQ ID NO: 7525600 - DNA, 22 bp, Homo sapiens
gaggcctggtctatgagatgtt

SEQ ID NO: 7525601 - DNA, 22 bp, Homo sapiens
gaggcctggtctatgagatgtt

SEQ ID NO: 7525602 - DNA, 22 bp, Homo sapiens
gaggcctggtctatgagatgtt

SEQ ID NO: 7525603 - DNA, 22 bp, Homo sapiens
gaggcctggtgctgtgtccaca

SEQ ID NO: 7525604 - DNA, 22 bp, Homo sapiens
gaggcctggtgctgtgtccaca

SEQ ID NO: 7525605 - DNA, 22 bp, Homo sapiens
gaggcctggtgctgtgtccaca

SEQ ID NO: 7525606 - DNA, 22 bp, Homo sapiens
gaggcctggtgctgtgtccaca

SEQ ID NO: 7525607 - DNA, 22 bp, Homo sapiens
gaggcctggtgtgtctcccgct

SEQ ID NO: 7525608 - DNA, 22 bp, Homo sapiens
gaggcctggtgtgtctcccgct

SEQ ID NO: 7525609 - DNA, 22 bp, Homo sapiens
gaggcctggtgtgtctcccgct

SEQ ID NO: 7525610 - DNA, 22 bp, Homo sapiens
gaggcctggtgtgtctcccgct

SEQ ID NO: 7525611 - DNA, 22 bp, Homo sapiens
gaggcctggtgtgtctcccgct

SEQ ID NO: 7525612 - DNA, 22 bp, Homo sapiens
gaggtctgccttcaggagagtt

SEQ ID NO: 7525613 - DNA, 22 bp, Homo sapiens
gaggtctgccttcaggagagtt

SEQ ID NO: 7525614 - DNA, 22 bp, Homo sapiens
gaggtctgccttcaggagagtt

SEQ ID NO: 7525615 - DNA, 22 bp, Homo sapiens
gaggtctgccttcaggagagtt

SEQ ID NO: 7525616 - DNA, 22 bp, Homo sapiens
gaggtctgccttcaggagagtt

SEQ ID NO: 7525617 - DNA, 22 bp, Homo sapiens
gaggtctgtgtcactttagtgc

SEQ ID NO: 7525618 - DNA, 22 bp, Homo sapiens
gaggtctgggcttgggcctggt

SEQ ID NO: 7525619 - DNA, 22 bp, Homo sapiens
gaggtctgggatggggcctgaa

SEQ ID NO: 7525620 - DNA, 22 bp, Homo sapiens
gaggtctgggcttgggcctggt

SEQ ID NO: 7525621 - DNA, 22 bp, Homo sapiens
gaggtctgggatggggcctgaa

SEQ ID NO: 7525622 - DNA, 18 bp, Homo sapiens
gaggtcctgctctagccc

SEQ ID NO: 7525623 - DNA, 22 bp, Homo sapiens
gaggtcctctgtgtccgcgggc

SEQ ID NO: 7525624 - DNA, 22 bp, Homo sapiens
gaggtcctctgtgtccgcgggc

SEQ ID NO: 7525625 - DNA, 22 bp, Homo sapiens
gaggtctgagtgcggaaagcct

SEQ ID NO: 7525626 - DNA, 22 bp, Homo sapiens
gaggtctcactatgttgcccag

SEQ ID NO: 7525627 - DNA, 22 bp, Homo sapiens
gaggtctgagtgcggaaagcct

SEQ ID NO: 7525628 - DNA, 22 bp, Homo sapiens
gaggtcctgtctgagaatggag

SEQ ID NO: 7525629 - DNA, 18 bp, Homo sapiens
gaggtcctgctctagccc

SEQ ID NO: 7525630 - DNA, 18 bp, Homo sapiens
gaggtcctgctctagccc

SEQ ID NO: 7525631 - DNA, 22 bp, Homo sapiens
gagggtggtggcttaaggtgct

SEQ ID NO: 7525632 - DNA, 22 bp, Homo sapiens
gagggtggtggcttaaggtgct

SEQ ID NO: 7525633 - DNA, 22 bp, Homo sapiens
gagggtgggtttcttgcacgtc

SEQ ID NO: 7525634 - DNA, 22 bp, Homo sapiens
gagggtgggtttcttgcacgtc

SEQ ID NO: 7525635 - DNA, 22 bp, Homo sapiens
gagggtgggtttcttgcacgtc

SEQ ID NO: 7525636 - DNA, 22 bp, Homo sapiens
gagggtgggtttcttgcacgtc

SEQ ID NO: 7525637 - DNA, 22 bp, Homo sapiens
gagggtggtggcttaaggtgct

SEQ ID NO: 7525638 - DNA, 22 bp, Homo sapiens
gagggtggtggcttaaggtgct

SEQ ID NO: 7525639 - DNA, 22 bp, Homo sapiens
gagggtggtggcttaaggtgct

SEQ ID NO: 7525640 - DNA, 22 bp, Homo sapiens
gagggtgggtacaccagccctc

SEQ ID NO: 7525641 - DNA, 22 bp, Homo sapiens
gagggtgggtacaccagccctc

SEQ ID NO: 7525642 - DNA, 22 bp, Homo sapiens
gagggtgggtacaccagccctc

SEQ ID NO: 7525643 - DNA, 22 bp, Homo sapiens
gagggtggggaatagactgcta

SEQ ID NO: 7525644 - DNA, 22 bp, Homo sapiens
gagggtgggtacaccagccctc

SEQ ID NO: 7525645 - DNA, 22 bp, Homo sapiens
gagggtgggtacaccagccctc

SEQ ID NO: 7525646 - DNA, 22 bp, Homo sapiens
gagggtgggtacaccagccctc

SEQ ID NO: 7525647 - DNA, 22 bp, Homo sapiens
gagggtggggaatagactgcta

SEQ ID NO: 7525648 - DNA, 22 bp, Homo sapiens
gagggtggggaatagactgcta

SEQ ID NO: 7525649 - DNA, 22 bp, Homo sapiens
gagggtggggaatagactgcta

SEQ ID NO: 7525650 - DNA, 22 bp, Homo sapiens
gagggtggggaatagactgcta

SEQ ID NO: 7525651 - DNA, 22 bp, Homo sapiens
gagggtggggaatagactgcta

SEQ ID NO: 7525652 - DNA, 22 bp, Homo sapiens
gagggtggggaatagactgcta

SEQ ID NO: 7525653 - DNA, 22 bp, Homo sapiens
gagggtggggaatagactgcta

SEQ ID NO: 7525654 - DNA, 22 bp, Homo sapiens
gagggtggggaatagactgcta

SEQ ID NO: 7525655 - DNA, 22 bp, Homo sapiens
gagggtggggaatagactgcta

SEQ ID NO: 7525656 - DNA, 22 bp, Homo sapiens
gagggtggggaatagactgcta

SEQ ID NO: 7525657 - DNA, 22 bp, Homo sapiens
gagggtgggccagatatgaggg

SEQ ID NO: 7525658 - DNA, 22 bp, Homo sapiens
gagggtgggccagatatgaggg

SEQ ID NO: 7525659 - DNA, 22 bp, Homo sapiens
gagggtgggccagatatgaggg

SEQ ID NO: 7525660 - DNA, 22 bp, Homo sapiens
gagggtgggccagatatgaggg

SEQ ID NO: 7525661 - DNA, 22 bp, Homo sapiens
gagggtgggccagatatgaggg

SEQ ID NO: 7525662 - DNA, 22 bp, Homo sapiens
gagggtgggctcctatctgggt

SEQ ID NO: 7525663 - DNA, 22 bp, Homo sapiens
gagggtgggctcctatctgggt

SEQ ID NO: 7525664 - DNA, 22 bp, Homo sapiens
gagggtggggaatagactgcta

SEQ ID NO: 7525665 - DNA, 22 bp, Homo sapiens
gagggtggggaatagactgcta

SEQ ID NO: 7525666 - DNA, 22 bp, Homo sapiens
gagggtggggaatagactgcta

SEQ ID NO: 7525667 - DNA, 22 bp, Homo sapiens
gagggtgggctttgttcctcca

SEQ ID NO: 7525668 - DNA, 22 bp, Homo sapiens
gagggtgggctttgttcctcca

SEQ ID NO: 7525669 - DNA, 22 bp, Homo sapiens
gagggtgggctttgttcctcca

SEQ ID NO: 7525670 - DNA, 22 bp, Homo sapiens
gagggtgggctttgttcctcca

SEQ ID NO: 7525671 - DNA, 22 bp, Homo sapiens
gagggtgggctcctatctgggt

SEQ ID NO: 7525672 - DNA, 22 bp, Homo sapiens
gagggtggagctccagaatctg

SEQ ID NO: 7525673 - DNA, 22 bp, Homo sapiens
gagggtggagctccagaatctg

SEQ ID NO: 7525674 - DNA, 22 bp, Homo sapiens
gagggtggagctccagaatctg

SEQ ID NO: 7525675 - DNA, 22 bp, Homo sapiens
gagggtggatcagcctgattgg

SEQ ID NO: 7525676 - DNA, 22 bp, Homo sapiens
gagggtggcctttagagcccat

SEQ ID NO: 7525677 - DNA, 22 bp, Homo sapiens
gagggtggcctttagagcccat

SEQ ID NO: 7525678 - DNA, 22 bp, Homo sapiens
gagggtggagctccagaatctg

SEQ ID NO: 7525679 - DNA, 22 bp, Homo sapiens
gagggtggagctccagaatctg

SEQ ID NO: 7525680 - DNA, 22 bp, Homo sapiens
gagggtggaagagctgctgaga

SEQ ID NO: 7525681 - DNA, 22 bp, Homo sapiens
gagggtggaagagctgctgaga

SEQ ID NO: 7525682 - DNA, 22 bp, Homo sapiens
gagggtggaagagctgctgaga

SEQ ID NO: 7525683 - DNA, 22 bp, Homo sapiens
gagggtggaagagctgctgaga

SEQ ID NO: 7525684 - DNA, 22 bp, Homo sapiens
gagggtggaagagctgctgaga

SEQ ID NO: 7525685 - DNA, 22 bp, Homo sapiens
gagggtggaagagctgctgaga

SEQ ID NO: 7525686 - DNA, 22 bp, Homo sapiens
gagggtggaagagctgctgaga

SEQ ID NO: 7525687 - DNA, 22 bp, Homo sapiens
gagggtggaagagctgctgaga

SEQ ID NO: 7525688 - DNA, 22 bp, Homo sapiens
gagggtggaagagctgctgaga

SEQ ID NO: 7525689 - DNA, 22 bp, Homo sapiens
gagggtggcctttagagcccat

SEQ ID NO: 7525690 - DNA, 22 bp, Homo sapiens
gagggtggcctttagagcccat

SEQ ID NO: 7525691 - DNA, 22 bp, Homo sapiens
gagggtggcctttagagcccat

SEQ ID NO: 7525692 - DNA, 22 bp, Homo sapiens
gagggtggcctttagagcccat

SEQ ID NO: 7525693 - DNA, 22 bp, Homo sapiens
gagggtggcctttagagcccat

SEQ ID NO: 7525694 - DNA, 22 bp, Homo sapiens
gagggtggcctttagagcccat

SEQ ID NO: 7525695 - DNA, 22 bp, Homo sapiens
gagggtggctcctccctgggcc

SEQ ID NO: 7525696 - DNA, 20 bp, Homo sapiens
gagggtgggacttcctaggc

SEQ ID NO: 7525697 - DNA, 20 bp, Homo sapiens
gagggtgggacttcctaggc

SEQ ID NO: 7525698 - DNA, 20 bp, Homo sapiens
gagggtgggacttcctaggc

SEQ ID NO: 7525699 - DNA, 20 bp, Homo sapiens
gagggtgggacttcctaggc

SEQ ID NO: 7525700 - DNA, 22 bp, Homo sapiens
gagggtggctcctccctgggcc

SEQ ID NO: 7525701 - DNA, 22 bp, Homo sapiens
gagggtggctcctccctgggcc

SEQ ID NO: 7525702 - DNA, 22 bp, Homo sapiens
gagggtggctcctccctgggcc

SEQ ID NO: 7525703 - DNA, 22 bp, Homo sapiens
gagggtggctcctccctgggcc

SEQ ID NO: 7525704 - DNA, 22 bp, Homo sapiens
gagggtggctcctccctgggcc

SEQ ID NO: 7525705 - DNA, 22 bp, Homo sapiens
gagggtgcagctgggccccacg

SEQ ID NO: 7525706 - DNA, 22 bp, Homo sapiens
gagggtgcagctgggccccacg

SEQ ID NO: 7525707 - DNA, 22 bp, Homo sapiens
gagggtgacagttctggtctct

SEQ ID NO: 7525708 - DNA, 22 bp, Homo sapiens
gagggctgataaatgcgcatgg

SEQ ID NO: 7525709 - DNA, 22 bp, Homo sapiens
gagggtgcagctgggccccacg

SEQ ID NO: 7525710 - DNA, 22 bp, Homo sapiens
gagggtgcaggaggatggtagt

SEQ ID NO: 7525711 - DNA, 22 bp, Homo sapiens
gagggtgcaggaggatggtagt

SEQ ID NO: 7525712 - DNA, 22 bp, Homo sapiens
gagggtgcaggaggatggtagt

SEQ ID NO: 7525713 - DNA, 22 bp, Homo sapiens
gagggtgcaggaggatggtagt

SEQ ID NO: 7525714 - DNA, 22 bp, Homo sapiens
gagggtgcaggaggatggtagt

SEQ ID NO: 7525715 - DNA, 22 bp, Homo sapiens
gagggtggaaagggtgtacctg

SEQ ID NO: 7525716 - DNA, 22 bp, Homo sapiens
gagggtggaaagggtgtacctg

SEQ ID NO: 7525717 - DNA, 22 bp, Homo sapiens
gagggtgctgtgccaagatgac

SEQ ID NO: 7525718 - DNA, 22 bp, Homo sapiens
gagggtgctgtgccaagatgac

SEQ ID NO: 7525719 - DNA, 22 bp, Homo sapiens
gagggtgctctgagcccttttg

SEQ ID NO: 7525720 - DNA, 22 bp, Homo sapiens
gagggtgctgtgccaagatgac

SEQ ID NO: 7525721 - DNA, 22 bp, Homo sapiens
gagggtgctgtgccaagatgac

SEQ ID NO: 7525722 - DNA, 22 bp, Homo sapiens
gagggtgcaggcaagagcaaaa

SEQ ID NO: 7525723 - DNA, 22 bp, Homo sapiens
gagggtgcaggcaagagcaaaa

SEQ ID NO: 7525724 - DNA, 22 bp, Homo sapiens
gagggtgcaggcaagagcaaaa

SEQ ID NO: 7525725 - DNA, 22 bp, Homo sapiens
gagggtgcaggcaagagcaaaa

SEQ ID NO: 7525726 - DNA, 22 bp, Homo sapiens
gagggctgatgcttacttattt

SEQ ID NO: 7525727 - DNA, 22 bp, Homo sapiens
gagggctgatgcttacttattt

SEQ ID NO: 7525728 - DNA, 22 bp, Homo sapiens
gagggctgatgcttacttattt

SEQ ID NO: 7525729 - DNA, 22 bp, Homo sapiens
gagggctgataacaggaataca

SEQ ID NO: 7525730 - DNA, 22 bp, Homo sapiens
gagggctgataacaggaataca

SEQ ID NO: 7525731 - DNA, 22 bp, Homo sapiens
gagggtcctggctaagtctgac

SEQ ID NO: 7525732 - DNA, 22 bp, Homo sapiens
gagggtcctggctaagtctgac

SEQ ID NO: 7525733 - DNA, 22 bp, Homo sapiens
gagggctgatgttgccacctca

SEQ ID NO: 7525734 - DNA, 22 bp, Homo sapiens
gagggtcttacctaagcagggt

SEQ ID NO: 7525735 - DNA, 22 bp, Homo sapiens
gagggtctcttaatgccagggg

SEQ ID NO: 7525736 - DNA, 22 bp, Homo sapiens
gagggtctcttaatgccagggg

SEQ ID NO: 7525737 - DNA, 22 bp, Homo sapiens
gagggtctcttaatgccagggg

SEQ ID NO: 7525738 - DNA, 22 bp, Homo sapiens
gaggtggctgcttgctgggaaa

SEQ ID NO: 7525739 - DNA, 22 bp, Homo sapiens
gaggtggctgcttgctgggaaa

SEQ ID NO: 7525740 - DNA, 22 bp, Homo sapiens
gaggtggctgcttgctgggaaa

SEQ ID NO: 7525741 - DNA, 22 bp, Homo sapiens
gaggtggctccttcagggaata

SEQ ID NO: 7525742 - DNA, 22 bp, Homo sapiens
gaggtggctgcttgctgggaaa

SEQ ID NO: 7525743 - DNA, 22 bp, Homo sapiens
gaggtggctccttcagggaata

SEQ ID NO: 7525744 - DNA, 22 bp, Homo sapiens
gaggtggctccaggagcaatgc

SEQ ID NO: 7525745 - DNA, 22 bp, Homo sapiens
gaggtggctccttcagggaata

SEQ ID NO: 7525746 - DNA, 22 bp, Homo sapiens
gaggtggctccttcagggaata

SEQ ID NO: 7525747 - DNA, 22 bp, Homo sapiens
gaggtggctccttcagggaata

SEQ ID NO: 7525748 - DNA, 22 bp, Homo sapiens
gaggtggatgttgcagtgagct

SEQ ID NO: 7525749 - DNA, 22 bp, Homo sapiens
gaggtggatgttgcagtgagct

SEQ ID NO: 7525750 - DNA, 22 bp, Homo sapiens
gaggtggatgttgcagtgagct

SEQ ID NO: 7525751 - DNA, 22 bp, Homo sapiens
gaggtggaggggaaaaatagat

SEQ ID NO: 7525752 - DNA, 22 bp, Homo sapiens
gaggtggaaggcaggaacaaat

SEQ ID NO: 7525753 - DNA, 22 bp, Homo sapiens
gaggtggaaggcaggaacaaat

SEQ ID NO: 7525754 - DNA, 22 bp, Homo sapiens
gaggtggaaggcaggaacaaat

SEQ ID NO: 7525755 - DNA, 22 bp, Homo sapiens
gaggtggatgttgcagtgagct

SEQ ID NO: 7525756 - DNA, 22 bp, Homo sapiens
gaggtggatgttgcagtgagct

SEQ ID NO: 7525757 - DNA, 22 bp, Homo sapiens
gaggtggatgttgcagtgagct

SEQ ID NO: 7525758 - DNA, 22 bp, Homo sapiens
gaggtggatgttgcagtgagct

SEQ ID NO: 7525759 - DNA, 22 bp, Homo sapiens
gaggtggctccaggagcaatgc

SEQ ID NO: 7525760 - DNA, 18 bp, Homo sapiens
gaggtggctgggccatct

SEQ ID NO: 7525761 - DNA, 22 bp, Homo sapiens
gaggtggctgggagtagggaat

SEQ ID NO: 7525762 - DNA, 22 bp, Homo sapiens
gaggtggctgggagtagggaat

SEQ ID NO: 7525763 - DNA, 22 bp, Homo sapiens
gaggtggctgggagtagggaat

SEQ ID NO: 7525764 - DNA, 22 bp, Homo sapiens
gaggtggctgtcagcttcactt

SEQ ID NO: 7525765 - DNA, 22 bp, Homo sapiens
gaggtggctgtcagcttcactt

SEQ ID NO: 7525766 - DNA, 18 bp, Homo sapiens
gaggtggctgggccatct

SEQ ID NO: 7525767 - DNA, 18 bp, Homo sapiens
gaggtggctgggccatct

SEQ ID NO: 7525768 - DNA, 22 bp, Homo sapiens
gaggtggctgcttgctgggaaa

SEQ ID NO: 7525769 - DNA, 22 bp, Homo sapiens
gaggtggctgcttgctgggaaa

SEQ ID NO: 7525770 - DNA, 22 bp, Homo sapiens
gaggtggctgcttgctgggaaa

SEQ ID NO: 7525771 - DNA, 22 bp, Homo sapiens
gaggtggctggctcagagccag

SEQ ID NO: 7525772 - DNA, 22 bp, Homo sapiens
gaggtggctggctcagagccag

SEQ ID NO: 7525773 - DNA, 22 bp, Homo sapiens
gaggtggctggctcagagccag

SEQ ID NO: 7525774 - DNA, 22 bp, Homo sapiens
gaggtggctggctcagagccag

SEQ ID NO: 7525775 - DNA, 22 bp, Homo sapiens
gaggtgagaagggggtcagatg

SEQ ID NO: 7525776 - DNA, 22 bp, Homo sapiens
gaggtgagaagggggtcagatg

SEQ ID NO: 7525777 - DNA, 22 bp, Homo sapiens
gaggtgagaagggggtcagatg

SEQ ID NO: 7525778 - DNA, 22 bp, Homo sapiens
gaggtgagaagggggtcagatg

SEQ ID NO: 7525779 - DNA, 22 bp, Homo sapiens
gaggtgagaagggggtcagatg

SEQ ID NO: 7525780 - DNA, 22 bp, Homo sapiens
gaggtgagaagggggtcagatg

SEQ ID NO: 7525781 - DNA, 22 bp, Homo sapiens
gaggtgagaagggggtcagatg

SEQ ID NO: 7525782 - DNA, 22 bp, Homo sapiens
gaggtcttagaagaaaaatcat

SEQ ID NO: 7525783 - DNA, 22 bp, Homo sapiens
gaggtctgtgtcactttagtgc

SEQ ID NO: 7525784 - DNA, 22 bp, Homo sapiens
gaggtgaaagttattcatttat

SEQ ID NO: 7525785 - DNA, 22 bp, Homo sapiens
gaggtgaaagttattcatttat

SEQ ID NO: 7525786 - DNA, 22 bp, Homo sapiens
gaggtgagaagggggtcagatg

SEQ ID NO: 7525787 - DNA, 22 bp, Homo sapiens
gaggtgagaagggggtcagatg

SEQ ID NO: 7525788 - DNA, 22 bp, Homo sapiens
gaggtgagaagggggtcagatg

SEQ ID NO: 7525789 - DNA, 22 bp, Homo sapiens
gaggtgagtggatcacgaggtc

SEQ ID NO: 7525790 - DNA, 22 bp, Homo sapiens
gaggtgagtggatcacgaggtc

SEQ ID NO: 7525791 - DNA, 22 bp, Homo sapiens
gaggtgagtggatcacgaggtc

SEQ ID NO: 7525792 - DNA, 22 bp, Homo sapiens
gaggtgagtggatcacgaggtc

SEQ ID NO: 7525793 - DNA, 22 bp, Homo sapiens
gaggtgctgctgtacttcttgc

SEQ ID NO: 7525794 - DNA, 22 bp, Homo sapiens
gaggtgctgctgtacttcttgc

SEQ ID NO: 7525795 - DNA, 22 bp, Homo sapiens
gaggtgcctggcgatgtctctg

SEQ ID NO: 7525796 - DNA, 22 bp, Homo sapiens
gaggtgcctggcgatgtctctg

SEQ ID NO: 7525797 - DNA, 22 bp, Homo sapiens
gaggtgctgctgtacttcttgc

SEQ ID NO: 7525798 - DNA, 22 bp, Homo sapiens
gaggtgcttcctttgggctctg

SEQ ID NO: 7525799 - DNA, 22 bp, Homo sapiens
gaggtgcttcctttgggctctg

SEQ ID NO: 7525800 - DNA, 22 bp, Homo sapiens
gaggtgcttcctttgggctctg

SEQ ID NO: 7525801 - DNA, 22 bp, Homo sapiens
gaggtgcctggcgatgtctctg

SEQ ID NO: 7525802 - DNA, 22 bp, Homo sapiens
gaggtgatggttgcacaatgct

SEQ ID NO: 7525803 - DNA, 22 bp, Homo sapiens
gaggtgattttcaaaagaactt

SEQ ID NO: 7525804 - DNA, 22 bp, Homo sapiens
gaggtgagtggatcacgaggtc

SEQ ID NO: 7525805 - DNA, 22 bp, Homo sapiens
gaggtgagtggatcacgaggtc

SEQ ID NO: 7525806 - DNA, 22 bp, Homo sapiens
gaggtgagtggatcacgaggtc

SEQ ID NO: 7525807 - DNA, 22 bp, Homo sapiens
gaggtgagtggatcacgaggtc

SEQ ID NO: 7525808 - DNA, 22 bp, Homo sapiens
gagtaattgtgtctggcacact

SEQ ID NO: 7525809 - DNA, 22 bp, Homo sapiens
gagtaattctggtaaatcattg

SEQ ID NO: 7525810 - DNA, 22 bp, Homo sapiens
gagtaattccaatataaatcac

SEQ ID NO: 7525811 - DNA, 22 bp, Homo sapiens
gagtaattagagcaatgacttt

SEQ ID NO: 7525812 - DNA, 22 bp, Homo sapiens
gagtaatattctgtactggagg

SEQ ID NO: 7525813 - DNA, 22 bp, Homo sapiens
gagtaattagagcaatgacttt

SEQ ID NO: 7525814 - DNA, 22 bp, Homo sapiens
gagtacagctcttttgttttca

SEQ ID NO: 7525815 - DNA, 22 bp, Homo sapiens
gagtacagctcttttgttttca

SEQ ID NO: 7525816 - DNA, 22 bp, Homo sapiens
gagtaattttcttaaaacatca

SEQ ID NO: 7525817 - DNA, 22 bp, Homo sapiens
gagtaattttcttaaaacatca

SEQ ID NO: 7525818 - DNA, 22 bp, Homo sapiens
gagtacatcttaatttgactaa

SEQ ID NO: 7525819 - DNA, 19 bp, Homo sapiens
gagtacaggtgcagaaatg

SEQ ID NO: 7525820 - DNA, 22 bp, Homo sapiens
gagtacatgtatagagattaac

SEQ ID NO: 7525821 - DNA, 22 bp, Homo sapiens
gagtacatcttaatttgactaa

SEQ ID NO: 7525822 - DNA, 22 bp, Homo sapiens
gagtaaggctgctgatggagtg

SEQ ID NO: 7525823 - DNA, 22 bp, Homo sapiens
gagtaaggctgctgatggagtg

SEQ ID NO: 7525824 - DNA, 22 bp, Homo sapiens
gagtaatattctgtactggagg

SEQ ID NO: 7525825 - DNA, 22 bp, Homo sapiens
gagtaatattctgtactggagg

SEQ ID NO: 7525826 - DNA, 22 bp, Homo sapiens
gagtaatattctgtactggagg

SEQ ID NO: 7525827 - DNA, 22 bp, Homo sapiens
gagtaacataccaaaattcaca

SEQ ID NO: 7525828 - DNA, 22 bp, Homo sapiens
gagtaacatctggaaccgacac

SEQ ID NO: 7525829 - DNA, 22 bp, Homo sapiens
gagtaacataccaaaattcaca

SEQ ID NO: 7525830 - DNA, 21 bp, Homo sapiens
gagtaacatttcctctccaca

SEQ ID NO: 7525831 - DNA, 22 bp, Homo sapiens
gagtaacataccaaaattcaca

SEQ ID NO: 7525832 - DNA, 22 bp, Homo sapiens
gagtaacagcataaatttgtga

SEQ ID NO: 7525833 - DNA, 22 bp, Homo sapiens
gagtaacaaatacttcagtagt

SEQ ID NO: 7525834 - DNA, 22 bp, Homo sapiens
gagtaaacagatattgactttc

SEQ ID NO: 7525835 - DNA, 21 bp, Homo sapiens
gagtaaacaggatggtgacct

SEQ ID NO: 7525836 - DNA, 22 bp, Homo sapiens
gagtaaaagttggattacaaag

SEQ ID NO: 7525837 - DNA, 22 bp, Homo sapiens
gagtaaaagttggattacaaag

SEQ ID NO: 7525838 - DNA, 22 bp, Homo sapiens
gagtaaaagttggattacaaag

SEQ ID NO: 7525839 - DNA, 22 bp, Homo sapiens
gagtaaaagttggattacaaag

SEQ ID NO: 7525840 - DNA, 22 bp, Homo sapiens
gaggtgggagggcagtccctaa

SEQ ID NO: 7525841 - DNA, 22 bp, Homo sapiens
gaggtgggagggcagtccctaa

SEQ ID NO: 7525842 - DNA, 22 bp, Homo sapiens
gaggtggcttagtctctggaca

SEQ ID NO: 7525843 - DNA, 22 bp, Homo sapiens
gaggtggcttagtctctggaca

SEQ ID NO: 7525844 - DNA, 22 bp, Homo sapiens
gaggtgggagggcagtccctaa

SEQ ID NO: 7525845 - DNA, 22 bp, Homo sapiens
gaggtggcttagtctctggaca

SEQ ID NO: 7525846 - DNA, 22 bp, Homo sapiens
gaggtggcttagtctctggaca

SEQ ID NO: 7525847 - DNA, 22 bp, Homo sapiens
gaggtggcttagtctctggaca

SEQ ID NO: 7525848 - DNA, 22 bp, Homo sapiens
gaggtggcttagtctctggaca

SEQ ID NO: 7525849 - DNA, 22 bp, Homo sapiens
gaggtggcttagtctctggaca

SEQ ID NO: 7525850 - DNA, 22 bp, Homo sapiens
gaggtgggagggcagtccctaa

SEQ ID NO: 7525851 - DNA, 22 bp, Homo sapiens
gaggtgggagggcagtccctaa

SEQ ID NO: 7525852 - DNA, 22 bp, Homo sapiens
gaggtgggagggcagtccctaa

SEQ ID NO: 7525853 - DNA, 22 bp, Homo sapiens
gaggtgggagggcagtccctaa

SEQ ID NO: 7525854 - DNA, 22 bp, Homo sapiens
gaggtgggagggcagtccctaa

SEQ ID NO: 7525855 - DNA, 22 bp, Homo sapiens
gaggtgtctgttaggaataggc

SEQ ID NO: 7525856 - DNA, 22 bp, Homo sapiens
gaggtgggagggcagtccctaa

SEQ ID NO: 7525857 - DNA, 19 bp, Homo sapiens
gaggtgtctttcctgagta

SEQ ID NO: 7525858 - DNA, 19 bp, Homo sapiens
gaggtgtctttcctgagta

SEQ ID NO: 7525859 - DNA, 22 bp, Homo sapiens
gagtaaaagatgaggcagtaga

SEQ ID NO: 7525860 - DNA, 22 bp, Homo sapiens
gagtaaaagatgaggcagtaga

SEQ ID NO: 7525861 - DNA, 22 bp, Homo sapiens
gagtaaaagttggattacaaag

SEQ ID NO: 7525862 - DNA, 22 bp, Homo sapiens
gagtaaaagttggattacaaag

SEQ ID NO: 7525863 - DNA, 19 bp, Homo sapiens
gaggtttctgaagtgggct

SEQ ID NO: 7525864 - DNA, 19 bp, Homo sapiens
gaggtttctgaagtgggct

SEQ ID NO: 7525865 - DNA, 22 bp, Homo sapiens
gaggtttcttatcaagaaagct

SEQ ID NO: 7525866 - DNA, 22 bp, Homo sapiens
gaggttttaagttgaaggggga

SEQ ID NO: 7525867 - DNA, 22 bp, Homo sapiens
gaggttttaggctgccattatt

SEQ ID NO: 7525868 - DNA, 22 bp, Homo sapiens
gaggttggtgaggggacacggt

SEQ ID NO: 7525869 - DNA, 22 bp, Homo sapiens
gaggtttcactgtgttgtccag

SEQ ID NO: 7525870 - DNA, 22 bp, Homo sapiens
gaggtttcactgtgttgtccag

SEQ ID NO: 7525871 - DNA, 23 bp, Homo sapiens
gaggtgtgaattctgggtgctgc

SEQ ID NO: 7525872 - DNA, 22 bp, Homo sapiens
gaggttggtgaggggacacggt

SEQ ID NO: 7525873 - DNA, 22 bp, Homo sapiens
gaggttggttccaaccctccca

SEQ ID NO: 7525874 - DNA, 23 bp, Homo sapiens
gaggtgtgaattctgggtgctgc

SEQ ID NO: 7525875 - DNA, 23 bp, Homo sapiens
gaggtgtgaattctgggtgctgc

SEQ ID NO: 7525876 - DNA, 23 bp, Homo sapiens
gaggtgtgaattctgggtgctgc

SEQ ID NO: 7525877 - DNA, 23 bp, Homo sapiens
gaggtgtgaattctgggtgctgc

SEQ ID NO: 7525878 - DNA, 22 bp, Homo sapiens
gaggtgtctggcctttgtagga

SEQ ID NO: 7525879 - DNA, 22 bp, Homo sapiens
gagctgtgaaaagtgcctgggg

SEQ ID NO: 7525880 - DNA, 22 bp, Homo sapiens
gagctgtgaaaagtgcctgggg

SEQ ID NO: 7525881 - DNA, 18 bp, Homo sapiens
gagctgtctgagctggtc

SEQ ID NO: 7525882 - DNA, 22 bp, Homo sapiens
gagctgtctggggactctgggt

SEQ ID NO: 7525883 - DNA, 22 bp, Homo sapiens
gagctgtgaaaagtgcctgggg

SEQ ID NO: 7525884 - DNA, 22 bp, Homo sapiens
gagctgtgaaaagtgcctgggg

SEQ ID NO: 7525885 - DNA, 22 bp, Homo sapiens
gagctgtgaaaagtgcctgggg

SEQ ID NO: 7525886 - DNA, 22 bp, Homo sapiens
gagctgtgaaaagtgcctgggg

SEQ ID NO: 7525887 - DNA, 22 bp, Homo sapiens
gagctgtgacacgcagcccagg

SEQ ID NO: 7525888 - DNA, 22 bp, Homo sapiens
gagctgtgacacgcagcccagg

SEQ ID NO: 7525889 - DNA, 22 bp, Homo sapiens
gagctgtgacacgcagcccagg

SEQ ID NO: 7525890 - DNA, 22 bp, Homo sapiens
gagctgtgagggacacattgct

SEQ ID NO: 7525891 - DNA, 22 bp, Homo sapiens
gagctgtgagggacacattgct

SEQ ID NO: 7525892 - DNA, 22 bp, Homo sapiens
gagctgtgattggtgtctcact

SEQ ID NO: 7525893 - DNA, 22 bp, Homo sapiens
gagctgtgattggtgtctcact

SEQ ID NO: 7525894 - DNA, 22 bp, Homo sapiens
gagctgtgattggtgtctcact

SEQ ID NO: 7525895 - DNA, 22 bp, Homo sapiens
gagctgtccaagatggtcgtaa

SEQ ID NO: 7525896 - DNA, 22 bp, Homo sapiens
gagctggttttaggctatgtct

SEQ ID NO: 7525897 - DNA, 22 bp, Homo sapiens
gagctggttctgtccagggaat

SEQ ID NO: 7525898 - DNA, 22 bp, Homo sapiens
gagctgtcctaccaggagtcct

SEQ ID NO: 7525899 - DNA, 22 bp, Homo sapiens
gagctgtcctaccaggagtcct

SEQ ID NO: 7525900 - DNA, 22 bp, Homo sapiens
gagctgtctctatatgaatgct

SEQ ID NO: 7525901 - DNA, 22 bp, Homo sapiens
gagctgtctctttgggcctttt

SEQ ID NO: 7525902 - DNA, 22 bp, Homo sapiens
gagctgtccaagatggtcgtaa

SEQ ID NO: 7525903 - DNA, 22 bp, Homo sapiens
gagctgtccgcccctgggccga

SEQ ID NO: 7525904 - DNA, 22 bp, Homo sapiens
gagctgtccgcccctgggccga

SEQ ID NO: 7525905 - DNA, 22 bp, Homo sapiens
gagctgtccgcccctgggccga

SEQ ID NO: 7525906 - DNA, 17 bp, Homo sapiens
gaggacagggaagtagg

SEQ ID NO: 7525907 - DNA, 22 bp, Homo sapiens
gaggacaggagactcactgttt

SEQ ID NO: 7525908 - DNA, 17 bp, Homo sapiens
gaggacagggaagtagg

SEQ ID NO: 7525909 - DNA, 17 bp, Homo sapiens
gaggacagggaagtagg

SEQ ID NO: 7525910 - DNA, 17 bp, Homo sapiens
gaggacagggaagtagg

SEQ ID NO: 7525911 - DNA, 17 bp, Homo sapiens
gaggacagggaagtagg

SEQ ID NO: 7525912 - DNA, 17 bp, Homo sapiens
gaggacagggaagtagg

SEQ ID NO: 7525913 - DNA, 17 bp, Homo sapiens
gaggacagggaagtagg

SEQ ID NO: 7525914 - DNA, 17 bp, Homo sapiens
gaggacagggaagtagg

SEQ ID NO: 7525915 - DNA, 17 bp, Homo sapiens
gaggacagggaagtagg

SEQ ID NO: 7525916 - DNA, 17 bp, Homo sapiens
gaggacagggaagtagg

SEQ ID NO: 7525917 - DNA, 17 bp, Homo sapiens
gaggacagggaagtagg

SEQ ID NO: 7525918 - DNA, 22 bp, Homo sapiens
gagctgtgtgcctggatggtct

SEQ ID NO: 7525919 - DNA, 22 bp, Homo sapiens
gaggacaggagactcactgttt

SEQ ID NO: 7525920 - DNA, 22 bp, Homo sapiens
gaggacaggagactcactgttt

SEQ ID NO: 7525921 - DNA, 22 bp, Homo sapiens
gaggacaggagactcactgttt

SEQ ID NO: 7525922 - DNA, 22 bp, Homo sapiens
gaggacaggagactcactgttt

SEQ ID NO: 7525923 - DNA, 22 bp, Homo sapiens
gaggacaggagactcactgttt

SEQ ID NO: 7525924 - DNA, 22 bp, Homo sapiens
gagctgtgccaatctgtctggg

SEQ ID NO: 7525925 - DNA, 22 bp, Homo sapiens
gagctgtgccaatctgtctggg

SEQ ID NO: 7525926 - DNA, 22 bp, Homo sapiens
gagctgtgattggtgtctcact

SEQ ID NO: 7525927 - DNA, 22 bp, Homo sapiens
gagctgtgccaatctgtctggg

SEQ ID NO: 7525928 - DNA, 20 bp, Homo sapiens
gagctgtgctctcaggagcc

SEQ ID NO: 7525929 - DNA, 22 bp, Homo sapiens
gagctgtgccaatctgtctggg

SEQ ID NO: 7525930 - DNA, 20 bp, Homo sapiens
gagctgtgctctcaggagcc

SEQ ID NO: 7525931 - DNA, 20 bp, Homo sapiens
gagctgtgctctcaggagcc

SEQ ID NO: 7525932 - DNA, 22 bp, Homo sapiens
gagctgtggaaggcagggacca

SEQ ID NO: 7525933 - DNA, 22 bp, Homo sapiens
gagctgtggaaggcagggacca

SEQ ID NO: 7525934 - DNA, 22 bp, Homo sapiens
gagctgtgcttataccaattca

SEQ ID NO: 7525935 - DNA, 22 bp, Homo sapiens
gagctgtggaaggcagggacca

SEQ ID NO: 7525936 - DNA, 22 bp, Homo sapiens
gagctcctggattgctcctagg

SEQ ID NO: 7525937 - DNA, 22 bp, Homo sapiens
gagctcctggattgctcctagg

SEQ ID NO: 7525938 - DNA, 22 bp, Homo sapiens
gagctcctgctgcatcctgcct

SEQ ID NO: 7525939 - DNA, 22 bp, Homo sapiens
gagctcctcccagggtagcact

SEQ ID NO: 7525940 - DNA, 22 bp, Homo sapiens
gagctcctcccagggtagcact

SEQ ID NO: 7525941 - DNA, 22 bp, Homo sapiens
gagctcctatggtcggtggctc

SEQ ID NO: 7525942 - DNA, 22 bp, Homo sapiens
gagctcctcccagggtagcact

SEQ ID NO: 7525943 - DNA, 22 bp, Homo sapiens
gagctcctgaaacgttcctgcc

SEQ ID NO: 7525944 - DNA, 22 bp, Homo sapiens
gagctccagcatctctgccaaa

SEQ ID NO: 7525945 - DNA, 22 bp, Homo sapiens
gagctccagggaacagcagcta

SEQ ID NO: 7525946 - DNA, 22 bp, Homo sapiens
gagctccagggaacagcagcta

SEQ ID NO: 7525947 - DNA, 22 bp, Homo sapiens
gagctcccaggccccagcaagg

SEQ ID NO: 7525948 - DNA, 22 bp, Homo sapiens
gagctccagggaacagcagcta

SEQ ID NO: 7525949 - DNA, 22 bp, Homo sapiens
gagctcccaggccccagcaagg

SEQ ID NO: 7525950 - DNA, 22 bp, Homo sapiens
gagctccctggaggttcagata

SEQ ID NO: 7525951 - DNA, 22 bp, Homo sapiens
gagctcccaggccccagcaagg

SEQ ID NO: 7525952 - DNA, 22 bp, Homo sapiens
gagctgggatttgaacctggga

SEQ ID NO: 7525953 - DNA, 22 bp, Homo sapiens
gagctgggatttgaacctggga

SEQ ID NO: 7525954 - DNA, 22 bp, Homo sapiens
gagctgggatttgaacctggga

SEQ ID NO: 7525955 - DNA, 22 bp, Homo sapiens
gagctgggatttgaacctggga

SEQ ID NO: 7525956 - DNA, 22 bp, Homo sapiens
gagctgggatttgaacctggga

SEQ ID NO: 7525957 - DNA, 22 bp, Homo sapiens
gagctgggattcatctatgtct

SEQ ID NO: 7525958 - DNA, 22 bp, Homo sapiens
gagctctaaccagggacaatta

SEQ ID NO: 7525959 - DNA, 22 bp, Homo sapiens
gagctcggcgagaaactttgcc

SEQ ID NO: 7525960 - DNA, 22 bp, Homo sapiens
gagctgggcctcagaacacagt

SEQ ID NO: 7525961 - DNA, 22 bp, Homo sapiens
gagctgggtatatggctttatg

SEQ ID NO: 7525962 - DNA, 22 bp, Homo sapiens
gagctgggcctcagaacacagt

SEQ ID NO: 7525963 - DNA, 22 bp, Homo sapiens
gagctgggcacacgccacttga

SEQ ID NO: 7525964 - DNA, 22 bp, Homo sapiens
gagctgggcacacgccacttga

SEQ ID NO: 7525965 - DNA, 22 bp, Homo sapiens
gagctgggcacacgccacttga

SEQ ID NO: 7525966 - DNA, 22 bp, Homo sapiens
gagctgggcacacgccacttga

SEQ ID NO: 7525967 - DNA, 22 bp, Homo sapiens
gagctgggcacacgccacttga

SEQ ID NO: 7525968 - DNA, 22 bp, Homo sapiens
gagctgggtgtttatttgccaa

SEQ ID NO: 7525969 - DNA, 22 bp, Homo sapiens
gagctgggtgtttatttgccaa

SEQ ID NO: 7525970 - DNA, 22 bp, Homo sapiens
gagctgggtctccaccttggca

SEQ ID NO: 7525971 - DNA, 22 bp, Homo sapiens
gagctgggtctccaccttggca

SEQ ID NO: 7525972 - DNA, 22 bp, Homo sapiens
gagctgggtatatggctttatg

SEQ ID NO: 7525973 - DNA, 22 bp, Homo sapiens
gagctgggtatatggctttatg

SEQ ID NO: 7525974 - DNA, 22 bp, Homo sapiens
gagctgggcctcagaacacagt

SEQ ID NO: 7525975 - DNA, 22 bp, Homo sapiens
gagctgggtatatggctttatg

SEQ ID NO: 7525976 - DNA, 22 bp, Homo sapiens
gagctgggtctccaccttggca

SEQ ID NO: 7525977 - DNA, 22 bp, Homo sapiens
gagctgggtctccaccttggca

SEQ ID NO: 7525978 - DNA, 22 bp, Homo sapiens
gagctgggtctccaccttggca

SEQ ID NO: 7525979 - DNA, 22 bp, Homo sapiens
gagctgggtctccaccttggca

SEQ ID NO: 7525980 - DNA, 16 bp, Homo sapiens
gagctggtagcagctg

SEQ ID NO: 7525981 - DNA, 22 bp, Homo sapiens
gagctggtcagtttcaggagag

SEQ ID NO: 7525982 - DNA, 22 bp, Homo sapiens
gagctggtcagtttcaggagag

SEQ ID NO: 7525983 - DNA, 22 bp, Homo sapiens
gagctggtcagtttcaggagag

SEQ ID NO: 7525984 - DNA, 22 bp, Homo sapiens
gagctggtcagtttcagggcca

SEQ ID NO: 7525985 - DNA, 22 bp, Homo sapiens
gagctggtgctcttgtcaagac

SEQ ID NO: 7525986 - DNA, 22 bp, Homo sapiens
gagctggtggtgagaaagctct

SEQ ID NO: 7525987 - DNA, 22 bp, Homo sapiens
gagctggtggtgagaaagctct

SEQ ID NO: 7525988 - DNA, 22 bp, Homo sapiens
gagctggtcgaaatgggctgac

SEQ ID NO: 7525989 - DNA, 22 bp, Homo sapiens
gagctggtcgaaatgggctgac

SEQ ID NO: 7525990 - DNA, 22 bp, Homo sapiens
gagctggtgatcagctggagga

SEQ ID NO: 7525991 - DNA, 22 bp, Homo sapiens
gagctggtgatcagctggagga

SEQ ID NO: 7525992 - DNA, 22 bp, Homo sapiens
gagctggtgatcagctggagga

SEQ ID NO: 7525993 - DNA, 22 bp, Homo sapiens
gagcaggatgggagctggggcc

SEQ ID NO: 7525994 - DNA, 22 bp, Homo sapiens
gagcaggatgggagctggggcc

SEQ ID NO: 7525995 - DNA, 22 bp, Homo sapiens
gagcaggatggcacttctgtga

SEQ ID NO: 7525996 - DNA, 22 bp, Homo sapiens
gagcaggatgggagctggggcc

SEQ ID NO: 7525997 - DNA, 22 bp, Homo sapiens
gagcaggatgggagctggggcc

SEQ ID NO: 7525998 - DNA, 22 bp, Homo sapiens
gagcaggatggcacttctgtga

SEQ ID NO: 7525999 - DNA, 22 bp, Homo sapiens
gagcaggacgtgggaatgggaa

SEQ ID NO: 7526000 - DNA, 22 bp, Homo sapiens
gagcaggatggcacttctgtga

SEQ ID NO: 7526001 - DNA, 22 bp, Homo sapiens
gagcaggacgtgggaatgggaa

SEQ ID NO: 7526002 - DNA, 22 bp, Homo sapiens
gagcaggcaaagatgaaaggag

SEQ ID NO: 7526003 - DNA, 22 bp, Homo sapiens
gagcaggcaactctgcagtgcc

SEQ ID NO: 7526004 - DNA, 22 bp, Homo sapiens
gagcaggcaactctgcagtgcc

SEQ ID NO: 7526005 - DNA, 22 bp, Homo sapiens
gagcaggcaactctgcagtgcc

SEQ ID NO: 7526006 - DNA, 22 bp, Homo sapiens
gagcaggcaaagatgaaaggag

SEQ ID NO: 7526007 - DNA, 22 bp, Homo sapiens
gagcaggcaactctgcagtgcc

SEQ ID NO: 7526008 - DNA, 22 bp, Homo sapiens
gagcaggcaaagatgaaaggag

SEQ ID NO: 7526009 - DNA, 22 bp, Homo sapiens
gagcaggcaaagatgaaaggag

SEQ ID NO: 7526010 - DNA, 22 bp, Homo sapiens
gagcaggcaaagatgaaaggag

SEQ ID NO: 7526011 - DNA, 22 bp, Homo sapiens
gagcaggatgggagctggggcc

SEQ ID NO: 7526012 - DNA, 22 bp, Homo sapiens
gagcaggcaaagatgaaaggag

SEQ ID NO: 7526013 - DNA, 22 bp, Homo sapiens
gagcaggcattctagtggctga

SEQ ID NO: 7526014 - DNA, 22 bp, Homo sapiens
gagcaggcattctagtggctga

SEQ ID NO: 7526015 - DNA, 22 bp, Homo sapiens
gagcaggcattctagtggctga

SEQ ID NO: 7526016 - DNA, 19 bp, Homo sapiens
gagcaggccacacatgtgt

SEQ ID NO: 7526017 - DNA, 19 bp, Homo sapiens
gagcaggccacacatgtgt

SEQ ID NO: 7526018 - DNA, 19 bp, Homo sapiens
gagcaggccacacatgtgt

SEQ ID NO: 7526019 - DNA, 22 bp, Homo sapiens
gagcaggcaactctgcagtgcc

SEQ ID NO: 7526020 - DNA, 22 bp, Homo sapiens
gagcaggcaactctgcagtgcc

SEQ ID NO: 7526021 - DNA, 22 bp, Homo sapiens
gagcaggcattctagtggctga

SEQ ID NO: 7526022 - DNA, 22 bp, Homo sapiens
gagcaggcattctagtggctga

SEQ ID NO: 7526023 - DNA, 22 bp, Homo sapiens
gagcaggcattctagtggctga

SEQ ID NO: 7526024 - DNA, 22 bp, Homo sapiens
gagcaggcattctagtggctga

SEQ ID NO: 7526025 - DNA, 22 bp, Homo sapiens
gagcaggcattctagtggctga

SEQ ID NO: 7526026 - DNA, 22 bp, Homo sapiens
gagcaggcattctagtggctga

SEQ ID NO: 7526027 - DNA, 22 bp, Homo sapiens
gagcaggcctggggtgaggcct

SEQ ID NO: 7526028 - DNA, 22 bp, Homo sapiens
gagcaggcctggggtgaggcct

SEQ ID NO: 7526029 - DNA, 22 bp, Homo sapiens
gagcaggcctggggtgaggcct

SEQ ID NO: 7526030 - DNA, 22 bp, Homo sapiens
gagcaggcctggggtgaggcct

SEQ ID NO: 7526031 - DNA, 22 bp, Homo sapiens
gagcaggcctggggtgaggcct

SEQ ID NO: 7526032 - DNA, 22 bp, Homo sapiens
gagcaggcctggggtgaggcct

SEQ ID NO: 7526033 - DNA, 22 bp, Homo sapiens
gagcaggcctggggtgaggcct

SEQ ID NO: 7526034 - DNA, 22 bp, Homo sapiens
gagcaggcctggggtgaggcct

SEQ ID NO: 7526035 - DNA, 22 bp, Homo sapiens
gagcaggcctggggtgaggcct

SEQ ID NO: 7526036 - DNA, 22 bp, Homo sapiens
gagcaggccagcaatggaaggg

SEQ ID NO: 7526037 - DNA, 22 bp, Homo sapiens
gagcaggccagcaatggaaggg

SEQ ID NO: 7526038 - DNA, 22 bp, Homo sapiens
gagcaggcctggggtgaggcct

SEQ ID NO: 7526039 - DNA, 22 bp, Homo sapiens
gagcaggccagcaatggaaggg

SEQ ID NO: 7526040 - DNA, 19 bp, Homo sapiens
gagcaggccacacatgtgt

SEQ ID NO: 7526041 - DNA, 22 bp, Homo sapiens
gagcaggccagcaatggaaggg

SEQ ID NO: 7526042 - DNA, 19 bp, Homo sapiens
gagcaggccacacatgtgt

SEQ ID NO: 7526043 - DNA, 22 bp, Homo sapiens
gagcaggccagcaatggaaggg

SEQ ID NO: 7526044 - DNA, 22 bp, Homo sapiens
gagcaggccagcaatggaaggg

SEQ ID NO: 7526045 - DNA, 22 bp, Homo sapiens
gagcaggcattctagtggctga

SEQ ID NO: 7526046 - DNA, 22 bp, Homo sapiens
gagcaggccagcaatggaaggg

SEQ ID NO: 7526047 - DNA, 22 bp, Homo sapiens
gagctcagagcctatagttggt

SEQ ID NO: 7526048 - DNA, 22 bp, Homo sapiens
gagctcagactcgggcctgggg

SEQ ID NO: 7526049 - DNA, 22 bp, Homo sapiens
gagctcagagcctatagttggt

SEQ ID NO: 7526050 - DNA, 22 bp, Homo sapiens
gagctcagaggattctggggag

SEQ ID NO: 7526051 - DNA, 22 bp, Homo sapiens
gagctcagaggattctggggag

SEQ ID NO: 7526052 - DNA, 22 bp, Homo sapiens
gagctcagagcctatagttggt

SEQ ID NO: 7526053 - DNA, 22 bp, Homo sapiens
gagctcagaggcgtctttgtcc

SEQ ID NO: 7526054 - DNA, 22 bp, Homo sapiens
gagctcagaggcgtctttgtcc

SEQ ID NO: 7526055 - DNA, 22 bp, Homo sapiens
gagctcagaggcgtctttgtcc

SEQ ID NO: 7526056 - DNA, 22 bp, Homo sapiens
gagctcagaggattctggggag

SEQ ID NO: 7526057 - DNA, 22 bp, Homo sapiens
gagctcagaggattctggggag

SEQ ID NO: 7526058 - DNA, 22 bp, Homo sapiens
gagcaggcctggggtgaggcct

SEQ ID NO: 7526059 - DNA, 22 bp, Homo sapiens
gagcaggctctgcctgtgtgtc

SEQ ID NO: 7526060 - DNA, 22 bp, Homo sapiens
gagcaggctctgcctgtgtgtc

SEQ ID NO: 7526061 - DNA, 22 bp, Homo sapiens
gagcaggctctgcctgtgtgtc

SEQ ID NO: 7526062 - DNA, 22 bp, Homo sapiens
gagcaggctctgcctgtgtgtc

SEQ ID NO: 7526063 - DNA, 22 bp, Homo sapiens
gagcaggctctgcctgtgtgtc

SEQ ID NO: 7526064 - DNA, 22 bp, Homo sapiens
gagcaggctctgcctgtgtgtc

SEQ ID NO: 7526065 - DNA, 22 bp, Homo sapiens
gagctcagactcgggcctgggg

SEQ ID NO: 7526066 - DNA, 22 bp, Homo sapiens
gagctcagactcgggcctgggg

SEQ ID NO: 7526067 - DNA, 22 bp, Homo sapiens
gagctcagactcgggcctgggg

SEQ ID NO: 7526068 - DNA, 22 bp, Homo sapiens
gagctcagactcgggcctgggg

SEQ ID NO: 7526069 - DNA, 18 bp, Homo sapiens
gagctcagcgtgtttcta

SEQ ID NO: 7526070 - DNA, 22 bp, Homo sapiens
gagctcagcctgaggcctggct

SEQ ID NO: 7526071 - DNA, 22 bp, Homo sapiens
gagctcagcctgaggcctggct

SEQ ID NO: 7526072 - DNA, 18 bp, Homo sapiens
gagctcagcgtgtttcta

SEQ ID NO: 7526073 - DNA, 22 bp, Homo sapiens
gagctcaggagcatcagaagaa

SEQ ID NO: 7526074 - DNA, 18 bp, Homo sapiens
gagctcagcgtgtttcta

SEQ ID NO: 7526075 - DNA, 22 bp, Homo sapiens
gagctcaggagcatcagaagaa

SEQ ID NO: 7526076 - DNA, 22 bp, Homo sapiens
gagctcaggagcatcagaagaa

SEQ ID NO: 7526077 - DNA, 22 bp, Homo sapiens
gagctcaggagcatcagaagaa

SEQ ID NO: 7526078 - DNA, 22 bp, Homo sapiens
gagctcaggagcatcagaagaa

SEQ ID NO: 7526079 - DNA, 22 bp, Homo sapiens
gagctcagcccaaagagcagtg

SEQ ID NO: 7526080 - DNA, 22 bp, Homo sapiens
gagctcagcccaaagagcagtg

SEQ ID NO: 7526081 - DNA, 22 bp, Homo sapiens
gagctcagcccaaagagcagtg

SEQ ID NO: 7526082 - DNA, 22 bp, Homo sapiens
gagctcagcctgaggcctggct

SEQ ID NO: 7526083 - DNA, 22 bp, Homo sapiens
gagctcagcctgaggcctggct

SEQ ID NO: 7526084 - DNA, 22 bp, Homo sapiens
gagctcagcctgaggcctggct

SEQ ID NO: 7526085 - DNA, 22 bp, Homo sapiens
gagctcagcccaaagagcagtg

SEQ ID NO: 7526086 - DNA, 22 bp, Homo sapiens
gagctcagcccaaagagcagtg

SEQ ID NO: 7526087 - DNA, 22 bp, Homo sapiens
gagctcagattctggtgtcaga

SEQ ID NO: 7526088 - DNA, 22 bp, Homo sapiens
gagctcagattctggtgtcaga

SEQ ID NO: 7526089 - DNA, 22 bp, Homo sapiens
gagctcagattctggtgtcaga

SEQ ID NO: 7526090 - DNA, 22 bp, Homo sapiens
gagctcagcaaaggtctgtgtg

SEQ ID NO: 7526091 - DNA, 22 bp, Homo sapiens
gagctcagcaaaggtctgtgtg

SEQ ID NO: 7526092 - DNA, 22 bp, Homo sapiens
gagctcagcaaaggtctgtgtg

SEQ ID NO: 7526093 - DNA, 22 bp, Homo sapiens
gagctcagattctggtgtcaga

SEQ ID NO: 7526094 - DNA, 22 bp, Homo sapiens
gagctcagcccaaagagcagtg

SEQ ID NO: 7526095 - DNA, 22 bp, Homo sapiens
gagctcagcccaaagagcagtg

SEQ ID NO: 7526096 - DNA, 22 bp, Homo sapiens
gagctcagcccaaagagcagtg

SEQ ID NO: 7526097 - DNA, 22 bp, Homo sapiens
gagctcagcactaaaatcatgt

SEQ ID NO: 7526098 - DNA, 22 bp, Homo sapiens
gagctcagcaaaggtctgtgtg

SEQ ID NO: 7526099 - DNA, 22 bp, Homo sapiens
gagctcagcactaaaatcatgt

SEQ ID NO: 7526100 - DNA, 22 bp, Homo sapiens
gagctccaccaccttcaggcag

SEQ ID NO: 7526101 - DNA, 22 bp, Homo sapiens
gagctcattcattcattgcctg

SEQ ID NO: 7526102 - DNA, 22 bp, Homo sapiens
gagctccaccaccttcaggcag

SEQ ID NO: 7526103 - DNA, 22 bp, Homo sapiens
gagctcattcattcattgcctg

SEQ ID NO: 7526104 - DNA, 22 bp, Homo sapiens
gagctcatccccatggtccgtc

SEQ ID NO: 7526105 - DNA, 22 bp, Homo sapiens
gagctccagggaacagcagcta

SEQ ID NO: 7526106 - DNA, 22 bp, Homo sapiens
gagctccagcatctctgccaaa

SEQ ID NO: 7526107 - DNA, 22 bp, Homo sapiens
gagctccagagttagacacccg

SEQ ID NO: 7526108 - DNA, 22 bp, Homo sapiens
gagctccagagttagacacccg

SEQ ID NO: 7526109 - DNA, 22 bp, Homo sapiens
gagctccacttagcaaggccac

SEQ ID NO: 7526110 - DNA, 22 bp, Homo sapiens
gagctccacttagcaaggccac

SEQ ID NO: 7526111 - DNA, 22 bp, Homo sapiens
gagctccacttagcaaggccac

SEQ ID NO: 7526112 - DNA, 22 bp, Homo sapiens
gagctccaccaccttcaggcag

SEQ ID NO: 7526113 - DNA, 22 bp, Homo sapiens
gagctccaccaccttcaggcag

SEQ ID NO: 7526114 - DNA, 22 bp, Homo sapiens
gagctcagtgtagtcatggctt

SEQ ID NO: 7526115 - DNA, 22 bp, Homo sapiens
gagctcagtgtagtcatggctt

SEQ ID NO: 7526116 - DNA, 22 bp, Homo sapiens
gagctcaggtggtcaaaacaat

SEQ ID NO: 7526117 - DNA, 22 bp, Homo sapiens
gagctcagtgtagtcatggctt

SEQ ID NO: 7526118 - DNA, 22 bp, Homo sapiens
gagctcagtgtagtcatggctt

SEQ ID NO: 7526119 - DNA, 22 bp, Homo sapiens
gagctcagtgtagtcatggctt

SEQ ID NO: 7526120 - DNA, 22 bp, Homo sapiens
gagctcataccctcttctcttt

SEQ ID NO: 7526121 - DNA, 22 bp, Homo sapiens
gagctcatccccatggtccgtc

SEQ ID NO: 7526122 - DNA, 22 bp, Homo sapiens
gagctcagggcattgagcaaga

SEQ ID NO: 7526123 - DNA, 22 bp, Homo sapiens
gagctcagggcattgagcaaga

SEQ ID NO: 7526124 - DNA, 22 bp, Homo sapiens
gagctcagggcattgagcaaga

SEQ ID NO: 7526125 - DNA, 22 bp, Homo sapiens
gagctcagggcattgagcaaga

SEQ ID NO: 7526126 - DNA, 22 bp, Homo sapiens
gagctcaggtggtcaaaacaat

SEQ ID NO: 7526127 - DNA, 23 bp, Homo sapiens
gagctcaggtagggctcgcccgc

SEQ ID NO: 7526128 - DNA, 23 bp, Homo sapiens
gagctcaggtagggctcgcccgc

SEQ ID NO: 7526129 - DNA, 22 bp, Homo sapiens
gaggcaagaaaggactttctag

SEQ ID NO: 7526130 - DNA, 22 bp, Homo sapiens
gaggcaagaaaggactttctag

SEQ ID NO: 7526131 - DNA, 22 bp, Homo sapiens
gaggcaacttcctgtcctctcc

SEQ ID NO: 7526132 - DNA, 22 bp, Homo sapiens
gaggcaacttcctgtcctctcc

SEQ ID NO: 7526133 - DNA, 22 bp, Homo sapiens
gaggcaactggaacactggtca

SEQ ID NO: 7526134 - DNA, 22 bp, Homo sapiens
gaggcaactggaacactggtca

SEQ ID NO: 7526135 - DNA, 22 bp, Homo sapiens
gaggcaactgcttttcctcctt

SEQ ID NO: 7526136 - DNA, 22 bp, Homo sapiens
gaggcaacattgagcttctgta

SEQ ID NO: 7526137 - DNA, 22 bp, Homo sapiens
gaggcaacacatttggaaagca

SEQ ID NO: 7526138 - DNA, 22 bp, Homo sapiens
gaggcaacacatttggaaagca

SEQ ID NO: 7526139 - DNA, 22 bp, Homo sapiens
gaggcaacattgagcttctgta

SEQ ID NO: 7526140 - DNA, 22 bp, Homo sapiens
gaggcaacaatgatggtgtgta

SEQ ID NO: 7526141 - DNA, 22 bp, Homo sapiens
gaggcaaagcatgtggctcagg

SEQ ID NO: 7526142 - DNA, 22 bp, Homo sapiens
gaggcaaagcatgtggctcagg

SEQ ID NO: 7526143 - DNA, 22 bp, Homo sapiens
gaggcaacaatgatggtgtgta

SEQ ID NO: 7526144 - DNA, 22 bp, Homo sapiens
gaggcaacaatgatggtgtgta

SEQ ID NO: 7526145 - DNA, 22 bp, Homo sapiens
gaggatttgatggctttctccc

SEQ ID NO: 7526146 - DNA, 22 bp, Homo sapiens
gaggatttgatggctttctccc

SEQ ID NO: 7526147 - DNA, 22 bp, Homo sapiens
gaggatgtgtctggtctgggca

SEQ ID NO: 7526148 - DNA, 22 bp, Homo sapiens
gaggatgtaaaatagacaaaat

SEQ ID NO: 7526149 - DNA, 22 bp, Homo sapiens
gaggatggtgagcaggacccag

SEQ ID NO: 7526150 - DNA, 22 bp, Homo sapiens
gaggatggtgagcaggacccag

SEQ ID NO: 7526151 - DNA, 22 bp, Homo sapiens
gaggatggtgagcaggacccag

SEQ ID NO: 7526152 - DNA, 22 bp, Homo sapiens
gaggatggtgagcaggacccag

SEQ ID NO: 7526153 - DNA, 22 bp, Homo sapiens
gaggatggtatgaggcaagcaa

SEQ ID NO: 7526154 - DNA, 22 bp, Homo sapiens
gaggatggtatgaggcaagcaa

SEQ ID NO: 7526155 - DNA, 22 bp, Homo sapiens
gaggatggtgagcaggacccag

SEQ ID NO: 7526156 - DNA, 22 bp, Homo sapiens
gaggatggtatgaggcaagcaa

SEQ ID NO: 7526157 - DNA, 22 bp, Homo sapiens
gaggatggtatgaggcaagcaa

SEQ ID NO: 7526158 - DNA, 22 bp, Homo sapiens
gaggatggatccgaccccttcc

SEQ ID NO: 7526159 - DNA, 22 bp, Homo sapiens
gaggatggatccgaccccttcc

SEQ ID NO: 7526160 - DNA, 22 bp, Homo sapiens
gaggatggtatgaggcaagcaa

SEQ ID NO: 7526161 - DNA, 22 bp, Homo sapiens
gaggatggatccgaccccttcc

SEQ ID NO: 7526162 - DNA, 22 bp, Homo sapiens
gaggatggaggtgtgagctatg

SEQ ID NO: 7526163 - DNA, 22 bp, Homo sapiens
gaggatggaggtgtgagctatg

SEQ ID NO: 7526164 - DNA, 22 bp, Homo sapiens
gaggatggaggcagttagggcc

SEQ ID NO: 7526165 - DNA, 22 bp, Homo sapiens
gaggccacgtgcttatgtttct

SEQ ID NO: 7526166 - DNA, 22 bp, Homo sapiens
gaggccacgtgcttatgtttct

SEQ ID NO: 7526167 - DNA, 22 bp, Homo sapiens
gaggccacgtgcttatgtttct

SEQ ID NO: 7526168 - DNA, 22 bp, Homo sapiens
gaggccacggttttccttgggg

SEQ ID NO: 7526169 - DNA, 22 bp, Homo sapiens
gaggccacggttttccttgggg

SEQ ID NO: 7526170 - DNA, 22 bp, Homo sapiens
gaggccacggttttccttgggg

SEQ ID NO: 7526171 - DNA, 22 bp, Homo sapiens
gaggccacggaagggagctgtg

SEQ ID NO: 7526172 - DNA, 22 bp, Homo sapiens
gaggccacggttttccttgggg

SEQ ID NO: 7526173 - DNA, 22 bp, Homo sapiens
gaggccacggaagggagctgtg

SEQ ID NO: 7526174 - DNA, 22 bp, Homo sapiens
gaggccacggaagggagctgtg

SEQ ID NO: 7526175 - DNA, 22 bp, Homo sapiens
gaggccactgtccctgccttcc

SEQ ID NO: 7526176 - DNA, 22 bp, Homo sapiens
gaggccactgtccctgccttcc

SEQ ID NO: 7526177 - DNA, 21 bp, Homo sapiens
gaggccactaataggggcaga

SEQ ID NO: 7526178 - DNA, 22 bp, Homo sapiens
gaggccactgtccctgccttcc

SEQ ID NO: 7526179 - DNA, 21 bp, Homo sapiens
gaggccactaataggggcaga

SEQ ID NO: 7526180 - DNA, 21 bp, Homo sapiens
gaggccactaataggggcaga

SEQ ID NO: 7526181 - DNA, 21 bp, Homo sapiens
gaggccactaataggggcaga

SEQ ID NO: 7526182 - DNA, 22 bp, Homo sapiens
gaggccacgtgcttatgtttct

SEQ ID NO: 7526183 - DNA, 21 bp, Homo sapiens
gaggccactaataggggcaga

SEQ ID NO: 7526184 - DNA, 22 bp, Homo sapiens
gaggccacggaagggagctgtg

SEQ ID NO: 7526185 - DNA, 22 bp, Homo sapiens
gaggccacggaagggagctgtg

SEQ ID NO: 7526186 - DNA, 22 bp, Homo sapiens
gaggcatgtctggcctgtccca

SEQ ID NO: 7526187 - DNA, 22 bp, Homo sapiens
gaggccacggaagggagctgtg

SEQ ID NO: 7526188 - DNA, 22 bp, Homo sapiens
gaggcatggcctgaggctagga

SEQ ID NO: 7526189 - DNA, 22 bp, Homo sapiens
gaggcatgtctggcctgtccca

SEQ ID NO: 7526190 - DNA, 22 bp, Homo sapiens
gaggcatggcctgaggctagga

SEQ ID NO: 7526191 - DNA, 22 bp, Homo sapiens
gaggcatggcctgaggctagga

SEQ ID NO: 7526192 - DNA, 22 bp, Homo sapiens
gaggcatggcctgaggctagga

SEQ ID NO: 7526193 - DNA, 22 bp, Homo sapiens
gaggcatggcctgaggctagga

SEQ ID NO: 7526194 - DNA, 22 bp, Homo sapiens
gaggcatggcctgaggctagga

SEQ ID NO: 7526195 - DNA, 22 bp, Homo sapiens
gaggcatgcagagctggagcag

SEQ ID NO: 7526196 - DNA, 22 bp, Homo sapiens
gaggcatgcagagctggagcag

SEQ ID NO: 7526197 - DNA, 22 bp, Homo sapiens
gaggcaagagaagccagctttc

SEQ ID NO: 7526198 - DNA, 22 bp, Homo sapiens
gaggcaagagaagccagctttc

SEQ ID NO: 7526199 - DNA, 22 bp, Homo sapiens
gaggcaagagaagccagctttc

SEQ ID NO: 7526200 - DNA, 22 bp, Homo sapiens
gaggcatgcagagctggagcag

SEQ ID NO: 7526201 - DNA, 22 bp, Homo sapiens
gaggcatgcagagctggagcag

SEQ ID NO: 7526202 - DNA, 22 bp, Homo sapiens
gaggcatgcagagctggagcag

SEQ ID NO: 7526203 - DNA, 22 bp, Homo sapiens
gaggccagatactctcttctgc

SEQ ID NO: 7526204 - DNA, 22 bp, Homo sapiens
gaggccagatactctcttctgc

SEQ ID NO: 7526205 - DNA, 22 bp, Homo sapiens
gaggccagatactctcttctgc

SEQ ID NO: 7526206 - DNA, 22 bp, Homo sapiens
gaggcctggaattccagcctgg

SEQ ID NO: 7526207 - DNA, 22 bp, Homo sapiens
gaggcctggaccagccacagag

SEQ ID NO: 7526208 - DNA, 22 bp, Homo sapiens
gaggcctggagccgcctaggcg

SEQ ID NO: 7526209 - DNA, 22 bp, Homo sapiens
gaggcctggagccgcctaggcg

SEQ ID NO: 7526210 - DNA, 22 bp, Homo sapiens
gaggcctggaccagccacagag

SEQ ID NO: 7526211 - DNA, 22 bp, Homo sapiens
gaggcctggaccagccacagag

SEQ ID NO: 7526212 - DNA, 22 bp, Homo sapiens
gaggcctggaccagccacagag

SEQ ID NO: 7526213 - DNA, 22 bp, Homo sapiens
gaggcctggaccagccacagag

SEQ ID NO: 7526214 - DNA, 22 bp, Homo sapiens
gaggcctggaccagccacagag

SEQ ID NO: 7526215 - DNA, 22 bp, Homo sapiens
gaggccagactgccttttatga

SEQ ID NO: 7526216 - DNA, 22 bp, Homo sapiens
gaggccagaatgagtctctggg

SEQ ID NO: 7526217 - DNA, 22 bp, Homo sapiens
gaggccagactgccttttatga

SEQ ID NO: 7526218 - DNA, 22 bp, Homo sapiens
gaggccagactgccttttatga

SEQ ID NO: 7526219 - DNA, 22 bp, Homo sapiens
gaggccagagttccccgagtca

SEQ ID NO: 7526220 - DNA, 22 bp, Homo sapiens
gaggccagagttccccgagtca

SEQ ID NO: 7526221 - DNA, 22 bp, Homo sapiens
gaggccagagttccccgagtca

SEQ ID NO: 7526222 - DNA, 22 bp, Homo sapiens
gaggccagagttccccgagtca

SEQ ID NO: 7526223 - DNA, 22 bp, Homo sapiens
gaggccagatactctcttctgc

SEQ ID NO: 7526224 - DNA, 22 bp, Homo sapiens
gaggccagaatgagtctctggg

SEQ ID NO: 7526225 - DNA, 22 bp, Homo sapiens
gaggccagaatgagtctctggg

SEQ ID NO: 7526226 - DNA, 22 bp, Homo sapiens
gaggccagaatgagtctctggg

SEQ ID NO: 7526227 - DNA, 22 bp, Homo sapiens
gaggccagaatgagtctctggg

SEQ ID NO: 7526228 - DNA, 22 bp, Homo sapiens
gaggccagaatgagctgaatgc

SEQ ID NO: 7526229 - DNA, 22 bp, Homo sapiens
gaggccagaatgagtctctggg

SEQ ID NO: 7526230 - DNA, 22 bp, Homo sapiens
gaggccagaatgagtctctggg

SEQ ID NO: 7526231 - DNA, 22 bp, Homo sapiens
gaggccagaatgagtctctggg

SEQ ID NO: 7526232 - DNA, 22 bp, Homo sapiens
gaggccagaagtgcctcgggct

SEQ ID NO: 7526233 - DNA, 22 bp, Homo sapiens
gaggccagaagtgcctcgggct

SEQ ID NO: 7526234 - DNA, 22 bp, Homo sapiens
gaggccagaagtctgagatcag

SEQ ID NO: 7526235 - DNA, 22 bp, Homo sapiens
gaggccagaagtctgagatcag

SEQ ID NO: 7526236 - DNA, 22 bp, Homo sapiens
gaggccagaagtctgagatcag

SEQ ID NO: 7526237 - DNA, 22 bp, Homo sapiens
gaggccagaagtctgagatcag

SEQ ID NO: 7526238 - DNA, 22 bp, Homo sapiens
gaggccacttcctactggagga

SEQ ID NO: 7526239 - DNA, 22 bp, Homo sapiens
gaggccactgtccctgccttcc

SEQ ID NO: 7526240 - DNA, 22 bp, Homo sapiens
gaggccactgtccctgccttcc

SEQ ID NO: 7526241 - DNA, 22 bp, Homo sapiens
gaggccacttcctactggagga

SEQ ID NO: 7526242 - DNA, 22 bp, Homo sapiens
gaggccacttcctactggagga

SEQ ID NO: 7526243 - DNA, 22 bp, Homo sapiens
gaggccacttcctactggagga

SEQ ID NO: 7526244 - DNA, 22 bp, Homo sapiens
gaggccagaagtctgagatcag

SEQ ID NO: 7526245 - DNA, 22 bp, Homo sapiens
gaggccacttcctactggagga

SEQ ID NO: 7526246 - DNA, 22 bp, Homo sapiens
gaggccagaagtctgagatcag

SEQ ID NO: 7526247 - DNA, 22 bp, Homo sapiens
gaggccagaatgagctgaatgc

SEQ ID NO: 7526248 - DNA, 22 bp, Homo sapiens
gaggccagaatgagctgaatgc

SEQ ID NO: 7526249 - DNA, 22 bp, Homo sapiens
gaggccagaatgagctgaatgc

SEQ ID NO: 7526250 - DNA, 22 bp, Homo sapiens
gaggccagaatgagtctctggg

SEQ ID NO: 7526251 - DNA, 22 bp, Homo sapiens
gaggccagaatgagctgaatgc

SEQ ID NO: 7526252 - DNA, 22 bp, Homo sapiens
gaggccagaagtgcctcgggct

SEQ ID NO: 7526253 - DNA, 22 bp, Homo sapiens
gaggccagaagtgcctcgggct

SEQ ID NO: 7526254 - DNA, 22 bp, Homo sapiens
gaggccagaagtgcctcgggct

SEQ ID NO: 7526255 - DNA, 22 bp, Homo sapiens
gaggccagaagtgcctcgggct

SEQ ID NO: 7526256 - DNA, 22 bp, Homo sapiens
gaggccagaagtgcctcgggct

SEQ ID NO: 7526257 - DNA, 22 bp, Homo sapiens
gaggccagaagtgcctcgggct

SEQ ID NO: 7526258 - DNA, 22 bp, Homo sapiens
gaggccagaagtgcctcgggct

SEQ ID NO: 7526259 - DNA, 22 bp, Homo sapiens
gaggccagaagtgcctcgggct

SEQ ID NO: 7526260 - DNA, 22 bp, Homo sapiens
gaggacagtgtgatctgccagc

SEQ ID NO: 7526261 - DNA, 22 bp, Homo sapiens
gaggacagtgtgatctgccagc

SEQ ID NO: 7526262 - DNA, 22 bp, Homo sapiens
gaggacagtgtgatctgccagc

SEQ ID NO: 7526263 - DNA, 22 bp, Homo sapiens
gaggacagtgtgatctgccagc

SEQ ID NO: 7526264 - DNA, 22 bp, Homo sapiens
gaggacagtgtgatctgccagc

SEQ ID NO: 7526265 - DNA, 22 bp, Homo sapiens
gaggacagtgtgatctgccagc

SEQ ID NO: 7526266 - DNA, 22 bp, Homo sapiens
gaggacagtgtgatctgccagc

SEQ ID NO: 7526267 - DNA, 22 bp, Homo sapiens
gaggacagtgtgatctgccagc

SEQ ID NO: 7526268 - DNA, 17 bp, Homo sapiens
gaggacagggaagtagg

SEQ ID NO: 7526269 - DNA, 17 bp, Homo sapiens
gaggacagggaagtagg

SEQ ID NO: 7526270 - DNA, 17 bp, Homo sapiens
gaggacagggaagtagg

SEQ ID NO: 7526271 - DNA, 17 bp, Homo sapiens
gaggacagggaagtagg

SEQ ID NO: 7526272 - DNA, 22 bp, Homo sapiens
gaggacagtgtgatctgccagc

SEQ ID NO: 7526273 - DNA, 22 bp, Homo sapiens
gaggacagtgtgatctgccagc

SEQ ID NO: 7526274 - DNA, 22 bp, Homo sapiens
gaggacagtgtgatctgccagc

SEQ ID NO: 7526275 - DNA, 22 bp, Homo sapiens
gaggacatagtccagatggcaa

SEQ ID NO: 7526276 - DNA, 22 bp, Homo sapiens
gaggacatagtggactagggtt

SEQ ID NO: 7526277 - DNA, 23 bp, Homo sapiens
gaggaccaaatatatacatggaa

SEQ ID NO: 7526278 - DNA, 22 bp, Homo sapiens
gaggacatagtccagatggcaa

SEQ ID NO: 7526279 - DNA, 22 bp, Homo sapiens
gaggacatagtggactagggtt

SEQ ID NO: 7526280 - DNA, 22 bp, Homo sapiens
gaggaccacagatgagcctgca

SEQ ID NO: 7526281 - DNA, 22 bp, Homo sapiens
gaggaccacagatgagcctgca

SEQ ID NO: 7526282 - DNA, 22 bp, Homo sapiens
gaggaccacagatgagcctgca

SEQ ID NO: 7526283 - DNA, 22 bp, Homo sapiens
gaggaccacagatgagcctgca

SEQ ID NO: 7526284 - DNA, 22 bp, Homo sapiens
gaggaccacagatgagcctgca

SEQ ID NO: 7526285 - DNA, 22 bp, Homo sapiens
gaggactctgcaggctgctcct

SEQ ID NO: 7526286 - DNA, 22 bp, Homo sapiens
gaggactctgcaggctgctcct

SEQ ID NO: 7526287 - DNA, 22 bp, Homo sapiens
gaggacctttagtagaagtgca

SEQ ID NO: 7526288 - DNA, 22 bp, Homo sapiens
gaggacctttagtagaagtgca

SEQ ID NO: 7526289 - DNA, 22 bp, Homo sapiens
gaggacgggcttcatggggcct

SEQ ID NO: 7526290 - DNA, 22 bp, Homo sapiens
gaggaccacagatgagcctgca

SEQ ID NO: 7526291 - DNA, 22 bp, Homo sapiens
gaggacctggaatccaagagtc

SEQ ID NO: 7526292 - DNA, 22 bp, Homo sapiens
gaggagagaacattcctccata

SEQ ID NO: 7526293 - DNA, 22 bp, Homo sapiens
gaggagagaacattcctccata

SEQ ID NO: 7526294 - DNA, 22 bp, Homo sapiens
gaggagagaagctaacggtgct

SEQ ID NO: 7526295 - DNA, 22 bp, Homo sapiens
gaggagagaagctaacggtgct

SEQ ID NO: 7526296 - DNA, 22 bp, Homo sapiens
gaggagagaagctaacggtgct

SEQ ID NO: 7526297 - DNA, 22 bp, Homo sapiens
gaggagagaagctaacggtgct

SEQ ID NO: 7526298 - DNA, 22 bp, Homo sapiens
gaggagagaagctaacggtgct

SEQ ID NO: 7526299 - DNA, 22 bp, Homo sapiens
gaggagactgacagcagattct

SEQ ID NO: 7526300 - DNA, 22 bp, Homo sapiens
gaggagactgacagcagattct

SEQ ID NO: 7526301 - DNA, 22 bp, Homo sapiens
gaggagacatatttttgaagca

SEQ ID NO: 7526302 - DNA, 22 bp, Homo sapiens
gaggagacggggtgcctggagc

SEQ ID NO: 7526303 - DNA, 22 bp, Homo sapiens
gaggagagaacattcctccata

SEQ ID NO: 7526304 - DNA, 22 bp, Homo sapiens
gaggagagaacattcctccata

SEQ ID NO: 7526305 - DNA, 22 bp, Homo sapiens
gaggagactgacagcagattct

SEQ ID NO: 7526306 - DNA, 22 bp, Homo sapiens
gaggagagaacattcctccata

SEQ ID NO: 7526307 - DNA, 22 bp, Homo sapiens
gaggagacatatttttgaagca

SEQ ID NO: 7526308 - DNA, 22 bp, Homo sapiens
gaggagacggggtgcctggagc

SEQ ID NO: 7526309 - DNA, 22 bp, Homo sapiens
gaggagacggggtgcctggagc

SEQ ID NO: 7526310 - DNA, 22 bp, Homo sapiens
gaggagacatatttttgaagca

SEQ ID NO: 7526311 - DNA, 22 bp, Homo sapiens
gaggagacatatttttgaagca

SEQ ID NO: 7526312 - DNA, 22 bp, Homo sapiens
gaggagaaagcagtgatttgtg

SEQ ID NO: 7526313 - DNA, 22 bp, Homo sapiens
gaggagaaagcagtgatttgtg

SEQ ID NO: 7526314 - DNA, 22 bp, Homo sapiens
gaggactgcagatgggtgcatc

SEQ ID NO: 7526315 - DNA, 22 bp, Homo sapiens
gaggagaaattatccttggtgt

SEQ ID NO: 7526316 - DNA, 22 bp, Homo sapiens
gaggagacagtggagccgctac

SEQ ID NO: 7526317 - DNA, 22 bp, Homo sapiens
gaggagacagtggagccgctac

SEQ ID NO: 7526318 - DNA, 22 bp, Homo sapiens
gaggactgaaacttacaggaaa

SEQ ID NO: 7526319 - DNA, 22 bp, Homo sapiens
gaggactgaaacttacaggaaa

SEQ ID NO: 7526320 - DNA, 22 bp, Homo sapiens
gaggactgaaacttacaggaaa

SEQ ID NO: 7526321 - DNA, 21 bp, Homo sapiens
gaggactgcacactctgattg

SEQ ID NO: 7526322 - DNA, 22 bp, Homo sapiens
gaggagaaagcagtgatttgtg

SEQ ID NO: 7526323 - DNA, 22 bp, Homo sapiens
gaggactgcagatgggtgcatc

SEQ ID NO: 7526324 - DNA, 22 bp, Homo sapiens
gaggactgcagatgggtgcatc

SEQ ID NO: 7526325 - DNA, 21 bp, Homo sapiens
gaggactgcacactctgattg

SEQ ID NO: 7526326 - DNA, 21 bp, Homo sapiens
gaggactgcacactctgattg

SEQ ID NO: 7526327 - DNA, 22 bp, Homo sapiens
gaggactgcagatgggtgcatc

SEQ ID NO: 7526328 - DNA, 18 bp, Homo sapiens
gaggatggaaggagatgc

SEQ ID NO: 7526329 - DNA, 22 bp, Homo sapiens
gaggatggaggcagttagggcc

SEQ ID NO: 7526330 - DNA, 22 bp, Homo sapiens
gaggatggaggcagttagggcc

SEQ ID NO: 7526331 - DNA, 22 bp, Homo sapiens
gaggatggaggcagttagggcc

SEQ ID NO: 7526332 - DNA, 22 bp, Homo sapiens
gaggatggaggcagttagggcc

SEQ ID NO: 7526333 - DNA, 22 bp, Homo sapiens
gaggatggaggcagttagggcc

SEQ ID NO: 7526334 - DNA, 18 bp, Homo sapiens
gaggatggaaggagatgc

SEQ ID NO: 7526335 - DNA, 18 bp, Homo sapiens
gaggatggaaggagatgc

SEQ ID NO: 7526336 - DNA, 18 bp, Homo sapiens
gaggatggaaggagatgc

SEQ ID NO: 7526337 - DNA, 18 bp, Homo sapiens
gaggatggaaggagatgc

SEQ ID NO: 7526338 - DNA, 18 bp, Homo sapiens
gaggatggaaggagatgc

SEQ ID NO: 7526339 - DNA, 18 bp, Homo sapiens
gaggatggaaggagatgc

SEQ ID NO: 7526340 - DNA, 18 bp, Homo sapiens
gaggatggaaggagatgc

SEQ ID NO: 7526341 - DNA, 18 bp, Homo sapiens
gaggatggaaggagatgc

SEQ ID NO: 7526342 - DNA, 18 bp, Homo sapiens
gaggatggaaggagatgc

SEQ ID NO: 7526343 - DNA, 18 bp, Homo sapiens
gaggatggaaggagatgc

SEQ ID NO: 7526344 - DNA, 18 bp, Homo sapiens
gaggatggaaggagatgc

SEQ ID NO: 7526345 - DNA, 22 bp, Homo sapiens
gaggagtggagttgctgggttg

SEQ ID NO: 7526346 - DNA, 22 bp, Homo sapiens
gaggagtgggttagtgcttatt

SEQ ID NO: 7526347 - DNA, 22 bp, Homo sapiens
gaggagtgggttagtgcttatt

SEQ ID NO: 7526348 - DNA, 22 bp, Homo sapiens
gaggagtgtattccacaccact

SEQ ID NO: 7526349 - DNA, 18 bp, Homo sapiens
gaggatcagaaatctgta

SEQ ID NO: 7526350 - DNA, 22 bp, Homo sapiens
gaggagtgggttagtgcttatt

SEQ ID NO: 7526351 - DNA, 22 bp, Homo sapiens
gaggagtgtattccacaccact

SEQ ID NO: 7526352 - DNA, 22 bp, Homo sapiens
gaggagtgtattccacaccact

SEQ ID NO: 7526353 - DNA, 22 bp, Homo sapiens
gaggagtgtattccacaccact

SEQ ID NO: 7526354 - DNA, 22 bp, Homo sapiens
gaggatgctgcagtgcaggaca

SEQ ID NO: 7526355 - DNA, 22 bp, Homo sapiens
gaggatgctgcagtgcaggaca

SEQ ID NO: 7526356 - DNA, 22 bp, Homo sapiens
gaggatgctgcagtgcaggaca

SEQ ID NO: 7526357 - DNA, 22 bp, Homo sapiens
gaggatgcctgggtcggggaag

SEQ ID NO: 7526358 - DNA, 19 bp, Homo sapiens
gaggatgctcggtcccagg

SEQ ID NO: 7526359 - DNA, 19 bp, Homo sapiens
gaggatgctcggtcccagg

SEQ ID NO: 7526360 - DNA, 20 bp, Homo sapiens
gaggatgcagacagagggca

SEQ ID NO: 7526361 - DNA, 20 bp, Homo sapiens
gaggatgcagacagagggca

SEQ ID NO: 7526362 - DNA, 22 bp, Homo sapiens
gaggatcatttgagcctaggag

SEQ ID NO: 7526363 - DNA, 20 bp, Homo sapiens
gaggatgcagacagagggca

SEQ ID NO: 7526364 - DNA, 22 bp, Homo sapiens
gaggagtgccagccgtggagtc

SEQ ID NO: 7526365 - DNA, 22 bp, Homo sapiens
gaggagtgccagccgtggagtc

SEQ ID NO: 7526366 - DNA, 22 bp, Homo sapiens
gaggagtgccagccgtggagtc

SEQ ID NO: 7526367 - DNA, 22 bp, Homo sapiens
gaggagtgccagccgtggagtc

SEQ ID NO: 7526368 - DNA, 22 bp, Homo sapiens
gaggagtctttttagggcctga

SEQ ID NO: 7526369 - DNA, 22 bp, Homo sapiens
gaggagtgccagccgtggagtc

SEQ ID NO: 7526370 - DNA, 22 bp, Homo sapiens
gaggagtgccagccgtggagtc

SEQ ID NO: 7526371 - DNA, 22 bp, Homo sapiens
gaggagtggagttgctgggttg

SEQ ID NO: 7526372 - DNA, 22 bp, Homo sapiens
gaggagtggagttgctgggttg

SEQ ID NO: 7526373 - DNA, 22 bp, Homo sapiens
gaggagtgccagccgtggagtc

SEQ ID NO: 7526374 - DNA, 22 bp, Homo sapiens
gaggagtgccagccgtggagtc

SEQ ID NO: 7526375 - DNA, 22 bp, Homo sapiens
gaggagtctttttagggcctga

SEQ ID NO: 7526376 - DNA, 22 bp, Homo sapiens
gaggagtctttccctaagtcct

SEQ ID NO: 7526377 - DNA, 22 bp, Homo sapiens
gaggagtctttccctaagtcct

SEQ ID NO: 7526378 - DNA, 22 bp, Homo sapiens
gaggagtctttttagggcctga

SEQ ID NO: 7526379 - DNA, 22 bp, Homo sapiens
gaggaggttgacggcactgtga

SEQ ID NO: 7526380 - DNA, 22 bp, Homo sapiens
gaggaggttccgggtggagaag

SEQ ID NO: 7526381 - DNA, 22 bp, Homo sapiens
gaggagtctagtttatggcttc

SEQ ID NO: 7526382 - DNA, 22 bp, Homo sapiens
gaggaggttgacggcactgtga

SEQ ID NO: 7526383 - DNA, 22 bp, Homo sapiens
gaggagtctagtttatggcttc

SEQ ID NO: 7526384 - DNA, 20 bp, Homo sapiens
gaggagtcttgtagaaaatg

SEQ ID NO: 7526385 - DNA, 22 bp, Homo sapiens
gaggagagagggactgtctgca

SEQ ID NO: 7526386 - DNA, 22 bp, Homo sapiens
gaggagagagggactgtctgca

SEQ ID NO: 7526387 - DNA, 22 bp, Homo sapiens
gaggagagagggactgtctgca

SEQ ID NO: 7526388 - DNA, 22 bp, Homo sapiens
gaggagagagggactgtctgca

SEQ ID NO: 7526389 - DNA, 22 bp, Homo sapiens
gaggagagaagctaacggtgct

SEQ ID NO: 7526390 - DNA, 22 bp, Homo sapiens
gaggaggtggagtcatgcagag

SEQ ID NO: 7526391 - DNA, 22 bp, Homo sapiens
gaggaggtggagtcatgcagag

SEQ ID NO: 7526392 - DNA, 22 bp, Homo sapiens
gaggaggttccgggtggagaag

SEQ ID NO: 7526393 - DNA, 22 bp, Homo sapiens
gaggaggttccgggtggagaag

SEQ ID NO: 7526394 - DNA, 22 bp, Homo sapiens
gaggaggttccgggtggagaag

SEQ ID NO: 7526395 - DNA, 22 bp, Homo sapiens
gaggaggttccgggtggagaag

SEQ ID NO: 7526396 - DNA, 23 bp, Homo sapiens
ttataaatattttcaggtgtgtt

SEQ ID NO: 7526397 - DNA, 23 bp, Homo sapiens
ttataaatattttcaggtgtgtt

SEQ ID NO: 7526398 - DNA, 23 bp, Homo sapiens
ttataaatattttcaggtgtgtt

SEQ ID NO: 7526399 - DNA, 23 bp, Homo sapiens
ttataaatattttcaggtgtgtt

SEQ ID NO: 7526400 - DNA, 22 bp, Homo sapiens
ttataacaacagtttactttaa

SEQ ID NO: 7526401 - DNA, 23 bp, Homo sapiens
ttataaatattttcaggtgtgtt

SEQ ID NO: 7526402 - DNA, 23 bp, Homo sapiens
ttataaatattttcaggtgtgtt

SEQ ID NO: 7526403 - DNA, 23 bp, Homo sapiens
ttataaatattttcaggtgtgtt

SEQ ID NO: 7526404 - DNA, 23 bp, Homo sapiens
ttataaatattttcaggtgtgtt

SEQ ID NO: 7526405 - DNA, 23 bp, Homo sapiens
ttataaatattttcaggtgtgtt

SEQ ID NO: 7526406 - DNA, 23 bp, Homo sapiens
ttataaatattttcaggtgtgtt

SEQ ID NO: 7526407 - DNA, 23 bp, Homo sapiens
ttataaatattttcaggtgtgtt

SEQ ID NO: 7526408 - DNA, 22 bp, Homo sapiens
ttataaaggtttgtgcatattt

SEQ ID NO: 7526409 - DNA, 22 bp, Homo sapiens
ttataaaggtttgtgcatattt

SEQ ID NO: 7526410 - DNA, 22 bp, Homo sapiens
ttataaagtgagaagtgctatg

SEQ ID NO: 7526411 - DNA, 22 bp, Homo sapiens
ttataaagtgagaagtgctatg

SEQ ID NO: 7526412 - DNA, 22 bp, Homo sapiens
ttataaagtgagaagtgctatg

SEQ ID NO: 7526413 - DNA, 22 bp, Homo sapiens
ttataacatcaatcagagttaa

SEQ ID NO: 7526414 - DNA, 22 bp, Homo sapiens
ttataacactgccttgtcacca

SEQ ID NO: 7526415 - DNA, 22 bp, Homo sapiens
ttataacactgccttgtcacca

SEQ ID NO: 7526416 - DNA, 22 bp, Homo sapiens
ttataacactgccttgtcacca

SEQ ID NO: 7526417 - DNA, 22 bp, Homo sapiens
ttataacactgccttgtcacca

SEQ ID NO: 7526418 - DNA, 22 bp, Homo sapiens
ttataacaacagtttactttaa

SEQ ID NO: 7526419 - DNA, 22 bp, Homo sapiens
ttataacaacagtttactttaa

SEQ ID NO: 7526420 - DNA, 22 bp, Homo sapiens
ttataactttggatatgacaag

SEQ ID NO: 7526421 - DNA, 22 bp, Homo sapiens
ttataacattataaagtggaga

SEQ ID NO: 7526422 - DNA, 22 bp, Homo sapiens
ttataactttggatatgacaag

SEQ ID NO: 7526423 - DNA, 22 bp, Homo sapiens
ttataactttggatatgacaag

SEQ ID NO: 7526424 - DNA, 22 bp, Homo sapiens
ttatattagttagacttgctgt

SEQ ID NO: 7526425 - DNA, 22 bp, Homo sapiens
ttataacatcaatcagagttaa

SEQ ID NO: 7526426 - DNA, 22 bp, Homo sapiens
ttataacatcaatcagagttaa

SEQ ID NO: 7526427 - DNA, 22 bp, Homo sapiens
ttataacatcaatcagagttaa

SEQ ID NO: 7526428 - DNA, 22 bp, Homo sapiens
ttatcatgacttcaagcatcca

SEQ ID NO: 7526429 - DNA, 22 bp, Homo sapiens
ttatcatctcctgctgtggtta

SEQ ID NO: 7526430 - DNA, 22 bp, Homo sapiens
ttatcacttatgagctttttgc

SEQ ID NO: 7526431 - DNA, 22 bp, Homo sapiens
ttatcatctcctgctgtggtta

SEQ ID NO: 7526432 - DNA, 22 bp, Homo sapiens
ttatcattgtcgcagtctaatt

SEQ ID NO: 7526433 - DNA, 22 bp, Homo sapiens
ttatcatgacaggatgatagaa

SEQ ID NO: 7526434 - DNA, 22 bp, Homo sapiens
ttatcatgggacctgaatttta

SEQ ID NO: 7526435 - DNA, 22 bp, Homo sapiens
ttatccaaactggtgaatcatt

SEQ ID NO: 7526436 - DNA, 22 bp, Homo sapiens
ttatcattgtcgcagtctaatt

SEQ ID NO: 7526437 - DNA, 22 bp, Homo sapiens
ttatccaaactggtgaatcatt

SEQ ID NO: 7526438 - DNA, 22 bp, Homo sapiens
ttatcattgtcgcagtctaatt

SEQ ID NO: 7526439 - DNA, 22 bp, Homo sapiens
ttatcattgtcgcagtctaatt

SEQ ID NO: 7526440 - DNA, 22 bp, Homo sapiens
ttatcataagtaattgaaataa

SEQ ID NO: 7526441 - DNA, 22 bp, Homo sapiens
ttatcataagtaattgaaataa

SEQ ID NO: 7526442 - DNA, 22 bp, Homo sapiens
ttatcataagtaattgaaataa

SEQ ID NO: 7526443 - DNA, 22 bp, Homo sapiens
ttatcagttgtgtgtatacacg

SEQ ID NO: 7526444 - DNA, 22 bp, Homo sapiens
ttatcagttgtgtgtatacacg

SEQ ID NO: 7526445 - DNA, 22 bp, Homo sapiens
ttatcagtcggcttaggttatg

SEQ ID NO: 7526446 - DNA, 22 bp, Homo sapiens
ttatcagttgtgtgtatacacg

SEQ ID NO: 7526447 - DNA, 22 bp, Homo sapiens
ttatcagagtccccaaaagaaa

SEQ ID NO: 7526448 - DNA, 22 bp, Homo sapiens
ttatcagagtccccaaaagaaa

SEQ ID NO: 7526449 - DNA, 22 bp, Homo sapiens
ttatatttctggtagccttcag

SEQ ID NO: 7526450 - DNA, 22 bp, Homo sapiens
ttataacattataaagtggaga

SEQ ID NO: 7526451 - DNA, 22 bp, Homo sapiens
ttatatttctggtagccttcag

SEQ ID NO: 7526452 - DNA, 22 bp, Homo sapiens
ttatatttctggtagccttcag

SEQ ID NO: 7526453 - DNA, 22 bp, Homo sapiens
ttatcacttatgagctttttgc

SEQ ID NO: 7526454 - DNA, 22 bp, Homo sapiens
ttatcacttatgagctttttgc

SEQ ID NO: 7526455 - DNA, 22 bp, Homo sapiens
ttatcaactagtttaggtttga

SEQ ID NO: 7526456 - DNA, 22 bp, Homo sapiens
ttatcaactagtttaggtttga

SEQ ID NO: 7526457 - DNA, 22 bp, Homo sapiens
ttatcaagggagaaacaggagg

SEQ ID NO: 7526458 - DNA, 22 bp, Homo sapiens
ttatcaagggagaaacaggagg

SEQ ID NO: 7526459 - DNA, 22 bp, Homo sapiens
ttatattgggtctggtatcagg

SEQ ID NO: 7526460 - DNA, 22 bp, Homo sapiens
ttatattgggtctggtatcagg

SEQ ID NO: 7526461 - DNA, 22 bp, Homo sapiens
ttatattagttagacttgctgt

SEQ ID NO: 7526462 - DNA, 22 bp, Homo sapiens
ttatattgtgtaataagtgaag

SEQ ID NO: 7526463 - DNA, 22 bp, Homo sapiens
ttatattgtgtaataagtgaag

SEQ ID NO: 7526464 - DNA, 22 bp, Homo sapiens
ttatatttctggtagccttcag

SEQ ID NO: 7526465 - DNA, 22 bp, Homo sapiens
ttatatttctggtagccttcag

SEQ ID NO: 7526466 - DNA, 22 bp, Homo sapiens
ttatatttctggtagccttcag

SEQ ID NO: 7526467 - DNA, 22 bp, Homo sapiens
ttatatttctggtagccttcag

SEQ ID NO: 7526468 - DNA, 22 bp, Homo sapiens
ccttgattcctaagagggggca

SEQ ID NO: 7526469 - DNA, 22 bp, Homo sapiens
ccttgcagacatcagtagtggc

SEQ ID NO: 7526470 - DNA, 22 bp, Homo sapiens
ccttgaggagtccatagtatca

SEQ ID NO: 7526471 - DNA, 21 bp, Homo sapiens
ccttgaggcccaggccaggcc

SEQ ID NO: 7526472 - DNA, 21 bp, Homo sapiens
ccttgaggcccaggccaggcc

SEQ ID NO: 7526473 - DNA, 22 bp, Homo sapiens
ccttgagttgaattaatggtgg

SEQ ID NO: 7526474 - DNA, 20 bp, Homo sapiens
ccttgatcttggacttccag

SEQ ID NO: 7526475 - DNA, 22 bp, Homo sapiens
ccttgagccagggagctggcag

SEQ ID NO: 7526476 - DNA, 22 bp, Homo sapiens
ccttgagccagggagctggcag

SEQ ID NO: 7526477 - DNA, 22 bp, Homo sapiens
ccttgagccagggagctggcag

SEQ ID NO: 7526478 - DNA, 22 bp, Homo sapiens
ccttgaaatgttctcactgggg

SEQ ID NO: 7526479 - DNA, 22 bp, Homo sapiens
ccttgaaatgttctcactgggg

SEQ ID NO: 7526480 - DNA, 22 bp, Homo sapiens
ccttgaatctctgctctagaac

SEQ ID NO: 7526481 - DNA, 22 bp, Homo sapiens
ccttgactgccttcaggctggg

SEQ ID NO: 7526482 - DNA, 22 bp, Homo sapiens
ccttgactgccttcaggctggg

SEQ ID NO: 7526483 - DNA, 22 bp, Homo sapiens
ccttgaaatgttctcactgggg

SEQ ID NO: 7526484 - DNA, 22 bp, Homo sapiens
ccttgactgtaatggagtaggg

SEQ ID NO: 7526485 - DNA, 22 bp, Homo sapiens
ccttgagaggaagtttgtagaa

SEQ ID NO: 7526486 - DNA, 22 bp, Homo sapiens
ccttgagatgagctaatttttt

SEQ ID NO: 7526487 - DNA, 22 bp, Homo sapiens
ccttgcagctgattatttttca

SEQ ID NO: 7526488 - DNA, 22 bp, Homo sapiens
ccttgcagggaaactggaccca

SEQ ID NO: 7526489 - DNA, 22 bp, Homo sapiens
ccttgcagggaaactggaccca

SEQ ID NO: 7526490 - DNA, 22 bp, Homo sapiens
ccttgcagcatatagagtccct

SEQ ID NO: 7526491 - DNA, 22 bp, Homo sapiens
ccttgcaggggaacaggcagtg

SEQ ID NO: 7526492 - DNA, 22 bp, Homo sapiens
ccttgcaggggaacaggcagtg

SEQ ID NO: 7526493 - DNA, 22 bp, Homo sapiens
ccttgcagagcataggagccct

SEQ ID NO: 7526494 - DNA, 22 bp, Homo sapiens
ccttgcagcatatagagtccct

SEQ ID NO: 7526495 - DNA, 22 bp, Homo sapiens
ccttgcagacatcagtagtggc

SEQ ID NO: 7526496 - DNA, 22 bp, Homo sapiens
ccttgcagagcataggagccct

SEQ ID NO: 7526497 - DNA, 22 bp, Homo sapiens
ccttgcagagcataggagccct

SEQ ID NO: 7526498 - DNA, 22 bp, Homo sapiens
ccttgccccatctgggaatccc

SEQ ID NO: 7526499 - DNA, 20 bp, Homo sapiens
ccttgccagtagggctggga

SEQ ID NO: 7526500 - DNA, 22 bp, Homo sapiens
ccttgcaggggaacaggcagtg

SEQ ID NO: 7526501 - DNA, 22 bp, Homo sapiens
ccttgcagttgttactgtagcc

SEQ ID NO: 7526502 - DNA, 22 bp, Homo sapiens
ccttgcagttgttactgtagcc

SEQ ID NO: 7526503 - DNA, 22 bp, Homo sapiens
ttataaagatccttccagagtt

SEQ ID NO: 7526504 - DNA, 22 bp, Homo sapiens
ttataaacttgccaagaaggag

SEQ ID NO: 7526505 - DNA, 22 bp, Homo sapiens
ttagttttctcatctatctcac

SEQ ID NO: 7526506 - DNA, 22 bp, Homo sapiens
ttagttttctcatctatctcac

SEQ ID NO: 7526507 - DNA, 22 bp, Homo sapiens
ttagttttcccatctttatggt

SEQ ID NO: 7526508 - DNA, 22 bp, Homo sapiens
ttagttttcccatctttatggt

SEQ ID NO: 7526509 - DNA, 22 bp, Homo sapiens
ttagttttcccatctttatggt

SEQ ID NO: 7526510 - DNA, 22 bp, Homo sapiens
ttagttttcccatctttatggt

SEQ ID NO: 7526511 - DNA, 22 bp, Homo sapiens
ttagttttctcatctatctcac

SEQ ID NO: 7526512 - DNA, 22 bp, Homo sapiens
ttagttttctcatctatctcac

SEQ ID NO: 7526513 - DNA, 22 bp, Homo sapiens
ttataaaggtttgtgcatattt

SEQ ID NO: 7526514 - DNA, 22 bp, Homo sapiens
ttataaaggtttgtgcatattt

SEQ ID NO: 7526515 - DNA, 22 bp, Homo sapiens
ttataaagattgttatgtatct

SEQ ID NO: 7526516 - DNA, 22 bp, Homo sapiens
ttataaagattgttatgtatct

SEQ ID NO: 7526517 - DNA, 22 bp, Homo sapiens
ttataaagatccttccagagtt

SEQ ID NO: 7526518 - DNA, 22 bp, Homo sapiens
ttataaagatccttccagagtt

SEQ ID NO: 7526519 - DNA, 22 bp, Homo sapiens
ttataaagattgttatgtatct

SEQ ID NO: 7526520 - DNA, 22 bp, Homo sapiens
ttataaagattgttatgtatct

SEQ ID NO: 7526521 - DNA, 22 bp, Homo sapiens
ttagttttcccatctttatggt

SEQ ID NO: 7526522 - DNA, 22 bp, Homo sapiens
ttagtttataattcatttctgt

SEQ ID NO: 7526523 - DNA, 22 bp, Homo sapiens
ttagtttccaccacacatgttc

SEQ ID NO: 7526524 - DNA, 22 bp, Homo sapiens
ttagggaaataaaattatcagt

SEQ ID NO: 7526525 - DNA, 22 bp, Homo sapiens
ttagggaaataaaattatcagt

SEQ ID NO: 7526526 - DNA, 22 bp, Homo sapiens
ttagggaaagcagcattccctt

SEQ ID NO: 7526527 - DNA, 22 bp, Homo sapiens
ttagggaaataaaattatcagt

SEQ ID NO: 7526528 - DNA, 22 bp, Homo sapiens
ccttgcccgctgcctctgagtt

SEQ ID NO: 7526529 - DNA, 22 bp, Homo sapiens
ccttgcccgctgcctctgagtt

SEQ ID NO: 7526530 - DNA, 22 bp, Homo sapiens
ccttgcccgctgcctctgagtt

SEQ ID NO: 7526531 - DNA, 22 bp, Homo sapiens
ttagggaaacaaacattttctt

SEQ ID NO: 7526532 - DNA, 22 bp, Homo sapiens
ccttgaaaccacatcttagaaa

SEQ ID NO: 7526533 - DNA, 22 bp, Homo sapiens
ccttgaaaccctgacactctgt

SEQ ID NO: 7526534 - DNA, 22 bp, Homo sapiens
ttagcactggatttcatcagaa

SEQ ID NO: 7526535 - DNA, 22 bp, Homo sapiens
ttagcactggattaatcaaagt

SEQ ID NO: 7526536 - DNA, 22 bp, Homo sapiens
ccttgaaagccaggcagaggaa

SEQ ID NO: 7526537 - DNA, 22 bp, Homo sapiens
ccttgaaagccaggcagaggaa

SEQ ID NO: 7526538 - DNA, 22 bp, Homo sapiens
ccttgaaagtatatgctcaatt

SEQ ID NO: 7526539 - DNA, 22 bp, Homo sapiens
ccttgaaagtatatgctcaatt

SEQ ID NO: 7526540 - DNA, 22 bp, Homo sapiens
ccttgaaaccctgacactctgt

SEQ ID NO: 7526541 - DNA, 22 bp, Homo sapiens
ccttgaaagccaggcagaggaa

SEQ ID NO: 7526542 - DNA, 22 bp, Homo sapiens
ccttgaaagtatatgctcaatt

SEQ ID NO: 7526543 - DNA, 22 bp, Homo sapiens
ccttgaaagtatatgctcaatt

SEQ ID NO: 7526544 - DNA, 22 bp, Homo sapiens
ccttgaaatgagaaaaagttgg

SEQ ID NO: 7526545 - DNA, 22 bp, Homo sapiens
ccttgaaagtatatgctcaatt

SEQ ID NO: 7526546 - DNA, 22 bp, Homo sapiens
ccttgaaagtatatgctcaatt

SEQ ID NO: 7526547 - DNA, 22 bp, Homo sapiens
ttagcaccctgatactagaatg

SEQ ID NO: 7526548 - DNA, 18 bp, Homo sapiens
ttagcacctatgtgggta

SEQ ID NO: 7526549 - DNA, 22 bp, Homo sapiens
ttagcacctcattcccaccttc

SEQ ID NO: 7526550 - DNA, 22 bp, Homo sapiens
ttagcaccttgaacagaccctg

SEQ ID NO: 7526551 - DNA, 22 bp, Homo sapiens
ttagcaccttaactgtggagat

SEQ ID NO: 7526552 - DNA, 22 bp, Homo sapiens
ttagcaccacacactttagagg

SEQ ID NO: 7526553 - DNA, 22 bp, Homo sapiens
ttagcaccagctatggatgtgc

SEQ ID NO: 7526554 - DNA, 22 bp, Homo sapiens
ttagcacccgggccagcggctg

SEQ ID NO: 7526555 - DNA, 22 bp, Homo sapiens
ttagcaagataacagtaatttt

SEQ ID NO: 7526556 - DNA, 21 bp, Homo sapiens
ttagcaagtctacccatttct

SEQ ID NO: 7526557 - DNA, 22 bp, Homo sapiens
ttagcaatatgaatgcatttgc

SEQ ID NO: 7526558 - DNA, 22 bp, Homo sapiens
ttagcaatatgaatgcatttgc

SEQ ID NO: 7526559 - DNA, 22 bp, Homo sapiens
ttagcaatatgaatgcatttgc

SEQ ID NO: 7526560 - DNA, 22 bp, Homo sapiens
ttagcaatcctaggctggatca

SEQ ID NO: 7526561 - DNA, 22 bp, Homo sapiens
ttagcaatcctaggctggatca

SEQ ID NO: 7526562 - DNA, 22 bp, Homo sapiens
ttagcaattccaggtaagttat

SEQ ID NO: 7526563 - DNA, 22 bp, Homo sapiens
ttagcaatgtatgattaaaata

SEQ ID NO: 7526564 - DNA, 22 bp, Homo sapiens
ttagcaatgtatgattaaaata

SEQ ID NO: 7526565 - DNA, 22 bp, Homo sapiens
ttagcaaatatcttgaaacagg

SEQ ID NO: 7526566 - DNA, 22 bp, Homo sapiens
ttagcaaatatcttgaaacagg

SEQ ID NO: 7526567 - DNA, 22 bp, Homo sapiens
ttagcaaatatcttgaaacagg

SEQ ID NO: 7526568 - DNA, 22 bp, Homo sapiens
ttagcaaatatcttgaaacagg

SEQ ID NO: 7526569 - DNA, 22 bp, Homo sapiens
ttagcaagaaagattgcagcac

SEQ ID NO: 7526570 - DNA, 22 bp, Homo sapiens
ttagcaaatttccaggtgatgc

SEQ ID NO: 7526571 - DNA, 22 bp, Homo sapiens
ttagcaaactctgttagattct

SEQ ID NO: 7526572 - DNA, 22 bp, Homo sapiens
ttagcaaactctgttagattct

SEQ ID NO: 7526573 - DNA, 22 bp, Homo sapiens
ttagcaaactctgttagattct

SEQ ID NO: 7526574 - DNA, 22 bp, Homo sapiens
ttagcaaactctgttagattct

SEQ ID NO: 7526575 - DNA, 22 bp, Homo sapiens
ttagcaaactctgttagattct

SEQ ID NO: 7526576 - DNA, 22 bp, Homo sapiens
ttagacatagaatattgtctag

SEQ ID NO: 7526577 - DNA, 22 bp, Homo sapiens
ttagacaggatgtatgaaagct

SEQ ID NO: 7526578 - DNA, 22 bp, Homo sapiens
ttagacagagctccttgagggc

SEQ ID NO: 7526579 - DNA, 22 bp, Homo sapiens
ttagacaggatgtatgaaagct

SEQ ID NO: 7526580 - DNA, 22 bp, Homo sapiens
ccttcagcgtcccctttacccg

SEQ ID NO: 7526581 - DNA, 18 bp, Homo sapiens
ccttcagctctgccagta

SEQ ID NO: 7526582 - DNA, 22 bp, Homo sapiens
ttagacagagctccttgagggc

SEQ ID NO: 7526583 - DNA, 18 bp, Homo sapiens
ccttcagctctgccagta

SEQ ID NO: 7526584 - DNA, 18 bp, Homo sapiens
ccttcagctctgccagta

SEQ ID NO: 7526585 - DNA, 18 bp, Homo sapiens
ccttcagctctgccagta

SEQ ID NO: 7526586 - DNA, 22 bp, Homo sapiens
ttagcaaatatcttgaaacagg

SEQ ID NO: 7526587 - DNA, 22 bp, Homo sapiens
ttagcaaatatcttgaaacagg

SEQ ID NO: 7526588 - DNA, 22 bp, Homo sapiens
ttagcaaatatcttgaaacagg

SEQ ID NO: 7526589 - DNA, 22 bp, Homo sapiens
ttagcaaatatcttgaaacagg

SEQ ID NO: 7526590 - DNA, 22 bp, Homo sapiens
ttagcaaatatcttgaaacagg

SEQ ID NO: 7526591 - DNA, 22 bp, Homo sapiens
ttagcaaagtttgccatctagt

SEQ ID NO: 7526592 - DNA, 22 bp, Homo sapiens
ttagcaaaggcccctacaccca

SEQ ID NO: 7526593 - DNA, 22 bp, Homo sapiens
ttagcaaaggcccctacaccca

SEQ ID NO: 7526594 - DNA, 22 bp, Homo sapiens
ttagcaaagtttgccatctagt

SEQ ID NO: 7526595 - DNA, 22 bp, Homo sapiens
ttagcaaagtttgccatctagt

SEQ ID NO: 7526596 - DNA, 22 bp, Homo sapiens
ttagcaaagtttgccatctagt

SEQ ID NO: 7526597 - DNA, 22 bp, Homo sapiens
ttagcaaagaagatgtgagttt

SEQ ID NO: 7526598 - DNA, 21 bp, Homo sapiens
ttagcaaagcaaacacatgct

SEQ ID NO: 7526599 - DNA, 22 bp, Homo sapiens
ttagcaaagaagatgtgagttt

SEQ ID NO: 7526600 - DNA, 21 bp, Homo sapiens
ttagcaaagcaaacacatgct

SEQ ID NO: 7526601 - DNA, 21 bp, Homo sapiens
ttagcaaagcaaacacatgct

SEQ ID NO: 7526602 - DNA, 21 bp, Homo sapiens
ttagcaaagcaaacacatgct

SEQ ID NO: 7526603 - DNA, 21 bp, Homo sapiens
ttagcaaagcaaacacatgct

SEQ ID NO: 7526604 - DNA, 21 bp, Homo sapiens
ttagcaaagcaaacacatgct

SEQ ID NO: 7526605 - DNA, 21 bp, Homo sapiens
ttagcaaagcaaacacatgct

SEQ ID NO: 7526606 - DNA, 22 bp, Homo sapiens
ccttcaaaacactagtttttga

SEQ ID NO: 7526607 - DNA, 22 bp, Homo sapiens
ttacatagttaaatagtacagc

SEQ ID NO: 7526608 - DNA, 22 bp, Homo sapiens
ccttcaaactttcattaaccag

SEQ ID NO: 7526609 - DNA, 22 bp, Homo sapiens
ttacataggtatgtttgctttg

SEQ ID NO: 7526610 - DNA, 22 bp, Homo sapiens
ccttcaaattctcttagctgaa

SEQ ID NO: 7526611 - DNA, 22 bp, Homo sapiens
ccttcaaagtacacatctttat

SEQ ID NO: 7526612 - DNA, 22 bp, Homo sapiens
ttacataactttaaaatgccgt

SEQ ID NO: 7526613 - DNA, 22 bp, Homo sapiens
ttacatacaaaggctgggttat

SEQ ID NO: 7526614 - DNA, 22 bp, Homo sapiens
ttacatacaaaggctgggttat

SEQ ID NO: 7526615 - DNA, 22 bp, Homo sapiens
ttacatacctcatagactcagg

SEQ ID NO: 7526616 - DNA, 22 bp, Homo sapiens
ttacatacctcatagactcagg

SEQ ID NO: 7526617 - DNA, 22 bp, Homo sapiens
ttacatacttactagatctatg

SEQ ID NO: 7526618 - DNA, 22 bp, Homo sapiens
ttacatagattcatttagttaa

SEQ ID NO: 7526619 - DNA, 22 bp, Homo sapiens
ttacatacttactagatctatg

SEQ ID NO: 7526620 - DNA, 22 bp, Homo sapiens
ttacatacttactagatctatg

SEQ ID NO: 7526621 - DNA, 22 bp, Homo sapiens
ttacatacctcatagactcagg

SEQ ID NO: 7526622 - DNA, 22 bp, Homo sapiens
ttacataacggtatgaaaaatg

SEQ ID NO: 7526623 - DNA, 22 bp, Homo sapiens
ttacataacggtatgaaaaatg

SEQ ID NO: 7526624 - DNA, 22 bp, Homo sapiens
ttacataacggtatgaaaaatg

SEQ ID NO: 7526625 - DNA, 22 bp, Homo sapiens
ttacataacggtatgaaaaatg

SEQ ID NO: 7526626 - DNA, 22 bp, Homo sapiens
ttacataacggtatgaaaaatg

SEQ ID NO: 7526627 - DNA, 22 bp, Homo sapiens
ttacataacggtatgaaaaatg

SEQ ID NO: 7526628 - DNA, 22 bp, Homo sapiens
ttacataacggtatgaaaaatg

SEQ ID NO: 7526629 - DNA, 22 bp, Homo sapiens
ttacataactttaaaatgccgt

SEQ ID NO: 7526630 - DNA, 22 bp, Homo sapiens
ttacataactttaaaatgccgt

SEQ ID NO: 7526631 - DNA, 22 bp, Homo sapiens
ttacataaaagttcacgtaggc

SEQ ID NO: 7526632 - DNA, 22 bp, Homo sapiens
ttacataaaagttcacgtaggc

SEQ ID NO: 7526633 - DNA, 22 bp, Homo sapiens
ttacataaaagttcacgtaggc

SEQ ID NO: 7526634 - DNA, 22 bp, Homo sapiens
ttacagtttctagtaatacttg

SEQ ID NO: 7526635 - DNA, 22 bp, Homo sapiens
ttacagtttctagtaatacttg

SEQ ID NO: 7526636 - DNA, 22 bp, Homo sapiens
ttacagtttatccaggaagagc

SEQ ID NO: 7526637 - DNA, 22 bp, Homo sapiens
ccttcaaatttagaacaagtga

SEQ ID NO: 7526638 - DNA, 22 bp, Homo sapiens
ccttcaaatttagaacaagtga

SEQ ID NO: 7526639 - DNA, 22 bp, Homo sapiens
ccttcaaatttagaacaagtga

SEQ ID NO: 7526640 - DNA, 22 bp, Homo sapiens
ccttcaagttcctggtccctgg

SEQ ID NO: 7526641 - DNA, 22 bp, Homo sapiens
ccttcaatcagcagtctagctt

SEQ ID NO: 7526642 - DNA, 20 bp, Homo sapiens
ccttcagaacttacatagta

SEQ ID NO: 7526643 - DNA, 20 bp, Homo sapiens
ccttcagaacttacatagta

SEQ ID NO: 7526644 - DNA, 22 bp, Homo sapiens
ccttcacaccatctttaccagg

SEQ ID NO: 7526645 - DNA, 22 bp, Homo sapiens
ccttcacactttcacttggata

SEQ ID NO: 7526646 - DNA, 20 bp, Homo sapiens
ccttcagaacttacatagta

SEQ ID NO: 7526647 - DNA, 22 bp, Homo sapiens
ccttcacaccatctttaccagg

SEQ ID NO: 7526648 - DNA, 22 bp, Homo sapiens
ccttcacactttcacttggata

SEQ ID NO: 7526649 - DNA, 22 bp, Homo sapiens
ccttcacacaggtagaagcaga

SEQ ID NO: 7526650 - DNA, 22 bp, Homo sapiens
ccttcacacaggtagaagcaga

SEQ ID NO: 7526651 - DNA, 22 bp, Homo sapiens
ccttcaatcttaagtcagccca

SEQ ID NO: 7526652 - DNA, 22 bp, Homo sapiens
ccttcaatcttaagtcagccca

SEQ ID NO: 7526653 - DNA, 22 bp, Homo sapiens
ccttcagacctagacaggaatc

SEQ ID NO: 7526654 - DNA, 22 bp, Homo sapiens
ccttcagaggtgtagattgcgt

SEQ ID NO: 7526655 - DNA, 22 bp, Homo sapiens
ccttcagaatgaaattctaatg

SEQ ID NO: 7526656 - DNA, 23 bp, Homo sapiens
ccttcagaagaagtaacaggggc

SEQ ID NO: 7526657 - DNA, 22 bp, Homo sapiens
ccttcagaatgaaattctaatg

SEQ ID NO: 7526658 - DNA, 23 bp, Homo sapiens
ccttcagaagaagtaacaggggc

SEQ ID NO: 7526659 - DNA, 23 bp, Homo sapiens
ccttcagaagaagtaacaggggc

SEQ ID NO: 7526660 - DNA, 22 bp, Homo sapiens
ccttcagaggtgtagattgcgt

SEQ ID NO: 7526661 - DNA, 20 bp, Homo sapiens
ccttcagatgactttttcag

SEQ ID NO: 7526662 - DNA, 22 bp, Homo sapiens
ccttcagccagttttctttgtt

SEQ ID NO: 7526663 - DNA, 22 bp, Homo sapiens
ccttcagccttcatccttcctt

SEQ ID NO: 7526664 - DNA, 22 bp, Homo sapiens
ccttcagcctcaagatccttca

SEQ ID NO: 7526665 - DNA, 22 bp, Homo sapiens
ttacaaagagtgccagagtgtg

SEQ ID NO: 7526666 - DNA, 22 bp, Homo sapiens
ccttatggccaacctttgcctt

SEQ ID NO: 7526667 - DNA, 22 bp, Homo sapiens
ttacaaagagtgttcttttcca

SEQ ID NO: 7526668 - DNA, 22 bp, Homo sapiens
ttacaaagagtgttcttttcca

SEQ ID NO: 7526669 - DNA, 22 bp, Homo sapiens
ttacaaagagtgccagagtgtg

SEQ ID NO: 7526670 - DNA, 22 bp, Homo sapiens
ttacaaagagtgccagagtgtg

SEQ ID NO: 7526671 - DNA, 22 bp, Homo sapiens
ttacaaagagtgccagagtgtg

SEQ ID NO: 7526672 - DNA, 22 bp, Homo sapiens
ccttagtgtgcctgaggcagat

SEQ ID NO: 7526673 - DNA, 22 bp, Homo sapiens
ccttatagggtgtgatgaggat

SEQ ID NO: 7526674 - DNA, 17 bp, Homo sapiens
ccttagggcagtgtggt

SEQ ID NO: 7526675 - DNA, 17 bp, Homo sapiens
ccttagggcagtgtggt

SEQ ID NO: 7526676 - DNA, 17 bp, Homo sapiens
ccttagggcagtgtggt

SEQ ID NO: 7526677 - DNA, 22 bp, Homo sapiens
ccttagggactaatagactgtc

SEQ ID NO: 7526678 - DNA, 22 bp, Homo sapiens
ccttagctggagtggtggaatg

SEQ ID NO: 7526679 - DNA, 22 bp, Homo sapiens
ccttagtgaaacagaggcaatt

SEQ ID NO: 7526680 - DNA, 22 bp, Homo sapiens
ccttagtgaaacagaggcaatt

SEQ ID NO: 7526681 - DNA, 22 bp, Homo sapiens
ccttagtgtgaggggatacccc

SEQ ID NO: 7526682 - DNA, 22 bp, Homo sapiens
ccttagtgtgcctgaggcagat

SEQ ID NO: 7526683 - DNA, 22 bp, Homo sapiens
ccttagaaggctgaataattct

SEQ ID NO: 7526684 - DNA, 22 bp, Homo sapiens
ccttacactgcctggggccacg

SEQ ID NO: 7526685 - DNA, 22 bp, Homo sapiens
ccttacctgattgctggcatcc

SEQ ID NO: 7526686 - DNA, 22 bp, Homo sapiens
ccttacctgattgctggcatcc

SEQ ID NO: 7526687 - DNA, 22 bp, Homo sapiens
ccttacctgattgctggcatcc

SEQ ID NO: 7526688 - DNA, 22 bp, Homo sapiens
ccttacctgattgctggcatcc

SEQ ID NO: 7526689 - DNA, 22 bp, Homo sapiens
ccttacctgattgctggcatcc

SEQ ID NO: 7526690 - DNA, 22 bp, Homo sapiens
ccttagcagggccgggcctggg

SEQ ID NO: 7526691 - DNA, 22 bp, Homo sapiens
ccttagagagtactgggctgcc

SEQ ID NO: 7526692 - DNA, 22 bp, Homo sapiens
ccttagaggcaggaagaattgc

SEQ ID NO: 7526693 - DNA, 22 bp, Homo sapiens
ccttaaaagaactatctcttct

SEQ ID NO: 7526694 - DNA, 22 bp, Homo sapiens
ccttaaaagaactatctcttct

SEQ ID NO: 7526695 - DNA, 22 bp, Homo sapiens
ccttaaaagaactatctcttct

SEQ ID NO: 7526696 - DNA, 22 bp, Homo sapiens
ccttaaaagaactatctcttct

SEQ ID NO: 7526697 - DNA, 22 bp, Homo sapiens
ccttaaaagaactatctcttct

SEQ ID NO: 7526698 - DNA, 22 bp, Homo sapiens
ccttaaaagaactatctcttct

SEQ ID NO: 7526699 - DNA, 22 bp, Homo sapiens
ccttaaaagaactatctcttct

SEQ ID NO: 7526700 - DNA, 22 bp, Homo sapiens
ccttaaagaataagtcttatct

SEQ ID NO: 7526701 - DNA, 22 bp, Homo sapiens
ccttaagtacctgactagcatg

SEQ ID NO: 7526702 - DNA, 22 bp, Homo sapiens
ccttacacctaaaatgagagtt

SEQ ID NO: 7526703 - DNA, 22 bp, Homo sapiens
ccttaaattctccatttgaaag

SEQ ID NO: 7526704 - DNA, 22 bp, Homo sapiens
ccttaaattctccatttgaaag

SEQ ID NO: 7526705 - DNA, 22 bp, Homo sapiens
ccttaaattctccatttgaaag

SEQ ID NO: 7526706 - DNA, 22 bp, Homo sapiens
ttaagcagaaaatttgagcact

SEQ ID NO: 7526707 - DNA, 17 bp, Homo sapiens
ttaagcatgtaatctgc

SEQ ID NO: 7526708 - DNA, 17 bp, Homo sapiens
ttaagcatgtaatctgc

SEQ ID NO: 7526709 - DNA, 22 bp, Homo sapiens
ttaagcagcatgcattcagtgg

SEQ ID NO: 7526710 - DNA, 22 bp, Homo sapiens
ttaagcataattaaagtgaaat

SEQ ID NO: 7526711 - DNA, 22 bp, Homo sapiens
ttaagcataattaaagtgaaat

SEQ ID NO: 7526712 - DNA, 22 bp, Homo sapiens
ttaagcaacacacattaattat

SEQ ID NO: 7526713 - DNA, 22 bp, Homo sapiens
ttaagcaacacacattaattat

SEQ ID NO: 7526714 - DNA, 22 bp, Homo sapiens
ttaagcaacaagaatcccattg

SEQ ID NO: 7526715 - DNA, 22 bp, Homo sapiens
ttaagcaacacacattaattat

SEQ ID NO: 7526716 - DNA, 22 bp, Homo sapiens
ttaagcaacacacattaattat

SEQ ID NO: 7526717 - DNA, 22 bp, Homo sapiens
ccttaaaagaactatctcttct

SEQ ID NO: 7526718 - DNA, 18 bp, Homo sapiens
cctgtgtgtgttgcaggc

SEQ ID NO: 7526719 - DNA, 21 bp, Homo sapiens
cctgtgtgtgtccctttaaga

SEQ ID NO: 7526720 - DNA, 22 bp, Homo sapiens
ttaagcatggaagtgaaataat

SEQ ID NO: 7526721 - DNA, 22 bp, Homo sapiens
cctgtgtgtctgtcactgcaca

SEQ ID NO: 7526722 - DNA, 22 bp, Homo sapiens
ttacaaagcaggtcagctgaaa

SEQ ID NO: 7526723 - DNA, 22 bp, Homo sapiens
ttacaaagcaggtcagctgaaa

SEQ ID NO: 7526724 - DNA, 22 bp, Homo sapiens
ttacaaagcaggtcagctgaaa

SEQ ID NO: 7526725 - DNA, 22 bp, Homo sapiens
ttacaaagcaggtcagctgaaa

SEQ ID NO: 7526726 - DNA, 22 bp, Homo sapiens
ttacaaagcaggtcagctgaaa

SEQ ID NO: 7526727 - DNA, 22 bp, Homo sapiens
ttacaaagcgctttacctctga

SEQ ID NO: 7526728 - DNA, 22 bp, Homo sapiens
ttacaaagcgctttacctctga

SEQ ID NO: 7526729 - DNA, 22 bp, Homo sapiens
ttacaaagcgctttacctctga

SEQ ID NO: 7526730 - DNA, 22 bp, Homo sapiens
ttacaaagcgctttacctctga

SEQ ID NO: 7526731 - DNA, 22 bp, Homo sapiens
ttacaaagcgttgagacaagta

SEQ ID NO: 7526732 - DNA, 22 bp, Homo sapiens
ttacaaagcgttgagacaagta

SEQ ID NO: 7526733 - DNA, 22 bp, Homo sapiens
ttacaaagcgttgagacaagta

SEQ ID NO: 7526734 - DNA, 22 bp, Homo sapiens
ttacaaagcgttgagacaagta

SEQ ID NO: 7526735 - DNA, 22 bp, Homo sapiens
ttacaaagcgttgagacaagta

SEQ ID NO: 7526736 - DNA, 22 bp, Homo sapiens
ttacaaagcgttgagacaagta

SEQ ID NO: 7526737 - DNA, 22 bp, Homo sapiens
ttacagaagtgaaggcctttaa

SEQ ID NO: 7526738 - DNA, 22 bp, Homo sapiens
ttacagaagtgaaggcctttaa

SEQ ID NO: 7526739 - DNA, 22 bp, Homo sapiens
ttacagaagtgaaggcctttaa

SEQ ID NO: 7526740 - DNA, 22 bp, Homo sapiens
ttacagaagtattgagagatcc

SEQ ID NO: 7526741 - DNA, 22 bp, Homo sapiens
ttacaaagcgttgagacaagta

SEQ ID NO: 7526742 - DNA, 22 bp, Homo sapiens
ttacaaagcgttgagacaagta

SEQ ID NO: 7526743 - DNA, 22 bp, Homo sapiens
ttacaaagattatattcagtta

SEQ ID NO: 7526744 - DNA, 22 bp, Homo sapiens
ttacaaagattatattcagtta

SEQ ID NO: 7526745 - DNA, 22 bp, Homo sapiens
ttacaaagattatattcagtta

SEQ ID NO: 7526746 - DNA, 22 bp, Homo sapiens
ttacaaagattatattcagtta

SEQ ID NO: 7526747 - DNA, 22 bp, Homo sapiens
ttacaaagattatattcagtta

SEQ ID NO: 7526748 - DNA, 22 bp, Homo sapiens
ttacaaagattatattcagtta

SEQ ID NO: 7526749 - DNA, 22 bp, Homo sapiens
ttacaaagattatattcagtta

SEQ ID NO: 7526750 - DNA, 22 bp, Homo sapiens
ttacaaagagtgttcttttcca

SEQ ID NO: 7526751 - DNA, 22 bp, Homo sapiens
ttacaaagagtgttcttttcca

SEQ ID NO: 7526752 - DNA, 22 bp, Homo sapiens
ttacaaagagtgttcttttcca

SEQ ID NO: 7526753 - DNA, 22 bp, Homo sapiens
ttacaaagagtgttcttttcca

SEQ ID NO: 7526754 - DNA, 22 bp, Homo sapiens
ttacaaagattatattcagtta

SEQ ID NO: 7526755 - DNA, 22 bp, Homo sapiens
ttacaaagattatattcagtta

SEQ ID NO: 7526756 - DNA, 22 bp, Homo sapiens
ttacaaagcaggtcagctgaaa

SEQ ID NO: 7526757 - DNA, 22 bp, Homo sapiens
ttacaaagcaggtcagctgaaa

SEQ ID NO: 7526758 - DNA, 22 bp, Homo sapiens
ttacaaagcaggtcagctgaaa

SEQ ID NO: 7526759 - DNA, 21 bp, Homo sapiens
ttacagttgatggagtattcc

SEQ ID NO: 7526760 - DNA, 21 bp, Homo sapiens
ttacagttgatggagtattcc

SEQ ID NO: 7526761 - DNA, 21 bp, Homo sapiens
ttacagttgatggagtattcc

SEQ ID NO: 7526762 - DNA, 22 bp, Homo sapiens
ttacagttactggtactgttaa

SEQ ID NO: 7526763 - DNA, 22 bp, Homo sapiens
ttacagttactggtactgttaa

SEQ ID NO: 7526764 - DNA, 22 bp, Homo sapiens
ttacagttactggtactgttaa

SEQ ID NO: 7526765 - DNA, 22 bp, Homo sapiens
ttacagttaatgtgactaacca

SEQ ID NO: 7526766 - DNA, 22 bp, Homo sapiens
ttacagttaatgtgactaacca

SEQ ID NO: 7526767 - DNA, 22 bp, Homo sapiens
ttacagttagaatctgatgaaa

SEQ ID NO: 7526768 - DNA, 22 bp, Homo sapiens
ttacagttagaatctgatgaaa

SEQ ID NO: 7526769 - DNA, 21 bp, Homo sapiens
ttacagaatccatgggaagtc

SEQ ID NO: 7526770 - DNA, 21 bp, Homo sapiens
ttacagaatccatgggaagtc

SEQ ID NO: 7526771 - DNA, 22 bp, Homo sapiens
ttacagaagtttcagcgtttta

SEQ ID NO: 7526772 - DNA, 22 bp, Homo sapiens
ttacagaagtttcagcgtttta

SEQ ID NO: 7526773 - DNA, 22 bp, Homo sapiens
ttacagaagtttcagcgtttta

SEQ ID NO: 7526774 - DNA, 22 bp, Homo sapiens
ttacagtggtcatttgggaaaa

SEQ ID NO: 7526775 - DNA, 22 bp, Homo sapiens
ttacagtgtgcaatcccagaat

SEQ ID NO: 7526776 - DNA, 22 bp, Homo sapiens
ttacagtgttacttgatgtcca

SEQ ID NO: 7526777 - DNA, 22 bp, Homo sapiens
ttacagtgttacttgatgtcca

SEQ ID NO: 7526778 - DNA, 22 bp, Homo sapiens
ttacagtttacataagaattgt

SEQ ID NO: 7526779 - DNA, 22 bp, Homo sapiens
ttacagtttaccaagaatattg

SEQ ID NO: 7526780 - DNA, 22 bp, Homo sapiens
ttacagtttaccaagaatattg

SEQ ID NO: 7526781 - DNA, 22 bp, Homo sapiens
ttacagtttaccaagaatattg

SEQ ID NO: 7526782 - DNA, 22 bp, Homo sapiens
ttacagtttaccaagaatattg

SEQ ID NO: 7526783 - DNA, 22 bp, Homo sapiens
ttacagtttatccaggaagagc

SEQ ID NO: 7526784 - DNA, 22 bp, Homo sapiens
ttacagtttatccaggaagagc

SEQ ID NO: 7526785 - DNA, 22 bp, Homo sapiens
ttacagttgttctatcagcatg

SEQ ID NO: 7526786 - DNA, 22 bp, Homo sapiens
ttacagttgttctatcagcatg

SEQ ID NO: 7526787 - DNA, 22 bp, Homo sapiens
ttacagttgttctatcagcatg

SEQ ID NO: 7526788 - DNA, 22 bp, Homo sapiens
ttacagttggtattagaccaaa

SEQ ID NO: 7526789 - DNA, 22 bp, Homo sapiens
ttacagtttaagaggaaacaaa

SEQ ID NO: 7526790 - DNA, 22 bp, Homo sapiens
ttacagtttacataagaattgt

SEQ ID NO: 7526791 - DNA, 22 bp, Homo sapiens
ttacagtttacataagaattgt

SEQ ID NO: 7526792 - DNA, 22 bp, Homo sapiens
ttacagtttacataagaattgt

SEQ ID NO: 7526793 - DNA, 22 bp, Homo sapiens
ttacagtttaagaggaaacaaa

SEQ ID NO: 7526794 - DNA, 22 bp, Homo sapiens
ttaaattatttctagtgaggtg

SEQ ID NO: 7526795 - DNA, 22 bp, Homo sapiens
ttaaattatttctagtgaggtg

SEQ ID NO: 7526796 - DNA, 22 bp, Homo sapiens
ttaaattatttctagtgaggtg

SEQ ID NO: 7526797 - DNA, 22 bp, Homo sapiens
ttaaattatttctagtgaggtg

SEQ ID NO: 7526798 - DNA, 22 bp, Homo sapiens
ttaaattatttctagtgaggtg

SEQ ID NO: 7526799 - DNA, 22 bp, Homo sapiens
ttaaattatttctagtgaggtg

SEQ ID NO: 7526800 - DNA, 22 bp, Homo sapiens
ttaaattatttctagtgaggtg

SEQ ID NO: 7526801 - DNA, 22 bp, Homo sapiens
ttaaattatttctagtgaggtg

SEQ ID NO: 7526802 - DNA, 22 bp, Homo sapiens
ttaaattattgagggattgtca

SEQ ID NO: 7526803 - DNA, 22 bp, Homo sapiens
ttaaattattgagggattgtca

SEQ ID NO: 7526804 - DNA, 22 bp, Homo sapiens
ttaaattatttctagtgaggtg

SEQ ID NO: 7526805 - DNA, 22 bp, Homo sapiens
ttaaattcattccaacttttga

SEQ ID NO: 7526806 - DNA, 22 bp, Homo sapiens
ttaaattcattccaacttttga

SEQ ID NO: 7526807 - DNA, 22 bp, Homo sapiens
ttaaattcattccaacttttga

SEQ ID NO: 7526808 - DNA, 22 bp, Homo sapiens
ttaaattcattccaacttttga

SEQ ID NO: 7526809 - DNA, 22 bp, Homo sapiens
ttaaattcattccaacttttga

SEQ ID NO: 7526810 - DNA, 22 bp, Homo sapiens
ttaaattcattccaacttttga

SEQ ID NO: 7526811 - DNA, 22 bp, Homo sapiens
ttaaattccagcctcataatag

SEQ ID NO: 7526812 - DNA, 22 bp, Homo sapiens
ttaaattccagcctcataatag

SEQ ID NO: 7526813 - DNA, 22 bp, Homo sapiens
ttaaattccagcctcataatag

SEQ ID NO: 7526814 - DNA, 22 bp, Homo sapiens
ttaaattccagcctcataatag

SEQ ID NO: 7526815 - DNA, 22 bp, Homo sapiens
ttaaattccagcctcataatag

SEQ ID NO: 7526816 - DNA, 22 bp, Homo sapiens
ttaaattccagcctcataatag

SEQ ID NO: 7526817 - DNA, 22 bp, Homo sapiens
ttaaattttagaaacagactct

SEQ ID NO: 7526818 - DNA, 22 bp, Homo sapiens
ttaaattttagaaacagactct

SEQ ID NO: 7526819 - DNA, 22 bp, Homo sapiens
ttaaatttctacgtgatccagg

SEQ ID NO: 7526820 - DNA, 22 bp, Homo sapiens
ttaaattttagaaacagactct

SEQ ID NO: 7526821 - DNA, 22 bp, Homo sapiens
ttaaattttagaaacagactct

SEQ ID NO: 7526822 - DNA, 22 bp, Homo sapiens
ttaaatttctacgtgatccagg

SEQ ID NO: 7526823 - DNA, 22 bp, Homo sapiens
ttaaatttctacgtgatccagg

SEQ ID NO: 7526824 - DNA, 22 bp, Homo sapiens
ttaaatttctacgtgatccagg

SEQ ID NO: 7526825 - DNA, 22 bp, Homo sapiens
ttaaatttctacgtgatccagg

SEQ ID NO: 7526826 - DNA, 22 bp, Homo sapiens
ttaaatttctacgtgatccagg

SEQ ID NO: 7526827 - DNA, 22 bp, Homo sapiens
ttaaatttctacgtgatccagg

SEQ ID NO: 7526828 - DNA, 22 bp, Homo sapiens
ttaaattccagcctcataatag

SEQ ID NO: 7526829 - DNA, 22 bp, Homo sapiens
ttaaattccagcctcataatag

SEQ ID NO: 7526830 - DNA, 22 bp, Homo sapiens
ttaaattccagcctcataatag

SEQ ID NO: 7526831 - DNA, 22 bp, Homo sapiens
ttaaattccagcctcataatag

SEQ ID NO: 7526832 - DNA, 22 bp, Homo sapiens
ttaaattccagcctcataatag

SEQ ID NO: 7526833 - DNA, 22 bp, Homo sapiens
ttaaattgtcatttgagcaatg

SEQ ID NO: 7526834 - DNA, 22 bp, Homo sapiens
ttaaattgtcatttgagcaatg

SEQ ID NO: 7526835 - DNA, 22 bp, Homo sapiens
ttaaattccagcctcataatag

SEQ ID NO: 7526836 - DNA, 22 bp, Homo sapiens
ttaagatttgtagagaaaaagc

SEQ ID NO: 7526837 - DNA, 22 bp, Homo sapiens
ttaagatttgtagagaaaaagc

SEQ ID NO: 7526838 - DNA, 22 bp, Homo sapiens
ttaagatgatgtttcttgttgt

SEQ ID NO: 7526839 - DNA, 22 bp, Homo sapiens
ttaagattttcttcagtattat

SEQ ID NO: 7526840 - DNA, 22 bp, Homo sapiens
ttaagcaaatgtcagttgttag

SEQ ID NO: 7526841 - DNA, 22 bp, Homo sapiens
ttaagcaaatgtcagttgttag

SEQ ID NO: 7526842 - DNA, 22 bp, Homo sapiens
ttaagattttcttcagtattat

SEQ ID NO: 7526843 - DNA, 22 bp, Homo sapiens
ttaagattttcttcagtattat

SEQ ID NO: 7526844 - DNA, 22 bp, Homo sapiens
ttaagatttgtagagaaaaagc

SEQ ID NO: 7526845 - DNA, 22 bp, Homo sapiens
ttaagattttcttcagtattat

SEQ ID NO: 7526846 - DNA, 22 bp, Homo sapiens
ttaagattttcttcagtattat

SEQ ID NO: 7526847 - DNA, 22 bp, Homo sapiens
ttaagattttcttcagtattat

SEQ ID NO: 7526848 - DNA, 22 bp, Homo sapiens
ttaagatagaacccagtagtct

SEQ ID NO: 7526849 - DNA, 22 bp, Homo sapiens
ttaagatgatgtttcttgttgt

SEQ ID NO: 7526850 - DNA, 22 bp, Homo sapiens
ttaagatcaagataagcaataa

SEQ ID NO: 7526851 - DNA, 22 bp, Homo sapiens
ttaagaggtggtcgtgtctgtg

SEQ ID NO: 7526852 - DNA, 22 bp, Homo sapiens
ttaagaggtggtcgtgtctgtg

SEQ ID NO: 7526853 - DNA, 22 bp, Homo sapiens
ttaagagttatttgcacataat

SEQ ID NO: 7526854 - DNA, 22 bp, Homo sapiens
ttaaattttagaaacagactct

SEQ ID NO: 7526855 - DNA, 22 bp, Homo sapiens
ttaaattttagaaacagactct

SEQ ID NO: 7526856 - DNA, 22 bp, Homo sapiens
ttaaattttagaaacagactct

SEQ ID NO: 7526857 - DNA, 22 bp, Homo sapiens
ttaaattttagaaacagactct

SEQ ID NO: 7526858 - DNA, 18 bp, Homo sapiens
ttaagagctgaaagggga

SEQ ID NO: 7526859 - DNA, 22 bp, Homo sapiens
ttaagagccaacttatccatct

SEQ ID NO: 7526860 - DNA, 21 bp, Homo sapiens
ttaagagcttagcagtaggcc

SEQ ID NO: 7526861 - DNA, 22 bp, Homo sapiens
ttaagaggagatcatactggag

SEQ ID NO: 7526862 - DNA, 22 bp, Homo sapiens
ttaagagggtgatgctagcatt

SEQ ID NO: 7526863 - DNA, 22 bp, Homo sapiens
ttaagagggtgatgctagcatt

SEQ ID NO: 7526864 - DNA, 22 bp, Homo sapiens
ttaagaggagatcatactggag

SEQ ID NO: 7526865 - DNA, 22 bp, Homo sapiens
ttaagaggtgaggcctttaaga

SEQ ID NO: 7526866 - DNA, 22 bp, Homo sapiens
ttaagaggtggtcgtgtctgtg

SEQ ID NO: 7526867 - DNA, 22 bp, Homo sapiens
ttaagagggtgatgctagcatt

SEQ ID NO: 7526868 - DNA, 22 bp, Homo sapiens
ttaagaggtgaggcctttaaga

SEQ ID NO: 7526869 - DNA, 22 bp, Homo sapiens
tgtcagcattgatgaaatgtgg

SEQ ID NO: 7526870 - DNA, 22 bp, Homo sapiens
tgtcagcattgcgtcactgagc

SEQ ID NO: 7526871 - DNA, 22 bp, Homo sapiens
tgtcagcatgtcagccaaagat

SEQ ID NO: 7526872 - DNA, 22 bp, Homo sapiens
tgtcagcattgatgaaatgtgg

SEQ ID NO: 7526873 - DNA, 22 bp, Homo sapiens
tgtcagcatcatttgttgaagg

SEQ ID NO: 7526874 - DNA, 22 bp, Homo sapiens
tgtcagcatcatttgttgaagg

SEQ ID NO: 7526875 - DNA, 22 bp, Homo sapiens
tgtcagcatgaaccctgaatta

SEQ ID NO: 7526876 - DNA, 22 bp, Homo sapiens
tgtcagcattgcgtcactgagc

SEQ ID NO: 7526877 - DNA, 22 bp, Homo sapiens
tgtcagcattgcgtcactgagc

SEQ ID NO: 7526878 - DNA, 22 bp, Homo sapiens
tgtcagcatttaaggagtaagg

SEQ ID NO: 7526879 - DNA, 22 bp, Homo sapiens
tgtcagcattgcgtcactgagc

SEQ ID NO: 7526880 - DNA, 22 bp, Homo sapiens
tgtcagctcccagtcagagaga

SEQ ID NO: 7526881 - DNA, 22 bp, Homo sapiens
tgtcagccttgctttagcggtt

SEQ ID NO: 7526882 - DNA, 22 bp, Homo sapiens
tgtcagccttgctttagcggtt

SEQ ID NO: 7526883 - DNA, 22 bp, Homo sapiens
tgtcagcatcatttgttgaagg

SEQ ID NO: 7526884 - DNA, 22 bp, Homo sapiens
tgtcagcatcatttgttgaagg

SEQ ID NO: 7526885 - DNA, 22 bp, Homo sapiens
tgtcagcagtttttagtggagg

SEQ ID NO: 7526886 - DNA, 22 bp, Homo sapiens
tgtcagcagtttttagtggagg

SEQ ID NO: 7526887 - DNA, 22 bp, Homo sapiens
tgtcagcagtatctctatctca

SEQ ID NO: 7526888 - DNA, 22 bp, Homo sapiens
tgtcagcaggacattaaaagct

SEQ ID NO: 7526889 - DNA, 22 bp, Homo sapiens
tgtcagcagaagtggtgcactc

SEQ ID NO: 7526890 - DNA, 22 bp, Homo sapiens
tgtcagcagatctcctgcagcc

SEQ ID NO: 7526891 - DNA, 22 bp, Homo sapiens
tgtcagcagatctcctgcagcc

SEQ ID NO: 7526892 - DNA, 22 bp, Homo sapiens
tgtcagcagctggtttgctgtt

SEQ ID NO: 7526893 - DNA, 22 bp, Homo sapiens
tgtcagcagctggtttgctgtt

SEQ ID NO: 7526894 - DNA, 22 bp, Homo sapiens
ttaaattagtcaagcttctctg

SEQ ID NO: 7526895 - DNA, 22 bp, Homo sapiens
ttaaattagtcaagcttctctg

SEQ ID NO: 7526896 - DNA, 22 bp, Homo sapiens
ttaaattagtcaagcttctctg

SEQ ID NO: 7526897 - DNA, 22 bp, Homo sapiens
ttaaattagtcaagcttctctg

SEQ ID NO: 7526898 - DNA, 22 bp, Homo sapiens
ttaaattagtcaagcttctctg

SEQ ID NO: 7526899 - DNA, 22 bp, Homo sapiens
ttaaattattgagggattgtca

SEQ ID NO: 7526900 - DNA, 22 bp, Homo sapiens
ttaaattattgagggattgtca

SEQ ID NO: 7526901 - DNA, 22 bp, Homo sapiens
ttaaattattgagggattgtca

SEQ ID NO: 7526902 - DNA, 22 bp, Homo sapiens
ttaaattattgagggattgtca

SEQ ID NO: 7526903 - DNA, 22 bp, Homo sapiens
ttaaattagtcaagcttctctg

SEQ ID NO: 7526904 - DNA, 22 bp, Homo sapiens
ttaaatagtaggtctattttgg

SEQ ID NO: 7526905 - DNA, 22 bp, Homo sapiens
ttaaatagtaggtctattttgg

SEQ ID NO: 7526906 - DNA, 22 bp, Homo sapiens
ttaaattagtcaagcttctctg

SEQ ID NO: 7526907 - DNA, 22 bp, Homo sapiens
ttaaatagtaggtctattttgg

SEQ ID NO: 7526908 - DNA, 22 bp, Homo sapiens
ttaaatagtaggtctattttgg

SEQ ID NO: 7526909 - DNA, 22 bp, Homo sapiens
ttaaatagtaggtctattttgg

SEQ ID NO: 7526910 - DNA, 22 bp, Homo sapiens
ttaaatagtaggtctattttgg

SEQ ID NO: 7526911 - DNA, 22 bp, Homo sapiens
ttaaatagtaggtctattttgg

SEQ ID NO: 7526912 - DNA, 22 bp, Homo sapiens
ttaaatagtaggtctattttgg

SEQ ID NO: 7526913 - DNA, 22 bp, Homo sapiens
tgtcagctcccagtcagagaga

SEQ ID NO: 7526914 - DNA, 22 bp, Homo sapiens
tgtcagcaacccatcactccca

SEQ ID NO: 7526915 - DNA, 22 bp, Homo sapiens
tgtcagcaacccatcactccca

SEQ ID NO: 7526916 - DNA, 22 bp, Homo sapiens
tgtcagcaagacatcagagtga

SEQ ID NO: 7526917 - DNA, 21 bp, Homo sapiens
tgtcagcaacaatactttctc

SEQ ID NO: 7526918 - DNA, 22 bp, Homo sapiens
tgtcagatgtgtctccaagtgc

SEQ ID NO: 7526919 - DNA, 21 bp, Homo sapiens
tgtcagcaacaatactttctc

SEQ ID NO: 7526920 - DNA, 21 bp, Homo sapiens
tgtcagagcttgtaggacatt

SEQ ID NO: 7526921 - DNA, 21 bp, Homo sapiens
tgtcagagcttgtaggacatt

SEQ ID NO: 7526922 - DNA, 22 bp, Homo sapiens
tgtcagaggctcagggtctcag

SEQ ID NO: 7526923 - DNA, 22 bp, Homo sapiens
tgtcagaggctcagggtctcag

SEQ ID NO: 7526924 - DNA, 20 bp, Homo sapiens
tgtcagcaattaggagaaaa

SEQ ID NO: 7526925 - DNA, 22 bp, Homo sapiens
tgtcagcacatctgtaatcaca

SEQ ID NO: 7526926 - DNA, 20 bp, Homo sapiens
tgtcagcaattaggagaaaa

SEQ ID NO: 7526927 - DNA, 22 bp, Homo sapiens
tgtcagcaattctggcttactc

SEQ ID NO: 7526928 - DNA, 22 bp, Homo sapiens
tgtcagcaccatgggtagtgat

SEQ ID NO: 7526929 - DNA, 22 bp, Homo sapiens
tgtcagcagaaatctggtctgc

SEQ ID NO: 7526930 - DNA, 21 bp, Homo sapiens
tgtcagcacgcatgaggccag

SEQ ID NO: 7526931 - DNA, 21 bp, Homo sapiens
tgtcagagcttgtaggacatt

SEQ ID NO: 7526932 - DNA, 21 bp, Homo sapiens
tgtcagagcttgtaggacatt

SEQ ID NO: 7526933 - DNA, 22 bp, Homo sapiens
tgtcagagcaatgaggttcagc

SEQ ID NO: 7526934 - DNA, 22 bp, Homo sapiens
tgtcagagcaatgaggttcagc

SEQ ID NO: 7526935 - DNA, 22 bp, Homo sapiens
tgtcagacctgtgatttcagca

SEQ ID NO: 7526936 - DNA, 22 bp, Homo sapiens
tgtcagagagcaggcagtagaa

SEQ ID NO: 7526937 - DNA, 22 bp, Homo sapiens
tgtcagagcaaggccaggccag

SEQ ID NO: 7526938 - DNA, 22 bp, Homo sapiens
tgtcagagcaaggccaggccag

SEQ ID NO: 7526939 - DNA, 22 bp, Homo sapiens
tgtcagagcaatgaggttcagc

SEQ ID NO: 7526940 - DNA, 20 bp, Homo sapiens
tgtcaatagcactgaggctg

SEQ ID NO: 7526941 - DNA, 22 bp, Homo sapiens
tgtcaataactggagtcattat

SEQ ID NO: 7526942 - DNA, 22 bp, Homo sapiens
tgtcaatagttttgagttctct

SEQ ID NO: 7526943 - DNA, 22 bp, Homo sapiens
tgtcaatagttttgagttctct

SEQ ID NO: 7526944 - DNA, 22 bp, Homo sapiens
tgtcaataactggagtcattat

SEQ ID NO: 7526945 - DNA, 22 bp, Homo sapiens
tgtcaatatcaggcagacctaa

SEQ ID NO: 7526946 - DNA, 22 bp, Homo sapiens
tgtcaatagttttgagttctct

SEQ ID NO: 7526947 - DNA, 22 bp, Homo sapiens
tgtcaatatgtaataactgaat

SEQ ID NO: 7526948 - DNA, 22 bp, Homo sapiens
tgtcagaactctattgatgtcc

SEQ ID NO: 7526949 - DNA, 22 bp, Homo sapiens
cggggccctggggctgaaggtc

SEQ ID NO: 7526950 - DNA, 22 bp, Homo sapiens
cggggccctggggctgaaggtc

SEQ ID NO: 7526951 - DNA, 22 bp, Homo sapiens
cggggccctggggctgaaggtc

SEQ ID NO: 7526952 - DNA, 22 bp, Homo sapiens
cggggccctggggctgaaggtc

SEQ ID NO: 7526953 - DNA, 22 bp, Homo sapiens
cggggccctggggctgaaggtc

SEQ ID NO: 7526954 - DNA, 22 bp, Homo sapiens
cggggccctggggctgaaggtc

SEQ ID NO: 7526955 - DNA, 22 bp, Homo sapiens
cggggccctggggctgaaggtc

SEQ ID NO: 7526956 - DNA, 22 bp, Homo sapiens
cggggccctggggctgaaggtc

SEQ ID NO: 7526957 - DNA, 22 bp, Homo sapiens
cggggccctggggctgaaggtc

SEQ ID NO: 7526958 - DNA, 22 bp, Homo sapiens
cggggccctggggctgaaggtc

SEQ ID NO: 7526959 - DNA, 22 bp, Homo sapiens
cggggcaggagtccctgtagag

SEQ ID NO: 7526960 - DNA, 22 bp, Homo sapiens
cggggcaggagtccctgtagag

SEQ ID NO: 7526961 - DNA, 22 bp, Homo sapiens
cggggcaggagtccctgtagag

SEQ ID NO: 7526962 - DNA, 22 bp, Homo sapiens
cggggcaggagtccctgtagag

SEQ ID NO: 7526963 - DNA, 23 bp, Homo sapiens
cggggccagggtcaggaccggtc

SEQ ID NO: 7526964 - DNA, 22 bp, Homo sapiens
cggggccctggggctgaaggtc

SEQ ID NO: 7526965 - DNA, 22 bp, Homo sapiens
cggggcagagggtcttctccag

SEQ ID NO: 7526966 - DNA, 22 bp, Homo sapiens
cggggcagaaagttgtcttttg

SEQ ID NO: 7526967 - DNA, 22 bp, Homo sapiens
cggggcagagggtcttctccag

SEQ ID NO: 7526968 - DNA, 22 bp, Homo sapiens
cggggcagagggtcttctccag

SEQ ID NO: 7526969 - DNA, 22 bp, Homo sapiens
cggggcaggagtccctgtagag

SEQ ID NO: 7526970 - DNA, 22 bp, Homo sapiens
cggggcaggagtccctgtagag

SEQ ID NO: 7526971 - DNA, 22 bp, Homo sapiens
cggggcaggagtccctgtagag

SEQ ID NO: 7526972 - DNA, 22 bp, Homo sapiens
cggggcaggagtccctgtagag

SEQ ID NO: 7526973 - DNA, 22 bp, Homo sapiens
cggggcagagggtcttctccag

SEQ ID NO: 7526974 - DNA, 22 bp, Homo sapiens
cggggcagagggtcttctccag

SEQ ID NO: 7526975 - DNA, 22 bp, Homo sapiens
cggggagggcagaggctccctc

SEQ ID NO: 7526976 - DNA, 22 bp, Homo sapiens
cggggcagaaagttgtcttttg

SEQ ID NO: 7526977 - DNA, 22 bp, Homo sapiens
cggggcagaaagttgtcttttg

SEQ ID NO: 7526978 - DNA, 22 bp, Homo sapiens
cggggcaccgacctcctgccgc

SEQ ID NO: 7526979 - DNA, 22 bp, Homo sapiens
cggggcaccgacctcctgccgc

SEQ ID NO: 7526980 - DNA, 22 bp, Homo sapiens
cggggcaccgacctcctgccgc

SEQ ID NO: 7526981 - DNA, 22 bp, Homo sapiens
cggggagggcagaggctccctc

SEQ ID NO: 7526982 - DNA, 22 bp, Homo sapiens
cggggagggcagaggctccctc

SEQ ID NO: 7526983 - DNA, 22 bp, Homo sapiens
cggggagggcagaggctccctc

SEQ ID NO: 7526984 - DNA, 22 bp, Homo sapiens
cggggagggcagaggctccctc

SEQ ID NO: 7526985 - DNA, 22 bp, Homo sapiens
cgggcaaggcgagactaggccc

SEQ ID NO: 7526986 - DNA, 22 bp, Homo sapiens
cgggaggaaaggcgaggctctg

SEQ ID NO: 7526987 - DNA, 22 bp, Homo sapiens
cgggcaaggcgagactaggccc

SEQ ID NO: 7526988 - DNA, 22 bp, Homo sapiens
cgggcaaggcgagactaggccc

SEQ ID NO: 7526989 - DNA, 21 bp, Homo sapiens
cgggctggccgggccctcacc

SEQ ID NO: 7526990 - DNA, 22 bp, Homo sapiens
cgggcaaggcgagactaggccc

SEQ ID NO: 7526991 - DNA, 22 bp, Homo sapiens
cgggcaaggcgagactaggccc

SEQ ID NO: 7526992 - DNA, 22 bp, Homo sapiens
cgggctggctgcagctgctgga

SEQ ID NO: 7526993 - DNA, 22 bp, Homo sapiens
cgggctggctgcagctgctgga

SEQ ID NO: 7526994 - DNA, 22 bp, Homo sapiens
cgggctggctgcagctgctgga

SEQ ID NO: 7526995 - DNA, 22 bp, Homo sapiens
cgggctggctgcagctgctgga

SEQ ID NO: 7526996 - DNA, 22 bp, Homo sapiens
cgggctggctgcagctgctgga

SEQ ID NO: 7526997 - DNA, 22 bp, Homo sapiens
cgggctggctgcagctgctgga

SEQ ID NO: 7526998 - DNA, 22 bp, Homo sapiens
cgggctggctgcagctgctgga

SEQ ID NO: 7526999 - DNA, 22 bp, Homo sapiens
cggggacacactggcagctcct

SEQ ID NO: 7527000 - DNA, 22 bp, Homo sapiens
cggggagaacactgtgtccttc

SEQ ID NO: 7527001 - DNA, 22 bp, Homo sapiens
cggggacacactggcagctcct

SEQ ID NO: 7527002 - DNA, 22 bp, Homo sapiens
cggggaggcttcggattaaagc

SEQ ID NO: 7527003 - DNA, 22 bp, Homo sapiens
cggggaggcttcggattaaagc

SEQ ID NO: 7527004 - DNA, 22 bp, Homo sapiens
cggggaggcttcggattaaagc

SEQ ID NO: 7527005 - DNA, 22 bp, Homo sapiens
cggggaagcggttctggcggta

SEQ ID NO: 7527006 - DNA, 22 bp, Homo sapiens
cggggaagcggttctggcggta

SEQ ID NO: 7527007 - DNA, 22 bp, Homo sapiens
cggggaagcggttctggcggta

SEQ ID NO: 7527008 - DNA, 22 bp, Homo sapiens
cggggaagcggttctggcggta

SEQ ID NO: 7527009 - DNA, 22 bp, Homo sapiens
cggggaatcatggctgggcagt

SEQ ID NO: 7527010 - DNA, 22 bp, Homo sapiens
cggggagggcagaggctccctc

SEQ ID NO: 7527011 - DNA, 22 bp, Homo sapiens
cggggagggcagaggctccctc

SEQ ID NO: 7527012 - DNA, 22 bp, Homo sapiens
cggggagggcagaggctccctc

SEQ ID NO: 7527013 - DNA, 22 bp, Homo sapiens
cggggagggcagaggctccctc

SEQ ID NO: 7527014 - DNA, 22 bp, Homo sapiens
cggggagggcagaggctccctc

SEQ ID NO: 7527015 - DNA, 22 bp, Homo sapiens
cggggaggcttcggattaaagc

SEQ ID NO: 7527016 - DNA, 22 bp, Homo sapiens
cggggaggcttcggattaaagc

SEQ ID NO: 7527017 - DNA, 22 bp, Homo sapiens
cggggaggcttcggattaaagc

SEQ ID NO: 7527018 - DNA, 22 bp, Homo sapiens
cggggaggcttcggattaaagc

SEQ ID NO: 7527019 - DNA, 22 bp, Homo sapiens
cggggctgacagcaggtgtgct

SEQ ID NO: 7527020 - DNA, 22 bp, Homo sapiens
cggggctgaggcaacgcggaga

SEQ ID NO: 7527021 - DNA, 22 bp, Homo sapiens
cggggctgaggcaacgcggaga

SEQ ID NO: 7527022 - DNA, 22 bp, Homo sapiens
cggggctgaggcaacgcggaga

SEQ ID NO: 7527023 - DNA, 22 bp, Homo sapiens
cggggctgaggcaacgcggaga

SEQ ID NO: 7527024 - DNA, 22 bp, Homo sapiens
cggggctgacagcaggtgtgct

SEQ ID NO: 7527025 - DNA, 22 bp, Homo sapiens
cggggctgacagcaggtgtgct

SEQ ID NO: 7527026 - DNA, 22 bp, Homo sapiens
cggggctgacagcaggtgtgct

SEQ ID NO: 7527027 - DNA, 22 bp, Homo sapiens
cggggctgacagcaggtgtgct

SEQ ID NO: 7527028 - DNA, 22 bp, Homo sapiens
cggggctgacagcaggtgtgct

SEQ ID NO: 7527029 - DNA, 22 bp, Homo sapiens
cggggctgacagcaggtgtgct

SEQ ID NO: 7527030 - DNA, 22 bp, Homo sapiens
cggggctgacagcaggtgtgct

SEQ ID NO: 7527031 - DNA, 22 bp, Homo sapiens
cggggctgcgctcttcctgccg

SEQ ID NO: 7527032 - DNA, 22 bp, Homo sapiens
cggggctgaggcaacgcggaga

SEQ ID NO: 7527033 - DNA, 22 bp, Homo sapiens
cggggctgcgctcttcctgccg

SEQ ID NO: 7527034 - DNA, 22 bp, Homo sapiens
cggggctgcgctcttcctgccg

SEQ ID NO: 7527035 - DNA, 22 bp, Homo sapiens
cggggctgcgctcttcctgccg

SEQ ID NO: 7527036 - DNA, 22 bp, Homo sapiens
cggggctgcgctcttcctgccg

SEQ ID NO: 7527037 - DNA, 22 bp, Homo sapiens
cggggctgctcgtcctcctgtg

SEQ ID NO: 7527038 - DNA, 22 bp, Homo sapiens
cggggctgctcgtcctcctgtg

SEQ ID NO: 7527039 - DNA, 22 bp, Homo sapiens
cggggctgctcgtcctcctgtg

SEQ ID NO: 7527040 - DNA, 22 bp, Homo sapiens
cggggctgctcgtcctcctgtg

SEQ ID NO: 7527041 - DNA, 22 bp, Homo sapiens
cggggcgagcagacggcggcaa

SEQ ID NO: 7527042 - DNA, 22 bp, Homo sapiens
cggggctgacagcaggtgtgct

SEQ ID NO: 7527043 - DNA, 22 bp, Homo sapiens
cggggctgacagcaggtgtgct

SEQ ID NO: 7527044 - DNA, 22 bp, Homo sapiens
cggggcgctgggatcccgcccg

SEQ ID NO: 7527045 - DNA, 22 bp, Homo sapiens
cggggctgacagcaggtgtgct

SEQ ID NO: 7527046 - DNA, 22 bp, Homo sapiens
cggggcctcagtttccccacct

SEQ ID NO: 7527047 - DNA, 22 bp, Homo sapiens
cggggcctaccgctgcgtggcc

SEQ ID NO: 7527048 - DNA, 22 bp, Homo sapiens
cggggccctggggctgaaggtc

SEQ ID NO: 7527049 - DNA, 22 bp, Homo sapiens
cggggccctggggctgaaggtc

SEQ ID NO: 7527050 - DNA, 22 bp, Homo sapiens
cggggccctggggctgaaggtc

SEQ ID NO: 7527051 - DNA, 22 bp, Homo sapiens
cggggccctggggctgaaggtc

SEQ ID NO: 7527052 - DNA, 22 bp, Homo sapiens
cggggccctggggctgaaggtc

SEQ ID NO: 7527053 - DNA, 22 bp, Homo sapiens
cgtgggctgcgcccagttcttc

SEQ ID NO: 7527054 - DNA, 22 bp, Homo sapiens
cgtggggacccacgtgcagcac

SEQ ID NO: 7527055 - DNA, 22 bp, Homo sapiens
cgtggggacccacgtgcagcac

SEQ ID NO: 7527056 - DNA, 22 bp, Homo sapiens
cgtgggctgcgcccagttcttc

SEQ ID NO: 7527057 - DNA, 22 bp, Homo sapiens
cgtgggctgcgcccagttcttc

SEQ ID NO: 7527058 - DNA, 22 bp, Homo sapiens
cgtgggccccagccactccctc

SEQ ID NO: 7527059 - DNA, 22 bp, Homo sapiens
cgtgggccccagccactccctc

SEQ ID NO: 7527060 - DNA, 22 bp, Homo sapiens
cgtgggtcgggactccgcctcg

SEQ ID NO: 7527061 - DNA, 22 bp, Homo sapiens
cgtgggtcgggactccgcctcg

SEQ ID NO: 7527062 - DNA, 22 bp, Homo sapiens
cgtggtctcccacagaaagaag

SEQ ID NO: 7527063 - DNA, 22 bp, Homo sapiens
cgtgggtcgggactccgcctcg

SEQ ID NO: 7527064 - DNA, 22 bp, Homo sapiens
cgtgggaggaaaaatgggcttc

SEQ ID NO: 7527065 - DNA, 22 bp, Homo sapiens
cgtgggaggaaaaatgggcttc

SEQ ID NO: 7527066 - DNA, 22 bp, Homo sapiens
cgtggctggtggacctgagggc

SEQ ID NO: 7527067 - DNA, 22 bp, Homo sapiens
cgtggctggtggacctgagggc

SEQ ID NO: 7527068 - DNA, 22 bp, Homo sapiens
cgtgggccccagccactccctc

SEQ ID NO: 7527069 - DNA, 22 bp, Homo sapiens
cgtgggagtggtgggtgctcag

SEQ ID NO: 7527070 - DNA, 22 bp, Homo sapiens
cgtgggagtggtgggtgctcag

SEQ ID NO: 7527071 - DNA, 22 bp, Homo sapiens
cgtgacagggtctggctggtca

SEQ ID NO: 7527072 - DNA, 21 bp, Homo sapiens
cgtgactgggtccgtctggct

SEQ ID NO: 7527073 - DNA, 22 bp, Homo sapiens
cggggctggcacaggtgaccac

SEQ ID NO: 7527074 - DNA, 22 bp, Homo sapiens
cggggctggcacaggtgaccac

SEQ ID NO: 7527075 - DNA, 22 bp, Homo sapiens
cggggctggcacaggtgaccac

SEQ ID NO: 7527076 - DNA, 22 bp, Homo sapiens
cggggctggcacaggtgaccac

SEQ ID NO: 7527077 - DNA, 22 bp, Homo sapiens
cggggctggcacaggtgaccac

SEQ ID NO: 7527078 - DNA, 22 bp, Homo sapiens
cggggctggcacaggtgaccac

SEQ ID NO: 7527079 - DNA, 22 bp, Homo sapiens
cggggctggcacaggtgaccac

SEQ ID NO: 7527080 - DNA, 22 bp, Homo sapiens
cgtgagcaaaatggacactccc

SEQ ID NO: 7527081 - DNA, 22 bp, Homo sapiens
cgtgagcaaaatggacactccc

SEQ ID NO: 7527082 - DNA, 22 bp, Homo sapiens
cgtgagcaaaatggacactccc

SEQ ID NO: 7527083 - DNA, 22 bp, Homo sapiens
cgtggctggtggacctgagggc

SEQ ID NO: 7527084 - DNA, 22 bp, Homo sapiens
cgtggctggtggacctgagggc

SEQ ID NO: 7527085 - DNA, 22 bp, Homo sapiens
cgtgagcaaaatggacactccc

SEQ ID NO: 7527086 - DNA, 22 bp, Homo sapiens
cgtgagcaaaatggacactccc

SEQ ID NO: 7527087 - DNA, 22 bp, Homo sapiens
cgtgagcaaaatggacactccc

SEQ ID NO: 7527088 - DNA, 22 bp, Homo sapiens
cgtgagcaaaatggacactccc

SEQ ID NO: 7527089 - DNA, 21 bp, Homo sapiens
cgtgactgggtccgtctggct

SEQ ID NO: 7527090 - DNA, 21 bp, Homo sapiens
cgtgactgggtccgtctggct

SEQ ID NO: 7527091 - DNA, 21 bp, Homo sapiens
cgtgactgggtccgtctggct

SEQ ID NO: 7527092 - DNA, 22 bp, Homo sapiens
cggagttagggaattgcattct

SEQ ID NO: 7527093 - DNA, 22 bp, Homo sapiens
cggagtggggactggggtaatc

SEQ ID NO: 7527094 - DNA, 22 bp, Homo sapiens
cggagtggagaaggtcacagaa

SEQ ID NO: 7527095 - DNA, 18 bp, Homo sapiens
cggatcatgcgctgaggc

SEQ ID NO: 7527096 - DNA, 22 bp, Homo sapiens
cggatatgttttgattgaagga

SEQ ID NO: 7527097 - DNA, 22 bp, Homo sapiens
cggatatgttttgattgaagga

SEQ ID NO: 7527098 - DNA, 22 bp, Homo sapiens
cggcacagccgggcaaggctgg

SEQ ID NO: 7527099 - DNA, 22 bp, Homo sapiens
cggatcatgtgacctttgagtg

SEQ ID NO: 7527100 - DNA, 22 bp, Homo sapiens
cggatcctcagtcgtgcgggag

SEQ ID NO: 7527101 - DNA, 22 bp, Homo sapiens
cggcacagccgggcaaggctgg

SEQ ID NO: 7527102 - DNA, 22 bp, Homo sapiens
cggcacagccgggcaaggctgg

SEQ ID NO: 7527103 - DNA, 22 bp, Homo sapiens
cggcacagccgggcaaggctgg

SEQ ID NO: 7527104 - DNA, 22 bp, Homo sapiens
cggcacagccgggcaaggctgg

SEQ ID NO: 7527105 - DNA, 22 bp, Homo sapiens
cggcacagccgggcaaggctgg

SEQ ID NO: 7527106 - DNA, 22 bp, Homo sapiens
cggcacagggtaaacgttaccc

SEQ ID NO: 7527107 - DNA, 22 bp, Homo sapiens
cggcagagacggcgctttgaac

SEQ ID NO: 7527108 - DNA, 22 bp, Homo sapiens
cggcagagacggcgctttgaac

SEQ ID NO: 7527109 - DNA, 22 bp, Homo sapiens
cggcacagtggctcacgcctgt

SEQ ID NO: 7527110 - DNA, 22 bp, Homo sapiens
cggcagagacggcgctttgaac

SEQ ID NO: 7527111 - DNA, 22 bp, Homo sapiens
cggcagagccctgagtcagcct

SEQ ID NO: 7527112 - DNA, 22 bp, Homo sapiens
cggcagagccctgagtcagcct

SEQ ID NO: 7527113 - DNA, 22 bp, Homo sapiens
cggcagagccctgagtcagcct

SEQ ID NO: 7527114 - DNA, 22 bp, Homo sapiens
cggcagagccctgagtcagcct

SEQ ID NO: 7527115 - DNA, 22 bp, Homo sapiens
cggcagagccctgagtcagcct

SEQ ID NO: 7527116 - DNA, 22 bp, Homo sapiens
cggcagagccctgagtcagcct

SEQ ID NO: 7527117 - DNA, 22 bp, Homo sapiens
cggcagagccctgagtcagcct

SEQ ID NO: 7527118 - DNA, 22 bp, Homo sapiens
cggcagagccctgagtcagcct

SEQ ID NO: 7527119 - DNA, 22 bp, Homo sapiens
cggcagagcggcgagcccctcc

SEQ ID NO: 7527120 - DNA, 22 bp, Homo sapiens
cggcagagcggcgagcccctcc

SEQ ID NO: 7527121 - DNA, 22 bp, Homo sapiens
cggcagagcggcgagcccctcc

SEQ ID NO: 7527122 - DNA, 22 bp, Homo sapiens
cggcagagcggcgagcccctcc

SEQ ID NO: 7527123 - DNA, 22 bp, Homo sapiens
cggcagagcttcctgctcagcg

SEQ ID NO: 7527124 - DNA, 22 bp, Homo sapiens
cggcagagcttcctgctcagcg

SEQ ID NO: 7527125 - DNA, 22 bp, Homo sapiens
cggcagagcttcctgctcagcg

SEQ ID NO: 7527126 - DNA, 22 bp, Homo sapiens
cggcagagcttcctgctcagcg

SEQ ID NO: 7527127 - DNA, 22 bp, Homo sapiens
cggcagagcttcctgctcagcg

SEQ ID NO: 7527128 - DNA, 22 bp, Homo sapiens
cggcagagcttcctgctcagcg

SEQ ID NO: 7527129 - DNA, 22 bp, Homo sapiens
cggcagctcgagggccacccgt

SEQ ID NO: 7527130 - DNA, 22 bp, Homo sapiens
cggcagctccgcgccgtaggac

SEQ ID NO: 7527131 - DNA, 22 bp, Homo sapiens
cggcagcatcgaaactacattc

SEQ ID NO: 7527132 - DNA, 22 bp, Homo sapiens
cggcagcggttggaggttgtag

SEQ ID NO: 7527133 - DNA, 22 bp, Homo sapiens
cggcagctgattgcagagcacc

SEQ ID NO: 7527134 - DNA, 22 bp, Homo sapiens
cggcaggacctcatttccttct

SEQ ID NO: 7527135 - DNA, 22 bp, Homo sapiens
cggcaggacctcatttccttct

SEQ ID NO: 7527136 - DNA, 22 bp, Homo sapiens
cggcagctcgagggccacccgt

SEQ ID NO: 7527137 - DNA, 22 bp, Homo sapiens
cggcagctgattgcagagcacc

SEQ ID NO: 7527138 - DNA, 22 bp, Homo sapiens
cggcagctgattgcagagcacc

SEQ ID NO: 7527139 - DNA, 22 bp, Homo sapiens
cggcaggacctcatttccttct

SEQ ID NO: 7527140 - DNA, 22 bp, Homo sapiens
cggcagggctccatgcatttct

SEQ ID NO: 7527141 - DNA, 22 bp, Homo sapiens
cggcaggacctcatttccttct

SEQ ID NO: 7527142 - DNA, 22 bp, Homo sapiens
cggcagggctccatgcatttct

SEQ ID NO: 7527143 - DNA, 22 bp, Homo sapiens
cggcagggttggttttctctga

SEQ ID NO: 7527144 - DNA, 22 bp, Homo sapiens
cggcagggttggttttctctga

SEQ ID NO: 7527145 - DNA, 18 bp, Homo sapiens
cggcagagtgcttctagc

SEQ ID NO: 7527146 - DNA, 18 bp, Homo sapiens
cggcagagtgcttctagc

SEQ ID NO: 7527147 - DNA, 18 bp, Homo sapiens
cggcagagtgcttctagc

SEQ ID NO: 7527148 - DNA, 22 bp, Homo sapiens
cggcagagcttcctgctcagcg

SEQ ID NO: 7527149 - DNA, 22 bp, Homo sapiens
cggcagagcttcctgctcagcg

SEQ ID NO: 7527150 - DNA, 22 bp, Homo sapiens
cggcagcaaaggaagccaggtc

SEQ ID NO: 7527151 - DNA, 22 bp, Homo sapiens
cggcagcaaaggaagccaggtc

SEQ ID NO: 7527152 - DNA, 22 bp, Homo sapiens
cggcagagtgtgtgcgtgcatg

SEQ ID NO: 7527153 - DNA, 22 bp, Homo sapiens
cggcagagtgtgtgcgtgcatg

SEQ ID NO: 7527154 - DNA, 22 bp, Homo sapiens
cggcagagtgtgtgcgtgcatg

SEQ ID NO: 7527155 - DNA, 22 bp, Homo sapiens
ttcaaatgatggcagtcctggc

SEQ ID NO: 7527156 - DNA, 22 bp, Homo sapiens
ttcaaatgatggcagtcctggc

SEQ ID NO: 7527157 - DNA, 22 bp, Homo sapiens
ttcaaatctctcctaatccact

SEQ ID NO: 7527158 - DNA, 22 bp, Homo sapiens
ttcaaatctctcctaatccact

SEQ ID NO: 7527159 - DNA, 22 bp, Homo sapiens
ttcaaatcctagccctgtggcc

SEQ ID NO: 7527160 - DNA, 22 bp, Homo sapiens
ttcaaatcctgcttatgctacc

SEQ ID NO: 7527161 - DNA, 22 bp, Homo sapiens
ttcaaatcactttggagcttaa

SEQ ID NO: 7527162 - DNA, 22 bp, Homo sapiens
ttcaaatccctgctccactatt

SEQ ID NO: 7527163 - DNA, 22 bp, Homo sapiens
ttcaaatcagaccgaaggcaac

SEQ ID NO: 7527164 - DNA, 22 bp, Homo sapiens
ttcaaatccctgctccactatt

SEQ ID NO: 7527165 - DNA, 22 bp, Homo sapiens
ttcaaatcctagccctgtggcc

SEQ ID NO: 7527166 - DNA, 22 bp, Homo sapiens
ttcaaatacattctttgccact

SEQ ID NO: 7527167 - DNA, 22 bp, Homo sapiens
ttcaaatacattctttgccact

SEQ ID NO: 7527168 - DNA, 21 bp, Homo sapiens
ttcaaagtttgcctaaagatt

SEQ ID NO: 7527169 - DNA, 22 bp, Homo sapiens
ttcaaatacattctttgccact

SEQ ID NO: 7527170 - DNA, 22 bp, Homo sapiens
ttcaaatacattctttgccact

SEQ ID NO: 7527171 - DNA, 21 bp, Homo sapiens
ttcaaagtttgcctaaagatt

SEQ ID NO: 7527172 - DNA, 22 bp, Homo sapiens
ttcaaagtgcttttaaccttta

SEQ ID NO: 7527173 - DNA, 20 bp, Homo sapiens
ttcaaagtgtatgatatgca

SEQ ID NO: 7527174 - DNA, 20 bp, Homo sapiens
ttcaaagtgtatgatatgca

SEQ ID NO: 7527175 - DNA, 22 bp, Homo sapiens
ttcaaagtgcatgttcctcaga

SEQ ID NO: 7527176 - DNA, 22 bp, Homo sapiens
ttcaaagtgcatgttcctcaga

SEQ ID NO: 7527177 - DNA, 22 bp, Homo sapiens
ttcaaagtcctgtcaggtagcc

SEQ ID NO: 7527178 - DNA, 22 bp, Homo sapiens
ttcaaagtgctgttcaaagtag

SEQ ID NO: 7527179 - DNA, 20 bp, Homo sapiens
ttcaaagtgtatgatatgca

SEQ ID NO: 7527180 - DNA, 22 bp, Homo sapiens
ttcaaagtgtgacctgacaagc

SEQ ID NO: 7527181 - DNA, 22 bp, Homo sapiens
ttcaaagtgtgacctgacaagc

SEQ ID NO: 7527182 - DNA, 22 bp, Homo sapiens
ttcaaagttgcatgacagctta

SEQ ID NO: 7527183 - DNA, 22 bp, Homo sapiens
ttcaaagtgtgacctgacaagc

SEQ ID NO: 7527184 - DNA, 22 bp, Homo sapiens
ttcaaagttgcatgacagctta

SEQ ID NO: 7527185 - DNA, 22 bp, Homo sapiens
ttcaaagtttcaatctgtatca

SEQ ID NO: 7527186 - DNA, 22 bp, Homo sapiens
ttcaaattaccacatttgctta

SEQ ID NO: 7527187 - DNA, 22 bp, Homo sapiens
ttcaaattaccacatttgctta

SEQ ID NO: 7527188 - DNA, 22 bp, Homo sapiens
ttcaaatggttagactgttagc

SEQ ID NO: 7527189 - DNA, 22 bp, Homo sapiens
ttcaaatggttagactgttagc

SEQ ID NO: 7527190 - DNA, 22 bp, Homo sapiens
ttcaaattaccacatttgctta

SEQ ID NO: 7527191 - DNA, 22 bp, Homo sapiens
ttcaaattaccacatttgctta

SEQ ID NO: 7527192 - DNA, 22 bp, Homo sapiens
ttcaaatggttagactgttagc

SEQ ID NO: 7527193 - DNA, 22 bp, Homo sapiens
ttcaaatggttagactgttagc

SEQ ID NO: 7527194 - DNA, 22 bp, Homo sapiens
ttcaaatggttagactgttagc

SEQ ID NO: 7527195 - DNA, 22 bp, Homo sapiens
ttcaaatgcaagttactacttt

SEQ ID NO: 7527196 - DNA, 22 bp, Homo sapiens
ttcaaatgcaagttactacttt

SEQ ID NO: 7527197 - DNA, 22 bp, Homo sapiens
ttcaaatgcaagttactacttt

SEQ ID NO: 7527198 - DNA, 22 bp, Homo sapiens
ttcaaatgcaagttactacttt

SEQ ID NO: 7527199 - DNA, 22 bp, Homo sapiens
cggaggttgaggctgcagtgag

SEQ ID NO: 7527200 - DNA, 22 bp, Homo sapiens
cggagaggtgggggcagcatct

SEQ ID NO: 7527201 - DNA, 22 bp, Homo sapiens
cggagaggacctgcaactcgct

SEQ ID NO: 7527202 - DNA, 20 bp, Homo sapiens
cggactttcttctcagggca

SEQ ID NO: 7527203 - DNA, 22 bp, Homo sapiens
cggagaggacctgcaactcgct

SEQ ID NO: 7527204 - DNA, 22 bp, Homo sapiens
cggagtcttgctatgttgccca

SEQ ID NO: 7527205 - DNA, 22 bp, Homo sapiens
cggagtggagaaggtcacagaa

SEQ ID NO: 7527206 - DNA, 22 bp, Homo sapiens
cggagtggggactggggtaatc

SEQ ID NO: 7527207 - DNA, 22 bp, Homo sapiens
cggagtgcctgtcatgcaggtt

SEQ ID NO: 7527208 - DNA, 22 bp, Homo sapiens
cggagtcttgctatgttgccca

SEQ ID NO: 7527209 - DNA, 22 bp, Homo sapiens
cggagtcttgctatgttgccca

SEQ ID NO: 7527210 - DNA, 22 bp, Homo sapiens
cggagtcttgctatgttgccca

SEQ ID NO: 7527211 - DNA, 22 bp, Homo sapiens
cggagtcttgctatgttgccca

SEQ ID NO: 7527212 - DNA, 22 bp, Homo sapiens
cggagaggtgggggcagcatct

SEQ ID NO: 7527213 - DNA, 22 bp, Homo sapiens
cggagtcttgctatgttgccca

SEQ ID NO: 7527214 - DNA, 22 bp, Homo sapiens
cggagtcttgctatgttgccca

SEQ ID NO: 7527215 - DNA, 22 bp, Homo sapiens
cggagtcttgctatgttgccca

SEQ ID NO: 7527216 - DNA, 22 bp, Homo sapiens
cggaggttgaggctgcagtgag

SEQ ID NO: 7527217 - DNA, 22 bp, Homo sapiens
cggaggttgaggctgcagtgag

SEQ ID NO: 7527218 - DNA, 22 bp, Homo sapiens
ccttttgtacacttactatata

SEQ ID NO: 7527219 - DNA, 22 bp, Homo sapiens
ccttttggccaggtcagtgcag

SEQ ID NO: 7527220 - DNA, 22 bp, Homo sapiens
ccttttgctctcccatccagaa

SEQ ID NO: 7527221 - DNA, 22 bp, Homo sapiens
ccttttgctctcccatccagaa

SEQ ID NO: 7527222 - DNA, 22 bp, Homo sapiens
cctttttctgagttgtagcttc

SEQ ID NO: 7527223 - DNA, 22 bp, Homo sapiens
cctttttccctggagggacagc

SEQ ID NO: 7527224 - DNA, 22 bp, Homo sapiens
cctttttccctggagggacagc

SEQ ID NO: 7527225 - DNA, 22 bp, Homo sapiens
ccttttgttggggtgtattcaa

SEQ ID NO: 7527226 - DNA, 22 bp, Homo sapiens
cctttttcaatatagaattgca

SEQ ID NO: 7527227 - DNA, 22 bp, Homo sapiens
ccttttcttgccactgactcgg

SEQ ID NO: 7527228 - DNA, 22 bp, Homo sapiens
ccttttcttgccactgactcgg

SEQ ID NO: 7527229 - DNA, 22 bp, Homo sapiens
ccttttctgtttcctgtcactg

SEQ ID NO: 7527230 - DNA, 22 bp, Homo sapiens
ccttttcttgccactgactcgg

SEQ ID NO: 7527231 - DNA, 22 bp, Homo sapiens
ccttttcttgccactgactcgg

SEQ ID NO: 7527232 - DNA, 22 bp, Homo sapiens
ccttttgaaggtgttgttaagt

SEQ ID NO: 7527233 - DNA, 22 bp, Homo sapiens
ccttttgaaggtgttgttaagt

SEQ ID NO: 7527234 - DNA, 22 bp, Homo sapiens
ccttttgaaggtgttgttaagt

SEQ ID NO: 7527235 - DNA, 22 bp, Homo sapiens
ccttttcttgccactgactcgg

SEQ ID NO: 7527236 - DNA, 22 bp, Homo sapiens
ccttttctggccaccaagcgct

SEQ ID NO: 7527237 - DNA, 22 bp, Homo sapiens
ccttttctgtgtgggtaattta

SEQ ID NO: 7527238 - DNA, 22 bp, Homo sapiens
ccttttctgtgtgggtaattta

SEQ ID NO: 7527239 - DNA, 22 bp, Homo sapiens
ccttttctgtttcctgtcactg

SEQ ID NO: 7527240 - DNA, 22 bp, Homo sapiens
ccttttctgtttcctgtcactg

SEQ ID NO: 7527241 - DNA, 22 bp, Homo sapiens
ccttttctgtgtgggtaattta

SEQ ID NO: 7527242 - DNA, 22 bp, Homo sapiens
ccttttctgaaccacttaaata

SEQ ID NO: 7527243 - DNA, 22 bp, Homo sapiens
ccttttctgaaccacttaaata

SEQ ID NO: 7527244 - DNA, 22 bp, Homo sapiens
ccttttctgaaccacttaaata

SEQ ID NO: 7527245 - DNA, 22 bp, Homo sapiens
ccttttctgaaccacttaaata

SEQ ID NO: 7527246 - DNA, 22 bp, Homo sapiens
ccttttctggccaccaagcgct

SEQ ID NO: 7527247 - DNA, 22 bp, Homo sapiens
ccttttctgaaccacttaaata

SEQ ID NO: 7527248 - DNA, 22 bp, Homo sapiens
ccttttctggccaccaagcgct

SEQ ID NO: 7527249 - DNA, 22 bp, Homo sapiens
ttatccaagcagaagctgcaca

SEQ ID NO: 7527250 - DNA, 22 bp, Homo sapiens
ttatccaagcagaagctgcaca

SEQ ID NO: 7527251 - DNA, 16 bp, Homo sapiens
ttatccaatcagttga

SEQ ID NO: 7527252 - DNA, 22 bp, Homo sapiens
ttatccaagcagaagctgcaca

SEQ ID NO: 7527253 - DNA, 22 bp, Homo sapiens
ttatccaacatgacttatgtcc

SEQ ID NO: 7527254 - DNA, 22 bp, Homo sapiens
ttatccaacatgacttatgtcc

SEQ ID NO: 7527255 - DNA, 22 bp, Homo sapiens
ttatccaaactggtgaatcatt

SEQ ID NO: 7527256 - DNA, 22 bp, Homo sapiens
cctttgggttcaatctcggtct

SEQ ID NO: 7527257 - DNA, 22 bp, Homo sapiens
cctttggtaacattccaacctt

SEQ ID NO: 7527258 - DNA, 22 bp, Homo sapiens
cctttggtaacattccaacctt

SEQ ID NO: 7527259 - DNA, 22 bp, Homo sapiens
cctttggtaacattccaacctt

SEQ ID NO: 7527260 - DNA, 22 bp, Homo sapiens
ccttttctaatcttaagaatgt

SEQ ID NO: 7527261 - DNA, 22 bp, Homo sapiens
cctttggtaattctgtgtagag

SEQ ID NO: 7527262 - DNA, 22 bp, Homo sapiens
ccttttcccatgtttctggagc

SEQ ID NO: 7527263 - DNA, 22 bp, Homo sapiens
cctttggtaattctgtgtagag

SEQ ID NO: 7527264 - DNA, 22 bp, Homo sapiens
cctttggtaacattccaacctt

SEQ ID NO: 7527265 - DNA, 22 bp, Homo sapiens
cctttggtaacattccaacctt

SEQ ID NO: 7527266 - DNA, 22 bp, Homo sapiens
cctttggtaattctgtgtagag

SEQ ID NO: 7527267 - DNA, 22 bp, Homo sapiens
ccttttctacaagcaaatgtgc

SEQ ID NO: 7527268 - DNA, 22 bp, Homo sapiens
ccttttctacaagcaaatgtgc

SEQ ID NO: 7527269 - DNA, 22 bp, Homo sapiens
ccttttctacaagcaaatgtgc

SEQ ID NO: 7527270 - DNA, 22 bp, Homo sapiens
ccttttctacaagcaaatgtgc

SEQ ID NO: 7527271 - DNA, 22 bp, Homo sapiens
ccttttctacaagcaaatgtgc

SEQ ID NO: 7527272 - DNA, 22 bp, Homo sapiens
ccttttctaatcttaagaatgt

SEQ ID NO: 7527273 - DNA, 22 bp, Homo sapiens
ccttttctaatcttaagaatgt

SEQ ID NO: 7527274 - DNA, 22 bp, Homo sapiens
ccttttctacaagcaaatgtgc

SEQ ID NO: 7527275 - DNA, 22 bp, Homo sapiens
ccttttctagaaagggaggcaa

SEQ ID NO: 7527276 - DNA, 22 bp, Homo sapiens
ccttttctagaaagggaggcaa

SEQ ID NO: 7527277 - DNA, 22 bp, Homo sapiens
ccttttctaggatgctttatag

SEQ ID NO: 7527278 - DNA, 22 bp, Homo sapiens
ccttttctaggatgctttatag

SEQ ID NO: 7527279 - DNA, 22 bp, Homo sapiens
ccttttctaggatgctttatag

SEQ ID NO: 7527280 - DNA, 22 bp, Homo sapiens
ccttttctatgtaccagcagtg

SEQ ID NO: 7527281 - DNA, 22 bp, Homo sapiens
ccttttctatgtaccagcagtg

SEQ ID NO: 7527282 - DNA, 22 bp, Homo sapiens
ccttttctatgtaccagcagtg

SEQ ID NO: 7527283 - DNA, 22 bp, Homo sapiens
ccttttctatgtaccagcagtg

SEQ ID NO: 7527284 - DNA, 22 bp, Homo sapiens
ccttttctatgtaccagcagtg

SEQ ID NO: 7527285 - DNA, 16 bp, Homo sapiens
ccttttctcatctcta

SEQ ID NO: 7527286 - DNA, 16 bp, Homo sapiens
ccttttctcatctcta

SEQ ID NO: 7527287 - DNA, 22 bp, Homo sapiens
ccttttctatccttctaggttc

SEQ ID NO: 7527288 - DNA, 22 bp, Homo sapiens
ccttttctatccttctaggttc

SEQ ID NO: 7527289 - DNA, 22 bp, Homo sapiens
ccttttctaggatgctttatag

SEQ ID NO: 7527290 - DNA, 22 bp, Homo sapiens
ccttttctatccttctaggttc

SEQ ID NO: 7527291 - DNA, 22 bp, Homo sapiens
ccttttctatccttctaggttc

SEQ ID NO: 7527292 - DNA, 22 bp, Homo sapiens
cctttttctgagttgtagcttc

SEQ ID NO: 7527293 - DNA, 22 bp, Homo sapiens
cctttttctgagttgtagcttc

SEQ ID NO: 7527294 - DNA, 21 bp, Homo sapiens
cctttttgcttatggacagac

SEQ ID NO: 7527295 - DNA, 21 bp, Homo sapiens
cctttttgcttatggacagac

SEQ ID NO: 7527296 - DNA, 19 bp, Homo sapiens
ccttttttaacttcagcaa

SEQ ID NO: 7527297 - DNA, 19 bp, Homo sapiens
ccttttttaacttcagcaa

SEQ ID NO: 7527298 - DNA, 22 bp, Homo sapiens
ccttttttctatgccaactctg

SEQ ID NO: 7527299 - DNA, 22 bp, Homo sapiens
ccttttttctatgccaactctg

SEQ ID NO: 7527300 - DNA, 19 bp, Homo sapiens
ccttttttaacttcagcaa

SEQ ID NO: 7527301 - DNA, 19 bp, Homo sapiens
ccttttttaacttcagcaa

SEQ ID NO: 7527302 - DNA, 19 bp, Homo sapiens
ccttttttaacttcagcaa

SEQ ID NO: 7527303 - DNA, 19 bp, Homo sapiens
ccttttttaacttcagcaa

SEQ ID NO: 7527304 - DNA, 22 bp, Homo sapiens
cgaaaatagatctgtttcccag

SEQ ID NO: 7527305 - DNA, 22 bp, Homo sapiens
cgaaacaggatcttagcccttg

SEQ ID NO: 7527306 - DNA, 22 bp, Homo sapiens
ccttttttctatgccaactctg

SEQ ID NO: 7527307 - DNA, 22 bp, Homo sapiens
ccttttttctatgccaactctg

SEQ ID NO: 7527308 - DNA, 22 bp, Homo sapiens
ccttttttctatgccaactctg

SEQ ID NO: 7527309 - DNA, 22 bp, Homo sapiens
cgaaacatctatgatcattaat

SEQ ID NO: 7527310 - DNA, 22 bp, Homo sapiens
cgaaatcagcatcttgaggcaa

SEQ ID NO: 7527311 - DNA, 22 bp, Homo sapiens
cgaacacacttgggagttctga

SEQ ID NO: 7527312 - DNA, 22 bp, Homo sapiens
cgaacacacttgggagttctga

SEQ ID NO: 7527313 - DNA, 22 bp, Homo sapiens
cgaacacacttgggagttctga

SEQ ID NO: 7527314 - DNA, 22 bp, Homo sapiens
cgagaggctggacagggctggg

SEQ ID NO: 7527315 - DNA, 22 bp, Homo sapiens
cgagagccggaaggggcggtgc

SEQ ID NO: 7527316 - DNA, 22 bp, Homo sapiens
cgagaggctggacagggctggg

SEQ ID NO: 7527317 - DNA, 22 bp, Homo sapiens
cgagagatgggttggcaggggc

SEQ ID NO: 7527318 - DNA, 22 bp, Homo sapiens
cgagaaggtcttcccacagagc

SEQ ID NO: 7527319 - DNA, 22 bp, Homo sapiens
cgacgggctcggtccgcttcct

SEQ ID NO: 7527320 - DNA, 22 bp, Homo sapiens
cgagagagacatggtgacctgc

SEQ ID NO: 7527321 - DNA, 22 bp, Homo sapiens
cgagagagacatggtgacctgc

SEQ ID NO: 7527322 - DNA, 22 bp, Homo sapiens
cgagaaatgagaaacccatttt

SEQ ID NO: 7527323 - DNA, 22 bp, Homo sapiens
cgagagagacatggtgacctgc

SEQ ID NO: 7527324 - DNA, 22 bp, Homo sapiens
cgagagatgggttggcaggggc

SEQ ID NO: 7527325 - DNA, 22 bp, Homo sapiens
cgaagtttggggagaggagtct

SEQ ID NO: 7527326 - DNA, 22 bp, Homo sapiens
cgacagcagaagaagcaagcca

SEQ ID NO: 7527327 - DNA, 22 bp, Homo sapiens
cgaatcttgaggtttcatgagg

SEQ ID NO: 7527328 - DNA, 22 bp, Homo sapiens
cgaattccatcagggtcttttg

SEQ ID NO: 7527329 - DNA, 22 bp, Homo sapiens
cgacagcagaagaagcaagcca

SEQ ID NO: 7527330 - DNA, 21 bp, Homo sapiens
cgaagtttgggcagaggggtc

SEQ ID NO: 7527331 - DNA, 22 bp, Homo sapiens
cgaagacagaccatctgagtag

SEQ ID NO: 7527332 - DNA, 22 bp, Homo sapiens
cgaagacagaccatctgagtag

SEQ ID NO: 7527333 - DNA, 22 bp, Homo sapiens
cgaagacagaccatctgagtag

SEQ ID NO: 7527334 - DNA, 21 bp, Homo sapiens
cgacagtgtatagattagagc

SEQ ID NO: 7527335 - DNA, 21 bp, Homo sapiens
cgacaggagaggcagccagcc

SEQ ID NO: 7527336 - DNA, 22 bp, Homo sapiens
cgacgggctcggtccgcttcct

SEQ ID NO: 7527337 - DNA, 22 bp, Homo sapiens
cgactctgcagggatccgggag

SEQ ID NO: 7527338 - DNA, 22 bp, Homo sapiens
cgagaaatgagaaacccatttt

SEQ ID NO: 7527339 - DNA, 22 bp, Homo sapiens
ttattgagtatctgcttggtgt

SEQ ID NO: 7527340 - DNA, 22 bp, Homo sapiens
ttattgagtatctgcttggtgt

SEQ ID NO: 7527341 - DNA, 22 bp, Homo sapiens
ttattgagttgtaagagctctt

SEQ ID NO: 7527342 - DNA, 16 bp, Homo sapiens
ttattgaggccaagga

SEQ ID NO: 7527343 - DNA, 22 bp, Homo sapiens
ttattgagttgtaagagctctt

SEQ ID NO: 7527344 - DNA, 22 bp, Homo sapiens
ttattgagtttacagctttaga

SEQ ID NO: 7527345 - DNA, 22 bp, Homo sapiens
ttattgcaaaggaagagcttga

SEQ ID NO: 7527346 - DNA, 22 bp, Homo sapiens
ttattgcaaaggaagagcttga

SEQ ID NO: 7527347 - DNA, 22 bp, Homo sapiens
ttattgcaactcctaaatagag

SEQ ID NO: 7527348 - DNA, 22 bp, Homo sapiens
ttattgcaaccttttctggtgt

SEQ ID NO: 7527349 - DNA, 22 bp, Homo sapiens
ttattgcaaccttttctggtgt

SEQ ID NO: 7527350 - DNA, 22 bp, Homo sapiens
ttattcagcatttagaggaagg

SEQ ID NO: 7527351 - DNA, 22 bp, Homo sapiens
ttattcagcagggacttccttt

SEQ ID NO: 7527352 - DNA, 22 bp, Homo sapiens
ttattcagcagggacttccttt

SEQ ID NO: 7527353 - DNA, 22 bp, Homo sapiens
ttattcagcagggacttccttt

SEQ ID NO: 7527354 - DNA, 22 bp, Homo sapiens
ttattcagattggctacaggat

SEQ ID NO: 7527355 - DNA, 22 bp, Homo sapiens
cgagcagaagcctggtggtctg

SEQ ID NO: 7527356 - DNA, 22 bp, Homo sapiens
ttattcagattggctacaggat

SEQ ID NO: 7527357 - DNA, 22 bp, Homo sapiens
ttattcagattggctacaggat

SEQ ID NO: 7527358 - DNA, 22 bp, Homo sapiens
ttattcagctctctagaggcac

SEQ ID NO: 7527359 - DNA, 22 bp, Homo sapiens
ttattcagctctctagaggcac

SEQ ID NO: 7527360 - DNA, 22 bp, Homo sapiens
ttattcagctctctagaggcac

SEQ ID NO: 7527361 - DNA, 22 bp, Homo sapiens
ttattcagctctctagaggcac

SEQ ID NO: 7527362 - DNA, 22 bp, Homo sapiens
ttattcaggaaggtgttactta

SEQ ID NO: 7527363 - DNA, 22 bp, Homo sapiens
ttattcaggaaggtgttactta

SEQ ID NO: 7527364 - DNA, 22 bp, Homo sapiens
ttattcagcatttagaggaagg

SEQ ID NO: 7527365 - DNA, 22 bp, Homo sapiens
ttattcagcatttagaggaagg

SEQ ID NO: 7527366 - DNA, 22 bp, Homo sapiens
ttattcagcatttagaggaagg

SEQ ID NO: 7527367 - DNA, 22 bp, Homo sapiens
cgagcagaagcctggtggtctg

SEQ ID NO: 7527368 - DNA, 22 bp, Homo sapiens
cgagatccttcagagcgcggac

SEQ ID NO: 7527369 - DNA, 22 bp, Homo sapiens
cgagagttagctaggagtcaca

SEQ ID NO: 7527370 - DNA, 22 bp, Homo sapiens
cgagagtggacagggcgcagct

SEQ ID NO: 7527371 - DNA, 22 bp, Homo sapiens
cgagagttagctaggagtcaca

SEQ ID NO: 7527372 - DNA, 22 bp, Homo sapiens
cgagagttagctaggagtcaca

SEQ ID NO: 7527373 - DNA, 22 bp, Homo sapiens
cgagagttagctaggagtcaca

SEQ ID NO: 7527374 - DNA, 22 bp, Homo sapiens
cgagagttagctaggagtcaca

SEQ ID NO: 7527375 - DNA, 22 bp, Homo sapiens
cgctgcctctctggggccctgg

SEQ ID NO: 7527376 - DNA, 22 bp, Homo sapiens
cgctgcctctctggggccctgg

SEQ ID NO: 7527377 - DNA, 22 bp, Homo sapiens
cgctgccttcatcccacgccta

SEQ ID NO: 7527378 - DNA, 22 bp, Homo sapiens
cgctgccttcatcccacgccta

SEQ ID NO: 7527379 - DNA, 22 bp, Homo sapiens
cgctgcctccaggtgcagcagg

SEQ ID NO: 7527380 - DNA, 22 bp, Homo sapiens
cgctgcctccaggtgcagcagg

SEQ ID NO: 7527381 - DNA, 22 bp, Homo sapiens
cgctgcctccaggtgcagcagg

SEQ ID NO: 7527382 - DNA, 22 bp, Homo sapiens
cgctgccaggtcaccaggggta

SEQ ID NO: 7527383 - DNA, 22 bp, Homo sapiens
cgctgccaggatcccctgccgg

SEQ ID NO: 7527384 - DNA, 22 bp, Homo sapiens
cgctgcagtttatgtgttcctg

SEQ ID NO: 7527385 - DNA, 22 bp, Homo sapiens
cgctgcagctggctgcagggaa

SEQ ID NO: 7527386 - DNA, 22 bp, Homo sapiens
cgctgcagctggctgcagggaa

SEQ ID NO: 7527387 - DNA, 22 bp, Homo sapiens
cgctgcagctggctgcagggaa

SEQ ID NO: 7527388 - DNA, 22 bp, Homo sapiens
cgctgcagatgggagctggttg

SEQ ID NO: 7527389 - DNA, 22 bp, Homo sapiens
cgctgcagatgggagctggttg

SEQ ID NO: 7527390 - DNA, 22 bp, Homo sapiens
cgctgcagatgggagctggttg

SEQ ID NO: 7527391 - DNA, 22 bp, Homo sapiens
cgctgcagacgcgctggcgaaa

SEQ ID NO: 7527392 - DNA, 22 bp, Homo sapiens
cgctgataaacgtcacgttccc

SEQ ID NO: 7527393 - DNA, 22 bp, Homo sapiens
cgctgcacgtgtcacactaacc

SEQ ID NO: 7527394 - DNA, 22 bp, Homo sapiens
cgctgcagaagcgtgttcagga

SEQ ID NO: 7527395 - DNA, 22 bp, Homo sapiens
cgctgccttcatcccacgccta

SEQ ID NO: 7527396 - DNA, 22 bp, Homo sapiens
cgctgccttcatcccacgccta

SEQ ID NO: 7527397 - DNA, 21 bp, Homo sapiens
cgctgccttgggagtggacct

SEQ ID NO: 7527398 - DNA, 21 bp, Homo sapiens
cgctgccttgggagtggacct

SEQ ID NO: 7527399 - DNA, 21 bp, Homo sapiens
cgctgccttgggagtggacct

SEQ ID NO: 7527400 - DNA, 22 bp, Homo sapiens
cgctgcgaggcgcccttgttgc

SEQ ID NO: 7527401 - DNA, 22 bp, Homo sapiens
cgctggcattagggcagtggcc

SEQ ID NO: 7527402 - DNA, 22 bp, Homo sapiens
cgctgctccgccttgtccatat

SEQ ID NO: 7527403 - DNA, 22 bp, Homo sapiens
cgctgctcggaaggtgtcacgt

SEQ ID NO: 7527404 - DNA, 22 bp, Homo sapiens
cgctggcttcctcctggggcca

SEQ ID NO: 7527405 - DNA, 22 bp, Homo sapiens
cgctgggcaggtccacttgtta

SEQ ID NO: 7527406 - DNA, 22 bp, Homo sapiens
cgctgggcaggtccacttgtta

SEQ ID NO: 7527407 - DNA, 22 bp, Homo sapiens
ttcaaagtcagccatctggcta

SEQ ID NO: 7527408 - DNA, 22 bp, Homo sapiens
cgctggcttcctcctggggcca

SEQ ID NO: 7527409 - DNA, 22 bp, Homo sapiens
cgctggcttcctcctggggcca

SEQ ID NO: 7527410 - DNA, 22 bp, Homo sapiens
cgctggcttcctcctggggcca

SEQ ID NO: 7527411 - DNA, 22 bp, Homo sapiens
cgctggcattagggcagtggcc

SEQ ID NO: 7527412 - DNA, 22 bp, Homo sapiens
cgctggcattagggcagtggcc

SEQ ID NO: 7527413 - DNA, 22 bp, Homo sapiens
cgctggccatagcctcctgtgt

SEQ ID NO: 7527414 - DNA, 22 bp, Homo sapiens
cgctggccatagcctcctgtgt

SEQ ID NO: 7527415 - DNA, 22 bp, Homo sapiens
ttatttcatgtaaaatttatgt

SEQ ID NO: 7527416 - DNA, 22 bp, Homo sapiens
ttatttcatgtaaaatttatgt

SEQ ID NO: 7527417 - DNA, 16 bp, Homo sapiens
cgcctccctccctcgc

SEQ ID NO: 7527418 - DNA, 16 bp, Homo sapiens
cgcctccctccctcgc

SEQ ID NO: 7527419 - DNA, 16 bp, Homo sapiens
cgcctccctccctcgc

SEQ ID NO: 7527420 - DNA, 22 bp, Homo sapiens
cgcctcagccgtggtcatcttc

SEQ ID NO: 7527421 - DNA, 22 bp, Homo sapiens
cgcctcagccgtggtcatcttc

SEQ ID NO: 7527422 - DNA, 22 bp, Homo sapiens
cgcctcagccgtggtcatcttc

SEQ ID NO: 7527423 - DNA, 22 bp, Homo sapiens
ttatttcatgtaaaatttatgt

SEQ ID NO: 7527424 - DNA, 22 bp, Homo sapiens
ttatttcatgtaaaatttatgt

SEQ ID NO: 7527425 - DNA, 22 bp, Homo sapiens
ttatttcatgtaaaatttatgt

SEQ ID NO: 7527426 - DNA, 22 bp, Homo sapiens
ttatttcatgtaaaatttatgt

SEQ ID NO: 7527427 - DNA, 22 bp, Homo sapiens
ttatttcatgtaaaatttatgt

SEQ ID NO: 7527428 - DNA, 22 bp, Homo sapiens
ttatttcatataatgttatcaa

SEQ ID NO: 7527429 - DNA, 22 bp, Homo sapiens
ttatttcatataatgttatcaa

SEQ ID NO: 7527430 - DNA, 22 bp, Homo sapiens
ttatttcatataatgttatcaa

SEQ ID NO: 7527431 - DNA, 22 bp, Homo sapiens
ttatttcatataatgttatcaa

SEQ ID NO: 7527432 - DNA, 22 bp, Homo sapiens
cgctgcacgtgtcacactaacc

SEQ ID NO: 7527433 - DNA, 19 bp, Homo sapiens
cgctctgggtttcgtgtca

SEQ ID NO: 7527434 - DNA, 19 bp, Homo sapiens
cgctctgggtttcgtgtca

SEQ ID NO: 7527435 - DNA, 22 bp, Homo sapiens
cgctgataaacgtcacgttccc

SEQ ID NO: 7527436 - DNA, 19 bp, Homo sapiens
cgctctgggtttcgtgtca

SEQ ID NO: 7527437 - DNA, 22 bp, Homo sapiens
cgctctggagaatagtagcttt

SEQ ID NO: 7527438 - DNA, 22 bp, Homo sapiens
cgctctggagaatagtagcttt

SEQ ID NO: 7527439 - DNA, 22 bp, Homo sapiens
cgctctggagaatagtagcttt

SEQ ID NO: 7527440 - DNA, 22 bp, Homo sapiens
cgctctggcaggcacaggaggg

SEQ ID NO: 7527441 - DNA, 22 bp, Homo sapiens
cgctctggcaggcacaggaggg

SEQ ID NO: 7527442 - DNA, 22 bp, Homo sapiens
cgctccttgagcgtgtcggcct

SEQ ID NO: 7527443 - DNA, 22 bp, Homo sapiens
cgctccttgagcgtgtcggcct

SEQ ID NO: 7527444 - DNA, 22 bp, Homo sapiens
cgcctctctttttctcccagac

SEQ ID NO: 7527445 - DNA, 22 bp, Homo sapiens
cgctccttgagcgtgtcggcct

SEQ ID NO: 7527446 - DNA, 22 bp, Homo sapiens
cgcctctctttttctcccagac

SEQ ID NO: 7527447 - DNA, 22 bp, Homo sapiens
cgcctctctttttctcccagac

SEQ ID NO: 7527448 - DNA, 16 bp, Homo sapiens
cgcctccctccctcgc

SEQ ID NO: 7527449 - DNA, 20 bp, Homo sapiens
ttatttcagttgctagattg

SEQ ID NO: 7527450 - DNA, 20 bp, Homo sapiens
ttatttcagttgctagattg

SEQ ID NO: 7527451 - DNA, 20 bp, Homo sapiens
ttatttcagttgctagattg

SEQ ID NO: 7527452 - DNA, 20 bp, Homo sapiens
ttatttcagttgctagattg

SEQ ID NO: 7527453 - DNA, 21 bp, Homo sapiens
ttatttcacatggacttccag

SEQ ID NO: 7527454 - DNA, 21 bp, Homo sapiens
ttatttcacatggacttccag

SEQ ID NO: 7527455 - DNA, 22 bp, Homo sapiens
ttatttattgtgtacctactgt

SEQ ID NO: 7527456 - DNA, 22 bp, Homo sapiens
ttatttcaaaagagcttggggt

SEQ ID NO: 7527457 - DNA, 22 bp, Homo sapiens
ttatttcaaaagagcttggggt

SEQ ID NO: 7527458 - DNA, 22 bp, Homo sapiens
ttatttcatataatgttatcaa

SEQ ID NO: 7527459 - DNA, 22 bp, Homo sapiens
ttatttcatataatgttatcaa

SEQ ID NO: 7527460 - DNA, 22 bp, Homo sapiens
ttatttcatataatgttatcaa

SEQ ID NO: 7527461 - DNA, 20 bp, Homo sapiens
ttatttcagttgctagattg

SEQ ID NO: 7527462 - DNA, 20 bp, Homo sapiens
ttatttcagttgctagattg

SEQ ID NO: 7527463 - DNA, 20 bp, Homo sapiens
ttatttcagttgctagattg

SEQ ID NO: 7527464 - DNA, 22 bp, Homo sapiens
ttatttattgtgtacctactgt

SEQ ID NO: 7527465 - DNA, 22 bp, Homo sapiens
ttatttattgtgtacctactgt

SEQ ID NO: 7527466 - DNA, 22 bp, Homo sapiens
ttatttattgtgtacctactgt

SEQ ID NO: 7527467 - DNA, 22 bp, Homo sapiens
ttatttattgtgtacctactgt

SEQ ID NO: 7527468 - DNA, 22 bp, Homo sapiens
ttatttattgtgtacctactgt

SEQ ID NO: 7527469 - DNA, 22 bp, Homo sapiens
ttatttattgtgtacctactgt

SEQ ID NO: 7527470 - DNA, 22 bp, Homo sapiens
ttatttattcattctgtctgtc

SEQ ID NO: 7527471 - DNA, 22 bp, Homo sapiens
ttatttattcattctgtctgtc

SEQ ID NO: 7527472 - DNA, 22 bp, Homo sapiens
ttatttatgttaacagtcgaga

SEQ ID NO: 7527473 - DNA, 22 bp, Homo sapiens
ttattgctatgatgatgtgtag

SEQ ID NO: 7527474 - DNA, 22 bp, Homo sapiens
ttattgctatggtgagagggat

SEQ ID NO: 7527475 - DNA, 22 bp, Homo sapiens
ttattgctatggtgagagggat

SEQ ID NO: 7527476 - DNA, 22 bp, Homo sapiens
ttattgctatggtgagagggat

SEQ ID NO: 7527477 - DNA, 22 bp, Homo sapiens
ttatttattcattctgtctgtc

SEQ ID NO: 7527478 - DNA, 22 bp, Homo sapiens
ttatttattcattctgtctgtc

SEQ ID NO: 7527479 - DNA, 22 bp, Homo sapiens
ttatttatgttaacagtcgaga

SEQ ID NO: 7527480 - DNA, 22 bp, Homo sapiens
ttatttattcattctgtctgtc

SEQ ID NO: 7527481 - DNA, 22 bp, Homo sapiens
ttattgcagatggtgtgagaga

SEQ ID NO: 7527482 - DNA, 22 bp, Homo sapiens
ttattgcagatggtgtgagaga

SEQ ID NO: 7527483 - DNA, 22 bp, Homo sapiens
ttattgcagatggtgtgagaga

SEQ ID NO: 7527484 - DNA, 22 bp, Homo sapiens
ttattgcagccgcagggcgctg

SEQ ID NO: 7527485 - DNA, 17 bp, Homo sapiens
ttattgcagtgctgaag

SEQ ID NO: 7527486 - DNA, 22 bp, Homo sapiens
ttattgcagccgcagggcgctg

SEQ ID NO: 7527487 - DNA, 22 bp, Homo sapiens
ttattgcatagattatgccata

SEQ ID NO: 7527488 - DNA, 22 bp, Homo sapiens
ttattgcatagattatgccata

SEQ ID NO: 7527489 - DNA, 23 bp, Homo sapiens
ttattgcatccaaatgcattcct

SEQ ID NO: 7527490 - DNA, 23 bp, Homo sapiens
ttattgcatccaaatgcattcct

SEQ ID NO: 7527491 - DNA, 22 bp, Homo sapiens
ttattgccatcctggaacctag

SEQ ID NO: 7527492 - DNA, 22 bp, Homo sapiens
ttattgcatagattatgccata

SEQ ID NO: 7527493 - DNA, 23 bp, Homo sapiens
ttattgcatccaaatgcattcct

SEQ ID NO: 7527494 - DNA, 22 bp, Homo sapiens
ttattgccatcctggaacctag

SEQ ID NO: 7527495 - DNA, 22 bp, Homo sapiens
ttattgcctgattgaggtcatt

SEQ ID NO: 7527496 - DNA, 22 bp, Homo sapiens
ttattgcctgattgaggtcatt

SEQ ID NO: 7527497 - DNA, 22 bp, Homo sapiens
ttattgcctgattgaggtcatt

SEQ ID NO: 7527498 - DNA, 22 bp, Homo sapiens
ttattgcctgtcattattgaat

SEQ ID NO: 7527499 - DNA, 22 bp, Homo sapiens
ttattgctaaggtactaggtgg

SEQ ID NO: 7527500 - DNA, 22 bp, Homo sapiens
ttattgctagtgtcatttcaca

SEQ ID NO: 7527501 - DNA, 22 bp, Homo sapiens
ttattgctagtgtcatttcaca

SEQ ID NO: 7527502 - DNA, 17 bp, Homo sapiens
ttattgctataagctga

SEQ ID NO: 7527503 - DNA, 22 bp, Homo sapiens
ttattgcaactttagggataga

SEQ ID NO: 7527504 - DNA, 22 bp, Homo sapiens
ttattgcaactcctaaatagag

SEQ ID NO: 7527505 - DNA, 22 bp, Homo sapiens
ttattgcaactcctaaatagag

SEQ ID NO: 7527506 - DNA, 23 bp, Homo sapiens
ttattgcaaggtaaaattgctga

SEQ ID NO: 7527507 - DNA, 22 bp, Homo sapiens
ttattgcaactttagggataga

SEQ ID NO: 7527508 - DNA, 22 bp, Homo sapiens
ttattgcaccatgcctcagttt

SEQ ID NO: 7527509 - DNA, 22 bp, Homo sapiens
ttattgcaccatgcctcagttt

SEQ ID NO: 7527510 - DNA, 23 bp, Homo sapiens
ttattgcaaggtaaaattgctga

SEQ ID NO: 7527511 - DNA, 23 bp, Homo sapiens
ttattgcaaggtaaaattgctga

SEQ ID NO: 7527512 - DNA, 22 bp, Homo sapiens
ttattgcactattgattttcta

SEQ ID NO: 7527513 - DNA, 22 bp, Homo sapiens
ttattgcactattgattttcta

SEQ ID NO: 7527514 - DNA, 22 bp, Homo sapiens
ttattgcaccttcctcactaac

SEQ ID NO: 7527515 - DNA, 22 bp, Homo sapiens
ttattgcaccttcctcactaac

SEQ ID NO: 7527516 - DNA, 22 bp, Homo sapiens
ttattgcactattgattttcta

SEQ ID NO: 7527517 - DNA, 22 bp, Homo sapiens
ttattgcactattgattttcta

SEQ ID NO: 7527518 - DNA, 22 bp, Homo sapiens
ttctggatgctgttaagatgta

SEQ ID NO: 7527519 - DNA, 23 bp, Homo sapiens
ttctggatgttctagtctgagag

SEQ ID NO: 7527520 - DNA, 22 bp, Homo sapiens
ttctggaaggcagggagaaccc

SEQ ID NO: 7527521 - DNA, 22 bp, Homo sapiens
ttctggaaggcagggagaaccc

SEQ ID NO: 7527522 - DNA, 22 bp, Homo sapiens
ttctggaaggcagggagaaccc

SEQ ID NO: 7527523 - DNA, 22 bp, Homo sapiens
ttctggaagggtggagtagctt

SEQ ID NO: 7527524 - DNA, 22 bp, Homo sapiens
ttctggaagggtggagtagctt

SEQ ID NO: 7527525 - DNA, 22 bp, Homo sapiens
ttctggaaggatgtttctatct

SEQ ID NO: 7527526 - DNA, 22 bp, Homo sapiens
ttctggaagctgggcagcaccc

SEQ ID NO: 7527527 - DNA, 22 bp, Homo sapiens
ttctggaagctgggcagcaccc

SEQ ID NO: 7527528 - DNA, 22 bp, Homo sapiens
ttctggaagctgggcagcaccc

SEQ ID NO: 7527529 - DNA, 22 bp, Homo sapiens
ttctggaagctgggcagcaccc

SEQ ID NO: 7527530 - DNA, 22 bp, Homo sapiens
ttctggaagctgggcagcaccc

SEQ ID NO: 7527531 - DNA, 22 bp, Homo sapiens
ttctggaagctggaaaaggcaa

SEQ ID NO: 7527532 - DNA, 22 bp, Homo sapiens
ttctggaagctggaaaaggcaa

SEQ ID NO: 7527533 - DNA, 22 bp, Homo sapiens
ttctggaagctggaaaaggcaa

SEQ ID NO: 7527534 - DNA, 22 bp, Homo sapiens
ttctggaagctggaaaaggcaa

SEQ ID NO: 7527535 - DNA, 23 bp, Homo sapiens
ttctggaagatttacttgagaca

SEQ ID NO: 7527536 - DNA, 22 bp, Homo sapiens
ttctggaagcagtggggagtga

SEQ ID NO: 7527537 - DNA, 23 bp, Homo sapiens
ttctggaagatttacttgagaca

SEQ ID NO: 7527538 - DNA, 23 bp, Homo sapiens
ttctggaagatttacttgagaca

SEQ ID NO: 7527539 - DNA, 22 bp, Homo sapiens
ttctggaagccatgggaacagg

SEQ ID NO: 7527540 - DNA, 22 bp, Homo sapiens
ttctggaagccatgggaacagg

SEQ ID NO: 7527541 - DNA, 22 bp, Homo sapiens
ttctggaagccatgggaacagg

SEQ ID NO: 7527542 - DNA, 22 bp, Homo sapiens
ttctggaagccatgggaacagg

SEQ ID NO: 7527543 - DNA, 22 bp, Homo sapiens
ttctggaagccccagagtcaga

SEQ ID NO: 7527544 - DNA, 22 bp, Homo sapiens
ttctggaagccctaagggagaa

SEQ ID NO: 7527545 - DNA, 22 bp, Homo sapiens
ttctggaagccctaagggagaa

SEQ ID NO: 7527546 - DNA, 22 bp, Homo sapiens
ttctggaagccccagagtcaga

SEQ ID NO: 7527547 - DNA, 22 bp, Homo sapiens
ttctggaagccccagagtcaga

SEQ ID NO: 7527548 - DNA, 22 bp, Homo sapiens
ttctggaagccccagagtcaga

SEQ ID NO: 7527549 - DNA, 22 bp, Homo sapiens
ttctggaagccccagagtcaga

SEQ ID NO: 7527550 - DNA, 22 bp, Homo sapiens
ttctggaagccccagagtcaga

SEQ ID NO: 7527551 - DNA, 22 bp, Homo sapiens
ttctggaagccccagagtcaga

SEQ ID NO: 7527552 - DNA, 22 bp, Homo sapiens
ttctggaagctgcaggtggccg

SEQ ID NO: 7527553 - DNA, 22 bp, Homo sapiens
ttctggaagctgcaggtggccg

SEQ ID NO: 7527554 - DNA, 22 bp, Homo sapiens
ttctggaagctgcaggtggccg

SEQ ID NO: 7527555 - DNA, 22 bp, Homo sapiens
ttctgcatgccctctgtgtggc

SEQ ID NO: 7527556 - DNA, 22 bp, Homo sapiens
ttctgcatgaacagtttattcc

SEQ ID NO: 7527557 - DNA, 22 bp, Homo sapiens
ttctgcatgatattaaatgtaa

SEQ ID NO: 7527558 - DNA, 22 bp, Homo sapiens
ttctgcatccctttttgggcca

SEQ ID NO: 7527559 - DNA, 22 bp, Homo sapiens
ttctgcatccctttttgggcca

SEQ ID NO: 7527560 - DNA, 22 bp, Homo sapiens
ttctgcatcctatgatcgcata

SEQ ID NO: 7527561 - DNA, 22 bp, Homo sapiens
ttctgcatctatttttctgctg

SEQ ID NO: 7527562 - DNA, 22 bp, Homo sapiens
ttctgcatctatttttctgctg

SEQ ID NO: 7527563 - DNA, 22 bp, Homo sapiens
ttctgcatctatttttctgctg

SEQ ID NO: 7527564 - DNA, 22 bp, Homo sapiens
ttctgcatctcacagccagtgc

SEQ ID NO: 7527565 - DNA, 22 bp, Homo sapiens
ttctgcatctcacagccagtgc

SEQ ID NO: 7527566 - DNA, 22 bp, Homo sapiens
ttctgcatctgaatttaagtac

SEQ ID NO: 7527567 - DNA, 22 bp, Homo sapiens
ttctgcatctgaatttaagtac

SEQ ID NO: 7527568 - DNA, 22 bp, Homo sapiens
ttctgcatgaaaagaactgaac

SEQ ID NO: 7527569 - DNA, 22 bp, Homo sapiens
ttctgcatgaaaagaactgaac

SEQ ID NO: 7527570 - DNA, 22 bp, Homo sapiens
ttctgcatgtgtttcaaatact

SEQ ID NO: 7527571 - DNA, 22 bp, Homo sapiens
ttctgcatgtgtttcaaatact

SEQ ID NO: 7527572 - DNA, 22 bp, Homo sapiens
ttctgcatgtgtttcaaatact

SEQ ID NO: 7527573 - DNA, 22 bp, Homo sapiens
ttctgcatgtgtttcaaatact

SEQ ID NO: 7527574 - DNA, 17 bp, Homo sapiens
ttctgcatgtgaagatg

SEQ ID NO: 7527575 - DNA, 17 bp, Homo sapiens
ttctgcatgtgaagatg

SEQ ID NO: 7527576 - DNA, 22 bp, Homo sapiens
ttctgcatggagaaactgagtc

SEQ ID NO: 7527577 - DNA, 22 bp, Homo sapiens
ttctgcatggagaaactgagtc

SEQ ID NO: 7527578 - DNA, 22 bp, Homo sapiens
ttctgcatgccctctgtgtggc

SEQ ID NO: 7527579 - DNA, 22 bp, Homo sapiens
ttctgcatggagaaactgagtc

SEQ ID NO: 7527580 - DNA, 22 bp, Homo sapiens
ttctgcatggagaaactgagtc

SEQ ID NO: 7527581 - DNA, 22 bp, Homo sapiens
ttctgcatgggctgttggcgtc

SEQ ID NO: 7527582 - DNA, 22 bp, Homo sapiens
ttctgcatgggctgttggcgtc

SEQ ID NO: 7527583 - DNA, 22 bp, Homo sapiens
ttctgcatggtcaaggctttct

SEQ ID NO: 7527584 - DNA, 22 bp, Homo sapiens
ttctgcatggtcaaggctttct

SEQ ID NO: 7527585 - DNA, 22 bp, Homo sapiens
ttctgcatggttggggagaagc

SEQ ID NO: 7527586 - DNA, 22 bp, Homo sapiens
ttctgcatggttggggagaagc

SEQ ID NO: 7527587 - DNA, 22 bp, Homo sapiens
ttctggaaccagcctgcctggg

SEQ ID NO: 7527588 - DNA, 22 bp, Homo sapiens
ttctggaaccagcctgcctggg

SEQ ID NO: 7527589 - DNA, 22 bp, Homo sapiens
ttctggaaccagcctgcctggg

SEQ ID NO: 7527590 - DNA, 22 bp, Homo sapiens
ttctggaaccagcctgcctggg

SEQ ID NO: 7527591 - DNA, 23 bp, Homo sapiens
ttctgcatgtttcagagctggga

SEQ ID NO: 7527592 - DNA, 22 bp, Homo sapiens
ttctggaaccaacatgccagtt

SEQ ID NO: 7527593 - DNA, 22 bp, Homo sapiens
ttctggaaccaacatgccagtt

SEQ ID NO: 7527594 - DNA, 22 bp, Homo sapiens
ttctggaaccaacatgccagtt

SEQ ID NO: 7527595 - DNA, 22 bp, Homo sapiens
ttctggaaccaacatgccagtt

SEQ ID NO: 7527596 - DNA, 22 bp, Homo sapiens
ttctggaagatacctctcctaa

SEQ ID NO: 7527597 - DNA, 22 bp, Homo sapiens
ttctggaagatacctctcctaa

SEQ ID NO: 7527598 - DNA, 22 bp, Homo sapiens
ttctggaagagtaaaataagcc

SEQ ID NO: 7527599 - DNA, 22 bp, Homo sapiens
ttctggaagagtaaaataagcc

SEQ ID NO: 7527600 - DNA, 22 bp, Homo sapiens
ttctggaagagtaaaataagcc

SEQ ID NO: 7527601 - DNA, 22 bp, Homo sapiens
ttctggaagagtaaaataagcc

SEQ ID NO: 7527602 - DNA, 22 bp, Homo sapiens
ttctggaagaggtgtaagtata

SEQ ID NO: 7527603 - DNA, 22 bp, Homo sapiens
ttctggaagaataatgggcaaa

SEQ ID NO: 7527604 - DNA, 22 bp, Homo sapiens
ttctggaagaataatgggcaaa

SEQ ID NO: 7527605 - DNA, 22 bp, Homo sapiens
ttctggaactatactgttggtg

SEQ ID NO: 7527606 - DNA, 22 bp, Homo sapiens
ttctggaactatactgttggtg

SEQ ID NO: 7527607 - DNA, 22 bp, Homo sapiens
ttctgaagctcccttttgtagt

SEQ ID NO: 7527608 - DNA, 22 bp, Homo sapiens
ttctatttcttaatcttggctg

SEQ ID NO: 7527609 - DNA, 22 bp, Homo sapiens
ttctgaagctcccttttgtagt

SEQ ID NO: 7527610 - DNA, 22 bp, Homo sapiens
ttctatttcttaatcttggctg

SEQ ID NO: 7527611 - DNA, 22 bp, Homo sapiens
ttctatttccagtccttcagag

SEQ ID NO: 7527612 - DNA, 22 bp, Homo sapiens
ttctatttcttaatcttggctg

SEQ ID NO: 7527613 - DNA, 22 bp, Homo sapiens
ttctatttcttaatcttggctg

SEQ ID NO: 7527614 - DNA, 22 bp, Homo sapiens
ttctgcaggagccctagtgtat

SEQ ID NO: 7527615 - DNA, 22 bp, Homo sapiens
ttctgcagcccaacagtagttt

SEQ ID NO: 7527616 - DNA, 22 bp, Homo sapiens
ttctgcagcccaacagtagttt

SEQ ID NO: 7527617 - DNA, 22 bp, Homo sapiens
ttctgaaggctcctcaggaaag

SEQ ID NO: 7527618 - DNA, 22 bp, Homo sapiens
ttctgaaggctcctcaggaaag

SEQ ID NO: 7527619 - DNA, 21 bp, Homo sapiens
ttctgcagccatgttggtttt

SEQ ID NO: 7527620 - DNA, 21 bp, Homo sapiens
ttctgcagccatgttggtttt

SEQ ID NO: 7527621 - DNA, 22 bp, Homo sapiens
ttctgcagcccaacagtagttt

SEQ ID NO: 7527622 - DNA, 22 bp, Homo sapiens
ttctgcagtgttaacaatgtca

SEQ ID NO: 7527623 - DNA, 22 bp, Homo sapiens
ttctgcagtgttaacaatgtca

SEQ ID NO: 7527624 - DNA, 22 bp, Homo sapiens
ttctgcagtgttaacaatgtca

SEQ ID NO: 7527625 - DNA, 22 bp, Homo sapiens
ttctgcagtgaatgactcaata

SEQ ID NO: 7527626 - DNA, 22 bp, Homo sapiens
ttctgcagtgaatgactcaata

SEQ ID NO: 7527627 - DNA, 22 bp, Homo sapiens
ttctgcaggagccctagtgtat

SEQ ID NO: 7527628 - DNA, 22 bp, Homo sapiens
ttctgcaggagccctagtgtat

SEQ ID NO: 7527629 - DNA, 22 bp, Homo sapiens
ttctgcaggagccctagtgtat

SEQ ID NO: 7527630 - DNA, 22 bp, Homo sapiens
ttctgcaggatgctctggtggt

SEQ ID NO: 7527631 - DNA, 22 bp, Homo sapiens
ttctgcaggctgtacaagaagc

SEQ ID NO: 7527632 - DNA, 22 bp, Homo sapiens
ttctgcaggctgtacaagaagc

SEQ ID NO: 7527633 - DNA, 22 bp, Homo sapiens
ttctgcaggatgctctggtggt

SEQ ID NO: 7527634 - DNA, 22 bp, Homo sapiens
ttctgcaggatgctctggtggt

SEQ ID NO: 7527635 - DNA, 22 bp, Homo sapiens
ttctgcatacactgaatgtagt

SEQ ID NO: 7527636 - DNA, 22 bp, Homo sapiens
ttctgcatacactgaatgtagt

SEQ ID NO: 7527637 - DNA, 22 bp, Homo sapiens
ttctgcatacactgaatgtagt

SEQ ID NO: 7527638 - DNA, 22 bp, Homo sapiens
ttctgcataacttcctgggtca

SEQ ID NO: 7527639 - DNA, 22 bp, Homo sapiens
ttctgcagtgtgcagggcctgt

SEQ ID NO: 7527640 - DNA, 22 bp, Homo sapiens
ttctgcagtgttaacaatgtca

SEQ ID NO: 7527641 - DNA, 22 bp, Homo sapiens
ttctgcagtgttaacaatgtca

SEQ ID NO: 7527642 - DNA, 22 bp, Homo sapiens
ttctgcataacttcctgggtca

SEQ ID NO: 7527643 - DNA, 22 bp, Homo sapiens
ttctgcataggctatatttgtt

SEQ ID NO: 7527644 - DNA, 22 bp, Homo sapiens
ttctgcataggctatatttgtt

SEQ ID NO: 7527645 - DNA, 22 bp, Homo sapiens
ttctgcataggctatatttgtt

SEQ ID NO: 7527646 - DNA, 22 bp, Homo sapiens
ttctgcatcccagaagaggaca

SEQ ID NO: 7527647 - DNA, 22 bp, Homo sapiens
ttctgcatcccagaagaggaca

SEQ ID NO: 7527648 - DNA, 22 bp, Homo sapiens
ttctattgggcagcattgcttc

SEQ ID NO: 7527649 - DNA, 22 bp, Homo sapiens
ttctattgggcagcattgcttc

SEQ ID NO: 7527650 - DNA, 22 bp, Homo sapiens
ttctattgggcagcattgcttc

SEQ ID NO: 7527651 - DNA, 22 bp, Homo sapiens
ttctattgcacacaaataatta

SEQ ID NO: 7527652 - DNA, 22 bp, Homo sapiens
ttctattgtaccttttctctca

SEQ ID NO: 7527653 - DNA, 22 bp, Homo sapiens
ttctattgtaccttttctctca

SEQ ID NO: 7527654 - DNA, 22 bp, Homo sapiens
ttctatttccagtccttcagag

SEQ ID NO: 7527655 - DNA, 22 bp, Homo sapiens
ttctatttccagtccttcagag

SEQ ID NO: 7527656 - DNA, 22 bp, Homo sapiens
ttctatttccagtccttcagag

SEQ ID NO: 7527657 - DNA, 22 bp, Homo sapiens
ttctattaatatgttaattctg

SEQ ID NO: 7527658 - DNA, 22 bp, Homo sapiens
ttctattaatatgttaattctg

SEQ ID NO: 7527659 - DNA, 22 bp, Homo sapiens
ttctatgttctaagtctcaagg

SEQ ID NO: 7527660 - DNA, 22 bp, Homo sapiens
ttctattaatatgttaattctg

SEQ ID NO: 7527661 - DNA, 22 bp, Homo sapiens
ttctattgacattcactgtaac

SEQ ID NO: 7527662 - DNA, 22 bp, Homo sapiens
ttctattgaatgataatctata

SEQ ID NO: 7527663 - DNA, 22 bp, Homo sapiens
ttctattgcacacaaataatta

SEQ ID NO: 7527664 - DNA, 22 bp, Homo sapiens
ttctattgcacacaaataatta

SEQ ID NO: 7527665 - DNA, 22 bp, Homo sapiens
ttctattgacattcactgtaac

SEQ ID NO: 7527666 - DNA, 22 bp, Homo sapiens
ttctattgcacacaaataatta

SEQ ID NO: 7527667 - DNA, 22 bp, Homo sapiens
ttctatgtggatatagaactgc

SEQ ID NO: 7527668 - DNA, 22 bp, Homo sapiens
ttctatgtggatatagaactgc

SEQ ID NO: 7527669 - DNA, 22 bp, Homo sapiens
ttctatgtgctggagaatattt

SEQ ID NO: 7527670 - DNA, 22 bp, Homo sapiens
ttctatgttctaagtctcaagg

SEQ ID NO: 7527671 - DNA, 22 bp, Homo sapiens
ttctatgtcagtgtgctctgtg

SEQ ID NO: 7527672 - DNA, 22 bp, Homo sapiens
ttctatgtagtagcagagccaa

SEQ ID NO: 7527673 - DNA, 20 bp, Homo sapiens
ttctatggaccagtatattt

SEQ ID NO: 7527674 - DNA, 22 bp, Homo sapiens
ttctatgtagataaggctgctc

SEQ ID NO: 7527675 - DNA, 22 bp, Homo sapiens
cgttcctctactccagctaccc

SEQ ID NO: 7527676 - DNA, 22 bp, Homo sapiens
cgttcttttcatatttacatgg

SEQ ID NO: 7527677 - DNA, 22 bp, Homo sapiens
cgtttattttgaagattccact

SEQ ID NO: 7527678 - DNA, 22 bp, Homo sapiens
cgttgtttgagattttcagaat

SEQ ID NO: 7527679 - DNA, 22 bp, Homo sapiens
cgtttattttgaagattccact

SEQ ID NO: 7527680 - DNA, 22 bp, Homo sapiens
cgtttattttgaagattccact

SEQ ID NO: 7527681 - DNA, 22 bp, Homo sapiens
cgtttattttgaagattccact

SEQ ID NO: 7527682 - DNA, 22 bp, Homo sapiens
cgtgtttcagccagggccacct

SEQ ID NO: 7527683 - DNA, 22 bp, Homo sapiens
cgtgtttcagccagggccacct

SEQ ID NO: 7527684 - DNA, 22 bp, Homo sapiens
cgtgtgtgtacctgcgcattta

SEQ ID NO: 7527685 - DNA, 22 bp, Homo sapiens
cgttcctctactccagctaccc

SEQ ID NO: 7527686 - DNA, 22 bp, Homo sapiens
cgttcagcgggctggccgtgga

SEQ ID NO: 7527687 - DNA, 17 bp, Homo sapiens
cgttagtgattcctgcc

SEQ ID NO: 7527688 - DNA, 22 bp, Homo sapiens
cgttagtggagtttgaagctgt

SEQ ID NO: 7527689 - DNA, 22 bp, Homo sapiens
cgttaataggtgcaaggtaagg

SEQ ID NO: 7527690 - DNA, 22 bp, Homo sapiens
cgttaataggtgcaaggtaagg

SEQ ID NO: 7527691 - DNA, 22 bp, Homo sapiens
ctaaaaatccacactaggtgaa

SEQ ID NO: 7527692 - DNA, 22 bp, Homo sapiens
ctaaaaatccacactaggtgaa

SEQ ID NO: 7527693 - DNA, 22 bp, Homo sapiens
ctaaaaactctacgatgcacag

SEQ ID NO: 7527694 - DNA, 22 bp, Homo sapiens
ctaaaaactctacgatgcacag

SEQ ID NO: 7527695 - DNA, 23 bp, Homo sapiens
cgttttttcctcagatgttctgg

SEQ ID NO: 7527696 - DNA, 23 bp, Homo sapiens
cgttttttcctcagatgttctgg

SEQ ID NO: 7527697 - DNA, 22 bp, Homo sapiens
cgttttcttcactttgcaagtt

SEQ ID NO: 7527698 - DNA, 22 bp, Homo sapiens
cgttttcttcactttgcaagtt

SEQ ID NO: 7527699 - DNA, 23 bp, Homo sapiens
cgttttttcctcagatgttctgg

SEQ ID NO: 7527700 - DNA, 23 bp, Homo sapiens
cgttttttcctcagatgttctgg

SEQ ID NO: 7527701 - DNA, 23 bp, Homo sapiens
cgttttttcctcagatgttctgg

SEQ ID NO: 7527702 - DNA, 16 bp, Homo sapiens
cgtttccatcctttgt

SEQ ID NO: 7527703 - DNA, 22 bp, Homo sapiens
cgtttgtagagttttctgaggg

SEQ ID NO: 7527704 - DNA, 22 bp, Homo sapiens
cgtttgtagagttttctgaggg

SEQ ID NO: 7527705 - DNA, 22 bp, Homo sapiens
cgttttcttcactttgcaagtt

SEQ ID NO: 7527706 - DNA, 22 bp, Homo sapiens
cgttttcttcactttgcaagtt

SEQ ID NO: 7527707 - DNA, 22 bp, Homo sapiens
cgtttttcagtggtcttaggtc

SEQ ID NO: 7527708 - DNA, 22 bp, Homo sapiens
cgtttccaactgtgatgaggtc

SEQ ID NO: 7527709 - DNA, 22 bp, Homo sapiens
cgtttcatcagtgctttaagaa

SEQ ID NO: 7527710 - DNA, 22 bp, Homo sapiens
cgtttattttgaagattccact

SEQ ID NO: 7527711 - DNA, 22 bp, Homo sapiens
cgtgtgtgtacctgcgcattta

SEQ ID NO: 7527712 - DNA, 22 bp, Homo sapiens
cgtgtgtgtacctgcgcattta

SEQ ID NO: 7527713 - DNA, 20 bp, Homo sapiens
cgtgtgtggctattttgggt

SEQ ID NO: 7527714 - DNA, 20 bp, Homo sapiens
cgtgtgtggctattttgggt

SEQ ID NO: 7527715 - DNA, 22 bp, Homo sapiens
cgtgtggtcccggcaaggcaag

SEQ ID NO: 7527716 - DNA, 22 bp, Homo sapiens
cgtgtggtcccggcaaggcaag

SEQ ID NO: 7527717 - DNA, 22 bp, Homo sapiens
cgtgtctgtgtatgcaggccgt

SEQ ID NO: 7527718 - DNA, 17 bp, Homo sapiens
cgtgtgcttgtgtgcac

SEQ ID NO: 7527719 - DNA, 17 bp, Homo sapiens
cgtgtgcttgtgtgcac

SEQ ID NO: 7527720 - DNA, 17 bp, Homo sapiens
cgtgtgcttgtgtgcac

SEQ ID NO: 7527721 - DNA, 22 bp, Homo sapiens
cgtgtgcgcacacctgtttcca

SEQ ID NO: 7527722 - DNA, 22 bp, Homo sapiens
cgtgtgcgtgcatatgcacaag

SEQ ID NO: 7527723 - DNA, 22 bp, Homo sapiens
cgtgtctgtgtatgcaggccgt

SEQ ID NO: 7527724 - DNA, 17 bp, Homo sapiens
cgtgtgcttgtgtgcac

SEQ ID NO: 7527725 - DNA, 22 bp, Homo sapiens
cgtgtggtcccggcaaggcaag

SEQ ID NO: 7527726 - DNA, 22 bp, Homo sapiens
cgtgtctgggctcccatggcag

SEQ ID NO: 7527727 - DNA, 22 bp, Homo sapiens
cgtgtctgggatagcagaagta

SEQ ID NO: 7527728 - DNA, 22 bp, Homo sapiens
cgtgtctgggctcccatggcag

SEQ ID NO: 7527729 - DNA, 22 bp, Homo sapiens
cgtgtctgggatagcagaagta

SEQ ID NO: 7527730 - DNA, 22 bp, Homo sapiens
cgtgtctgtgtatgcaggccgt

SEQ ID NO: 7527731 - DNA, 23 bp, Homo sapiens
cgtgtctgtgggcgatccggcct

SEQ ID NO: 7527732 - DNA, 22 bp, Homo sapiens
cgtgtctgtatgtcaatcagct

SEQ ID NO: 7527733 - DNA, 23 bp, Homo sapiens
cgtgtctgtgggcgatccggcct

SEQ ID NO: 7527734 - DNA, 22 bp, Homo sapiens
cgtgtctgtatgtcaatcagct

SEQ ID NO: 7527735 - DNA, 22 bp, Homo sapiens
cgtgtctgggctcccatggcag

SEQ ID NO: 7527736 - DNA, 22 bp, Homo sapiens
cgtgtctgtatgtcaatcagct

SEQ ID NO: 7527737 - DNA, 23 bp, Homo sapiens
cgtgtctgtgggcgatccggcct

SEQ ID NO: 7527738 - DNA, 16 bp, Homo sapiens
cgtggtctgatttcct

SEQ ID NO: 7527739 - DNA, 22 bp, Homo sapiens
cgtgtacagtctatcttttttc

SEQ ID NO: 7527740 - DNA, 22 bp, Homo sapiens
cgtgtacagtctatcttttttc

SEQ ID NO: 7527741 - DNA, 22 bp, Homo sapiens
cgtgtacagtctatcttttttc

SEQ ID NO: 7527742 - DNA, 22 bp, Homo sapiens
cgtgtacagtctatcttttttc

SEQ ID NO: 7527743 - DNA, 22 bp, Homo sapiens
cgtgtagcatgcgccaccacca

SEQ ID NO: 7527744 - DNA, 22 bp, Homo sapiens
cgtgtagctgatctgagatttt

SEQ ID NO: 7527745 - DNA, 22 bp, Homo sapiens
ctagagaaaatgttaatacagt

SEQ ID NO: 7527746 - DNA, 22 bp, Homo sapiens
ctagagaaaccccatgagcttt

SEQ ID NO: 7527747 - DNA, 22 bp, Homo sapiens
ctagagaaaccccatgagcttt

SEQ ID NO: 7527748 - DNA, 22 bp, Homo sapiens
ctagagaaacagtgctctgaac

SEQ ID NO: 7527749 - DNA, 22 bp, Homo sapiens
ctagagaaacagtgctctgaac

SEQ ID NO: 7527750 - DNA, 22 bp, Homo sapiens
ctagagaaacagtgctctgaac

SEQ ID NO: 7527751 - DNA, 22 bp, Homo sapiens
ctagaaatattttacagtcaag

SEQ ID NO: 7527752 - DNA, 22 bp, Homo sapiens
ctagaaatattttacagtcaag

SEQ ID NO: 7527753 - DNA, 22 bp, Homo sapiens
ctagagaaaatgatagcaggaa

SEQ ID NO: 7527754 - DNA, 22 bp, Homo sapiens
ctagaaagatacttaaatcaag

SEQ ID NO: 7527755 - DNA, 22 bp, Homo sapiens
ctagaaatacaggcacgtgcca

SEQ ID NO: 7527756 - DNA, 22 bp, Homo sapiens
ctagaaatacaggcacgtgcca

SEQ ID NO: 7527757 - DNA, 22 bp, Homo sapiens
ctaaaaatccacactaggtgaa

SEQ ID NO: 7527758 - DNA, 22 bp, Homo sapiens
ctagaaagatacttaaatcaag

SEQ ID NO: 7527759 - DNA, 22 bp, Homo sapiens
ctaaaaatccacactaggtgaa

SEQ ID NO: 7527760 - DNA, 22 bp, Homo sapiens
ctaaaaactctacgatgcacag

SEQ ID NO: 7527761 - DNA, 22 bp, Homo sapiens
ctaaaaatccacactaggtgaa

SEQ ID NO: 7527762 - DNA, 22 bp, Homo sapiens
ctagaaagatacttaaatcaag

SEQ ID NO: 7527763 - DNA, 22 bp, Homo sapiens
ctagagaattgtcttgagagtt

SEQ ID NO: 7527764 - DNA, 22 bp, Homo sapiens
ctagagaatggcaaagattaga

SEQ ID NO: 7527765 - DNA, 22 bp, Homo sapiens
ctagagaattgtcttgagagtt

SEQ ID NO: 7527766 - DNA, 22 bp, Homo sapiens
ctagagaattgtcttgagagtt

SEQ ID NO: 7527767 - DNA, 22 bp, Homo sapiens
ctagagaatcttttaagaagtg

SEQ ID NO: 7527768 - DNA, 22 bp, Homo sapiens
ctagagaatggcaaagattaga

SEQ ID NO: 7527769 - DNA, 22 bp, Homo sapiens
ctagagaatggcaaagattaga

SEQ ID NO: 7527770 - DNA, 22 bp, Homo sapiens
ctagagaatggcaaagattaga

SEQ ID NO: 7527771 - DNA, 22 bp, Homo sapiens
ctagagaatcttttaagaagtg

SEQ ID NO: 7527772 - DNA, 22 bp, Homo sapiens
ctagagaatcttttaagaagtg

SEQ ID NO: 7527773 - DNA, 22 bp, Homo sapiens
ctagagaatcttttaagaagtg

SEQ ID NO: 7527774 - DNA, 22 bp, Homo sapiens
ctagagaatcttttaagaagtg

SEQ ID NO: 7527775 - DNA, 22 bp, Homo sapiens
ctagagaatatgagggagtgaa

SEQ ID NO: 7527776 - DNA, 18 bp, Homo sapiens
ctagagaaggttactatg

SEQ ID NO: 7527777 - DNA, 22 bp, Homo sapiens
ctagagaagaggctcagccagc

SEQ ID NO: 7527778 - DNA, 22 bp, Homo sapiens
ctagagaacaacattcatatgg

SEQ ID NO: 7527779 - DNA, 22 bp, Homo sapiens
ctagagaacaacattcatatgg

SEQ ID NO: 7527780 - DNA, 22 bp, Homo sapiens
ctagagaacaacattcatatgg

SEQ ID NO: 7527781 - DNA, 22 bp, Homo sapiens
ctagagaagaggttaagcatga

SEQ ID NO: 7527782 - DNA, 22 bp, Homo sapiens
ctagagaagaggttaagcatga

SEQ ID NO: 7527783 - DNA, 22 bp, Homo sapiens
ctagagaagaggttaagcatga

SEQ ID NO: 7527784 - DNA, 22 bp, Homo sapiens
ctagagaagaggctcagccagc

SEQ ID NO: 7527785 - DNA, 22 bp, Homo sapiens
ctagagaaacgccgtgggagga

SEQ ID NO: 7527786 - DNA, 22 bp, Homo sapiens
ctagagaaacgccgtgggagga

SEQ ID NO: 7527787 - DNA, 22 bp, Homo sapiens
ctagagaaaggcagtggagcaa

SEQ ID NO: 7527788 - DNA, 22 bp, Homo sapiens
ctagagaaaggcagtggagcaa

SEQ ID NO: 7527789 - DNA, 22 bp, Homo sapiens
ctagagaaacgccgtgggagga

SEQ ID NO: 7527790 - DNA, 22 bp, Homo sapiens
ctagagaaaccccatgagcttt

SEQ ID NO: 7527791 - DNA, 22 bp, Homo sapiens
ctagagaaaccccatgagcttt

SEQ ID NO: 7527792 - DNA, 23 bp, Homo sapiens
ctagatgcaagctccatgaggga

SEQ ID NO: 7527793 - DNA, 22 bp, Homo sapiens
ttctatgattcatttagaagtt

SEQ ID NO: 7527794 - DNA, 18 bp, Homo sapiens
ctagatgagcttggcaag

SEQ ID NO: 7527795 - DNA, 22 bp, Homo sapiens
ttctatgccatgttcagctact

SEQ ID NO: 7527796 - DNA, 22 bp, Homo sapiens
ctagatccattttctgtctctg

SEQ ID NO: 7527797 - DNA, 22 bp, Homo sapiens
ctagatccattttctgtctctg

SEQ ID NO: 7527798 - DNA, 22 bp, Homo sapiens
ctagatccgcaggttttcagtg

SEQ ID NO: 7527799 - DNA, 22 bp, Homo sapiens
ctagatctgcccactgaagttc

SEQ ID NO: 7527800 - DNA, 19 bp, Homo sapiens
ctagatccagaaagtggta

SEQ ID NO: 7527801 - DNA, 22 bp, Homo sapiens
ctagatcatgaatgtcctcaaa

SEQ ID NO: 7527802 - DNA, 22 bp, Homo sapiens
ctagatcagctaactttccagt

SEQ ID NO: 7527803 - DNA, 22 bp, Homo sapiens
ctagatcacactggttggctgc

SEQ ID NO: 7527804 - DNA, 22 bp, Homo sapiens
ctagatcagattgctgtttcta

SEQ ID NO: 7527805 - DNA, 22 bp, Homo sapiens
ctagaggggaaaaaggtcttgt

SEQ ID NO: 7527806 - DNA, 22 bp, Homo sapiens
ctagaggggaaaaaggtcttgt

SEQ ID NO: 7527807 - DNA, 22 bp, Homo sapiens
ctagaggggaaaaaggtcttgt

SEQ ID NO: 7527808 - DNA, 22 bp, Homo sapiens
ctagaggtctactcttggtagt

SEQ ID NO: 7527809 - DNA, 22 bp, Homo sapiens
ctagaggtctactcttggtagt

SEQ ID NO: 7527810 - DNA, 22 bp, Homo sapiens
ctagaggtagaggcagtgggaa

SEQ ID NO: 7527811 - DNA, 22 bp, Homo sapiens
ctagataaggatttctcaactt

SEQ ID NO: 7527812 - DNA, 22 bp, Homo sapiens
ctagataaggtggcttggaatt

SEQ ID NO: 7527813 - DNA, 22 bp, Homo sapiens
ctagaggtgagatggaatcact

SEQ ID NO: 7527814 - DNA, 22 bp, Homo sapiens
ctagagtcctcctggaaaaggt

SEQ ID NO: 7527815 - DNA, 19 bp, Homo sapiens
ctagagtaataagtacttt

SEQ ID NO: 7527816 - DNA, 22 bp, Homo sapiens
ctagaggctcagcagatgcctg

SEQ ID NO: 7527817 - DNA, 22 bp, Homo sapiens
ctagagggatgttaggatagca

SEQ ID NO: 7527818 - DNA, 22 bp, Homo sapiens
ctagagggatgttaggatagca

SEQ ID NO: 7527819 - DNA, 22 bp, Homo sapiens
ctagagggatgttaggatagca

SEQ ID NO: 7527820 - DNA, 22 bp, Homo sapiens
ctagaggaacagtttcaggttt

SEQ ID NO: 7527821 - DNA, 22 bp, Homo sapiens
ctagagctttctgctggtgttg

SEQ ID NO: 7527822 - DNA, 22 bp, Homo sapiens
ctagaggctcagcagatgcctg

SEQ ID NO: 7527823 - DNA, 22 bp, Homo sapiens
ctagaggaacagtttcaggttt

SEQ ID NO: 7527824 - DNA, 22 bp, Homo sapiens
ctagagcagattgcagagtagg

SEQ ID NO: 7527825 - DNA, 22 bp, Homo sapiens
ctagagcagattgcagagtagg

SEQ ID NO: 7527826 - DNA, 22 bp, Homo sapiens
ctagagctgttctgtgcactca

SEQ ID NO: 7527827 - DNA, 22 bp, Homo sapiens
ctagagctgttctgtgcactca

SEQ ID NO: 7527828 - DNA, 22 bp, Homo sapiens
ctagagctgttctgtgcactca

SEQ ID NO: 7527829 - DNA, 22 bp, Homo sapiens
ctagagctttctgctggtgttg

SEQ ID NO: 7527830 - DNA, 22 bp, Homo sapiens
ctagagagccgctgtggaaaat

SEQ ID NO: 7527831 - DNA, 17 bp, Homo sapiens
ctagagagaaagagcta

SEQ ID NO: 7527832 - DNA, 17 bp, Homo sapiens
ctagagagaaagagcta

SEQ ID NO: 7527833 - DNA, 17 bp, Homo sapiens
ctagagagaaagagcta

SEQ ID NO: 7527834 - DNA, 22 bp, Homo sapiens
ctagagaattgtcttgagagtt

SEQ ID NO: 7527835 - DNA, 22 bp, Homo sapiens
ctagagcagattgcagagtagg

SEQ ID NO: 7527836 - DNA, 22 bp, Homo sapiens
ctagagaggtggtgttgggtgg

SEQ ID NO: 7527837 - DNA, 22 bp, Homo sapiens
ctagagagcttttaaaaatact

SEQ ID NO: 7527838 - DNA, 22 bp, Homo sapiens
ctagagaggcagatgtcctgtg

SEQ ID NO: 7527839 - DNA, 22 bp, Homo sapiens
ctagagagccgctgtggaaaat

SEQ ID NO: 7527840 - DNA, 22 bp, Homo sapiens
ctcacaggttctgcagctcaca

SEQ ID NO: 7527841 - DNA, 22 bp, Homo sapiens
ctcacaggttctgcagctcaca

SEQ ID NO: 7527842 - DNA, 22 bp, Homo sapiens
ctcacaggttctgcagctcaca

SEQ ID NO: 7527843 - DNA, 22 bp, Homo sapiens
ctatatacttttcacagatgtt

SEQ ID NO: 7527844 - DNA, 22 bp, Homo sapiens
ctatagaaacaacctctctttc

SEQ ID NO: 7527845 - DNA, 22 bp, Homo sapiens
ctcacaggttctgcagctcaca

SEQ ID NO: 7527846 - DNA, 18 bp, Homo sapiens
ctcaccattctgcccaat

SEQ ID NO: 7527847 - DNA, 22 bp, Homo sapiens
ctcacccatatctccatgactc

SEQ ID NO: 7527848 - DNA, 22 bp, Homo sapiens
ctcacccagaggctttccccct

SEQ ID NO: 7527849 - DNA, 22 bp, Homo sapiens
ctcacccatatctccatgactc

SEQ ID NO: 7527850 - DNA, 22 bp, Homo sapiens
ctatacagtaaccacagtgatt

SEQ ID NO: 7527851 - DNA, 22 bp, Homo sapiens
ctatacagcagcttactagtta

SEQ ID NO: 7527852 - DNA, 22 bp, Homo sapiens
ctatacagtaaccacagtgatt

SEQ ID NO: 7527853 - DNA, 22 bp, Homo sapiens
ctatacagtaaccacagtgatt

SEQ ID NO: 7527854 - DNA, 22 bp, Homo sapiens
ctatacagtgactagaagtaat

SEQ ID NO: 7527855 - DNA, 22 bp, Homo sapiens
ctatacagcagcttactagtta

SEQ ID NO: 7527856 - DNA, 19 bp, Homo sapiens
ctatacagcctctgaggaa

SEQ ID NO: 7527857 - DNA, 22 bp, Homo sapiens
ctatacagcagcttactagtta

SEQ ID NO: 7527858 - DNA, 22 bp, Homo sapiens
ctatacagcagcttactagtta

SEQ ID NO: 7527859 - DNA, 22 bp, Homo sapiens
ctatagaaaattgtatcacacg

SEQ ID NO: 7527860 - DNA, 22 bp, Homo sapiens
ctatactactatacagatgtaa

SEQ ID NO: 7527861 - DNA, 22 bp, Homo sapiens
ctatagaaaattgtatcacacg

SEQ ID NO: 7527862 - DNA, 22 bp, Homo sapiens
ctatagaaaattgtatcacacg

SEQ ID NO: 7527863 - DNA, 22 bp, Homo sapiens
ctatacatcccaatttcagaga

SEQ ID NO: 7527864 - DNA, 22 bp, Homo sapiens
ctatactactatacagatgtaa

SEQ ID NO: 7527865 - DNA, 22 bp, Homo sapiens
ctatacagtgactagaagtaat

SEQ ID NO: 7527866 - DNA, 22 bp, Homo sapiens
ctatacagtgactagaagtaat

SEQ ID NO: 7527867 - DNA, 22 bp, Homo sapiens
ctcacctccaggagctgctggc

SEQ ID NO: 7527868 - DNA, 22 bp, Homo sapiens
ctcacctccaggagctgctggc

SEQ ID NO: 7527869 - DNA, 22 bp, Homo sapiens
ctcacctataagtctcacagtc

SEQ ID NO: 7527870 - DNA, 22 bp, Homo sapiens
ctcacctgcaatcccttccagg

SEQ ID NO: 7527871 - DNA, 22 bp, Homo sapiens
ctcacctgcaatcccttccagg

SEQ ID NO: 7527872 - DNA, 19 bp, Homo sapiens
ctcacctctgtgcgccccc

SEQ ID NO: 7527873 - DNA, 22 bp, Homo sapiens
ctcactataatgtgttcagtgt

SEQ ID NO: 7527874 - DNA, 19 bp, Homo sapiens
ctcacctggaggtgctgat

SEQ ID NO: 7527875 - DNA, 19 bp, Homo sapiens
ctcacctggaggtgctgat

SEQ ID NO: 7527876 - DNA, 19 bp, Homo sapiens
ctcacctctgtgcgccccc

SEQ ID NO: 7527877 - DNA, 22 bp, Homo sapiens
ctcacctgggtcagacagttgt

SEQ ID NO: 7527878 - DNA, 22 bp, Homo sapiens
ctcacccctgtaattccagcac

SEQ ID NO: 7527879 - DNA, 22 bp, Homo sapiens
ctcacccctgtaattccagcac

SEQ ID NO: 7527880 - DNA, 22 bp, Homo sapiens
ctcacccctgtaattccagcac

SEQ ID NO: 7527881 - DNA, 22 bp, Homo sapiens
ctcaccccactaccccttggtg

SEQ ID NO: 7527882 - DNA, 22 bp, Homo sapiens
ctcacccatatctccatgactc

SEQ ID NO: 7527883 - DNA, 22 bp, Homo sapiens
ctcaccccactaccccttggtg

SEQ ID NO: 7527884 - DNA, 22 bp, Homo sapiens
ctcacccctgtaattccagcac

SEQ ID NO: 7527885 - DNA, 22 bp, Homo sapiens
ctcactgaaccttggcacctca

SEQ ID NO: 7527886 - DNA, 22 bp, Homo sapiens
ctcactgaaacctccgcctccc

SEQ ID NO: 7527887 - DNA, 22 bp, Homo sapiens
ctcactcagacatccagtgcag

SEQ ID NO: 7527888 - DNA, 22 bp, Homo sapiens
ctcactcagacatccagtgcag

SEQ ID NO: 7527889 - DNA, 22 bp, Homo sapiens
ctcactgactgcaagtcaagtt

SEQ ID NO: 7527890 - DNA, 22 bp, Homo sapiens
ctcactgcaacctccgcctcct

SEQ ID NO: 7527891 - DNA, 22 bp, Homo sapiens
ctcactgcaacctccgcctcct

SEQ ID NO: 7527892 - DNA, 22 bp, Homo sapiens
ctcactgcaacctccgtctccc

SEQ ID NO: 7527893 - DNA, 22 bp, Homo sapiens
ctcactgcaacctccgcctcct

SEQ ID NO: 7527894 - DNA, 22 bp, Homo sapiens
ctcactgcaacctctgccccca

SEQ ID NO: 7527895 - DNA, 22 bp, Homo sapiens
ctcactgcaacctctgcctccc

SEQ ID NO: 7527896 - DNA, 22 bp, Homo sapiens
ctcactgcaacctctgcctccc

SEQ ID NO: 7527897 - DNA, 22 bp, Homo sapiens
ctcactgcaacctctgcctccc

SEQ ID NO: 7527898 - DNA, 22 bp, Homo sapiens
ctcactgcaacctctgcctccc

SEQ ID NO: 7527899 - DNA, 22 bp, Homo sapiens
ctcactgcaacctctgcctccc

SEQ ID NO: 7527900 - DNA, 22 bp, Homo sapiens
ctcactgcaagctcagcctccc

SEQ ID NO: 7527901 - DNA, 22 bp, Homo sapiens
ctcactgcaagctcagcctccc

SEQ ID NO: 7527902 - DNA, 22 bp, Homo sapiens
ctcactgcaagctcagcctccc

SEQ ID NO: 7527903 - DNA, 22 bp, Homo sapiens
ttctggatgttgtagtctgaga

SEQ ID NO: 7527904 - DNA, 22 bp, Homo sapiens
ttctggatgttgtagtctgaga

SEQ ID NO: 7527905 - DNA, 22 bp, Homo sapiens
ttctggattagcatgatcccta

SEQ ID NO: 7527906 - DNA, 22 bp, Homo sapiens
ttctggattatgtgtaagtgaa

SEQ ID NO: 7527907 - DNA, 22 bp, Homo sapiens
ttctggattctcaggatagaga

SEQ ID NO: 7527908 - DNA, 22 bp, Homo sapiens
ttctggcaaggcaagcctggct

SEQ ID NO: 7527909 - DNA, 22 bp, Homo sapiens
ttctggccaaggctgccagatt

SEQ ID NO: 7527910 - DNA, 22 bp, Homo sapiens
ttctggccaaggctgccagatt

SEQ ID NO: 7527911 - DNA, 22 bp, Homo sapiens
ttctggccaaggctgccagatt

SEQ ID NO: 7527912 - DNA, 22 bp, Homo sapiens
ttctggctaccctcctaatgtt

SEQ ID NO: 7527913 - DNA, 22 bp, Homo sapiens
ttctggctaccctcctaatgtt

SEQ ID NO: 7527914 - DNA, 22 bp, Homo sapiens
ttctggctaccctcctaatgtt

SEQ ID NO: 7527915 - DNA, 22 bp, Homo sapiens
ttctggctaccctcctaatgtt

SEQ ID NO: 7527916 - DNA, 18 bp, Homo sapiens
ttctggctcactcatgct

SEQ ID NO: 7527917 - DNA, 18 bp, Homo sapiens
ttctggctcactcatgct

SEQ ID NO: 7527918 - DNA, 18 bp, Homo sapiens
ttctggctcactcatgct

SEQ ID NO: 7527919 - DNA, 22 bp, Homo sapiens
ttctggctcatatgctaagaag

SEQ ID NO: 7527920 - DNA, 22 bp, Homo sapiens
ttctggctccactcagccccac

SEQ ID NO: 7527921 - DNA, 22 bp, Homo sapiens
ttctggctcatatgctaagaag

SEQ ID NO: 7527922 - DNA, 22 bp, Homo sapiens
ttctggctccagatgcttctgt

SEQ ID NO: 7527923 - DNA, 22 bp, Homo sapiens
ttctggctccagatgcttctgt

SEQ ID NO: 7527924 - DNA, 22 bp, Homo sapiens
ttctggctccagatgcttctgt

SEQ ID NO: 7527925 - DNA, 22 bp, Homo sapiens
ttctggctcgattctctgaccg

SEQ ID NO: 7527926 - DNA, 23 bp, Homo sapiens
ttctggctccgagctccatcttc

SEQ ID NO: 7527927 - DNA, 23 bp, Homo sapiens
ttctggctccgagctccatcttc

SEQ ID NO: 7527928 - DNA, 23 bp, Homo sapiens
ttctggctccgagctccatcttc

SEQ ID NO: 7527929 - DNA, 22 bp, Homo sapiens
ttctggctccgcggggcggccc

SEQ ID NO: 7527930 - DNA, 22 bp, Homo sapiens
ttctggctctcccctgctgggt

SEQ ID NO: 7527931 - DNA, 22 bp, Homo sapiens
ttctggctgaaagtttatttga

SEQ ID NO: 7527932 - DNA, 22 bp, Homo sapiens
ttctggctcgattctctgaccg

SEQ ID NO: 7527933 - DNA, 22 bp, Homo sapiens
ttctggctctcccctgctgggt

SEQ ID NO: 7527934 - DNA, 22 bp, Homo sapiens
ttctggctctcccctgctgggt

SEQ ID NO: 7527935 - DNA, 22 bp, Homo sapiens
ttctggctcgattctctgaccg

SEQ ID NO: 7527936 - DNA, 22 bp, Homo sapiens
ttctggctgtatgatatttaat

SEQ ID NO: 7527937 - DNA, 22 bp, Homo sapiens
ttctggctgtatgatatttaat

SEQ ID NO: 7527938 - DNA, 22 bp, Homo sapiens
ttctggctgtatgatatttaat

SEQ ID NO: 7527939 - DNA, 22 bp, Homo sapiens
ttctggctgaaagtttatttga

SEQ ID NO: 7527940 - DNA, 22 bp, Homo sapiens
ttctggctgaaagtttatttga

SEQ ID NO: 7527941 - DNA, 22 bp, Homo sapiens
ttctggctgcagtccctgtaat

SEQ ID NO: 7527942 - DNA, 22 bp, Homo sapiens
ctataattatgctcaaaatgta

SEQ ID NO: 7527943 - DNA, 22 bp, Homo sapiens
ctataagacagatactgacttt

SEQ ID NO: 7527944 - DNA, 22 bp, Homo sapiens
ctataagacagatactgacttt

SEQ ID NO: 7527945 - DNA, 22 bp, Homo sapiens
ctataattatgctcaaaatgta

SEQ ID NO: 7527946 - DNA, 22 bp, Homo sapiens
ctatacagagcatccttaactt

SEQ ID NO: 7527947 - DNA, 22 bp, Homo sapiens
ctatacagagcatccttaactt

SEQ ID NO: 7527948 - DNA, 22 bp, Homo sapiens
ctatacagagcatccttaactt

SEQ ID NO: 7527949 - DNA, 22 bp, Homo sapiens
ctatacagcagcttactagtta

SEQ ID NO: 7527950 - DNA, 22 bp, Homo sapiens
ctatacagcagcttactagtta

SEQ ID NO: 7527951 - DNA, 22 bp, Homo sapiens
ctatacactttttgaaaataga

SEQ ID NO: 7527952 - DNA, 22 bp, Homo sapiens
ctatacactttttgaaaataga

SEQ ID NO: 7527953 - DNA, 22 bp, Homo sapiens
ctataaatctacccagcattgg

SEQ ID NO: 7527954 - DNA, 22 bp, Homo sapiens
ctataaatctacccagcattgg

SEQ ID NO: 7527955 - DNA, 22 bp, Homo sapiens
ctataaatctacccagcattgg

SEQ ID NO: 7527956 - DNA, 22 bp, Homo sapiens
ctataaatctacccagcattgg

SEQ ID NO: 7527957 - DNA, 22 bp, Homo sapiens
ctataactgggtattagactac

SEQ ID NO: 7527958 - DNA, 22 bp, Homo sapiens
ctataaatctacccagcattgg

SEQ ID NO: 7527959 - DNA, 22 bp, Homo sapiens
ctataaatctacccagcattgg

SEQ ID NO: 7527960 - DNA, 22 bp, Homo sapiens
ctataaatctacccagcattgg

SEQ ID NO: 7527961 - DNA, 22 bp, Homo sapiens
ctataaatctacccagcattgg

SEQ ID NO: 7527962 - DNA, 22 bp, Homo sapiens
ttctggcttagttgttgtatat

SEQ ID NO: 7527963 - DNA, 22 bp, Homo sapiens
ttctggcttagttgttgtatat

SEQ ID NO: 7527964 - DNA, 22 bp, Homo sapiens
ttctggcttagttgttgtatat

SEQ ID NO: 7527965 - DNA, 22 bp, Homo sapiens
ttctggcttagttgttgtatat

SEQ ID NO: 7527966 - DNA, 22 bp, Homo sapiens
ttctggcttacttcactcattt

SEQ ID NO: 7527967 - DNA, 22 bp, Homo sapiens
ttctggcttacttcactcattt

SEQ ID NO: 7527968 - DNA, 22 bp, Homo sapiens
ttctggcttacttcactcattt

SEQ ID NO: 7527969 - DNA, 23 bp, Homo sapiens
ttctggctgtgggtggcgtctct

SEQ ID NO: 7527970 - DNA, 23 bp, Homo sapiens
ttctggctgtgggtggcgtctct

SEQ ID NO: 7527971 - DNA, 22 bp, Homo sapiens
ttctggctttacttcccatcca

SEQ ID NO: 7527972 - DNA, 22 bp, Homo sapiens
ttctggctttaggcttttcaag

SEQ ID NO: 7527973 - DNA, 22 bp, Homo sapiens
ttctggcttcatctgacaagcc

SEQ ID NO: 7527974 - DNA, 22 bp, Homo sapiens
ttctggcttcatctgacaagcc

SEQ ID NO: 7527975 - DNA, 22 bp, Homo sapiens
ttctggcttatgagctataatg

SEQ ID NO: 7527976 - DNA, 22 bp, Homo sapiens
ttctggcttcatctgacaagcc

SEQ ID NO: 7527977 - DNA, 22 bp, Homo sapiens
ttctggcttgacccctacttcc

SEQ ID NO: 7527978 - DNA, 21 bp, Homo sapiens
ttctttctgaatctgaagtat

SEQ ID NO: 7527979 - DNA, 21 bp, Homo sapiens
ttctttctgaatctgaagtat

SEQ ID NO: 7527980 - DNA, 21 bp, Homo sapiens
ttctttctgaatctgaagtat

SEQ ID NO: 7527981 - DNA, 21 bp, Homo sapiens
ttctttctgaatctgaagtat

SEQ ID NO: 7527982 - DNA, 21 bp, Homo sapiens
ttctttctgaatctgaagtat

SEQ ID NO: 7527983 - DNA, 22 bp, Homo sapiens
ttctttctgggaagagttcaga

SEQ ID NO: 7527984 - DNA, 22 bp, Homo sapiens
ttctttctgggaagagttcaga

SEQ ID NO: 7527985 - DNA, 22 bp, Homo sapiens
ttctttctggggtccttcggct

SEQ ID NO: 7527986 - DNA, 22 bp, Homo sapiens
ttctttctgggaagagttcaga

SEQ ID NO: 7527987 - DNA, 22 bp, Homo sapiens
ttctttctgaatacagttgagt

SEQ ID NO: 7527988 - DNA, 22 bp, Homo sapiens
ttctttctgaatacagttgagt

SEQ ID NO: 7527989 - DNA, 22 bp, Homo sapiens
ttctttctctgtaaaaggaaaa

SEQ ID NO: 7527990 - DNA, 22 bp, Homo sapiens
ttctttctctgtaaaaggaaaa

SEQ ID NO: 7527991 - DNA, 22 bp, Homo sapiens
ttctttctctgtaaaaggaaaa

SEQ ID NO: 7527992 - DNA, 22 bp, Homo sapiens
ttctttctctgtaaaaggaaaa

SEQ ID NO: 7527993 - DNA, 22 bp, Homo sapiens
ttctttctctccacaaggcttg

SEQ ID NO: 7527994 - DNA, 22 bp, Homo sapiens
ttctttctctccacaaggcttg

SEQ ID NO: 7527995 - DNA, 22 bp, Homo sapiens
ttctttctctccacaaggcttg

SEQ ID NO: 7527996 - DNA, 22 bp, Homo sapiens
ttctttctctccacaaggcttg

SEQ ID NO: 7527997 - DNA, 22 bp, Homo sapiens
ttctttctctccacaaggcttg

SEQ ID NO: 7527998 - DNA, 22 bp, Homo sapiens
ttctttctctactagcagagct

SEQ ID NO: 7527999 - DNA, 22 bp, Homo sapiens
ttctttctctactagcagagct

SEQ ID NO: 7528000 - DNA, 22 bp, Homo sapiens
ttctttctctactagcagagct

SEQ ID NO: 7528001 - DNA, 22 bp, Homo sapiens
ctcactgcaagctcagcctccc

SEQ ID NO: 7528002 - DNA, 22 bp, Homo sapiens
ctcactgcaagctcagcctccc

SEQ ID NO: 7528003 - DNA, 22 bp, Homo sapiens
ctcactgcaagctcagcctccc

SEQ ID NO: 7528004 - DNA, 22 bp, Homo sapiens
ctcactgcaagctccacctctt

SEQ ID NO: 7528005 - DNA, 22 bp, Homo sapiens
ttctttctctactagcagagct

SEQ ID NO: 7528006 - DNA, 22 bp, Homo sapiens
ctcagagaaaaggagcaagggt

SEQ ID NO: 7528007 - DNA, 22 bp, Homo sapiens
ctcagagaaaaggagcaagggt

SEQ ID NO: 7528008 - DNA, 22 bp, Homo sapiens
ctcagagaaaaggagcaagggt

SEQ ID NO: 7528009 - DNA, 22 bp, Homo sapiens
ctcagagaaaaggagcaagggt

SEQ ID NO: 7528010 - DNA, 22 bp, Homo sapiens
ctcagagaaatgtcacaacaat

SEQ ID NO: 7528011 - DNA, 22 bp, Homo sapiens
ctcagagaaatgtcacaacaat

SEQ ID NO: 7528012 - DNA, 21 bp, Homo sapiens
ctcagagaaatgtctgggagc

SEQ ID NO: 7528013 - DNA, 21 bp, Homo sapiens
ctcagagaaatgtctgggagc

SEQ ID NO: 7528014 - DNA, 21 bp, Homo sapiens
ctcagagaaatgtctgggagc

SEQ ID NO: 7528015 - DNA, 21 bp, Homo sapiens
ctcagagaaatgtctgggagc

SEQ ID NO: 7528016 - DNA, 22 bp, Homo sapiens
ctcagagaagatggatgaggta

SEQ ID NO: 7528017 - DNA, 22 bp, Homo sapiens
ctcagagaagtctttgctaaac

SEQ ID NO: 7528018 - DNA, 21 bp, Homo sapiens
ctcagagacaaatgccatccc

SEQ ID NO: 7528019 - DNA, 22 bp, Homo sapiens
ctcagagaagatggatgaggta

SEQ ID NO: 7528020 - DNA, 22 bp, Homo sapiens
ctcagagaagatggatgaggta

SEQ ID NO: 7528021 - DNA, 22 bp, Homo sapiens
ctcagagaacctaagcggagga

SEQ ID NO: 7528022 - DNA, 22 bp, Homo sapiens
ctcagagaacctaagcggagga

SEQ ID NO: 7528023 - DNA, 22 bp, Homo sapiens
ctcagagaacctaagcggagga

SEQ ID NO: 7528024 - DNA, 21 bp, Homo sapiens
ctcagagaaatgtctgggagc

SEQ ID NO: 7528025 - DNA, 22 bp, Homo sapiens
ttctttctgtccataatgagac

SEQ ID NO: 7528026 - DNA, 22 bp, Homo sapiens
ttctttctgtccataatgagac

SEQ ID NO: 7528027 - DNA, 22 bp, Homo sapiens
ttctttctgtccataatgagac

SEQ ID NO: 7528028 - DNA, 22 bp, Homo sapiens
ttctttctgtccataatgagac

SEQ ID NO: 7528029 - DNA, 22 bp, Homo sapiens
ttctttctgtcatggtgtactg

SEQ ID NO: 7528030 - DNA, 22 bp, Homo sapiens
ttctttctgtcatggtgtactg

SEQ ID NO: 7528031 - DNA, 22 bp, Homo sapiens
ttctttctggggtccttcggct

SEQ ID NO: 7528032 - DNA, 22 bp, Homo sapiens
ctcagaaagggttgctgagggc

SEQ ID NO: 7528033 - DNA, 22 bp, Homo sapiens
ctcagaaagggttgctgagggc

SEQ ID NO: 7528034 - DNA, 22 bp, Homo sapiens
ttctttctgtccataatgagac

SEQ ID NO: 7528035 - DNA, 22 bp, Homo sapiens
ctcagaaagggttgctgagggc

SEQ ID NO: 7528036 - DNA, 22 bp, Homo sapiens
ctcagagaaaaggagcaagggt

SEQ ID NO: 7528037 - DNA, 22 bp, Homo sapiens
ctcagagaaaaggagcaagggt

SEQ ID NO: 7528038 - DNA, 22 bp, Homo sapiens
ctcagaaaggtgccatttatgt

SEQ ID NO: 7528039 - DNA, 22 bp, Homo sapiens
ctcagaaaggtgccatttatgt

SEQ ID NO: 7528040 - DNA, 22 bp, Homo sapiens
ctcagaaaggtgccatttatgt

SEQ ID NO: 7528041 - DNA, 22 bp, Homo sapiens
ctcagagccagttagcaggtgc

SEQ ID NO: 7528042 - DNA, 22 bp, Homo sapiens
ctcagagcccagggtacacccg

SEQ ID NO: 7528043 - DNA, 22 bp, Homo sapiens
ctcagagcccagggtacacccg

SEQ ID NO: 7528044 - DNA, 22 bp, Homo sapiens
ctcagagccagttagcaggtgc

SEQ ID NO: 7528045 - DNA, 22 bp, Homo sapiens
ctcagagccagttagcaggtgc

SEQ ID NO: 7528046 - DNA, 22 bp, Homo sapiens
ctcagagccagttagcaggtgc

SEQ ID NO: 7528047 - DNA, 22 bp, Homo sapiens
ctcagagccagttagcaggtgc

SEQ ID NO: 7528048 - DNA, 21 bp, Homo sapiens
ctcagagcagttcagagggat

SEQ ID NO: 7528049 - DNA, 21 bp, Homo sapiens
ctcagagcagttcagagggat

SEQ ID NO: 7528050 - DNA, 21 bp, Homo sapiens
ctcagagcagttcagagggat

SEQ ID NO: 7528051 - DNA, 17 bp, Homo sapiens
ctcagagcaggacagaa

SEQ ID NO: 7528052 - DNA, 17 bp, Homo sapiens
ctcagagcaggacagaa

SEQ ID NO: 7528053 - DNA, 17 bp, Homo sapiens
ctcagagcaggacagaa

SEQ ID NO: 7528054 - DNA, 17 bp, Homo sapiens
ctcagagcaggacagaa

SEQ ID NO: 7528055 - DNA, 22 bp, Homo sapiens
ctcagagcccagggtacacccg

SEQ ID NO: 7528056 - DNA, 22 bp, Homo sapiens
ctcagagcccagggtacacccg

SEQ ID NO: 7528057 - DNA, 22 bp, Homo sapiens
ctcagagctgaggccagggaca

SEQ ID NO: 7528058 - DNA, 22 bp, Homo sapiens
ctcagagctgaggccagggaca

SEQ ID NO: 7528059 - DNA, 22 bp, Homo sapiens
ctcagagctcgtgggaccttgg

SEQ ID NO: 7528060 - DNA, 22 bp, Homo sapiens
ctcagagctgaggccagggaca

SEQ ID NO: 7528061 - DNA, 22 bp, Homo sapiens
ctcagaggcaagcaaggagctg

SEQ ID NO: 7528062 - DNA, 22 bp, Homo sapiens
ctcagagctgaggccagggaca

SEQ ID NO: 7528063 - DNA, 22 bp, Homo sapiens
ctcagaggcaagcaaggagctg

SEQ ID NO: 7528064 - DNA, 22 bp, Homo sapiens
ctcagaggcaagcaaggagctg

SEQ ID NO: 7528065 - DNA, 22 bp, Homo sapiens
ctcagaggcaagcaaggagctg

SEQ ID NO: 7528066 - DNA, 22 bp, Homo sapiens
ctcagaggcaagcaaggagctg

SEQ ID NO: 7528067 - DNA, 22 bp, Homo sapiens
ctcagaggcaagcaaggagctg

SEQ ID NO: 7528068 - DNA, 22 bp, Homo sapiens
ctcagaggcaagcaaggagctg

SEQ ID NO: 7528069 - DNA, 22 bp, Homo sapiens
ctcagaggcaagcaaggagctg

SEQ ID NO: 7528070 - DNA, 22 bp, Homo sapiens
ctcagaggcaagcaaggagctg

SEQ ID NO: 7528071 - DNA, 18 bp, Homo sapiens
ctcagagatgcccttatt

SEQ ID NO: 7528072 - DNA, 18 bp, Homo sapiens
ctcagagatgcccttatt

SEQ ID NO: 7528073 - DNA, 22 bp, Homo sapiens
ctcagagcaatgaacatgcaaa

SEQ ID NO: 7528074 - DNA, 22 bp, Homo sapiens
ctcagagcaatgaacatgcaaa

SEQ ID NO: 7528075 - DNA, 22 bp, Homo sapiens
ctcagagcaatgaacatgcaaa

SEQ ID NO: 7528076 - DNA, 22 bp, Homo sapiens
ctcagagcaatgaacatgcaaa

SEQ ID NO: 7528077 - DNA, 17 bp, Homo sapiens
ctcagagcaggacagaa

SEQ ID NO: 7528078 - DNA, 17 bp, Homo sapiens
ctcagagcaggacagaa

SEQ ID NO: 7528079 - DNA, 17 bp, Homo sapiens
ctcagagcaggacagaa

SEQ ID NO: 7528080 - DNA, 17 bp, Homo sapiens
ctcagagcaggacagaa

SEQ ID NO: 7528081 - DNA, 22 bp, Homo sapiens
ctcagagcacttttgaaagctc

SEQ ID NO: 7528082 - DNA, 22 bp, Homo sapiens
ctcagagagggcaccagggcca

SEQ ID NO: 7528083 - DNA, 22 bp, Homo sapiens
ctcagagagggcaccagggcca

SEQ ID NO: 7528084 - DNA, 22 bp, Homo sapiens
ctcagagagggcaccagggcca

SEQ ID NO: 7528085 - DNA, 22 bp, Homo sapiens
ctcagagagacaatgtgggaca

SEQ ID NO: 7528086 - DNA, 21 bp, Homo sapiens
ctcagagacaaatgccatccc

SEQ ID NO: 7528087 - DNA, 19 bp, Homo sapiens
ctcagagaggggcagtgcc

SEQ ID NO: 7528088 - DNA, 19 bp, Homo sapiens
ctcagagaggggcagtgcc

SEQ ID NO: 7528089 - DNA, 19 bp, Homo sapiens
ctcagagaggggcagtgcc

SEQ ID NO: 7528090 - DNA, 17 bp, Homo sapiens
ctcagagagggtaagta

SEQ ID NO: 7528091 - DNA, 17 bp, Homo sapiens
ctcagagagggtaagta

SEQ ID NO: 7528092 - DNA, 22 bp, Homo sapiens
ctcagagagtgaattcctgcct

SEQ ID NO: 7528093 - DNA, 22 bp, Homo sapiens
ctcagagagttaagtgaattac

SEQ ID NO: 7528094 - DNA, 22 bp, Homo sapiens
ctcagagaggttgaacaacttg

SEQ ID NO: 7528095 - DNA, 22 bp, Homo sapiens
ctcagagagtgaattcctgcct

SEQ ID NO: 7528096 - DNA, 22 bp, Homo sapiens
ttggaagggatattggcatatg

SEQ ID NO: 7528097 - DNA, 23 bp, Homo sapiens
ttggaagggaagagcatttgaga

SEQ ID NO: 7528098 - DNA, 22 bp, Homo sapiens
ttggaagggaaccgagtttgct

SEQ ID NO: 7528099 - DNA, 22 bp, Homo sapiens
ttggaagggaaccgagtttgct

SEQ ID NO: 7528100 - DNA, 23 bp, Homo sapiens
ttggaagggaagagcatttgaga

SEQ ID NO: 7528101 - DNA, 22 bp, Homo sapiens
ttggaaggccctgcctagcagg

SEQ ID NO: 7528102 - DNA, 22 bp, Homo sapiens
ttggaaggctgaatggcctctc

SEQ ID NO: 7528103 - DNA, 22 bp, Homo sapiens
ttggaaggctgaatggcctctc

SEQ ID NO: 7528104 - DNA, 22 bp, Homo sapiens
ttggaagggaacaccatttgac

SEQ ID NO: 7528105 - DNA, 22 bp, Homo sapiens
ttggaagggaacaccatttgac

SEQ ID NO: 7528106 - DNA, 20 bp, Homo sapiens
ttggaaggtggagaagagga

SEQ ID NO: 7528107 - DNA, 20 bp, Homo sapiens
ttggaaggtggagaagagga

SEQ ID NO: 7528108 - DNA, 20 bp, Homo sapiens
ttggaaggtggagaagagga

SEQ ID NO: 7528109 - DNA, 22 bp, Homo sapiens
ttggaaggttctggtcatggtt

SEQ ID NO: 7528110 - DNA, 20 bp, Homo sapiens
ttggaaggtggagaagagga

SEQ ID NO: 7528111 - DNA, 22 bp, Homo sapiens
ttggaaggggcagagtggctgc

SEQ ID NO: 7528112 - DNA, 22 bp, Homo sapiens
ttggaagggatattggcatatg

SEQ ID NO: 7528113 - DNA, 22 bp, Homo sapiens
ttggaagggtttcagttagtct

SEQ ID NO: 7528114 - DNA, 22 bp, Homo sapiens
ttggaaggtgagtccctgggtt

SEQ ID NO: 7528115 - DNA, 22 bp, Homo sapiens
ttggagggacagatggctaggc

SEQ ID NO: 7528116 - DNA, 22 bp, Homo sapiens
ttggagggacagatggctaggc

SEQ ID NO: 7528117 - DNA, 22 bp, Homo sapiens
ttggagggactgagcttcagtc

SEQ ID NO: 7528118 - DNA, 22 bp, Homo sapiens
ttggaaggttctggtcatggtt

SEQ ID NO: 7528119 - DNA, 22 bp, Homo sapiens
ttggaagtaatgaagaggtggg

SEQ ID NO: 7528120 - DNA, 22 bp, Homo sapiens
ttggaagtaatgaagaggtggg

SEQ ID NO: 7528121 - DNA, 22 bp, Homo sapiens
ttggaggggccactgcagagct

SEQ ID NO: 7528122 - DNA, 22 bp, Homo sapiens
ttggaggggccactgcagagct

SEQ ID NO: 7528123 - DNA, 22 bp, Homo sapiens
ttggagggactgagcttcagtc

SEQ ID NO: 7528124 - DNA, 22 bp, Homo sapiens
ttggagggactgagcttcagtc

SEQ ID NO: 7528125 - DNA, 22 bp, Homo sapiens
ttggagggactgagcttcagtc

SEQ ID NO: 7528126 - DNA, 22 bp, Homo sapiens
ttggaggggccactgcagagct

SEQ ID NO: 7528127 - DNA, 22 bp, Homo sapiens
ttggaggggccactgcagagct

SEQ ID NO: 7528128 - DNA, 22 bp, Homo sapiens
ttggaggggccactgcagagct

SEQ ID NO: 7528129 - DNA, 22 bp, Homo sapiens
ttggaggggccactgcagagct

SEQ ID NO: 7528130 - DNA, 22 bp, Homo sapiens
ttggaggggccactgcagagct

SEQ ID NO: 7528131 - DNA, 20 bp, Homo sapiens
ttggaggtgcagtgcatgca

SEQ ID NO: 7528132 - DNA, 22 bp, Homo sapiens
ttggagggtcttccacagccat

SEQ ID NO: 7528133 - DNA, 22 bp, Homo sapiens
ttggagggtcttccacagccat

SEQ ID NO: 7528134 - DNA, 22 bp, Homo sapiens
ttggagggtcttccacagccat

SEQ ID NO: 7528135 - DNA, 22 bp, Homo sapiens
ttggatccatctcaggcatagg

SEQ ID NO: 7528136 - DNA, 22 bp, Homo sapiens
ttggatccatctcaggcatagg

SEQ ID NO: 7528137 - DNA, 22 bp, Homo sapiens
ttggatccatctcaggcatagg

SEQ ID NO: 7528138 - DNA, 22 bp, Homo sapiens
ttggatccatctcaggcatagg

SEQ ID NO: 7528139 - DNA, 22 bp, Homo sapiens
ttggatccatctcaggcatagg

SEQ ID NO: 7528140 - DNA, 22 bp, Homo sapiens
ttggatccatctcaggcatagg

SEQ ID NO: 7528141 - DNA, 22 bp, Homo sapiens
ttggatccatctcaggcatagg

SEQ ID NO: 7528142 - DNA, 22 bp, Homo sapiens
ttggatccatctcaggcatagg

SEQ ID NO: 7528143 - DNA, 22 bp, Homo sapiens
ttggatcagatgatatctttgt

SEQ ID NO: 7528144 - DNA, 22 bp, Homo sapiens
ttggatcactctgaagccttac

SEQ ID NO: 7528145 - DNA, 22 bp, Homo sapiens
ctccactcaccagatgccagga

SEQ ID NO: 7528146 - DNA, 22 bp, Homo sapiens
ctccactcaccagatgccagga

SEQ ID NO: 7528147 - DNA, 22 bp, Homo sapiens
ttggatccatctcaggcatagg

SEQ ID NO: 7528148 - DNA, 22 bp, Homo sapiens
ctccactcaacaagcccagtgt

SEQ ID NO: 7528149 - DNA, 22 bp, Homo sapiens
ctccactcaacaagcccagtgt

SEQ ID NO: 7528150 - DNA, 22 bp, Homo sapiens
ctccactcaacaagcccagtgt

SEQ ID NO: 7528151 - DNA, 22 bp, Homo sapiens
ttggatacagatgaaaggaagg

SEQ ID NO: 7528152 - DNA, 22 bp, Homo sapiens
ttggagttctgggcacagctgc

SEQ ID NO: 7528153 - DNA, 22 bp, Homo sapiens
ttggagttctgggcacagctgc

SEQ ID NO: 7528154 - DNA, 22 bp, Homo sapiens
ttggataaagaggaagattatc

SEQ ID NO: 7528155 - DNA, 22 bp, Homo sapiens
ttggatacagatgaaaggaagg

SEQ ID NO: 7528156 - DNA, 20 bp, Homo sapiens
ttggagtctaaagactgggg

SEQ ID NO: 7528157 - DNA, 18 bp, Homo sapiens
ttggagtccaggtatgac

SEQ ID NO: 7528158 - DNA, 22 bp, Homo sapiens
ttggagtccttgctgcttcact

SEQ ID NO: 7528159 - DNA, 22 bp, Homo sapiens
ttggagtccttgctgcttcact

SEQ ID NO: 7528160 - DNA, 20 bp, Homo sapiens
ttggagtctaaagactgggg

SEQ ID NO: 7528161 - DNA, 22 bp, Homo sapiens
ttggaggtttgaaaatatgtgt

SEQ ID NO: 7528162 - DNA, 22 bp, Homo sapiens
ttggaggttccatgatttgtct

SEQ ID NO: 7528163 - DNA, 22 bp, Homo sapiens
ttggaggtttgaaaatatgtgt

SEQ ID NO: 7528164 - DNA, 22 bp, Homo sapiens
ttggaggtttcccaactgtggg

SEQ ID NO: 7528165 - DNA, 20 bp, Homo sapiens
ttggaggtgcagtgcatgca

SEQ ID NO: 7528166 - DNA, 22 bp, Homo sapiens
ttggaggttattaacactggcc

SEQ ID NO: 7528167 - DNA, 22 bp, Homo sapiens
ttggagtcacaggagaagaatg

SEQ ID NO: 7528168 - DNA, 22 bp, Homo sapiens
ttggagtcacaggagaagaatg

SEQ ID NO: 7528169 - DNA, 22 bp, Homo sapiens
ttggagtcagatgactgtagga

SEQ ID NO: 7528170 - DNA, 22 bp, Homo sapiens
ttggagtcatatggaattcaca

SEQ ID NO: 7528171 - DNA, 22 bp, Homo sapiens
ttggagtcatatggaattcaca

SEQ ID NO: 7528172 - DNA, 22 bp, Homo sapiens
ttggagtcattggcctgggtga

SEQ ID NO: 7528173 - DNA, 22 bp, Homo sapiens
ttggaaggagtcaaccagctga

SEQ ID NO: 7528174 - DNA, 22 bp, Homo sapiens
ttggaaggagcctaaaagagac

SEQ ID NO: 7528175 - DNA, 22 bp, Homo sapiens
ttggaaggagcctaaaagagac

SEQ ID NO: 7528176 - DNA, 19 bp, Homo sapiens
ttggaaggagccagagtgg

SEQ ID NO: 7528177 - DNA, 19 bp, Homo sapiens
ttggaaggagccagagtgg

SEQ ID NO: 7528178 - DNA, 22 bp, Homo sapiens
ttggaaggaagaaccgcggtag

SEQ ID NO: 7528179 - DNA, 22 bp, Homo sapiens
ttggaaggaagaaccgcggtag

SEQ ID NO: 7528180 - DNA, 22 bp, Homo sapiens
ttggaaggaattaaggtcatga

SEQ ID NO: 7528181 - DNA, 22 bp, Homo sapiens
ttggaaggaattaaggtcatga

SEQ ID NO: 7528182 - DNA, 22 bp, Homo sapiens
ttggaaggaccaggccttgatt

SEQ ID NO: 7528183 - DNA, 22 bp, Homo sapiens
ttggaaggagtctttggggatg

SEQ ID NO: 7528184 - DNA, 22 bp, Homo sapiens
ttggaaggatttagagatgtct

SEQ ID NO: 7528185 - DNA, 22 bp, Homo sapiens
ttggaaggatttagagatgtct

SEQ ID NO: 7528186 - DNA, 22 bp, Homo sapiens
ttggaaggcagcatttgtccat

SEQ ID NO: 7528187 - DNA, 22 bp, Homo sapiens
ttggaaggcagcatttgtccat

SEQ ID NO: 7528188 - DNA, 22 bp, Homo sapiens
ttggaaggccagcaccttgagt

SEQ ID NO: 7528189 - DNA, 22 bp, Homo sapiens
ttggaaggccctgcctagcagg

SEQ ID NO: 7528190 - DNA, 22 bp, Homo sapiens
ttggaagcgagcacatggagga

SEQ ID NO: 7528191 - DNA, 22 bp, Homo sapiens
ttggaagcgagcacatggagga

SEQ ID NO: 7528192 - DNA, 22 bp, Homo sapiens
ttggaagcctagttaagatgaa

SEQ ID NO: 7528193 - DNA, 22 bp, Homo sapiens
ttggaagccctgtgataggcca

SEQ ID NO: 7528194 - DNA, 22 bp, Homo sapiens
ttggaagccctctgcaagatcc

SEQ ID NO: 7528195 - DNA, 22 bp, Homo sapiens
ttggaagccctctgcaagatcc

SEQ ID NO: 7528196 - DNA, 22 bp, Homo sapiens
ttggaagcattctgaatgtcca

SEQ ID NO: 7528197 - DNA, 23 bp, Homo sapiens
ttggaagccagacagctgtgcag

SEQ ID NO: 7528198 - DNA, 22 bp, Homo sapiens
ttggaagattacttagttttct

SEQ ID NO: 7528199 - DNA, 22 bp, Homo sapiens
ttggaagatctaacagaggcat

SEQ ID NO: 7528200 - DNA, 22 bp, Homo sapiens
ttggaagatctaacagaggcat

SEQ ID NO: 7528201 - DNA, 22 bp, Homo sapiens
ttggaagatctaacagaggcat

SEQ ID NO: 7528202 - DNA, 21 bp, Homo sapiens
ttggaagataatgcttatgat

SEQ ID NO: 7528203 - DNA, 22 bp, Homo sapiens
ttggaagattctgtgtctggtg

SEQ ID NO: 7528204 - DNA, 22 bp, Homo sapiens
ttggaagcaataaatggaaaga

SEQ ID NO: 7528205 - DNA, 22 bp, Homo sapiens
ttggaagcagtgtacactgtac

SEQ ID NO: 7528206 - DNA, 22 bp, Homo sapiens
ttggaagcagtgtacactgtac

SEQ ID NO: 7528207 - DNA, 22 bp, Homo sapiens
ttggaaaagtgaaactagatgc

SEQ ID NO: 7528208 - DNA, 22 bp, Homo sapiens
ttggaaaagtgaaactagatgc

SEQ ID NO: 7528209 - DNA, 22 bp, Homo sapiens
ttggaaaagtgaaactagatgc

SEQ ID NO: 7528210 - DNA, 22 bp, Homo sapiens
ttggaaaagtgaaactagatgc

SEQ ID NO: 7528211 - DNA, 22 bp, Homo sapiens
ctcagtgcttctagcttgatga

SEQ ID NO: 7528212 - DNA, 22 bp, Homo sapiens
ttggaaaatgaggcacagagag

SEQ ID NO: 7528213 - DNA, 22 bp, Homo sapiens
ttggaaaatgaggcacagagag

SEQ ID NO: 7528214 - DNA, 22 bp, Homo sapiens
ttggaaaatgaggcacagagag

SEQ ID NO: 7528215 - DNA, 22 bp, Homo sapiens
ttggaaaagtgaaactagatgc

SEQ ID NO: 7528216 - DNA, 22 bp, Homo sapiens
ctcagtgctagaagtagattgc

SEQ ID NO: 7528217 - DNA, 22 bp, Homo sapiens
ctcagtgcaaccaaagtgatct

SEQ ID NO: 7528218 - DNA, 22 bp, Homo sapiens
ctcagtgcagctaggcatgaga

SEQ ID NO: 7528219 - DNA, 22 bp, Homo sapiens
ctcagtgcagctaggcatgaga

SEQ ID NO: 7528220 - DNA, 22 bp, Homo sapiens
ctcagtgcaaccaaagtgatct

SEQ ID NO: 7528221 - DNA, 22 bp, Homo sapiens
ctcagtcttctcctccaatgga

SEQ ID NO: 7528222 - DNA, 22 bp, Homo sapiens
ctcagtcttctcctccaatgga

SEQ ID NO: 7528223 - DNA, 22 bp, Homo sapiens
ctcagtcttctcctccaatgga

SEQ ID NO: 7528224 - DNA, 22 bp, Homo sapiens
ctcagtccgtcccgctaggtgc

SEQ ID NO: 7528225 - DNA, 22 bp, Homo sapiens
ctcagtccttatttgcctctac

SEQ ID NO: 7528226 - DNA, 22 bp, Homo sapiens
ctcagtctcttgggctgtgaag

SEQ ID NO: 7528227 - DNA, 22 bp, Homo sapiens
ctcagtccacgcagcctcctga

SEQ ID NO: 7528228 - DNA, 22 bp, Homo sapiens
ctcagtccagggaccggcctcc

SEQ ID NO: 7528229 - DNA, 22 bp, Homo sapiens
ctcagtccagggaccggcctcc

SEQ ID NO: 7528230 - DNA, 22 bp, Homo sapiens
ctcagtcatgacgctcaggacc

SEQ ID NO: 7528231 - DNA, 22 bp, Homo sapiens
ctcagtcatgacgctcaggacc

SEQ ID NO: 7528232 - DNA, 19 bp, Homo sapiens
ctcagtctggctctgcctg

SEQ ID NO: 7528233 - DNA, 22 bp, Homo sapiens
ctcagtctcttgggctgtgaag

SEQ ID NO: 7528234 - DNA, 19 bp, Homo sapiens
ctcagtctggctctgcctg

SEQ ID NO: 7528235 - DNA, 22 bp, Homo sapiens
ctcagtctgtcttgtctgtgtt

SEQ ID NO: 7528236 - DNA, 22 bp, Homo sapiens
ctcagtctgtcttgtctgtgtt

SEQ ID NO: 7528237 - DNA, 22 bp, Homo sapiens
ctcagtctgtcttgtctgtgtt

SEQ ID NO: 7528238 - DNA, 17 bp, Homo sapiens
ttggctctattgcctct

SEQ ID NO: 7528239 - DNA, 17 bp, Homo sapiens
ttggctctattgcctct

SEQ ID NO: 7528240 - DNA, 17 bp, Homo sapiens
ttggctctattgcctct

SEQ ID NO: 7528241 - DNA, 22 bp, Homo sapiens
ttggctctgaaacccaagctct

SEQ ID NO: 7528242 - DNA, 22 bp, Homo sapiens
ttggctctcattttccccatta

SEQ ID NO: 7528243 - DNA, 21 bp, Homo sapiens
ttggctctgaaacttgcacct

SEQ ID NO: 7528244 - DNA, 21 bp, Homo sapiens
ttggctctgaaacttgcacct

SEQ ID NO: 7528245 - DNA, 21 bp, Homo sapiens
ttggctctgaaacttgcacct

SEQ ID NO: 7528246 - DNA, 22 bp, Homo sapiens
ttggctctgaactatgcagttt

SEQ ID NO: 7528247 - DNA, 22 bp, Homo sapiens
ttggctctgacattaaaacaat

SEQ ID NO: 7528248 - DNA, 22 bp, Homo sapiens
ttggctctgaaacccaagctct

SEQ ID NO: 7528249 - DNA, 22 bp, Homo sapiens
ttggctctgaaacccaagctct

SEQ ID NO: 7528250 - DNA, 22 bp, Homo sapiens
ttggctctgaaacccaagctct

SEQ ID NO: 7528251 - DNA, 22 bp, Homo sapiens
ttggctctcattttccccatta

SEQ ID NO: 7528252 - DNA, 22 bp, Homo sapiens
ttggctctgaaacccaagctct

SEQ ID NO: 7528253 - DNA, 22 bp, Homo sapiens
ttggctctgtgtctccactcaa

SEQ ID NO: 7528254 - DNA, 22 bp, Homo sapiens
ttggctctggcaaggggcaccg

SEQ ID NO: 7528255 - DNA, 22 bp, Homo sapiens
ttggctctggttgccctgtgac

SEQ ID NO: 7528256 - DNA, 22 bp, Homo sapiens
ttggctctgtgtctccactcaa

SEQ ID NO: 7528257 - DNA, 22 bp, Homo sapiens
ttggctctggaactatttctga

SEQ ID NO: 7528258 - DNA, 22 bp, Homo sapiens
ttggctctggaactatttctga

SEQ ID NO: 7528259 - DNA, 22 bp, Homo sapiens
ttggctctggaactatttctga

SEQ ID NO: 7528260 - DNA, 22 bp, Homo sapiens
ttggctctggaactatttctga

SEQ ID NO: 7528261 - DNA, 22 bp, Homo sapiens
ttggctctggcaaggggcaccg

SEQ ID NO: 7528262 - DNA, 20 bp, Homo sapiens
ttggctctgatcagtggagc

SEQ ID NO: 7528263 - DNA, 20 bp, Homo sapiens
ttggctctgatcagtggagc

SEQ ID NO: 7528264 - DNA, 22 bp, Homo sapiens
ttggctctgatggggatcagga

SEQ ID NO: 7528265 - DNA, 22 bp, Homo sapiens
ctccagagtcacactgcctggg

SEQ ID NO: 7528266 - DNA, 22 bp, Homo sapiens
ctccagagtcacactgcctggg

SEQ ID NO: 7528267 - DNA, 22 bp, Homo sapiens
ctccagagtcatcgagcattcc

SEQ ID NO: 7528268 - DNA, 22 bp, Homo sapiens
ctccagataggagggggtcccc

SEQ ID NO: 7528269 - DNA, 22 bp, Homo sapiens
ctccagagtcatcgagcattcc

SEQ ID NO: 7528270 - DNA, 22 bp, Homo sapiens
ctccagagtcatcgagcattcc

SEQ ID NO: 7528271 - DNA, 22 bp, Homo sapiens
ctccagagtcatcgagcattcc

SEQ ID NO: 7528272 - DNA, 22 bp, Homo sapiens
ctccagagtcacactgcctggg

SEQ ID NO: 7528273 - DNA, 22 bp, Homo sapiens
ctccagagtcacactgcctggg

SEQ ID NO: 7528274 - DNA, 22 bp, Homo sapiens
ctccagagtcacactgcctggg

SEQ ID NO: 7528275 - DNA, 22 bp, Homo sapiens
ctccagaggttctcatctggga

SEQ ID NO: 7528276 - DNA, 22 bp, Homo sapiens
ctccagaggttctcatctggga

SEQ ID NO: 7528277 - DNA, 22 bp, Homo sapiens
ctccagaggttctcatctggga

SEQ ID NO: 7528278 - DNA, 22 bp, Homo sapiens
ctccagaggttctcatctggga

SEQ ID NO: 7528279 - DNA, 22 bp, Homo sapiens
ctccagaggtccccgcggcact

SEQ ID NO: 7528280 - DNA, 22 bp, Homo sapiens
ctccagaggtccccgcggcact

SEQ ID NO: 7528281 - DNA, 22 bp, Homo sapiens
ctccagaggtccccgcggcact

SEQ ID NO: 7528282 - DNA, 22 bp, Homo sapiens
ctccagagggtcagactctgag

SEQ ID NO: 7528283 - DNA, 22 bp, Homo sapiens
ctccagaggttctcatctggga

SEQ ID NO: 7528284 - DNA, 22 bp, Homo sapiens
ctccagaggtccccgcggcact

SEQ ID NO: 7528285 - DNA, 22 bp, Homo sapiens
ctccagaggtccccgcggcact

SEQ ID NO: 7528286 - DNA, 22 bp, Homo sapiens
ctccagaggttctcatctggga

SEQ ID NO: 7528287 - DNA, 22 bp, Homo sapiens
ctccagaggttctcatctggga

SEQ ID NO: 7528288 - DNA, 22 bp, Homo sapiens
ctccagaggtccccgcggcact

SEQ ID NO: 7528289 - DNA, 22 bp, Homo sapiens
ctccagaggtccccgcggcact

SEQ ID NO: 7528290 - DNA, 22 bp, Homo sapiens
ctccagaggccctatcccacta

SEQ ID NO: 7528291 - DNA, 22 bp, Homo sapiens
ctccagaggccctatcccacta

SEQ ID NO: 7528292 - DNA, 22 bp, Homo sapiens
ctccagaggcgacttgcatcac

SEQ ID NO: 7528293 - DNA, 22 bp, Homo sapiens
ctccagaggcgacttgcatcac

SEQ ID NO: 7528294 - DNA, 22 bp, Homo sapiens
ctccagaggcgacttgcatcac

SEQ ID NO: 7528295 - DNA, 22 bp, Homo sapiens
ctccagagggtcagactctgag

SEQ ID NO: 7528296 - DNA, 22 bp, Homo sapiens
ctccagaggcgacttgcatcac

SEQ ID NO: 7528297 - DNA, 22 bp, Homo sapiens
ctccagagggtcagactctgag

SEQ ID NO: 7528298 - DNA, 22 bp, Homo sapiens
ctccagagggtcagactctgag

SEQ ID NO: 7528299 - DNA, 22 bp, Homo sapiens
ctccagagggtcagactctgag

SEQ ID NO: 7528300 - DNA, 22 bp, Homo sapiens
ctccagaggatgcaggtgaggg

SEQ ID NO: 7528301 - DNA, 22 bp, Homo sapiens
ctccagaggatgcaggtgaggg

SEQ ID NO: 7528302 - DNA, 22 bp, Homo sapiens
ctccagaggatgcaggtgaggg

SEQ ID NO: 7528303 - DNA, 22 bp, Homo sapiens
ctccagaggatgcaggtgaggg

SEQ ID NO: 7528304 - DNA, 22 bp, Homo sapiens
ctccagaggatgcaggtgaggg

SEQ ID NO: 7528305 - DNA, 22 bp, Homo sapiens
ctccagaggatgcaggtgaggg

SEQ ID NO: 7528306 - DNA, 22 bp, Homo sapiens
ctccagaggatgcaggtgaggg

SEQ ID NO: 7528307 - DNA, 22 bp, Homo sapiens
ctccagaggatgcaggtgaggg

SEQ ID NO: 7528308 - DNA, 22 bp, Homo sapiens
ctccagaggatgcaggtgaggg

SEQ ID NO: 7528309 - DNA, 22 bp, Homo sapiens
ctccagaggatgcaggtgaggg

SEQ ID NO: 7528310 - DNA, 22 bp, Homo sapiens
ctccagaggatgcaggtgaggg

SEQ ID NO: 7528311 - DNA, 22 bp, Homo sapiens
ctccagaggatgcaggtgaggg

SEQ ID NO: 7528312 - DNA, 22 bp, Homo sapiens
ctccagaggaaagcacatagtg

SEQ ID NO: 7528313 - DNA, 22 bp, Homo sapiens
ctccagaggaaagcacatagtg

SEQ ID NO: 7528314 - DNA, 22 bp, Homo sapiens
ctccagaggaaagcacatagtg

SEQ ID NO: 7528315 - DNA, 22 bp, Homo sapiens
ctccagaggaaagcacatagtg

SEQ ID NO: 7528316 - DNA, 18 bp, Homo sapiens
ctccagagctgtgagaca

SEQ ID NO: 7528317 - DNA, 18 bp, Homo sapiens
ctccagagctgtgagaca

SEQ ID NO: 7528318 - DNA, 18 bp, Homo sapiens
ctccagagctgtgagaca

SEQ ID NO: 7528319 - DNA, 18 bp, Homo sapiens
ctccagagctgtgagaca

SEQ ID NO: 7528320 - DNA, 18 bp, Homo sapiens
ctccagagctgtgagaca

SEQ ID NO: 7528321 - DNA, 18 bp, Homo sapiens
ctccagagctgtgagaca

SEQ ID NO: 7528322 - DNA, 18 bp, Homo sapiens
ctccagagctgtgagaca

SEQ ID NO: 7528323 - DNA, 22 bp, Homo sapiens
ctccaggacagattcagggcca

SEQ ID NO: 7528324 - DNA, 22 bp, Homo sapiens
ctccaggacagattcagggcca

SEQ ID NO: 7528325 - DNA, 22 bp, Homo sapiens
ctccaggacagattcagggcca

SEQ ID NO: 7528326 - DNA, 22 bp, Homo sapiens
ctccaggacactaacccaggct

SEQ ID NO: 7528327 - DNA, 22 bp, Homo sapiens
ctccaggacagattcagggcca

SEQ ID NO: 7528328 - DNA, 22 bp, Homo sapiens
ctccaggacagattcagggcca

SEQ ID NO: 7528329 - DNA, 22 bp, Homo sapiens
ctccaggacagattcagggcca

SEQ ID NO: 7528330 - DNA, 22 bp, Homo sapiens
ctccaggacatgactttcttgc

SEQ ID NO: 7528331 - DNA, 22 bp, Homo sapiens
ctccaggacatgactttcttgc

SEQ ID NO: 7528332 - DNA, 22 bp, Homo sapiens
ctccaggaccagggctcctgga

SEQ ID NO: 7528333 - DNA, 22 bp, Homo sapiens
ctccaggaccagggctcctgga

SEQ ID NO: 7528334 - DNA, 22 bp, Homo sapiens
ctccaggacatgactttcttgc

SEQ ID NO: 7528335 - DNA, 22 bp, Homo sapiens
ctccaggaccagggctcctgga

SEQ ID NO: 7528336 - DNA, 22 bp, Homo sapiens
ctccaggaccagggctcctgga

SEQ ID NO: 7528337 - DNA, 22 bp, Homo sapiens
ctccaggaccagggctcctgga

SEQ ID NO: 7528338 - DNA, 22 bp, Homo sapiens
ctccaggaccagggctcctgga

SEQ ID NO: 7528339 - DNA, 22 bp, Homo sapiens
ctccaggacccagtggctccag

SEQ ID NO: 7528340 - DNA, 22 bp, Homo sapiens
ctccaggacccagtggctccag

SEQ ID NO: 7528341 - DNA, 22 bp, Homo sapiens
ctccaggaccagggctcctgga

SEQ ID NO: 7528342 - DNA, 22 bp, Homo sapiens
ctccaggacccagtggctccag

SEQ ID NO: 7528343 - DNA, 22 bp, Homo sapiens
ctccaggacccagtggctccag

SEQ ID NO: 7528344 - DNA, 22 bp, Homo sapiens
ctccaggactcaggcccctggg

SEQ ID NO: 7528345 - DNA, 22 bp, Homo sapiens
ctccaggactcaggcccctggg

SEQ ID NO: 7528346 - DNA, 22 bp, Homo sapiens
ctccaggacccagtggctccag

SEQ ID NO: 7528347 - DNA, 22 bp, Homo sapiens
ctccaggactgaggacagagct

SEQ ID NO: 7528348 - DNA, 22 bp, Homo sapiens
ctccaggactgaggacagagct

SEQ ID NO: 7528349 - DNA, 22 bp, Homo sapiens
ctccaggactgaggacagagct

SEQ ID NO: 7528350 - DNA, 22 bp, Homo sapiens
ctccaggactgaggacagagct

SEQ ID NO: 7528351 - DNA, 22 bp, Homo sapiens
ctccaggactgaggacagagct

SEQ ID NO: 7528352 - DNA, 22 bp, Homo sapiens
ctccaggactcaggcccctggg

SEQ ID NO: 7528353 - DNA, 22 bp, Homo sapiens
ctccaggactcaggcccctggg

SEQ ID NO: 7528354 - DNA, 22 bp, Homo sapiens
ctccaggactgaggacagagct

SEQ ID NO: 7528355 - DNA, 22 bp, Homo sapiens
ctccaggactgaggacagagct

SEQ ID NO: 7528356 - DNA, 22 bp, Homo sapiens
ctccaggactcaggcccctggg

SEQ ID NO: 7528357 - DNA, 22 bp, Homo sapiens
ttggctgaaggaataaatggat

SEQ ID NO: 7528358 - DNA, 22 bp, Homo sapiens
ttggctgaatgaggtcaccttt

SEQ ID NO: 7528359 - DNA, 22 bp, Homo sapiens
ttggctgaaggttaagtgctgg

SEQ ID NO: 7528360 - DNA, 22 bp, Homo sapiens
ttggctgaaggttaagtgctgg

SEQ ID NO: 7528361 - DNA, 22 bp, Homo sapiens
ttggctgagagaggaaaagggc

SEQ ID NO: 7528362 - DNA, 22 bp, Homo sapiens
ttggctgagagaggaaaagggc

SEQ ID NO: 7528363 - DNA, 22 bp, Homo sapiens
ttggctgacaaatggaatctct

SEQ ID NO: 7528364 - DNA, 22 bp, Homo sapiens
ttggctgacaaatggaatctct

SEQ ID NO: 7528365 - DNA, 22 bp, Homo sapiens
ttggctgaccagaacctgcccc

SEQ ID NO: 7528366 - DNA, 22 bp, Homo sapiens
ttggctgaccagaacctgcccc

SEQ ID NO: 7528367 - DNA, 22 bp, Homo sapiens
ttggctctttctcagtcacgtt

SEQ ID NO: 7528368 - DNA, 22 bp, Homo sapiens
ttggctctttcctcacacagga

SEQ ID NO: 7528369 - DNA, 22 bp, Homo sapiens
ttggctcttctcccagtggcct

SEQ ID NO: 7528370 - DNA, 22 bp, Homo sapiens
ttggctctgtgtctccactcaa

SEQ ID NO: 7528371 - DNA, 22 bp, Homo sapiens
ttggctctgtgtctccactcaa

SEQ ID NO: 7528372 - DNA, 22 bp, Homo sapiens
ttggctctgtgtctccactcaa

SEQ ID NO: 7528373 - DNA, 22 bp, Homo sapiens
ttggctgaaagccatgagaccg

SEQ ID NO: 7528374 - DNA, 22 bp, Homo sapiens
ttggctctttctcagtcacgtt

SEQ ID NO: 7528375 - DNA, 22 bp, Homo sapiens
ttggctctttcctcacacagga

SEQ ID NO: 7528376 - DNA, 22 bp, Homo sapiens
ttggctgaaagccatgagaccg

SEQ ID NO: 7528377 - DNA, 22 bp, Homo sapiens
ttggctgaactgagctccatcg

SEQ ID NO: 7528378 - DNA, 22 bp, Homo sapiens
ttggctgaagactagatgttta

SEQ ID NO: 7528379 - DNA, 22 bp, Homo sapiens
ttggctgaagactagatgttta

SEQ ID NO: 7528380 - DNA, 22 bp, Homo sapiens
ttggctgaaggaataaatggat

SEQ ID NO: 7528381 - DNA, 22 bp, Homo sapiens
ttggctgagagctgctctgcag

SEQ ID NO: 7528382 - DNA, 22 bp, Homo sapiens
ttggctgagagctgctctgcag

SEQ ID NO: 7528383 - DNA, 22 bp, Homo sapiens
ttggctgagccatgtgaaacca

SEQ ID NO: 7528384 - DNA, 22 bp, Homo sapiens
ttggctgagccatgtgaaacca

SEQ ID NO: 7528385 - DNA, 22 bp, Homo sapiens
ttggctgatgcaagagcttcct

SEQ ID NO: 7528386 - DNA, 22 bp, Homo sapiens
ttggctgcaatcacagggactc

SEQ ID NO: 7528387 - DNA, 22 bp, Homo sapiens
ttggctgcaatcacagggactc

SEQ ID NO: 7528388 - DNA, 21 bp, Homo sapiens
ttggctgcctgagattagaat

SEQ ID NO: 7528389 - DNA, 22 bp, Homo sapiens
ttggctgccgagcgcatcccgg

SEQ ID NO: 7528390 - DNA, 22 bp, Homo sapiens
ctccagcctcatctcctggctg

SEQ ID NO: 7528391 - DNA, 22 bp, Homo sapiens
ctccaggacactaacccaggct

SEQ ID NO: 7528392 - DNA, 22 bp, Homo sapiens
ctccagcctcatctcctggctg

SEQ ID NO: 7528393 - DNA, 22 bp, Homo sapiens
ttggctgctagatggtgttaga

SEQ ID NO: 7528394 - DNA, 22 bp, Homo sapiens
ctccagcctcatctcctggctg

SEQ ID NO: 7528395 - DNA, 22 bp, Homo sapiens
ttggctgccttcacccctggcc

SEQ ID NO: 7528396 - DNA, 22 bp, Homo sapiens
ttggctgccttcacccctggcc

SEQ ID NO: 7528397 - DNA, 22 bp, Homo sapiens
ttggctgctaatggctgacagc

SEQ ID NO: 7528398 - DNA, 22 bp, Homo sapiens
ttggctgctaatggctgacagc

SEQ ID NO: 7528399 - DNA, 22 bp, Homo sapiens
ctcaggtcacaggatggccagg

SEQ ID NO: 7528400 - DNA, 22 bp, Homo sapiens
ctcaggtcacaggatggccagg

SEQ ID NO: 7528401 - DNA, 22 bp, Homo sapiens
ctcaggtcacaggatggccagg

SEQ ID NO: 7528402 - DNA, 22 bp, Homo sapiens
ctcaggtcacggatctgagctg

SEQ ID NO: 7528403 - DNA, 22 bp, Homo sapiens
ctcaggtcgctatttctcttac

SEQ ID NO: 7528404 - DNA, 22 bp, Homo sapiens
ctcaggtcgctatttctcttac

SEQ ID NO: 7528405 - DNA, 22 bp, Homo sapiens
ctcaggtagagtctgcatgggg

SEQ ID NO: 7528406 - DNA, 22 bp, Homo sapiens
ctcagggtgcccggatcccagg

SEQ ID NO: 7528407 - DNA, 18 bp, Homo sapiens
ctcagggtgaccaatgca

SEQ ID NO: 7528408 - DNA, 22 bp, Homo sapiens
ctcagggtgagaaattgatcca

SEQ ID NO: 7528409 - DNA, 22 bp, Homo sapiens
ctcagggtgcagcacagttcct

SEQ ID NO: 7528410 - DNA, 22 bp, Homo sapiens
ctcagggtgcccggatcccagg

SEQ ID NO: 7528411 - DNA, 22 bp, Homo sapiens
ctcagtaaggatgcttcagcgg

SEQ ID NO: 7528412 - DNA, 20 bp, Homo sapiens
ctcagtaaaagcacagggtc

SEQ ID NO: 7528413 - DNA, 22 bp, Homo sapiens
ctcaggtcttagttctgtcatc

SEQ ID NO: 7528414 - DNA, 22 bp, Homo sapiens
ctcaggtcttagttctgtcatc

SEQ ID NO: 7528415 - DNA, 22 bp, Homo sapiens
ctcaggtcttagttctgtcatc

SEQ ID NO: 7528416 - DNA, 22 bp, Homo sapiens
ctcagtcagtttttgtgagaga

SEQ ID NO: 7528417 - DNA, 22 bp, Homo sapiens
ctcagtagaaaatacatggact

SEQ ID NO: 7528418 - DNA, 22 bp, Homo sapiens
ctcagtactttatgtatatgat

SEQ ID NO: 7528419 - DNA, 22 bp, Homo sapiens
ctcagtaaggatgcttcagcgg

SEQ ID NO: 7528420 - DNA, 22 bp, Homo sapiens
ctcagggcttgagtgtccagga

SEQ ID NO: 7528421 - DNA, 22 bp, Homo sapiens
ctcagggctggaaagccaggaa

SEQ ID NO: 7528422 - DNA, 22 bp, Homo sapiens
ctcagggcttgagtgtccagga

SEQ ID NO: 7528423 - DNA, 22 bp, Homo sapiens
ctcagggcttgagtgtccagga

SEQ ID NO: 7528424 - DNA, 21 bp, Homo sapiens
ctcagggcttggtgtcctcat

SEQ ID NO: 7528425 - DNA, 22 bp, Homo sapiens
ctcaggggacctggctccgagt

SEQ ID NO: 7528426 - DNA, 22 bp, Homo sapiens
ctcaggggacctggctccgagt

SEQ ID NO: 7528427 - DNA, 21 bp, Homo sapiens
ctcagggcttggtgtcctcat

SEQ ID NO: 7528428 - DNA, 21 bp, Homo sapiens
ctcagggcttggtgtcctcat

SEQ ID NO: 7528429 - DNA, 22 bp, Homo sapiens
ctcagggggaatcaggtcacag

SEQ ID NO: 7528430 - DNA, 22 bp, Homo sapiens
ctcagggtctggtccttagatt

SEQ ID NO: 7528431 - DNA, 22 bp, Homo sapiens
ctcagggtaatgaaagacgaat

SEQ ID NO: 7528432 - DNA, 22 bp, Homo sapiens
ctcagggcggcgggcagcccag

SEQ ID NO: 7528433 - DNA, 22 bp, Homo sapiens
ctcagggcggcgggcagcccag

SEQ ID NO: 7528434 - DNA, 22 bp, Homo sapiens
ctcagggcggcgggcagcccag

SEQ ID NO: 7528435 - DNA, 22 bp, Homo sapiens
ctcagggcggcgggcagcccag

SEQ ID NO: 7528436 - DNA, 22 bp, Homo sapiens
ctcagggctctgcatgcacacg

SEQ ID NO: 7528437 - DNA, 22 bp, Homo sapiens
ctcagggctctgcatgcacacg

SEQ ID NO: 7528438 - DNA, 22 bp, Homo sapiens
ctcagggctctgcatgcacacg

SEQ ID NO: 7528439 - DNA, 22 bp, Homo sapiens
ctcagggctggaaagccaggaa

SEQ ID NO: 7528440 - DNA, 22 bp, Homo sapiens
ctcagggctggaaagccaggaa

SEQ ID NO: 7528441 - DNA, 22 bp, Homo sapiens
ctcagggctggaaagccaggaa

SEQ ID NO: 7528442 - DNA, 22 bp, Homo sapiens
ctcagggctggaaagccaggaa

SEQ ID NO: 7528443 - DNA, 22 bp, Homo sapiens
ctcagggctctgcatgcacacg

SEQ ID NO: 7528444 - DNA, 18 bp, Homo sapiens
ctcagggcatcagtctgg

SEQ ID NO: 7528445 - DNA, 18 bp, Homo sapiens
ctcagggcatcagtctgg

SEQ ID NO: 7528446 - DNA, 18 bp, Homo sapiens
ctcagggcatcagtctgg

SEQ ID NO: 7528447 - DNA, 18 bp, Homo sapiens
ctcagggcatcagtctgg

SEQ ID NO: 7528448 - DNA, 22 bp, Homo sapiens
ctcagggcagtatggctgagag

SEQ ID NO: 7528449 - DNA, 22 bp, Homo sapiens
ctcagggccaaggatgctgttg

SEQ ID NO: 7528450 - DNA, 21 bp, Homo sapiens
ctcagggccatcttgccactg

SEQ ID NO: 7528451 - DNA, 21 bp, Homo sapiens
ctcagggccatcttgccactg

SEQ ID NO: 7528452 - DNA, 22 bp, Homo sapiens
ctcagggccaaggatgctgttg

SEQ ID NO: 7528453 - DNA, 22 bp, Homo sapiens
ctcagggccaaggatgctgttg

SEQ ID NO: 7528454 - DNA, 22 bp, Homo sapiens
ctcagggcagtatggctgagag

SEQ ID NO: 7528455 - DNA, 22 bp, Homo sapiens
ctcagggcagtatggctgagag

SEQ ID NO: 7528456 - DNA, 22 bp, Homo sapiens
ctcagggcagtatggctgagag

SEQ ID NO: 7528457 - DNA, 22 bp, Homo sapiens
ctcagggcagtatggctgagag

SEQ ID NO: 7528458 - DNA, 22 bp, Homo sapiens
ctcagggatggtgaagcaccca

SEQ ID NO: 7528459 - DNA, 22 bp, Homo sapiens
ctcagggatggtgaagcaccca

SEQ ID NO: 7528460 - DNA, 22 bp, Homo sapiens
ctcagggatggtgaagcaccca

SEQ ID NO: 7528461 - DNA, 22 bp, Homo sapiens
ctcagggatgggcagatgttaa

SEQ ID NO: 7528462 - DNA, 23 bp, Homo sapiens
ctcagggatagaaaggaagacag

SEQ ID NO: 7528463 - DNA, 22 bp, Homo sapiens
ctcagggatgggcagatgttaa

SEQ ID NO: 7528464 - DNA, 23 bp, Homo sapiens
ctcagggatagaaaggaagacag

SEQ ID NO: 7528465 - DNA, 23 bp, Homo sapiens
ctcagggatagaaaggaagacag

SEQ ID NO: 7528466 - DNA, 23 bp, Homo sapiens
ctcagggatagaaaggaagacag

SEQ ID NO: 7528467 - DNA, 23 bp, Homo sapiens
ctcagggatagaaaggaagacag

SEQ ID NO: 7528468 - DNA, 22 bp, Homo sapiens
ctcagggaagctatggtgaggg

SEQ ID NO: 7528469 - DNA, 22 bp, Homo sapiens
ctcagggaattatttctgtcct

SEQ ID NO: 7528470 - DNA, 22 bp, Homo sapiens
ctcagggaattgaatctccttg

SEQ ID NO: 7528471 - DNA, 22 bp, Homo sapiens
ctcagggaagctatggtgaggg

SEQ ID NO: 7528472 - DNA, 22 bp, Homo sapiens
ctcagggaattatttctgtcct

SEQ ID NO: 7528473 - DNA, 22 bp, Homo sapiens
ttgccccttggccgttaaaaca

SEQ ID NO: 7528474 - DNA, 18 bp, Homo sapiens
ttgcccctgggtgaggat

SEQ ID NO: 7528475 - DNA, 22 bp, Homo sapiens
ttgcccctggtcagaggaggct

SEQ ID NO: 7528476 - DNA, 22 bp, Homo sapiens
ttgcccaggctggagtgcagtg

SEQ ID NO: 7528477 - DNA, 22 bp, Homo sapiens
ttgcccaggctggagtgcagtg

SEQ ID NO: 7528478 - DNA, 22 bp, Homo sapiens
ttgcccatctcagtgcctcgct

SEQ ID NO: 7528479 - DNA, 22 bp, Homo sapiens
ttgcccatctcagtgcctcgct

SEQ ID NO: 7528480 - DNA, 22 bp, Homo sapiens
ttgcccctcttggattttccgg

SEQ ID NO: 7528481 - DNA, 22 bp, Homo sapiens
ttgccctgcagcggtgagtggt

SEQ ID NO: 7528482 - DNA, 22 bp, Homo sapiens
ttgccctgcctccctgaggtga

SEQ ID NO: 7528483 - DNA, 22 bp, Homo sapiens
ttgccctgcagcggtgagtggt

SEQ ID NO: 7528484 - DNA, 22 bp, Homo sapiens
ttgccctgcctccctgaggtga

SEQ ID NO: 7528485 - DNA, 22 bp, Homo sapiens
ttgccctgaagaacgtcccaga

SEQ ID NO: 7528486 - DNA, 22 bp, Homo sapiens
ttgccctgaagaacgtcccaga

SEQ ID NO: 7528487 - DNA, 17 bp, Homo sapiens
ttgccctgatttttaac

SEQ ID NO: 7528488 - DNA, 16 bp, Homo sapiens
ttgccctgaggggagg

SEQ ID NO: 7528489 - DNA, 22 bp, Homo sapiens
ttgccctgaagaacgtcccaga

SEQ ID NO: 7528490 - DNA, 22 bp, Homo sapiens
ttgccctgtggggcctccagcc

SEQ ID NO: 7528491 - DNA, 22 bp, Homo sapiens
ttgccctgtggggcctccagcc

SEQ ID NO: 7528492 - DNA, 22 bp, Homo sapiens
ttgccctgtctcactatgttaa

SEQ ID NO: 7528493 - DNA, 22 bp, Homo sapiens
ttgccctgtcttaagctggcaa

SEQ ID NO: 7528494 - DNA, 22 bp, Homo sapiens
ttgccctgtcttaagctggcaa

SEQ ID NO: 7528495 - DNA, 22 bp, Homo sapiens
ttgccctgtcagtagaagtgca

SEQ ID NO: 7528496 - DNA, 22 bp, Homo sapiens
ttgccctgtcagtagaagtgca

SEQ ID NO: 7528497 - DNA, 22 bp, Homo sapiens
ttgccctgcgggtcctgcgcaa

SEQ ID NO: 7528498 - DNA, 22 bp, Homo sapiens
ttgccctgcgttaccatctctt

SEQ ID NO: 7528499 - DNA, 22 bp, Homo sapiens
ttgccctgcgggtcctgcgcaa

SEQ ID NO: 7528500 - DNA, 22 bp, Homo sapiens
ttgccctgcgggtcctgcgcaa

SEQ ID NO: 7528501 - DNA, 22 bp, Homo sapiens
ttgccctggggctggcctggca

SEQ ID NO: 7528502 - DNA, 22 bp, Homo sapiens
ttgccctgcgttaccatctctt

SEQ ID NO: 7528503 - DNA, 22 bp, Homo sapiens
ttgccctgcgttaccatctctt

SEQ ID NO: 7528504 - DNA, 22 bp, Homo sapiens
ttgccctggggctggcctggca

SEQ ID NO: 7528505 - DNA, 22 bp, Homo sapiens
ttgccctggggctggcctggca

SEQ ID NO: 7528506 - DNA, 22 bp, Homo sapiens
ttgcatcagcaggcataattgg

SEQ ID NO: 7528507 - DNA, 22 bp, Homo sapiens
ttgcatcagaattacttggagg

SEQ ID NO: 7528508 - DNA, 22 bp, Homo sapiens
ttgcatcagcaggcataattgg

SEQ ID NO: 7528509 - DNA, 22 bp, Homo sapiens
ttgcatcaggtagacaactata

SEQ ID NO: 7528510 - DNA, 22 bp, Homo sapiens
ttgcatcaggtagacaactata

SEQ ID NO: 7528511 - DNA, 22 bp, Homo sapiens
ttgcatcaggtagacaactata

SEQ ID NO: 7528512 - DNA, 22 bp, Homo sapiens
ttgcatcacagtatctctgtaa

SEQ ID NO: 7528513 - DNA, 22 bp, Homo sapiens
ttgcatcagaaaatatgggaag

SEQ ID NO: 7528514 - DNA, 22 bp, Homo sapiens
ttgcatcaattccttgtcctga

SEQ ID NO: 7528515 - DNA, 22 bp, Homo sapiens
ttgcatcaaatatgtaccacag

SEQ ID NO: 7528516 - DNA, 22 bp, Homo sapiens
ttgcatatgaagctgacttaaa

SEQ ID NO: 7528517 - DNA, 22 bp, Homo sapiens
ttgcatatgaagctgacttaaa

SEQ ID NO: 7528518 - DNA, 22 bp, Homo sapiens
ttgcatatcctccaacacatgg

SEQ ID NO: 7528519 - DNA, 22 bp, Homo sapiens
ttgcatatcctccaacacatgg

SEQ ID NO: 7528520 - DNA, 22 bp, Homo sapiens
ttgcatatgaagctgacttaaa

SEQ ID NO: 7528521 - DNA, 22 bp, Homo sapiens
ttgcatatcctccaacacatgg

SEQ ID NO: 7528522 - DNA, 22 bp, Homo sapiens
ttgcatatatttctaaggaggt

SEQ ID NO: 7528523 - DNA, 22 bp, Homo sapiens
ttgcatatatttctaaggaggt

SEQ ID NO: 7528524 - DNA, 22 bp, Homo sapiens
ttgcatatatttctaaggaggt

SEQ ID NO: 7528525 - DNA, 22 bp, Homo sapiens
ttgcatatcctccaacacatgg

SEQ ID NO: 7528526 - DNA, 22 bp, Homo sapiens
ttgcatgcatgtttctcattct

SEQ ID NO: 7528527 - DNA, 22 bp, Homo sapiens
ttgcatgctagaaagattgatt

SEQ ID NO: 7528528 - DNA, 22 bp, Homo sapiens
ttgcatgcaaggcctccgtggc

SEQ ID NO: 7528529 - DNA, 22 bp, Homo sapiens
ttgcatcatttcctggccgtgt

SEQ ID NO: 7528530 - DNA, 22 bp, Homo sapiens
ttgcatcagtcctcaataaaat

SEQ ID NO: 7528531 - DNA, 22 bp, Homo sapiens
ttgcatccgaaacaatttctct

SEQ ID NO: 7528532 - DNA, 23 bp, Homo sapiens
ttgcatcctgacgtctattttct

SEQ ID NO: 7528533 - DNA, 22 bp, Homo sapiens
ttgcatccaagaaggttcttaa

SEQ ID NO: 7528534 - DNA, 22 bp, Homo sapiens
ttgcatccaagaaggttcttaa

SEQ ID NO: 7528535 - DNA, 22 bp, Homo sapiens
ttgcccaggctggagtgcagtg

SEQ ID NO: 7528536 - DNA, 22 bp, Homo sapiens
ttgcccaggctggagtgcagta

SEQ ID NO: 7528537 - DNA, 22 bp, Homo sapiens
ttgcccaggctggagtgcagta

SEQ ID NO: 7528538 - DNA, 22 bp, Homo sapiens
ttgcccaggctggagtgcagta

SEQ ID NO: 7528539 - DNA, 22 bp, Homo sapiens
ttgcccagagtccacagcgtac

SEQ ID NO: 7528540 - DNA, 22 bp, Homo sapiens
ttgcccagagtccacagcgtac

SEQ ID NO: 7528541 - DNA, 22 bp, Homo sapiens
ttgcccagagtccacagcgtac

SEQ ID NO: 7528542 - DNA, 22 bp, Homo sapiens
ttgcccagagtcacccagctca

SEQ ID NO: 7528543 - DNA, 22 bp, Homo sapiens
ttgcagtttgcttttaatggga

SEQ ID NO: 7528544 - DNA, 22 bp, Homo sapiens
ttgcagtttgcttttaatggga

SEQ ID NO: 7528545 - DNA, 22 bp, Homo sapiens
ttgcagtttctggatgccttct

SEQ ID NO: 7528546 - DNA, 22 bp, Homo sapiens
ttgcagtttctggatgccttct

SEQ ID NO: 7528547 - DNA, 22 bp, Homo sapiens
ttgcagtttgtggcaactttga

SEQ ID NO: 7528548 - DNA, 22 bp, Homo sapiens
ttgcagtttctggatgccttct

SEQ ID NO: 7528549 - DNA, 22 bp, Homo sapiens
ttgcagtttgtggcaactttga

SEQ ID NO: 7528550 - DNA, 22 bp, Homo sapiens
ttgcagttttctgcctcatttc

SEQ ID NO: 7528551 - DNA, 22 bp, Homo sapiens
ttgcagtttgtggcaactttga

SEQ ID NO: 7528552 - DNA, 22 bp, Homo sapiens
ttgcagttttctgcctcatttc

SEQ ID NO: 7528553 - DNA, 22 bp, Homo sapiens
ttgcataaagattttattgcat

SEQ ID NO: 7528554 - DNA, 22 bp, Homo sapiens
ttgcataaaagagtatatctta

SEQ ID NO: 7528555 - DNA, 22 bp, Homo sapiens
ttgcataaaagagtatatctta

SEQ ID NO: 7528556 - DNA, 22 bp, Homo sapiens
ttgcagttttgacagaccaaat

SEQ ID NO: 7528557 - DNA, 22 bp, Homo sapiens
ttgcagttttctgcctcatttc

SEQ ID NO: 7528558 - DNA, 22 bp, Homo sapiens
ttgcatactgacctctaagctt

SEQ ID NO: 7528559 - DNA, 22 bp, Homo sapiens
ttgcatagaatatcatattttc

SEQ ID NO: 7528560 - DNA, 22 bp, Homo sapiens
ttgcataacagccattaaagta

SEQ ID NO: 7528561 - DNA, 22 bp, Homo sapiens
ttgcatagtgctgaggttcggg

SEQ ID NO: 7528562 - DNA, 22 bp, Homo sapiens
ttgcataaatgcttaaaatttg

SEQ ID NO: 7528563 - DNA, 22 bp, Homo sapiens
ttgcataacagccattaaagta

SEQ ID NO: 7528564 - DNA, 22 bp, Homo sapiens
ttgcataaatgcttaaaatttg

SEQ ID NO: 7528565 - DNA, 22 bp, Homo sapiens
ttgcataaaagagtatatctta

SEQ ID NO: 7528566 - DNA, 22 bp, Homo sapiens
ttgcagttgctttctatattga

SEQ ID NO: 7528567 - DNA, 22 bp, Homo sapiens
ttgcagttgctttctatattga

SEQ ID NO: 7528568 - DNA, 19 bp, Homo sapiens
ttgcagttgggtggggagt

SEQ ID NO: 7528569 - DNA, 22 bp, Homo sapiens
ttgcagttgctttctatattga

SEQ ID NO: 7528570 - DNA, 19 bp, Homo sapiens
ttgcagttgggtggggagt

SEQ ID NO: 7528571 - DNA, 22 bp, Homo sapiens
ttgcagttgtctttcctaattt

SEQ ID NO: 7528572 - DNA, 22 bp, Homo sapiens
ttgcagtttatgttcctgcagt

SEQ ID NO: 7528573 - DNA, 22 bp, Homo sapiens
ttgcagtttctggatgccttct

SEQ ID NO: 7528574 - DNA, 22 bp, Homo sapiens
ttgcagttgtttagaatatgtg

SEQ ID NO: 7528575 - DNA, 22 bp, Homo sapiens
ttgcagttgtttagaatatgtg

SEQ ID NO: 7528576 - DNA, 22 bp, Homo sapiens
ttgcagttgttgccttccctga

SEQ ID NO: 7528577 - DNA, 22 bp, Homo sapiens
ttgcagttgtttagaatatgtg

SEQ ID NO: 7528578 - DNA, 22 bp, Homo sapiens
ttgcagttgttgccttccctga

SEQ ID NO: 7528579 - DNA, 22 bp, Homo sapiens
ttgcagttgtctttcctaattt

SEQ ID NO: 7528580 - DNA, 22 bp, Homo sapiens
ttgcagttgtctttcctaattt

SEQ ID NO: 7528581 - DNA, 22 bp, Homo sapiens
ttgcactttgaaataacagtgg

SEQ ID NO: 7528582 - DNA, 22 bp, Homo sapiens
ttgcactttgaaataacagtgg

SEQ ID NO: 7528583 - DNA, 22 bp, Homo sapiens
ttgcagaacttaaagacagagt

SEQ ID NO: 7528584 - DNA, 22 bp, Homo sapiens
ttgcactttgaaataacagtgg

SEQ ID NO: 7528585 - DNA, 22 bp, Homo sapiens
ctcaggagtagttcagcagctg

SEQ ID NO: 7528586 - DNA, 22 bp, Homo sapiens
ctcaggagtagttcagcagctg

SEQ ID NO: 7528587 - DNA, 22 bp, Homo sapiens
ctcaggaggtggtagaggccct

SEQ ID NO: 7528588 - DNA, 22 bp, Homo sapiens
ctcaggaggtggtagaggccct

SEQ ID NO: 7528589 - DNA, 22 bp, Homo sapiens
ctcaggaggtggtagaggccct

SEQ ID NO: 7528590 - DNA, 22 bp, Homo sapiens
ctcaggaggtggtagaggccct

SEQ ID NO: 7528591 - DNA, 22 bp, Homo sapiens
ctcaggaggtggtagaggccct

SEQ ID NO: 7528592 - DNA, 22 bp, Homo sapiens
ctcaggaggtggtagaggccct

SEQ ID NO: 7528593 - DNA, 22 bp, Homo sapiens
ctcaggaggtggtagaggccct

SEQ ID NO: 7528594 - DNA, 22 bp, Homo sapiens
ctcaggaggtggtagaggccct

SEQ ID NO: 7528595 - DNA, 22 bp, Homo sapiens
ctcaggagtagttcagcagctg

SEQ ID NO: 7528596 - DNA, 22 bp, Homo sapiens
ctcaggaggtttcctgtctagg

SEQ ID NO: 7528597 - DNA, 22 bp, Homo sapiens
ctcaggagtagttcagcagctg

SEQ ID NO: 7528598 - DNA, 22 bp, Homo sapiens
ctcaggagtagttcagcagctg

SEQ ID NO: 7528599 - DNA, 22 bp, Homo sapiens
ctcaggagtagttcagcagctg

SEQ ID NO: 7528600 - DNA, 22 bp, Homo sapiens
ctcaggagtagttcagcagctg

SEQ ID NO: 7528601 - DNA, 22 bp, Homo sapiens
ctcaggaggtttcctgtctagg

SEQ ID NO: 7528602 - DNA, 22 bp, Homo sapiens
ctcaggaggtttcctgtctagg

SEQ ID NO: 7528603 - DNA, 22 bp, Homo sapiens
ctcaggaggtttcctgtctagg

SEQ ID NO: 7528604 - DNA, 22 bp, Homo sapiens
ctcaggaggtttcctgtctagg

SEQ ID NO: 7528605 - DNA, 22 bp, Homo sapiens
ctcaggaggtttcctgtctagg

SEQ ID NO: 7528606 - DNA, 22 bp, Homo sapiens
ctcaggaggatgactgccttgg

SEQ ID NO: 7528607 - DNA, 22 bp, Homo sapiens
ctcaggaggatgactgccttgg

SEQ ID NO: 7528608 - DNA, 22 bp, Homo sapiens
ctcaggaggatgactgccttgg

SEQ ID NO: 7528609 - DNA, 22 bp, Homo sapiens
ctcaggaggatgactgccttgg

SEQ ID NO: 7528610 - DNA, 22 bp, Homo sapiens
ctcaggaggccattctcaaggt

SEQ ID NO: 7528611 - DNA, 22 bp, Homo sapiens
ctcaggaggccattctcaaggt

SEQ ID NO: 7528612 - DNA, 22 bp, Homo sapiens
ctcaggaggccattctcaaggt

SEQ ID NO: 7528613 - DNA, 22 bp, Homo sapiens
ctcaggaggatgactgccttgg

SEQ ID NO: 7528614 - DNA, 22 bp, Homo sapiens
ctcaggaggaggaagttcattg

SEQ ID NO: 7528615 - DNA, 22 bp, Homo sapiens
ctcaggaggaggaagttcattg

SEQ ID NO: 7528616 - DNA, 22 bp, Homo sapiens
ctcaggagcttcctcagcccat

SEQ ID NO: 7528617 - DNA, 22 bp, Homo sapiens
ctcaggaggaggaagttcattg

SEQ ID NO: 7528618 - DNA, 22 bp, Homo sapiens
ctcaggagatgacagaaggtat

SEQ ID NO: 7528619 - DNA, 22 bp, Homo sapiens
ctcaggagatgacagaaggtat

SEQ ID NO: 7528620 - DNA, 22 bp, Homo sapiens
ctcaggagcttcctcagcccat

SEQ ID NO: 7528621 - DNA, 22 bp, Homo sapiens
ctcaggagcttcctcagcccat

SEQ ID NO: 7528622 - DNA, 22 bp, Homo sapiens
ctcaggagcttcctcagcccat

SEQ ID NO: 7528623 - DNA, 19 bp, Homo sapiens
ctcagctgtagctcatgtg

SEQ ID NO: 7528624 - DNA, 19 bp, Homo sapiens
ctcagctgtagctcatgtg

SEQ ID NO: 7528625 - DNA, 19 bp, Homo sapiens
ctcagctgtagctcatgtg

SEQ ID NO: 7528626 - DNA, 19 bp, Homo sapiens
ctcagctgtagctcatgtg

SEQ ID NO: 7528627 - DNA, 19 bp, Homo sapiens
ctcagctgtagctcatgtg

SEQ ID NO: 7528628 - DNA, 22 bp, Homo sapiens
ctcagctggcaattctggctcc

SEQ ID NO: 7528629 - DNA, 22 bp, Homo sapiens
ctcagccccaatttgccctctt

SEQ ID NO: 7528630 - DNA, 22 bp, Homo sapiens
ctcagccccaatttgccctctt

SEQ ID NO: 7528631 - DNA, 23 bp, Homo sapiens
ctcagaggcctgtccagggtggt

SEQ ID NO: 7528632 - DNA, 23 bp, Homo sapiens
ctcagaggcctgtccagggtggt

SEQ ID NO: 7528633 - DNA, 23 bp, Homo sapiens
ctcagaggcctgtccagggtggt

SEQ ID NO: 7528634 - DNA, 23 bp, Homo sapiens
ctcagaggcctgtccagggtggt

SEQ ID NO: 7528635 - DNA, 22 bp, Homo sapiens
ctcagaggcaagcaaggagctg

SEQ ID NO: 7528636 - DNA, 22 bp, Homo sapiens
ctcagaggcaagcaaggagctg

SEQ ID NO: 7528637 - DNA, 22 bp, Homo sapiens
ctcagaggcaagcaaggagctg

SEQ ID NO: 7528638 - DNA, 22 bp, Homo sapiens
ctcagccccaatttgccctctt

SEQ ID NO: 7528639 - DNA, 22 bp, Homo sapiens
ctcagccccaatttgccctctt

SEQ ID NO: 7528640 - DNA, 22 bp, Homo sapiens
ctcagccccaatttgccctctt

SEQ ID NO: 7528641 - DNA, 23 bp, Homo sapiens
ctcagaggcctgtccagggtggt

SEQ ID NO: 7528642 - DNA, 23 bp, Homo sapiens
ctcagaggcctgtccagggtggt

SEQ ID NO: 7528643 - DNA, 23 bp, Homo sapiens
ctcagaggcctgtccagggtggt

SEQ ID NO: 7528644 - DNA, 22 bp, Homo sapiens
ctcaggaaaggccatgcaaggg

SEQ ID NO: 7528645 - DNA, 22 bp, Homo sapiens
ctcaggaaaatattgaagaagt

SEQ ID NO: 7528646 - DNA, 22 bp, Homo sapiens
ctcaggaaaatattgaagaagt

SEQ ID NO: 7528647 - DNA, 22 bp, Homo sapiens
ctcaggaaaggccatgcaaggg

SEQ ID NO: 7528648 - DNA, 22 bp, Homo sapiens
ctcaggaaaggccatgcaaggg

SEQ ID NO: 7528649 - DNA, 22 bp, Homo sapiens
ctcaggaaaggccatgcaaggg

SEQ ID NO: 7528650 - DNA, 22 bp, Homo sapiens
ctcaggaaaggccatgcaaggg

SEQ ID NO: 7528651 - DNA, 22 bp, Homo sapiens
ctcaggaaccgcggcagcagcc

SEQ ID NO: 7528652 - DNA, 19 bp, Homo sapiens
ctcagctgtagctcatgtg

SEQ ID NO: 7528653 - DNA, 22 bp, Homo sapiens
ctcagctgtctcatgggtctgt

SEQ ID NO: 7528654 - DNA, 22 bp, Homo sapiens
ctcagcttcatttgttccatga

SEQ ID NO: 7528655 - DNA, 22 bp, Homo sapiens
ctcagcttcatttgttccatga

SEQ ID NO: 7528656 - DNA, 22 bp, Homo sapiens
ctcagcttctacctcctgagtg

SEQ ID NO: 7528657 - DNA, 22 bp, Homo sapiens
ctcagcttctacctcctgagtg

SEQ ID NO: 7528658 - DNA, 22 bp, Homo sapiens
ctcagcttttcccggataggtg

SEQ ID NO: 7528659 - DNA, 22 bp, Homo sapiens
ctcaggaaaatattgaagaagt

SEQ ID NO: 7528660 - DNA, 22 bp, Homo sapiens
ctcaggacttggttagtgtttt

SEQ ID NO: 7528661 - DNA, 22 bp, Homo sapiens
ctcaggacccggtccaggtggg

SEQ ID NO: 7528662 - DNA, 22 bp, Homo sapiens
ctcaggacggccgggggagcct

SEQ ID NO: 7528663 - DNA, 22 bp, Homo sapiens
ctcaggacccaccttattagga

SEQ ID NO: 7528664 - DNA, 22 bp, Homo sapiens
ctcaggacagattccagagaaa

SEQ ID NO: 7528665 - DNA, 22 bp, Homo sapiens
ctcaggacccggtccaggtggg

SEQ ID NO: 7528666 - DNA, 22 bp, Homo sapiens
ctcaggaaccgcggcagcagcc

SEQ ID NO: 7528667 - DNA, 22 bp, Homo sapiens
ctcaggaaccgcggcagcagcc

SEQ ID NO: 7528668 - DNA, 22 bp, Homo sapiens
ctcaggaaccgcggcagcagcc

SEQ ID NO: 7528669 - DNA, 22 bp, Homo sapiens
ctcaggaaccgcggcagcagcc

SEQ ID NO: 7528670 - DNA, 22 bp, Homo sapiens
ctcaggaaggaagcagggagcc

SEQ ID NO: 7528671 - DNA, 22 bp, Homo sapiens
ctcaggaaggaagcagggagcc

SEQ ID NO: 7528672 - DNA, 22 bp, Homo sapiens
ctcaggaaggaagcagggagcc

SEQ ID NO: 7528673 - DNA, 22 bp, Homo sapiens
ctcaggaaggaagcagggagcc

SEQ ID NO: 7528674 - DNA, 22 bp, Homo sapiens
ctcaggagacagtgtccacatg

SEQ ID NO: 7528675 - DNA, 22 bp, Homo sapiens
ctcaggagacagtgtccacatg

SEQ ID NO: 7528676 - DNA, 22 bp, Homo sapiens
ctcaggactttcaaatagaaat

SEQ ID NO: 7528677 - DNA, 22 bp, Homo sapiens
ctcaggagacagtgtccacatg

SEQ ID NO: 7528678 - DNA, 22 bp, Homo sapiens
ctcaggagacagtgtccacatg

SEQ ID NO: 7528679 - DNA, 22 bp, Homo sapiens
ctcaggagacagtgtccacatg

SEQ ID NO: 7528680 - DNA, 22 bp, Homo sapiens
ctcaggagagtcttatatctcc

SEQ ID NO: 7528681 - DNA, 22 bp, Homo sapiens
ctcaggagacagtgtccacatg

SEQ ID NO: 7528682 - DNA, 22 bp, Homo sapiens
ctcaggagacagtgtccacatg

SEQ ID NO: 7528683 - DNA, 22 bp, Homo sapiens
ctcaggagagtcttatatctcc

SEQ ID NO: 7528684 - DNA, 22 bp, Homo sapiens
ctcaggagatgacagaaggtat

SEQ ID NO: 7528685 - DNA, 22 bp, Homo sapiens
ctcaggagatgacagaaggtat

SEQ ID NO: 7528686 - DNA, 22 bp, Homo sapiens
ctcaggagatgacagaaggtat

SEQ ID NO: 7528687 - DNA, 22 bp, Homo sapiens
ctcaggagatgacagaaggtat

SEQ ID NO: 7528688 - DNA, 22 bp, Homo sapiens
ctcaggagatgacagaaggtat

SEQ ID NO: 7528689 - DNA, 22 bp, Homo sapiens
ctcaggagatgacagaaggtat

SEQ ID NO: 7528690 - DNA, 22 bp, Homo sapiens
ctcaggagatgacagaaggtat

SEQ ID NO: 7528691 - DNA, 22 bp, Homo sapiens
ctcaggagatgacagaaggtat

SEQ ID NO: 7528692 - DNA, 20 bp, Homo sapiens
tttattcagcctaccctctt

SEQ ID NO: 7528693 - DNA, 20 bp, Homo sapiens
tttattcagcctaccctctt

SEQ ID NO: 7528694 - DNA, 20 bp, Homo sapiens
tttattcagcctaccctctt

SEQ ID NO: 7528695 - DNA, 20 bp, Homo sapiens
tttattcagcctaccctctt

SEQ ID NO: 7528696 - DNA, 22 bp, Homo sapiens
tttattcagcagcagcagtggt

SEQ ID NO: 7528697 - DNA, 22 bp, Homo sapiens
tttattcagcagcagcagtggt

SEQ ID NO: 7528698 - DNA, 22 bp, Homo sapiens
tttattcagcagcagcagtggt

SEQ ID NO: 7528699 - DNA, 22 bp, Homo sapiens
tttattcagcagcagcagtggt

SEQ ID NO: 7528700 - DNA, 22 bp, Homo sapiens
tttattcatcatctgttcatat

SEQ ID NO: 7528701 - DNA, 22 bp, Homo sapiens
tttattcatcatctgttcatat

SEQ ID NO: 7528702 - DNA, 22 bp, Homo sapiens
tttattcatcatctgttcatat

SEQ ID NO: 7528703 - DNA, 22 bp, Homo sapiens
tttattcatcatctgttcatat

SEQ ID NO: 7528704 - DNA, 22 bp, Homo sapiens
tttattcatcatctgttcatat

SEQ ID NO: 7528705 - DNA, 22 bp, Homo sapiens
tttattcatcatctgttcatat

SEQ ID NO: 7528706 - DNA, 22 bp, Homo sapiens
tttattcatcatctgttcatat

SEQ ID NO: 7528707 - DNA, 22 bp, Homo sapiens
tttattcatcatctgttcatat

SEQ ID NO: 7528708 - DNA, 22 bp, Homo sapiens
tttattcatcatctgttcatat

SEQ ID NO: 7528709 - DNA, 22 bp, Homo sapiens
tttattcatcatctgttcatat

SEQ ID NO: 7528710 - DNA, 22 bp, Homo sapiens
tttattcatcatctgttcatat

SEQ ID NO: 7528711 - DNA, 22 bp, Homo sapiens
tttattcattgtttcgtcgcag

SEQ ID NO: 7528712 - DNA, 22 bp, Homo sapiens
tttattcattgtttcgtcgcag

SEQ ID NO: 7528713 - DNA, 22 bp, Homo sapiens
tttattccaaagcttgcacttt

SEQ ID NO: 7528714 - DNA, 22 bp, Homo sapiens
tttattccaaagcttgcacttt

SEQ ID NO: 7528715 - DNA, 22 bp, Homo sapiens
tttattccaaagcttgcacttt

SEQ ID NO: 7528716 - DNA, 22 bp, Homo sapiens
tttattcattgtttcgtcgcag

SEQ ID NO: 7528717 - DNA, 22 bp, Homo sapiens
tttattcattgtttcgtcgcag

SEQ ID NO: 7528718 - DNA, 22 bp, Homo sapiens
tttattcattgtttcgtcgcag

SEQ ID NO: 7528719 - DNA, 22 bp, Homo sapiens
tttcacatataggggaagctac

SEQ ID NO: 7528720 - DNA, 22 bp, Homo sapiens
tttcacatatcaactctatcct

SEQ ID NO: 7528721 - DNA, 22 bp, Homo sapiens
tttcacatatcaactctatcct

SEQ ID NO: 7528722 - DNA, 22 bp, Homo sapiens
tttattccaaagcttgcacttt

SEQ ID NO: 7528723 - DNA, 22 bp, Homo sapiens
tttattccagtgtttctcaaat

SEQ ID NO: 7528724 - DNA, 22 bp, Homo sapiens
tttcacatataggggaagctac

SEQ ID NO: 7528725 - DNA, 22 bp, Homo sapiens
tttcacatataggggaagctac

SEQ ID NO: 7528726 - DNA, 22 bp, Homo sapiens
tttcagaaccgctaaaataaat

SEQ ID NO: 7528727 - DNA, 22 bp, Homo sapiens
tttcagaaccgctaaaataaat

SEQ ID NO: 7528728 - DNA, 22 bp, Homo sapiens
tttcagaaccgctaaaataaat

SEQ ID NO: 7528729 - DNA, 22 bp, Homo sapiens
tttcagaaccaagagagacatc

SEQ ID NO: 7528730 - DNA, 22 bp, Homo sapiens
tttcagaaccaagagagacatc

SEQ ID NO: 7528731 - DNA, 22 bp, Homo sapiens
tttcagaaccgctaaaataaat

SEQ ID NO: 7528732 - DNA, 22 bp, Homo sapiens
tttcagaaccgctaaaataaat

SEQ ID NO: 7528733 - DNA, 22 bp, Homo sapiens
tttcagaaccgctaaaataaat

SEQ ID NO: 7528734 - DNA, 22 bp, Homo sapiens
tttcagaaccgctaaaataaat

SEQ ID NO: 7528735 - DNA, 22 bp, Homo sapiens
tttcagaaccgctaaaataaat

SEQ ID NO: 7528736 - DNA, 22 bp, Homo sapiens
tttcagaaccgctaaaataaat

SEQ ID NO: 7528737 - DNA, 22 bp, Homo sapiens
tttcagaaggggagaaaggtca

SEQ ID NO: 7528738 - DNA, 22 bp, Homo sapiens
tttcagaagtcaactaggtaaa

SEQ ID NO: 7528739 - DNA, 22 bp, Homo sapiens
tttcagaagtcaactaggtaaa

SEQ ID NO: 7528740 - DNA, 22 bp, Homo sapiens
tttcagaagtcaactaggtaaa

SEQ ID NO: 7528741 - DNA, 22 bp, Homo sapiens
tttcagaagtcaactaggtaaa

SEQ ID NO: 7528742 - DNA, 22 bp, Homo sapiens
tttcagaaggggagaaaggtca

SEQ ID NO: 7528743 - DNA, 22 bp, Homo sapiens
tttcagaaggggagaaaggtca

SEQ ID NO: 7528744 - DNA, 22 bp, Homo sapiens
tttcagaaggggagaaaggtca

SEQ ID NO: 7528745 - DNA, 22 bp, Homo sapiens
tttcagaaccgctaaaataaat

SEQ ID NO: 7528746 - DNA, 22 bp, Homo sapiens
tttcagaaccgctaaaataaat

SEQ ID NO: 7528747 - DNA, 22 bp, Homo sapiens
tttcagaaattatattagatgc

SEQ ID NO: 7528748 - DNA, 22 bp, Homo sapiens
tttcagaaattatattagatgc

SEQ ID NO: 7528749 - DNA, 22 bp, Homo sapiens
tttcagaaattatattagatgc

SEQ ID NO: 7528750 - DNA, 22 bp, Homo sapiens
tttcagaaattatattagatgc

SEQ ID NO: 7528751 - DNA, 22 bp, Homo sapiens
tttcagaaattatattagatgc

SEQ ID NO: 7528752 - DNA, 22 bp, Homo sapiens
tttcagaaattatattagatgc

SEQ ID NO: 7528753 - DNA, 22 bp, Homo sapiens
tttcagaaattatattagatgc

SEQ ID NO: 7528754 - DNA, 22 bp, Homo sapiens
tttcagaaattatattagatgc

SEQ ID NO: 7528755 - DNA, 22 bp, Homo sapiens
tttcagaaattatattagatgc

SEQ ID NO: 7528756 - DNA, 22 bp, Homo sapiens
tttcagaaccaagagagacatc

SEQ ID NO: 7528757 - DNA, 22 bp, Homo sapiens
tttcagaaccaagagagacatc

SEQ ID NO: 7528758 - DNA, 22 bp, Homo sapiens
tttcagaaccaagagagacatc

SEQ ID NO: 7528759 - DNA, 22 bp, Homo sapiens
tttcagaaccaagagagacatc

SEQ ID NO: 7528760 - DNA, 22 bp, Homo sapiens
tttcagaaccaagagagacatc

SEQ ID NO: 7528761 - DNA, 22 bp, Homo sapiens
tttcagaacagggattgggcct

SEQ ID NO: 7528762 - DNA, 22 bp, Homo sapiens
tttcagaacagggattgggcct

SEQ ID NO: 7528763 - DNA, 22 bp, Homo sapiens
tttcagaacataatgtgagcat

SEQ ID NO: 7528764 - DNA, 22 bp, Homo sapiens
tttcagaacataatgtgagcat

SEQ ID NO: 7528765 - DNA, 22 bp, Homo sapiens
tttcagaaattgttattattct

SEQ ID NO: 7528766 - DNA, 22 bp, Homo sapiens
tttcagaaattgttattattct

SEQ ID NO: 7528767 - DNA, 22 bp, Homo sapiens
tttcagaaattgttattattct

SEQ ID NO: 7528768 - DNA, 22 bp, Homo sapiens
tttcagaaattgttattattct

SEQ ID NO: 7528769 - DNA, 22 bp, Homo sapiens
tttcagtttccagctttgtcat

SEQ ID NO: 7528770 - DNA, 22 bp, Homo sapiens
tttcagtttccagctttgtcat

SEQ ID NO: 7528771 - DNA, 22 bp, Homo sapiens
tttcagtttcatggcacagcta

SEQ ID NO: 7528772 - DNA, 22 bp, Homo sapiens
tttcagtttcatggcacagcta

SEQ ID NO: 7528773 - DNA, 22 bp, Homo sapiens
tttcagtttatgtcttgaatta

SEQ ID NO: 7528774 - DNA, 22 bp, Homo sapiens
tttcagtttatgtcttgaatta

SEQ ID NO: 7528775 - DNA, 22 bp, Homo sapiens
tttcagtttatgtcttgaatta

SEQ ID NO: 7528776 - DNA, 22 bp, Homo sapiens
tttcagtttagactaaaggtag

SEQ ID NO: 7528777 - DNA, 22 bp, Homo sapiens
tttcagtttagactaaaggtag

SEQ ID NO: 7528778 - DNA, 22 bp, Homo sapiens
ctccttcctggttagcacctta

SEQ ID NO: 7528779 - DNA, 22 bp, Homo sapiens
ctccttcctgcagatctgagat

SEQ ID NO: 7528780 - DNA, 22 bp, Homo sapiens
ctccttcctgcagatctgagat

SEQ ID NO: 7528781 - DNA, 22 bp, Homo sapiens
ctccttcctgcagatctgagat

SEQ ID NO: 7528782 - DNA, 22 bp, Homo sapiens
ctccttcctgcagatctgagat

SEQ ID NO: 7528783 - DNA, 22 bp, Homo sapiens
ctccttcctgcagatctgagat

SEQ ID NO: 7528784 - DNA, 22 bp, Homo sapiens
ctccttcctgcagatctgagat

SEQ ID NO: 7528785 - DNA, 22 bp, Homo sapiens
ctccttcctgcagatctgagat

SEQ ID NO: 7528786 - DNA, 22 bp, Homo sapiens
ctccttcctggttagcacctta

SEQ ID NO: 7528787 - DNA, 22 bp, Homo sapiens
ctccttcctggttagcacctta

SEQ ID NO: 7528788 - DNA, 22 bp, Homo sapiens
ctccttcctgccccagtgataa

SEQ ID NO: 7528789 - DNA, 22 bp, Homo sapiens
ctccttcctgccccagtgataa

SEQ ID NO: 7528790 - DNA, 22 bp, Homo sapiens
ctccttcctgccccagtgataa

SEQ ID NO: 7528791 - DNA, 22 bp, Homo sapiens
ctccttcctgccccagtgataa

SEQ ID NO: 7528792 - DNA, 22 bp, Homo sapiens
ctccttcccatgagtgtgggca

SEQ ID NO: 7528793 - DNA, 22 bp, Homo sapiens
ctccttccaacaagagaaagag

SEQ ID NO: 7528794 - DNA, 22 bp, Homo sapiens
ctccttccaacaagagaaagag

SEQ ID NO: 7528795 - DNA, 22 bp, Homo sapiens
ctccttccaacaagagaaagag

SEQ ID NO: 7528796 - DNA, 22 bp, Homo sapiens
ctccttcccatgagtgtgggca

SEQ ID NO: 7528797 - DNA, 22 bp, Homo sapiens
ctccttcccatgagtgtgggca

SEQ ID NO: 7528798 - DNA, 22 bp, Homo sapiens
ctccttcccatgagtgtgggca

SEQ ID NO: 7528799 - DNA, 22 bp, Homo sapiens
ctccttcccctactcagcatcc

SEQ ID NO: 7528800 - DNA, 22 bp, Homo sapiens
ctccttcccctactcagcatcc

SEQ ID NO: 7528801 - DNA, 22 bp, Homo sapiens
ctccttcccctactcagcatcc

SEQ ID NO: 7528802 - DNA, 22 bp, Homo sapiens
ctccttcccatgagtgtgggca

SEQ ID NO: 7528803 - DNA, 22 bp, Homo sapiens
ctccttcccctactcagcatcc

SEQ ID NO: 7528804 - DNA, 22 bp, Homo sapiens
ctccttcccctactcagcatcc

SEQ ID NO: 7528805 - DNA, 19 bp, Homo sapiens
ctccttccctggtttctgt

SEQ ID NO: 7528806 - DNA, 19 bp, Homo sapiens
ctccttccctggtttctgt

SEQ ID NO: 7528807 - DNA, 22 bp, Homo sapiens
ctccttccctaccatcaatgtt

SEQ ID NO: 7528808 - DNA, 22 bp, Homo sapiens
ctccttccctaccatcaatgtt

SEQ ID NO: 7528809 - DNA, 22 bp, Homo sapiens
ctccttccctaccatcaatgtt

SEQ ID NO: 7528810 - DNA, 22 bp, Homo sapiens
ctccttccctaccatcaatgtt

SEQ ID NO: 7528811 - DNA, 22 bp, Homo sapiens
ctccttcccctactcagcatcc

SEQ ID NO: 7528812 - DNA, 22 bp, Homo sapiens
ctccttcccttcaagtgttcct

SEQ ID NO: 7528813 - DNA, 22 bp, Homo sapiens
ctccttcccttcaagtgttcct

SEQ ID NO: 7528814 - DNA, 22 bp, Homo sapiens
ctccttcccttcaagtgttcct

SEQ ID NO: 7528815 - DNA, 22 bp, Homo sapiens
ctccttcccttcaagtgttcct

SEQ ID NO: 7528816 - DNA, 19 bp, Homo sapiens
ctccttccctggtttctgt

SEQ ID NO: 7528817 - DNA, 23 bp, Homo sapiens
tttcagaagtggtcctaggaagc

SEQ ID NO: 7528818 - DNA, 22 bp, Homo sapiens
tttcagaatagcaaagcaagct

SEQ ID NO: 7528819 - DNA, 22 bp, Homo sapiens
tttcagaatagcaaagcaagct

SEQ ID NO: 7528820 - DNA, 22 bp, Homo sapiens
tttcagaatagcaaagcaagct

SEQ ID NO: 7528821 - DNA, 22 bp, Homo sapiens
tttcagaatagcaaagcaagct

SEQ ID NO: 7528822 - DNA, 22 bp, Homo sapiens
tttcagaagtcaactaggtaaa

SEQ ID NO: 7528823 - DNA, 22 bp, Homo sapiens
tttcagaagtcacagttgactg

SEQ ID NO: 7528824 - DNA, 22 bp, Homo sapiens
tttcagaagtcacagttgactg

SEQ ID NO: 7528825 - DNA, 22 bp, Homo sapiens
tttcagaagtcacagttgactg

SEQ ID NO: 7528826 - DNA, 22 bp, Homo sapiens
tttcagaagtcacagttgactg

SEQ ID NO: 7528827 - DNA, 23 bp, Homo sapiens
tttcagaagtggtcctaggaagc

SEQ ID NO: 7528828 - DNA, 23 bp, Homo sapiens
tttcagaagtggtcctaggaagc

SEQ ID NO: 7528829 - DNA, 23 bp, Homo sapiens
tttcagaagtggtcctaggaagc

SEQ ID NO: 7528830 - DNA, 22 bp, Homo sapiens
tttcagaatagcaaagcaagct

SEQ ID NO: 7528831 - DNA, 22 bp, Homo sapiens
tttcagaatagcaaagcaagct

SEQ ID NO: 7528832 - DNA, 22 bp, Homo sapiens
tttcagaatagcaaagcaagct

SEQ ID NO: 7528833 - DNA, 22 bp, Homo sapiens
tttcagaatagcaaagcaagct

SEQ ID NO: 7528834 - DNA, 22 bp, Homo sapiens
ctcctgtggtcaagggtgggac

SEQ ID NO: 7528835 - DNA, 22 bp, Homo sapiens
tttcagaatatcgattcagtga

SEQ ID NO: 7528836 - DNA, 22 bp, Homo sapiens
tttcagaatatcgattcagtga

SEQ ID NO: 7528837 - DNA, 22 bp, Homo sapiens
tttcagaatatcgattcagtga

SEQ ID NO: 7528838 - DNA, 22 bp, Homo sapiens
tttcagaatatcgattcagtga

SEQ ID NO: 7528839 - DNA, 22 bp, Homo sapiens
tttcagaatatcgattcagtga

SEQ ID NO: 7528840 - DNA, 22 bp, Homo sapiens
tttcagaatatcgattcagtga

SEQ ID NO: 7528841 - DNA, 22 bp, Homo sapiens
tttcagaatatcgattcagtga

SEQ ID NO: 7528842 - DNA, 22 bp, Homo sapiens
ctccttaactttgaagtgggta

SEQ ID NO: 7528843 - DNA, 22 bp, Homo sapiens
ctccttcaaaagtcatagtaaa

SEQ ID NO: 7528844 - DNA, 22 bp, Homo sapiens
ctccttcaaaagtcatagtaaa

SEQ ID NO: 7528845 - DNA, 22 bp, Homo sapiens
ctccttcagctgaatccctgct

SEQ ID NO: 7528846 - DNA, 22 bp, Homo sapiens
ctccttcagctgaatccctgct

SEQ ID NO: 7528847 - DNA, 22 bp, Homo sapiens
ctccttcaaagtggaattaaga

SEQ ID NO: 7528848 - DNA, 22 bp, Homo sapiens
ctccttcaaagtggaattaaga

SEQ ID NO: 7528849 - DNA, 22 bp, Homo sapiens
ctccttcacgcaggctgccatg

SEQ ID NO: 7528850 - DNA, 22 bp, Homo sapiens
ctccttcacgcaggctgccatg

SEQ ID NO: 7528851 - DNA, 22 bp, Homo sapiens
ctccttcacgcaggctgccatg

SEQ ID NO: 7528852 - DNA, 22 bp, Homo sapiens
ctccttcatgtcatgtgtccgg

SEQ ID NO: 7528853 - DNA, 22 bp, Homo sapiens
ctccttcagtctgcgtggctgt

SEQ ID NO: 7528854 - DNA, 22 bp, Homo sapiens
ctccttcagtctgcgtggctgt

SEQ ID NO: 7528855 - DNA, 22 bp, Homo sapiens
ctccttcagtctgcgtggctgt

SEQ ID NO: 7528856 - DNA, 22 bp, Homo sapiens
ctccttccaacaagagaaagag

SEQ ID NO: 7528857 - DNA, 22 bp, Homo sapiens
ctccttccaacaagagaaagag

SEQ ID NO: 7528858 - DNA, 22 bp, Homo sapiens
ctccttcatgtcatgtgtccgg

SEQ ID NO: 7528859 - DNA, 22 bp, Homo sapiens
ctccttcatgtcatgtgtccgg

SEQ ID NO: 7528860 - DNA, 22 bp, Homo sapiens
ctccttcatgtcatgtgtccgg

SEQ ID NO: 7528861 - DNA, 22 bp, Homo sapiens
tttattcactcattcagccagt

SEQ ID NO: 7528862 - DNA, 22 bp, Homo sapiens
tttattcactcattcagccagt

SEQ ID NO: 7528863 - DNA, 22 bp, Homo sapiens
tttattcactcattcagccagt

SEQ ID NO: 7528864 - DNA, 22 bp, Homo sapiens
tttattcactcattcagccagt

SEQ ID NO: 7528865 - DNA, 19 bp, Homo sapiens
tttattcacctttaccttg

SEQ ID NO: 7528866 - DNA, 19 bp, Homo sapiens
tttattcacctttaccttg

SEQ ID NO: 7528867 - DNA, 19 bp, Homo sapiens
tttattcacctttaccttg

SEQ ID NO: 7528868 - DNA, 19 bp, Homo sapiens
tttattcacctttaccttg

SEQ ID NO: 7528869 - DNA, 22 bp, Homo sapiens
tttatgtaatttcataggtgtg

SEQ ID NO: 7528870 - DNA, 22 bp, Homo sapiens
tttatgtaagtggaatgatgcc

SEQ ID NO: 7528871 - DNA, 22 bp, Homo sapiens
tttatgtaagtggaatgatgcc

SEQ ID NO: 7528872 - DNA, 22 bp, Homo sapiens
tttatgtaagtggaatgatgcc

SEQ ID NO: 7528873 - DNA, 22 bp, Homo sapiens
tttatgtaagtggaatgatgcc

SEQ ID NO: 7528874 - DNA, 22 bp, Homo sapiens
tttatgtaagtggaatgatgcc

SEQ ID NO: 7528875 - DNA, 22 bp, Homo sapiens
tttattcacttcagtgccaaag

SEQ ID NO: 7528876 - DNA, 22 bp, Homo sapiens
tttattcacttcagtgccaaag

SEQ ID NO: 7528877 - DNA, 22 bp, Homo sapiens
tttattcacttcagtgccaaag

SEQ ID NO: 7528878 - DNA, 22 bp, Homo sapiens
tttattcactggggtctgcccg

SEQ ID NO: 7528879 - DNA, 22 bp, Homo sapiens
tttattcactggggtctgcccg

SEQ ID NO: 7528880 - DNA, 22 bp, Homo sapiens
tttattcactcattcagccagt

SEQ ID NO: 7528881 - DNA, 22 bp, Homo sapiens
tttattcactggggtctgcccg

SEQ ID NO: 7528882 - DNA, 22 bp, Homo sapiens
tttattcactggggtctgcccg

SEQ ID NO: 7528883 - DNA, 22 bp, Homo sapiens
tttattcactggggtctgcccg

SEQ ID NO: 7528884 - DNA, 22 bp, Homo sapiens
tttattcagcagcagcagtggt

SEQ ID NO: 7528885 - DNA, 22 bp, Homo sapiens
tttattcagcagcagcagtggt

SEQ ID NO: 7528886 - DNA, 22 bp, Homo sapiens
tttattcagcagcagcagtggt

SEQ ID NO: 7528887 - DNA, 22 bp, Homo sapiens
tttattcacttcagtgccaaag

SEQ ID NO: 7528888 - DNA, 22 bp, Homo sapiens
tttattcacttcagtgccaaag

SEQ ID NO: 7528889 - DNA, 22 bp, Homo sapiens
tttatgggcatccagggggtat

SEQ ID NO: 7528890 - DNA, 22 bp, Homo sapiens
tttatgtaagtggaatgatgcc

SEQ ID NO: 7528891 - DNA, 22 bp, Homo sapiens
tttatgtaagtggaatgatgcc

SEQ ID NO: 7528892 - DNA, 22 bp, Homo sapiens
tttatgctgaggcccaggaata

SEQ ID NO: 7528893 - DNA, 22 bp, Homo sapiens
tttatgctgaggcccaggaata

SEQ ID NO: 7528894 - DNA, 22 bp, Homo sapiens
tttatggcacacaaatatcaaa

SEQ ID NO: 7528895 - DNA, 22 bp, Homo sapiens
tttatgctactcaatagtcagt

SEQ ID NO: 7528896 - DNA, 22 bp, Homo sapiens
tttatgctactcaatagtcagt

SEQ ID NO: 7528897 - DNA, 22 bp, Homo sapiens
tttatgctactcaatagtcagt

SEQ ID NO: 7528898 - DNA, 22 bp, Homo sapiens
tttatgctatactgctgacatg

SEQ ID NO: 7528899 - DNA, 23 bp, Homo sapiens
tttatgctatactggaagggaaa

SEQ ID NO: 7528900 - DNA, 22 bp, Homo sapiens
tttatgctcatccaaggaaggt

SEQ ID NO: 7528901 - DNA, 22 bp, Homo sapiens
tttatgcatctctaggaagggc

SEQ ID NO: 7528902 - DNA, 22 bp, Homo sapiens
tttatgcatctctaggaagggc

SEQ ID NO: 7528903 - DNA, 22 bp, Homo sapiens
tttatgctactcaatagtcagt

SEQ ID NO: 7528904 - DNA, 22 bp, Homo sapiens
tttatgcctccagatcttgctt

SEQ ID NO: 7528905 - DNA, 21 bp, Homo sapiens
tttatgcatgcctctctgtca

SEQ ID NO: 7528906 - DNA, 22 bp, Homo sapiens
tttatgcagatttgtacagtga

SEQ ID NO: 7528907 - DNA, 22 bp, Homo sapiens
tttatgcagcctcagtatcaga

SEQ ID NO: 7528908 - DNA, 22 bp, Homo sapiens
tttatgcagcctcagtatcaga

SEQ ID NO: 7528909 - DNA, 22 bp, Homo sapiens
tttatgcagcctcagtatcaga

SEQ ID NO: 7528910 - DNA, 22 bp, Homo sapiens
tttatgcagcctcagtatcaga

SEQ ID NO: 7528911 - DNA, 22 bp, Homo sapiens
tttatgcagcctcagtatcaga

SEQ ID NO: 7528912 - DNA, 22 bp, Homo sapiens
tttatgcagcctcagtatcaga

SEQ ID NO: 7528913 - DNA, 22 bp, Homo sapiens
tttatgcagatttgtacagtga

SEQ ID NO: 7528914 - DNA, 21 bp, Homo sapiens
tttatgcagataatgctattt

SEQ ID NO: 7528915 - DNA, 21 bp, Homo sapiens
tttatgcagataatgctattt

SEQ ID NO: 7528916 - DNA, 22 bp, Homo sapiens
tttatgcagcactttacatttg

SEQ ID NO: 7528917 - DNA, 22 bp, Homo sapiens
tttatgcagatttgtacagtga

SEQ ID NO: 7528918 - DNA, 22 bp, Homo sapiens
tttatgcagatttgtacagtga

SEQ ID NO: 7528919 - DNA, 23 bp, Homo sapiens
tttatgcagcatgtagaacatgg

SEQ ID NO: 7528920 - DNA, 23 bp, Homo sapiens
tttatgcagcatgtagaacatgg

SEQ ID NO: 7528921 - DNA, 23 bp, Homo sapiens
tttatgcagcatgtagaacatgg

SEQ ID NO: 7528922 - DNA, 23 bp, Homo sapiens
tttatgcagcatgtagaacatgg

SEQ ID NO: 7528923 - DNA, 23 bp, Homo sapiens
tttatgcagcatgtagaacatgg

SEQ ID NO: 7528924 - DNA, 23 bp, Homo sapiens
tttatgcagcatgtagaacatgg

SEQ ID NO: 7528925 - DNA, 23 bp, Homo sapiens
tttatgcagcatgtagaacatgg

SEQ ID NO: 7528926 - DNA, 22 bp, Homo sapiens
tttatgcagcactttacatttg

SEQ ID NO: 7528927 - DNA, 22 bp, Homo sapiens
tttatgcagcactttacatttg

SEQ ID NO: 7528928 - DNA, 22 bp, Homo sapiens
tttatgattattttaaagcagc

SEQ ID NO: 7528929 - DNA, 22 bp, Homo sapiens
tttatgattattttaaagcagc

SEQ ID NO: 7528930 - DNA, 22 bp, Homo sapiens
tttatgattattttaaagcagc

SEQ ID NO: 7528931 - DNA, 21 bp, Homo sapiens
tttatgcagataatgctattt

SEQ ID NO: 7528932 - DNA, 22 bp, Homo sapiens
tttatgcacacttagacatggc

SEQ ID NO: 7528933 - DNA, 22 bp, Homo sapiens
tttatgcacaattagtcttata

SEQ ID NO: 7528934 - DNA, 22 bp, Homo sapiens
tttatgcacacttagacatggc

SEQ ID NO: 7528935 - DNA, 22 bp, Homo sapiens
tttatgcacacttagacatggc

SEQ ID NO: 7528936 - DNA, 22 bp, Homo sapiens
tttatgcacacttagacatggc

SEQ ID NO: 7528937 - DNA, 22 bp, Homo sapiens
tttatgcacacttagacatggc

SEQ ID NO: 7528938 - DNA, 22 bp, Homo sapiens
ctccaggcccctggccttctgc

SEQ ID NO: 7528939 - DNA, 22 bp, Homo sapiens
ctccaggcccctggccttctgc

SEQ ID NO: 7528940 - DNA, 22 bp, Homo sapiens
ctccaggcccctggccttctgc

SEQ ID NO: 7528941 - DNA, 22 bp, Homo sapiens
ctccaggcccctggccttctgc

SEQ ID NO: 7528942 - DNA, 22 bp, Homo sapiens
ctccaggcccctggccttctgc

SEQ ID NO: 7528943 - DNA, 23 bp, Homo sapiens
tttatattcctaatgtcttgagc

SEQ ID NO: 7528944 - DNA, 23 bp, Homo sapiens
tttatattcctaatgtcttgagc

SEQ ID NO: 7528945 - DNA, 22 bp, Homo sapiens
tttatattacctggaatagctt

SEQ ID NO: 7528946 - DNA, 22 bp, Homo sapiens
tttatgattattttaaagcagc

SEQ ID NO: 7528947 - DNA, 22 bp, Homo sapiens
tttatgattattttaaagcagc

SEQ ID NO: 7528948 - DNA, 23 bp, Homo sapiens
tttatattcctaatgtcttgagc

SEQ ID NO: 7528949 - DNA, 23 bp, Homo sapiens
tttatattcctaatgtcttgagc

SEQ ID NO: 7528950 - DNA, 23 bp, Homo sapiens
tttatattcctaatgtcttgagc

SEQ ID NO: 7528951 - DNA, 23 bp, Homo sapiens
tttatattcctaatgtcttgagc

SEQ ID NO: 7528952 - DNA, 23 bp, Homo sapiens
tttatattcctaatgtcttgagc

SEQ ID NO: 7528953 - DNA, 22 bp, Homo sapiens
tttatgattaatccaattctgt

SEQ ID NO: 7528954 - DNA, 22 bp, Homo sapiens
ctccaggccatggctgcggagg

SEQ ID NO: 7528955 - DNA, 22 bp, Homo sapiens
ctccaggccatggctgcggagg

SEQ ID NO: 7528956 - DNA, 22 bp, Homo sapiens
ctccaggccatggctgcggagg

SEQ ID NO: 7528957 - DNA, 22 bp, Homo sapiens
ctccaggccagggaagtggaca

SEQ ID NO: 7528958 - DNA, 22 bp, Homo sapiens
ctccaggccagggaagtggaca

SEQ ID NO: 7528959 - DNA, 22 bp, Homo sapiens
ctccaggccagggaagtggaca

SEQ ID NO: 7528960 - DNA, 22 bp, Homo sapiens
ctccaggccagggaagtggaca

SEQ ID NO: 7528961 - DNA, 22 bp, Homo sapiens
ctccaggccagggaagtggaca

SEQ ID NO: 7528962 - DNA, 22 bp, Homo sapiens
ctccaggccagggaagtggaca

SEQ ID NO: 7528963 - DNA, 22 bp, Homo sapiens
ctccaggccaagattaagtaat

SEQ ID NO: 7528964 - DNA, 22 bp, Homo sapiens
ctccaggccagggaagtggaca

SEQ ID NO: 7528965 - DNA, 22 bp, Homo sapiens
ctccaggcccacgtcgaggagg

SEQ ID NO: 7528966 - DNA, 22 bp, Homo sapiens
ctccaggcccacgtcgaggagg

SEQ ID NO: 7528967 - DNA, 22 bp, Homo sapiens
ctccaggcccacgtcgaggagg

SEQ ID NO: 7528968 - DNA, 22 bp, Homo sapiens
ctccaggcccacggccgcggcc

SEQ ID NO: 7528969 - DNA, 22 bp, Homo sapiens
ctccaggcccacggccgcggcc

SEQ ID NO: 7528970 - DNA, 22 bp, Homo sapiens
ctccaggcccacggccgcggcc

SEQ ID NO: 7528971 - DNA, 22 bp, Homo sapiens
ctccaggcccacggccgcggcc

SEQ ID NO: 7528972 - DNA, 22 bp, Homo sapiens
ctccaggccatggctgcggagg

SEQ ID NO: 7528973 - DNA, 22 bp, Homo sapiens
ctccaggccatggctgcggagg

SEQ ID NO: 7528974 - DNA, 22 bp, Homo sapiens
ctccaggccatggctgcggagg

SEQ ID NO: 7528975 - DNA, 22 bp, Homo sapiens
ctccaggagggggatggctgta

SEQ ID NO: 7528976 - DNA, 22 bp, Homo sapiens
ctccaggagggcttcctgtgat

SEQ ID NO: 7528977 - DNA, 22 bp, Homo sapiens
ctccaggagggcttcctgtgat

SEQ ID NO: 7528978 - DNA, 22 bp, Homo sapiens
ctccaggagggcttcctgtgat

SEQ ID NO: 7528979 - DNA, 22 bp, Homo sapiens
ctccaggagggcttcctgtgat

SEQ ID NO: 7528980 - DNA, 22 bp, Homo sapiens
ctccaggagctgtgtctttctt

SEQ ID NO: 7528981 - DNA, 22 bp, Homo sapiens
ctccaggagctgtgtctttctt

SEQ ID NO: 7528982 - DNA, 22 bp, Homo sapiens
ctccaggactgaggacagagct

SEQ ID NO: 7528983 - DNA, 22 bp, Homo sapiens
ctccaggactgaggacagagct

SEQ ID NO: 7528984 - DNA, 22 bp, Homo sapiens
ctccaggagctgtgtctttctt

SEQ ID NO: 7528985 - DNA, 22 bp, Homo sapiens
ctccaggagggggatggctgta

SEQ ID NO: 7528986 - DNA, 22 bp, Homo sapiens
ctccaggagggggatggctgta

SEQ ID NO: 7528987 - DNA, 22 bp, Homo sapiens
ctccaggaggttgctgcttcct

SEQ ID NO: 7528988 - DNA, 22 bp, Homo sapiens
ctccaggagggggatggctgta

SEQ ID NO: 7528989 - DNA, 22 bp, Homo sapiens
ctccaggagggggatggctgta

SEQ ID NO: 7528990 - DNA, 22 bp, Homo sapiens
ctccaggagggggatggctgta

SEQ ID NO: 7528991 - DNA, 22 bp, Homo sapiens
ctccaggaggttgctgcttcct

SEQ ID NO: 7528992 - DNA, 22 bp, Homo sapiens
ctccaggaggttgctgcttcct

SEQ ID NO: 7528993 - DNA, 22 bp, Homo sapiens
ctccaggaggttgctgcttcct

SEQ ID NO: 7528994 - DNA, 22 bp, Homo sapiens
ctccaggaggttgctgcttcct

SEQ ID NO: 7528995 - DNA, 22 bp, Homo sapiens
ctccaggagtggcctggacacc

SEQ ID NO: 7528996 - DNA, 22 bp, Homo sapiens
ctccaggagtggcctggacacc

SEQ ID NO: 7528997 - DNA, 22 bp, Homo sapiens
ctccaggagtggcctggacacc

SEQ ID NO: 7528998 - DNA, 19 bp, Homo sapiens
ctccaggatggctgggcga

SEQ ID NO: 7528999 - DNA, 19 bp, Homo sapiens
ctccaggatggctgggcga

SEQ ID NO: 7529000 - DNA, 19 bp, Homo sapiens
ctccaggatggctgggcga

SEQ ID NO: 7529001 - DNA, 19 bp, Homo sapiens
ctccaggatggctgggcga

SEQ ID NO: 7529002 - DNA, 19 bp, Homo sapiens
ctccaggatggctgggcga

SEQ ID NO: 7529003 - DNA, 22 bp, Homo sapiens
ctccaggatacctgttcctata

SEQ ID NO: 7529004 - DNA, 22 bp, Homo sapiens
ctccaggatacctgttcctata

SEQ ID NO: 7529005 - DNA, 22 bp, Homo sapiens
ctccaggagtggcctggacacc

SEQ ID NO: 7529006 - DNA, 22 bp, Homo sapiens
ctccaggatgttagacgtccag

SEQ ID NO: 7529007 - DNA, 22 bp, Homo sapiens
ctccaggatgttagacgtccag

SEQ ID NO: 7529008 - DNA, 22 bp, Homo sapiens
ctccaggatgttagacgtccag

SEQ ID NO: 7529009 - DNA, 22 bp, Homo sapiens
ctccaggatgttagacgtccag

SEQ ID NO: 7529010 - DNA, 19 bp, Homo sapiens
ctccaggatggctgggcga

SEQ ID NO: 7529011 - DNA, 19 bp, Homo sapiens
ctccaggatggctgggcga

SEQ ID NO: 7529012 - DNA, 22 bp, Homo sapiens
ctccaggccaagattaagtaat

SEQ ID NO: 7529013 - DNA, 22 bp, Homo sapiens
ctccaggatgttagacgtccag

SEQ ID NO: 7529014 - DNA, 22 bp, Homo sapiens
ctccaggatgttagacgtccag

SEQ ID NO: 7529015 - DNA, 22 bp, Homo sapiens
tttctacatgtcagtaactgat

SEQ ID NO: 7529016 - DNA, 22 bp, Homo sapiens
tttctacatgtcagtaactgat

SEQ ID NO: 7529017 - DNA, 22 bp, Homo sapiens
tttctacatgtcagtaactgat

SEQ ID NO: 7529018 - DNA, 22 bp, Homo sapiens
tttctattttaaaggcatatgg

SEQ ID NO: 7529019 - DNA, 22 bp, Homo sapiens
tttctattttaaaggcatatgg

SEQ ID NO: 7529020 - DNA, 22 bp, Homo sapiens
tttctattttaaaggcatatgg

SEQ ID NO: 7529021 - DNA, 22 bp, Homo sapiens
tttctattttaaaggcatatgg

SEQ ID NO: 7529022 - DNA, 22 bp, Homo sapiens
tttctacatgtcaatccaaacc

SEQ ID NO: 7529023 - DNA, 22 bp, Homo sapiens
tttctacatgtcaatccaaacc

SEQ ID NO: 7529024 - DNA, 22 bp, Homo sapiens
tttctacatgtcaatccaaacc

SEQ ID NO: 7529025 - DNA, 22 bp, Homo sapiens
tttctacatgtcaatccaaacc

SEQ ID NO: 7529026 - DNA, 17 bp, Homo sapiens
tttctacagttggcagc

SEQ ID NO: 7529027 - DNA, 22 bp, Homo sapiens
tttctacagtactgatttcata

SEQ ID NO: 7529028 - DNA, 22 bp, Homo sapiens
tttctacatgtcaatccaaacc

SEQ ID NO: 7529029 - DNA, 22 bp, Homo sapiens
tttctacatgtcaatccaaacc

SEQ ID NO: 7529030 - DNA, 22 bp, Homo sapiens
tttctacatgtcaatccaaacc

SEQ ID NO: 7529031 - DNA, 22 bp, Homo sapiens
tttctacatgtcaatccaaacc

SEQ ID NO: 7529032 - DNA, 22 bp, Homo sapiens
tttctcaaattgcatgagtagc

SEQ ID NO: 7529033 - DNA, 22 bp, Homo sapiens
tttctcaaattgcatgagtagc

SEQ ID NO: 7529034 - DNA, 22 bp, Homo sapiens
tttctcaaattgcatgagtagc

SEQ ID NO: 7529035 - DNA, 22 bp, Homo sapiens
tttctcaaattgcatgagtagc

SEQ ID NO: 7529036 - DNA, 22 bp, Homo sapiens
tttctcaaattgcatgagtagc

SEQ ID NO: 7529037 - DNA, 22 bp, Homo sapiens
tttctcaaattgcatgagtagc

SEQ ID NO: 7529038 - DNA, 22 bp, Homo sapiens
tttctcaaattgcatgagtagc

SEQ ID NO: 7529039 - DNA, 22 bp, Homo sapiens
tttctcaaattgcatgagtagc

SEQ ID NO: 7529040 - DNA, 22 bp, Homo sapiens
tttctcaacagagtatgccctt

SEQ ID NO: 7529041 - DNA, 22 bp, Homo sapiens
tttctcaacctcaacactattt

SEQ ID NO: 7529042 - DNA, 22 bp, Homo sapiens
tttctcaacctcaacactattt

SEQ ID NO: 7529043 - DNA, 22 bp, Homo sapiens
tttctcaacctcaacactattt

SEQ ID NO: 7529044 - DNA, 22 bp, Homo sapiens
tttctcaacctcaacactattt

SEQ ID NO: 7529045 - DNA, 22 bp, Homo sapiens
tttctcaacctcaacactattt

SEQ ID NO: 7529046 - DNA, 22 bp, Homo sapiens
tttctcaacctcaacactattt

SEQ ID NO: 7529047 - DNA, 22 bp, Homo sapiens
tttctcaaaattcagtggtatc

SEQ ID NO: 7529048 - DNA, 22 bp, Homo sapiens
tttctcaaaattcagtggtatc

SEQ ID NO: 7529049 - DNA, 22 bp, Homo sapiens
tttctcaaaagacagaagtgaa

SEQ ID NO: 7529050 - DNA, 22 bp, Homo sapiens
tttctcaaaagacagaagtgaa

SEQ ID NO: 7529051 - DNA, 22 bp, Homo sapiens
tttctcaaaagacagaagtgaa

SEQ ID NO: 7529052 - DNA, 22 bp, Homo sapiens
tttctcaaaagacagaagtgaa

SEQ ID NO: 7529053 - DNA, 22 bp, Homo sapiens
tttctcaaaagacagaagtgaa

SEQ ID NO: 7529054 - DNA, 22 bp, Homo sapiens
tttctcaaatactgttccagga

SEQ ID NO: 7529055 - DNA, 22 bp, Homo sapiens
tttctcaaatactgttccagga

SEQ ID NO: 7529056 - DNA, 23 bp, Homo sapiens
tttctcaaagagtggcagcttca

SEQ ID NO: 7529057 - DNA, 22 bp, Homo sapiens
tttctcaaatactgttccagga

SEQ ID NO: 7529058 - DNA, 23 bp, Homo sapiens
tttctcaaagagtggcagcttca

SEQ ID NO: 7529059 - DNA, 23 bp, Homo sapiens
tttctcaaagagtggcagcttca

SEQ ID NO: 7529060 - DNA, 22 bp, Homo sapiens
tttctcaaaattcagtggtatc

SEQ ID NO: 7529061 - DNA, 23 bp, Homo sapiens
tttctcaaagagtggcagcttca

SEQ ID NO: 7529062 - DNA, 22 bp, Homo sapiens
tttctcaactgtattatgcaga

SEQ ID NO: 7529063 - DNA, 22 bp, Homo sapiens
tttctcaactgtattatgcaga

SEQ ID NO: 7529064 - DNA, 22 bp, Homo sapiens
tttctcaactgtattatgcaga

SEQ ID NO: 7529065 - DNA, 22 bp, Homo sapiens
tttctcaactgtattatgcaga

SEQ ID NO: 7529066 - DNA, 22 bp, Homo sapiens
tttctcaagctgtttgccaatt

SEQ ID NO: 7529067 - DNA, 18 bp, Homo sapiens
tttctcaaggctgacatt

SEQ ID NO: 7529068 - DNA, 18 bp, Homo sapiens
tttctcaaggctgacatt

SEQ ID NO: 7529069 - DNA, 18 bp, Homo sapiens
tttctcaaggctgacatt

SEQ ID NO: 7529070 - DNA, 18 bp, Homo sapiens
tttctcaaggctgacatt

SEQ ID NO: 7529071 - DNA, 18 bp, Homo sapiens
tttctcaaggctgacatt

SEQ ID NO: 7529072 - DNA, 18 bp, Homo sapiens
tttctcaaggctgacatt

SEQ ID NO: 7529073 - DNA, 22 bp, Homo sapiens
tttctcaaggtgtcatgtattt

SEQ ID NO: 7529074 - DNA, 22 bp, Homo sapiens
tttctcaaggtgtcatgtattt

SEQ ID NO: 7529075 - DNA, 22 bp, Homo sapiens
tttctcaaggtgtcatgtattt

SEQ ID NO: 7529076 - DNA, 22 bp, Homo sapiens
tttctcaaggtgtcatgtattt

SEQ ID NO: 7529077 - DNA, 22 bp, Homo sapiens
tttctcaaggtgtcatgtattt

SEQ ID NO: 7529078 - DNA, 22 bp, Homo sapiens
tttctcaaggtgtcatgtattt

SEQ ID NO: 7529079 - DNA, 22 bp, Homo sapiens
tttctcaaggtgtcatgtattt

SEQ ID NO: 7529080 - DNA, 22 bp, Homo sapiens
tttctcaagtactgcacatgaa

SEQ ID NO: 7529081 - DNA, 22 bp, Homo sapiens
tttctcaagtactgcacatgaa

SEQ ID NO: 7529082 - DNA, 22 bp, Homo sapiens
tttctcaagtactgcacatgaa

SEQ ID NO: 7529083 - DNA, 22 bp, Homo sapiens
tttctcaagtactgcacatgaa

SEQ ID NO: 7529084 - DNA, 22 bp, Homo sapiens
tttctcaagtactgcacatgaa

SEQ ID NO: 7529085 - DNA, 18 bp, Homo sapiens
ctctctggtctggatccc

SEQ ID NO: 7529086 - DNA, 18 bp, Homo sapiens
ctctctggtctggatccc

SEQ ID NO: 7529087 - DNA, 18 bp, Homo sapiens
ctctctggtctggatccc

SEQ ID NO: 7529088 - DNA, 22 bp, Homo sapiens
ctctctggtcccagattccaga

SEQ ID NO: 7529089 - DNA, 22 bp, Homo sapiens
ctctctggcttggcacggagat

SEQ ID NO: 7529090 - DNA, 19 bp, Homo sapiens
ctctctggcggtgtctgcg

SEQ ID NO: 7529091 - DNA, 19 bp, Homo sapiens
ctctctggcggtgtctgcg

SEQ ID NO: 7529092 - DNA, 22 bp, Homo sapiens
tttctcaagttcagatatttga

SEQ ID NO: 7529093 - DNA, 22 bp, Homo sapiens
tttctcaagttcagatatttga

SEQ ID NO: 7529094 - DNA, 22 bp, Homo sapiens
tttctcaagttcagatatttga

SEQ ID NO: 7529095 - DNA, 22 bp, Homo sapiens
tttctcaagttcagatatttga

SEQ ID NO: 7529096 - DNA, 22 bp, Homo sapiens
tttctcaagttcagatatttga

SEQ ID NO: 7529097 - DNA, 22 bp, Homo sapiens
tttctcaagttcagatatttga

SEQ ID NO: 7529098 - DNA, 22 bp, Homo sapiens
tttctcaagttcagatatttga

SEQ ID NO: 7529099 - DNA, 21 bp, Homo sapiens
tttctcaccatggtatggaaa

SEQ ID NO: 7529100 - DNA, 21 bp, Homo sapiens
tttctcaccatggtatggaaa

SEQ ID NO: 7529101 - DNA, 19 bp, Homo sapiens
ctctctggcggtgtctgcg

SEQ ID NO: 7529102 - DNA, 19 bp, Homo sapiens
ctctctggcggtgtctgcg

SEQ ID NO: 7529103 - DNA, 19 bp, Homo sapiens
ctctctggcggtgtctgcg

SEQ ID NO: 7529104 - DNA, 22 bp, Homo sapiens
ctctgaaagagtttagtattat

SEQ ID NO: 7529105 - DNA, 22 bp, Homo sapiens
ctctgaaagttagagaaaatag

SEQ ID NO: 7529106 - DNA, 22 bp, Homo sapiens
ctctgaaagttagagaaaatag

SEQ ID NO: 7529107 - DNA, 22 bp, Homo sapiens
ctctgaaagttagagaaaatag

SEQ ID NO: 7529108 - DNA, 22 bp, Homo sapiens
ctctgaaagttagagaaaatag

SEQ ID NO: 7529109 - DNA, 22 bp, Homo sapiens
ctctgaaagcaaaactagagaa

SEQ ID NO: 7529110 - DNA, 22 bp, Homo sapiens
ctctgaaagcaaaactagagaa

SEQ ID NO: 7529111 - DNA, 22 bp, Homo sapiens
ctctgaaagcaaaactagagaa

SEQ ID NO: 7529112 - DNA, 22 bp, Homo sapiens
ctctgaaagcaaaactagagaa

SEQ ID NO: 7529113 - DNA, 22 bp, Homo sapiens
ctctctttctgaatgaggacta

SEQ ID NO: 7529114 - DNA, 22 bp, Homo sapiens
ctctctttgatgtataaataat

SEQ ID NO: 7529115 - DNA, 22 bp, Homo sapiens
ctctctttgatgtataaataat

SEQ ID NO: 7529116 - DNA, 22 bp, Homo sapiens
ctctctttgatgtataaataat

SEQ ID NO: 7529117 - DNA, 18 bp, Homo sapiens
ctctctttccactctttg

SEQ ID NO: 7529118 - DNA, 18 bp, Homo sapiens
ctctctttccactctttg

SEQ ID NO: 7529119 - DNA, 18 bp, Homo sapiens
ctctctttccactctttg

SEQ ID NO: 7529120 - DNA, 22 bp, Homo sapiens
ctctctttgatgtataaataat

SEQ ID NO: 7529121 - DNA, 22 bp, Homo sapiens
ctctctttgatgtataaataat

SEQ ID NO: 7529122 - DNA, 22 bp, Homo sapiens
ctctctttgatgtataaataat

SEQ ID NO: 7529123 - DNA, 22 bp, Homo sapiens
ctctctttgatgtataaataat

SEQ ID NO: 7529124 - DNA, 22 bp, Homo sapiens
ctctctttttcgtgtgccgaag

SEQ ID NO: 7529125 - DNA, 18 bp, Homo sapiens
ctctctttccactctttg

SEQ ID NO: 7529126 - DNA, 18 bp, Homo sapiens
ctctctttccactctttg

SEQ ID NO: 7529127 - DNA, 18 bp, Homo sapiens
ctctctttccactctttg

SEQ ID NO: 7529128 - DNA, 18 bp, Homo sapiens
ctctctttccactctttg

SEQ ID NO: 7529129 - DNA, 18 bp, Homo sapiens
ctctctttccactctttg

SEQ ID NO: 7529130 - DNA, 18 bp, Homo sapiens
ctctctttccactctttg

SEQ ID NO: 7529131 - DNA, 22 bp, Homo sapiens
ctctctttcattggtcgccttg

SEQ ID NO: 7529132 - DNA, 22 bp, Homo sapiens
ctctctttcattggtcgccttg

SEQ ID NO: 7529133 - DNA, 22 bp, Homo sapiens
ctctctttcattggtcgccttg

SEQ ID NO: 7529134 - DNA, 22 bp, Homo sapiens
ctctctgttatgctttcatgaa

SEQ ID NO: 7529135 - DNA, 22 bp, Homo sapiens
ctctctgttatgctttcatgaa

SEQ ID NO: 7529136 - DNA, 22 bp, Homo sapiens
ctctctgttatgctttcatgaa

SEQ ID NO: 7529137 - DNA, 22 bp, Homo sapiens
ctctctgttcattgagtcaaaa

SEQ ID NO: 7529138 - DNA, 22 bp, Homo sapiens
ctctcttcccgtgagtgttgca

SEQ ID NO: 7529139 - DNA, 22 bp, Homo sapiens
ctctcttcccgtgagtgttgca

SEQ ID NO: 7529140 - DNA, 22 bp, Homo sapiens
ctctcttcccgtgagtgttgca

SEQ ID NO: 7529141 - DNA, 22 bp, Homo sapiens
ctctcttcccgtgagtgttgca

SEQ ID NO: 7529142 - DNA, 22 bp, Homo sapiens
ctctctgttcattgagtcaaaa

SEQ ID NO: 7529143 - DNA, 22 bp, Homo sapiens
ctctctgttcattgagtcaaaa

SEQ ID NO: 7529144 - DNA, 22 bp, Homo sapiens
ctctctggtttcagcgaagggg

SEQ ID NO: 7529145 - DNA, 22 bp, Homo sapiens
ctctctggtttcagcgaagggg

SEQ ID NO: 7529146 - DNA, 22 bp, Homo sapiens
ctctctggtttcagcgaagggg

SEQ ID NO: 7529147 - DNA, 22 bp, Homo sapiens
ctctctggtttcagcgaagggg

SEQ ID NO: 7529148 - DNA, 22 bp, Homo sapiens
ctctctggtttcagcgaagggg

SEQ ID NO: 7529149 - DNA, 22 bp, Homo sapiens
ctctctgtatgtgtatatttat

SEQ ID NO: 7529150 - DNA, 22 bp, Homo sapiens
ctctctgtatgtgtatatttat

SEQ ID NO: 7529151 - DNA, 22 bp, Homo sapiens
ctctctgtcttggcatttggtc

SEQ ID NO: 7529152 - DNA, 22 bp, Homo sapiens
ctctctgtcttggcatttggtc

SEQ ID NO: 7529153 - DNA, 22 bp, Homo sapiens
ctctctgtggtggctgtcccat

SEQ ID NO: 7529154 - DNA, 22 bp, Homo sapiens
ctctctgtggtggctgtcccat

SEQ ID NO: 7529155 - DNA, 22 bp, Homo sapiens
ctctctgttatgctttcatgaa

SEQ ID NO: 7529156 - DNA, 22 bp, Homo sapiens
ctctctgtggtggctgtcccat

SEQ ID NO: 7529157 - DNA, 22 bp, Homo sapiens
ctctctgtggtggctgtcccat

SEQ ID NO: 7529158 - DNA, 22 bp, Homo sapiens
ctctctgtggtggctgtcccat

SEQ ID NO: 7529159 - DNA, 22 bp, Homo sapiens
ctctctgtggtggctgtcccat

SEQ ID NO: 7529160 - DNA, 22 bp, Homo sapiens
ctctctgtggtggctgtcccat

SEQ ID NO: 7529161 - DNA, 22 bp, Homo sapiens
ctctctgtggtggctgtcccat

SEQ ID NO: 7529162 - DNA, 22 bp, Homo sapiens
ctctctgtggtggctgtcccat

SEQ ID NO: 7529163 - DNA, 22 bp, Homo sapiens
ctctctgtgctcacaagggcag

SEQ ID NO: 7529164 - DNA, 22 bp, Homo sapiens
tttcatgtttatggaaaatgag

SEQ ID NO: 7529165 - DNA, 22 bp, Homo sapiens
tttcatgtttatggaaaatgag

SEQ ID NO: 7529166 - DNA, 22 bp, Homo sapiens
tttcatgttttcttaaatggca

SEQ ID NO: 7529167 - DNA, 22 bp, Homo sapiens
tttcatgtttatggaaaatgag

SEQ ID NO: 7529168 - DNA, 22 bp, Homo sapiens
tttcatgtttatggaaaatgag

SEQ ID NO: 7529169 - DNA, 22 bp, Homo sapiens
tttcatgtttatggaaaatgag

SEQ ID NO: 7529170 - DNA, 22 bp, Homo sapiens
tttcattaaagtcaaatctggt

SEQ ID NO: 7529171 - DNA, 19 bp, Homo sapiens
tttcatgtttttggtgaga

SEQ ID NO: 7529172 - DNA, 22 bp, Homo sapiens
tttcattaaagtcaaatctggt

SEQ ID NO: 7529173 - DNA, 22 bp, Homo sapiens
tttcattaaagtcaaatctggt

SEQ ID NO: 7529174 - DNA, 19 bp, Homo sapiens
tttcatgtttttggtgaga

SEQ ID NO: 7529175 - DNA, 22 bp, Homo sapiens
tttcatgttttcttaaatggca

SEQ ID NO: 7529176 - DNA, 22 bp, Homo sapiens
tttcatgttttcttaaatggca

SEQ ID NO: 7529177 - DNA, 22 bp, Homo sapiens
tttcatgttttcttaaatggca

SEQ ID NO: 7529178 - DNA, 22 bp, Homo sapiens
tttcattacgtgtttgacttgt

SEQ ID NO: 7529179 - DNA, 22 bp, Homo sapiens
tttcattacgtgtttgacttgt

SEQ ID NO: 7529180 - DNA, 22 bp, Homo sapiens
tttcattacgtgtttgacttgt

SEQ ID NO: 7529181 - DNA, 22 bp, Homo sapiens
tttcattacgtgtttgacttgt

SEQ ID NO: 7529182 - DNA, 22 bp, Homo sapiens
tttcattacgtgtttgacttgt

SEQ ID NO: 7529183 - DNA, 22 bp, Homo sapiens
tttcattacgtgtttgacttgt

SEQ ID NO: 7529184 - DNA, 22 bp, Homo sapiens
tttcattaaagtcaaatctggt

SEQ ID NO: 7529185 - DNA, 22 bp, Homo sapiens
tttcattacgtgtttgacttgt

SEQ ID NO: 7529186 - DNA, 22 bp, Homo sapiens
tttcattaaagtcaaatctggt

SEQ ID NO: 7529187 - DNA, 22 bp, Homo sapiens
tttcattaaagtcaaatctggt

SEQ ID NO: 7529188 - DNA, 22 bp, Homo sapiens
tttcatgttggggagttgagtg

SEQ ID NO: 7529189 - DNA, 23 bp, Homo sapiens
tttcatgttggcatgactgactt

SEQ ID NO: 7529190 - DNA, 22 bp, Homo sapiens
tttcatgttggggagttgagtg

SEQ ID NO: 7529191 - DNA, 22 bp, Homo sapiens
tttcatgttggggagttgagtg

SEQ ID NO: 7529192 - DNA, 22 bp, Homo sapiens
tttcatgtttatggaaaatgag

SEQ ID NO: 7529193 - DNA, 22 bp, Homo sapiens
tttcatgttggatactgtttca

SEQ ID NO: 7529194 - DNA, 23 bp, Homo sapiens
tttcatgttggcatgactgactt

SEQ ID NO: 7529195 - DNA, 22 bp, Homo sapiens
tttcatgttggatactgtttca

SEQ ID NO: 7529196 - DNA, 22 bp, Homo sapiens
tttcatgttggatactgtttca

SEQ ID NO: 7529197 - DNA, 22 bp, Homo sapiens
tttcatgttggatactgtttca

SEQ ID NO: 7529198 - DNA, 22 bp, Homo sapiens
tttcatgttggatactgtttca

SEQ ID NO: 7529199 - DNA, 22 bp, Homo sapiens
tttcatgttagttggttcttgg

SEQ ID NO: 7529200 - DNA, 22 bp, Homo sapiens
tttcatgttattaatagtgctg

SEQ ID NO: 7529201 - DNA, 22 bp, Homo sapiens
tttcatgttacatttaaaatgt

SEQ ID NO: 7529202 - DNA, 22 bp, Homo sapiens
tttcatgttattaatagtgctg

SEQ ID NO: 7529203 - DNA, 22 bp, Homo sapiens
tttcatgttattaatagtgctg

SEQ ID NO: 7529204 - DNA, 22 bp, Homo sapiens
tttcatgttagttggttcttgg

SEQ ID NO: 7529205 - DNA, 22 bp, Homo sapiens
tttcatgttagttggttcttgg

SEQ ID NO: 7529206 - DNA, 22 bp, Homo sapiens
tttcatgttacatttaaaatgt

SEQ ID NO: 7529207 - DNA, 22 bp, Homo sapiens
tttcatgttacatttaaaatgt

SEQ ID NO: 7529208 - DNA, 22 bp, Homo sapiens
tttcagtttccagctttgtcat

SEQ ID NO: 7529209 - DNA, 22 bp, Homo sapiens
tttcatgttacatttaaaatgt

SEQ ID NO: 7529210 - DNA, 22 bp, Homo sapiens
tttcatgttacatttaaaatgt

SEQ ID NO: 7529211 - DNA, 22 bp, Homo sapiens
tttcattagtatgacagcacgc

SEQ ID NO: 7529212 - DNA, 22 bp, Homo sapiens
tttcattagtatgacagcacgc

SEQ ID NO: 7529213 - DNA, 22 bp, Homo sapiens
tttcattagtatgacagcacgc

SEQ ID NO: 7529214 - DNA, 22 bp, Homo sapiens
tttcattagtatgacagcacgc

SEQ ID NO: 7529215 - DNA, 22 bp, Homo sapiens
tttcattagtatgacagcacgc

SEQ ID NO: 7529216 - DNA, 22 bp, Homo sapiens
tttcattagtatgacagcacgc

SEQ ID NO: 7529217 - DNA, 22 bp, Homo sapiens
tttcattataaaaagttggctt

SEQ ID NO: 7529218 - DNA, 22 bp, Homo sapiens
tttcattacgtgtttgacttgt

SEQ ID NO: 7529219 - DNA, 22 bp, Homo sapiens
tttcattagtatgacagcacgc

SEQ ID NO: 7529220 - DNA, 22 bp, Homo sapiens
tttcattacttgttaagggtag

SEQ ID NO: 7529221 - DNA, 22 bp, Homo sapiens
tttcattacgtgtttgacttgt

SEQ ID NO: 7529222 - DNA, 22 bp, Homo sapiens
tttcattacttgttaagggtag

SEQ ID NO: 7529223 - DNA, 18 bp, Homo sapiens
tttcattataaagcaggc

SEQ ID NO: 7529224 - DNA, 18 bp, Homo sapiens
tttcattataaagcaggc

SEQ ID NO: 7529225 - DNA, 18 bp, Homo sapiens
tttcattataaagcaggc

SEQ ID NO: 7529226 - DNA, 22 bp, Homo sapiens
tttcattataaaaagttggctt

SEQ ID NO: 7529227 - DNA, 22 bp, Homo sapiens
tttcattatacagcttcataaa

SEQ ID NO: 7529228 - DNA, 22 bp, Homo sapiens
tttcattatacagcttcataaa

SEQ ID NO: 7529229 - DNA, 22 bp, Homo sapiens
tttcattatacagcttcataaa

SEQ ID NO: 7529230 - DNA, 22 bp, Homo sapiens
tttcattatacagcttcataaa

SEQ ID NO: 7529231 - DNA, 22 bp, Homo sapiens
tttcattatacagcttcataaa

SEQ ID NO: 7529232 - DNA, 18 bp, Homo sapiens
tttcattataaagcaggc

SEQ ID NO: 7529233 - DNA, 22 bp, Homo sapiens
tttccaagagcttatttctgaa

SEQ ID NO: 7529234 - DNA, 22 bp, Homo sapiens
tttccaagagcttatttctgaa

SEQ ID NO: 7529235 - DNA, 22 bp, Homo sapiens
tttccaagctgtcttggcccac

SEQ ID NO: 7529236 - DNA, 22 bp, Homo sapiens
tttccaagataatacacagaaa

SEQ ID NO: 7529237 - DNA, 22 bp, Homo sapiens
tttccaagataatacacagaaa

SEQ ID NO: 7529238 - DNA, 18 bp, Homo sapiens
tttccaagaagagagctc

SEQ ID NO: 7529239 - DNA, 22 bp, Homo sapiens
tttccaagactccagttctccc

SEQ ID NO: 7529240 - DNA, 22 bp, Homo sapiens
tttccaagactccagttctccc

SEQ ID NO: 7529241 - DNA, 22 bp, Homo sapiens
tttccaagagcttatttctgaa

SEQ ID NO: 7529242 - DNA, 22 bp, Homo sapiens
tttccaagagcttatttctgaa

SEQ ID NO: 7529243 - DNA, 18 bp, Homo sapiens
tttccaagaagagagctc

SEQ ID NO: 7529244 - DNA, 22 bp, Homo sapiens
tttccaataaagtgtcattgtt

SEQ ID NO: 7529245 - DNA, 22 bp, Homo sapiens
tttccaagtgtcaggtgcaaaa

SEQ ID NO: 7529246 - DNA, 22 bp, Homo sapiens
tttccaagtgtcaggtgcaaaa

SEQ ID NO: 7529247 - DNA, 22 bp, Homo sapiens
tttccaataaagtgtcattgtt

SEQ ID NO: 7529248 - DNA, 22 bp, Homo sapiens
tttccaataaggtcaccttcct

SEQ ID NO: 7529249 - DNA, 22 bp, Homo sapiens
tttccaataaggtcaccttcct

SEQ ID NO: 7529250 - DNA, 22 bp, Homo sapiens
tttccaagttgttaccttctac

SEQ ID NO: 7529251 - DNA, 22 bp, Homo sapiens
tttccaagttgttaccttctac

SEQ ID NO: 7529252 - DNA, 22 bp, Homo sapiens
tttccaagtgtcaggtgcaaaa

SEQ ID NO: 7529253 - DNA, 22 bp, Homo sapiens
tttccaaggatgtgtctctcta

SEQ ID NO: 7529254 - DNA, 22 bp, Homo sapiens
tttccaagtactgagctgtcaa

SEQ ID NO: 7529255 - DNA, 22 bp, Homo sapiens
tttccaagtactgagctgtcaa

SEQ ID NO: 7529256 - DNA, 22 bp, Homo sapiens
tttccaagctgtcttggcccac

SEQ ID NO: 7529257 - DNA, 22 bp, Homo sapiens
tttccaagctgtcttggcccac

SEQ ID NO: 7529258 - DNA, 22 bp, Homo sapiens
tttccaagtactgagctgtcaa

SEQ ID NO: 7529259 - DNA, 22 bp, Homo sapiens
tttccaagtactgagctgtcaa

SEQ ID NO: 7529260 - DNA, 22 bp, Homo sapiens
tttccaatttggtagtcatcgg

SEQ ID NO: 7529261 - DNA, 22 bp, Homo sapiens
tttccacaatgtttttgcagga

SEQ ID NO: 7529262 - DNA, 22 bp, Homo sapiens
tttccacaatgtttttgcagga

SEQ ID NO: 7529263 - DNA, 22 bp, Homo sapiens
tttccaattcaagcttttacgt

SEQ ID NO: 7529264 - DNA, 22 bp, Homo sapiens
tttccaattcaagcttttacgt

SEQ ID NO: 7529265 - DNA, 22 bp, Homo sapiens
tttccaatttggtagtcatcgg

SEQ ID NO: 7529266 - DNA, 22 bp, Homo sapiens
tttccaattcaagcttttacgt

SEQ ID NO: 7529267 - DNA, 22 bp, Homo sapiens
tttccaatgtagatgtctctgg

SEQ ID NO: 7529268 - DNA, 22 bp, Homo sapiens
tttccacactgcagccagcaaa

SEQ ID NO: 7529269 - DNA, 22 bp, Homo sapiens
tttccacactcactgcactcat

SEQ ID NO: 7529270 - DNA, 22 bp, Homo sapiens
tttccacacaggctctactact

SEQ ID NO: 7529271 - DNA, 22 bp, Homo sapiens
tttccacactcactgcactcat

SEQ ID NO: 7529272 - DNA, 22 bp, Homo sapiens
tttccacactcactgcactcat

SEQ ID NO: 7529273 - DNA, 22 bp, Homo sapiens
tttccacacaggctctactact

SEQ ID NO: 7529274 - DNA, 22 bp, Homo sapiens
tttccacaatttgagcagcaga

SEQ ID NO: 7529275 - DNA, 22 bp, Homo sapiens
tttccacaatttgagcagcaga

SEQ ID NO: 7529276 - DNA, 22 bp, Homo sapiens
tttccacaatttgagcagcaga

SEQ ID NO: 7529277 - DNA, 22 bp, Homo sapiens
tttccactcctattgcatctca

SEQ ID NO: 7529278 - DNA, 22 bp, Homo sapiens
tttccactcctattgcatctca

SEQ ID NO: 7529279 - DNA, 22 bp, Homo sapiens
tttccactctggccaccatctt

SEQ ID NO: 7529280 - DNA, 22 bp, Homo sapiens
tttccactctggccaccatctt

SEQ ID NO: 7529281 - DNA, 22 bp, Homo sapiens
tttccactctggccaccatctt

SEQ ID NO: 7529282 - DNA, 22 bp, Homo sapiens
tttccactctggccaccatctt

SEQ ID NO: 7529283 - DNA, 22 bp, Homo sapiens
tttcctttctagaagcctaaat

SEQ ID NO: 7529284 - DNA, 22 bp, Homo sapiens
tttcctttctagaagcctaaat

SEQ ID NO: 7529285 - DNA, 22 bp, Homo sapiens
tttcctttctagaagcctaaat

SEQ ID NO: 7529286 - DNA, 22 bp, Homo sapiens
tttccacactgcagccagcaaa

SEQ ID NO: 7529287 - DNA, 20 bp, Homo sapiens
tttccactgtaatgtatgat

SEQ ID NO: 7529288 - DNA, 22 bp, Homo sapiens
tttcctttccaaaattctgcct

SEQ ID NO: 7529289 - DNA, 22 bp, Homo sapiens
tttccacagctgtataaaataa

SEQ ID NO: 7529290 - DNA, 22 bp, Homo sapiens
tttccacagctgtataaaataa

SEQ ID NO: 7529291 - DNA, 22 bp, Homo sapiens
tttccacagctgtataaaataa

SEQ ID NO: 7529292 - DNA, 22 bp, Homo sapiens
tttccacactgcagccagcaaa

SEQ ID NO: 7529293 - DNA, 22 bp, Homo sapiens
tttccacatcaccatgaggtga

SEQ ID NO: 7529294 - DNA, 22 bp, Homo sapiens
tttccacatcaccatgaggtga

SEQ ID NO: 7529295 - DNA, 22 bp, Homo sapiens
tttccactcctattgcatctca

SEQ ID NO: 7529296 - DNA, 22 bp, Homo sapiens
tttccactcctattgcatctca

SEQ ID NO: 7529297 - DNA, 22 bp, Homo sapiens
tttccacccagagcatttgttt

SEQ ID NO: 7529298 - DNA, 22 bp, Homo sapiens
tttcctttctcaagagccggca

SEQ ID NO: 7529299 - DNA, 22 bp, Homo sapiens
tttcctttctagaagcctaaat

SEQ ID NO: 7529300 - DNA, 22 bp, Homo sapiens
tttctaattgtggccgaggtag

SEQ ID NO: 7529301 - DNA, 22 bp, Homo sapiens
tttctacaacacttctgaatct

SEQ ID NO: 7529302 - DNA, 22 bp, Homo sapiens
tttcctttctcaagagccggca

SEQ ID NO: 7529303 - DNA, 22 bp, Homo sapiens
tttctacaacacttctgaatct

SEQ ID NO: 7529304 - DNA, 22 bp, Homo sapiens
tttctacaacacttctgaatct

SEQ ID NO: 7529305 - DNA, 22 bp, Homo sapiens
tttctacaacacttctgaatct

SEQ ID NO: 7529306 - DNA, 22 bp, Homo sapiens
tttctacaacacttctgaatct

SEQ ID NO: 7529307 - DNA, 22 bp, Homo sapiens
tttctacaatttttggcatgag

SEQ ID NO: 7529308 - DNA, 22 bp, Homo sapiens
tttctacaatttttggcatgag

SEQ ID NO: 7529309 - DNA, 22 bp, Homo sapiens
tttctacacttcgtggtgtttt

SEQ ID NO: 7529310 - DNA, 22 bp, Homo sapiens
tttctacacttcgtggtgtttt

SEQ ID NO: 7529311 - DNA, 22 bp, Homo sapiens
tttctacagaagatacactgct

SEQ ID NO: 7529312 - DNA, 22 bp, Homo sapiens
tttctacagaagatacactgct

SEQ ID NO: 7529313 - DNA, 22 bp, Homo sapiens
tttctacagaagatacactgct

SEQ ID NO: 7529314 - DNA, 22 bp, Homo sapiens
tttctacagaagatacactgct

SEQ ID NO: 7529315 - DNA, 22 bp, Homo sapiens
tttctacagaagatacactgct

SEQ ID NO: 7529316 - DNA, 22 bp, Homo sapiens
tttctacagaagatacactgct

SEQ ID NO: 7529317 - DNA, 22 bp, Homo sapiens
tttctacagaagatacactgct

SEQ ID NO: 7529318 - DNA, 22 bp, Homo sapiens
tttctacagctggtgcaacttt

SEQ ID NO: 7529319 - DNA, 22 bp, Homo sapiens
tttctacagctggtgcaacttt

SEQ ID NO: 7529320 - DNA, 22 bp, Homo sapiens
tttctacagctggtgcaacttt

SEQ ID NO: 7529321 - DNA, 22 bp, Homo sapiens
tttctacagctggtgcaacttt

SEQ ID NO: 7529322 - DNA, 22 bp, Homo sapiens
tttctacagaagatacactgct

SEQ ID NO: 7529323 - DNA, 22 bp, Homo sapiens
tttctacagaagatacactgct

SEQ ID NO: 7529324 - DNA, 22 bp, Homo sapiens
tttctacagaagatacactgct

SEQ ID NO: 7529325 - DNA, 22 bp, Homo sapiens
tttctacagaagatacactgct

SEQ ID NO: 7529326 - DNA, 22 bp, Homo sapiens
tttctacagctggtgcaacttt

SEQ ID NO: 7529327 - DNA, 22 bp, Homo sapiens
tttctacagtactgatttcata

SEQ ID NO: 7529328 - DNA, 22 bp, Homo sapiens
tttctacagtactgatttcata

SEQ ID NO: 7529329 - DNA, 22 bp, Homo sapiens
tttctacaggttgatgggtttg

SEQ ID NO: 7529330 - DNA, 22 bp, Homo sapiens
tttctacagtactgatttcata

SEQ ID NO: 7529331 - DNA, 22 bp, Homo sapiens
tttctacagtactgatttcata

SEQ ID NO: 7529332 - DNA, 22 bp, Homo sapiens
tttctacagtactgatttcata

SEQ ID NO: 7529333 - DNA, 22 bp, Homo sapiens
tttctacagtactgatttcata

SEQ ID NO: 7529334 - DNA, 22 bp, Homo sapiens
tttctacaggttgatgggtttg

SEQ ID NO: 7529335 - DNA, 22 bp, Homo sapiens
tttctacaggttgatgggtttg

SEQ ID NO: 7529336 - DNA, 22 bp, Homo sapiens
tttctacagctggtgcaacttt

SEQ ID NO: 7529337 - DNA, 21 bp, Homo sapiens
tttgttcaggcaagttacagt

SEQ ID NO: 7529338 - DNA, 21 bp, Homo sapiens
tttgttcaggcaagttacagt

SEQ ID NO: 7529339 - DNA, 21 bp, Homo sapiens
tttgttcaggcaagttacagt

SEQ ID NO: 7529340 - DNA, 22 bp, Homo sapiens
tttgttcagctctcattgatta

SEQ ID NO: 7529341 - DNA, 22 bp, Homo sapiens
tttgttcagctctcattgatta

SEQ ID NO: 7529342 - DNA, 21 bp, Homo sapiens
tttgttcaggcaagttacagt

SEQ ID NO: 7529343 - DNA, 21 bp, Homo sapiens
tttgttcaggcaagttacagt

SEQ ID NO: 7529344 - DNA, 21 bp, Homo sapiens
tttgttcaggcaagttacagt

SEQ ID NO: 7529345 - DNA, 21 bp, Homo sapiens
tttgttcaggggcaaagttaa

SEQ ID NO: 7529346 - DNA, 21 bp, Homo sapiens
tttgttcaggggcaaagttaa

SEQ ID NO: 7529347 - DNA, 22 bp, Homo sapiens
ctctgggtgtgacagcacctgg

SEQ ID NO: 7529348 - DNA, 22 bp, Homo sapiens
ctctgggtgtgacagcacctgg

SEQ ID NO: 7529349 - DNA, 22 bp, Homo sapiens
ctctgggtgtcttaggagctca

SEQ ID NO: 7529350 - DNA, 22 bp, Homo sapiens
ctctgggtgttaatgtcagtgt

SEQ ID NO: 7529351 - DNA, 22 bp, Homo sapiens
ctctgggtgtgacagcacctgg

SEQ ID NO: 7529352 - DNA, 22 bp, Homo sapiens
tttgttcagctctcattgatta

SEQ ID NO: 7529353 - DNA, 22 bp, Homo sapiens
tttgttcagctctcattgatta

SEQ ID NO: 7529354 - DNA, 22 bp, Homo sapiens
tttgttcatgaaaacctagatc

SEQ ID NO: 7529355 - DNA, 22 bp, Homo sapiens
tttgttcatgcctatattctca

SEQ ID NO: 7529356 - DNA, 22 bp, Homo sapiens
tttgttcatgcctatattctca

SEQ ID NO: 7529357 - DNA, 22 bp, Homo sapiens
tttgttcatgcctatattctca

SEQ ID NO: 7529358 - DNA, 22 bp, Homo sapiens
tttgttcattaaaagtgctgta

SEQ ID NO: 7529359 - DNA, 22 bp, Homo sapiens
tttgttcattaaaagtgctgta

SEQ ID NO: 7529360 - DNA, 22 bp, Homo sapiens
tttgttcattaaaagtgctgta

SEQ ID NO: 7529361 - DNA, 22 bp, Homo sapiens
tttgttcattagcattggcctt

SEQ ID NO: 7529362 - DNA, 22 bp, Homo sapiens
tttgttcattagtacagttgta

SEQ ID NO: 7529363 - DNA, 22 bp, Homo sapiens
tttgttcattagtacagttgta

SEQ ID NO: 7529364 - DNA, 22 bp, Homo sapiens
tttgttcattagtacagttgta

SEQ ID NO: 7529365 - DNA, 22 bp, Homo sapiens
tttgttcatgaaaacctagatc

SEQ ID NO: 7529366 - DNA, 21 bp, Homo sapiens
tttgttcatagctcactcttt

SEQ ID NO: 7529367 - DNA, 23 bp, Homo sapiens
tttgttcatcattagagtctagc

SEQ ID NO: 7529368 - DNA, 23 bp, Homo sapiens
tttgttcatcattagagtctagc

SEQ ID NO: 7529369 - DNA, 21 bp, Homo sapiens
tttgttcatagctcactcttt

SEQ ID NO: 7529370 - DNA, 22 bp, Homo sapiens
tttgttcataatggcaaagaga

SEQ ID NO: 7529371 - DNA, 21 bp, Homo sapiens
tttgttcatagctcactcttt

SEQ ID NO: 7529372 - DNA, 22 bp, Homo sapiens
tttgttcataatggcaaagaga

SEQ ID NO: 7529373 - DNA, 21 bp, Homo sapiens
tttgttcaggggcaaagttaa

SEQ ID NO: 7529374 - DNA, 22 bp, Homo sapiens
ctctgggtgtcatggcctcagc

SEQ ID NO: 7529375 - DNA, 22 bp, Homo sapiens
ctctgggtgtcatggcctcagc

SEQ ID NO: 7529376 - DNA, 22 bp, Homo sapiens
ctctgggtgtcttaggagctca

SEQ ID NO: 7529377 - DNA, 22 bp, Homo sapiens
ctctgggtggtctcactgagtg

SEQ ID NO: 7529378 - DNA, 22 bp, Homo sapiens
ctctgggtgtcttaggagctca

SEQ ID NO: 7529379 - DNA, 22 bp, Homo sapiens
ctctgggtgtcttaggagctca

SEQ ID NO: 7529380 - DNA, 22 bp, Homo sapiens
ctctgggtgtgacagcacctgg

SEQ ID NO: 7529381 - DNA, 22 bp, Homo sapiens
ctctgggtgggcagcagatgga

SEQ ID NO: 7529382 - DNA, 22 bp, Homo sapiens
ctctgggtggtctcactgagtg

SEQ ID NO: 7529383 - DNA, 22 bp, Homo sapiens
ctctgggtggtctcactgagtg

SEQ ID NO: 7529384 - DNA, 22 bp, Homo sapiens
ctctgggtggtctcactgagtg

SEQ ID NO: 7529385 - DNA, 22 bp, Homo sapiens
ctctgggtgcagcgctgaccgg

SEQ ID NO: 7529386 - DNA, 22 bp, Homo sapiens
ctctgggtgcagcgctgaccgg

SEQ ID NO: 7529387 - DNA, 22 bp, Homo sapiens
ctctgggtgcagcgctgaccgg

SEQ ID NO: 7529388 - DNA, 17 bp, Homo sapiens
ctctgggtgcctgtgtg

SEQ ID NO: 7529389 - DNA, 22 bp, Homo sapiens
ctctgggtgggcagcagatgga

SEQ ID NO: 7529390 - DNA, 22 bp, Homo sapiens
ctctgggtgggcagcagatgga

SEQ ID NO: 7529391 - DNA, 22 bp, Homo sapiens
ctctgggtcctggggctacaag

SEQ ID NO: 7529392 - DNA, 20 bp, Homo sapiens
ctctgggtcgagacagactt

SEQ ID NO: 7529393 - DNA, 22 bp, Homo sapiens
ctctgggtctacctgtggccag

SEQ ID NO: 7529394 - DNA, 22 bp, Homo sapiens
ctctgggtctacctgtggccag

SEQ ID NO: 7529395 - DNA, 20 bp, Homo sapiens
ctctgggtcgagacagactt

SEQ ID NO: 7529396 - DNA, 20 bp, Homo sapiens
ctctgggtcgagacagactt

SEQ ID NO: 7529397 - DNA, 22 bp, Homo sapiens
ctctgggtctataatgcagctg

SEQ ID NO: 7529398 - DNA, 22 bp, Homo sapiens
ctctgggtgagacagacctggt

SEQ ID NO: 7529399 - DNA, 22 bp, Homo sapiens
ctctgggtgagacagacctggt

SEQ ID NO: 7529400 - DNA, 22 bp, Homo sapiens
ctctgggtgagacagacctggt

SEQ ID NO: 7529401 - DNA, 17 bp, Homo sapiens
ctctgggtctcctgctt

SEQ ID NO: 7529402 - DNA, 22 bp, Homo sapiens
ctctgggtctccctgaggctaa

SEQ ID NO: 7529403 - DNA, 22 bp, Homo sapiens
ctctggctatctgtttctatgt

SEQ ID NO: 7529404 - DNA, 22 bp, Homo sapiens
ctctggctatctgtttctatgt

SEQ ID NO: 7529405 - DNA, 22 bp, Homo sapiens
ctctggctatggcacggcgctc

SEQ ID NO: 7529406 - DNA, 22 bp, Homo sapiens
ctctggctccatttccctatgt

SEQ ID NO: 7529407 - DNA, 22 bp, Homo sapiens
ctctggctcccgcagcccccat

SEQ ID NO: 7529408 - DNA, 22 bp, Homo sapiens
ctctggctcccgcagcccccat

SEQ ID NO: 7529409 - DNA, 22 bp, Homo sapiens
tttggaataatcagatcctagt

SEQ ID NO: 7529410 - DNA, 22 bp, Homo sapiens
tttggaagtcctgaaatagagg

SEQ ID NO: 7529411 - DNA, 22 bp, Homo sapiens
tttggaagtcctgaaatagagg

SEQ ID NO: 7529412 - DNA, 22 bp, Homo sapiens
tttggaagtcctgaaatagagg

SEQ ID NO: 7529413 - DNA, 20 bp, Homo sapiens
ctctggctccgcgtgaccgc

SEQ ID NO: 7529414 - DNA, 22 bp, Homo sapiens
ctctggctcccgcagcccccat

SEQ ID NO: 7529415 - DNA, 22 bp, Homo sapiens
ctctggctcccgcagcccccat

SEQ ID NO: 7529416 - DNA, 22 bp, Homo sapiens
ctctggctcccgcagcccccat

SEQ ID NO: 7529417 - DNA, 22 bp, Homo sapiens
tttggaatattaaaatgtctca

SEQ ID NO: 7529418 - DNA, 22 bp, Homo sapiens
tttggaatattaaaatgtctca

SEQ ID NO: 7529419 - DNA, 22 bp, Homo sapiens
tttggaatattaaaatgtctca

SEQ ID NO: 7529420 - DNA, 22 bp, Homo sapiens
tttggaatattaaaatgtctca

SEQ ID NO: 7529421 - DNA, 22 bp, Homo sapiens
tttggaatagcatagaagctca

SEQ ID NO: 7529422 - DNA, 22 bp, Homo sapiens
tttggaatagcatagaagctca

SEQ ID NO: 7529423 - DNA, 22 bp, Homo sapiens
tttggaatattgagaaagtgaa

SEQ ID NO: 7529424 - DNA, 22 bp, Homo sapiens
tttggaatcatagatatattca

SEQ ID NO: 7529425 - DNA, 22 bp, Homo sapiens
tttggaatcatagatatattca

SEQ ID NO: 7529426 - DNA, 22 bp, Homo sapiens
tttggaatcatagatatattca

SEQ ID NO: 7529427 - DNA, 22 bp, Homo sapiens
tttggaatcctcagtatgatca

SEQ ID NO: 7529428 - DNA, 22 bp, Homo sapiens
tttggaatcctcagtatgatca

SEQ ID NO: 7529429 - DNA, 22 bp, Homo sapiens
tttggaatgacagatatcaata

SEQ ID NO: 7529430 - DNA, 22 bp, Homo sapiens
tttggaatgacagatatcaata

SEQ ID NO: 7529431 - DNA, 22 bp, Homo sapiens
tttggaatgcccatggactggt

SEQ ID NO: 7529432 - DNA, 22 bp, Homo sapiens
tttggaatggaatagagattgc

SEQ ID NO: 7529433 - DNA, 22 bp, Homo sapiens
tttggaatggaatagagattgc

SEQ ID NO: 7529434 - DNA, 22 bp, Homo sapiens
tttggaatctgagggcttagtt

SEQ ID NO: 7529435 - DNA, 22 bp, Homo sapiens
tttggaatgaaacagcagagcc

SEQ ID NO: 7529436 - DNA, 22 bp, Homo sapiens
tttggaatctgagggcttagtt

SEQ ID NO: 7529437 - DNA, 22 bp, Homo sapiens
tttggaatgaaacagcagagcc

SEQ ID NO: 7529438 - DNA, 22 bp, Homo sapiens
tttggaatgaaacagcagagcc

SEQ ID NO: 7529439 - DNA, 22 bp, Homo sapiens
tttggaatgtagtttaatcatc

SEQ ID NO: 7529440 - DNA, 22 bp, Homo sapiens
tttggaatggtgctgtacagat

SEQ ID NO: 7529441 - DNA, 22 bp, Homo sapiens
tttggaatgtagtttaatcatc

SEQ ID NO: 7529442 - DNA, 22 bp, Homo sapiens
tttggaatggtgctgtacagat

SEQ ID NO: 7529443 - DNA, 22 bp, Homo sapiens
tttggaatggtaccttcagttg

SEQ ID NO: 7529444 - DNA, 22 bp, Homo sapiens
tttggaatggaatagagattgc

SEQ ID NO: 7529445 - DNA, 22 bp, Homo sapiens
tttggaatggtaccttcagttg

SEQ ID NO: 7529446 - DNA, 22 bp, Homo sapiens
tttggaattcagatggcttagg

SEQ ID NO: 7529447 - DNA, 22 bp, Homo sapiens
tttggaattatgcttaaagttt

SEQ ID NO: 7529448 - DNA, 22 bp, Homo sapiens
tttggaattatgcttaaagttt

SEQ ID NO: 7529449 - DNA, 22 bp, Homo sapiens
tttggaattacttactcaagcc

SEQ ID NO: 7529450 - DNA, 22 bp, Homo sapiens
tttggaattacttactcaagcc

SEQ ID NO: 7529451 - DNA, 22 bp, Homo sapiens
tttggaatgtatttgaccaaag

SEQ ID NO: 7529452 - DNA, 22 bp, Homo sapiens
tttggaatgttaggtgtctcat

SEQ ID NO: 7529453 - DNA, 22 bp, Homo sapiens
tttggaatgttaggtgtctcat

SEQ ID NO: 7529454 - DNA, 22 bp, Homo sapiens
tttggaatggtgctgtacagat

SEQ ID NO: 7529455 - DNA, 22 bp, Homo sapiens
tttggaatgtagtttaatcatc

SEQ ID NO: 7529456 - DNA, 19 bp, Homo sapiens
ctctgggctgcatcttggt

SEQ ID NO: 7529457 - DNA, 20 bp, Homo sapiens
ctctgggctgcaccctcgcc

SEQ ID NO: 7529458 - DNA, 23 bp, Homo sapiens
ctctgggtccgatgtcctgacag

SEQ ID NO: 7529459 - DNA, 19 bp, Homo sapiens
ctctgggctgcatcttggt

SEQ ID NO: 7529460 - DNA, 23 bp, Homo sapiens
ctctgggtccgatgtcctgacag

SEQ ID NO: 7529461 - DNA, 23 bp, Homo sapiens
ctctgggtccgatgtcctgacag

SEQ ID NO: 7529462 - DNA, 22 bp, Homo sapiens
tttggaattctgcagctcatgt

SEQ ID NO: 7529463 - DNA, 22 bp, Homo sapiens
tttggaattccatttctgcatt

SEQ ID NO: 7529464 - DNA, 22 bp, Homo sapiens
tttggaattcagatggcttagg

SEQ ID NO: 7529465 - DNA, 22 bp, Homo sapiens
tttggaattccatttctgcatt

SEQ ID NO: 7529466 - DNA, 22 bp, Homo sapiens
tttggaattccatttctgcatt

SEQ ID NO: 7529467 - DNA, 22 bp, Homo sapiens
tttggaattggaaagtgctgtg

SEQ ID NO: 7529468 - DNA, 22 bp, Homo sapiens
tttggaattccatttctgcatt

SEQ ID NO: 7529469 - DNA, 22 bp, Homo sapiens
tttggaattctgcagctcatgt

SEQ ID NO: 7529470 - DNA, 22 bp, Homo sapiens
tttggaattggaaagtgctgtg

SEQ ID NO: 7529471 - DNA, 22 bp, Homo sapiens
ctctgggctgaatggctgaacc

SEQ ID NO: 7529472 - DNA, 22 bp, Homo sapiens
ctctgtgcttatgctccatggg

SEQ ID NO: 7529473 - DNA, 22 bp, Homo sapiens
ctctgtgcttatgctccatggg

SEQ ID NO: 7529474 - DNA, 22 bp, Homo sapiens
ctctgtgcctcagttttcttct

SEQ ID NO: 7529475 - DNA, 22 bp, Homo sapiens
ctctgtgcctcagttttcttct

SEQ ID NO: 7529476 - DNA, 22 bp, Homo sapiens
ctctgtgcctcagttttcttct

SEQ ID NO: 7529477 - DNA, 22 bp, Homo sapiens
ctctgtgctcccatgctagtaa

SEQ ID NO: 7529478 - DNA, 22 bp, Homo sapiens
ctctgtgcgggccatggtcagg

SEQ ID NO: 7529479 - DNA, 22 bp, Homo sapiens
ctctgtgctcccatgctagtaa

SEQ ID NO: 7529480 - DNA, 22 bp, Homo sapiens
ctctgtgctcccatgctagtaa

SEQ ID NO: 7529481 - DNA, 22 bp, Homo sapiens
ctctgtgccctactgctcagct

SEQ ID NO: 7529482 - DNA, 22 bp, Homo sapiens
ctctgtgccctactgctcagct

SEQ ID NO: 7529483 - DNA, 22 bp, Homo sapiens
ctctgtgccagtctgcactcgg

SEQ ID NO: 7529484 - DNA, 22 bp, Homo sapiens
ctctgtgccagtctgcactcgg

SEQ ID NO: 7529485 - DNA, 22 bp, Homo sapiens
ctctgtgattttgtgagccaga

SEQ ID NO: 7529486 - DNA, 22 bp, Homo sapiens
ctctgtgccagtctgcactcgg

SEQ ID NO: 7529487 - DNA, 22 bp, Homo sapiens
ctctgtgccctactgctcagct

SEQ ID NO: 7529488 - DNA, 22 bp, Homo sapiens
ctctgtgccctactgctcagct

SEQ ID NO: 7529489 - DNA, 22 bp, Homo sapiens
tttgttcattttgagctcatca

SEQ ID NO: 7529490 - DNA, 17 bp, Homo sapiens
tttgttcattgaagaga

SEQ ID NO: 7529491 - DNA, 22 bp, Homo sapiens
tttgttcattttgagctcatca

SEQ ID NO: 7529492 - DNA, 17 bp, Homo sapiens
tttgttcattgaagaga

SEQ ID NO: 7529493 - DNA, 22 bp, Homo sapiens
tttgttcattagtacagttgta

SEQ ID NO: 7529494 - DNA, 17 bp, Homo sapiens
tttgttcattgaagaga

SEQ ID NO: 7529495 - DNA, 22 bp, Homo sapiens
tttgttcattttgagctcatca

SEQ ID NO: 7529496 - DNA, 22 bp, Homo sapiens
tttgttcattttgagctcatca

SEQ ID NO: 7529497 - DNA, 22 bp, Homo sapiens
tttgttcccagatttgctggca

SEQ ID NO: 7529498 - DNA, 22 bp, Homo sapiens
tttgttcattttgagctcatca

SEQ ID NO: 7529499 - DNA, 22 bp, Homo sapiens
tttgttctaacttctgcagaca

SEQ ID NO: 7529500 - DNA, 22 bp, Homo sapiens
tttgttcccagatttgctggca

SEQ ID NO: 7529501 - DNA, 22 bp, Homo sapiens
tttgttctaacttctgcagaca

SEQ ID NO: 7529502 - DNA, 22 bp, Homo sapiens
tttgttctaacttctgcagaca

SEQ ID NO: 7529503 - DNA, 22 bp, Homo sapiens
tttgttctaacttctgcagaca

SEQ ID NO: 7529504 - DNA, 22 bp, Homo sapiens
tttgttctagatcgtgtttgtg

SEQ ID NO: 7529505 - DNA, 22 bp, Homo sapiens
ctctgtgggtatttatatgtat

SEQ ID NO: 7529506 - DNA, 22 bp, Homo sapiens
ctctgtgggggagaggcagctg

SEQ ID NO: 7529507 - DNA, 22 bp, Homo sapiens
ctctgtgggtatttatatgtat

SEQ ID NO: 7529508 - DNA, 22 bp, Homo sapiens
ctctgtggtaaaatagcagtat

SEQ ID NO: 7529509 - DNA, 22 bp, Homo sapiens
ctctgtggtggagtgggtcacc

SEQ ID NO: 7529510 - DNA, 22 bp, Homo sapiens
ctctgtggtggagtgggtcacc

SEQ ID NO: 7529511 - DNA, 22 bp, Homo sapiens
ctctgtggtaaaatagcagtat

SEQ ID NO: 7529512 - DNA, 22 bp, Homo sapiens
ctctgtggtggagtgggtcacc

SEQ ID NO: 7529513 - DNA, 22 bp, Homo sapiens
ctctgtgggccagagaggcccc

SEQ ID NO: 7529514 - DNA, 22 bp, Homo sapiens
ctctgtgggcctgtgctttagt

SEQ ID NO: 7529515 - DNA, 22 bp, Homo sapiens
ctctgtgggcctgtgctttagt

SEQ ID NO: 7529516 - DNA, 22 bp, Homo sapiens
ctctgtgggggagaggcagctg

SEQ ID NO: 7529517 - DNA, 22 bp, Homo sapiens
ctctgtgggggagaggcagctg

SEQ ID NO: 7529518 - DNA, 22 bp, Homo sapiens
ctctgtgggggagaggcagctg

SEQ ID NO: 7529519 - DNA, 22 bp, Homo sapiens
ctctgtgggggagaggcagctg

SEQ ID NO: 7529520 - DNA, 22 bp, Homo sapiens
ctctgtgggggagaggcagctg

SEQ ID NO: 7529521 - DNA, 22 bp, Homo sapiens
ctctgtgggaagctgggtgtga

SEQ ID NO: 7529522 - DNA, 22 bp, Homo sapiens
ctctgtgggaagctgggtgtga

SEQ ID NO: 7529523 - DNA, 22 bp, Homo sapiens
ctctgtgggaggaggagtaggc

SEQ ID NO: 7529524 - DNA, 22 bp, Homo sapiens
ctctgtgggaagctgggtgtga

SEQ ID NO: 7529525 - DNA, 22 bp, Homo sapiens
ctctgtgggaagctgggtgtga

SEQ ID NO: 7529526 - DNA, 22 bp, Homo sapiens
ctctgtgggccagagaggcccc

SEQ ID NO: 7529527 - DNA, 22 bp, Homo sapiens
ctctgtgggaagctgggtgtga

SEQ ID NO: 7529528 - DNA, 22 bp, Homo sapiens
ctctgtgggaggaggagtaggc

SEQ ID NO: 7529529 - DNA, 22 bp, Homo sapiens
ctctgtgggaggaggagtaggc

SEQ ID NO: 7529530 - DNA, 22 bp, Homo sapiens
ctctgtgggccagagaggcccc

SEQ ID NO: 7529531 - DNA, 22 bp, Homo sapiens
ctctgtggcttgcctttctgtc

SEQ ID NO: 7529532 - DNA, 22 bp, Homo sapiens
ctctgtggctacacaaacctcc

SEQ ID NO: 7529533 - DNA, 17 bp, Homo sapiens
ctctgtggaggtgttta

SEQ ID NO: 7529534 - DNA, 22 bp, Homo sapiens
ctctgtggctacacaaacctcc

SEQ ID NO: 7529535 - DNA, 22 bp, Homo sapiens
ctctgtggctacacaaacctcc

SEQ ID NO: 7529536 - DNA, 22 bp, Homo sapiens
ctctgtggcttgcctttctgtc

SEQ ID NO: 7529537 - DNA, 17 bp, Homo sapiens
ctctgtggaggtgttta

SEQ ID NO: 7529538 - DNA, 22 bp, Homo sapiens
ctctgtgcttatgctccatggg

SEQ ID NO: 7529539 - DNA, 22 bp, Homo sapiens
ctctgtggaagaagaaagaagg

SEQ ID NO: 7529540 - DNA, 22 bp, Homo sapiens
ttttgcctgcactgtatatata

SEQ ID NO: 7529541 - DNA, 22 bp, Homo sapiens
ttttgctgcattgaagtcagat

SEQ ID NO: 7529542 - DNA, 22 bp, Homo sapiens
ttttgctggggtggctagctta

SEQ ID NO: 7529543 - DNA, 22 bp, Homo sapiens
ttttgctggtttatctctatta

SEQ ID NO: 7529544 - DNA, 22 bp, Homo sapiens
ttttgctggggtggctagctta

SEQ ID NO: 7529545 - DNA, 22 bp, Homo sapiens
ttttgctggggtggctagctta

SEQ ID NO: 7529546 - DNA, 22 bp, Homo sapiens
ttttgcctgtgaatactatctt

SEQ ID NO: 7529547 - DNA, 22 bp, Homo sapiens
ttttgcctgcactgtatatata

SEQ ID NO: 7529548 - DNA, 22 bp, Homo sapiens
ttttgcctgagagtgaaaataa

SEQ ID NO: 7529549 - DNA, 22 bp, Homo sapiens
ttttgcctgagatccgagtctg

SEQ ID NO: 7529550 - DNA, 22 bp, Homo sapiens
ttttgcctgcactgtatatata

SEQ ID NO: 7529551 - DNA, 22 bp, Homo sapiens
ttttgcctgagatccgagtctg

SEQ ID NO: 7529552 - DNA, 22 bp, Homo sapiens
ttttgcttaatctagattttgc

SEQ ID NO: 7529553 - DNA, 22 bp, Homo sapiens
ttttgcttaatctagattttgc

SEQ ID NO: 7529554 - DNA, 22 bp, Homo sapiens
ttttgcttaatctagattttgc

SEQ ID NO: 7529555 - DNA, 22 bp, Homo sapiens
ttttgcttatctgagtgcagcc

SEQ ID NO: 7529556 - DNA, 22 bp, Homo sapiens
ttttgcttaatctagattttgc

SEQ ID NO: 7529557 - DNA, 22 bp, Homo sapiens
ttttgcttaatctagattttgc

SEQ ID NO: 7529558 - DNA, 22 bp, Homo sapiens
ttttgcttaatctagattttgc

SEQ ID NO: 7529559 - DNA, 22 bp, Homo sapiens
ttttgctgttatatgctattat

SEQ ID NO: 7529560 - DNA, 21 bp, Homo sapiens
ttttgctgttttagaatgaga

SEQ ID NO: 7529561 - DNA, 21 bp, Homo sapiens
ttttgctgttttagaatgaga

SEQ ID NO: 7529562 - DNA, 22 bp, Homo sapiens
ttttgctgtgtccttgagccgg

SEQ ID NO: 7529563 - DNA, 22 bp, Homo sapiens
ttttctcttccctctggacctg

SEQ ID NO: 7529564 - DNA, 22 bp, Homo sapiens
ttttgcctaagaatctctctga

SEQ ID NO: 7529565 - DNA, 22 bp, Homo sapiens
ttttctcttccctctggacctg

SEQ ID NO: 7529566 - DNA, 22 bp, Homo sapiens
ttttgcctaagaatctctctga

SEQ ID NO: 7529567 - DNA, 22 bp, Homo sapiens
ttttctcttccctctggacctg

SEQ ID NO: 7529568 - DNA, 17 bp, Homo sapiens
ttttctctcttggattc

SEQ ID NO: 7529569 - DNA, 22 bp, Homo sapiens
ttttgcctgagagtgaaaataa

SEQ ID NO: 7529570 - DNA, 22 bp, Homo sapiens
ttttgcctgagagtgaaaataa

SEQ ID NO: 7529571 - DNA, 22 bp, Homo sapiens
ttttgcctagggttgacccgtt

SEQ ID NO: 7529572 - DNA, 21 bp, Homo sapiens
ctctgtgttgagggtgttgag

SEQ ID NO: 7529573 - DNA, 22 bp, Homo sapiens
ctctgtgttccgggttgctgct

SEQ ID NO: 7529574 - DNA, 21 bp, Homo sapiens
ctctgtgttgagggtgttgag

SEQ ID NO: 7529575 - DNA, 21 bp, Homo sapiens
ctctgtgttgagggtgttgag

SEQ ID NO: 7529576 - DNA, 22 bp, Homo sapiens
ttttctctccaggtggggtgat

SEQ ID NO: 7529577 - DNA, 17 bp, Homo sapiens
ttttctctcttggattc

SEQ ID NO: 7529578 - DNA, 17 bp, Homo sapiens
ttttctctcttggattc

SEQ ID NO: 7529579 - DNA, 17 bp, Homo sapiens
ttttctctcttggattc

SEQ ID NO: 7529580 - DNA, 17 bp, Homo sapiens
ttttctctcttggattc

SEQ ID NO: 7529581 - DNA, 17 bp, Homo sapiens
ttttctctcttggattc

SEQ ID NO: 7529582 - DNA, 22 bp, Homo sapiens
ctctgtgttccgggttgctgct

SEQ ID NO: 7529583 - DNA, 22 bp, Homo sapiens
ctctgtgttccgggttgctgct

SEQ ID NO: 7529584 - DNA, 22 bp, Homo sapiens
ctctgtgttccgggttgctgct

SEQ ID NO: 7529585 - DNA, 22 bp, Homo sapiens
ctctgtgttccgggttgctgct

SEQ ID NO: 7529586 - DNA, 22 bp, Homo sapiens
ctctgtgttccgggttgctgct

SEQ ID NO: 7529587 - DNA, 22 bp, Homo sapiens
ctctgtgttcagcctagcagaa

SEQ ID NO: 7529588 - DNA, 22 bp, Homo sapiens
ctctgtgttcagcctagcagaa

SEQ ID NO: 7529589 - DNA, 22 bp, Homo sapiens
ctctgtgttcagcctagcagaa

SEQ ID NO: 7529590 - DNA, 22 bp, Homo sapiens
ctctgtgtggtcctctgtattg

SEQ ID NO: 7529591 - DNA, 22 bp, Homo sapiens
ctctgtgtggtcctctgtattg

SEQ ID NO: 7529592 - DNA, 22 bp, Homo sapiens
ctctgtgtggtatgattgtcat

SEQ ID NO: 7529593 - DNA, 22 bp, Homo sapiens
ctctgtgtggtatgattgtcat

SEQ ID NO: 7529594 - DNA, 22 bp, Homo sapiens
ctctgtgttcagcctagcagaa

SEQ ID NO: 7529595 - DNA, 22 bp, Homo sapiens
ctctgtgttcagcctagcagaa

SEQ ID NO: 7529596 - DNA, 22 bp, Homo sapiens
ctctgtgtggtcctctgtattg

SEQ ID NO: 7529597 - DNA, 22 bp, Homo sapiens
ctctgtgtggtcctctgtattg

SEQ ID NO: 7529598 - DNA, 22 bp, Homo sapiens
ctctgtgtggtcctctgtattg

SEQ ID NO: 7529599 - DNA, 22 bp, Homo sapiens
ctctgtgtgctggtggggtcct

SEQ ID NO: 7529600 - DNA, 22 bp, Homo sapiens
ctctgtgtgctggtggggtcct

SEQ ID NO: 7529601 - DNA, 22 bp, Homo sapiens
ctctgtgtgctggtggggtcct

SEQ ID NO: 7529602 - DNA, 22 bp, Homo sapiens
ctctgtgtgctggtggggtcct

SEQ ID NO: 7529603 - DNA, 22 bp, Homo sapiens
ctctgtgtctgagttatggtct

SEQ ID NO: 7529604 - DNA, 22 bp, Homo sapiens
ctctgtgtctgagttatggtct

SEQ ID NO: 7529605 - DNA, 22 bp, Homo sapiens
ctctgtgtcagctgggtgtgca

SEQ ID NO: 7529606 - DNA, 22 bp, Homo sapiens
ctctgtgtcagctgggtgtgca

SEQ ID NO: 7529607 - DNA, 22 bp, Homo sapiens
ctctgtgtctgaagccctattt

SEQ ID NO: 7529608 - DNA, 22 bp, Homo sapiens
ctctgtgtatccaagttcaggt

SEQ ID NO: 7529609 - DNA, 22 bp, Homo sapiens
ctctgtgtcagctgggtgtgca

SEQ ID NO: 7529610 - DNA, 22 bp, Homo sapiens
ctctgtggttagactatggctg

SEQ ID NO: 7529611 - DNA, 22 bp, Homo sapiens
ctctgtgtatccaagttcaggt

SEQ ID NO: 7529612 - DNA, 22 bp, Homo sapiens
ctctgtgtatccaagttcaggt

SEQ ID NO: 7529613 - DNA, 22 bp, Homo sapiens
ctctgtggttagactatggctg

SEQ ID NO: 7529614 - DNA, 22 bp, Homo sapiens
ctctgtggttagactatggctg

SEQ ID NO: 7529615 - DNA, 22 bp, Homo sapiens
ctctgtggttagactatggctg

SEQ ID NO: 7529616 - DNA, 22 bp, Homo sapiens
ctctgtggttagactatggctg

SEQ ID NO: 7529617 - DNA, 22 bp, Homo sapiens
ctctgtggtggagtgggtcacc

SEQ ID NO: 7529618 - DNA, 22 bp, Homo sapiens
ctctgtggtggagtgggtcacc

SEQ ID NO: 7529619 - DNA, 22 bp, Homo sapiens
ctctgtggttagactatggctg

SEQ ID NO: 7529620 - DNA, 22 bp, Homo sapiens
tttgaaactcatgatcatcact

SEQ ID NO: 7529621 - DNA, 22 bp, Homo sapiens
tttgaaactcatgatcatcact

SEQ ID NO: 7529622 - DNA, 22 bp, Homo sapiens
tttgaaactctgaacatgtttc

SEQ ID NO: 7529623 - DNA, 22 bp, Homo sapiens
tttgaaactctgaacatgtttc

SEQ ID NO: 7529624 - DNA, 22 bp, Homo sapiens
tttgaaactctgaacatgtttc

SEQ ID NO: 7529625 - DNA, 22 bp, Homo sapiens
tttgaaactctgaacatgtttc

SEQ ID NO: 7529626 - DNA, 22 bp, Homo sapiens
tttgaaagaaaccagtgagtga

SEQ ID NO: 7529627 - DNA, 22 bp, Homo sapiens
tttgaaagaaaccagtgagtga

SEQ ID NO: 7529628 - DNA, 22 bp, Homo sapiens
tttgaaagacagaatatttttg

SEQ ID NO: 7529629 - DNA, 22 bp, Homo sapiens
tttgaaagacagaatatttttg

SEQ ID NO: 7529630 - DNA, 22 bp, Homo sapiens
tttgaaagacagaatatttttg

SEQ ID NO: 7529631 - DNA, 22 bp, Homo sapiens
tttgaaagacagaatatttttg

SEQ ID NO: 7529632 - DNA, 22 bp, Homo sapiens
tttgaaagaatttatgtacttt

SEQ ID NO: 7529633 - DNA, 22 bp, Homo sapiens
tttgaaagaatttatgtacttt

SEQ ID NO: 7529634 - DNA, 22 bp, Homo sapiens
tttgaaagaatttatgtacttt

SEQ ID NO: 7529635 - DNA, 22 bp, Homo sapiens
tttgaaacaggtgattcagcta

SEQ ID NO: 7529636 - DNA, 22 bp, Homo sapiens
tttgaaacccgtcactttgagt

SEQ ID NO: 7529637 - DNA, 22 bp, Homo sapiens
tttgaaacccgtcactttgagt

SEQ ID NO: 7529638 - DNA, 22 bp, Homo sapiens
tttgaaacctagttatatgact

SEQ ID NO: 7529639 - DNA, 22 bp, Homo sapiens
tttgaaacctagttatatgact

SEQ ID NO: 7529640 - DNA, 22 bp, Homo sapiens
tttgaaacctagttatatgact

SEQ ID NO: 7529641 - DNA, 22 bp, Homo sapiens
tttgaaacctagttatatgact

SEQ ID NO: 7529642 - DNA, 22 bp, Homo sapiens
tttgaaacctagttatatgact

SEQ ID NO: 7529643 - DNA, 22 bp, Homo sapiens
tttgaaaattagacacaggcta

SEQ ID NO: 7529644 - DNA, 22 bp, Homo sapiens
tttgaaaattagacacaggcta

SEQ ID NO: 7529645 - DNA, 22 bp, Homo sapiens
tttgaaaattagacacaggcta

SEQ ID NO: 7529646 - DNA, 22 bp, Homo sapiens
tttgaaaatttaagtgctacac

SEQ ID NO: 7529647 - DNA, 22 bp, Homo sapiens
tttgaaaatttaagtgctacac

SEQ ID NO: 7529648 - DNA, 22 bp, Homo sapiens
tttgaaaatttaagtgctacac

SEQ ID NO: 7529649 - DNA, 22 bp, Homo sapiens
tttgaaaatttaagtgctacac

SEQ ID NO: 7529650 - DNA, 22 bp, Homo sapiens
tttgaaaatttaagtgctacac

SEQ ID NO: 7529651 - DNA, 22 bp, Homo sapiens
tttgaaaaaggcctttggtatg

SEQ ID NO: 7529652 - DNA, 22 bp, Homo sapiens
tttgaaaacttaatttggtcgt

SEQ ID NO: 7529653 - DNA, 22 bp, Homo sapiens
tttgaaaacttaatttggtcgt

SEQ ID NO: 7529654 - DNA, 22 bp, Homo sapiens
tttgaaaacttaatttggtcgt

SEQ ID NO: 7529655 - DNA, 22 bp, Homo sapiens
tttgaaaagaaccatcgcctta

SEQ ID NO: 7529656 - DNA, 22 bp, Homo sapiens
tttgaaaagaaccatcgcctta

SEQ ID NO: 7529657 - DNA, 22 bp, Homo sapiens
tttgaaaagaaccatcgcctta

SEQ ID NO: 7529658 - DNA, 22 bp, Homo sapiens
tttgaaaaaggcctttggtatg

SEQ ID NO: 7529659 - DNA, 22 bp, Homo sapiens
tttcttgtaagatgtttattaa

SEQ ID NO: 7529660 - DNA, 22 bp, Homo sapiens
tttcttgtaagatgtttattaa

SEQ ID NO: 7529661 - DNA, 22 bp, Homo sapiens
tttcttgtaagatgtttattaa

SEQ ID NO: 7529662 - DNA, 22 bp, Homo sapiens
tttcttgtaaaagctgtgggaa

SEQ ID NO: 7529663 - DNA, 22 bp, Homo sapiens
tttcttggagctcttagggtcg

SEQ ID NO: 7529664 - DNA, 22 bp, Homo sapiens
tttcttggatgtgaaactaggg

SEQ ID NO: 7529665 - DNA, 22 bp, Homo sapiens
tttcttgggttccagttcccag

SEQ ID NO: 7529666 - DNA, 22 bp, Homo sapiens
ctctgaagggagggccaagccc

SEQ ID NO: 7529667 - DNA, 22 bp, Homo sapiens
ctctgaagggagggccaagccc

SEQ ID NO: 7529668 - DNA, 22 bp, Homo sapiens
ctctgaaggtttctgttactgt

SEQ ID NO: 7529669 - DNA, 22 bp, Homo sapiens
ctctgaagccccaaatagtccg

SEQ ID NO: 7529670 - DNA, 22 bp, Homo sapiens
ctctgaagccccaaatagtccg

SEQ ID NO: 7529671 - DNA, 22 bp, Homo sapiens
ctctgaagatggtaccagcttt

SEQ ID NO: 7529672 - DNA, 18 bp, Homo sapiens
ctctgaacatctttctgg

SEQ ID NO: 7529673 - DNA, 22 bp, Homo sapiens
ctctgaagatggtaccagcttt

SEQ ID NO: 7529674 - DNA, 22 bp, Homo sapiens
ctctgaagatggtaccagcttt

SEQ ID NO: 7529675 - DNA, 22 bp, Homo sapiens
ctctgaaggtttctgttactgt

SEQ ID NO: 7529676 - DNA, 22 bp, Homo sapiens
ctctgaatactttaagaattgt

SEQ ID NO: 7529677 - DNA, 21 bp, Homo sapiens
ctctgaatcctgcttctcagt

SEQ ID NO: 7529678 - DNA, 21 bp, Homo sapiens
ctctgaatcctgcttctcagt

SEQ ID NO: 7529679 - DNA, 22 bp, Homo sapiens
ctctgaatggacactccagtgt

SEQ ID NO: 7529680 - DNA, 22 bp, Homo sapiens
ctctgacaagacagaccataac

SEQ ID NO: 7529681 - DNA, 22 bp, Homo sapiens
ctctgacaagacagaccataac

SEQ ID NO: 7529682 - DNA, 22 bp, Homo sapiens
ctctgacaccatctcatgacag

SEQ ID NO: 7529683 - DNA, 22 bp, Homo sapiens
ctctgacaccatctcatgacag

SEQ ID NO: 7529684 - DNA, 22 bp, Homo sapiens
ctctgacaccatctcatgacag

SEQ ID NO: 7529685 - DNA, 22 bp, Homo sapiens
tttcttgccagagaaaaagagt

SEQ ID NO: 7529686 - DNA, 22 bp, Homo sapiens
tttcttgattagctgtggctca

SEQ ID NO: 7529687 - DNA, 22 bp, Homo sapiens
tttcttgattagctgtggctca

SEQ ID NO: 7529688 - DNA, 22 bp, Homo sapiens
ctctgacagccacatagaggct

SEQ ID NO: 7529689 - DNA, 22 bp, Homo sapiens
ctctgacagccacatagaggct

SEQ ID NO: 7529690 - DNA, 22 bp, Homo sapiens
tttcttgattagctgtggctca

SEQ ID NO: 7529691 - DNA, 22 bp, Homo sapiens
ctctgcaatctgagcacttgta

SEQ ID NO: 7529692 - DNA, 22 bp, Homo sapiens
ctctgcaatctgagcacttgta

SEQ ID NO: 7529693 - DNA, 22 bp, Homo sapiens
ctctgcaagtccagcccctggc

SEQ ID NO: 7529694 - DNA, 22 bp, Homo sapiens
ctctgcaagtccagcccctggc

SEQ ID NO: 7529695 - DNA, 22 bp, Homo sapiens
ctctgcaaggccctccagtagc

SEQ ID NO: 7529696 - DNA, 22 bp, Homo sapiens
ctctgatttccttattctgtca

SEQ ID NO: 7529697 - DNA, 22 bp, Homo sapiens
ctctgcacctacacaacaggaa

SEQ ID NO: 7529698 - DNA, 22 bp, Homo sapiens
ctctgcacctacacaacaggaa

SEQ ID NO: 7529699 - DNA, 22 bp, Homo sapiens
ctctgcacctacacaacaggaa

SEQ ID NO: 7529700 - DNA, 22 bp, Homo sapiens
ctctgcacccccggctcctcgt

SEQ ID NO: 7529701 - DNA, 22 bp, Homo sapiens
ctctgaggtttcctcacaagct

SEQ ID NO: 7529702 - DNA, 22 bp, Homo sapiens
ctctgaggtttcctcacaagct

SEQ ID NO: 7529703 - DNA, 22 bp, Homo sapiens
ctctgcaacttctagcagtgtc

SEQ ID NO: 7529704 - DNA, 22 bp, Homo sapiens
ctctgcaacttctagcagtgtc

SEQ ID NO: 7529705 - DNA, 22 bp, Homo sapiens
ctctgcaacttctagcagtgtc

SEQ ID NO: 7529706 - DNA, 22 bp, Homo sapiens
ctctgatttatattataaagtg

SEQ ID NO: 7529707 - DNA, 22 bp, Homo sapiens
ctctgatgtctgggggctggat

SEQ ID NO: 7529708 - DNA, 22 bp, Homo sapiens
ctctgatgtctgggggctggat

SEQ ID NO: 7529709 - DNA, 22 bp, Homo sapiens
ctctgagtttcatttccctcct

SEQ ID NO: 7529710 - DNA, 22 bp, Homo sapiens
ctctgagtttcatttccctcct

SEQ ID NO: 7529711 - DNA, 22 bp, Homo sapiens
ctctgaggttcctttgccctcg

SEQ ID NO: 7529712 - DNA, 22 bp, Homo sapiens
ctctgaggttccctgggtccca

SEQ ID NO: 7529713 - DNA, 22 bp, Homo sapiens
ctctgaggttccctgggtccca

SEQ ID NO: 7529714 - DNA, 22 bp, Homo sapiens
ctctgaggttccctgggtccca

SEQ ID NO: 7529715 - DNA, 22 bp, Homo sapiens
ctctgaggtttcctcacaagct

SEQ ID NO: 7529716 - DNA, 22 bp, Homo sapiens
ctctgaggtttcctcacaagct

SEQ ID NO: 7529717 - DNA, 22 bp, Homo sapiens
ctctgaggttcctttgccctcg

SEQ ID NO: 7529718 - DNA, 22 bp, Homo sapiens
ctctgaggtctaggaccatggc

SEQ ID NO: 7529719 - DNA, 22 bp, Homo sapiens
ctctgaggtctaggaccatggc

SEQ ID NO: 7529720 - DNA, 22 bp, Homo sapiens
ctctgaggtctaggaccatggc

SEQ ID NO: 7529721 - DNA, 22 bp, Homo sapiens
ctctgaggttccctgggtccca

SEQ ID NO: 7529722 - DNA, 22 bp, Homo sapiens
tttgaaagagctgatacatgaa

SEQ ID NO: 7529723 - DNA, 19 bp, Homo sapiens
tttgaaagagttttattgg

SEQ ID NO: 7529724 - DNA, 22 bp, Homo sapiens
ctctgaggtctaggaccatggc

SEQ ID NO: 7529725 - DNA, 19 bp, Homo sapiens
tttgaaagagttttattgg

SEQ ID NO: 7529726 - DNA, 19 bp, Homo sapiens
tttgaaagagttttattgg

SEQ ID NO: 7529727 - DNA, 22 bp, Homo sapiens
tttgacctctggaccctctgaa

SEQ ID NO: 7529728 - DNA, 18 bp, Homo sapiens
tttgaccctcagtgccat

SEQ ID NO: 7529729 - DNA, 22 bp, Homo sapiens
tttgaccctgttattctccctg

SEQ ID NO: 7529730 - DNA, 20 bp, Homo sapiens
tttgacctttatgaagataa

SEQ ID NO: 7529731 - DNA, 20 bp, Homo sapiens
tttgactaggtaagtgcttt

SEQ ID NO: 7529732 - DNA, 22 bp, Homo sapiens
tttgacctccagaactataaga

SEQ ID NO: 7529733 - DNA, 22 bp, Homo sapiens
tttgaccttgttggtaggtatt

SEQ ID NO: 7529734 - DNA, 19 bp, Homo sapiens
tttgacgttgaatatcact

SEQ ID NO: 7529735 - DNA, 22 bp, Homo sapiens
tttgactcaagcctttctttag

SEQ ID NO: 7529736 - DNA, 22 bp, Homo sapiens
tttgactcattgattttctctg

SEQ ID NO: 7529737 - DNA, 22 bp, Homo sapiens
tttgaatagaggcccctcagaa

SEQ ID NO: 7529738 - DNA, 22 bp, Homo sapiens
tttgacattggcttattctgtt

SEQ ID NO: 7529739 - DNA, 22 bp, Homo sapiens
tttgaatagcataggattacat

SEQ ID NO: 7529740 - DNA, 21 bp, Homo sapiens
tttgaatagaaatagtgctta

SEQ ID NO: 7529741 - DNA, 21 bp, Homo sapiens
tttgaatagaaatagtgctta

SEQ ID NO: 7529742 - DNA, 21 bp, Homo sapiens
tttgaatagaaatagtgctta

SEQ ID NO: 7529743 - DNA, 22 bp, Homo sapiens
ctctgcagaggcccaaggctga

SEQ ID NO: 7529744 - DNA, 22 bp, Homo sapiens
tttgaataatcactgggcatta

SEQ ID NO: 7529745 - DNA, 22 bp, Homo sapiens
ctctgcactgtccggctttctt

SEQ ID NO: 7529746 - DNA, 22 bp, Homo sapiens
ctctgcactgtccggctttctt

SEQ ID NO: 7529747 - DNA, 22 bp, Homo sapiens
ctctgcagaatttgagctgctc

SEQ ID NO: 7529748 - DNA, 22 bp, Homo sapiens
ctctgcagaatttgagctgctc

SEQ ID NO: 7529749 - DNA, 22 bp, Homo sapiens
ctctgcagaatttgagctgctc

SEQ ID NO: 7529750 - DNA, 22 bp, Homo sapiens
ctctgcaccttgtaggaggcaa

SEQ ID NO: 7529751 - DNA, 22 bp, Homo sapiens
ctctgcaccttgtaggaggcaa

SEQ ID NO: 7529752 - DNA, 22 bp, Homo sapiens
ctctgcactgtccggctttctt

SEQ ID NO: 7529753 - DNA, 22 bp, Homo sapiens
ctctgcaccttgtaggaggcaa

SEQ ID NO: 7529754 - DNA, 22 bp, Homo sapiens
ctctgcaccttgtaggaggcaa

SEQ ID NO: 7529755 - DNA, 22 bp, Homo sapiens
ctctgcagaggcccaaggctga

SEQ ID NO: 7529756 - DNA, 22 bp, Homo sapiens
ctctgcagaggcccaaggctga

SEQ ID NO: 7529757 - DNA, 22 bp, Homo sapiens
ctctgcagaggcccaaggctga

SEQ ID NO: 7529758 - DNA, 22 bp, Homo sapiens
ctctgcagaatttgagctgctc

SEQ ID NO: 7529759 - DNA, 22 bp, Homo sapiens
ctctgcagaatttgagctgctc

SEQ ID NO: 7529760 - DNA, 22 bp, Homo sapiens
ctctgcagaatttgagctgctc

SEQ ID NO: 7529761 - DNA, 22 bp, Homo sapiens
ctctgcagagcctccagcccag

SEQ ID NO: 7529762 - DNA, 22 bp, Homo sapiens
ctctgcagagcctccagcccag

SEQ ID NO: 7529763 - DNA, 22 bp, Homo sapiens
ctctgcagagcctccagcccag

SEQ ID NO: 7529764 - DNA, 18 bp, Homo sapiens
tttgcaaaggaagtatgg

SEQ ID NO: 7529765 - DNA, 18 bp, Homo sapiens
tttgcaaaggaagtatgg

SEQ ID NO: 7529766 - DNA, 18 bp, Homo sapiens
tttgcaaaggaagtatgg

SEQ ID NO: 7529767 - DNA, 18 bp, Homo sapiens
tttgcaaaggaagtatgg

SEQ ID NO: 7529768 - DNA, 22 bp, Homo sapiens
tttgcaaagaaattattgctgt

SEQ ID NO: 7529769 - DNA, 22 bp, Homo sapiens
tttgcaaagaaattattgctgt

SEQ ID NO: 7529770 - DNA, 22 bp, Homo sapiens
tttgcaaagaaattattgctgt

SEQ ID NO: 7529771 - DNA, 22 bp, Homo sapiens
tttgcaaactttcctctggacc

SEQ ID NO: 7529772 - DNA, 22 bp, Homo sapiens
tttgcaaactttcctctggacc

SEQ ID NO: 7529773 - DNA, 22 bp, Homo sapiens
tttgcaaagaaattattgctgt

SEQ ID NO: 7529774 - DNA, 22 bp, Homo sapiens
tttgcaaagaaattattgctgt

SEQ ID NO: 7529775 - DNA, 22 bp, Homo sapiens
tttgcaaagtgactattatatg

SEQ ID NO: 7529776 - DNA, 22 bp, Homo sapiens
tttgcaaagtgactattatatg

SEQ ID NO: 7529777 - DNA, 22 bp, Homo sapiens
tttgcaaagtccctgggatgga

SEQ ID NO: 7529778 - DNA, 22 bp, Homo sapiens
tttgcaaagtccattgaagtta

SEQ ID NO: 7529779 - DNA, 22 bp, Homo sapiens
tttgcaaagtccattgaagtta

SEQ ID NO: 7529780 - DNA, 22 bp, Homo sapiens
tttgcaaagtccattgaagtta

SEQ ID NO: 7529781 - DNA, 18 bp, Homo sapiens
tttgcaaaggaagtatgg

SEQ ID NO: 7529782 - DNA, 18 bp, Homo sapiens
tttgcaaaggaagtatgg

SEQ ID NO: 7529783 - DNA, 18 bp, Homo sapiens
tttgcaaaggaagtatgg

SEQ ID NO: 7529784 - DNA, 20 bp, Homo sapiens
ctctggcaaaggatgcctat

SEQ ID NO: 7529785 - DNA, 20 bp, Homo sapiens
ctctggcaaaggatgcctat

SEQ ID NO: 7529786 - DNA, 22 bp, Homo sapiens
ctctggagtgggtggccgggag

SEQ ID NO: 7529787 - DNA, 22 bp, Homo sapiens
tttgcaaagtgcttgcagagta

SEQ ID NO: 7529788 - DNA, 22 bp, Homo sapiens
tttgcaaagtgcttgcagagta

SEQ ID NO: 7529789 - DNA, 22 bp, Homo sapiens
tttgcaaagtgcttgcagagta

SEQ ID NO: 7529790 - DNA, 22 bp, Homo sapiens
ctctggagtgcagcctggtggc

SEQ ID NO: 7529791 - DNA, 22 bp, Homo sapiens
tttgcaaagtgcttgcagagta

SEQ ID NO: 7529792 - DNA, 22 bp, Homo sapiens
ctctggagtgcagcctggtggc

SEQ ID NO: 7529793 - DNA, 22 bp, Homo sapiens
tttgcaaagtgactattatatg

SEQ ID NO: 7529794 - DNA, 22 bp, Homo sapiens
tttgcaaagtgactattatatg

SEQ ID NO: 7529795 - DNA, 22 bp, Homo sapiens
tttgcaaagtgactattatatg

SEQ ID NO: 7529796 - DNA, 22 bp, Homo sapiens
tttgcaaagtgactattatatg

SEQ ID NO: 7529797 - DNA, 22 bp, Homo sapiens
ctctggccgagcatgggggtta

SEQ ID NO: 7529798 - DNA, 22 bp, Homo sapiens
ctctggccgagcatgggggtta

SEQ ID NO: 7529799 - DNA, 22 bp, Homo sapiens
ctctggccgcagctcagctctg

SEQ ID NO: 7529800 - DNA, 22 bp, Homo sapiens
ctctggccgcagctcagctctg

SEQ ID NO: 7529801 - DNA, 22 bp, Homo sapiens
ctctggccgcagctcagctctg

SEQ ID NO: 7529802 - DNA, 22 bp, Homo sapiens
ctctggccgcagctcagctctg

SEQ ID NO: 7529803 - DNA, 22 bp, Homo sapiens
ctctggccccagtggccccttg

SEQ ID NO: 7529804 - DNA, 22 bp, Homo sapiens
ctctggccgagcatgggggtta

SEQ ID NO: 7529805 - DNA, 19 bp, Homo sapiens
ctctggcctctggatgctg

SEQ ID NO: 7529806 - DNA, 19 bp, Homo sapiens
ctctggcctctggatgctg

SEQ ID NO: 7529807 - DNA, 22 bp, Homo sapiens
ctctggccgcagctcagctctg

SEQ ID NO: 7529808 - DNA, 22 bp, Homo sapiens
ctctggccagagcctgcgggaa

SEQ ID NO: 7529809 - DNA, 22 bp, Homo sapiens
ctctggccagagcctgcgggaa

SEQ ID NO: 7529810 - DNA, 22 bp, Homo sapiens
ctctggccccagtggccccttg

SEQ ID NO: 7529811 - DNA, 22 bp, Homo sapiens
ctctggccccagtggccccttg

SEQ ID NO: 7529812 - DNA, 22 bp, Homo sapiens
ctctggccccagtggccccttg

SEQ ID NO: 7529813 - DNA, 22 bp, Homo sapiens
ctctggccccagtggccccttg

SEQ ID NO: 7529814 - DNA, 22 bp, Homo sapiens
ctctggccagagcctgcgggaa

SEQ ID NO: 7529815 - DNA, 22 bp, Homo sapiens
ctctggcagagctgtagacttc

SEQ ID NO: 7529816 - DNA, 22 bp, Homo sapiens
ctctggcagagctgtagacttc

SEQ ID NO: 7529817 - DNA, 22 bp, Homo sapiens
ctctggcctgcttcctcaggta

SEQ ID NO: 7529818 - DNA, 22 bp, Homo sapiens
ctctggcctgcttcctcaggta

SEQ ID NO: 7529819 - DNA, 22 bp, Homo sapiens
ctctggcctgcagatccatgct

SEQ ID NO: 7529820 - DNA, 22 bp, Homo sapiens
ctctggcctgcttcctcaggta

SEQ ID NO: 7529821 - DNA, 22 bp, Homo sapiens
ctctggcctgcttcctcaggta

SEQ ID NO: 7529822 - DNA, 22 bp, Homo sapiens
ctctggcctgcttcctcaggta

SEQ ID NO: 7529823 - DNA, 22 bp, Homo sapiens
ctctggcctgcttcctcaggta

SEQ ID NO: 7529824 - DNA, 19 bp, Homo sapiens
ctctggcctctggatgctg

SEQ ID NO: 7529825 - DNA, 22 bp, Homo sapiens
ctctggcctgcagatccatgct

SEQ ID NO: 7529826 - DNA, 22 bp, Homo sapiens
ctctggcctgcagatccatgct

SEQ ID NO: 7529827 - DNA, 22 bp, Homo sapiens
ctctggcctgcagatccatgct

SEQ ID NO: 7529828 - DNA, 22 bp, Homo sapiens
ctctggcctgcagatccatgct

SEQ ID NO: 7529829 - DNA, 22 bp, Homo sapiens
ctctggcctggggcctgctccc

SEQ ID NO: 7529830 - DNA, 22 bp, Homo sapiens
ctctggcctggggcctgctccc

SEQ ID NO: 7529831 - DNA, 22 bp, Homo sapiens
ctctggcctggggcctgctccc

SEQ ID NO: 7529832 - DNA, 22 bp, Homo sapiens
ctctggcctggggcctgctccc

SEQ ID NO: 7529833 - DNA, 22 bp, Homo sapiens
ctctggcctggggcctgctccc

SEQ ID NO: 7529834 - DNA, 22 bp, Homo sapiens
ctctggcctgcttcctcaggta

SEQ ID NO: 7529835 - DNA, 22 bp, Homo sapiens
ctctggcctgcttcctcaggta

SEQ ID NO: 7529836 - DNA, 22 bp, Homo sapiens
ctctggcctgcttcctcaggta

SEQ ID NO: 7529837 - DNA, 22 bp, Homo sapiens
ctctggcggccatgctcgtggt

SEQ ID NO: 7529838 - DNA, 22 bp, Homo sapiens
ctctggcctggggcctgctccc

SEQ ID NO: 7529839 - DNA, 22 bp, Homo sapiens
ctctggcctggggcctgctccc

SEQ ID NO: 7529840 - DNA, 22 bp, Homo sapiens
ctctggcctggggcctgctccc

SEQ ID NO: 7529841 - DNA, 22 bp, Homo sapiens
tttgagaagagtttgaggtatt

SEQ ID NO: 7529842 - DNA, 22 bp, Homo sapiens
tttgagaactttggtattttcc

SEQ ID NO: 7529843 - DNA, 22 bp, Homo sapiens
tttgagaactttggtattttcc

SEQ ID NO: 7529844 - DNA, 22 bp, Homo sapiens
tttgagaagatgtaatgttaag

SEQ ID NO: 7529845 - DNA, 22 bp, Homo sapiens
tttgagaagatgtaatgttaag

SEQ ID NO: 7529846 - DNA, 22 bp, Homo sapiens
tttgagaagatgtaatgttaag

SEQ ID NO: 7529847 - DNA, 22 bp, Homo sapiens
tttgagaagatgtaatgttaag

SEQ ID NO: 7529848 - DNA, 22 bp, Homo sapiens
tttgagaagagtttgaggtatt

SEQ ID NO: 7529849 - DNA, 22 bp, Homo sapiens
tttgagaagataggggaatact

SEQ ID NO: 7529850 - DNA, 22 bp, Homo sapiens
tttgcaaaatgaggtgaagagt

SEQ ID NO: 7529851 - DNA, 22 bp, Homo sapiens
tttgcaaaatgtcttgtgttag

SEQ ID NO: 7529852 - DNA, 22 bp, Homo sapiens
tttgcaaaattattcccagcat

SEQ ID NO: 7529853 - DNA, 22 bp, Homo sapiens
tttgcaaaattattcccagcat

SEQ ID NO: 7529854 - DNA, 22 bp, Homo sapiens
tttgcaaaatgaggtgaagagt

SEQ ID NO: 7529855 - DNA, 22 bp, Homo sapiens
tttgagaagcatctggtccact

SEQ ID NO: 7529856 - DNA, 22 bp, Homo sapiens
tttgcaaacggccctgagtccc

SEQ ID NO: 7529857 - DNA, 22 bp, Homo sapiens
tttgcaaacggccctgagtccc

SEQ ID NO: 7529858 - DNA, 22 bp, Homo sapiens
tttgcaaactttcctctggacc

SEQ ID NO: 7529859 - DNA, 22 bp, Homo sapiens
tttgcaaactttcctctggacc

SEQ ID NO: 7529860 - DNA, 22 bp, Homo sapiens
tttgcaaacattcagggctcca

SEQ ID NO: 7529861 - DNA, 22 bp, Homo sapiens
tttgcaaacacttaagaagaga

SEQ ID NO: 7529862 - DNA, 22 bp, Homo sapiens
tttgcaaaccggagctctgcaa

SEQ ID NO: 7529863 - DNA, 22 bp, Homo sapiens
tttgcaaaccggagctctgcaa

SEQ ID NO: 7529864 - DNA, 22 bp, Homo sapiens
tttgcaaaccggagctctgcaa

SEQ ID NO: 7529865 - DNA, 22 bp, Homo sapiens
tttgcaaacacttaagaagaga

SEQ ID NO: 7529866 - DNA, 22 bp, Homo sapiens
tttgcaaacacttaagaagaga

SEQ ID NO: 7529867 - DNA, 22 bp, Homo sapiens
tttgcaaacacttaagaagaga

SEQ ID NO: 7529868 - DNA, 22 bp, Homo sapiens
tttgcaaacacttaagaagaga

SEQ ID NO: 7529869 - DNA, 22 bp, Homo sapiens
tttgcaaacacttaagaagaga

SEQ ID NO: 7529870 - DNA, 22 bp, Homo sapiens
tttgcaaacacttaagaagaga

SEQ ID NO: 7529871 - DNA, 22 bp, Homo sapiens
tttgcaaacacttaagaagaga

SEQ ID NO: 7529872 - DNA, 22 bp, Homo sapiens
tttgcaaacacttaagaagaga

SEQ ID NO: 7529873 - DNA, 22 bp, Homo sapiens
tttgagaaaggggatttaattc

SEQ ID NO: 7529874 - DNA, 22 bp, Homo sapiens
tttgagaaaggggatttaattc

SEQ ID NO: 7529875 - DNA, 22 bp, Homo sapiens
tttgagaaaggggatttaattc

SEQ ID NO: 7529876 - DNA, 22 bp, Homo sapiens
tttgagaaactgattattatgg

SEQ ID NO: 7529877 - DNA, 22 bp, Homo sapiens
tttgagaaccctgtattttaag

SEQ ID NO: 7529878 - DNA, 22 bp, Homo sapiens
tttgagaaccctgtattttaag

SEQ ID NO: 7529879 - DNA, 22 bp, Homo sapiens
tttgagaaccctgtattttaag

SEQ ID NO: 7529880 - DNA, 22 bp, Homo sapiens
tttgagaaccctgtattttaag

SEQ ID NO: 7529881 - DNA, 22 bp, Homo sapiens
tttgagaaatgggctctgtgct

SEQ ID NO: 7529882 - DNA, 22 bp, Homo sapiens
tttgagaaatgggctctgtgct

SEQ ID NO: 7529883 - DNA, 22 bp, Homo sapiens
tttgagaaactgattattatgg

SEQ ID NO: 7529884 - DNA, 22 bp, Homo sapiens
tttgagaaactgattattatgg

SEQ ID NO: 7529885 - DNA, 22 bp, Homo sapiens
tttgagaaacagacgaaagaca

SEQ ID NO: 7529886 - DNA, 22 bp, Homo sapiens
tttgagaaacagacgaaagaca

SEQ ID NO: 7529887 - DNA, 22 bp, Homo sapiens
tttgagaaacagacgaaagaca

SEQ ID NO: 7529888 - DNA, 22 bp, Homo sapiens
tttgagaaacagacgaaagaca

SEQ ID NO: 7529889 - DNA, 22 bp, Homo sapiens
tttgagaaaaccagaaagatct

SEQ ID NO: 7529890 - DNA, 22 bp, Homo sapiens
tttgagaaaaccagaaagatct

SEQ ID NO: 7529891 - DNA, 22 bp, Homo sapiens
tttgagaaaaccagaaagatct

SEQ ID NO: 7529892 - DNA, 22 bp, Homo sapiens
tttgagaaaaagtgatgatgat

SEQ ID NO: 7529893 - DNA, 22 bp, Homo sapiens
tttgagaaaaccagaaagatct

SEQ ID NO: 7529894 - DNA, 22 bp, Homo sapiens
tttgagaaaaccagaaagatct

SEQ ID NO: 7529895 - DNA, 22 bp, Homo sapiens
tttgagaaaaagtgatgatgat

SEQ ID NO: 7529896 - DNA, 22 bp, Homo sapiens
tttgactcctgccttctcctgt

SEQ ID NO: 7529897 - DNA, 22 bp, Homo sapiens
tttgactcctgtgtttctggaa

SEQ ID NO: 7529898 - DNA, 22 bp, Homo sapiens
tttgactcctgtgtttctggaa

SEQ ID NO: 7529899 - DNA, 22 bp, Homo sapiens
tttgactctagtcatagaagtg

SEQ ID NO: 7529900 - DNA, 22 bp, Homo sapiens
tttgactcttgtctcttgttag

SEQ ID NO: 7529901 - DNA, 22 bp, Homo sapiens
tttgactcttagcccaggactc

SEQ ID NO: 7529902 - DNA, 22 bp, Homo sapiens
tttgactgttttatgaggtggt

SEQ ID NO: 7529903 - DNA, 22 bp, Homo sapiens
tttgacttctatctagtaagaa

SEQ ID NO: 7529904 - DNA, 22 bp, Homo sapiens
tttgacttctgggcattttggt

SEQ ID NO: 7529905 - DNA, 22 bp, Homo sapiens
tttgacttctgggcattttggt

SEQ ID NO: 7529906 - DNA, 22 bp, Homo sapiens
ctgcccaggctgaaggaacatc

SEQ ID NO: 7529907 - DNA, 22 bp, Homo sapiens
ctgcccaggctgaaggaacatc

SEQ ID NO: 7529908 - DNA, 22 bp, Homo sapiens
ctgcccaggctgaaggaacatc

SEQ ID NO: 7529909 - DNA, 22 bp, Homo sapiens
ctgcccaggctgaaggaacatc

SEQ ID NO: 7529910 - DNA, 22 bp, Homo sapiens
ctgcccaggaaggagaggatgg

SEQ ID NO: 7529911 - DNA, 22 bp, Homo sapiens
ctgcccaggaaggagaggatgg

SEQ ID NO: 7529912 - DNA, 22 bp, Homo sapiens
ctgcccaggaaggagaggatgg

SEQ ID NO: 7529913 - DNA, 22 bp, Homo sapiens
ctgcccaggaaggagaggatgg

SEQ ID NO: 7529914 - DNA, 22 bp, Homo sapiens
ctgcccaggggagtgctgtcgg

SEQ ID NO: 7529915 - DNA, 22 bp, Homo sapiens
ctgcccaggggagtgctgtcgg

SEQ ID NO: 7529916 - DNA, 22 bp, Homo sapiens
ctgcccaggggagtgctgtcgg

SEQ ID NO: 7529917 - DNA, 22 bp, Homo sapiens
ctgcccaggctgaaggaacatc

SEQ ID NO: 7529918 - DNA, 22 bp, Homo sapiens
ctgcccaggctgaaggaacatc

SEQ ID NO: 7529919 - DNA, 22 bp, Homo sapiens
ctgcccaggggagtgctgtcgg

SEQ ID NO: 7529920 - DNA, 22 bp, Homo sapiens
ctgcccaggggagtgctgtcgg

SEQ ID NO: 7529921 - DNA, 22 bp, Homo sapiens
ctgcccaggggagtgctgtcgg

SEQ ID NO: 7529922 - DNA, 22 bp, Homo sapiens
ctgcccaggggagtgctgtcgg

SEQ ID NO: 7529923 - DNA, 22 bp, Homo sapiens
ctgcccaggggagtgctgtcgg

SEQ ID NO: 7529924 - DNA, 22 bp, Homo sapiens
ctgcccagtttgggagcctttc

SEQ ID NO: 7529925 - DNA, 22 bp, Homo sapiens
ctgcccagtttgggagcctttc

SEQ ID NO: 7529926 - DNA, 22 bp, Homo sapiens
ctgcccagtttgggagcctttc

SEQ ID NO: 7529927 - DNA, 22 bp, Homo sapiens
ctgcccaggggagtgctgtcgg

SEQ ID NO: 7529928 - DNA, 22 bp, Homo sapiens
ctgcccagtttgggagcctttc

SEQ ID NO: 7529929 - DNA, 22 bp, Homo sapiens
ctgcccagtttgggagcctttc

SEQ ID NO: 7529930 - DNA, 22 bp, Homo sapiens
ctgcccagtttgggagcctttc

SEQ ID NO: 7529931 - DNA, 22 bp, Homo sapiens
ctgcccagtttgggagcctttc

SEQ ID NO: 7529932 - DNA, 22 bp, Homo sapiens
ctgcccagtttgggagcctttc

SEQ ID NO: 7529933 - DNA, 22 bp, Homo sapiens
ctgcccagtttgggagcctttc

SEQ ID NO: 7529934 - DNA, 22 bp, Homo sapiens
ctgcccataaactttccacctg

SEQ ID NO: 7529935 - DNA, 22 bp, Homo sapiens
ctgcccagtttgggagcctttc

SEQ ID NO: 7529936 - DNA, 22 bp, Homo sapiens
ctgcccatctgcagacatgcgt

SEQ ID NO: 7529937 - DNA, 22 bp, Homo sapiens
ctgcccatcgtcatttaataaa

SEQ ID NO: 7529938 - DNA, 22 bp, Homo sapiens
ctgcccatctgcagacatgcgt

SEQ ID NO: 7529939 - DNA, 22 bp, Homo sapiens
ctgccccaccccaacctgaggt

SEQ ID NO: 7529940 - DNA, 22 bp, Homo sapiens
ctgccccaccccaacctgaggt

SEQ ID NO: 7529941 - DNA, 22 bp, Homo sapiens
ctgccccaccccaacctgaggt

SEQ ID NO: 7529942 - DNA, 22 bp, Homo sapiens
ctgccccacaggcttggtaggg

SEQ ID NO: 7529943 - DNA, 23 bp, Homo sapiens
ctgccccaattataaaagaagat

SEQ ID NO: 7529944 - DNA, 23 bp, Homo sapiens
ctgccccaattataaaagaagat

SEQ ID NO: 7529945 - DNA, 22 bp, Homo sapiens
ctgcccattcaaccagctacag

SEQ ID NO: 7529946 - DNA, 21 bp, Homo sapiens
ctgcccatttgtgatgtcccc

SEQ ID NO: 7529947 - DNA, 22 bp, Homo sapiens
ctgcccatctggccacacacag

SEQ ID NO: 7529948 - DNA, 22 bp, Homo sapiens
ctgcccattcaaccagctacag

SEQ ID NO: 7529949 - DNA, 22 bp, Homo sapiens
ctgcccattcaaccagctacag

SEQ ID NO: 7529950 - DNA, 22 bp, Homo sapiens
ctgccccctgctttgtccttga

SEQ ID NO: 7529951 - DNA, 22 bp, Homo sapiens
ctgcccccaggctgcatggctg

SEQ ID NO: 7529952 - DNA, 22 bp, Homo sapiens
ctgccccctgctttgtccttga

SEQ ID NO: 7529953 - DNA, 22 bp, Homo sapiens
ctgcccctcgaccaagcgcgtc

SEQ ID NO: 7529954 - DNA, 22 bp, Homo sapiens
ctgcccctcgaccaagcgcgtc

SEQ ID NO: 7529955 - DNA, 22 bp, Homo sapiens
ctgcccctcgaccaagcgcgtc

SEQ ID NO: 7529956 - DNA, 22 bp, Homo sapiens
ctgcccctgccaggcagctgtc

SEQ ID NO: 7529957 - DNA, 22 bp, Homo sapiens
ctgcccctgccaggcagctgtc

SEQ ID NO: 7529958 - DNA, 22 bp, Homo sapiens
ctgcccctgccaggcagctgtc

SEQ ID NO: 7529959 - DNA, 22 bp, Homo sapiens
ctgcccctgccaggcagctgtc

SEQ ID NO: 7529960 - DNA, 22 bp, Homo sapiens
ctgccccatggtccctggtggg

SEQ ID NO: 7529961 - DNA, 22 bp, Homo sapiens
ctgccccatggtccctggtggg

SEQ ID NO: 7529962 - DNA, 22 bp, Homo sapiens
ctgccccatggtccctggtggg

SEQ ID NO: 7529963 - DNA, 22 bp, Homo sapiens
ctgccccagtgccaggcaggtg

SEQ ID NO: 7529964 - DNA, 22 bp, Homo sapiens
ctgccccatggtccctggtggg

SEQ ID NO: 7529965 - DNA, 22 bp, Homo sapiens
ctgccccatggtccctggtggg

SEQ ID NO: 7529966 - DNA, 22 bp, Homo sapiens
ctgcccccaggctgcatggctg

SEQ ID NO: 7529967 - DNA, 22 bp, Homo sapiens
ctgccccatggtccctggtggg

SEQ ID NO: 7529968 - DNA, 22 bp, Homo sapiens
ctgccccagcctggggccttct

SEQ ID NO: 7529969 - DNA, 22 bp, Homo sapiens
ctgccccagcctggggccttct

SEQ ID NO: 7529970 - DNA, 22 bp, Homo sapiens
ctgccccagcctggggccttct

SEQ ID NO: 7529971 - DNA, 22 bp, Homo sapiens
ctgccccaccccaacctgaggt

SEQ ID NO: 7529972 - DNA, 22 bp, Homo sapiens
ctgccccaggacctcttctgga

SEQ ID NO: 7529973 - DNA, 22 bp, Homo sapiens
ctgccccaggacctcttctgga

SEQ ID NO: 7529974 - DNA, 22 bp, Homo sapiens
ctgccccaggacctcttctgga

SEQ ID NO: 7529975 - DNA, 22 bp, Homo sapiens
ctgccccaggacctcttctgga

SEQ ID NO: 7529976 - DNA, 22 bp, Homo sapiens
ctgccccagtgccaggcaggtg

SEQ ID NO: 7529977 - DNA, 22 bp, Homo sapiens
ctgccccagtgccaggcaggtg

SEQ ID NO: 7529978 - DNA, 22 bp, Homo sapiens
ctgccccagtgccaggcaggtg

SEQ ID NO: 7529979 - DNA, 22 bp, Homo sapiens
ctgccccagtgccaggcaggtg

SEQ ID NO: 7529980 - DNA, 22 bp, Homo sapiens
ctgccccaggcctcgggaggag

SEQ ID NO: 7529981 - DNA, 22 bp, Homo sapiens
ctgccccaggcctccttttctt

SEQ ID NO: 7529982 - DNA, 22 bp, Homo sapiens
ctgccccaggcctccttttctt

SEQ ID NO: 7529983 - DNA, 22 bp, Homo sapiens
ctgccccaggcctccttttctt

SEQ ID NO: 7529984 - DNA, 22 bp, Homo sapiens
ctgccccaggcctccttttctt

SEQ ID NO: 7529985 - DNA, 22 bp, Homo sapiens
ctgccccaggacctcttctgga

SEQ ID NO: 7529986 - DNA, 22 bp, Homo sapiens
ctgccattaaagagcgttcaga

SEQ ID NO: 7529987 - DNA, 22 bp, Homo sapiens
ctgcccacacctgagctgggcc

SEQ ID NO: 7529988 - DNA, 22 bp, Homo sapiens
ctgcccaagtggagtctccgca

SEQ ID NO: 7529989 - DNA, 22 bp, Homo sapiens
ctgccattggattttcacattt

SEQ ID NO: 7529990 - DNA, 18 bp, Homo sapiens
ctgccatgtcctactgtc

SEQ ID NO: 7529991 - DNA, 22 bp, Homo sapiens
ctgccatgtgtgaaaggggagg

SEQ ID NO: 7529992 - DNA, 22 bp, Homo sapiens
ctgccatgttacctgcacaggt

SEQ ID NO: 7529993 - DNA, 22 bp, Homo sapiens
ctgccatgttacctgcacaggt

SEQ ID NO: 7529994 - DNA, 22 bp, Homo sapiens
ctgccatgttacctgcacaggt

SEQ ID NO: 7529995 - DNA, 22 bp, Homo sapiens
ctgcccacactcatggggaagg

SEQ ID NO: 7529996 - DNA, 22 bp, Homo sapiens
ctgcccacactcatggggaagg

SEQ ID NO: 7529997 - DNA, 22 bp, Homo sapiens
ctgcccaagtggagtctccgca

SEQ ID NO: 7529998 - DNA, 22 bp, Homo sapiens
ctgcccacacctgagctgggcc

SEQ ID NO: 7529999 - DNA, 22 bp, Homo sapiens
ctgcccagattttaccacctgc

SEQ ID NO: 7530000 - DNA, 22 bp, Homo sapiens
ctgcccacagttctctgccatg

SEQ ID NO: 7530001 - DNA, 22 bp, Homo sapiens
ctgcccacagttctctgccatg

SEQ ID NO: 7530002 - DNA, 22 bp, Homo sapiens
ctgcccagattttaccacctgc

SEQ ID NO: 7530003 - DNA, 22 bp, Homo sapiens
ctgcccagattttaccacctgc

SEQ ID NO: 7530004 - DNA, 22 bp, Homo sapiens
ctgcccagattttaccacctgc

SEQ ID NO: 7530005 - DNA, 20 bp, Homo sapiens
ctgcccagccactgagggat

SEQ ID NO: 7530006 - DNA, 22 bp, Homo sapiens
ctgcccaggaaccagaggggca

SEQ ID NO: 7530007 - DNA, 22 bp, Homo sapiens
ctgcccaggaaccagaggggca

SEQ ID NO: 7530008 - DNA, 22 bp, Homo sapiens
ctgcccaggaaccagaggggca

SEQ ID NO: 7530009 - DNA, 22 bp, Homo sapiens
ctgcccaggaaccagaggggca

SEQ ID NO: 7530010 - DNA, 22 bp, Homo sapiens
ctgcccaggaaccagaggggca

SEQ ID NO: 7530011 - DNA, 20 bp, Homo sapiens
ctgcccagccactgagggat

SEQ ID NO: 7530012 - DNA, 20 bp, Homo sapiens
ctgcccagccactgagggat

SEQ ID NO: 7530013 - DNA, 20 bp, Homo sapiens
ctgcccagccactgagggat

SEQ ID NO: 7530014 - DNA, 20 bp, Homo sapiens
ctgcccagccactgagggat

SEQ ID NO: 7530015 - DNA, 20 bp, Homo sapiens
ctgcccagccactgagggat

SEQ ID NO: 7530016 - DNA, 20 bp, Homo sapiens
ctgcccagccactgagggat

SEQ ID NO: 7530017 - DNA, 20 bp, Homo sapiens
ctgcccagccactgagggat

SEQ ID NO: 7530018 - DNA, 20 bp, Homo sapiens
ctgcccagccactgagggat

SEQ ID NO: 7530019 - DNA, 22 bp, Homo sapiens
ctgcccagattttaccacctgc

SEQ ID NO: 7530020 - DNA, 20 bp, Homo sapiens
ctgcccagccactgagggat

SEQ ID NO: 7530021 - DNA, 20 bp, Homo sapiens
ctgcccagccactgagggat

SEQ ID NO: 7530022 - DNA, 20 bp, Homo sapiens
ctgcccagccactgagggat

SEQ ID NO: 7530023 - DNA, 20 bp, Homo sapiens
ctgcccagccactgagggat

SEQ ID NO: 7530024 - DNA, 20 bp, Homo sapiens
ctgcccagccactgagggat

SEQ ID NO: 7530025 - DNA, 21 bp, Homo sapiens
ctgcaggatgctgaagccagg

SEQ ID NO: 7530026 - DNA, 21 bp, Homo sapiens
ctgcaggatgctgaagccagg

SEQ ID NO: 7530027 - DNA, 22 bp, Homo sapiens
ctgcaggagtgaaagcaggcct

SEQ ID NO: 7530028 - DNA, 22 bp, Homo sapiens
ctgcaggagtgaaagcaggcct

SEQ ID NO: 7530029 - DNA, 22 bp, Homo sapiens
ctgcaggagtgaaagcaggcct

SEQ ID NO: 7530030 - DNA, 22 bp, Homo sapiens
ctgcaggcatctaactgtgggc

SEQ ID NO: 7530031 - DNA, 22 bp, Homo sapiens
ctgcaggcatctaactgtgggc

SEQ ID NO: 7530032 - DNA, 22 bp, Homo sapiens
ctgcaggcatctaactgtgggc

SEQ ID NO: 7530033 - DNA, 22 bp, Homo sapiens
ctgcaggcatctaactgtgggc

SEQ ID NO: 7530034 - DNA, 22 bp, Homo sapiens
ctgcaggatttcatgggctgac

SEQ ID NO: 7530035 - DNA, 22 bp, Homo sapiens
ctgcaggcatctaactgtgggc

SEQ ID NO: 7530036 - DNA, 22 bp, Homo sapiens
ctgcaggcatctaactgtgggc

SEQ ID NO: 7530037 - DNA, 22 bp, Homo sapiens
ctgcaggatttcatgggctgac

SEQ ID NO: 7530038 - DNA, 22 bp, Homo sapiens
ctgcaggattctcccagttgga

SEQ ID NO: 7530039 - DNA, 22 bp, Homo sapiens
ctgcaggatttcatgggctgac

SEQ ID NO: 7530040 - DNA, 22 bp, Homo sapiens
ctgcaggatttcatgggctgac

SEQ ID NO: 7530041 - DNA, 22 bp, Homo sapiens
ctgcaggatttcatgggctgac

SEQ ID NO: 7530042 - DNA, 22 bp, Homo sapiens
ctgcaggaggatcctgagagtg

SEQ ID NO: 7530043 - DNA, 22 bp, Homo sapiens
ctgcaggaggatcctgagagtg

SEQ ID NO: 7530044 - DNA, 22 bp, Homo sapiens
ctgcaggagggctggggaagcc

SEQ ID NO: 7530045 - DNA, 22 bp, Homo sapiens
ctgcaggagtgaaagcaggcct

SEQ ID NO: 7530046 - DNA, 22 bp, Homo sapiens
ctgcaggagtgaaagcaggcct

SEQ ID NO: 7530047 - DNA, 22 bp, Homo sapiens
ctgcaggagtgaaagcaggcct

SEQ ID NO: 7530048 - DNA, 22 bp, Homo sapiens
ctgcaggagtgaaagcaggcct

SEQ ID NO: 7530049 - DNA, 22 bp, Homo sapiens
ctgcaggagggctggggaagcc

SEQ ID NO: 7530050 - DNA, 22 bp, Homo sapiens
ctgcaggagcaagcctgggaga

SEQ ID NO: 7530051 - DNA, 22 bp, Homo sapiens
ctgcaggagcaagcctgggaga

SEQ ID NO: 7530052 - DNA, 22 bp, Homo sapiens
ctgcaggaggatcctgagagtg

SEQ ID NO: 7530053 - DNA, 22 bp, Homo sapiens
ctgcaggaggatcctgagagtg

SEQ ID NO: 7530054 - DNA, 22 bp, Homo sapiens
ctgcaggaggatcctgagagtg

SEQ ID NO: 7530055 - DNA, 22 bp, Homo sapiens
ctgcaggagcaaagcctctgct

SEQ ID NO: 7530056 - DNA, 22 bp, Homo sapiens
ctgcaggagcaaagcctctgct

SEQ ID NO: 7530057 - DNA, 22 bp, Homo sapiens
ctgcaggagcaaagcctctgct

SEQ ID NO: 7530058 - DNA, 22 bp, Homo sapiens
ctgcaggagcaagcctgggaga

SEQ ID NO: 7530059 - DNA, 22 bp, Homo sapiens
ctgcaggaatctgtgctaggtg

SEQ ID NO: 7530060 - DNA, 22 bp, Homo sapiens
ctgcaggaatctgtgctaggtg

SEQ ID NO: 7530061 - DNA, 22 bp, Homo sapiens
ctgcaggaattcaaagtgagct

SEQ ID NO: 7530062 - DNA, 22 bp, Homo sapiens
ctgcaggaattcaaagtgagct

SEQ ID NO: 7530063 - DNA, 22 bp, Homo sapiens
ctgcaggaaggggacggagtgg

SEQ ID NO: 7530064 - DNA, 22 bp, Homo sapiens
ctgcaggaaggggacggagtgg

SEQ ID NO: 7530065 - DNA, 22 bp, Homo sapiens
ctgcaggaatctgtgctaggtg

SEQ ID NO: 7530066 - DNA, 22 bp, Homo sapiens
ctgcagctttttgtgcttgtaa

SEQ ID NO: 7530067 - DNA, 22 bp, Homo sapiens
ctgcagctttttgtgcttgtaa

SEQ ID NO: 7530068 - DNA, 22 bp, Homo sapiens
ctgcagctttttgtgcttgtaa

SEQ ID NO: 7530069 - DNA, 22 bp, Homo sapiens
ctgcagctttggaaacctgttt

SEQ ID NO: 7530070 - DNA, 22 bp, Homo sapiens
ctgcagctttggaaacctgttt

SEQ ID NO: 7530071 - DNA, 22 bp, Homo sapiens
ctgcagctttcgctccatcagc

SEQ ID NO: 7530072 - DNA, 22 bp, Homo sapiens
ctgcagctttggaaacctgttt

SEQ ID NO: 7530073 - DNA, 22 bp, Homo sapiens
ctgcagctttcgctccatcagc

SEQ ID NO: 7530074 - DNA, 22 bp, Homo sapiens
ctgcagctttcgctccatcagc

SEQ ID NO: 7530075 - DNA, 22 bp, Homo sapiens
ctgcagcttatttgctgtgtga

SEQ ID NO: 7530076 - DNA, 22 bp, Homo sapiens
ctgcaggacagggaggagcaag

SEQ ID NO: 7530077 - DNA, 22 bp, Homo sapiens
ctgcaggacagggaggagcaag

SEQ ID NO: 7530078 - DNA, 22 bp, Homo sapiens
ctgcaggacagggaggagcaag

SEQ ID NO: 7530079 - DNA, 22 bp, Homo sapiens
ctgcaggaattcaaagtgagct

SEQ ID NO: 7530080 - DNA, 22 bp, Homo sapiens
ctgcaggaattcaaagtgagct

SEQ ID NO: 7530081 - DNA, 22 bp, Homo sapiens
ctgcaggacagggaggagcaag

SEQ ID NO: 7530082 - DNA, 22 bp, Homo sapiens
ctgcaggacagggccggaggcc

SEQ ID NO: 7530083 - DNA, 22 bp, Homo sapiens
ctgcaggacagggccggaggcc

SEQ ID NO: 7530084 - DNA, 22 bp, Homo sapiens
ctgcaggacagggaggagcaag

SEQ ID NO: 7530085 - DNA, 22 bp, Homo sapiens
ctgcaggagcaaagcctctgct

SEQ ID NO: 7530086 - DNA, 22 bp, Homo sapiens
ctgcaggactgaaagatgaggt

SEQ ID NO: 7530087 - DNA, 22 bp, Homo sapiens
ctgcaggactgaaagatgaggt

SEQ ID NO: 7530088 - DNA, 22 bp, Homo sapiens
ctgcaggactgaaagatgaggt

SEQ ID NO: 7530089 - DNA, 22 bp, Homo sapiens
ctgcaggactgaaagatgaggt

SEQ ID NO: 7530090 - DNA, 22 bp, Homo sapiens
ctgcaggactgaaagatgaggt

SEQ ID NO: 7530091 - DNA, 22 bp, Homo sapiens
ctgcaggactgaaagatgaggt

SEQ ID NO: 7530092 - DNA, 22 bp, Homo sapiens
ctgcaggactgaaagatgaggt

SEQ ID NO: 7530093 - DNA, 22 bp, Homo sapiens
ctgcaggacgaccgcctcatct

SEQ ID NO: 7530094 - DNA, 22 bp, Homo sapiens
ctgcaggacgaccgcctcatct

SEQ ID NO: 7530095 - DNA, 22 bp, Homo sapiens
ctgcaggacgaccgcctcatct

SEQ ID NO: 7530096 - DNA, 22 bp, Homo sapiens
ctgcagcctaggtgcagctggg

SEQ ID NO: 7530097 - DNA, 16 bp, Homo sapiens
ctgaggtttggccaca

SEQ ID NO: 7530098 - DNA, 22 bp, Homo sapiens
ctgaggtttacaagctattgct

SEQ ID NO: 7530099 - DNA, 22 bp, Homo sapiens
ctgcagcctaggtgcagctggg

SEQ ID NO: 7530100 - DNA, 22 bp, Homo sapiens
ctgcagcctcaacctcctgagc

SEQ ID NO: 7530101 - DNA, 22 bp, Homo sapiens
ctgcagctgggccagggccacc

SEQ ID NO: 7530102 - DNA, 22 bp, Homo sapiens
ctgcagcctcaacctcctgagc

SEQ ID NO: 7530103 - DNA, 22 bp, Homo sapiens
ctgcagcctcaacctcctgagc

SEQ ID NO: 7530104 - DNA, 22 bp, Homo sapiens
ctgcagctgtgagtgctggatg

SEQ ID NO: 7530105 - DNA, 22 bp, Homo sapiens
ctgcagctgtgagtgctggatg

SEQ ID NO: 7530106 - DNA, 22 bp, Homo sapiens
ctgcagctgtgagtgctggatg

SEQ ID NO: 7530107 - DNA, 22 bp, Homo sapiens
ctgcagctgtgagtgctggatg

SEQ ID NO: 7530108 - DNA, 22 bp, Homo sapiens
ctgcagctgtgagtgctggatg

SEQ ID NO: 7530109 - DNA, 22 bp, Homo sapiens
ctgcagctgtgagtgctggatg

SEQ ID NO: 7530110 - DNA, 22 bp, Homo sapiens
ctgcagcttaaaggagttcaat

SEQ ID NO: 7530111 - DNA, 22 bp, Homo sapiens
ctgcagcttaaaggagttcaat

SEQ ID NO: 7530112 - DNA, 22 bp, Homo sapiens
ctgcagcttatttgctgtgtga

SEQ ID NO: 7530113 - DNA, 22 bp, Homo sapiens
ctgcagcttatttgctgtgtga

SEQ ID NO: 7530114 - DNA, 22 bp, Homo sapiens
ctgcagcttatttgctgtgtga

SEQ ID NO: 7530115 - DNA, 22 bp, Homo sapiens
ctgcagcttaaaggagttcaat

SEQ ID NO: 7530116 - DNA, 22 bp, Homo sapiens
ctgcagcttaagggaggggttg

SEQ ID NO: 7530117 - DNA, 22 bp, Homo sapiens
ctgcagcttaagggaggggttg

SEQ ID NO: 7530118 - DNA, 22 bp, Homo sapiens
ctgcagctgtagaggacagtgg

SEQ ID NO: 7530119 - DNA, 22 bp, Homo sapiens
ctgcagctgtagaggacagtgg

SEQ ID NO: 7530120 - DNA, 22 bp, Homo sapiens
ctgcagctgtagaggacagtgg

SEQ ID NO: 7530121 - DNA, 22 bp, Homo sapiens
ctgcagctgtagaggacagtgg

SEQ ID NO: 7530122 - DNA, 22 bp, Homo sapiens
ctgcagctgtctctactgggca

SEQ ID NO: 7530123 - DNA, 22 bp, Homo sapiens
ctgcagctgtctctactgggca

SEQ ID NO: 7530124 - DNA, 22 bp, Homo sapiens
ctgcagctgtctctactgggca

SEQ ID NO: 7530125 - DNA, 22 bp, Homo sapiens
ctgcagctgtctctactgggca

SEQ ID NO: 7530126 - DNA, 22 bp, Homo sapiens
ctgcagctgtctctactgggca

SEQ ID NO: 7530127 - DNA, 22 bp, Homo sapiens
ctgcagctgtctctactgggca

SEQ ID NO: 7530128 - DNA, 22 bp, Homo sapiens
ctgaggtgtttagtaggggcgg

SEQ ID NO: 7530129 - DNA, 22 bp, Homo sapiens
ctgaggtgtttagtaggggcgg

SEQ ID NO: 7530130 - DNA, 22 bp, Homo sapiens
ctgaggtgtttagtaggggcgg

SEQ ID NO: 7530131 - DNA, 22 bp, Homo sapiens
ctgaggtgtttagtaggggcgg

SEQ ID NO: 7530132 - DNA, 22 bp, Homo sapiens
ctgaggtgttgatgacctatgc

SEQ ID NO: 7530133 - DNA, 22 bp, Homo sapiens
ctgaggtgttgatgacctatgc

SEQ ID NO: 7530134 - DNA, 22 bp, Homo sapiens
ctgaggtgtggtctgggagtat

SEQ ID NO: 7530135 - DNA, 22 bp, Homo sapiens
ctgaggtgtggtctgggagtat

SEQ ID NO: 7530136 - DNA, 22 bp, Homo sapiens
ctgaggtgtgctttcaatgggt

SEQ ID NO: 7530137 - DNA, 22 bp, Homo sapiens
ctgaggtgtggtctgggagtat

SEQ ID NO: 7530138 - DNA, 22 bp, Homo sapiens
ctgaggtgtggtctgggagtat

SEQ ID NO: 7530139 - DNA, 22 bp, Homo sapiens
ctgaggtgtgctttcaatgggt

SEQ ID NO: 7530140 - DNA, 22 bp, Homo sapiens
ctgaggtgtgctttcaatgggt

SEQ ID NO: 7530141 - DNA, 22 bp, Homo sapiens
ctgaggtgtgagccacttcccc

SEQ ID NO: 7530142 - DNA, 22 bp, Homo sapiens
ctgaggtgtgagccacttcccc

SEQ ID NO: 7530143 - DNA, 22 bp, Homo sapiens
ctgaggtgtgagccacttcccc

SEQ ID NO: 7530144 - DNA, 22 bp, Homo sapiens
ctgaggtgtgaaatggtggcaa

SEQ ID NO: 7530145 - DNA, 22 bp, Homo sapiens
ctgaggtgtgagccacttcccc

SEQ ID NO: 7530146 - DNA, 22 bp, Homo sapiens
ctgaggtgtgaaatggtggcaa

SEQ ID NO: 7530147 - DNA, 22 bp, Homo sapiens
ctgaggtggggcctgggcatca

SEQ ID NO: 7530148 - DNA, 22 bp, Homo sapiens
ctgaggtgtgaaatggtggcaa

SEQ ID NO: 7530149 - DNA, 22 bp, Homo sapiens
ctgaggtggcctctgccgggga

SEQ ID NO: 7530150 - DNA, 22 bp, Homo sapiens
ctgaggtggcctctgccgggga

SEQ ID NO: 7530151 - DNA, 22 bp, Homo sapiens
ctgaggtggcgcctctctttaa

SEQ ID NO: 7530152 - DNA, 22 bp, Homo sapiens
ctgaggtggcgcctctctttaa

SEQ ID NO: 7530153 - DNA, 22 bp, Homo sapiens
ctgaggtggcgcctctctttaa

SEQ ID NO: 7530154 - DNA, 22 bp, Homo sapiens
ctgaggtggggcctgggcatca

SEQ ID NO: 7530155 - DNA, 22 bp, Homo sapiens
ctgaggtgggagtttttctcat

SEQ ID NO: 7530156 - DNA, 22 bp, Homo sapiens
ctgaggtggggcctgggcatca

SEQ ID NO: 7530157 - DNA, 22 bp, Homo sapiens
ctgaggtgtgaaatggtggcaa

SEQ ID NO: 7530158 - DNA, 22 bp, Homo sapiens
ctgaggtggggcctgggcatca

SEQ ID NO: 7530159 - DNA, 22 bp, Homo sapiens
ctgaggtggcatcctagctcta

SEQ ID NO: 7530160 - DNA, 22 bp, Homo sapiens
ctgaggtggcatcctagctcta

SEQ ID NO: 7530161 - DNA, 22 bp, Homo sapiens
ctgaggtggcatcctagctcta

SEQ ID NO: 7530162 - DNA, 22 bp, Homo sapiens
ctgaggtggcatcctagctcta

SEQ ID NO: 7530163 - DNA, 22 bp, Homo sapiens
ctgaggtggcatcctagctcta

SEQ ID NO: 7530164 - DNA, 23 bp, Homo sapiens
ctgaggtggagagtgaggtaagt

SEQ ID NO: 7530165 - DNA, 23 bp, Homo sapiens
ctgaggtggagagtgaggtaagt

SEQ ID NO: 7530166 - DNA, 23 bp, Homo sapiens
ctgaggtggagagtgaggtaagt

SEQ ID NO: 7530167 - DNA, 22 bp, Homo sapiens
ctgaggtggaacagaggtgaag

SEQ ID NO: 7530168 - DNA, 23 bp, Homo sapiens
ctgaggtctgcaattctagtagt

SEQ ID NO: 7530169 - DNA, 23 bp, Homo sapiens
ctgaggtctgcaattctagtagt

SEQ ID NO: 7530170 - DNA, 22 bp, Homo sapiens
ctgaggtgagaggaggccatgt

SEQ ID NO: 7530171 - DNA, 22 bp, Homo sapiens
ctgaggtgagaggaggccatgt

SEQ ID NO: 7530172 - DNA, 22 bp, Homo sapiens
ctgaggtgagaggaggccatgt

SEQ ID NO: 7530173 - DNA, 22 bp, Homo sapiens
ctgaggtgagaggaggccatgt

SEQ ID NO: 7530174 - DNA, 22 bp, Homo sapiens
ctgaggtgagaggaggccatgt

SEQ ID NO: 7530175 - DNA, 22 bp, Homo sapiens
ctgaggtctctttccatagtga

SEQ ID NO: 7530176 - DNA, 23 bp, Homo sapiens
ctgaggtctgcaattctagtagt

SEQ ID NO: 7530177 - DNA, 22 bp, Homo sapiens
ctgaggtctattttgaaactgc

SEQ ID NO: 7530178 - DNA, 22 bp, Homo sapiens
ctgaggtctctttccatagtga

SEQ ID NO: 7530179 - DNA, 22 bp, Homo sapiens
ctgaggtctattttgaaactgc

SEQ ID NO: 7530180 - DNA, 22 bp, Homo sapiens
ctgaggtctctttccatagtga

SEQ ID NO: 7530181 - DNA, 22 bp, Homo sapiens
ctgaggtgagaggaggccatgt

SEQ ID NO: 7530182 - DNA, 22 bp, Homo sapiens
ctgaggtgagcttccctgggct

SEQ ID NO: 7530183 - DNA, 19 bp, Homo sapiens
ctgaggtgaggggcatcat

SEQ ID NO: 7530184 - DNA, 22 bp, Homo sapiens
ctgaggtgagcttccctgggct

SEQ ID NO: 7530185 - DNA, 19 bp, Homo sapiens
ctgaggtgaggggcatcat

SEQ ID NO: 7530186 - DNA, 19 bp, Homo sapiens
ctgaggtgaggggcatcat

SEQ ID NO: 7530187 - DNA, 19 bp, Homo sapiens
ctgaggtgaggggcatcat

SEQ ID NO: 7530188 - DNA, 22 bp, Homo sapiens
ctgaggtgatggcccgttttcc

SEQ ID NO: 7530189 - DNA, 22 bp, Homo sapiens
ctgaggtggaacagaggtgaag

SEQ ID NO: 7530190 - DNA, 22 bp, Homo sapiens
ctgaggtgctatggaggatacg

SEQ ID NO: 7530191 - DNA, 22 bp, Homo sapiens
ctgaggtggaacagaggtgaag

SEQ ID NO: 7530192 - DNA, 22 bp, Homo sapiens
ctgaggtgctatggaggatacg

SEQ ID NO: 7530193 - DNA, 22 bp, Homo sapiens
ctgaggtgctagggtccctgct

SEQ ID NO: 7530194 - DNA, 22 bp, Homo sapiens
ctgaggtgctatggaggatacg

SEQ ID NO: 7530195 - DNA, 22 bp, Homo sapiens
ctgaggtgctatggaggatacg

SEQ ID NO: 7530196 - DNA, 19 bp, Homo sapiens
ctgaggtgcagtaagaggc

SEQ ID NO: 7530197 - DNA, 22 bp, Homo sapiens
ctgaggtgctagggtccctgct

SEQ ID NO: 7530198 - DNA, 22 bp, Homo sapiens
ctgaggtgctagggtccctgct

SEQ ID NO: 7530199 - DNA, 22 bp, Homo sapiens
ctgaggtgctagggtccctgct

SEQ ID NO: 7530200 - DNA, 22 bp, Homo sapiens
ctgaggtgatgtcaaatgggtt

SEQ ID NO: 7530201 - DNA, 22 bp, Homo sapiens
ctgaggtgatggcccgttttcc

SEQ ID NO: 7530202 - DNA, 22 bp, Homo sapiens
ctgaggtgatgtcaaatgggtt

SEQ ID NO: 7530203 - DNA, 22 bp, Homo sapiens
ctgaggtgatgtcaaatgggtt

SEQ ID NO: 7530204 - DNA, 22 bp, Homo sapiens
ctgaggcctggtgaggtggtga

SEQ ID NO: 7530205 - DNA, 22 bp, Homo sapiens
ctgaggcctggtgaggtggtga

SEQ ID NO: 7530206 - DNA, 22 bp, Homo sapiens
ctgaggcctgggggcgtggacg

SEQ ID NO: 7530207 - DNA, 22 bp, Homo sapiens
ctgaggcctggtgaggtggtga

SEQ ID NO: 7530208 - DNA, 22 bp, Homo sapiens
ctgaggcctgggggcgtggacg

SEQ ID NO: 7530209 - DNA, 22 bp, Homo sapiens
ctgaggcctgggggcgtggacg

SEQ ID NO: 7530210 - DNA, 22 bp, Homo sapiens
ctgaggcctgggggcgtggacg

SEQ ID NO: 7530211 - DNA, 22 bp, Homo sapiens
ctgaggcctgggggcgtggacg

SEQ ID NO: 7530212 - DNA, 22 bp, Homo sapiens
ctgaggcctggccccaccacag

SEQ ID NO: 7530213 - DNA, 22 bp, Homo sapiens
ctgaggcctgtgttggggcagt

SEQ ID NO: 7530214 - DNA, 22 bp, Homo sapiens
ctgaggcctggtgaggtggtga

SEQ ID NO: 7530215 - DNA, 22 bp, Homo sapiens
ctgaggctaacctcgagagaca

SEQ ID NO: 7530216 - DNA, 22 bp, Homo sapiens
ctgaggctaacctcgagagaca

SEQ ID NO: 7530217 - DNA, 22 bp, Homo sapiens
ctgaggcctgtgttggggcagt

SEQ ID NO: 7530218 - DNA, 22 bp, Homo sapiens
ctgaggctaacctcgagagaca

SEQ ID NO: 7530219 - DNA, 22 bp, Homo sapiens
ctgaggctcaagggcaggtggg

SEQ ID NO: 7530220 - DNA, 22 bp, Homo sapiens
ctgaggctcagcgtgaggaaag

SEQ ID NO: 7530221 - DNA, 22 bp, Homo sapiens
ctgaggctcaagggcaggtggg

SEQ ID NO: 7530222 - DNA, 22 bp, Homo sapiens
ctgaggctcaagggcaggtggg

SEQ ID NO: 7530223 - DNA, 22 bp, Homo sapiens
ctgaggctcaagggcaggtggg

SEQ ID NO: 7530224 - DNA, 22 bp, Homo sapiens
ctgaggctcaagggcaggtggg

SEQ ID NO: 7530225 - DNA, 22 bp, Homo sapiens
ctgaggctcaagggcaggtggg

SEQ ID NO: 7530226 - DNA, 22 bp, Homo sapiens
ctgaggctcaagggcaggtggg

SEQ ID NO: 7530227 - DNA, 22 bp, Homo sapiens
ctgaggctcaagggcaggtggg

SEQ ID NO: 7530228 - DNA, 22 bp, Homo sapiens
ctgaggctcaagggcaggtggg

SEQ ID NO: 7530229 - DNA, 22 bp, Homo sapiens
ctgaggctcaagggcaggtggg

SEQ ID NO: 7530230 - DNA, 22 bp, Homo sapiens
ctgaggctcaagggcaggtggg

SEQ ID NO: 7530231 - DNA, 22 bp, Homo sapiens
ctgaggctcaagggcaggtggg

SEQ ID NO: 7530232 - DNA, 22 bp, Homo sapiens
ctgaggctaacctcgagagaca

SEQ ID NO: 7530233 - DNA, 22 bp, Homo sapiens
ctgaggctaacctcgagagaca

SEQ ID NO: 7530234 - DNA, 22 bp, Homo sapiens
ctgaggctagtataaagagcat

SEQ ID NO: 7530235 - DNA, 22 bp, Homo sapiens
ctgaggcctggccccaccacag

SEQ ID NO: 7530236 - DNA, 22 bp, Homo sapiens
ctgaggcctggccccaccacag

SEQ ID NO: 7530237 - DNA, 22 bp, Homo sapiens
ctgaggccgttggtgggcctta

SEQ ID NO: 7530238 - DNA, 22 bp, Homo sapiens
ctgaggccgttggtgggcctta

SEQ ID NO: 7530239 - DNA, 22 bp, Homo sapiens
ctgaggccgttggtgggcctta

SEQ ID NO: 7530240 - DNA, 22 bp, Homo sapiens
ctgaggccgtctgggtctgcag

SEQ ID NO: 7530241 - DNA, 22 bp, Homo sapiens
ctgaggccgtctgggtctgcag

SEQ ID NO: 7530242 - DNA, 22 bp, Homo sapiens
ctgaggccgtctgggtctgcag

SEQ ID NO: 7530243 - DNA, 22 bp, Homo sapiens
ctgagccaaccacagcaggagc

SEQ ID NO: 7530244 - DNA, 22 bp, Homo sapiens
ctgagccaaaaagcagagcttg

SEQ ID NO: 7530245 - DNA, 22 bp, Homo sapiens
ctgagccaaaaagcagagcttg

SEQ ID NO: 7530246 - DNA, 22 bp, Homo sapiens
ctgagccaaaaagcagagcttg

SEQ ID NO: 7530247 - DNA, 22 bp, Homo sapiens
ctgagccaaaaagcagagcttg

SEQ ID NO: 7530248 - DNA, 22 bp, Homo sapiens
ctgagcatttgtgcagcttctc

SEQ ID NO: 7530249 - DNA, 22 bp, Homo sapiens
ctgagccaaaaagcagagcttg

SEQ ID NO: 7530250 - DNA, 22 bp, Homo sapiens
ctgagccaaaaagcagagcttg

SEQ ID NO: 7530251 - DNA, 22 bp, Homo sapiens
ctgagccaaaaagcagagcttg

SEQ ID NO: 7530252 - DNA, 22 bp, Homo sapiens
ctgagccaaaaagcagagcttg

SEQ ID NO: 7530253 - DNA, 22 bp, Homo sapiens
ctgagccaaaaagcagagcttg

SEQ ID NO: 7530254 - DNA, 22 bp, Homo sapiens
ctgagccaaaaagcagagcttg

SEQ ID NO: 7530255 - DNA, 22 bp, Homo sapiens
ctgagcatccagcaggtactgc

SEQ ID NO: 7530256 - DNA, 22 bp, Homo sapiens
ctgagcatggccggtccatggt

SEQ ID NO: 7530257 - DNA, 22 bp, Homo sapiens
ctgagcatgctacatgcagcac

SEQ ID NO: 7530258 - DNA, 22 bp, Homo sapiens
ctgaggctctgggtgtcactgt

SEQ ID NO: 7530259 - DNA, 22 bp, Homo sapiens
ctgaggctgaagagggcctacg

SEQ ID NO: 7530260 - DNA, 22 bp, Homo sapiens
ctgaggctgaagagggcctacg

SEQ ID NO: 7530261 - DNA, 22 bp, Homo sapiens
ctgaggctgaagagggcctacg

SEQ ID NO: 7530262 - DNA, 22 bp, Homo sapiens
ctgaggctctgggtgtcactgt

SEQ ID NO: 7530263 - DNA, 22 bp, Homo sapiens
ctgaggctctgggtgtcactgt

SEQ ID NO: 7530264 - DNA, 22 bp, Homo sapiens
ctgaggctccctcgggtctgct

SEQ ID NO: 7530265 - DNA, 22 bp, Homo sapiens
ctgaggctctgggtgtcactgt

SEQ ID NO: 7530266 - DNA, 22 bp, Homo sapiens
ctgaggctctgagaaagccaaa

SEQ ID NO: 7530267 - DNA, 22 bp, Homo sapiens
ctgaggctcagcgtgaggaaag

SEQ ID NO: 7530268 - DNA, 22 bp, Homo sapiens
ctgaggctccctcgggtctgct

SEQ ID NO: 7530269 - DNA, 22 bp, Homo sapiens
ctgaggctccctcgggtctgct

SEQ ID NO: 7530270 - DNA, 22 bp, Homo sapiens
ctgaggctccctcgggtctgct

SEQ ID NO: 7530271 - DNA, 22 bp, Homo sapiens
ctgaggctctgagaaagccaaa

SEQ ID NO: 7530272 - DNA, 22 bp, Homo sapiens
ctgaggctgcccagggccaggt

SEQ ID NO: 7530273 - DNA, 22 bp, Homo sapiens
ctgaggctgcccagggccaggt

SEQ ID NO: 7530274 - DNA, 22 bp, Homo sapiens
ctgaggctgcccagggccaggt

SEQ ID NO: 7530275 - DNA, 22 bp, Homo sapiens
ctgaggctgcccagggccaggt

SEQ ID NO: 7530276 - DNA, 22 bp, Homo sapiens
ctgaggctgcccagggccaggt

SEQ ID NO: 7530277 - DNA, 22 bp, Homo sapiens
ctgaggctgaagagggcctacg

SEQ ID NO: 7530278 - DNA, 22 bp, Homo sapiens
ctgaggctgaagagggcctacg

SEQ ID NO: 7530279 - DNA, 22 bp, Homo sapiens
ctgaggctgagacaggtgaaat

SEQ ID NO: 7530280 - DNA, 22 bp, Homo sapiens
ctgaggctgagacaggtgaaat

SEQ ID NO: 7530281 - DNA, 22 bp, Homo sapiens
ctgaggctgagacaggtgaaat

SEQ ID NO: 7530282 - DNA, 22 bp, Homo sapiens
ctgaggctgcccagggccaggt

SEQ ID NO: 7530283 - DNA, 22 bp, Homo sapiens
ctgaggctgcccagggccaggt

SEQ ID NO: 7530284 - DNA, 22 bp, Homo sapiens
ctgaggctggagtgcagtggtg

SEQ ID NO: 7530285 - DNA, 22 bp, Homo sapiens
ctgaggctggagtgcagtggtg

SEQ ID NO: 7530286 - DNA, 22 bp, Homo sapiens
ctgaggctggagtgcagtggtg

SEQ ID NO: 7530287 - DNA, 22 bp, Homo sapiens
ctgaggctggagtgcagtggtg

SEQ ID NO: 7530288 - DNA, 22 bp, Homo sapiens
ctgaggctggagtgcagtggtg

SEQ ID NO: 7530289 - DNA, 22 bp, Homo sapiens
ctgaggctggagtgcagtggtg

SEQ ID NO: 7530290 - DNA, 22 bp, Homo sapiens
ctgaggggaaaagtcaggatga

SEQ ID NO: 7530291 - DNA, 22 bp, Homo sapiens
ctgaggggaaaagtcaggatga

SEQ ID NO: 7530292 - DNA, 22 bp, Homo sapiens
ctgaggggaaaagtcaggatga

SEQ ID NO: 7530293 - DNA, 22 bp, Homo sapiens
ctgaggggaaaagtcaggatga

SEQ ID NO: 7530294 - DNA, 17 bp, Homo sapiens
ctgaggggagtgctgtg

SEQ ID NO: 7530295 - DNA, 17 bp, Homo sapiens
ctgaggggagtgctgtg

SEQ ID NO: 7530296 - DNA, 22 bp, Homo sapiens
ctgaggggaaaagtcaggatga

SEQ ID NO: 7530297 - DNA, 23 bp, Homo sapiens
ctgaggggaaaagggcttcaggc

SEQ ID NO: 7530298 - DNA, 23 bp, Homo sapiens
ctgaggggaaaagggcttcaggc

SEQ ID NO: 7530299 - DNA, 18 bp, Homo sapiens
ctgaggctggcaggagcc

SEQ ID NO: 7530300 - DNA, 18 bp, Homo sapiens
ctgaggctggcaggagcc

SEQ ID NO: 7530301 - DNA, 18 bp, Homo sapiens
ctgaggctggcaggagcc

SEQ ID NO: 7530302 - DNA, 18 bp, Homo sapiens
ctgaggctggcaggagcc

SEQ ID NO: 7530303 - DNA, 18 bp, Homo sapiens
ctgaggctggcaggagcc

SEQ ID NO: 7530304 - DNA, 18 bp, Homo sapiens
ctgaggctggcaggagcc

SEQ ID NO: 7530305 - DNA, 22 bp, Homo sapiens
ctgaggctggagtgcagtggtg

SEQ ID NO: 7530306 - DNA, 22 bp, Homo sapiens
ctgaggctggagtgcagtggtg

SEQ ID NO: 7530307 - DNA, 22 bp, Homo sapiens
ctgaggctggagtgcagtggtg

SEQ ID NO: 7530308 - DNA, 18 bp, Homo sapiens
ctgaggctggcaggagcc

SEQ ID NO: 7530309 - DNA, 22 bp, Homo sapiens
ctgaggctggagtgcagtggtg

SEQ ID NO: 7530310 - DNA, 22 bp, Homo sapiens
ctgaggctggagtgcagtggtg

SEQ ID NO: 7530311 - DNA, 22 bp, Homo sapiens
ctgaggtccttgactgcttgcc

SEQ ID NO: 7530312 - DNA, 22 bp, Homo sapiens
ctgaggtctagacaccccaggg

SEQ ID NO: 7530313 - DNA, 22 bp, Homo sapiens
ctgaggtccttgactgcttgcc

SEQ ID NO: 7530314 - DNA, 22 bp, Homo sapiens
ctgaggtctagacaccccaggg

SEQ ID NO: 7530315 - DNA, 22 bp, Homo sapiens
ctgaggtctattttgaaactgc

SEQ ID NO: 7530316 - DNA, 22 bp, Homo sapiens
ctgaggtcctcagagggaaagg

SEQ ID NO: 7530317 - DNA, 22 bp, Homo sapiens
ctgaggtcctcagagggaaagg

SEQ ID NO: 7530318 - DNA, 22 bp, Homo sapiens
ctgaggtccttgactgcttgcc

SEQ ID NO: 7530319 - DNA, 22 bp, Homo sapiens
ctgaggtcaggagttcaagctg

SEQ ID NO: 7530320 - DNA, 22 bp, Homo sapiens
ctgaggtcctcagagggaaagg

SEQ ID NO: 7530321 - DNA, 22 bp, Homo sapiens
ctgaggtcaggagttcaagctg

SEQ ID NO: 7530322 - DNA, 17 bp, Homo sapiens
ctgaggggagtgctgtg

SEQ ID NO: 7530323 - DNA, 17 bp, Homo sapiens
ctgaggggagtgctgtg

SEQ ID NO: 7530324 - DNA, 17 bp, Homo sapiens
ctgaggggagtgctgtg

SEQ ID NO: 7530325 - DNA, 17 bp, Homo sapiens
ctgaggggagtgctgtg

SEQ ID NO: 7530326 - DNA, 17 bp, Homo sapiens
ctgaggggagtgctgtg

SEQ ID NO: 7530327 - DNA, 17 bp, Homo sapiens
ctgaggggagtgctgtg

SEQ ID NO: 7530328 - DNA, 17 bp, Homo sapiens
ctgaggggagtgctgtg

SEQ ID NO: 7530329 - DNA, 22 bp, Homo sapiens
ctcttccttaagactataaaga

SEQ ID NO: 7530330 - DNA, 22 bp, Homo sapiens
ctcttccttaagactataaaga

SEQ ID NO: 7530331 - DNA, 22 bp, Homo sapiens
ctcttcctttcccttgagggtg

SEQ ID NO: 7530332 - DNA, 22 bp, Homo sapiens
ctcttccttaagactataaaga

SEQ ID NO: 7530333 - DNA, 22 bp, Homo sapiens
ctcttctctgcagcctttgaag

SEQ ID NO: 7530334 - DNA, 22 bp, Homo sapiens
ctcttctctgcagcctttgaag

SEQ ID NO: 7530335 - DNA, 22 bp, Homo sapiens
ctcttcctttcccttgagggtg

SEQ ID NO: 7530336 - DNA, 22 bp, Homo sapiens
ctcttcctttcccttgagggtg

SEQ ID NO: 7530337 - DNA, 22 bp, Homo sapiens
ctcttcctttcccttgagggtg

SEQ ID NO: 7530338 - DNA, 22 bp, Homo sapiens
ctcttcctacagtctgctatgc

SEQ ID NO: 7530339 - DNA, 22 bp, Homo sapiens
ctcttcctagtgtgcagcgtgg

SEQ ID NO: 7530340 - DNA, 22 bp, Homo sapiens
ctcttcctagtgtgcagcgtgg

SEQ ID NO: 7530341 - DNA, 22 bp, Homo sapiens
ctcttcctagtgtgcagcgtgg

SEQ ID NO: 7530342 - DNA, 22 bp, Homo sapiens
ctcttcctagtgtgcagcgtgg

SEQ ID NO: 7530343 - DNA, 22 bp, Homo sapiens
ctcttcctagtgtgcagcgtgg

SEQ ID NO: 7530344 - DNA, 22 bp, Homo sapiens
ctcttcctagtgtgcagcgtgg

SEQ ID NO: 7530345 - DNA, 22 bp, Homo sapiens
ctcttcctagtgtgcagcgtgg

SEQ ID NO: 7530346 - DNA, 22 bp, Homo sapiens
ctcttcctctcatgcggtcata

SEQ ID NO: 7530347 - DNA, 22 bp, Homo sapiens
ctcttcctctcatgcggtcata

SEQ ID NO: 7530348 - DNA, 22 bp, Homo sapiens
ctcttctgtacctcggcctcca

SEQ ID NO: 7530349 - DNA, 22 bp, Homo sapiens
ctcttctgtacctcggcctcca

SEQ ID NO: 7530350 - DNA, 22 bp, Homo sapiens
ctcttctgtacctcggcctcca

SEQ ID NO: 7530351 - DNA, 22 bp, Homo sapiens
ctcttctctgcagcctttgaag

SEQ ID NO: 7530352 - DNA, 22 bp, Homo sapiens
ctcttctgtacctcggcctcca

SEQ ID NO: 7530353 - DNA, 22 bp, Homo sapiens
ctcttctctgcagcctttgaag

SEQ ID NO: 7530354 - DNA, 22 bp, Homo sapiens
ctcttctctgcagcctttgaag

SEQ ID NO: 7530355 - DNA, 22 bp, Homo sapiens
ctcttctctgcagcctttgaag

SEQ ID NO: 7530356 - DNA, 22 bp, Homo sapiens
ctcttcttgaaagaggaattca

SEQ ID NO: 7530357 - DNA, 22 bp, Homo sapiens
ctcttcttgaaagaggaattca

SEQ ID NO: 7530358 - DNA, 22 bp, Homo sapiens
ctcttcttgaaagaggaattca

SEQ ID NO: 7530359 - DNA, 22 bp, Homo sapiens
ctgagcactgggcacatagctg

SEQ ID NO: 7530360 - DNA, 22 bp, Homo sapiens
ctcttcttatggccgtggctga

SEQ ID NO: 7530361 - DNA, 19 bp, Homo sapiens
ttttggaaatgtgaacagc

SEQ ID NO: 7530362 - DNA, 19 bp, Homo sapiens
ttttggaaatgtgaacagc

SEQ ID NO: 7530363 - DNA, 19 bp, Homo sapiens
ttttggaaatgtgaacagc

SEQ ID NO: 7530364 - DNA, 22 bp, Homo sapiens
ttttgcttttgtaacacagtgt

SEQ ID NO: 7530365 - DNA, 22 bp, Homo sapiens
ttttgctttaagatggagagga

SEQ ID NO: 7530366 - DNA, 19 bp, Homo sapiens
ttttggaaatgtgaacagc

SEQ ID NO: 7530367 - DNA, 19 bp, Homo sapiens
ttttggaaatgtgaacagc

SEQ ID NO: 7530368 - DNA, 22 bp, Homo sapiens
ttttgcttttgtaacacagtgt

SEQ ID NO: 7530369 - DNA, 22 bp, Homo sapiens
ttttgcttttgtaacacagtgt

SEQ ID NO: 7530370 - DNA, 22 bp, Homo sapiens
ttttgcttttgtaacacagtgt

SEQ ID NO: 7530371 - DNA, 22 bp, Homo sapiens
ttttgcttttgtaacacagtgt

SEQ ID NO: 7530372 - DNA, 22 bp, Homo sapiens
ttttgcttttgtaacacagtgt

SEQ ID NO: 7530373 - DNA, 22 bp, Homo sapiens
ttttgcttttgtaacacagtgt

SEQ ID NO: 7530374 - DNA, 22 bp, Homo sapiens
ttttgctttaagatggagagga

SEQ ID NO: 7530375 - DNA, 22 bp, Homo sapiens
ttttgctttaagatggagagga

SEQ ID NO: 7530376 - DNA, 22 bp, Homo sapiens
ttttgctttaagatggagagga

SEQ ID NO: 7530377 - DNA, 22 bp, Homo sapiens
ttttgctttaagatggagagga

SEQ ID NO: 7530378 - DNA, 22 bp, Homo sapiens
ttttgcttgagtgcacaaaatg

SEQ ID NO: 7530379 - DNA, 22 bp, Homo sapiens
ttttgcttgagtgcacaaaatg

SEQ ID NO: 7530380 - DNA, 22 bp, Homo sapiens
ttttgcttgagtgcacaaaatg

SEQ ID NO: 7530381 - DNA, 22 bp, Homo sapiens
ttttgcttgagtgcacaaaatg

SEQ ID NO: 7530382 - DNA, 22 bp, Homo sapiens
ttttgcttatctgagtgcagcc

SEQ ID NO: 7530383 - DNA, 22 bp, Homo sapiens
ttttgcttatctgagtgcagcc

SEQ ID NO: 7530384 - DNA, 22 bp, Homo sapiens
ttttgcttatctgagtgcagcc

SEQ ID NO: 7530385 - DNA, 22 bp, Homo sapiens
ttttgcttatctgagtgcagcc

SEQ ID NO: 7530386 - DNA, 22 bp, Homo sapiens
ttttgcttgagtgcacaaaatg

SEQ ID NO: 7530387 - DNA, 22 bp, Homo sapiens
ttttgcttgagtgcacaaaatg

SEQ ID NO: 7530388 - DNA, 22 bp, Homo sapiens
ttttggaaccaacagtgcacct

SEQ ID NO: 7530389 - DNA, 22 bp, Homo sapiens
ttttggaaccaacagtgcacct

SEQ ID NO: 7530390 - DNA, 22 bp, Homo sapiens
ttttggaatcatttacagagca

SEQ ID NO: 7530391 - DNA, 22 bp, Homo sapiens
ttttggaagccgcggctgggca

SEQ ID NO: 7530392 - DNA, 22 bp, Homo sapiens
ttttggaagccgcggctgggca

SEQ ID NO: 7530393 - DNA, 22 bp, Homo sapiens
ttttggaatcatttacagagca

SEQ ID NO: 7530394 - DNA, 22 bp, Homo sapiens
ttttggaatcatttacagagca

SEQ ID NO: 7530395 - DNA, 22 bp, Homo sapiens
ttttggaatcatttacagagca

SEQ ID NO: 7530396 - DNA, 22 bp, Homo sapiens
ttttggaatctgggaaaacagt

SEQ ID NO: 7530397 - DNA, 22 bp, Homo sapiens
ttttggaatcatttacagagca

SEQ ID NO: 7530398 - DNA, 22 bp, Homo sapiens
ttttggaacacagacattagaa

SEQ ID NO: 7530399 - DNA, 22 bp, Homo sapiens
ttttggaaccaacagtgcacct

SEQ ID NO: 7530400 - DNA, 22 bp, Homo sapiens
ttttggaacacagacattagaa

SEQ ID NO: 7530401 - DNA, 22 bp, Homo sapiens
ttttggaacacagacattagaa

SEQ ID NO: 7530402 - DNA, 22 bp, Homo sapiens
ttttggaacacagacattagaa

SEQ ID NO: 7530403 - DNA, 22 bp, Homo sapiens
ttttggaacacagacattagaa

SEQ ID NO: 7530404 - DNA, 22 bp, Homo sapiens
ttttggaacacagacattagaa

SEQ ID NO: 7530405 - DNA, 22 bp, Homo sapiens
ctcttcccagctccacgagagg

SEQ ID NO: 7530406 - DNA, 22 bp, Homo sapiens
ctcttcctacagtctgctatgc

SEQ ID NO: 7530407 - DNA, 22 bp, Homo sapiens
ctcttcctacagtctgctatgc

SEQ ID NO: 7530408 - DNA, 22 bp, Homo sapiens
ctcttcctacagtctgctatgc

SEQ ID NO: 7530409 - DNA, 22 bp, Homo sapiens
ctcttcctacagtctgctatgc

SEQ ID NO: 7530410 - DNA, 22 bp, Homo sapiens
ctgagcagtctgactcaagcta

SEQ ID NO: 7530411 - DNA, 22 bp, Homo sapiens
ctgagcagtctgactcaagcta

SEQ ID NO: 7530412 - DNA, 22 bp, Homo sapiens
ctgagcagtctgactcaagcta

SEQ ID NO: 7530413 - DNA, 22 bp, Homo sapiens
ctgagcagtctgactcaagcta

SEQ ID NO: 7530414 - DNA, 22 bp, Homo sapiens
ctgagcagtgctttgcagtggg

SEQ ID NO: 7530415 - DNA, 22 bp, Homo sapiens
ctgagcagtgctttgcagtggg

SEQ ID NO: 7530416 - DNA, 22 bp, Homo sapiens
ctgagcagtgctttgcagtggg

SEQ ID NO: 7530417 - DNA, 22 bp, Homo sapiens
ctgagcagtgctttgcagtggg

SEQ ID NO: 7530418 - DNA, 22 bp, Homo sapiens
ctgagcagtctgactcaagcta

SEQ ID NO: 7530419 - DNA, 22 bp, Homo sapiens
ctgagcagtctgactcaagcta

SEQ ID NO: 7530420 - DNA, 22 bp, Homo sapiens
ctgagcagtttcttagggctca

SEQ ID NO: 7530421 - DNA, 22 bp, Homo sapiens
ctgagcagtttcttagggctca

SEQ ID NO: 7530422 - DNA, 22 bp, Homo sapiens
ctgagcagtggttcttgagcgc

SEQ ID NO: 7530423 - DNA, 22 bp, Homo sapiens
ctgagcagtggttcttgagcgc

SEQ ID NO: 7530424 - DNA, 22 bp, Homo sapiens
ctgagcagtgctttgcagtggg

SEQ ID NO: 7530425 - DNA, 22 bp, Homo sapiens
ctgagcagtgctttgcagtggg

SEQ ID NO: 7530426 - DNA, 22 bp, Homo sapiens
ctgagcagtggttcttgagcgc

SEQ ID NO: 7530427 - DNA, 22 bp, Homo sapiens
ctgagcagtggttcttgagcgc

SEQ ID NO: 7530428 - DNA, 22 bp, Homo sapiens
ctgagcagtggttcttgagcgc

SEQ ID NO: 7530429 - DNA, 22 bp, Homo sapiens
ctgagcagggaccaaaagcatt

SEQ ID NO: 7530430 - DNA, 19 bp, Homo sapiens
ctgagcaggcaggtaggat

SEQ ID NO: 7530431 - DNA, 22 bp, Homo sapiens
ctgagcaggcggtggagcggct

SEQ ID NO: 7530432 - DNA, 22 bp, Homo sapiens
ctgagcaggcggtggagcggct

SEQ ID NO: 7530433 - DNA, 19 bp, Homo sapiens
ctgagcaggcaggtaggat

SEQ ID NO: 7530434 - DNA, 19 bp, Homo sapiens
ctgagcaggcaggtaggat

SEQ ID NO: 7530435 - DNA, 22 bp, Homo sapiens
ctgagcaggatattcacagcag

SEQ ID NO: 7530436 - DNA, 19 bp, Homo sapiens
ctgagcaggcaggtaggat

SEQ ID NO: 7530437 - DNA, 22 bp, Homo sapiens
ctgagcagtagagggtctcttt

SEQ ID NO: 7530438 - DNA, 22 bp, Homo sapiens
ctgagcagggaccaaaagcatt

SEQ ID NO: 7530439 - DNA, 22 bp, Homo sapiens
ctgagcagtctagccaggtgtt

SEQ ID NO: 7530440 - DNA, 22 bp, Homo sapiens
ctgagcagtagagggtctcttt

SEQ ID NO: 7530441 - DNA, 22 bp, Homo sapiens
ctgagcagtctagccaggtgtt

SEQ ID NO: 7530442 - DNA, 22 bp, Homo sapiens
ctgagcagtctagccaggtgtt

SEQ ID NO: 7530443 - DNA, 22 bp, Homo sapiens
ctgagcagtagagggtctcttt

SEQ ID NO: 7530444 - DNA, 22 bp, Homo sapiens
ctgagcagtctagccaggtgtt

SEQ ID NO: 7530445 - DNA, 22 bp, Homo sapiens
ctgagcagtctagccaggtgtt

SEQ ID NO: 7530446 - DNA, 22 bp, Homo sapiens
ctgagcagaccatggcagaggt

SEQ ID NO: 7530447 - DNA, 22 bp, Homo sapiens
ctgagcagaccatggcagaggt

SEQ ID NO: 7530448 - DNA, 22 bp, Homo sapiens
ctgagcagaccatggcagaggt

SEQ ID NO: 7530449 - DNA, 19 bp, Homo sapiens
ctgagcagcggcagcactt

SEQ ID NO: 7530450 - DNA, 19 bp, Homo sapiens
ctgagcagcggcagcactt

SEQ ID NO: 7530451 - DNA, 19 bp, Homo sapiens
ctgagcagcggcagcactt

SEQ ID NO: 7530452 - DNA, 19 bp, Homo sapiens
ctgagcagcggcagcactt

SEQ ID NO: 7530453 - DNA, 19 bp, Homo sapiens
ctgagcagcggcagcactt

SEQ ID NO: 7530454 - DNA, 22 bp, Homo sapiens
ctgagcagaagggtgcacgtgc

SEQ ID NO: 7530455 - DNA, 22 bp, Homo sapiens
ctgagcagaagggtgcacgtgc

SEQ ID NO: 7530456 - DNA, 22 bp, Homo sapiens
ctgagcagaagggtgcacgtgc

SEQ ID NO: 7530457 - DNA, 22 bp, Homo sapiens
ctgagcagaagggtgcacgtgc

SEQ ID NO: 7530458 - DNA, 22 bp, Homo sapiens
ctgagcagaagggtgcacgtgc

SEQ ID NO: 7530459 - DNA, 22 bp, Homo sapiens
ctgagcagaccatggcagaggt

SEQ ID NO: 7530460 - DNA, 22 bp, Homo sapiens
ctgagcagaccatggcagaggt

SEQ ID NO: 7530461 - DNA, 22 bp, Homo sapiens
ctgagcagaccatggcagaggt

SEQ ID NO: 7530462 - DNA, 22 bp, Homo sapiens
ctgagcagaccatggcagaggt

SEQ ID NO: 7530463 - DNA, 22 bp, Homo sapiens
ctgagcaggacagtgggagacc

SEQ ID NO: 7530464 - DNA, 22 bp, Homo sapiens
ctgagcaggatattcacagcag

SEQ ID NO: 7530465 - DNA, 22 bp, Homo sapiens
ctgagcaggatattcacagcag

SEQ ID NO: 7530466 - DNA, 22 bp, Homo sapiens
ctgagcaggacagtgggagacc

SEQ ID NO: 7530467 - DNA, 22 bp, Homo sapiens
ctgagcagctgttacagagtgt

SEQ ID NO: 7530468 - DNA, 22 bp, Homo sapiens
ctgagcagctgttacagagtgt

SEQ ID NO: 7530469 - DNA, 22 bp, Homo sapiens
ctgagcagctgttacagagtgt

SEQ ID NO: 7530470 - DNA, 22 bp, Homo sapiens
ctgagcagctgttacagagtgt

SEQ ID NO: 7530471 - DNA, 22 bp, Homo sapiens
ctgagcagcgtggggagctggc

SEQ ID NO: 7530472 - DNA, 22 bp, Homo sapiens
ctgagcagcgtggggagctggc

SEQ ID NO: 7530473 - DNA, 22 bp, Homo sapiens
ctgagcagcgtggggagctggc

SEQ ID NO: 7530474 - DNA, 22 bp, Homo sapiens
ctgagcagcgtggggagctggc

SEQ ID NO: 7530475 - DNA, 22 bp, Homo sapiens
ctggaaggtggatggcgaggcc

SEQ ID NO: 7530476 - DNA, 22 bp, Homo sapiens
ctggaaggtgactgtcttgaat

SEQ ID NO: 7530477 - DNA, 22 bp, Homo sapiens
ctggaaggtgactgtcttgaat

SEQ ID NO: 7530478 - DNA, 22 bp, Homo sapiens
ctggaaggtggatggcgaggcc

SEQ ID NO: 7530479 - DNA, 22 bp, Homo sapiens
ctggaaggtggatggcgaggcc

SEQ ID NO: 7530480 - DNA, 22 bp, Homo sapiens
ctggaaggtggatggcgaggcc

SEQ ID NO: 7530481 - DNA, 22 bp, Homo sapiens
ctggaaggtctgtccccactgc

SEQ ID NO: 7530482 - DNA, 22 bp, Homo sapiens
ctggaaggtctgtccccactgc

SEQ ID NO: 7530483 - DNA, 22 bp, Homo sapiens
ctggaaggtaacaaggccatta

SEQ ID NO: 7530484 - DNA, 22 bp, Homo sapiens
ctggaaggtaacaaggccatta

SEQ ID NO: 7530485 - DNA, 22 bp, Homo sapiens
ctggaaggtaacaaggccatta

SEQ ID NO: 7530486 - DNA, 22 bp, Homo sapiens
ctggaaggtaacaaggccatta

SEQ ID NO: 7530487 - DNA, 22 bp, Homo sapiens
ctggaagggtctacttagcaga

SEQ ID NO: 7530488 - DNA, 22 bp, Homo sapiens
ctggaagggtctacttagcaga

SEQ ID NO: 7530489 - DNA, 22 bp, Homo sapiens
ctggaagggtcagagtgatgag

SEQ ID NO: 7530490 - DNA, 22 bp, Homo sapiens
ctggaagggtcagagtgatgag

SEQ ID NO: 7530491 - DNA, 22 bp, Homo sapiens
ctggaagggtcagagtgatgag

SEQ ID NO: 7530492 - DNA, 22 bp, Homo sapiens
ctggaagggtcagagtgatgag

SEQ ID NO: 7530493 - DNA, 22 bp, Homo sapiens
ctggaagggtctacttagcaga

SEQ ID NO: 7530494 - DNA, 22 bp, Homo sapiens
ctggaagggtcagagtgatgag

SEQ ID NO: 7530495 - DNA, 22 bp, Homo sapiens
ctggagaaacatcaggcatagg

SEQ ID NO: 7530496 - DNA, 22 bp, Homo sapiens
ctggagaacagagctgtttaga

SEQ ID NO: 7530497 - DNA, 22 bp, Homo sapiens
ctggagaactagttaaacacgt

SEQ ID NO: 7530498 - DNA, 22 bp, Homo sapiens
ctggagagaccgaaagaggctg

SEQ ID NO: 7530499 - DNA, 22 bp, Homo sapiens
ctggagaactagttaaacacgt

SEQ ID NO: 7530500 - DNA, 22 bp, Homo sapiens
ctggagagaccgaaagaggctg

SEQ ID NO: 7530501 - DNA, 22 bp, Homo sapiens
ctggagagaccgaaagaggctg

SEQ ID NO: 7530502 - DNA, 22 bp, Homo sapiens
ctggagagaccgaaagaggctg

SEQ ID NO: 7530503 - DNA, 22 bp, Homo sapiens
ctggagagaccgaaagaggctg

SEQ ID NO: 7530504 - DNA, 22 bp, Homo sapiens
ctggaaggttcctcccagctcc

SEQ ID NO: 7530505 - DNA, 22 bp, Homo sapiens
ctggagaaaatccatgtgtatg

SEQ ID NO: 7530506 - DNA, 22 bp, Homo sapiens
ctggagaaaatccatgtgtatg

SEQ ID NO: 7530507 - DNA, 22 bp, Homo sapiens
ctggagaaaatccatgtgtatg

SEQ ID NO: 7530508 - DNA, 22 bp, Homo sapiens
ctggaaggttcctcccagctcc

SEQ ID NO: 7530509 - DNA, 22 bp, Homo sapiens
ctggaaggttcctcccagctcc

SEQ ID NO: 7530510 - DNA, 22 bp, Homo sapiens
ctggaaggttcctcccagctcc

SEQ ID NO: 7530511 - DNA, 22 bp, Homo sapiens
ctggaaggttcctcccagctcc

SEQ ID NO: 7530512 - DNA, 22 bp, Homo sapiens
ctggaaggttcctcccagctcc

SEQ ID NO: 7530513 - DNA, 22 bp, Homo sapiens
ctggaaggagcccgggcggatc

SEQ ID NO: 7530514 - DNA, 22 bp, Homo sapiens
ctggaaggagcccgggcggatc

SEQ ID NO: 7530515 - DNA, 22 bp, Homo sapiens
ctggaaggagcccgggcggatc

SEQ ID NO: 7530516 - DNA, 22 bp, Homo sapiens
ctggaaggagaaggaggctgtg

SEQ ID NO: 7530517 - DNA, 19 bp, Homo sapiens
ctggaaggagggactgttc

SEQ ID NO: 7530518 - DNA, 19 bp, Homo sapiens
ctggaaggagggactgttc

SEQ ID NO: 7530519 - DNA, 19 bp, Homo sapiens
ctggaaggagggactgttc

SEQ ID NO: 7530520 - DNA, 19 bp, Homo sapiens
ctggaaggagggactgttc

SEQ ID NO: 7530521 - DNA, 22 bp, Homo sapiens
ctggaaggagcccgggcggatc

SEQ ID NO: 7530522 - DNA, 22 bp, Homo sapiens
ctggaaggctctgctgcctgtc

SEQ ID NO: 7530523 - DNA, 22 bp, Homo sapiens
ctggaaggcggaggttgtagtg

SEQ ID NO: 7530524 - DNA, 22 bp, Homo sapiens
ctggaaggctctgctgcctgtc

SEQ ID NO: 7530525 - DNA, 22 bp, Homo sapiens
ctggaaggcagaggttgcagtg

SEQ ID NO: 7530526 - DNA, 22 bp, Homo sapiens
ctggaaggagcccgggcggatc

SEQ ID NO: 7530527 - DNA, 22 bp, Homo sapiens
ctggaaggcggaggttgtagtg

SEQ ID NO: 7530528 - DNA, 22 bp, Homo sapiens
ctggaaggcggaggttgtagtg

SEQ ID NO: 7530529 - DNA, 22 bp, Homo sapiens
ctggaaggcggaggttgtagtg

SEQ ID NO: 7530530 - DNA, 22 bp, Homo sapiens
ctggaaggcagaggttgcagtg

SEQ ID NO: 7530531 - DNA, 22 bp, Homo sapiens
ctggaaggcagaggttgcagtg

SEQ ID NO: 7530532 - DNA, 22 bp, Homo sapiens
ctggaaggcagaggttgcagtg

SEQ ID NO: 7530533 - DNA, 22 bp, Homo sapiens
ctggaaggcagaggttgcagtg

SEQ ID NO: 7530534 - DNA, 22 bp, Homo sapiens
ctggaaggcagaggttgcagtg

SEQ ID NO: 7530535 - DNA, 19 bp, Homo sapiens
ctggaaggagggactgttc

SEQ ID NO: 7530536 - DNA, 22 bp, Homo sapiens
ctggaagggggacagccacaca

SEQ ID NO: 7530537 - DNA, 22 bp, Homo sapiens
ctggaagggtacataggaaact

SEQ ID NO: 7530538 - DNA, 22 bp, Homo sapiens
ctggaagggtacataggaaact

SEQ ID NO: 7530539 - DNA, 22 bp, Homo sapiens
ctggaagggtacataggaaact

SEQ ID NO: 7530540 - DNA, 22 bp, Homo sapiens
ctggaagggtcagagtgatgag

SEQ ID NO: 7530541 - DNA, 22 bp, Homo sapiens
ctggaagggtacataggaaact

SEQ ID NO: 7530542 - DNA, 22 bp, Homo sapiens
ctggaagggggacagccacaca

SEQ ID NO: 7530543 - DNA, 22 bp, Homo sapiens
ctggaaggggcagtctttgggc

SEQ ID NO: 7530544 - DNA, 22 bp, Homo sapiens
ctggaagggggacagccacaca

SEQ ID NO: 7530545 - DNA, 22 bp, Homo sapiens
ctggaagggggacagccacaca

SEQ ID NO: 7530546 - DNA, 22 bp, Homo sapiens
ctggaagggagcactgtagaga

SEQ ID NO: 7530547 - DNA, 22 bp, Homo sapiens
ctggaagggagcactgtagaga

SEQ ID NO: 7530548 - DNA, 22 bp, Homo sapiens
ctggaaggggcagtctttgggc

SEQ ID NO: 7530549 - DNA, 22 bp, Homo sapiens
ctggaagggagcactgtagaga

SEQ ID NO: 7530550 - DNA, 22 bp, Homo sapiens
ctggaagggaaatctcttggca

SEQ ID NO: 7530551 - DNA, 22 bp, Homo sapiens
ctggaagggagcactgtagaga

SEQ ID NO: 7530552 - DNA, 22 bp, Homo sapiens
ctggaagggagcactgtagaga

SEQ ID NO: 7530553 - DNA, 22 bp, Homo sapiens
ctggaaggctctgctgcctgtc

SEQ ID NO: 7530554 - DNA, 22 bp, Homo sapiens
ctggaaggctctgctgcctgtc

SEQ ID NO: 7530555 - DNA, 22 bp, Homo sapiens
ctggaagggaaatctcttggca

SEQ ID NO: 7530556 - DNA, 22 bp, Homo sapiens
ctggaagggaaatctcttggca

SEQ ID NO: 7530557 - DNA, 22 bp, Homo sapiens
ctggaagggaaatctcttggca

SEQ ID NO: 7530558 - DNA, 22 bp, Homo sapiens
ctggaagaggacacacgaatca

SEQ ID NO: 7530559 - DNA, 22 bp, Homo sapiens
ctggaagaggacacacgaatca

SEQ ID NO: 7530560 - DNA, 22 bp, Homo sapiens
ctggaagaggggaaatgccatg

SEQ ID NO: 7530561 - DNA, 22 bp, Homo sapiens
ctggaagaggggaaatgccatg

SEQ ID NO: 7530562 - DNA, 22 bp, Homo sapiens
ctggaagaggacacacgaatca

SEQ ID NO: 7530563 - DNA, 22 bp, Homo sapiens
ctggaagaggaagccagctgga

SEQ ID NO: 7530564 - DNA, 22 bp, Homo sapiens
ctggaagaggaagccagctgga

SEQ ID NO: 7530565 - DNA, 22 bp, Homo sapiens
ctggaagaggggaaatgccatg

SEQ ID NO: 7530566 - DNA, 22 bp, Homo sapiens
ctggaagagtaatataaattag

SEQ ID NO: 7530567 - DNA, 22 bp, Homo sapiens
ctggaagagtaatataaattag

SEQ ID NO: 7530568 - DNA, 22 bp, Homo sapiens
ctggaagagtaatataaattag

SEQ ID NO: 7530569 - DNA, 22 bp, Homo sapiens
ctggaagagtaatataaattag

SEQ ID NO: 7530570 - DNA, 22 bp, Homo sapiens
ctggaagagtcctaaacagata

SEQ ID NO: 7530571 - DNA, 22 bp, Homo sapiens
ctggaagagtcctaaacagata

SEQ ID NO: 7530572 - DNA, 22 bp, Homo sapiens
ctggaagagtcctaaacagata

SEQ ID NO: 7530573 - DNA, 22 bp, Homo sapiens
ctggaagagtcctaaacagata

SEQ ID NO: 7530574 - DNA, 22 bp, Homo sapiens
ctggaagagtcctaaacagata

SEQ ID NO: 7530575 - DNA, 22 bp, Homo sapiens
ctggaagagtgactttgcattt

SEQ ID NO: 7530576 - DNA, 20 bp, Homo sapiens
ctggaagcctttccagagca

SEQ ID NO: 7530577 - DNA, 22 bp, Homo sapiens
ctggaagagtgactttgcattt

SEQ ID NO: 7530578 - DNA, 22 bp, Homo sapiens
ctggaagagtgactttgcattt

SEQ ID NO: 7530579 - DNA, 20 bp, Homo sapiens
ctggaagcctttccagagca

SEQ ID NO: 7530580 - DNA, 20 bp, Homo sapiens
ctggaagcctttccagagca

SEQ ID NO: 7530581 - DNA, 22 bp, Homo sapiens
ctggaaggagaaggaggctgtg

SEQ ID NO: 7530582 - DNA, 22 bp, Homo sapiens
ctggaaggagaaggaggctgtg

SEQ ID NO: 7530583 - DNA, 22 bp, Homo sapiens
ctggaaggagaaggaggctgtg

SEQ ID NO: 7530584 - DNA, 22 bp, Homo sapiens
ctggaagctggaacaggtgtgg

SEQ ID NO: 7530585 - DNA, 22 bp, Homo sapiens
ctggaagcttgtttgccagtct

SEQ ID NO: 7530586 - DNA, 22 bp, Homo sapiens
ctggaagcttgtttgccagtct

SEQ ID NO: 7530587 - DNA, 22 bp, Homo sapiens
ctggaaggagaaggaggctgtg

SEQ ID NO: 7530588 - DNA, 22 bp, Homo sapiens
ctggaaggagaaggaggctgtg

SEQ ID NO: 7530589 - DNA, 22 bp, Homo sapiens
ctggaaggagaaggaggctgtg

SEQ ID NO: 7530590 - DNA, 22 bp, Homo sapiens
ctggaaggagaaggaggctgtg

SEQ ID NO: 7530591 - DNA, 22 bp, Homo sapiens
ctggaaggagaaggaggctgtg

SEQ ID NO: 7530592 - DNA, 22 bp, Homo sapiens
ctggaaggagaaggaggctgtg

SEQ ID NO: 7530593 - DNA, 22 bp, Homo sapiens
ctggaaggagaaggaggctgtg

SEQ ID NO: 7530594 - DNA, 22 bp, Homo sapiens
ctgctgtgagcactccagcctg

SEQ ID NO: 7530595 - DNA, 22 bp, Homo sapiens
ctgctgtgagcactccagcctg

SEQ ID NO: 7530596 - DNA, 22 bp, Homo sapiens
ctgctgtgacagctgccgtgtt

SEQ ID NO: 7530597 - DNA, 22 bp, Homo sapiens
ctgctgtgagtggttcttgcct

SEQ ID NO: 7530598 - DNA, 22 bp, Homo sapiens
ctgctgtgagtggttcttgcct

SEQ ID NO: 7530599 - DNA, 22 bp, Homo sapiens
ctgctgtgagtggttcttgcct

SEQ ID NO: 7530600 - DNA, 22 bp, Homo sapiens
ctgctgtctttatttcactgct

SEQ ID NO: 7530601 - DNA, 22 bp, Homo sapiens
ctgctgtctttatttcactgct

SEQ ID NO: 7530602 - DNA, 22 bp, Homo sapiens
ctgctgtctagtatcttaaaaa

SEQ ID NO: 7530603 - DNA, 22 bp, Homo sapiens
ctgctgtcgccgagctgcatgc

SEQ ID NO: 7530604 - DNA, 22 bp, Homo sapiens
ctgctgtctagtatcttaaaaa

SEQ ID NO: 7530605 - DNA, 22 bp, Homo sapiens
ctgctgtctcactggtgtggtt

SEQ ID NO: 7530606 - DNA, 22 bp, Homo sapiens
ctgctgtctcactggtgtggtt

SEQ ID NO: 7530607 - DNA, 22 bp, Homo sapiens
ctgctgtctcactggtgtggtt

SEQ ID NO: 7530608 - DNA, 22 bp, Homo sapiens
ctgctgtctcactggtgtggtt

SEQ ID NO: 7530609 - DNA, 22 bp, Homo sapiens
ctggaaagtgctgagacaattg

SEQ ID NO: 7530610 - DNA, 22 bp, Homo sapiens
ctggaaagtgcatgtaatgagg

SEQ ID NO: 7530611 - DNA, 22 bp, Homo sapiens
ctggaaagtgtctccatcctgg

SEQ ID NO: 7530612 - DNA, 22 bp, Homo sapiens
ctggaaagtgcttttctgagag

SEQ ID NO: 7530613 - DNA, 22 bp, Homo sapiens
ctggaaagtgcttttctgagag

SEQ ID NO: 7530614 - DNA, 22 bp, Homo sapiens
ctgctgtgagtttggaggtcta

SEQ ID NO: 7530615 - DNA, 22 bp, Homo sapiens
ctgctgtgagtttggaggtcta

SEQ ID NO: 7530616 - DNA, 22 bp, Homo sapiens
ctgctgtgagtggttcttgcct

SEQ ID NO: 7530617 - DNA, 22 bp, Homo sapiens
ctgctgtgagtttggaggtcta

SEQ ID NO: 7530618 - DNA, 22 bp, Homo sapiens
ctgctgtgagtttggaggtcta

SEQ ID NO: 7530619 - DNA, 22 bp, Homo sapiens
ctgctgtgagtttggaggtcta

SEQ ID NO: 7530620 - DNA, 22 bp, Homo sapiens
ctggaaagtgaggagagttcca

SEQ ID NO: 7530621 - DNA, 22 bp, Homo sapiens
ctgctgtgagtttggaggtcta

SEQ ID NO: 7530622 - DNA, 22 bp, Homo sapiens
ctggaaagtgaggagagttcca

SEQ ID NO: 7530623 - DNA, 22 bp, Homo sapiens
ctggaaagtgaggagagttcca

SEQ ID NO: 7530624 - DNA, 22 bp, Homo sapiens
ctggaaagtgaggagagttcca

SEQ ID NO: 7530625 - DNA, 22 bp, Homo sapiens
ctggaaagtcaggtcagaaact

SEQ ID NO: 7530626 - DNA, 22 bp, Homo sapiens
ctggagataagcagtcccaggc

SEQ ID NO: 7530627 - DNA, 22 bp, Homo sapiens
ctggagagttggaagatggact

SEQ ID NO: 7530628 - DNA, 22 bp, Homo sapiens
ctggagatgtccgggtgctgtt

SEQ ID NO: 7530629 - DNA, 19 bp, Homo sapiens
ctggagatagggcctttaa

SEQ ID NO: 7530630 - DNA, 19 bp, Homo sapiens
ctggagatagggcctttaa

SEQ ID NO: 7530631 - DNA, 22 bp, Homo sapiens
ctggagatactgctctccatat

SEQ ID NO: 7530632 - DNA, 22 bp, Homo sapiens
ctggagcaaaagtgactcctct

SEQ ID NO: 7530633 - DNA, 22 bp, Homo sapiens
ctggagattaagttctcagcca

SEQ ID NO: 7530634 - DNA, 22 bp, Homo sapiens
ctggagattaagttctcagcca

SEQ ID NO: 7530635 - DNA, 22 bp, Homo sapiens
ctggagatgtccgggtgctgtt

SEQ ID NO: 7530636 - DNA, 22 bp, Homo sapiens
ctggagatgtccgggtgctgtt

SEQ ID NO: 7530637 - DNA, 22 bp, Homo sapiens
ctggagatgtccgggtgctgtt

SEQ ID NO: 7530638 - DNA, 22 bp, Homo sapiens
ctggagattaagttctcagcca

SEQ ID NO: 7530639 - DNA, 22 bp, Homo sapiens
ctggagcagcaggtggccaggg

SEQ ID NO: 7530640 - DNA, 22 bp, Homo sapiens
ctggagcagcaggtggccaggg

SEQ ID NO: 7530641 - DNA, 22 bp, Homo sapiens
ctggagcagcaggtggccaggg

SEQ ID NO: 7530642 - DNA, 22 bp, Homo sapiens
ctggagcagcaggtggccaggg

SEQ ID NO: 7530643 - DNA, 22 bp, Homo sapiens
ctggagcaaaagtgactcctct

SEQ ID NO: 7530644 - DNA, 22 bp, Homo sapiens
ctggagcaaaagtgactcctct

SEQ ID NO: 7530645 - DNA, 17 bp, Homo sapiens
ctggagcagacaaaagg

SEQ ID NO: 7530646 - DNA, 22 bp, Homo sapiens
ctggagagtaatctctgtgtta

SEQ ID NO: 7530647 - DNA, 22 bp, Homo sapiens
ctggagagtaatctctgtgtta

SEQ ID NO: 7530648 - DNA, 22 bp, Homo sapiens
ctggagagttggaagatggact

SEQ ID NO: 7530649 - DNA, 22 bp, Homo sapiens
ctggagagggagctgttggaag

SEQ ID NO: 7530650 - DNA, 22 bp, Homo sapiens
ctggagagggagctgttggaag

SEQ ID NO: 7530651 - DNA, 22 bp, Homo sapiens
ctggagagggagctgttggaag

SEQ ID NO: 7530652 - DNA, 22 bp, Homo sapiens
ctggagagggagctgttggaag

SEQ ID NO: 7530653 - DNA, 22 bp, Homo sapiens
ctggagagttggaagatggact

SEQ ID NO: 7530654 - DNA, 22 bp, Homo sapiens
ctggagagttggaagatggact

SEQ ID NO: 7530655 - DNA, 22 bp, Homo sapiens
ctggagagttggaagatggact

SEQ ID NO: 7530656 - DNA, 22 bp, Homo sapiens
ctggagagttggaagatggact

SEQ ID NO: 7530657 - DNA, 22 bp, Homo sapiens
ctggagagttggaagatggact

SEQ ID NO: 7530658 - DNA, 22 bp, Homo sapiens
ctggagagttggaagatggact

SEQ ID NO: 7530659 - DNA, 22 bp, Homo sapiens
ctggagagttggaagatggact

SEQ ID NO: 7530660 - DNA, 22 bp, Homo sapiens
ctggagagttggaagatggact

SEQ ID NO: 7530661 - DNA, 22 bp, Homo sapiens
ctggagagttggaagatggact

SEQ ID NO: 7530662 - DNA, 22 bp, Homo sapiens
ctggagagttggaagatggact

SEQ ID NO: 7530663 - DNA, 22 bp, Homo sapiens
ctggagagggagccctggcagt

SEQ ID NO: 7530664 - DNA, 22 bp, Homo sapiens
ctggagagggagccctggcagt

SEQ ID NO: 7530665 - DNA, 22 bp, Homo sapiens
ctggagagggagccctggcagt

SEQ ID NO: 7530666 - DNA, 22 bp, Homo sapiens
ctggagagggagccctggcagt

SEQ ID NO: 7530667 - DNA, 22 bp, Homo sapiens
ctggagagggagccctggcagt

SEQ ID NO: 7530668 - DNA, 22 bp, Homo sapiens
ctggagagggagccctggcagt

SEQ ID NO: 7530669 - DNA, 22 bp, Homo sapiens
ctggagagggagctgttggaag

SEQ ID NO: 7530670 - DNA, 22 bp, Homo sapiens
ctggagagggagccctggcagt

SEQ ID NO: 7530671 - DNA, 22 bp, Homo sapiens
ctggagaggctgggaacaggtt

SEQ ID NO: 7530672 - DNA, 22 bp, Homo sapiens
ctggagagggagccctggcagt

SEQ ID NO: 7530673 - DNA, 22 bp, Homo sapiens
ctggagagggagccctggcagt

SEQ ID NO: 7530674 - DNA, 22 bp, Homo sapiens
ctggagagggagccctggcagt

SEQ ID NO: 7530675 - DNA, 22 bp, Homo sapiens
ctggagaggctgggaacaggtt

SEQ ID NO: 7530676 - DNA, 22 bp, Homo sapiens
ctggagaggctgggaacaggtt

SEQ ID NO: 7530677 - DNA, 22 bp, Homo sapiens
ctggagaggctgggaacaggtt

SEQ ID NO: 7530678 - DNA, 22 bp, Homo sapiens
ctggagaggctgggaacaggtt

SEQ ID NO: 7530679 - DNA, 22 bp, Homo sapiens
ctggagaggctgggaacaggtt

SEQ ID NO: 7530680 - DNA, 22 bp, Homo sapiens
ctggagaggctgggaacaggtt

SEQ ID NO: 7530681 - DNA, 22 bp, Homo sapiens
ctggagaggctgggaacaggtt

SEQ ID NO: 7530682 - DNA, 22 bp, Homo sapiens
ctggagaggctgggaacaggtt

SEQ ID NO: 7530683 - DNA, 22 bp, Homo sapiens
ctggagaggctgggaacaggtt

SEQ ID NO: 7530684 - DNA, 22 bp, Homo sapiens
ctggagaggccccaagatattt

SEQ ID NO: 7530685 - DNA, 22 bp, Homo sapiens
ctggagaggccccaagatattt

SEQ ID NO: 7530686 - DNA, 22 bp, Homo sapiens
ctggagaggccccaagatattt

SEQ ID NO: 7530687 - DNA, 22 bp, Homo sapiens
ctggagaggccccaagatattt

SEQ ID NO: 7530688 - DNA, 22 bp, Homo sapiens
ctggagaggccccaagatattt

SEQ ID NO: 7530689 - DNA, 22 bp, Homo sapiens
ctggagaggccccaagatattt

SEQ ID NO: 7530690 - DNA, 22 bp, Homo sapiens
ctggagagatcctcctgaaaaa

SEQ ID NO: 7530691 - DNA, 22 bp, Homo sapiens
ctggagagatcctcctgaaaaa

SEQ ID NO: 7530692 - DNA, 22 bp, Homo sapiens
ctggagagatcctcctgaaaaa

SEQ ID NO: 7530693 - DNA, 22 bp, Homo sapiens
ctggagagagaaaaagccttaa

SEQ ID NO: 7530694 - DNA, 22 bp, Homo sapiens
ctggagagagaaaaagccttaa

SEQ ID NO: 7530695 - DNA, 22 bp, Homo sapiens
ctggagagaccgaaagaggctg

SEQ ID NO: 7530696 - DNA, 22 bp, Homo sapiens
ctggagagagaaaaagccttaa

SEQ ID NO: 7530697 - DNA, 22 bp, Homo sapiens
ctggagagagaaaaagccttaa

SEQ ID NO: 7530698 - DNA, 22 bp, Homo sapiens
ctggagagaccgaaagaggctg

SEQ ID NO: 7530699 - DNA, 22 bp, Homo sapiens
ctggagccctgaatgggcagga

SEQ ID NO: 7530700 - DNA, 22 bp, Homo sapiens
ctggagccctgaatgggcagga

SEQ ID NO: 7530701 - DNA, 22 bp, Homo sapiens
ctggagccctgaatgggcagga

SEQ ID NO: 7530702 - DNA, 22 bp, Homo sapiens
ctggagccctgaatgggcagga

SEQ ID NO: 7530703 - DNA, 22 bp, Homo sapiens
ctggagccctgaatgggcagga

SEQ ID NO: 7530704 - DNA, 22 bp, Homo sapiens
ctggagccccaggctgtgcaga

SEQ ID NO: 7530705 - DNA, 22 bp, Homo sapiens
ctggagccccaggctgtgcaga

SEQ ID NO: 7530706 - DNA, 22 bp, Homo sapiens
ctggagcatccatgcccagggt

SEQ ID NO: 7530707 - DNA, 22 bp, Homo sapiens
ctggagccccaggctgtgcaga

SEQ ID NO: 7530708 - DNA, 22 bp, Homo sapiens
ctggagccccaggctgtgcaga

SEQ ID NO: 7530709 - DNA, 22 bp, Homo sapiens
ctggagcatccatgcccagggt

SEQ ID NO: 7530710 - DNA, 22 bp, Homo sapiens
ctggagcatccatgcccagggt

SEQ ID NO: 7530711 - DNA, 22 bp, Homo sapiens
ctggagcatccatgcccagggt

SEQ ID NO: 7530712 - DNA, 22 bp, Homo sapiens
ctggagcatccatgcccagggt

SEQ ID NO: 7530713 - DNA, 22 bp, Homo sapiens
ctggagcaggtttaggagtccc

SEQ ID NO: 7530714 - DNA, 22 bp, Homo sapiens
ctggagcagcaggtggccaggg

SEQ ID NO: 7530715 - DNA, 22 bp, Homo sapiens
ctggagcagcaggtggccaggg

SEQ ID NO: 7530716 - DNA, 22 bp, Homo sapiens
ctggagcagcaggtggccaggg

SEQ ID NO: 7530717 - DNA, 22 bp, Homo sapiens
ctggagcagcaggtggccaggg

SEQ ID NO: 7530718 - DNA, 22 bp, Homo sapiens
ctggagcaggcttgtcccagct

SEQ ID NO: 7530719 - DNA, 22 bp, Homo sapiens
ctggagcaggcttgtcccagct

SEQ ID NO: 7530720 - DNA, 22 bp, Homo sapiens
ctggagcaggcttgtcccagct

SEQ ID NO: 7530721 - DNA, 22 bp, Homo sapiens
ctggagcaggcttgtcccagct

SEQ ID NO: 7530722 - DNA, 22 bp, Homo sapiens
ctggagcaggcttgtcccagct

SEQ ID NO: 7530723 - DNA, 22 bp, Homo sapiens
ctggagcagcaggtggccaggg

SEQ ID NO: 7530724 - DNA, 22 bp, Homo sapiens
ctggagcaggcttgtcccagct

SEQ ID NO: 7530725 - DNA, 22 bp, Homo sapiens
ctggagcaggcttgtcccagct

SEQ ID NO: 7530726 - DNA, 22 bp, Homo sapiens
ctggagcaggtttaggagtccc

SEQ ID NO: 7530727 - DNA, 22 bp, Homo sapiens
ctggagcaggtttaggagtccc

SEQ ID NO: 7530728 - DNA, 22 bp, Homo sapiens
ctggagcaggtttaggagtccc

SEQ ID NO: 7530729 - DNA, 22 bp, Homo sapiens
ctggagcaggtttaggagtccc

SEQ ID NO: 7530730 - DNA, 22 bp, Homo sapiens
ctggagcaggtttaggagtccc

SEQ ID NO: 7530731 - DNA, 22 bp, Homo sapiens
ctggagcaggtttaggagtccc

SEQ ID NO: 7530732 - DNA, 22 bp, Homo sapiens
ctggagcaggcttgtcccagct

SEQ ID NO: 7530733 - DNA, 22 bp, Homo sapiens
ctggagcaggtttaggagtccc

SEQ ID NO: 7530734 - DNA, 22 bp, Homo sapiens
ctggagcaggcttgtcccagct

SEQ ID NO: 7530735 - DNA, 22 bp, Homo sapiens
ctggagcaggtttaggagtccc

SEQ ID NO: 7530736 - DNA, 22 bp, Homo sapiens
ctggagccggcgagccccagcc

SEQ ID NO: 7530737 - DNA, 22 bp, Homo sapiens
ctggagcctaggttgacctggg

SEQ ID NO: 7530738 - DNA, 22 bp, Homo sapiens
ctggagcctaggttgacctggg

SEQ ID NO: 7530739 - DNA, 22 bp, Homo sapiens
ctggagccggcgagccccagcc

SEQ ID NO: 7530740 - DNA, 22 bp, Homo sapiens
ctggagccggcgagccccagcc

SEQ ID NO: 7530741 - DNA, 22 bp, Homo sapiens
ctggagccggcgagccccagcc

SEQ ID NO: 7530742 - DNA, 22 bp, Homo sapiens
ctggagccggcgagccccagcc

SEQ ID NO: 7530743 - DNA, 17 bp, Homo sapiens
ctggagcctccaactcc

SEQ ID NO: 7530744 - DNA, 22 bp, Homo sapiens
ctggagcctgcagttttcactt

SEQ ID NO: 7530745 - DNA, 22 bp, Homo sapiens
ctggagcctgcagttttcactt

SEQ ID NO: 7530746 - DNA, 22 bp, Homo sapiens
ctggagcctaggttgacctggg

SEQ ID NO: 7530747 - DNA, 22 bp, Homo sapiens
ctggagcctaggttgacctggg

SEQ ID NO: 7530748 - DNA, 22 bp, Homo sapiens
ctggagcctaggttgacctggg

SEQ ID NO: 7530749 - DNA, 17 bp, Homo sapiens
ctggagcctccaactcc

SEQ ID NO: 7530750 - DNA, 22 bp, Homo sapiens
ctggagccgcatggagcaggga

SEQ ID NO: 7530751 - DNA, 22 bp, Homo sapiens
ctggagccgcatggagcaggga

SEQ ID NO: 7530752 - DNA, 22 bp, Homo sapiens
ctggagccgcatggagcaggga

SEQ ID NO: 7530753 - DNA, 22 bp, Homo sapiens
ctggagccgcatggagcaggga

SEQ ID NO: 7530754 - DNA, 22 bp, Homo sapiens
ctggagccgcatggagcaggga

SEQ ID NO: 7530755 - DNA, 22 bp, Homo sapiens
ctggagccctgaatgggcagga

SEQ ID NO: 7530756 - DNA, 22 bp, Homo sapiens
ctggagccctgaatgggcagga

SEQ ID NO: 7530757 - DNA, 22 bp, Homo sapiens
ctggagccctgaatgggcagga

SEQ ID NO: 7530758 - DNA, 22 bp, Homo sapiens
ctggagccgcatggagcaggga

SEQ ID NO: 7530759 - DNA, 22 bp, Homo sapiens
ctggagccctgaatgggcagga

SEQ ID NO: 7530760 - DNA, 22 bp, Homo sapiens
ctggagccctgaatgggcagga

SEQ ID NO: 7530761 - DNA, 22 bp, Homo sapiens
ctggagccggaccagggacggt

SEQ ID NO: 7530762 - DNA, 22 bp, Homo sapiens
ctggagccggaccagggacggt

SEQ ID NO: 7530763 - DNA, 22 bp, Homo sapiens
ctggagccggcgagccccagcc

SEQ ID NO: 7530764 - DNA, 22 bp, Homo sapiens
ctggagccggcgagccccagcc

SEQ ID NO: 7530765 - DNA, 22 bp, Homo sapiens
ctggagccggaccagggacggt

SEQ ID NO: 7530766 - DNA, 22 bp, Homo sapiens
ctggagccggaccagggacggt

SEQ ID NO: 7530767 - DNA, 22 bp, Homo sapiens
ctggagccggaccagggacggt

SEQ ID NO: 7530768 - DNA, 22 bp, Homo sapiens
ctggagccgcatggagcaggga

SEQ ID NO: 7530769 - DNA, 22 bp, Homo sapiens
ctggagccggaccagggacggt

SEQ ID NO: 7530770 - DNA, 22 bp, Homo sapiens
ctggagccggaccagggacggt

SEQ ID NO: 7530771 - DNA, 22 bp, Homo sapiens
ctgctggtgatgtctgggcatg

SEQ ID NO: 7530772 - DNA, 22 bp, Homo sapiens
ctgctggtctctttggattgcg

SEQ ID NO: 7530773 - DNA, 22 bp, Homo sapiens
ctgctggtctctttggattgcg

SEQ ID NO: 7530774 - DNA, 22 bp, Homo sapiens
ctgctggtctctttggattgcg

SEQ ID NO: 7530775 - DNA, 22 bp, Homo sapiens
ctgctggtgatgtctgggcatg

SEQ ID NO: 7530776 - DNA, 22 bp, Homo sapiens
ctgctggtgatgtctgggcatg

SEQ ID NO: 7530777 - DNA, 22 bp, Homo sapiens
ctgctggtgatgtctgggcatg

SEQ ID NO: 7530778 - DNA, 22 bp, Homo sapiens
ctgctggtgcagagtggggctg

SEQ ID NO: 7530779 - DNA, 22 bp, Homo sapiens
ctgctggtgcagagtggggctg

SEQ ID NO: 7530780 - DNA, 22 bp, Homo sapiens
ctgctggtgcagagtggggctg

SEQ ID NO: 7530781 - DNA, 22 bp, Homo sapiens
ctgctggtgggaatttacaaga

SEQ ID NO: 7530782 - DNA, 22 bp, Homo sapiens
ctgctggttgcacagagctagg

SEQ ID NO: 7530783 - DNA, 22 bp, Homo sapiens
ctgctggttagtcttagtggga

SEQ ID NO: 7530784 - DNA, 22 bp, Homo sapiens
ctgctggttagtcttagtggga

SEQ ID NO: 7530785 - DNA, 22 bp, Homo sapiens
ctgctggttgcacagagctagg

SEQ ID NO: 7530786 - DNA, 22 bp, Homo sapiens
ctgctggtgcagagtggggctg

SEQ ID NO: 7530787 - DNA, 22 bp, Homo sapiens
ctgctggtgggaatttacaaga

SEQ ID NO: 7530788 - DNA, 22 bp, Homo sapiens
ctgctggttagtcttagtggga

SEQ ID NO: 7530789 - DNA, 22 bp, Homo sapiens
ctgctggttagtcttagtggga

SEQ ID NO: 7530790 - DNA, 22 bp, Homo sapiens
ctgctgtcaaaaatcactccat

SEQ ID NO: 7530791 - DNA, 22 bp, Homo sapiens
ctgctgtcaaaaatcactccat

SEQ ID NO: 7530792 - DNA, 22 bp, Homo sapiens
ctgctgtcaaaggaaatatttg

SEQ ID NO: 7530793 - DNA, 22 bp, Homo sapiens
ctgctgtagagaagggttgtca

SEQ ID NO: 7530794 - DNA, 22 bp, Homo sapiens
ctgctgtagccactgggctcag

SEQ ID NO: 7530795 - DNA, 22 bp, Homo sapiens
ctgctgtatagtagtccattgt

SEQ ID NO: 7530796 - DNA, 22 bp, Homo sapiens
ctgctgtaataggagcgttttg

SEQ ID NO: 7530797 - DNA, 22 bp, Homo sapiens
ctgctgtaatgagtcagcatct

SEQ ID NO: 7530798 - DNA, 22 bp, Homo sapiens
ctgctgtaatgagtcagcatct

SEQ ID NO: 7530799 - DNA, 22 bp, Homo sapiens
ctgctgtaatgagtcagcatct

SEQ ID NO: 7530800 - DNA, 22 bp, Homo sapiens
ctgctgtacttaggaagaggaa

SEQ ID NO: 7530801 - DNA, 22 bp, Homo sapiens
ctgctgtcccagcctcctcaca

SEQ ID NO: 7530802 - DNA, 22 bp, Homo sapiens
ctgctgtcccagcctcctcaca

SEQ ID NO: 7530803 - DNA, 22 bp, Homo sapiens
ctgctgtccaggagtgccctgt

SEQ ID NO: 7530804 - DNA, 22 bp, Homo sapiens
ctgctgtccaggagtgccctgt

SEQ ID NO: 7530805 - DNA, 22 bp, Homo sapiens
ctgctgtccaggagtgccctgt

SEQ ID NO: 7530806 - DNA, 22 bp, Homo sapiens
ctgctgtccaggagtgccctgt

SEQ ID NO: 7530807 - DNA, 22 bp, Homo sapiens
ctgctgtcgccgagctgcatgc

SEQ ID NO: 7530808 - DNA, 22 bp, Homo sapiens
ctgctgtcgccgagctgcatgc

SEQ ID NO: 7530809 - DNA, 22 bp, Homo sapiens
ctgctgtcgccacggtcgccgc

SEQ ID NO: 7530810 - DNA, 22 bp, Homo sapiens
ctgctgtcccagcctcctcaca

SEQ ID NO: 7530811 - DNA, 22 bp, Homo sapiens
ctgctgtcctatctctttgttc

SEQ ID NO: 7530812 - DNA, 22 bp, Homo sapiens
ctgctgtcccagcctcctcaca

SEQ ID NO: 7530813 - DNA, 22 bp, Homo sapiens
ctgctgtccaacctgcactcgc

SEQ ID NO: 7530814 - DNA, 22 bp, Homo sapiens
ctgctgtccaacctgcactcgc

SEQ ID NO: 7530815 - DNA, 22 bp, Homo sapiens
ctgctgtccaggagtgccctgt

SEQ ID NO: 7530816 - DNA, 22 bp, Homo sapiens
ctgctgtcatctggcgctgtgc

SEQ ID NO: 7530817 - DNA, 22 bp, Homo sapiens
ctgctgtcatctggcgctgtgc

SEQ ID NO: 7530818 - DNA, 22 bp, Homo sapiens
ctgctgtccaacctgcactcgc

SEQ ID NO: 7530819 - DNA, 22 bp, Homo sapiens
ctgctgtccaacctgcactcgc

SEQ ID NO: 7530820 - DNA, 22 bp, Homo sapiens
ctgctgtcatagccatccctcc

SEQ ID NO: 7530821 - DNA, 22 bp, Homo sapiens
ctgctgtcatagccatccctcc

SEQ ID NO: 7530822 - DNA, 22 bp, Homo sapiens
ctgctgtcaaaggaaatatttg

SEQ ID NO: 7530823 - DNA, 19 bp, Homo sapiens
ctgctgggtgctgagggag

SEQ ID NO: 7530824 - DNA, 19 bp, Homo sapiens
ctgctgggtgctgagggag

SEQ ID NO: 7530825 - DNA, 19 bp, Homo sapiens
ctgctgggtgctgagggag

SEQ ID NO: 7530826 - DNA, 19 bp, Homo sapiens
ctgctgggtgctgagggag

SEQ ID NO: 7530827 - DNA, 19 bp, Homo sapiens
ctgctgggtgctgagggag

SEQ ID NO: 7530828 - DNA, 19 bp, Homo sapiens
ctgctgggtgctgagggag

SEQ ID NO: 7530829 - DNA, 19 bp, Homo sapiens
ctgctgggtgctgagggag

SEQ ID NO: 7530830 - DNA, 19 bp, Homo sapiens
ctgctgggtgctgagggag

SEQ ID NO: 7530831 - DNA, 22 bp, Homo sapiens
ctgctgggtttgcctttcacca

SEQ ID NO: 7530832 - DNA, 19 bp, Homo sapiens
ctgctgggtgctgagggag

SEQ ID NO: 7530833 - DNA, 19 bp, Homo sapiens
ctgctgggtgctgagggag

SEQ ID NO: 7530834 - DNA, 22 bp, Homo sapiens
ctgctggtaccagtggccgtca

SEQ ID NO: 7530835 - DNA, 22 bp, Homo sapiens
ctgctggtctctttggattgcg

SEQ ID NO: 7530836 - DNA, 22 bp, Homo sapiens
ctgctggtaccagtggccgtca

SEQ ID NO: 7530837 - DNA, 22 bp, Homo sapiens
ctgctggtaccagtggccgtca

SEQ ID NO: 7530838 - DNA, 22 bp, Homo sapiens
ctgctgggtttgcctttcacca

SEQ ID NO: 7530839 - DNA, 22 bp, Homo sapiens
ctgctgggtttgcctttcacca

SEQ ID NO: 7530840 - DNA, 22 bp, Homo sapiens
ctgctgggtctatgcaagtgga

SEQ ID NO: 7530841 - DNA, 22 bp, Homo sapiens
ctgctgggtctatgcaagtgga

SEQ ID NO: 7530842 - DNA, 22 bp, Homo sapiens
ctgctgggtctatgcaagtgga

SEQ ID NO: 7530843 - DNA, 22 bp, Homo sapiens
ctgctgggtctatgcaagtgga

SEQ ID NO: 7530844 - DNA, 22 bp, Homo sapiens
ctgctgggtctatgcaagtgga

SEQ ID NO: 7530845 - DNA, 22 bp, Homo sapiens
ctgctgggtctatgcaagtgga

SEQ ID NO: 7530846 - DNA, 22 bp, Homo sapiens
ctgctgggtctatgcaagtgga

SEQ ID NO: 7530847 - DNA, 22 bp, Homo sapiens
ctgctgggtctatgcaagtgga

SEQ ID NO: 7530848 - DNA, 22 bp, Homo sapiens
ctgctgggtctatgcaagtgga

SEQ ID NO: 7530849 - DNA, 22 bp, Homo sapiens
ctgctgggtccccctgctgatt

SEQ ID NO: 7530850 - DNA, 22 bp, Homo sapiens
ctgctgggtccccctgctgatt

SEQ ID NO: 7530851 - DNA, 22 bp, Homo sapiens
ctgctgggtccccctgctgatt

SEQ ID NO: 7530852 - DNA, 22 bp, Homo sapiens
ctgctggggtcagagcactggg

SEQ ID NO: 7530853 - DNA, 22 bp, Homo sapiens
ctgctgggcagaggctgcatga

SEQ ID NO: 7530854 - DNA, 22 bp, Homo sapiens
ctgctgggtccccctgctgatt

SEQ ID NO: 7530855 - DNA, 22 bp, Homo sapiens
ctgctgggtccccctgctgatt

SEQ ID NO: 7530856 - DNA, 22 bp, Homo sapiens
ctgctgggtccccctgctgatt

SEQ ID NO: 7530857 - DNA, 22 bp, Homo sapiens
ctgctgggtccccctgctgatt

SEQ ID NO: 7530858 - DNA, 22 bp, Homo sapiens
ctgctcttgagggactgcggtc

SEQ ID NO: 7530859 - DNA, 22 bp, Homo sapiens
ctgctgaaaacaataatgatga

SEQ ID NO: 7530860 - DNA, 22 bp, Homo sapiens
ctgctctgtttcttagctgggt

SEQ ID NO: 7530861 - DNA, 22 bp, Homo sapiens
ctgctcttcccactcactccca

SEQ ID NO: 7530862 - DNA, 22 bp, Homo sapiens
ctgctcttcccactcactccca

SEQ ID NO: 7530863 - DNA, 22 bp, Homo sapiens
ctgctcttgagggactgcggtc

SEQ ID NO: 7530864 - DNA, 22 bp, Homo sapiens
ctgctgactcttcctggagtga

SEQ ID NO: 7530865 - DNA, 19 bp, Homo sapiens
ctgctgaattagctctgga

SEQ ID NO: 7530866 - DNA, 22 bp, Homo sapiens
ctgctgagaaaagactgaggga

SEQ ID NO: 7530867 - DNA, 22 bp, Homo sapiens
ctgctgagaaaagactgaggga

SEQ ID NO: 7530868 - DNA, 22 bp, Homo sapiens
ctgctgagaaaagactgaggga

SEQ ID NO: 7530869 - DNA, 22 bp, Homo sapiens
ctgctgagaaaagactgaggga

SEQ ID NO: 7530870 - DNA, 22 bp, Homo sapiens
ctgctgagaaatgcatccagtt

SEQ ID NO: 7530871 - DNA, 22 bp, Homo sapiens
ctgctgagaaccagggagaatt

SEQ ID NO: 7530872 - DNA, 22 bp, Homo sapiens
ctgctgagactggctttgtgtc

SEQ ID NO: 7530873 - DNA, 22 bp, Homo sapiens
ctgctgagagccacgtggcaca

SEQ ID NO: 7530874 - DNA, 22 bp, Homo sapiens
ctgctgagagatgccaatctca

SEQ ID NO: 7530875 - DNA, 22 bp, Homo sapiens
ctgctgagactggctttgtgtc

SEQ ID NO: 7530876 - DNA, 22 bp, Homo sapiens
ctgctgagactggctttgtgtc

SEQ ID NO: 7530877 - DNA, 22 bp, Homo sapiens
ctgctgagactggctttgtgtc

SEQ ID NO: 7530878 - DNA, 20 bp, Homo sapiens
ctgctgagagcctggcttgc

SEQ ID NO: 7530879 - DNA, 20 bp, Homo sapiens
ctgctgagagcctggcttgc

SEQ ID NO: 7530880 - DNA, 20 bp, Homo sapiens
ctgctgagagcctggcttgc

SEQ ID NO: 7530881 - DNA, 20 bp, Homo sapiens
ctgctgagagcctggcttgc

SEQ ID NO: 7530882 - DNA, 22 bp, Homo sapiens
ctgctgagagccccagctgaga

SEQ ID NO: 7530883 - DNA, 22 bp, Homo sapiens
ctgctgagagccccagctgaga

SEQ ID NO: 7530884 - DNA, 22 bp, Homo sapiens
ctgctgagagccccagctgaga

SEQ ID NO: 7530885 - DNA, 22 bp, Homo sapiens
ctgctgagagctgaaggctgta

SEQ ID NO: 7530886 - DNA, 22 bp, Homo sapiens
ctgctgagagctgaaggctgta

SEQ ID NO: 7530887 - DNA, 22 bp, Homo sapiens
ctgctgagagctgaaggctgta

SEQ ID NO: 7530888 - DNA, 22 bp, Homo sapiens
ctgctgagagctgaaggctgta

SEQ ID NO: 7530889 - DNA, 22 bp, Homo sapiens
ctgctgagatgccaggagctct

SEQ ID NO: 7530890 - DNA, 22 bp, Homo sapiens
ctgctgagcatcagggctgccc

SEQ ID NO: 7530891 - DNA, 22 bp, Homo sapiens
ctgctgagcatcagggctgccc

SEQ ID NO: 7530892 - DNA, 22 bp, Homo sapiens
ctgctgggaaggtctgctcagt

SEQ ID NO: 7530893 - DNA, 22 bp, Homo sapiens
ctgctgagcatcagggctgccc

SEQ ID NO: 7530894 - DNA, 22 bp, Homo sapiens
ctgctgagcatcagggctgccc

SEQ ID NO: 7530895 - DNA, 22 bp, Homo sapiens
ctgctgagatgccaggagctct

SEQ ID NO: 7530896 - DNA, 22 bp, Homo sapiens
ctgctgggcagaggctgcatga

SEQ ID NO: 7530897 - DNA, 22 bp, Homo sapiens
ctgctgggcagaggctgcatga

SEQ ID NO: 7530898 - DNA, 22 bp, Homo sapiens
ctgctgggcagaggctgcatga

SEQ ID NO: 7530899 - DNA, 22 bp, Homo sapiens
ctgctgggcagaggctgcatga

SEQ ID NO: 7530900 - DNA, 22 bp, Homo sapiens
ctgctgggatagaagtatctca

SEQ ID NO: 7530901 - DNA, 22 bp, Homo sapiens
ctgctgggaaggtctgctcagt

SEQ ID NO: 7530902 - DNA, 22 bp, Homo sapiens
ctgctgggaaggtctgctcagt

SEQ ID NO: 7530903 - DNA, 22 bp, Homo sapiens
ctgctgggatagaagtatctca

SEQ ID NO: 7530904 - DNA, 22 bp, Homo sapiens
ctgcctttggggagttagaggg

SEQ ID NO: 7530905 - DNA, 22 bp, Homo sapiens
ctgcctttggaagtccagagct

SEQ ID NO: 7530906 - DNA, 22 bp, Homo sapiens
ctgcctttggaagtccagagct

SEQ ID NO: 7530907 - DNA, 22 bp, Homo sapiens
ctgcctttgcccttgacactgt

SEQ ID NO: 7530908 - DNA, 22 bp, Homo sapiens
ctgcctttgcccttgacactgt

SEQ ID NO: 7530909 - DNA, 22 bp, Homo sapiens
ctgccttttaaagccagtgtta

SEQ ID NO: 7530910 - DNA, 22 bp, Homo sapiens
ctgcctttgtgatcagttcttt

SEQ ID NO: 7530911 - DNA, 22 bp, Homo sapiens
ctgcctttgtgatcagttcttt

SEQ ID NO: 7530912 - DNA, 22 bp, Homo sapiens
ctgcctttgtgatcagttcttt

SEQ ID NO: 7530913 - DNA, 22 bp, Homo sapiens
ctgccttttcatctgagctgga

SEQ ID NO: 7530914 - DNA, 22 bp, Homo sapiens
ctgcgatggctgtatgtgctca

SEQ ID NO: 7530915 - DNA, 22 bp, Homo sapiens
ctgcgcaggggtggcgccagaa

SEQ ID NO: 7530916 - DNA, 22 bp, Homo sapiens
ctgcgcaggggtggcgccagaa

SEQ ID NO: 7530917 - DNA, 22 bp, Homo sapiens
ctgcgcaggggtggcgccagaa

SEQ ID NO: 7530918 - DNA, 22 bp, Homo sapiens
ctgcgcaggggtggcgccagaa

SEQ ID NO: 7530919 - DNA, 21 bp, Homo sapiens
ctgctctgacagtgaggccag

SEQ ID NO: 7530920 - DNA, 21 bp, Homo sapiens
ctgctctgacagtgaggccag

SEQ ID NO: 7530921 - DNA, 21 bp, Homo sapiens
ctgctctgacagtgaggccag

SEQ ID NO: 7530922 - DNA, 22 bp, Homo sapiens
ctgcctttgcccttgacactgt

SEQ ID NO: 7530923 - DNA, 22 bp, Homo sapiens
ctgcctttgcccttgacactgt

SEQ ID NO: 7530924 - DNA, 22 bp, Homo sapiens
ctgcctttgcccttgacactgt

SEQ ID NO: 7530925 - DNA, 22 bp, Homo sapiens
ctgcctttgcccttgacactgt

SEQ ID NO: 7530926 - DNA, 22 bp, Homo sapiens
ctgcctttgcccttgacactgt

SEQ ID NO: 7530927 - DNA, 22 bp, Homo sapiens
ctgcctttgaaagttctgttga

SEQ ID NO: 7530928 - DNA, 22 bp, Homo sapiens
ctgcctttgaaagttctgttga

SEQ ID NO: 7530929 - DNA, 22 bp, Homo sapiens
ctgcctttgaaagttctgttga

SEQ ID NO: 7530930 - DNA, 22 bp, Homo sapiens
ctgccttggttcccagccagca

SEQ ID NO: 7530931 - DNA, 22 bp, Homo sapiens
ctgccttggtttctagcagggc

SEQ ID NO: 7530932 - DNA, 22 bp, Homo sapiens
ctgccttggtttctagcagggc

SEQ ID NO: 7530933 - DNA, 22 bp, Homo sapiens
ctgccttggtttctagcagggc

SEQ ID NO: 7530934 - DNA, 22 bp, Homo sapiens
ctgccttggtttctagcagggc

SEQ ID NO: 7530935 - DNA, 22 bp, Homo sapiens
ctgccttggttcccagccagca

SEQ ID NO: 7530936 - DNA, 22 bp, Homo sapiens
ctgccttggttcccagccagca

SEQ ID NO: 7530937 - DNA, 22 bp, Homo sapiens
ctgccttggccctagttcatgg

SEQ ID NO: 7530938 - DNA, 22 bp, Homo sapiens
ctgccttgcaccggctctctgg

SEQ ID NO: 7530939 - DNA, 22 bp, Homo sapiens
ctgccttgcaccggctctctgg

SEQ ID NO: 7530940 - DNA, 22 bp, Homo sapiens
ctgccttggaaaatgtggtaat

SEQ ID NO: 7530941 - DNA, 22 bp, Homo sapiens
ctgctcttcacactacacccgt

SEQ ID NO: 7530942 - DNA, 22 bp, Homo sapiens
ctgctcttcccactcactccca

SEQ ID NO: 7530943 - DNA, 22 bp, Homo sapiens
ctgctcttcacactacacccgt

SEQ ID NO: 7530944 - DNA, 22 bp, Homo sapiens
ctgctcttcacactacacccgt

SEQ ID NO: 7530945 - DNA, 22 bp, Homo sapiens
ctgctctgtttcttagctgggt

SEQ ID NO: 7530946 - DNA, 22 bp, Homo sapiens
ctgctctgtttcttagctgggt

SEQ ID NO: 7530947 - DNA, 22 bp, Homo sapiens
ctgctctgtttcttagctgggt

SEQ ID NO: 7530948 - DNA, 22 bp, Homo sapiens
ctgctctgtttcttagctgggt

SEQ ID NO: 7530949 - DNA, 22 bp, Homo sapiens
ctgctctgttcccccatcatct

SEQ ID NO: 7530950 - DNA, 22 bp, Homo sapiens
ctgctctgttcccccatcatct

SEQ ID NO: 7530951 - DNA, 22 bp, Homo sapiens
ctgctctgttcccccatcatct

SEQ ID NO: 7530952 - DNA, 22 bp, Homo sapiens
ctgctctgttcccccatcatct

SEQ ID NO: 7530953 - DNA, 22 bp, Homo sapiens
ctgctctgttcccccatcatct

SEQ ID NO: 7530954 - DNA, 22 bp, Homo sapiens
ctgctctgttcccccatcatct

SEQ ID NO: 7530955 - DNA, 21 bp, Homo sapiens
ctgctctgacagtgaggccag

SEQ ID NO: 7530956 - DNA, 22 bp, Homo sapiens
ctgctctgaccctttcaccttc

SEQ ID NO: 7530957 - DNA, 21 bp, Homo sapiens
ctgctctgacagtgaggccag

SEQ ID NO: 7530958 - DNA, 21 bp, Homo sapiens
ctgctctgacagtgaggccag

SEQ ID NO: 7530959 - DNA, 22 bp, Homo sapiens
ctgctctgaccctttcaccttc

SEQ ID NO: 7530960 - DNA, 22 bp, Homo sapiens
ctgctctgagaggctcttccta

SEQ ID NO: 7530961 - DNA, 22 bp, Homo sapiens
ctgctctgtatatgagcaggaa

SEQ ID NO: 7530962 - DNA, 22 bp, Homo sapiens
ctgctctgtggtccatgagaca

SEQ ID NO: 7530963 - DNA, 22 bp, Homo sapiens
ctgctctgtgcacttgttcagg

SEQ ID NO: 7530964 - DNA, 22 bp, Homo sapiens
ctgctctgtggtccatgagaca

SEQ ID NO: 7530965 - DNA, 22 bp, Homo sapiens
ctgctctgtggtccatgagaca

SEQ ID NO: 7530966 - DNA, 22 bp, Homo sapiens
ctgctctgtggtccatgagaca

SEQ ID NO: 7530967 - DNA, 22 bp, Homo sapiens
ctgctctgttaattaaactttg

SEQ ID NO: 7530968 - DNA, 22 bp, Homo sapiens
ctgcctgtgggtacaagtggaa

SEQ ID NO: 7530969 - DNA, 22 bp, Homo sapiens
ctgcctgtgggtacaagtggaa

SEQ ID NO: 7530970 - DNA, 22 bp, Homo sapiens
ctgcctgtggtctgtgatctaa

SEQ ID NO: 7530971 - DNA, 22 bp, Homo sapiens
ctgcctgtggtctgtgatctaa

SEQ ID NO: 7530972 - DNA, 22 bp, Homo sapiens
ctgcctgtggtctgtgatctaa

SEQ ID NO: 7530973 - DNA, 22 bp, Homo sapiens
ctgcctgtggtctgtgatctaa

SEQ ID NO: 7530974 - DNA, 22 bp, Homo sapiens
ctgcctgtgtgtgcctgcagaa

SEQ ID NO: 7530975 - DNA, 19 bp, Homo sapiens
ctgcctgttatggagagaa

SEQ ID NO: 7530976 - DNA, 22 bp, Homo sapiens
ctgcctgttagtctagcagtta

SEQ ID NO: 7530977 - DNA, 22 bp, Homo sapiens
ctgcctgtgtgtgcctgcagaa

SEQ ID NO: 7530978 - DNA, 22 bp, Homo sapiens
ctgcctgtgtgtgcctgcagaa

SEQ ID NO: 7530979 - DNA, 22 bp, Homo sapiens
ctgcctgtgtgtgcctgcagaa

SEQ ID NO: 7530980 - DNA, 22 bp, Homo sapiens
ctgcctggggaatgtgaggatt

SEQ ID NO: 7530981 - DNA, 22 bp, Homo sapiens
ctgcctggggaatgtgaggatt

SEQ ID NO: 7530982 - DNA, 22 bp, Homo sapiens
ctgcctggggaatgtgaggatt

SEQ ID NO: 7530983 - DNA, 22 bp, Homo sapiens
ctgcctggggaatgtgaggatt

SEQ ID NO: 7530984 - DNA, 22 bp, Homo sapiens
ctgcctggggaatgtgaggatt

SEQ ID NO: 7530985 - DNA, 22 bp, Homo sapiens
ctgcccctgctcatggctgtcc

SEQ ID NO: 7530986 - DNA, 22 bp, Homo sapiens
ctgcctggggaatgtgaggatt

SEQ ID NO: 7530987 - DNA, 22 bp, Homo sapiens
ctgcctggggaatgtgaggatt

SEQ ID NO: 7530988 - DNA, 22 bp, Homo sapiens
ctgcccctgccaggcagctgtc

SEQ ID NO: 7530989 - DNA, 22 bp, Homo sapiens
ctgcccctgccaggcagctgtc

SEQ ID NO: 7530990 - DNA, 22 bp, Homo sapiens
ctgcctgtggacaccctggagg

SEQ ID NO: 7530991 - DNA, 22 bp, Homo sapiens
ctgcctgtggacaccctggagg

SEQ ID NO: 7530992 - DNA, 22 bp, Homo sapiens
ctgcctggggcatcagtcaagg

SEQ ID NO: 7530993 - DNA, 22 bp, Homo sapiens
ctgcctggggcatcagtcaagg

SEQ ID NO: 7530994 - DNA, 22 bp, Homo sapiens
ctgcctggggaatgtgaggatt

SEQ ID NO: 7530995 - DNA, 22 bp, Homo sapiens
ctgcctggggcatcagtcaagg

SEQ ID NO: 7530996 - DNA, 22 bp, Homo sapiens
ctgcctggggcatcagtcaagg

SEQ ID NO: 7530997 - DNA, 22 bp, Homo sapiens
ctgcctggggcatcagtcaagg

SEQ ID NO: 7530998 - DNA, 22 bp, Homo sapiens
ctgcctggggaatgtgaggatt

SEQ ID NO: 7530999 - DNA, 22 bp, Homo sapiens
ctgccttgaggaggttgtggga

SEQ ID NO: 7531000 - DNA, 21 bp, Homo sapiens
ctgccttgaatggtactggga

SEQ ID NO: 7531001 - DNA, 22 bp, Homo sapiens
ctgccttgcaccggctctctgg

SEQ ID NO: 7531002 - DNA, 22 bp, Homo sapiens
ctgccttgcaccggctctctgg

SEQ ID NO: 7531003 - DNA, 22 bp, Homo sapiens
ctgccttgcaccggctctctgg

SEQ ID NO: 7531004 - DNA, 22 bp, Homo sapiens
ctgccttgcaccggctctctgg

SEQ ID NO: 7531005 - DNA, 22 bp, Homo sapiens
ctgccttgaaaatgaagcttta

SEQ ID NO: 7531006 - DNA, 22 bp, Homo sapiens
ctgccttctttcaagggtaagc

SEQ ID NO: 7531007 - DNA, 22 bp, Homo sapiens
ctgccttctttcaagggtaagc

SEQ ID NO: 7531008 - DNA, 22 bp, Homo sapiens
ctgccttccaaccccagactcc

SEQ ID NO: 7531009 - DNA, 22 bp, Homo sapiens
ctgccttccaaccccagactcc

SEQ ID NO: 7531010 - DNA, 22 bp, Homo sapiens
ctgccttccaaccccagactcc

SEQ ID NO: 7531011 - DNA, 22 bp, Homo sapiens
ctgccttccaaccccagactcc

SEQ ID NO: 7531012 - DNA, 22 bp, Homo sapiens
ctgccttcatctctgagctggg

SEQ ID NO: 7531013 - DNA, 22 bp, Homo sapiens
ctgccttcatctctgagctggg

SEQ ID NO: 7531014 - DNA, 22 bp, Homo sapiens
ctgccttccaaccccagactcc

SEQ ID NO: 7531015 - DNA, 22 bp, Homo sapiens
ctgccttccaaccccagactcc

SEQ ID NO: 7531016 - DNA, 22 bp, Homo sapiens
ctgccttccaaccccagactcc

SEQ ID NO: 7531017 - DNA, 19 bp, Homo sapiens
ctgcctgttatggagagaa

SEQ ID NO: 7531018 - DNA, 22 bp, Homo sapiens
ctgcctgttcctgatcattcta

SEQ ID NO: 7531019 - DNA, 22 bp, Homo sapiens
ctgcctgtgggtacaagtggaa

SEQ ID NO: 7531020 - DNA, 18 bp, Homo sapiens
ctgcctgttgctgagagg

SEQ ID NO: 7531021 - DNA, 22 bp, Homo sapiens
ctgcctgtttcctcttgctccc

SEQ ID NO: 7531022 - DNA, 18 bp, Homo sapiens
ctgcctgttgctgagagg

SEQ ID NO: 7531023 - DNA, 22 bp, Homo sapiens
ctgccttcatctctgagctggg

SEQ ID NO: 7531024 - DNA, 22 bp, Homo sapiens
ctgccttcatctctgagctggg

SEQ ID NO: 7531025 - DNA, 22 bp, Homo sapiens
ctgcctgttttctgatagattt

SEQ ID NO: 7531026 - DNA, 22 bp, Homo sapiens
ctgccttaaaagtacttttact

SEQ ID NO: 7531027 - DNA, 22 bp, Homo sapiens
ctgccttcatctctgagctggg

SEQ ID NO: 7531028 - DNA, 22 bp, Homo sapiens
ctgcctgtttcctcttgctccc

SEQ ID NO: 7531029 - DNA, 22 bp, Homo sapiens
ctgcctgtttcctcttgctccc

SEQ ID NO: 7531030 - DNA, 22 bp, Homo sapiens
ctgcctgtttcctcttgctccc

SEQ ID NO: 7531031 - DNA, 22 bp, Homo sapiens
ctgcctgtttcctcttgctccc

SEQ ID NO: 7531032 - DNA, 22 bp, Homo sapiens
tagtgattcgatgtgggtaagt

SEQ ID NO: 7531033 - DNA, 22 bp, Homo sapiens
tagtgattctgatgtaagacaa

SEQ ID NO: 7531034 - DNA, 22 bp, Homo sapiens
tatatttaaatccaggttgaaa

SEQ ID NO: 7531035 - DNA, 22 bp, Homo sapiens
tatattgttggtgggaatataa

SEQ ID NO: 7531036 - DNA, 22 bp, Homo sapiens
tatattgttggtgggaatataa

SEQ ID NO: 7531037 - DNA, 22 bp, Homo sapiens
tatatttaaatccaggttgaaa

SEQ ID NO: 7531038 - DNA, 22 bp, Homo sapiens
tatcaggaggaaatttccattg

SEQ ID NO: 7531039 - DNA, 22 bp, Homo sapiens
tatcaggaggaaatttccattg

SEQ ID NO: 7531040 - DNA, 22 bp, Homo sapiens
tatcaggaggaaatttccattg

SEQ ID NO: 7531041 - DNA, 22 bp, Homo sapiens
tatcaggagttgacagttgcta

SEQ ID NO: 7531042 - DNA, 22 bp, Homo sapiens
tatatttaaatccaggttgaaa

SEQ ID NO: 7531043 - DNA, 22 bp, Homo sapiens
tatcaggacttcattcctttta

SEQ ID NO: 7531044 - DNA, 22 bp, Homo sapiens
tatcaggacttcattcctttta

SEQ ID NO: 7531045 - DNA, 22 bp, Homo sapiens
tagtgattaaaggcagaatgtt

SEQ ID NO: 7531046 - DNA, 22 bp, Homo sapiens
tagtgattaaaggcagaatgtt

SEQ ID NO: 7531047 - DNA, 22 bp, Homo sapiens
tagtgattataaaacagttttt

SEQ ID NO: 7531048 - DNA, 22 bp, Homo sapiens
tagtgattccaatgtgaagtgg

SEQ ID NO: 7531049 - DNA, 22 bp, Homo sapiens
tagtgattccctatcaaccctg

SEQ ID NO: 7531050 - DNA, 22 bp, Homo sapiens
tagtgattcctgttgccctgga

SEQ ID NO: 7531051 - DNA, 19 bp, Homo sapiens
tagtgagtagtgaattaga

SEQ ID NO: 7531052 - DNA, 19 bp, Homo sapiens
tagtgagtagtgaattaga

SEQ ID NO: 7531053 - DNA, 22 bp, Homo sapiens
tagtgacaggaactgaatctct

SEQ ID NO: 7531054 - DNA, 22 bp, Homo sapiens
tagtgacaggaactgaatctct

SEQ ID NO: 7531055 - DNA, 22 bp, Homo sapiens
tagtgacatctagtggactgtt

SEQ ID NO: 7531056 - DNA, 22 bp, Homo sapiens
tagtgacatctagtggactgtt

SEQ ID NO: 7531057 - DNA, 22 bp, Homo sapiens
tagtgaaagtattaaacagctg

SEQ ID NO: 7531058 - DNA, 22 bp, Homo sapiens
tagtgaaagtattaaacagctg

SEQ ID NO: 7531059 - DNA, 22 bp, Homo sapiens
tagtgaaacctgacagatcatg

SEQ ID NO: 7531060 - DNA, 22 bp, Homo sapiens
tagtgaaagtcaaagacagcta

SEQ ID NO: 7531061 - DNA, 22 bp, Homo sapiens
tagtgaaagtcaaagacagcta

SEQ ID NO: 7531062 - DNA, 22 bp, Homo sapiens
tagtgaaagtcaaagacagcta

SEQ ID NO: 7531063 - DNA, 22 bp, Homo sapiens
tagtgaaatatgtgctgatagc

SEQ ID NO: 7531064 - DNA, 22 bp, Homo sapiens
tagtgaaagtcaaagacagcta

SEQ ID NO: 7531065 - DNA, 22 bp, Homo sapiens
tagtgaaagtcaaagacagcta

SEQ ID NO: 7531066 - DNA, 22 bp, Homo sapiens
tagtgaaatttatgcacagcta

SEQ ID NO: 7531067 - DNA, 22 bp, Homo sapiens
tagtgaatgggggttatgagac

SEQ ID NO: 7531068 - DNA, 22 bp, Homo sapiens
tagtgaatgttggctattaata

SEQ ID NO: 7531069 - DNA, 22 bp, Homo sapiens
tagtgaattcctaataggaaga

SEQ ID NO: 7531070 - DNA, 22 bp, Homo sapiens
tagtgaaatgataacagagcag

SEQ ID NO: 7531071 - DNA, 22 bp, Homo sapiens
tagtgaaatgataacagagcag

SEQ ID NO: 7531072 - DNA, 22 bp, Homo sapiens
tagtgaaatgataacagagcag

SEQ ID NO: 7531073 - DNA, 22 bp, Homo sapiens
tagtgaaatgagaatgtatgac

SEQ ID NO: 7531074 - DNA, 22 bp, Homo sapiens
tagtgaaatgagaatgtatgac

SEQ ID NO: 7531075 - DNA, 22 bp, Homo sapiens
tagtgaaatgataacagagcag

SEQ ID NO: 7531076 - DNA, 22 bp, Homo sapiens
tagtgaaatgataacagagcag

SEQ ID NO: 7531077 - DNA, 22 bp, Homo sapiens
tagtgaaacagttatcaatctg

SEQ ID NO: 7531078 - DNA, 22 bp, Homo sapiens
tagtctttttaataaataatgc

SEQ ID NO: 7531079 - DNA, 22 bp, Homo sapiens
tagtctttttaataaataatgc

SEQ ID NO: 7531080 - DNA, 22 bp, Homo sapiens
tagtctttttaataaataatgc

SEQ ID NO: 7531081 - DNA, 22 bp, Homo sapiens
tagtctttttaataaataatgc

SEQ ID NO: 7531082 - DNA, 22 bp, Homo sapiens
tagtgaaacctgacagatcatg

SEQ ID NO: 7531083 - DNA, 22 bp, Homo sapiens
tagtgaaacctgacagatcatg

SEQ ID NO: 7531084 - DNA, 22 bp, Homo sapiens
tagtgaaacctgacagatcatg

SEQ ID NO: 7531085 - DNA, 22 bp, Homo sapiens
tagtgaaacctgacagatcatg

SEQ ID NO: 7531086 - DNA, 19 bp, Homo sapiens
tagtctttattcttaattt

SEQ ID NO: 7531087 - DNA, 19 bp, Homo sapiens
tagtctttattcttaattt

SEQ ID NO: 7531088 - DNA, 19 bp, Homo sapiens
tagtctttattcttaattt

SEQ ID NO: 7531089 - DNA, 19 bp, Homo sapiens
tagtctttattcttaattt

SEQ ID NO: 7531090 - DNA, 22 bp, Homo sapiens
tagtcttttgagaagtatatct

SEQ ID NO: 7531091 - DNA, 22 bp, Homo sapiens
tagtctttcatttggagcattt

SEQ ID NO: 7531092 - DNA, 22 bp, Homo sapiens
tagtcttttgagaagtatatct

SEQ ID NO: 7531093 - DNA, 22 bp, Homo sapiens
tagtcttttgagaagtatatct

SEQ ID NO: 7531094 - DNA, 22 bp, Homo sapiens
tagtcttttgagaagtatatct

SEQ ID NO: 7531095 - DNA, 22 bp, Homo sapiens
tagtcttttgagaagtatatct

SEQ ID NO: 7531096 - DNA, 22 bp, Homo sapiens
tagtcttttgagaagtatatct

SEQ ID NO: 7531097 - DNA, 22 bp, Homo sapiens
tagtctttttaataaataatgc

SEQ ID NO: 7531098 - DNA, 22 bp, Homo sapiens
caggggcaagaatgctgtcagc

SEQ ID NO: 7531099 - DNA, 22 bp, Homo sapiens
caggggcaagaatgctgtcagc

SEQ ID NO: 7531100 - DNA, 22 bp, Homo sapiens
caggggcaagaatgctgtcagc

SEQ ID NO: 7531101 - DNA, 22 bp, Homo sapiens
caggggagttttatgcaacaga

SEQ ID NO: 7531102 - DNA, 22 bp, Homo sapiens
caggggcaagaatgctgtcagc

SEQ ID NO: 7531103 - DNA, 22 bp, Homo sapiens
caggggagttttatgcaacaga

SEQ ID NO: 7531104 - DNA, 22 bp, Homo sapiens
caggggagttttatgcaacaga

SEQ ID NO: 7531105 - DNA, 22 bp, Homo sapiens
caggggagttttatgcaacaga

SEQ ID NO: 7531106 - DNA, 22 bp, Homo sapiens
caggggagttttatgcaacaga

SEQ ID NO: 7531107 - DNA, 22 bp, Homo sapiens
caggggagttttatgcaacaga

SEQ ID NO: 7531108 - DNA, 22 bp, Homo sapiens
caggggagttttatgcaacaga

SEQ ID NO: 7531109 - DNA, 22 bp, Homo sapiens
caggggagttttatgcaacaga

SEQ ID NO: 7531110 - DNA, 22 bp, Homo sapiens
caggggagtgagtccctctctg

SEQ ID NO: 7531111 - DNA, 22 bp, Homo sapiens
caggggagtgagtccctctctg

SEQ ID NO: 7531112 - DNA, 22 bp, Homo sapiens
caggggagtgagtccctctctg

SEQ ID NO: 7531113 - DNA, 22 bp, Homo sapiens
caggggacattaaagctccata

SEQ ID NO: 7531114 - DNA, 22 bp, Homo sapiens
cagggtggcaggcaccatggcc

SEQ ID NO: 7531115 - DNA, 22 bp, Homo sapiens
cagggtggcaggcaccatggcc

SEQ ID NO: 7531116 - DNA, 22 bp, Homo sapiens
cagggtggcactcagcgcatct

SEQ ID NO: 7531117 - DNA, 22 bp, Homo sapiens
cagggtggcaggcaccatggcc

SEQ ID NO: 7531118 - DNA, 22 bp, Homo sapiens
cagggtggcaggcaccatggcc

SEQ ID NO: 7531119 - DNA, 22 bp, Homo sapiens
cagggtggcaggcaccatggcc

SEQ ID NO: 7531120 - DNA, 22 bp, Homo sapiens
cagggtggcaggcaccatggcc

SEQ ID NO: 7531121 - DNA, 22 bp, Homo sapiens
cagggtggcaggcaccatggcc

SEQ ID NO: 7531122 - DNA, 22 bp, Homo sapiens
cagggtggcaggcaccatggcc

SEQ ID NO: 7531123 - DNA, 22 bp, Homo sapiens
cagggtggccaggtagataata

SEQ ID NO: 7531124 - DNA, 22 bp, Homo sapiens
cagggtggccaggtagataata

SEQ ID NO: 7531125 - DNA, 22 bp, Homo sapiens
cagggtggcaggcaccatggcc

SEQ ID NO: 7531126 - DNA, 22 bp, Homo sapiens
cagggtggcaggcaccatggcc

SEQ ID NO: 7531127 - DNA, 22 bp, Homo sapiens
cagggtggccctgtggtctcat

SEQ ID NO: 7531128 - DNA, 22 bp, Homo sapiens
cagggtggccaggtagataata

SEQ ID NO: 7531129 - DNA, 22 bp, Homo sapiens
cagggtggccaggtagataata

SEQ ID NO: 7531130 - DNA, 22 bp, Homo sapiens
tatcatgtgactccaatgtgga

SEQ ID NO: 7531131 - DNA, 22 bp, Homo sapiens
tatcatgtgactccaatgtgga

SEQ ID NO: 7531132 - DNA, 22 bp, Homo sapiens
tatcatgtctggagatactttt

SEQ ID NO: 7531133 - DNA, 22 bp, Homo sapiens
tatcatgtctggagatactttt

SEQ ID NO: 7531134 - DNA, 22 bp, Homo sapiens
tatcatgtgcgcttattgattt

SEQ ID NO: 7531135 - DNA, 20 bp, Homo sapiens
tatcatgtttctagaccttt

SEQ ID NO: 7531136 - DNA, 22 bp, Homo sapiens
tatcatgtgcgcttattgattt

SEQ ID NO: 7531137 - DNA, 22 bp, Homo sapiens
tatcattcttctcacctttgaa

SEQ ID NO: 7531138 - DNA, 22 bp, Homo sapiens
tatcattatacagacgtataca

SEQ ID NO: 7531139 - DNA, 22 bp, Homo sapiens
tatcatttaacagaatcattgc

SEQ ID NO: 7531140 - DNA, 22 bp, Homo sapiens
tatcatttaacagaatcattgc

SEQ ID NO: 7531141 - DNA, 22 bp, Homo sapiens
tatcatttaacagaatcattgc

SEQ ID NO: 7531142 - DNA, 22 bp, Homo sapiens
tatcatttaacagaatcattgc

SEQ ID NO: 7531143 - DNA, 22 bp, Homo sapiens
tatcatttaacagaatcattgc

SEQ ID NO: 7531144 - DNA, 22 bp, Homo sapiens
tatcatttaacagaatcattgc

SEQ ID NO: 7531145 - DNA, 22 bp, Homo sapiens
cagggtggcactcagcgcatct

SEQ ID NO: 7531146 - DNA, 22 bp, Homo sapiens
tatcatttaacagaatcattgc

SEQ ID NO: 7531147 - DNA, 22 bp, Homo sapiens
tatcatttaacagaatcattgc

SEQ ID NO: 7531148 - DNA, 22 bp, Homo sapiens
tatcatttaacagaatcattgc

SEQ ID NO: 7531149 - DNA, 22 bp, Homo sapiens
tatcagtgtgcatctctgaatg

SEQ ID NO: 7531150 - DNA, 22 bp, Homo sapiens
tatcagtgattgctgtatacaa

SEQ ID NO: 7531151 - DNA, 22 bp, Homo sapiens
tatcagtggtcacaagatacat

SEQ ID NO: 7531152 - DNA, 22 bp, Homo sapiens
tatcagtttattctataaatag

SEQ ID NO: 7531153 - DNA, 22 bp, Homo sapiens
tatcagtttattctataaatag

SEQ ID NO: 7531154 - DNA, 22 bp, Homo sapiens
tatcataagttaattaaacagt

SEQ ID NO: 7531155 - DNA, 22 bp, Homo sapiens
tatcagtcctattcccagtgag

SEQ ID NO: 7531156 - DNA, 22 bp, Homo sapiens
tatcagtctcctggctgtgtca

SEQ ID NO: 7531157 - DNA, 22 bp, Homo sapiens
tatcagtccagggttttgtgac

SEQ ID NO: 7531158 - DNA, 22 bp, Homo sapiens
tatcagtccagggttttgtgac

SEQ ID NO: 7531159 - DNA, 22 bp, Homo sapiens
tatcagtccagggttttgtgac

SEQ ID NO: 7531160 - DNA, 22 bp, Homo sapiens
tatcagtccagggttttgtgac

SEQ ID NO: 7531161 - DNA, 22 bp, Homo sapiens
tatcagtatggattcatggatt

SEQ ID NO: 7531162 - DNA, 22 bp, Homo sapiens
tatcagtagggttgaactttgg

SEQ ID NO: 7531163 - DNA, 22 bp, Homo sapiens
tatcaggagttgacagttgcta

SEQ ID NO: 7531164 - DNA, 22 bp, Homo sapiens
tatcaggagttgacagttgcta

SEQ ID NO: 7531165 - DNA, 22 bp, Homo sapiens
tatcaggagttgacagttgcta

SEQ ID NO: 7531166 - DNA, 23 bp, Homo sapiens
tatcagtaagcatccctgaaccc

SEQ ID NO: 7531167 - DNA, 23 bp, Homo sapiens
tatcagtaagcatccctgaaccc

SEQ ID NO: 7531168 - DNA, 22 bp, Homo sapiens
tatcagtagaacaatggacatt

SEQ ID NO: 7531169 - DNA, 22 bp, Homo sapiens
tatcagtagataaacggattgc

SEQ ID NO: 7531170 - DNA, 20 bp, Homo sapiens
tatcagtaggatattctgcc

SEQ ID NO: 7531171 - DNA, 22 bp, Homo sapiens
tatcagtagataaacggattgc

SEQ ID NO: 7531172 - DNA, 22 bp, Homo sapiens
tatcagtagaacaatggacatt

SEQ ID NO: 7531173 - DNA, 22 bp, Homo sapiens
tatcatgatcagcaactaatca

SEQ ID NO: 7531174 - DNA, 22 bp, Homo sapiens
tatcatcttgttgtcatgcagc

SEQ ID NO: 7531175 - DNA, 22 bp, Homo sapiens
tatcatcagttcaggtattgat

SEQ ID NO: 7531176 - DNA, 22 bp, Homo sapiens
tatcatctgcaaagcacatcta

SEQ ID NO: 7531177 - DNA, 22 bp, Homo sapiens
tatcatctgcaaagcacatcta

SEQ ID NO: 7531178 - DNA, 22 bp, Homo sapiens
tatcatcattggcaggtgagaa

SEQ ID NO: 7531179 - DNA, 22 bp, Homo sapiens
tatcatcttgttgtcatgcagc

SEQ ID NO: 7531180 - DNA, 22 bp, Homo sapiens
tatcatcactgtaatccgttga

SEQ ID NO: 7531181 - DNA, 22 bp, Homo sapiens
tatcatcacattacctcttggg

SEQ ID NO: 7531182 - DNA, 22 bp, Homo sapiens
tatcatcacattacctcttggg

SEQ ID NO: 7531183 - DNA, 22 bp, Homo sapiens
tatcatcactgtaatccgttga

SEQ ID NO: 7531184 - DNA, 22 bp, Homo sapiens
tatcataagttaattaaacagt

SEQ ID NO: 7531185 - DNA, 22 bp, Homo sapiens
tatcataagttaattaaacagt

SEQ ID NO: 7531186 - DNA, 22 bp, Homo sapiens
tatcataagttaattaaacagt

SEQ ID NO: 7531187 - DNA, 22 bp, Homo sapiens
taggtagctttggcgtttcttg

SEQ ID NO: 7531188 - DNA, 22 bp, Homo sapiens
taggtagacaaagaaatgtgtt

SEQ ID NO: 7531189 - DNA, 22 bp, Homo sapiens
taggtagatatgttgatttgtt

SEQ ID NO: 7531190 - DNA, 22 bp, Homo sapiens
taggtagctttggcgtttcttg

SEQ ID NO: 7531191 - DNA, 22 bp, Homo sapiens
taggtagatcttagtaatgaaa

SEQ ID NO: 7531192 - DNA, 22 bp, Homo sapiens
taggtagatttaaagattttct

SEQ ID NO: 7531193 - DNA, 22 bp, Homo sapiens
taggtagctttggcgtttcttg

SEQ ID NO: 7531194 - DNA, 19 bp, Homo sapiens
taggtaggtaggtaggtat

SEQ ID NO: 7531195 - DNA, 19 bp, Homo sapiens
taggtaggtaggtaggtat

SEQ ID NO: 7531196 - DNA, 22 bp, Homo sapiens
taggtaggtaaacaggactaat

SEQ ID NO: 7531197 - DNA, 22 bp, Homo sapiens
taggtagggaaatggttcctgt

SEQ ID NO: 7531198 - DNA, 22 bp, Homo sapiens
taggtagggaccaccttgggga

SEQ ID NO: 7531199 - DNA, 22 bp, Homo sapiens
taggtagggaccaccttgggga

SEQ ID NO: 7531200 - DNA, 22 bp, Homo sapiens
taggtacattattagatgcatg

SEQ ID NO: 7531201 - DNA, 22 bp, Homo sapiens
taggtacattattagatgcatg

SEQ ID NO: 7531202 - DNA, 22 bp, Homo sapiens
taggtacagctaaaaattatct

SEQ ID NO: 7531203 - DNA, 22 bp, Homo sapiens
taggtacagctaaaaattatct

SEQ ID NO: 7531204 - DNA, 22 bp, Homo sapiens
taggtacttaagatctcagcta

SEQ ID NO: 7531205 - DNA, 23 bp, Homo sapiens
taggtagaagttattttcttctc

SEQ ID NO: 7531206 - DNA, 23 bp, Homo sapiens
taggtagaagttattttcttctc

SEQ ID NO: 7531207 - DNA, 22 bp, Homo sapiens
taggtagaatgcattttggatg

SEQ ID NO: 7531208 - DNA, 22 bp, Homo sapiens
taggtagatacatgtgttggct

SEQ ID NO: 7531209 - DNA, 22 bp, Homo sapiens
tagggtgggcagttcttgggga

SEQ ID NO: 7531210 - DNA, 22 bp, Homo sapiens
tagggtgggcagttcttgggga

SEQ ID NO: 7531211 - DNA, 22 bp, Homo sapiens
tagggtgggcagttcttgggga

SEQ ID NO: 7531212 - DNA, 22 bp, Homo sapiens
tagggtggagactggaagcagg

SEQ ID NO: 7531213 - DNA, 22 bp, Homo sapiens
tagggtggagactggaagcagg

SEQ ID NO: 7531214 - DNA, 22 bp, Homo sapiens
tagggtggagactggaagcagg

SEQ ID NO: 7531215 - DNA, 22 bp, Homo sapiens
tagggtggagactggaagcagg

SEQ ID NO: 7531216 - DNA, 22 bp, Homo sapiens
tagggtgcttaatactagattt

SEQ ID NO: 7531217 - DNA, 22 bp, Homo sapiens
tagggtggagactggaagcagg

SEQ ID NO: 7531218 - DNA, 22 bp, Homo sapiens
tagggtggagactggaagcagg

SEQ ID NO: 7531219 - DNA, 22 bp, Homo sapiens
tagggtcctgcctacagagaca

SEQ ID NO: 7531220 - DNA, 22 bp, Homo sapiens
tagggtgcatgacaagatccct

SEQ ID NO: 7531221 - DNA, 22 bp, Homo sapiens
tagggtgccttttattgctgtg

SEQ ID NO: 7531222 - DNA, 22 bp, Homo sapiens
tagggtggttagaaggagtatg

SEQ ID NO: 7531223 - DNA, 22 bp, Homo sapiens
tagggtggttagaaggagtatg

SEQ ID NO: 7531224 - DNA, 22 bp, Homo sapiens
tagggtggttagaaggagtatg

SEQ ID NO: 7531225 - DNA, 22 bp, Homo sapiens
tagggtggttagaaggagtatg

SEQ ID NO: 7531226 - DNA, 22 bp, Homo sapiens
tagggtggttagaaggagtatg

SEQ ID NO: 7531227 - DNA, 22 bp, Homo sapiens
tagggtggttagaaggagtatg

SEQ ID NO: 7531228 - DNA, 22 bp, Homo sapiens
taggtacacagtaagtgctcaa

SEQ ID NO: 7531229 - DNA, 22 bp, Homo sapiens
taggtaatggataatgaagtga

SEQ ID NO: 7531230 - DNA, 22 bp, Homo sapiens
taggtaatggataatgaagtga

SEQ ID NO: 7531231 - DNA, 22 bp, Homo sapiens
tagggttgtaatttatgtatgg

SEQ ID NO: 7531232 - DNA, 22 bp, Homo sapiens
caggggacattaaagctccata

SEQ ID NO: 7531233 - DNA, 22 bp, Homo sapiens
caggggacattaaagctccata

SEQ ID NO: 7531234 - DNA, 22 bp, Homo sapiens
caggggacattaaagctccata

SEQ ID NO: 7531235 - DNA, 22 bp, Homo sapiens
caggggacattaaagctccata

SEQ ID NO: 7531236 - DNA, 22 bp, Homo sapiens
caggggacattaaagctccata

SEQ ID NO: 7531237 - DNA, 22 bp, Homo sapiens
caggggacactcctgcttgggc

SEQ ID NO: 7531238 - DNA, 22 bp, Homo sapiens
caggggacagtatggtggatga

SEQ ID NO: 7531239 - DNA, 22 bp, Homo sapiens
caggggacagtatggtggatga

SEQ ID NO: 7531240 - DNA, 22 bp, Homo sapiens
caggggacagtatggtggatga

SEQ ID NO: 7531241 - DNA, 22 bp, Homo sapiens
caggggacactcctgcttgggc

SEQ ID NO: 7531242 - DNA, 22 bp, Homo sapiens
caggggacactcctgcttgggc

SEQ ID NO: 7531243 - DNA, 22 bp, Homo sapiens
caggggaaggagccttgaaact

SEQ ID NO: 7531244 - DNA, 22 bp, Homo sapiens
caggggaagatgccaagggaga

SEQ ID NO: 7531245 - DNA, 22 bp, Homo sapiens
caggggaagatgccaagggaga

SEQ ID NO: 7531246 - DNA, 22 bp, Homo sapiens
caggggaagatgccaagggaga

SEQ ID NO: 7531247 - DNA, 22 bp, Homo sapiens
caggggaagatgccaagggaga

SEQ ID NO: 7531248 - DNA, 22 bp, Homo sapiens
caggggaaggagccttgaaact

SEQ ID NO: 7531249 - DNA, 22 bp, Homo sapiens
caggggaagatgccaagggaga

SEQ ID NO: 7531250 - DNA, 22 bp, Homo sapiens
caggggaagatgccaagggaga

SEQ ID NO: 7531251 - DNA, 22 bp, Homo sapiens
caggggaaggagccttgaaact

SEQ ID NO: 7531252 - DNA, 22 bp, Homo sapiens
caggggaaggagccttgaaact

SEQ ID NO: 7531253 - DNA, 22 bp, Homo sapiens
taggtaggtgcaattaaaagta

SEQ ID NO: 7531254 - DNA, 22 bp, Homo sapiens
cagggctgtggctttgtgctgt

SEQ ID NO: 7531255 - DNA, 22 bp, Homo sapiens
cagggctgtggctttgtgctgt

SEQ ID NO: 7531256 - DNA, 22 bp, Homo sapiens
cagggctgtggctttgtgctgt

SEQ ID NO: 7531257 - DNA, 18 bp, Homo sapiens
cagggctgtggggtcact

SEQ ID NO: 7531258 - DNA, 18 bp, Homo sapiens
cagggctgtggggtcact

SEQ ID NO: 7531259 - DNA, 22 bp, Homo sapiens
cagggcttggatctgtggtcag

SEQ ID NO: 7531260 - DNA, 22 bp, Homo sapiens
cagggcttggttggaaccaccc

SEQ ID NO: 7531261 - DNA, 22 bp, Homo sapiens
cagggctttcccttgtagaaat

SEQ ID NO: 7531262 - DNA, 22 bp, Homo sapiens
cagggcttggatctgtggtcag

SEQ ID NO: 7531263 - DNA, 22 bp, Homo sapiens
cagggcttggttggaaccaccc

SEQ ID NO: 7531264 - DNA, 22 bp, Homo sapiens
cagggctttcctgagaagtgat

SEQ ID NO: 7531265 - DNA, 22 bp, Homo sapiens
cagggctttgaacaggcatcaa

SEQ ID NO: 7531266 - DNA, 22 bp, Homo sapiens
cagggctttgaacaggcatcaa

SEQ ID NO: 7531267 - DNA, 22 bp, Homo sapiens
cagggctttgaacaggcatcaa

SEQ ID NO: 7531268 - DNA, 22 bp, Homo sapiens
cagggctttcctgagaagtgat

SEQ ID NO: 7531269 - DNA, 22 bp, Homo sapiens
cagggctttcctgagaagtgat

SEQ ID NO: 7531270 - DNA, 22 bp, Homo sapiens
cagggctttgtgtgcctgggga

SEQ ID NO: 7531271 - DNA, 22 bp, Homo sapiens
cagggctttgtgtgcctgggga

SEQ ID NO: 7531272 - DNA, 22 bp, Homo sapiens
cagggctttgtgtgcctgggga

SEQ ID NO: 7531273 - DNA, 22 bp, Homo sapiens
cagggctttgtgtgcctgggga

SEQ ID NO: 7531274 - DNA, 22 bp, Homo sapiens
cagggctttttattagctgcct

SEQ ID NO: 7531275 - DNA, 22 bp, Homo sapiens
cagggctttttattagctgcct

SEQ ID NO: 7531276 - DNA, 22 bp, Homo sapiens
cagggctttttattagctgcct

SEQ ID NO: 7531277 - DNA, 22 bp, Homo sapiens
tagggaaggagaccaagccaca

SEQ ID NO: 7531278 - DNA, 22 bp, Homo sapiens
tagggaaggagaccaagccaca

SEQ ID NO: 7531279 - DNA, 22 bp, Homo sapiens
cagggctccatgcagggactcc

SEQ ID NO: 7531280 - DNA, 22 bp, Homo sapiens
cagggctcatctgtgtgaccag

SEQ ID NO: 7531281 - DNA, 22 bp, Homo sapiens
cagggctccatgcagggactcc

SEQ ID NO: 7531282 - DNA, 22 bp, Homo sapiens
cagggctcagggactgcagaaa

SEQ ID NO: 7531283 - DNA, 22 bp, Homo sapiens
cagggctcatctgtgtgaccag

SEQ ID NO: 7531284 - DNA, 22 bp, Homo sapiens
cagggctcatctgtgtgaccag

SEQ ID NO: 7531285 - DNA, 22 bp, Homo sapiens
cagggctcatctgtgtgaccag

SEQ ID NO: 7531286 - DNA, 22 bp, Homo sapiens
tagggacaaagagctgaggcct

SEQ ID NO: 7531287 - DNA, 22 bp, Homo sapiens
tagggaagtgtataggggtcat

SEQ ID NO: 7531288 - DNA, 21 bp, Homo sapiens
tagggcaggcattggaagaga

SEQ ID NO: 7531289 - DNA, 21 bp, Homo sapiens
tagggcaggcattggaagaga

SEQ ID NO: 7531290 - DNA, 21 bp, Homo sapiens
tagggcaggcattggaagaga

SEQ ID NO: 7531291 - DNA, 22 bp, Homo sapiens
tagggcaggggaggaatctgaa

SEQ ID NO: 7531292 - DNA, 21 bp, Homo sapiens
tagggcaggcattggaagaga

SEQ ID NO: 7531293 - DNA, 22 bp, Homo sapiens
tagggcaggggaggaatctgaa

SEQ ID NO: 7531294 - DNA, 22 bp, Homo sapiens
tagggcaggggaggaatctgaa

SEQ ID NO: 7531295 - DNA, 21 bp, Homo sapiens
tagggcaggcattggaagaga

SEQ ID NO: 7531296 - DNA, 21 bp, Homo sapiens
tagggcaggcattggaagaga

SEQ ID NO: 7531297 - DNA, 21 bp, Homo sapiens
tagggcaggcattggaagaga

SEQ ID NO: 7531298 - DNA, 21 bp, Homo sapiens
tagggcaggcattggaagaga

SEQ ID NO: 7531299 - DNA, 21 bp, Homo sapiens
tagggcaggcattggaagaga

SEQ ID NO: 7531300 - DNA, 21 bp, Homo sapiens
tagggcaggcattggaagaga

SEQ ID NO: 7531301 - DNA, 22 bp, Homo sapiens
tagggcaggtgaagaaaagcta

SEQ ID NO: 7531302 - DNA, 22 bp, Homo sapiens
tagggcaggtgaagaaaagcta

SEQ ID NO: 7531303 - DNA, 22 bp, Homo sapiens
tagggcaggggaggaatctgaa

SEQ ID NO: 7531304 - DNA, 22 bp, Homo sapiens
tagggcaggggaggaatctgaa

SEQ ID NO: 7531305 - DNA, 22 bp, Homo sapiens
tagggcaggtgaagaaaagcta

SEQ ID NO: 7531306 - DNA, 22 bp, Homo sapiens
tagggcaggtgaagaaaagcta

SEQ ID NO: 7531307 - DNA, 22 bp, Homo sapiens
tagggcaggtgaagaaaagcta

SEQ ID NO: 7531308 - DNA, 22 bp, Homo sapiens
tagggcaggtgaagaaaagcta

SEQ ID NO: 7531309 - DNA, 22 bp, Homo sapiens
tagggccatgtctgtcttgttc

SEQ ID NO: 7531310 - DNA, 22 bp, Homo sapiens
tagggcctaagtcctgacatgg

SEQ ID NO: 7531311 - DNA, 22 bp, Homo sapiens
tagggccagttagggaagcttt

SEQ ID NO: 7531312 - DNA, 22 bp, Homo sapiens
tagggccagttagggaagcttt

SEQ ID NO: 7531313 - DNA, 22 bp, Homo sapiens
tagggccagataggcttcttga

SEQ ID NO: 7531314 - DNA, 22 bp, Homo sapiens
tagggccagataggcttcttga

SEQ ID NO: 7531315 - DNA, 22 bp, Homo sapiens
tagggctcactgagatgaatat

SEQ ID NO: 7531316 - DNA, 22 bp, Homo sapiens
tagggcctgacattcagtaggt

SEQ ID NO: 7531317 - DNA, 22 bp, Homo sapiens
tagggcctgacattcagtaggt

SEQ ID NO: 7531318 - DNA, 22 bp, Homo sapiens
tagggctataagagaataagac

SEQ ID NO: 7531319 - DNA, 22 bp, Homo sapiens
tagggctattctgagtaataat

SEQ ID NO: 7531320 - DNA, 18 bp, Homo sapiens
tagggccaaaatggaaaa

SEQ ID NO: 7531321 - DNA, 22 bp, Homo sapiens
tagggcatttgtgggtgttgtt

SEQ ID NO: 7531322 - DNA, 21 bp, Homo sapiens
tagggcatattcagtggtctg

SEQ ID NO: 7531323 - DNA, 22 bp, Homo sapiens
tagggcagtttcatgttatctt

SEQ ID NO: 7531324 - DNA, 22 bp, Homo sapiens
tagggcagtttcatgttatctt

SEQ ID NO: 7531325 - DNA, 22 bp, Homo sapiens
tagggcagtttcatgttatctt

SEQ ID NO: 7531326 - DNA, 22 bp, Homo sapiens
tagggcagttataacattagtg

SEQ ID NO: 7531327 - DNA, 22 bp, Homo sapiens
tagggcagttataacattagtg

SEQ ID NO: 7531328 - DNA, 22 bp, Homo sapiens
tagggcagttataacattagtg

SEQ ID NO: 7531329 - DNA, 22 bp, Homo sapiens
tagggctccactcccagagatt

SEQ ID NO: 7531330 - DNA, 22 bp, Homo sapiens
tagggctcgggcacaggacagg

SEQ ID NO: 7531331 - DNA, 22 bp, Homo sapiens
tagggctcgggcacaggacagg

SEQ ID NO: 7531332 - DNA, 18 bp, Homo sapiens
tagggctctagggagtga

SEQ ID NO: 7531333 - DNA, 22 bp, Homo sapiens
tagggctcagagaagtggggcc

SEQ ID NO: 7531334 - DNA, 22 bp, Homo sapiens
tagggctcagagtccagtttct

SEQ ID NO: 7531335 - DNA, 22 bp, Homo sapiens
tagggctcagctctagctcctg

SEQ ID NO: 7531336 - DNA, 20 bp, Homo sapiens
tagggctcattatgatctcc

SEQ ID NO: 7531337 - DNA, 22 bp, Homo sapiens
tagggctccactcccagagatt

SEQ ID NO: 7531338 - DNA, 22 bp, Homo sapiens
tagggtacatgtgcacaacatg

SEQ ID NO: 7531339 - DNA, 22 bp, Homo sapiens
tagggtacatgtgcacaacatg

SEQ ID NO: 7531340 - DNA, 22 bp, Homo sapiens
tagggtagtaccatgctgccag

SEQ ID NO: 7531341 - DNA, 22 bp, Homo sapiens
tagggtccaagccttataatta

SEQ ID NO: 7531342 - DNA, 22 bp, Homo sapiens
tagggtccatatggatgaatgg

SEQ ID NO: 7531343 - DNA, 22 bp, Homo sapiens
tagggtcccagataggagccag

SEQ ID NO: 7531344 - DNA, 22 bp, Homo sapiens
tagggtcctcatctgtaaatga

SEQ ID NO: 7531345 - DNA, 22 bp, Homo sapiens
taggaaattgccaatatatgac

SEQ ID NO: 7531346 - DNA, 22 bp, Homo sapiens
taggaaattgccaatatatgac

SEQ ID NO: 7531347 - DNA, 22 bp, Homo sapiens
taggaaattgccaatatatgac

SEQ ID NO: 7531348 - DNA, 22 bp, Homo sapiens
taggaaattgccaatatatgac

SEQ ID NO: 7531349 - DNA, 22 bp, Homo sapiens
taggaaattgacacctgcttga

SEQ ID NO: 7531350 - DNA, 22 bp, Homo sapiens
taggaaattgccaatatatgac

SEQ ID NO: 7531351 - DNA, 22 bp, Homo sapiens
taggaaattctcttgctaagtt

SEQ ID NO: 7531352 - DNA, 22 bp, Homo sapiens
taggaaattctcttgctaagtt

SEQ ID NO: 7531353 - DNA, 22 bp, Homo sapiens
taggaaattagaacttggaaac

SEQ ID NO: 7531354 - DNA, 22 bp, Homo sapiens
taggaaattagaacttggaaac

SEQ ID NO: 7531355 - DNA, 22 bp, Homo sapiens
taggaaattagaacttggaaac

SEQ ID NO: 7531356 - DNA, 22 bp, Homo sapiens
taggaaattagaacttggaaac

SEQ ID NO: 7531357 - DNA, 22 bp, Homo sapiens
taggaaattgacacctgcttga

SEQ ID NO: 7531358 - DNA, 22 bp, Homo sapiens
taggaaattgacacctgcttga

SEQ ID NO: 7531359 - DNA, 22 bp, Homo sapiens
taggaaattgacacctgcttga

SEQ ID NO: 7531360 - DNA, 22 bp, Homo sapiens
taggaaattgacacctgcttga

SEQ ID NO: 7531361 - DNA, 22 bp, Homo sapiens
taggaaattctcttgctaagtt

SEQ ID NO: 7531362 - DNA, 22 bp, Homo sapiens
taggaaattctcttgctaagtt

SEQ ID NO: 7531363 - DNA, 22 bp, Homo sapiens
taggaaattctcttgctaagtt

SEQ ID NO: 7531364 - DNA, 22 bp, Homo sapiens
cagggcaggaatttgacattgc

SEQ ID NO: 7531365 - DNA, 22 bp, Homo sapiens
cagggcaggaatttgacattgc

SEQ ID NO: 7531366 - DNA, 22 bp, Homo sapiens
cagggcaggaatttgacattgc

SEQ ID NO: 7531367 - DNA, 22 bp, Homo sapiens
cagggcaggaatttgacattgc

SEQ ID NO: 7531368 - DNA, 22 bp, Homo sapiens
cagggcaggaatttgacattgc

SEQ ID NO: 7531369 - DNA, 22 bp, Homo sapiens
cagggcagcttcctttgttagg

SEQ ID NO: 7531370 - DNA, 22 bp, Homo sapiens
cagggcaggaatttgacattgc

SEQ ID NO: 7531371 - DNA, 22 bp, Homo sapiens
cagggcaggaatttgacattgc

SEQ ID NO: 7531372 - DNA, 22 bp, Homo sapiens
cagggcaggaatttgacattgc

SEQ ID NO: 7531373 - DNA, 22 bp, Homo sapiens
cagggcaggaatttgacattgc

SEQ ID NO: 7531374 - DNA, 22 bp, Homo sapiens
taggaaattaagtctcttttgt

SEQ ID NO: 7531375 - DNA, 22 bp, Homo sapiens
taggaaattaagtctcttttgt

SEQ ID NO: 7531376 - DNA, 22 bp, Homo sapiens
taggaaattaagtctcttttgt

SEQ ID NO: 7531377 - DNA, 22 bp, Homo sapiens
tagctttaataagctgctgaat

SEQ ID NO: 7531378 - DNA, 22 bp, Homo sapiens
taggaaatggctcagttactgc

SEQ ID NO: 7531379 - DNA, 22 bp, Homo sapiens
cagggcaggaatttgacattgc

SEQ ID NO: 7531380 - DNA, 22 bp, Homo sapiens
tagctttaagatgagatgtgga

SEQ ID NO: 7531381 - DNA, 22 bp, Homo sapiens
tagctttaagatgagatgtgga

SEQ ID NO: 7531382 - DNA, 22 bp, Homo sapiens
taggaaatttgaaatatgtggg

SEQ ID NO: 7531383 - DNA, 22 bp, Homo sapiens
taggaaatttgaaatatgtggg

SEQ ID NO: 7531384 - DNA, 22 bp, Homo sapiens
taggaaatttgaaatatgtggg

SEQ ID NO: 7531385 - DNA, 22 bp, Homo sapiens
taggaaatttatagaggtgttt

SEQ ID NO: 7531386 - DNA, 22 bp, Homo sapiens
taggaaatttatagaggtgttt

SEQ ID NO: 7531387 - DNA, 22 bp, Homo sapiens
taggaaatttcatttgaggtct

SEQ ID NO: 7531388 - DNA, 22 bp, Homo sapiens
taggaaatttcatttgaggtct

SEQ ID NO: 7531389 - DNA, 22 bp, Homo sapiens
taggaaattggaaactcttcac

SEQ ID NO: 7531390 - DNA, 22 bp, Homo sapiens
taggaaattggaaactcttcac

SEQ ID NO: 7531391 - DNA, 22 bp, Homo sapiens
taggaaattggaaactcttcac

SEQ ID NO: 7531392 - DNA, 22 bp, Homo sapiens
taggaaattggaaactcttcac

SEQ ID NO: 7531393 - DNA, 22 bp, Homo sapiens
taggaaattggaaactcttcac

SEQ ID NO: 7531394 - DNA, 22 bp, Homo sapiens
taggaaattttactggtctggg

SEQ ID NO: 7531395 - DNA, 22 bp, Homo sapiens
taggaaattttactggtctggg

SEQ ID NO: 7531396 - DNA, 22 bp, Homo sapiens
taggaaattttactggtctggg

SEQ ID NO: 7531397 - DNA, 22 bp, Homo sapiens
taggaacaaagagcctcacatt

SEQ ID NO: 7531398 - DNA, 22 bp, Homo sapiens
taggaacaaagagcctcacatt

SEQ ID NO: 7531399 - DNA, 22 bp, Homo sapiens
taggaacaaaaggttttcctga

SEQ ID NO: 7531400 - DNA, 22 bp, Homo sapiens
taggaacaagtttccttgctgt

SEQ ID NO: 7531401 - DNA, 22 bp, Homo sapiens
taggaacaagtttccttgctgt

SEQ ID NO: 7531402 - DNA, 22 bp, Homo sapiens
taggaacaactgcaggtacaag

SEQ ID NO: 7531403 - DNA, 22 bp, Homo sapiens
taggaacaactgcaggtacaag

SEQ ID NO: 7531404 - DNA, 22 bp, Homo sapiens
taggaacaactgcaggtacaag

SEQ ID NO: 7531405 - DNA, 22 bp, Homo sapiens
taggaacagtcctagaaatctg

SEQ ID NO: 7531406 - DNA, 22 bp, Homo sapiens
taggaacagtcctagaaatctg

SEQ ID NO: 7531407 - DNA, 22 bp, Homo sapiens
taggaacagtcctagaaatctg

SEQ ID NO: 7531408 - DNA, 22 bp, Homo sapiens
taggaacagtcctagaaatctg

SEQ ID NO: 7531409 - DNA, 22 bp, Homo sapiens
taggaacacagggacttgatga

SEQ ID NO: 7531410 - DNA, 22 bp, Homo sapiens
taggaacacacatgtgtagctg

SEQ ID NO: 7531411 - DNA, 22 bp, Homo sapiens
taggaacacagggacttgatga

SEQ ID NO: 7531412 - DNA, 22 bp, Homo sapiens
taggacatgctacataaatagg

SEQ ID NO: 7531413 - DNA, 18 bp, Homo sapiens
taggaacattgattggag

SEQ ID NO: 7531414 - DNA, 18 bp, Homo sapiens
taggaacattgattggag

SEQ ID NO: 7531415 - DNA, 22 bp, Homo sapiens
taggaacatgcccttaccttcc

SEQ ID NO: 7531416 - DNA, 22 bp, Homo sapiens
taggaacatatgcagtgctttt

SEQ ID NO: 7531417 - DNA, 22 bp, Homo sapiens
taggaacacatcctcctctagc

SEQ ID NO: 7531418 - DNA, 22 bp, Homo sapiens
taggaacagtcctagaaatctg

SEQ ID NO: 7531419 - DNA, 22 bp, Homo sapiens
taggaacagtttcaggatgttt

SEQ ID NO: 7531420 - DNA, 20 bp, Homo sapiens
tagctaccttgatcccctgg

SEQ ID NO: 7531421 - DNA, 22 bp, Homo sapiens
tagctactgatgcaagagtttg

SEQ ID NO: 7531422 - DNA, 22 bp, Homo sapiens
tagctacatttatacactgtag

SEQ ID NO: 7531423 - DNA, 22 bp, Homo sapiens
tagctacatttatacactgtag

SEQ ID NO: 7531424 - DNA, 22 bp, Homo sapiens
tagctacatacttggccattct

SEQ ID NO: 7531425 - DNA, 22 bp, Homo sapiens
tagctacactgaggctgcttaa

SEQ ID NO: 7531426 - DNA, 22 bp, Homo sapiens
tagctacactgaggctgcttaa

SEQ ID NO: 7531427 - DNA, 22 bp, Homo sapiens
tagctagaaagtgaagatcaca

SEQ ID NO: 7531428 - DNA, 22 bp, Homo sapiens
tagctagaaggttgaaagcagg

SEQ ID NO: 7531429 - DNA, 22 bp, Homo sapiens
tagctagaaggttgaaagcagg

SEQ ID NO: 7531430 - DNA, 22 bp, Homo sapiens
tagctagaggtagatgggttag

SEQ ID NO: 7531431 - DNA, 22 bp, Homo sapiens
tagctattgttggtagttaccc

SEQ ID NO: 7531432 - DNA, 22 bp, Homo sapiens
tagctatttagcccagataagt

SEQ ID NO: 7531433 - DNA, 22 bp, Homo sapiens
tagctattgttggtagttaccc

SEQ ID NO: 7531434 - DNA, 22 bp, Homo sapiens
tagctatttggaaaattccaat

SEQ ID NO: 7531435 - DNA, 22 bp, Homo sapiens
tagctatttggaaaattccaat

SEQ ID NO: 7531436 - DNA, 22 bp, Homo sapiens
tagctatttagcccagataagt

SEQ ID NO: 7531437 - DNA, 22 bp, Homo sapiens
tagctatttagcccagataagt

SEQ ID NO: 7531438 - DNA, 22 bp, Homo sapiens
tagctatttgagcatattccag

SEQ ID NO: 7531439 - DNA, 22 bp, Homo sapiens
tagctattttgcttggaaatac

SEQ ID NO: 7531440 - DNA, 22 bp, Homo sapiens
tagctatttggaaaattccaat

SEQ ID NO: 7531441 - DNA, 22 bp, Homo sapiens
tagctcatgtaatccgaacata

SEQ ID NO: 7531442 - DNA, 22 bp, Homo sapiens
tagctcatctaggctaccacag

SEQ ID NO: 7531443 - DNA, 22 bp, Homo sapiens
tagctcatctaggctaccacag

SEQ ID NO: 7531444 - DNA, 22 bp, Homo sapiens
tagctcatgtaatccgaacata

SEQ ID NO: 7531445 - DNA, 22 bp, Homo sapiens
tagctcctccccatccaggttc

SEQ ID NO: 7531446 - DNA, 22 bp, Homo sapiens
tagctcctggctgcagggcctc

SEQ ID NO: 7531447 - DNA, 22 bp, Homo sapiens
tagctcctggctgcagggcctc

SEQ ID NO: 7531448 - DNA, 22 bp, Homo sapiens
tagctcaaaggttaagtgtgga

SEQ ID NO: 7531449 - DNA, 22 bp, Homo sapiens
tagctcagcaggtgggacaggt

SEQ ID NO: 7531450 - DNA, 22 bp, Homo sapiens
tagctcacttgagctctgctag

SEQ ID NO: 7531451 - DNA, 22 bp, Homo sapiens
tagctcactatttcaggctttt

SEQ ID NO: 7531452 - DNA, 22 bp, Homo sapiens
tagctcaaaggttaagtgtgga

SEQ ID NO: 7531453 - DNA, 22 bp, Homo sapiens
tagctattgttggtagttaccc

SEQ ID NO: 7531454 - DNA, 22 bp, Homo sapiens
tagctcaaaggttaagtgtgga

SEQ ID NO: 7531455 - DNA, 22 bp, Homo sapiens
tagctattttgcttggaaatac

SEQ ID NO: 7531456 - DNA, 22 bp, Homo sapiens
tagctcaaaggttaagtgtgga

SEQ ID NO: 7531457 - DNA, 22 bp, Homo sapiens
tagctcaaaggttaagtgtgga

SEQ ID NO: 7531458 - DNA, 22 bp, Homo sapiens
cagggcagccaggccccgtggg

SEQ ID NO: 7531459 - DNA, 22 bp, Homo sapiens
cagggcagccaggccccgtggg

SEQ ID NO: 7531460 - DNA, 22 bp, Homo sapiens
cagggcagccaggccccgtggg

SEQ ID NO: 7531461 - DNA, 22 bp, Homo sapiens
cagggcagccaggccccgtggg

SEQ ID NO: 7531462 - DNA, 22 bp, Homo sapiens
cagggcagccaggccccgtggg

SEQ ID NO: 7531463 - DNA, 22 bp, Homo sapiens
cagggcagccaggccccgtggg

SEQ ID NO: 7531464 - DNA, 22 bp, Homo sapiens
cagggcagccaggccccgtggg

SEQ ID NO: 7531465 - DNA, 22 bp, Homo sapiens
cagggcagccaggccccgtggg

SEQ ID NO: 7531466 - DNA, 22 bp, Homo sapiens
cagggcagcttcctttgttagg

SEQ ID NO: 7531467 - DNA, 22 bp, Homo sapiens
cagggcagcttcctttgttagg

SEQ ID NO: 7531468 - DNA, 22 bp, Homo sapiens
cagggcagcttcctttgttagg

SEQ ID NO: 7531469 - DNA, 22 bp, Homo sapiens
cagggcaggaatttgacattgc

SEQ ID NO: 7531470 - DNA, 22 bp, Homo sapiens
cagggcagcttcctttgttagg

SEQ ID NO: 7531471 - DNA, 22 bp, Homo sapiens
cagggcagccaggccccgtggg

SEQ ID NO: 7531472 - DNA, 22 bp, Homo sapiens
cagggcagcttcctttgttagg

SEQ ID NO: 7531473 - DNA, 22 bp, Homo sapiens
cagggcagcttcctttgttagg

SEQ ID NO: 7531474 - DNA, 22 bp, Homo sapiens
cagggcagcttcctttgttagg

SEQ ID NO: 7531475 - DNA, 22 bp, Homo sapiens
cagggcagccaggccccgtggg

SEQ ID NO: 7531476 - DNA, 22 bp, Homo sapiens
cagggcagccaggccccgtggg

SEQ ID NO: 7531477 - DNA, 22 bp, Homo sapiens
cagggcagagggaaactccttt

SEQ ID NO: 7531478 - DNA, 22 bp, Homo sapiens
cagggcagagggaaactccttt

SEQ ID NO: 7531479 - DNA, 22 bp, Homo sapiens
cagggcagagccaggatttcaa

SEQ ID NO: 7531480 - DNA, 22 bp, Homo sapiens
cagggcagagccaggatttcaa

SEQ ID NO: 7531481 - DNA, 22 bp, Homo sapiens
cagggcagagccaggatttcaa

SEQ ID NO: 7531482 - DNA, 22 bp, Homo sapiens
cagggcagagccaggatttcaa

SEQ ID NO: 7531483 - DNA, 22 bp, Homo sapiens
cagggcagagccaggatttcaa

SEQ ID NO: 7531484 - DNA, 22 bp, Homo sapiens
cagggcagagccaggatttcaa

SEQ ID NO: 7531485 - DNA, 22 bp, Homo sapiens
cagggcagagccaggatttcaa

SEQ ID NO: 7531486 - DNA, 22 bp, Homo sapiens
cagggcagagccaggatttcaa

SEQ ID NO: 7531487 - DNA, 22 bp, Homo sapiens
cagggcagccaggccccgtggg

SEQ ID NO: 7531488 - DNA, 22 bp, Homo sapiens
cagggcagagggaaactccttt

SEQ ID NO: 7531489 - DNA, 22 bp, Homo sapiens
cagggcagagggaaactccttt

SEQ ID NO: 7531490 - DNA, 22 bp, Homo sapiens
cagggcagagggaaactccttt

SEQ ID NO: 7531491 - DNA, 22 bp, Homo sapiens
cagggcagagggaaactccttt

SEQ ID NO: 7531492 - DNA, 22 bp, Homo sapiens
cagggcagagggaaactccttt

SEQ ID NO: 7531493 - DNA, 22 bp, Homo sapiens
cagggcagagggaaactccttt

SEQ ID NO: 7531494 - DNA, 22 bp, Homo sapiens
cagggcagagggaaactccttt

SEQ ID NO: 7531495 - DNA, 22 bp, Homo sapiens
cagggcagagggaaactccttt

SEQ ID NO: 7531496 - DNA, 22 bp, Homo sapiens
cagggcagagggaaactccttt

SEQ ID NO: 7531497 - DNA, 22 bp, Homo sapiens
taggaccaagtggagtgcaggt

SEQ ID NO: 7531498 - DNA, 22 bp, Homo sapiens
taggacatgtgttttatatatg

SEQ ID NO: 7531499 - DNA, 22 bp, Homo sapiens
taggaccacccctgttggcagc

SEQ ID NO: 7531500 - DNA, 22 bp, Homo sapiens
taggaccagcagggtcagggtc

SEQ ID NO: 7531501 - DNA, 22 bp, Homo sapiens
taggaccagcagggtcagggtc

SEQ ID NO: 7531502 - DNA, 22 bp, Homo sapiens
taggaccagatcaagactcttg

SEQ ID NO: 7531503 - DNA, 22 bp, Homo sapiens
taggaccagccagttgctgaga

SEQ ID NO: 7531504 - DNA, 22 bp, Homo sapiens
taggaccaggcttggagatagg

SEQ ID NO: 7531505 - DNA, 22 bp, Homo sapiens
taggacccctgtggtagatggg

SEQ ID NO: 7531506 - DNA, 22 bp, Homo sapiens
taggaccaggggctgccaggaa

SEQ ID NO: 7531507 - DNA, 22 bp, Homo sapiens
taggaccaggggctgccaggaa

SEQ ID NO: 7531508 - DNA, 19 bp, Homo sapiens
taggaccctggtggccccc

SEQ ID NO: 7531509 - DNA, 19 bp, Homo sapiens
taggaccctggtggccccc

SEQ ID NO: 7531510 - DNA, 19 bp, Homo sapiens
taggaccctggtggccccc

SEQ ID NO: 7531511 - DNA, 19 bp, Homo sapiens
taggaccctggtggccccc

SEQ ID NO: 7531512 - DNA, 19 bp, Homo sapiens
taggaccctggtggccccc

SEQ ID NO: 7531513 - DNA, 19 bp, Homo sapiens
taggaccctggtggccccc

SEQ ID NO: 7531514 - DNA, 19 bp, Homo sapiens
taggaccctggtggccccc

SEQ ID NO: 7531515 - DNA, 22 bp, Homo sapiens
taggacctggagcccagcaccg

SEQ ID NO: 7531516 - DNA, 22 bp, Homo sapiens
taggacttggtgactctcaatg

SEQ ID NO: 7531517 - DNA, 22 bp, Homo sapiens
taggagaggtgaatggcacact

SEQ ID NO: 7531518 - DNA, 18 bp, Homo sapiens
taggagataatagagggc

SEQ ID NO: 7531519 - DNA, 22 bp, Homo sapiens
taggagatagtttttacctggc

SEQ ID NO: 7531520 - DNA, 22 bp, Homo sapiens
taggagatagtttttacctggc

SEQ ID NO: 7531521 - DNA, 20 bp, Homo sapiens
taggagcaatgagagtagaa

SEQ ID NO: 7531522 - DNA, 20 bp, Homo sapiens
taggagcaatgagagtagaa

SEQ ID NO: 7531523 - DNA, 22 bp, Homo sapiens
taggagaggtgaatggcacact

SEQ ID NO: 7531524 - DNA, 22 bp, Homo sapiens
taggagaggtgaatggcacact

SEQ ID NO: 7531525 - DNA, 18 bp, Homo sapiens
taggagataatagagggc

SEQ ID NO: 7531526 - DNA, 22 bp, Homo sapiens
taggagaagagtcagggcctaa

SEQ ID NO: 7531527 - DNA, 22 bp, Homo sapiens
taggagaagagtcagggcctaa

SEQ ID NO: 7531528 - DNA, 22 bp, Homo sapiens
taggagaagagtcagggcctaa

SEQ ID NO: 7531529 - DNA, 22 bp, Homo sapiens
taggagaagagtcagggcctaa

SEQ ID NO: 7531530 - DNA, 18 bp, Homo sapiens
taggagagaatttattta

SEQ ID NO: 7531531 - DNA, 17 bp, Homo sapiens
taggagactggctgtcc

SEQ ID NO: 7531532 - DNA, 22 bp, Homo sapiens
taggagacattgatcccaagaa

SEQ ID NO: 7531533 - DNA, 17 bp, Homo sapiens
taggagactggctgtcc

SEQ ID NO: 7531534 - DNA, 22 bp, Homo sapiens
cagggcctggagctgggcctgc

SEQ ID NO: 7531535 - DNA, 22 bp, Homo sapiens
cagggcctggagctgggcctgc

SEQ ID NO: 7531536 - DNA, 22 bp, Homo sapiens
cagggcctggagctgggcctgc

SEQ ID NO: 7531537 - DNA, 22 bp, Homo sapiens
cagggcctggagctgggcctgc

SEQ ID NO: 7531538 - DNA, 22 bp, Homo sapiens
cagggcctggagctgggcctgc

SEQ ID NO: 7531539 - DNA, 22 bp, Homo sapiens
cagggcctggagctgggcctgc

SEQ ID NO: 7531540 - DNA, 22 bp, Homo sapiens
cagggcctgcttccttcttgtt

SEQ ID NO: 7531541 - DNA, 22 bp, Homo sapiens
cagggcctgcttccttcttgtt

SEQ ID NO: 7531542 - DNA, 22 bp, Homo sapiens
cagggcctggagctgggcctgc

SEQ ID NO: 7531543 - DNA, 22 bp, Homo sapiens
cagggcctgcttccttcttgtt

SEQ ID NO: 7531544 - DNA, 22 bp, Homo sapiens
cagggcctgcctggttcctgga

SEQ ID NO: 7531545 - DNA, 22 bp, Homo sapiens
cagggcctgcctggttcctgga

SEQ ID NO: 7531546 - DNA, 22 bp, Homo sapiens
cagggcctgcttccttcttgtt

SEQ ID NO: 7531547 - DNA, 22 bp, Homo sapiens
cagggcctgcttccttcttgtt

SEQ ID NO: 7531548 - DNA, 22 bp, Homo sapiens
cagggcctgcttccttcttgtt

SEQ ID NO: 7531549 - DNA, 22 bp, Homo sapiens
cagggcctgcttccttcttgtt

SEQ ID NO: 7531550 - DNA, 18 bp, Homo sapiens
taggaggatactgagatg

SEQ ID NO: 7531551 - DNA, 18 bp, Homo sapiens
taggaggatactgagatg

SEQ ID NO: 7531552 - DNA, 22 bp, Homo sapiens
taggaggagggcatttgaagta

SEQ ID NO: 7531553 - DNA, 22 bp, Homo sapiens
cagggcctcattgtcagtcctg

SEQ ID NO: 7531554 - DNA, 22 bp, Homo sapiens
cagggcctcattgtcagtcctg

SEQ ID NO: 7531555 - DNA, 22 bp, Homo sapiens
cagggcctcattgtcagtcctg

SEQ ID NO: 7531556 - DNA, 22 bp, Homo sapiens
cagggcctcattgtcagtcctg

SEQ ID NO: 7531557 - DNA, 22 bp, Homo sapiens
cagggcctccccggcagtcttt

SEQ ID NO: 7531558 - DNA, 22 bp, Homo sapiens
cagggcctccccggcagtcttt

SEQ ID NO: 7531559 - DNA, 22 bp, Homo sapiens
cagggcctccccggcagtcttt

SEQ ID NO: 7531560 - DNA, 22 bp, Homo sapiens
cagggcctccccggcagtcttt

SEQ ID NO: 7531561 - DNA, 22 bp, Homo sapiens
cagggcctcattgtcagtcctg

SEQ ID NO: 7531562 - DNA, 18 bp, Homo sapiens
taggaggatactgagatg

SEQ ID NO: 7531563 - DNA, 22 bp, Homo sapiens
taggagctaaaatattttatat

SEQ ID NO: 7531564 - DNA, 22 bp, Homo sapiens
taggagctaaaatattttatat

SEQ ID NO: 7531565 - DNA, 22 bp, Homo sapiens
taggagcctgctctgcagggac

SEQ ID NO: 7531566 - DNA, 22 bp, Homo sapiens
taggagcctgctctgcagggac

SEQ ID NO: 7531567 - DNA, 22 bp, Homo sapiens
taggagctataatgtgaagtct

SEQ ID NO: 7531568 - DNA, 22 bp, Homo sapiens
taggagctataatgtgaagtct

SEQ ID NO: 7531569 - DNA, 21 bp, Homo sapiens
taggagctgatggggaagtag

SEQ ID NO: 7531570 - DNA, 22 bp, Homo sapiens
taggagctgagacatctttaaa

SEQ ID NO: 7531571 - DNA, 22 bp, Homo sapiens
taggagctgagacatctttaaa

SEQ ID NO: 7531572 - DNA, 22 bp, Homo sapiens
taggagcttttggagtcctgtg

SEQ ID NO: 7531573 - DNA, 22 bp, Homo sapiens
taggagcttttggagtcctgtg

SEQ ID NO: 7531574 - DNA, 23 bp, Homo sapiens
taggaggagaccgcagtgttacc

SEQ ID NO: 7531575 - DNA, 23 bp, Homo sapiens
taggaggagaccgcagtgttacc

SEQ ID NO: 7531576 - DNA, 22 bp, Homo sapiens
taggaggaactttttgtttgga

SEQ ID NO: 7531577 - DNA, 22 bp, Homo sapiens
taggaggaactttttgtttgga

SEQ ID NO: 7531578 - DNA, 22 bp, Homo sapiens
cagggcctgtcacgacgctcat

SEQ ID NO: 7531579 - DNA, 22 bp, Homo sapiens
cagggcctgtcacgacgctcat

SEQ ID NO: 7531580 - DNA, 22 bp, Homo sapiens
cagggcctgtcacgacgctcat

SEQ ID NO: 7531581 - DNA, 22 bp, Homo sapiens
cagggcctgtcacgacgctcat

SEQ ID NO: 7531582 - DNA, 22 bp, Homo sapiens
cagggcctgtacaagtcccacc

SEQ ID NO: 7531583 - DNA, 22 bp, Homo sapiens
cagggcctgtacaagtcccacc

SEQ ID NO: 7531584 - DNA, 22 bp, Homo sapiens
cagggcctgtacaagtcccacc

SEQ ID NO: 7531585 - DNA, 22 bp, Homo sapiens
cagggcctgtacaagtcccacc

SEQ ID NO: 7531586 - DNA, 22 bp, Homo sapiens
cagggcctgtacaagtcccacc

SEQ ID NO: 7531587 - DNA, 22 bp, Homo sapiens
cagggccttcgtaagtgtccgg

SEQ ID NO: 7531588 - DNA, 22 bp, Homo sapiens
cagggccttcgtaagtgtccgg

SEQ ID NO: 7531589 - DNA, 22 bp, Homo sapiens
cagggccttcgtaagtgtccgg

SEQ ID NO: 7531590 - DNA, 22 bp, Homo sapiens
cagggccttatcctgccattga

SEQ ID NO: 7531591 - DNA, 22 bp, Homo sapiens
cagggccttcgtaagtgtccgg

SEQ ID NO: 7531592 - DNA, 22 bp, Homo sapiens
cagggccttatcctgccattga

SEQ ID NO: 7531593 - DNA, 22 bp, Homo sapiens
cagggccttatcctgccattga

SEQ ID NO: 7531594 - DNA, 22 bp, Homo sapiens
cagggccttcgtaagtgtccgg

SEQ ID NO: 7531595 - DNA, 21 bp, Homo sapiens
cagggctagagagaatgacaa

SEQ ID NO: 7531596 - DNA, 21 bp, Homo sapiens
cagggctagagagaatgacaa

SEQ ID NO: 7531597 - DNA, 21 bp, Homo sapiens
cagggctagagagaatgacaa

SEQ ID NO: 7531598 - DNA, 22 bp, Homo sapiens
cagggcgaacttggcggtgggc

SEQ ID NO: 7531599 - DNA, 22 bp, Homo sapiens
cagggcggggtctgccggccct

SEQ ID NO: 7531600 - DNA, 22 bp, Homo sapiens
cagggccttttagcatcttctc

SEQ ID NO: 7531601 - DNA, 22 bp, Homo sapiens
cagggccttttagcatcttctc

SEQ ID NO: 7531602 - DNA, 22 bp, Homo sapiens
cagggccttttagcatcttctc

SEQ ID NO: 7531603 - DNA, 22 bp, Homo sapiens
cagggccttttagcatcttctc

SEQ ID NO: 7531604 - DNA, 22 bp, Homo sapiens
cagggccttgttcaggagtgaa

SEQ ID NO: 7531605 - DNA, 22 bp, Homo sapiens
cagggccttgttcaggagtgaa

SEQ ID NO: 7531606 - DNA, 22 bp, Homo sapiens
cagggccttgttcaggagtgaa

SEQ ID NO: 7531607 - DNA, 22 bp, Homo sapiens
cagggccttgttcaggagtgaa

SEQ ID NO: 7531608 - DNA, 22 bp, Homo sapiens
cagggccttgttcaggagtgaa

SEQ ID NO: 7531609 - DNA, 22 bp, Homo sapiens
cagggccttgttcaggagtgaa

SEQ ID NO: 7531610 - DNA, 22 bp, Homo sapiens
cagggccttgttcaggagtgaa

SEQ ID NO: 7531611 - DNA, 22 bp, Homo sapiens
cagggccttgttcaggagtgaa

SEQ ID NO: 7531612 - DNA, 22 bp, Homo sapiens
cagggctcagggactgcagaaa

SEQ ID NO: 7531613 - DNA, 22 bp, Homo sapiens
cagggctcagggactgcagaaa

SEQ ID NO: 7531614 - DNA, 22 bp, Homo sapiens
cagggctcagggactgcagaaa

SEQ ID NO: 7531615 - DNA, 22 bp, Homo sapiens
cagggctcagggactgcagaaa

SEQ ID NO: 7531616 - DNA, 22 bp, Homo sapiens
cagggctcagggactgcagaaa

SEQ ID NO: 7531617 - DNA, 22 bp, Homo sapiens
cagggctcaggctctgggattc

SEQ ID NO: 7531618 - DNA, 22 bp, Homo sapiens
cagggctcagggactgcagaaa

SEQ ID NO: 7531619 - DNA, 22 bp, Homo sapiens
cagggctcagggactgcagaaa

SEQ ID NO: 7531620 - DNA, 22 bp, Homo sapiens
cagggctcaggctctgggattc

SEQ ID NO: 7531621 - DNA, 22 bp, Homo sapiens
cagggctcaggctctgggattc

SEQ ID NO: 7531622 - DNA, 22 bp, Homo sapiens
cagggctcaggctctgggattc

SEQ ID NO: 7531623 - DNA, 22 bp, Homo sapiens
cagggctcaggctctgggattc

SEQ ID NO: 7531624 - DNA, 22 bp, Homo sapiens
cagggctcaggctctgggattc

SEQ ID NO: 7531625 - DNA, 22 bp, Homo sapiens
cagggctcaggctctgggattc

SEQ ID NO: 7531626 - DNA, 22 bp, Homo sapiens
cagggctcaggaaatcagacgt

SEQ ID NO: 7531627 - DNA, 22 bp, Homo sapiens
cagggctcaggaaatcagacgt

SEQ ID NO: 7531628 - DNA, 22 bp, Homo sapiens
cagggctcaggaaatcagacgt

SEQ ID NO: 7531629 - DNA, 22 bp, Homo sapiens
cagggctcaggaaatcagacgt

SEQ ID NO: 7531630 - DNA, 22 bp, Homo sapiens
cagggctcagaagacagacctc

SEQ ID NO: 7531631 - DNA, 22 bp, Homo sapiens
cagggctcactcggctggcgtc

SEQ ID NO: 7531632 - DNA, 22 bp, Homo sapiens
cagggctcactcggctggcgtc

SEQ ID NO: 7531633 - DNA, 22 bp, Homo sapiens
cagggctcactcggctggcgtc

SEQ ID NO: 7531634 - DNA, 22 bp, Homo sapiens
cagggctcagaagacagacctc

SEQ ID NO: 7531635 - DNA, 22 bp, Homo sapiens
cagggctcaggaaatcagacgt

SEQ ID NO: 7531636 - DNA, 22 bp, Homo sapiens
cagggctcagaagacagacctc

SEQ ID NO: 7531637 - DNA, 22 bp, Homo sapiens
cagggctcaggaaatcagacgt

SEQ ID NO: 7531638 - DNA, 22 bp, Homo sapiens
cagggctcagaagacagacctc

SEQ ID NO: 7531639 - DNA, 22 bp, Homo sapiens
cagggctcagaagacagacctc

SEQ ID NO: 7531640 - DNA, 22 bp, Homo sapiens
cagggctcagaagacagacctc

SEQ ID NO: 7531641 - DNA, 22 bp, Homo sapiens
cagggctcagaagacagacctc

SEQ ID NO: 7531642 - DNA, 22 bp, Homo sapiens
cagggctagtgacaccccagtc

SEQ ID NO: 7531643 - DNA, 22 bp, Homo sapiens
cagggctcaccactgggatcct

SEQ ID NO: 7531644 - DNA, 22 bp, Homo sapiens
cagggctcaccactgggatcct

SEQ ID NO: 7531645 - DNA, 22 bp, Homo sapiens
cagggctcaccactgggatcct

SEQ ID NO: 7531646 - DNA, 22 bp, Homo sapiens
cagggctcaccactgggatcct

SEQ ID NO: 7531647 - DNA, 22 bp, Homo sapiens
cagggctcaccactgggatcct

SEQ ID NO: 7531648 - DNA, 22 bp, Homo sapiens
cagggctcactcggctggcgtc

SEQ ID NO: 7531649 - DNA, 22 bp, Homo sapiens
cagggctcactcggctggcgtc

SEQ ID NO: 7531650 - DNA, 22 bp, Homo sapiens
cagggctcactcggctggcgtc

SEQ ID NO: 7531651 - DNA, 22 bp, Homo sapiens
cagggctcactcggctggcgtc

SEQ ID NO: 7531652 - DNA, 22 bp, Homo sapiens
cagggctcaccactgggatcct

SEQ ID NO: 7531653 - DNA, 22 bp, Homo sapiens
tactatttttgcaacgtataca

SEQ ID NO: 7531654 - DNA, 22 bp, Homo sapiens
tactcaaaaagttatgaatcat

SEQ ID NO: 7531655 - DNA, 22 bp, Homo sapiens
tactcaaaaagttatgaatcat

SEQ ID NO: 7531656 - DNA, 22 bp, Homo sapiens
tactcaaactcactaagacaga

SEQ ID NO: 7531657 - DNA, 22 bp, Homo sapiens
tactcaaactcactaagacaga

SEQ ID NO: 7531658 - DNA, 22 bp, Homo sapiens
tactatttttgcaacgtataca

SEQ ID NO: 7531659 - DNA, 22 bp, Homo sapiens
tactatttttgcaacgtataca

SEQ ID NO: 7531660 - DNA, 22 bp, Homo sapiens
tactatttttgcaacgtataca

SEQ ID NO: 7531661 - DNA, 22 bp, Homo sapiens
tactatttttgcaacgtataca

SEQ ID NO: 7531662 - DNA, 22 bp, Homo sapiens
tactatttttgcaacgtataca

SEQ ID NO: 7531663 - DNA, 22 bp, Homo sapiens
tactatttttgcaacgtataca

SEQ ID NO: 7531664 - DNA, 22 bp, Homo sapiens
tactattttgacatgaaattga

SEQ ID NO: 7531665 - DNA, 22 bp, Homo sapiens
tactattttgacatgaaattga

SEQ ID NO: 7531666 - DNA, 22 bp, Homo sapiens
tactattttgacatgaaattga

SEQ ID NO: 7531667 - DNA, 22 bp, Homo sapiens
tactattttgacatgaaattga

SEQ ID NO: 7531668 - DNA, 22 bp, Homo sapiens
tactattttgacatgaaattga

SEQ ID NO: 7531669 - DNA, 22 bp, Homo sapiens
tactatttggaattttaaattg

SEQ ID NO: 7531670 - DNA, 22 bp, Homo sapiens
tactatttggaattttaaattg

SEQ ID NO: 7531671 - DNA, 22 bp, Homo sapiens
tactcacattctgtttcttgct

SEQ ID NO: 7531672 - DNA, 22 bp, Homo sapiens
tactcatcagactccagggtgg

SEQ ID NO: 7531673 - DNA, 22 bp, Homo sapiens
tactcagtttatgatttcaagt

SEQ ID NO: 7531674 - DNA, 22 bp, Homo sapiens
tactcagtttatgatttcaagt

SEQ ID NO: 7531675 - DNA, 22 bp, Homo sapiens
tactcagtttatgatttcaagt

SEQ ID NO: 7531676 - DNA, 22 bp, Homo sapiens
tactcagaaggaattgtgtttt

SEQ ID NO: 7531677 - DNA, 22 bp, Homo sapiens
tactcagacttgaatctcaaga

SEQ ID NO: 7531678 - DNA, 22 bp, Homo sapiens
tactcagtttatgatttcaagt

SEQ ID NO: 7531679 - DNA, 22 bp, Homo sapiens
tactcagattcttcatattcag

SEQ ID NO: 7531680 - DNA, 22 bp, Homo sapiens
tactgtaggtgggtcactagta

SEQ ID NO: 7531681 - DNA, 21 bp, Homo sapiens
tactgtagccttgcactgtag

SEQ ID NO: 7531682 - DNA, 21 bp, Homo sapiens
tactgtagccttgcactgtag

SEQ ID NO: 7531683 - DNA, 19 bp, Homo sapiens
tactccaatcaggaacaca

SEQ ID NO: 7531684 - DNA, 22 bp, Homo sapiens
tactcattcatgttgttgtatg

SEQ ID NO: 7531685 - DNA, 21 bp, Homo sapiens
tactgtagccttgcactgtag

SEQ ID NO: 7531686 - DNA, 22 bp, Homo sapiens
tactgtatatgcttgtatctga

SEQ ID NO: 7531687 - DNA, 22 bp, Homo sapiens
tactgtatatgcttgtatctga

SEQ ID NO: 7531688 - DNA, 21 bp, Homo sapiens
tactgtatagatgtgttcttg

SEQ ID NO: 7531689 - DNA, 21 bp, Homo sapiens
tactgtatagatgtgttcttg

SEQ ID NO: 7531690 - DNA, 22 bp, Homo sapiens
tactgtattgttggctcttttg

SEQ ID NO: 7531691 - DNA, 22 bp, Homo sapiens
tactgtatgatttcatgtatat

SEQ ID NO: 7531692 - DNA, 22 bp, Homo sapiens
tactgtattgttggctcttttg

SEQ ID NO: 7531693 - DNA, 22 bp, Homo sapiens
tactgtatgatttcatgtatat

SEQ ID NO: 7531694 - DNA, 22 bp, Homo sapiens
tactgtatgatttcatgtatat

SEQ ID NO: 7531695 - DNA, 22 bp, Homo sapiens
tactgtatgaattatgttattt

SEQ ID NO: 7531696 - DNA, 22 bp, Homo sapiens
tactgtatgatttcatgtatat

SEQ ID NO: 7531697 - DNA, 22 bp, Homo sapiens
tactgtatgaattatgttattt

SEQ ID NO: 7531698 - DNA, 22 bp, Homo sapiens
tactgtaggtgggtcactagta

SEQ ID NO: 7531699 - DNA, 23 bp, Homo sapiens
tactgtatattactgtgttatac

SEQ ID NO: 7531700 - DNA, 23 bp, Homo sapiens
tactgtatattactgtgttatac

SEQ ID NO: 7531701 - DNA, 22 bp, Homo sapiens
tactgtatgaattatgttattt

SEQ ID NO: 7531702 - DNA, 23 bp, Homo sapiens
tactgtatattactgtgttatac

SEQ ID NO: 7531703 - DNA, 22 bp, Homo sapiens
tactgtatgaattatgttattt

SEQ ID NO: 7531704 - DNA, 22 bp, Homo sapiens
tactgtatgaattatgttattt

SEQ ID NO: 7531705 - DNA, 22 bp, Homo sapiens
tactgtctggcaattaagaatc

SEQ ID NO: 7531706 - DNA, 22 bp, Homo sapiens
tactgtctggagttgccaaagg

SEQ ID NO: 7531707 - DNA, 22 bp, Homo sapiens
tactgtctatacacttgattac

SEQ ID NO: 7531708 - DNA, 22 bp, Homo sapiens
tactgtctaataagattgatgg

SEQ ID NO: 7531709 - DNA, 22 bp, Homo sapiens
tactgtcattagcattaacttt

SEQ ID NO: 7531710 - DNA, 22 bp, Homo sapiens
tactgtccatggtgctggacgg

SEQ ID NO: 7531711 - DNA, 22 bp, Homo sapiens
tactgtatttagaaagaactcc

SEQ ID NO: 7531712 - DNA, 22 bp, Homo sapiens
tactgtatttagaaagaactcc

SEQ ID NO: 7531713 - DNA, 22 bp, Homo sapiens
tactgtatttagaaagaactcc

SEQ ID NO: 7531714 - DNA, 22 bp, Homo sapiens
tactgtatttgataagtgaagt

SEQ ID NO: 7531715 - DNA, 22 bp, Homo sapiens
tactgtatttgataagtgaagt

SEQ ID NO: 7531716 - DNA, 22 bp, Homo sapiens
tactgtatttgataagtgaagt

SEQ ID NO: 7531717 - DNA, 22 bp, Homo sapiens
tactgtatttgataagtgaagt

SEQ ID NO: 7531718 - DNA, 22 bp, Homo sapiens
tactatgttcttcctaaatagt

SEQ ID NO: 7531719 - DNA, 22 bp, Homo sapiens
tactattgaatcattgtcaatc

SEQ ID NO: 7531720 - DNA, 22 bp, Homo sapiens
tactatgttcttcctaaatagt

SEQ ID NO: 7531721 - DNA, 22 bp, Homo sapiens
tactattgaatcattgtcaatc

SEQ ID NO: 7531722 - DNA, 22 bp, Homo sapiens
tactatttatggagtggttatt

SEQ ID NO: 7531723 - DNA, 22 bp, Homo sapiens
tactatttggaattttaaattg

SEQ ID NO: 7531724 - DNA, 22 bp, Homo sapiens
tactatttggaattttaaattg

SEQ ID NO: 7531725 - DNA, 22 bp, Homo sapiens
tactatttggaattttaaattg

SEQ ID NO: 7531726 - DNA, 22 bp, Homo sapiens
tactatttggaattttaaattg

SEQ ID NO: 7531727 - DNA, 22 bp, Homo sapiens
tactatgtgaaaatactatagt

SEQ ID NO: 7531728 - DNA, 22 bp, Homo sapiens
tactatgtgaaaatactatagt

SEQ ID NO: 7531729 - DNA, 22 bp, Homo sapiens
tactatgtgaaaatactatagt

SEQ ID NO: 7531730 - DNA, 22 bp, Homo sapiens
tacctgaagtaacaatgaatat

SEQ ID NO: 7531731 - DNA, 22 bp, Homo sapiens
tacctgaagtaacaatgaatat

SEQ ID NO: 7531732 - DNA, 22 bp, Homo sapiens
tacctgaagtaacaatgaatat

SEQ ID NO: 7531733 - DNA, 22 bp, Homo sapiens
tacctgaaccaagcccagctct

SEQ ID NO: 7531734 - DNA, 22 bp, Homo sapiens
tacctctggacattgtggagca

SEQ ID NO: 7531735 - DNA, 22 bp, Homo sapiens
gtgaggggtggctgagcagttt

SEQ ID NO: 7531736 - DNA, 22 bp, Homo sapiens
gtgaggggtggctgagcagttt

SEQ ID NO: 7531737 - DNA, 22 bp, Homo sapiens
gtgaggggtggctgagcagttt

SEQ ID NO: 7531738 - DNA, 22 bp, Homo sapiens
gtgaggggtggctgagcagttt

SEQ ID NO: 7531739 - DNA, 22 bp, Homo sapiens
gtgaggggtggctgagcagttt

SEQ ID NO: 7531740 - DNA, 22 bp, Homo sapiens
gtgaggggtggctgagcagttt

SEQ ID NO: 7531741 - DNA, 22 bp, Homo sapiens
gtgaggggtggctgagcagttt

SEQ ID NO: 7531742 - DNA, 22 bp, Homo sapiens
gtgaggggtggctgagcagttt

SEQ ID NO: 7531743 - DNA, 22 bp, Homo sapiens
gtgaggggtctggacgcacagt

SEQ ID NO: 7531744 - DNA, 22 bp, Homo sapiens
gtgaggggtctggacgcacagt

SEQ ID NO: 7531745 - DNA, 22 bp, Homo sapiens
gtgaggggtctggacgcacagt

SEQ ID NO: 7531746 - DNA, 22 bp, Homo sapiens
gtgaggggtctggacgcacagt

SEQ ID NO: 7531747 - DNA, 22 bp, Homo sapiens
gtgaggggccaagagtagggca

SEQ ID NO: 7531748 - DNA, 22 bp, Homo sapiens
gtgaggggccaagagtagggca

SEQ ID NO: 7531749 - DNA, 22 bp, Homo sapiens
gtgaggggccaagagtagggca

SEQ ID NO: 7531750 - DNA, 22 bp, Homo sapiens
gtgagggataatatgcggggtt

SEQ ID NO: 7531751 - DNA, 22 bp, Homo sapiens
gtgagggcaaattagaatcaaa

SEQ ID NO: 7531752 - DNA, 22 bp, Homo sapiens
cagccctgtgcggagggccctg

SEQ ID NO: 7531753 - DNA, 22 bp, Homo sapiens
gtgagggcagaacccccaggcc

SEQ ID NO: 7531754 - DNA, 22 bp, Homo sapiens
gtgagggcagaacccccaggcc

SEQ ID NO: 7531755 - DNA, 20 bp, Homo sapiens
cagccctgtgacctggccct

SEQ ID NO: 7531756 - DNA, 20 bp, Homo sapiens
cagccctgtgacctggccct

SEQ ID NO: 7531757 - DNA, 22 bp, Homo sapiens
cagccctgtctatgactgatga

SEQ ID NO: 7531758 - DNA, 20 bp, Homo sapiens
cagccctgtgacctggccct

SEQ ID NO: 7531759 - DNA, 20 bp, Homo sapiens
cagccctgtgacctggccct

SEQ ID NO: 7531760 - DNA, 20 bp, Homo sapiens
cagccctgtgacctggccct

SEQ ID NO: 7531761 - DNA, 20 bp, Homo sapiens
cagccctgtgacctggccct

SEQ ID NO: 7531762 - DNA, 20 bp, Homo sapiens
cagccctgtgacctggccct

SEQ ID NO: 7531763 - DNA, 20 bp, Homo sapiens
cagccctgtgacctggccct

SEQ ID NO: 7531764 - DNA, 20 bp, Homo sapiens
cagccctgtgacctggccct

SEQ ID NO: 7531765 - DNA, 20 bp, Homo sapiens
cagccctgtgacctggccct

SEQ ID NO: 7531766 - DNA, 17 bp, Homo sapiens
gtgagggcagaggatgg

SEQ ID NO: 7531767 - DNA, 22 bp, Homo sapiens
gtgaggggagtaaagccatgtt

SEQ ID NO: 7531768 - DNA, 22 bp, Homo sapiens
gtgaggggagtaaagccatgtt

SEQ ID NO: 7531769 - DNA, 22 bp, Homo sapiens
gtgagggcagcttggtcagtgt

SEQ ID NO: 7531770 - DNA, 17 bp, Homo sapiens
gtgagggcagaggatgg

SEQ ID NO: 7531771 - DNA, 17 bp, Homo sapiens
gtgagggcagaggatgg

SEQ ID NO: 7531772 - DNA, 17 bp, Homo sapiens
gtgagggcagaggatgg

SEQ ID NO: 7531773 - DNA, 22 bp, Homo sapiens
gtgaggggagtaaagccatgtt

SEQ ID NO: 7531774 - DNA, 22 bp, Homo sapiens
gtgaggggagtaaagccatgtt

SEQ ID NO: 7531775 - DNA, 22 bp, Homo sapiens
gtgagggcagcttggtcagtgt

SEQ ID NO: 7531776 - DNA, 22 bp, Homo sapiens
gtgaggggagtaaagccatgtt

SEQ ID NO: 7531777 - DNA, 22 bp, Homo sapiens
gtgagggcagcttggtcagtgt

SEQ ID NO: 7531778 - DNA, 22 bp, Homo sapiens
gtgaggggagtaaagccatgtt

SEQ ID NO: 7531779 - DNA, 22 bp, Homo sapiens
gtgaggggagtaaagccatgtt

SEQ ID NO: 7531780 - DNA, 22 bp, Homo sapiens
gtgaggggccaagagtagggca

SEQ ID NO: 7531781 - DNA, 22 bp, Homo sapiens
gtgaggggccaagagtagggca

SEQ ID NO: 7531782 - DNA, 22 bp, Homo sapiens
gtgaggggccaagagtagggca

SEQ ID NO: 7531783 - DNA, 22 bp, Homo sapiens
gtgaggggccaagagtagggca

SEQ ID NO: 7531784 - DNA, 22 bp, Homo sapiens
gtgaggggccaagagtagggca

SEQ ID NO: 7531785 - DNA, 22 bp, Homo sapiens
tagaataatctgaggaaatgct

SEQ ID NO: 7531786 - DNA, 22 bp, Homo sapiens
tagaatacagtttaagaactac

SEQ ID NO: 7531787 - DNA, 22 bp, Homo sapiens
tagaatacagtttaagaactac

SEQ ID NO: 7531788 - DNA, 22 bp, Homo sapiens
tagaatacagtttaagaactac

SEQ ID NO: 7531789 - DNA, 22 bp, Homo sapiens
tagaacatcaggttgaatttgg

SEQ ID NO: 7531790 - DNA, 22 bp, Homo sapiens
tagaataagttgatgatatatg

SEQ ID NO: 7531791 - DNA, 22 bp, Homo sapiens
caggctggagtgcagtggggcg

SEQ ID NO: 7531792 - DNA, 22 bp, Homo sapiens
caggctggagtgcagtggtgcc

SEQ ID NO: 7531793 - DNA, 22 bp, Homo sapiens
caggctggagtgcagtggtgcc

SEQ ID NO: 7531794 - DNA, 22 bp, Homo sapiens
caggctggagtgcagtggtgcc

SEQ ID NO: 7531795 - DNA, 22 bp, Homo sapiens
tagaacataagtcattcatttg

SEQ ID NO: 7531796 - DNA, 22 bp, Homo sapiens
tagaacataagtcattcatttg

SEQ ID NO: 7531797 - DNA, 22 bp, Homo sapiens
tagaatatgattaattttctta

SEQ ID NO: 7531798 - DNA, 22 bp, Homo sapiens
tagaatatgattaattttctta

SEQ ID NO: 7531799 - DNA, 18 bp, Homo sapiens
tagaatataggtcattct

SEQ ID NO: 7531800 - DNA, 22 bp, Homo sapiens
tagaatatacactacagcttaa

SEQ ID NO: 7531801 - DNA, 22 bp, Homo sapiens
tagaatatacactacagcttaa

SEQ ID NO: 7531802 - DNA, 22 bp, Homo sapiens
tagaatatacactacagcttaa

SEQ ID NO: 7531803 - DNA, 22 bp, Homo sapiens
tagaatagtggctggcatattt

SEQ ID NO: 7531804 - DNA, 22 bp, Homo sapiens
tagaatactagtgaagtcatcg

SEQ ID NO: 7531805 - DNA, 22 bp, Homo sapiens
tagaatactagtgaagtcatcg

SEQ ID NO: 7531806 - DNA, 19 bp, Homo sapiens
tagaatagttacacagatt

SEQ ID NO: 7531807 - DNA, 22 bp, Homo sapiens
tagaatagtgttttcattatgg

SEQ ID NO: 7531808 - DNA, 22 bp, Homo sapiens
tagaatagtggctggcatattt

SEQ ID NO: 7531809 - DNA, 22 bp, Homo sapiens
tagaatatacactacagcttaa

SEQ ID NO: 7531810 - DNA, 22 bp, Homo sapiens
caggctggagtgcagtggcgct

SEQ ID NO: 7531811 - DNA, 22 bp, Homo sapiens
caggctggagtgcagtggcgct

SEQ ID NO: 7531812 - DNA, 22 bp, Homo sapiens
caggctggagtgcagtggcgct

SEQ ID NO: 7531813 - DNA, 22 bp, Homo sapiens
caggctggagtgcagtggcgct

SEQ ID NO: 7531814 - DNA, 22 bp, Homo sapiens
caggctggagtgcagtggcgct

SEQ ID NO: 7531815 - DNA, 22 bp, Homo sapiens
caggctggagtgcagtggcgct

SEQ ID NO: 7531816 - DNA, 22 bp, Homo sapiens
caggctggagtgcagtggcgct

SEQ ID NO: 7531817 - DNA, 22 bp, Homo sapiens
caggctggagtgcagtggcgct

SEQ ID NO: 7531818 - DNA, 22 bp, Homo sapiens
caggctggagtgcagtggcgcc

SEQ ID NO: 7531819 - DNA, 22 bp, Homo sapiens
caggctggagtgcagtggcgcc

SEQ ID NO: 7531820 - DNA, 22 bp, Homo sapiens
caggctggagtgcagtggcgcc

SEQ ID NO: 7531821 - DNA, 22 bp, Homo sapiens
caggctggagtgcagtggcgcc

SEQ ID NO: 7531822 - DNA, 22 bp, Homo sapiens
caggctggagtgcagtggcgcc

SEQ ID NO: 7531823 - DNA, 22 bp, Homo sapiens
caggctggagtgcagtggcgcc

SEQ ID NO: 7531824 - DNA, 22 bp, Homo sapiens
caggctggagtgcagtggcgcc

SEQ ID NO: 7531825 - DNA, 22 bp, Homo sapiens
caggctggagtgcagtggcgct

SEQ ID NO: 7531826 - DNA, 22 bp, Homo sapiens
caggctggagtgcagtggcgct

SEQ ID NO: 7531827 - DNA, 22 bp, Homo sapiens
caggctggagtgcagtggcgct

SEQ ID NO: 7531828 - DNA, 22 bp, Homo sapiens
caggctggagtgcagtggggcg

SEQ ID NO: 7531829 - DNA, 22 bp, Homo sapiens
caggctggagtgcagtggcgct

SEQ ID NO: 7531830 - DNA, 22 bp, Homo sapiens
caggctggagtgcagtggcgct

SEQ ID NO: 7531831 - DNA, 22 bp, Homo sapiens
caggctggagtgcagtggcgct

SEQ ID NO: 7531832 - DNA, 22 bp, Homo sapiens
caggctggagtgcagtggggcg

SEQ ID NO: 7531833 - DNA, 22 bp, Homo sapiens
caggctggagtgcagtggggcg

SEQ ID NO: 7531834 - DNA, 22 bp, Homo sapiens
caggctggagtgcagtggggcg

SEQ ID NO: 7531835 - DNA, 22 bp, Homo sapiens
caggctggagtgcagtggggcg

SEQ ID NO: 7531836 - DNA, 22 bp, Homo sapiens
caggctggagtgcagtggggcg

SEQ ID NO: 7531837 - DNA, 22 bp, Homo sapiens
caggctggagtgcagtggcgct

SEQ ID NO: 7531838 - DNA, 22 bp, Homo sapiens
caggctggagtgcagtggggcg

SEQ ID NO: 7531839 - DNA, 22 bp, Homo sapiens
caggctggagtgcagtggggcg

SEQ ID NO: 7531840 - DNA, 22 bp, Homo sapiens
caggctggagtgcagtggggcg

SEQ ID NO: 7531841 - DNA, 22 bp, Homo sapiens
caggctggagtgcagtggggcg

SEQ ID NO: 7531842 - DNA, 22 bp, Homo sapiens
caggctggagtgcagtggggcg

SEQ ID NO: 7531843 - DNA, 22 bp, Homo sapiens
caggctggagtgcagtggggcg

SEQ ID NO: 7531844 - DNA, 22 bp, Homo sapiens
caggctggagtgcagtggggcg

SEQ ID NO: 7531845 - DNA, 22 bp, Homo sapiens
caggctggagtgcagtggggcg

SEQ ID NO: 7531846 - DNA, 22 bp, Homo sapiens
caggctggagtgcagtggggcg

SEQ ID NO: 7531847 - DNA, 22 bp, Homo sapiens
caggctggagtgagtgtagtgg

SEQ ID NO: 7531848 - DNA, 22 bp, Homo sapiens
caggctggagtgagtgtagtgg

SEQ ID NO: 7531849 - DNA, 22 bp, Homo sapiens
caggctggagtgagtgtagtgg

SEQ ID NO: 7531850 - DNA, 22 bp, Homo sapiens
caggctggagtgagtgtagtgg

SEQ ID NO: 7531851 - DNA, 22 bp, Homo sapiens
caggctggagtgagtgtagtgg

SEQ ID NO: 7531852 - DNA, 22 bp, Homo sapiens
caggctggagtgagtgtagtgg

SEQ ID NO: 7531853 - DNA, 22 bp, Homo sapiens
caggctggagtgagtgtagtgg

SEQ ID NO: 7531854 - DNA, 22 bp, Homo sapiens
caggctggagtgagtgtagtgg

SEQ ID NO: 7531855 - DNA, 22 bp, Homo sapiens
caggctggagtgagtgtagtgg

SEQ ID NO: 7531856 - DNA, 22 bp, Homo sapiens
caggctgcctggaagaggactg

SEQ ID NO: 7531857 - DNA, 22 bp, Homo sapiens
caggctgcctggaagaggactg

SEQ ID NO: 7531858 - DNA, 22 bp, Homo sapiens
caggctgcctggaagaggactg

SEQ ID NO: 7531859 - DNA, 22 bp, Homo sapiens
caggctgcctggaagaggactg

SEQ ID NO: 7531860 - DNA, 22 bp, Homo sapiens
caggctgcctggaagaggactg

SEQ ID NO: 7531861 - DNA, 22 bp, Homo sapiens
caggctgcctggaagaggactg

SEQ ID NO: 7531862 - DNA, 22 bp, Homo sapiens
caggctggagtgagtgtagtgg

SEQ ID NO: 7531863 - DNA, 22 bp, Homo sapiens
caggctggagtgagtgtagtgg

SEQ ID NO: 7531864 - DNA, 22 bp, Homo sapiens
tactgtgaatacaaaataaatt

SEQ ID NO: 7531865 - DNA, 22 bp, Homo sapiens
caggctgcctggaagaggactg

SEQ ID NO: 7531866 - DNA, 22 bp, Homo sapiens
caggctgccgtggggtccaggc

SEQ ID NO: 7531867 - DNA, 22 bp, Homo sapiens
tactgtgccctgggtcagaact

SEQ ID NO: 7531868 - DNA, 22 bp, Homo sapiens
tactgtgccctgggtcagaact

SEQ ID NO: 7531869 - DNA, 23 bp, Homo sapiens
tactgtgctgaatatttgagagg

SEQ ID NO: 7531870 - DNA, 22 bp, Homo sapiens
tactgtgaatacaaaataaatt

SEQ ID NO: 7531871 - DNA, 22 bp, Homo sapiens
caggctggagtgcagtggcgcc

SEQ ID NO: 7531872 - DNA, 22 bp, Homo sapiens
caggctggagtgcagtggcgcc

SEQ ID NO: 7531873 - DNA, 22 bp, Homo sapiens
caggctggagtgcagtggcgcc

SEQ ID NO: 7531874 - DNA, 22 bp, Homo sapiens
caggctggagtgcagtggcgcc

SEQ ID NO: 7531875 - DNA, 22 bp, Homo sapiens
caggctggagtgcagtggcgcc

SEQ ID NO: 7531876 - DNA, 22 bp, Homo sapiens
caggctggagtgcagtggcgcc

SEQ ID NO: 7531877 - DNA, 22 bp, Homo sapiens
caggctggagtgcagtggcgcc

SEQ ID NO: 7531878 - DNA, 22 bp, Homo sapiens
caggctggagtgcagtggcgcc

SEQ ID NO: 7531879 - DNA, 22 bp, Homo sapiens
caggctggagtgcaatggtgct

SEQ ID NO: 7531880 - DNA, 22 bp, Homo sapiens
caggctggagtgcaatggtgct

SEQ ID NO: 7531881 - DNA, 22 bp, Homo sapiens
caggctggagtgcaatggtgct

SEQ ID NO: 7531882 - DNA, 22 bp, Homo sapiens
caggctggagtgcaatggtgct

SEQ ID NO: 7531883 - DNA, 22 bp, Homo sapiens
caggctggagtgcaatggtgct

SEQ ID NO: 7531884 - DNA, 22 bp, Homo sapiens
caggctggagtgcaatggtgct

SEQ ID NO: 7531885 - DNA, 22 bp, Homo sapiens
caggctggagtgcaatggtgct

SEQ ID NO: 7531886 - DNA, 22 bp, Homo sapiens
caggctggagtgcaatggtgct

SEQ ID NO: 7531887 - DNA, 22 bp, Homo sapiens
caggctggagtgcaatgacgcc

SEQ ID NO: 7531888 - DNA, 22 bp, Homo sapiens
caggctggagtgcaatggcaca

SEQ ID NO: 7531889 - DNA, 22 bp, Homo sapiens
caggctggagtgcaatggcaca

SEQ ID NO: 7531890 - DNA, 22 bp, Homo sapiens
caggctggagtgcaatggcaca

SEQ ID NO: 7531891 - DNA, 22 bp, Homo sapiens
caggctggagtgcaatggcaca

SEQ ID NO: 7531892 - DNA, 22 bp, Homo sapiens
caggctggagtgcaatggcaca

SEQ ID NO: 7531893 - DNA, 22 bp, Homo sapiens
caggctggagtgcaatggcaca

SEQ ID NO: 7531894 - DNA, 22 bp, Homo sapiens
caggctggagtgcaatggcaca

SEQ ID NO: 7531895 - DNA, 22 bp, Homo sapiens
caggctggagtgcaatggcaca

SEQ ID NO: 7531896 - DNA, 22 bp, Homo sapiens
caggctggagtgcaatgacgcc

SEQ ID NO: 7531897 - DNA, 22 bp, Homo sapiens
caggctggagtgcaatgacgcc

SEQ ID NO: 7531898 - DNA, 22 bp, Homo sapiens
caggctggagtgcaatgacgcc

SEQ ID NO: 7531899 - DNA, 22 bp, Homo sapiens
caggctggagtgcaatgacgcc

SEQ ID NO: 7531900 - DNA, 22 bp, Homo sapiens
caggctggagtgcaatgacgcc

SEQ ID NO: 7531901 - DNA, 22 bp, Homo sapiens
tagataatttggcatcatattg

SEQ ID NO: 7531902 - DNA, 22 bp, Homo sapiens
tagataatttggcatcatattg

SEQ ID NO: 7531903 - DNA, 19 bp, Homo sapiens
tagataaggcatttaatct

SEQ ID NO: 7531904 - DNA, 19 bp, Homo sapiens
tagataaggcatttaatct

SEQ ID NO: 7531905 - DNA, 22 bp, Homo sapiens
tagataatttggcatcatattg

SEQ ID NO: 7531906 - DNA, 22 bp, Homo sapiens
tagataatttggcatcatattg

SEQ ID NO: 7531907 - DNA, 22 bp, Homo sapiens
tagataatttggcatcatattg

SEQ ID NO: 7531908 - DNA, 22 bp, Homo sapiens
tagataagaatggcatcttctc

SEQ ID NO: 7531909 - DNA, 22 bp, Homo sapiens
tagataacttgcacctacagga

SEQ ID NO: 7531910 - DNA, 22 bp, Homo sapiens
tagataacagcactggcctcgc

SEQ ID NO: 7531911 - DNA, 22 bp, Homo sapiens
tagataaattagaaagtttact

SEQ ID NO: 7531912 - DNA, 22 bp, Homo sapiens
tagataaattagaaagtttact

SEQ ID NO: 7531913 - DNA, 22 bp, Homo sapiens
tagataaattagaaagtttact

SEQ ID NO: 7531914 - DNA, 22 bp, Homo sapiens
tagataaattagaaagtttact

SEQ ID NO: 7531915 - DNA, 22 bp, Homo sapiens
tagataaattagaaagtttact

SEQ ID NO: 7531916 - DNA, 22 bp, Homo sapiens
cagggcaaagagagcacatgct

SEQ ID NO: 7531917 - DNA, 22 bp, Homo sapiens
cagggcaaagagagcacatgct

SEQ ID NO: 7531918 - DNA, 21 bp, Homo sapiens
cagggcaaccaagtccagaga

SEQ ID NO: 7531919 - DNA, 21 bp, Homo sapiens
cagggcacacagaggatggta

SEQ ID NO: 7531920 - DNA, 21 bp, Homo sapiens
cagggcacacagaggatggta

SEQ ID NO: 7531921 - DNA, 21 bp, Homo sapiens
cagggcacacagaggatggta

SEQ ID NO: 7531922 - DNA, 22 bp, Homo sapiens
cagggcaaggcagagcgtcccc

SEQ ID NO: 7531923 - DNA, 22 bp, Homo sapiens
cagggcaaggcagagcgtcccc

SEQ ID NO: 7531924 - DNA, 22 bp, Homo sapiens
tagatacacacacagtcatgtg

SEQ ID NO: 7531925 - DNA, 22 bp, Homo sapiens
tagatacacacacagtcatgtg

SEQ ID NO: 7531926 - DNA, 22 bp, Homo sapiens
cagggatggcgctggctgcccg

SEQ ID NO: 7531927 - DNA, 22 bp, Homo sapiens
cagggatggcgctggctgcccg

SEQ ID NO: 7531928 - DNA, 22 bp, Homo sapiens
cagggatggcgctggctgcccg

SEQ ID NO: 7531929 - DNA, 22 bp, Homo sapiens
cagggatggcgctggctgcccg

SEQ ID NO: 7531930 - DNA, 22 bp, Homo sapiens
cagggatggcgctggctgcccg

SEQ ID NO: 7531931 - DNA, 22 bp, Homo sapiens
cagggatggcgctggctgcccg

SEQ ID NO: 7531932 - DNA, 22 bp, Homo sapiens
cagggcaaagagagcacatgct

SEQ ID NO: 7531933 - DNA, 20 bp, Homo sapiens
cagggcacactgcagcctcg

SEQ ID NO: 7531934 - DNA, 20 bp, Homo sapiens
cagggcacactgcagcctcg

SEQ ID NO: 7531935 - DNA, 21 bp, Homo sapiens
cagggcacacagaggatggta

SEQ ID NO: 7531936 - DNA, 20 bp, Homo sapiens
cagggcacactgcagcctcg

SEQ ID NO: 7531937 - DNA, 20 bp, Homo sapiens
cagggcacactgcagcctcg

SEQ ID NO: 7531938 - DNA, 20 bp, Homo sapiens
cagggcacactgcagcctcg

SEQ ID NO: 7531939 - DNA, 20 bp, Homo sapiens
cagggcacactgcagcctcg

SEQ ID NO: 7531940 - DNA, 22 bp, Homo sapiens
cagggcacggagaagtcacccc

SEQ ID NO: 7531941 - DNA, 22 bp, Homo sapiens
cagggcacggagaagtcacccc

SEQ ID NO: 7531942 - DNA, 22 bp, Homo sapiens
cagggcacagttatggaggtgg

SEQ ID NO: 7531943 - DNA, 22 bp, Homo sapiens
cagggcacagttatggaggtgg

SEQ ID NO: 7531944 - DNA, 22 bp, Homo sapiens
cagggcacagttatggaggtgg

SEQ ID NO: 7531945 - DNA, 22 bp, Homo sapiens
cagggcacagttatggaggtgg

SEQ ID NO: 7531946 - DNA, 22 bp, Homo sapiens
cagggcacagatcggggcgcac

SEQ ID NO: 7531947 - DNA, 22 bp, Homo sapiens
cagggcacagatcggggcgcac

SEQ ID NO: 7531948 - DNA, 20 bp, Homo sapiens
cagggcacactgcagcctcg

SEQ ID NO: 7531949 - DNA, 22 bp, Homo sapiens
cagggcacagatcggggcgcac

SEQ ID NO: 7531950 - DNA, 22 bp, Homo sapiens
cagggcagaaggcactctactc

SEQ ID NO: 7531951 - DNA, 22 bp, Homo sapiens
cagggcagaacatatagatagt

SEQ ID NO: 7531952 - DNA, 22 bp, Homo sapiens
cagggcagaacatatagatagt

SEQ ID NO: 7531953 - DNA, 22 bp, Homo sapiens
cagggcagaacatatagatagt

SEQ ID NO: 7531954 - DNA, 22 bp, Homo sapiens
cagggcagaaggcactctactc

SEQ ID NO: 7531955 - DNA, 22 bp, Homo sapiens
cagggcagaaggcactctactc

SEQ ID NO: 7531956 - DNA, 22 bp, Homo sapiens
cagggcagaaggcactctactc

SEQ ID NO: 7531957 - DNA, 22 bp, Homo sapiens
cagggcagaaggcactctactc

SEQ ID NO: 7531958 - DNA, 22 bp, Homo sapiens
cagggcagaaggcactctactc

SEQ ID NO: 7531959 - DNA, 22 bp, Homo sapiens
cagggcacttaaattgcctcgt

SEQ ID NO: 7531960 - DNA, 22 bp, Homo sapiens
cagggcacggagaagtcacccc

SEQ ID NO: 7531961 - DNA, 22 bp, Homo sapiens
cagggcagaacatatagatagt

SEQ ID NO: 7531962 - DNA, 22 bp, Homo sapiens
cagggcagaacatatagatagt

SEQ ID NO: 7531963 - DNA, 22 bp, Homo sapiens
cagggcagaacatatagatagt

SEQ ID NO: 7531964 - DNA, 22 bp, Homo sapiens
cagggcagaacatatagatagt

SEQ ID NO: 7531965 - DNA, 22 bp, Homo sapiens
cagggcagaacatatagatagt

SEQ ID NO: 7531966 - DNA, 22 bp, Homo sapiens
cagggcagaacatatagatagt

SEQ ID NO: 7531967 - DNA, 22 bp, Homo sapiens
tagcaaggacaacatatgagag

SEQ ID NO: 7531968 - DNA, 22 bp, Homo sapiens
tagcaagcagattagaagatcc

SEQ ID NO: 7531969 - DNA, 20 bp, Homo sapiens
tagcaagcaggaggtgcaga

SEQ ID NO: 7531970 - DNA, 20 bp, Homo sapiens
tagcaagcaggaggtgcaga

SEQ ID NO: 7531971 - DNA, 22 bp, Homo sapiens
tagcaaggacgtccaaagaact

SEQ ID NO: 7531972 - DNA, 22 bp, Homo sapiens
tagcaaggacaacatatgagag

SEQ ID NO: 7531973 - DNA, 22 bp, Homo sapiens
tagcaaggcgtggcactcaaat

SEQ ID NO: 7531974 - DNA, 22 bp, Homo sapiens
tagcaaggacaacatatgagag

SEQ ID NO: 7531975 - DNA, 22 bp, Homo sapiens
tagcaaggacaacatatgagag

SEQ ID NO: 7531976 - DNA, 22 bp, Homo sapiens
tagcaaggacgtccaaagaact

SEQ ID NO: 7531977 - DNA, 22 bp, Homo sapiens
tagcaaggacgtccaaagaact

SEQ ID NO: 7531978 - DNA, 22 bp, Homo sapiens
tagcaaggcttccaatgaacag

SEQ ID NO: 7531979 - DNA, 22 bp, Homo sapiens
tagcaaggcttccaatgaacag

SEQ ID NO: 7531980 - DNA, 22 bp, Homo sapiens
tagcaaggtgaagtatgggtga

SEQ ID NO: 7531981 - DNA, 22 bp, Homo sapiens
tagcaaggtgaagtatgggtga

SEQ ID NO: 7531982 - DNA, 22 bp, Homo sapiens
tagcaagtatgatactccatga

SEQ ID NO: 7531983 - DNA, 22 bp, Homo sapiens
tagcaaggcgtggcactcaaat

SEQ ID NO: 7531984 - DNA, 22 bp, Homo sapiens
tagcaagtgttggtgaagatgt

SEQ ID NO: 7531985 - DNA, 22 bp, Homo sapiens
tagcaagtgttggtgaagatgt

SEQ ID NO: 7531986 - DNA, 22 bp, Homo sapiens
tagcaagatccttccctggcgt

SEQ ID NO: 7531987 - DNA, 22 bp, Homo sapiens
tagcaagagtgggctttgtggg

SEQ ID NO: 7531988 - DNA, 22 bp, Homo sapiens
tagcaagagtgggctttgtggg

SEQ ID NO: 7531989 - DNA, 22 bp, Homo sapiens
cagggcagaaggcactctactc

SEQ ID NO: 7531990 - DNA, 22 bp, Homo sapiens
cagggcagaaggcactctactc

SEQ ID NO: 7531991 - DNA, 22 bp, Homo sapiens
cagggcagaaggcactctactc

SEQ ID NO: 7531992 - DNA, 22 bp, Homo sapiens
cagggcagaaggcactctactc

SEQ ID NO: 7531993 - DNA, 22 bp, Homo sapiens
cagggcagaaggcactctactc

SEQ ID NO: 7531994 - DNA, 22 bp, Homo sapiens
tagcaagaggtgaaggtttcat

SEQ ID NO: 7531995 - DNA, 22 bp, Homo sapiens
tagcaagatgatgaattattca

SEQ ID NO: 7531996 - DNA, 22 bp, Homo sapiens
tagcaagatcgtgtctctaaaa

SEQ ID NO: 7531997 - DNA, 22 bp, Homo sapiens
tagcaagatccttccctggcgt

SEQ ID NO: 7531998 - DNA, 22 bp, Homo sapiens
tagcaagatgatgaattattca

SEQ ID NO: 7531999 - DNA, 22 bp, Homo sapiens
tagcaagatgtcactccaagtt

SEQ ID NO: 7532000 - DNA, 22 bp, Homo sapiens
tagctacaaggaagaatggaaa

SEQ ID NO: 7532001 - DNA, 22 bp, Homo sapiens
tagctacacatctaaacagcaa

SEQ ID NO: 7532002 - DNA, 22 bp, Homo sapiens
tagctacaaggaagaatggaaa

SEQ ID NO: 7532003 - DNA, 22 bp, Homo sapiens
tagctacacatctaaacagcaa

SEQ ID NO: 7532004 - DNA, 22 bp, Homo sapiens
tagctacacatctaaacagcaa

SEQ ID NO: 7532005 - DNA, 22 bp, Homo sapiens
tagctacaatcactgtcctttg

SEQ ID NO: 7532006 - DNA, 22 bp, Homo sapiens
tagctacaatcactgtcctttg

SEQ ID NO: 7532007 - DNA, 22 bp, Homo sapiens
tagctacaaatctgataagtgg

SEQ ID NO: 7532008 - DNA, 22 bp, Homo sapiens
tagctacaaatctgataagtgg

SEQ ID NO: 7532009 - DNA, 22 bp, Homo sapiens
tagctaagttacttggcaacag

SEQ ID NO: 7532010 - DNA, 22 bp, Homo sapiens
tagctaatggtgaagattcaga

SEQ ID NO: 7532011 - DNA, 22 bp, Homo sapiens
tagctaagtacacattgaataa

SEQ ID NO: 7532012 - DNA, 22 bp, Homo sapiens
tagctaaggcaatcttttgcac

SEQ ID NO: 7532013 - DNA, 22 bp, Homo sapiens
tagctaagcattatgtaaacta

SEQ ID NO: 7532014 - DNA, 22 bp, Homo sapiens
tagcattccttgtggcttctga

SEQ ID NO: 7532015 - DNA, 22 bp, Homo sapiens
tagcattccatcactcagcacc

SEQ ID NO: 7532016 - DNA, 22 bp, Homo sapiens
tagctaaaccagtatgtgaagg

SEQ ID NO: 7532017 - DNA, 22 bp, Homo sapiens
tagctaaatttttcatgtaata

SEQ ID NO: 7532018 - DNA, 22 bp, Homo sapiens
tagcattccatcactcagcacc

SEQ ID NO: 7532019 - DNA, 20 bp, Homo sapiens
tagcattccagaaaactcag

SEQ ID NO: 7532020 - DNA, 22 bp, Homo sapiens
tagcaatagaaacatataaagt

SEQ ID NO: 7532021 - DNA, 22 bp, Homo sapiens
tagcaatatttggtgaaggtta

SEQ ID NO: 7532022 - DNA, 21 bp, Homo sapiens
tagcaatacgtggaccatggg

SEQ ID NO: 7532023 - DNA, 20 bp, Homo sapiens
tagcaatgagtgttccattt

SEQ ID NO: 7532024 - DNA, 20 bp, Homo sapiens
tagcaatgagtgttccattt

SEQ ID NO: 7532025 - DNA, 22 bp, Homo sapiens
tagcaatccgttgatcccttgc

SEQ ID NO: 7532026 - DNA, 22 bp, Homo sapiens
tagcaatgctctatgatgaaaa

SEQ ID NO: 7532027 - DNA, 22 bp, Homo sapiens
tagcaatgctctatgatgaaaa

SEQ ID NO: 7532028 - DNA, 22 bp, Homo sapiens
tagcaatgctctatgatgaaaa

SEQ ID NO: 7532029 - DNA, 22 bp, Homo sapiens
tagcaatgcttcattatttaaa

SEQ ID NO: 7532030 - DNA, 22 bp, Homo sapiens
tagcaatgcttcattatttaaa

SEQ ID NO: 7532031 - DNA, 22 bp, Homo sapiens
tagcaatgcttcattatttaaa

SEQ ID NO: 7532032 - DNA, 22 bp, Homo sapiens
tagcaatgtaagatgttaacac

SEQ ID NO: 7532033 - DNA, 22 bp, Homo sapiens
tagcaatgtgtgtgtataaatt

SEQ ID NO: 7532034 - DNA, 22 bp, Homo sapiens
tagcaatgcttcattatttaaa

SEQ ID NO: 7532035 - DNA, 22 bp, Homo sapiens
tagcaatgtaagatgttaacac

SEQ ID NO: 7532036 - DNA, 22 bp, Homo sapiens
tagcaatgtgtgtgtataaatt

SEQ ID NO: 7532037 - DNA, 22 bp, Homo sapiens
tagcaatgtgtgtgtataaatt

SEQ ID NO: 7532038 - DNA, 22 bp, Homo sapiens
tagcaatgtaagatgttaacac

SEQ ID NO: 7532039 - DNA, 22 bp, Homo sapiens
tagcattatctgtcttatcatt

SEQ ID NO: 7532040 - DNA, 22 bp, Homo sapiens
tagcattagtcagatatgtttt

SEQ ID NO: 7532041 - DNA, 21 bp, Homo sapiens
tagaatcactaataagatgta

SEQ ID NO: 7532042 - DNA, 21 bp, Homo sapiens
tagaatcactaataagatgta

SEQ ID NO: 7532043 - DNA, 21 bp, Homo sapiens
tagaatcactaataagatgta

SEQ ID NO: 7532044 - DNA, 21 bp, Homo sapiens
tagaatcactaataagatgta

SEQ ID NO: 7532045 - DNA, 21 bp, Homo sapiens
tagaatcactaataagatgta

SEQ ID NO: 7532046 - DNA, 22 bp, Homo sapiens
caggctgggcagcctccccggc

SEQ ID NO: 7532047 - DNA, 22 bp, Homo sapiens
caggctgggcagcctccccggc

SEQ ID NO: 7532048 - DNA, 22 bp, Homo sapiens
caggctgggcagcctccccggc

SEQ ID NO: 7532049 - DNA, 22 bp, Homo sapiens
caggctgggcagcctccccggc

SEQ ID NO: 7532050 - DNA, 22 bp, Homo sapiens
caggctgggcagcctccccggc

SEQ ID NO: 7532051 - DNA, 22 bp, Homo sapiens
caggctgggctccggagataaa

SEQ ID NO: 7532052 - DNA, 22 bp, Homo sapiens
caggctgggctccggagataaa

SEQ ID NO: 7532053 - DNA, 22 bp, Homo sapiens
caggctgggctccggagataaa

SEQ ID NO: 7532054 - DNA, 22 bp, Homo sapiens
caggctgggctccggagataaa

SEQ ID NO: 7532055 - DNA, 22 bp, Homo sapiens
caggctgggctccggagataaa

SEQ ID NO: 7532056 - DNA, 22 bp, Homo sapiens
caggctgggcagcctccccggc

SEQ ID NO: 7532057 - DNA, 22 bp, Homo sapiens
caggctgggcagcctccccggc

SEQ ID NO: 7532058 - DNA, 22 bp, Homo sapiens
caggctgggcagcctccccggc

SEQ ID NO: 7532059 - DNA, 22 bp, Homo sapiens
caggctgggcagcctccccggc

SEQ ID NO: 7532060 - DNA, 22 bp, Homo sapiens
caggctgggcagcctccccggc

SEQ ID NO: 7532061 - DNA, 22 bp, Homo sapiens
tagaatcaagcagtagagcaga

SEQ ID NO: 7532062 - DNA, 22 bp, Homo sapiens
tagaatcaagcagtagagcaga

SEQ ID NO: 7532063 - DNA, 18 bp, Homo sapiens
tagaatcaaatattttac

SEQ ID NO: 7532064 - DNA, 22 bp, Homo sapiens
tagaatatgtggtgtatacttt

SEQ ID NO: 7532065 - DNA, 22 bp, Homo sapiens
tagaatatgtggtgtatacttt

SEQ ID NO: 7532066 - DNA, 18 bp, Homo sapiens
tagaatcaaatattttac

SEQ ID NO: 7532067 - DNA, 22 bp, Homo sapiens
tagaatatgtggtgtatacttt

SEQ ID NO: 7532068 - DNA, 22 bp, Homo sapiens
tagaatatgtggtgtatacttt

SEQ ID NO: 7532069 - DNA, 22 bp, Homo sapiens
tagaatatgtggtaggatctgg

SEQ ID NO: 7532070 - DNA, 22 bp, Homo sapiens
tagaatatgtggtaggatctgg

SEQ ID NO: 7532071 - DNA, 22 bp, Homo sapiens
tagaatatgattaattttctta

SEQ ID NO: 7532072 - DNA, 22 bp, Homo sapiens
tagaatatgattaattttctta

SEQ ID NO: 7532073 - DNA, 22 bp, Homo sapiens
tagaatatgattaattttctta

SEQ ID NO: 7532074 - DNA, 22 bp, Homo sapiens
tagaatatgattaattttctta

SEQ ID NO: 7532075 - DNA, 22 bp, Homo sapiens
caggctgggctccggagataaa

SEQ ID NO: 7532076 - DNA, 22 bp, Homo sapiens
caggctgggctccggagataaa

SEQ ID NO: 7532077 - DNA, 22 bp, Homo sapiens
caggctgggctccggagataaa

SEQ ID NO: 7532078 - DNA, 22 bp, Homo sapiens
caggctgggctccggagataaa

SEQ ID NO: 7532079 - DNA, 22 bp, Homo sapiens
caggctgggctggtgttagagt

SEQ ID NO: 7532080 - DNA, 22 bp, Homo sapiens
caggctgggctggtgttagagt

SEQ ID NO: 7532081 - DNA, 22 bp, Homo sapiens
caggctgggctggtgttagagt

SEQ ID NO: 7532082 - DNA, 22 bp, Homo sapiens
caggctgggctccggagataaa

SEQ ID NO: 7532083 - DNA, 22 bp, Homo sapiens
caggctgggctggtgttagagt

SEQ ID NO: 7532084 - DNA, 22 bp, Homo sapiens
caggctgggctggtgttagagt

SEQ ID NO: 7532085 - DNA, 22 bp, Homo sapiens
caggctgggctggtgttagagt

SEQ ID NO: 7532086 - DNA, 22 bp, Homo sapiens
caggctgggctggtgttagagt

SEQ ID NO: 7532087 - DNA, 22 bp, Homo sapiens
caggctggtcccagagcattgc

SEQ ID NO: 7532088 - DNA, 22 bp, Homo sapiens
caggctggtcccagagcattgc

SEQ ID NO: 7532089 - DNA, 22 bp, Homo sapiens
caggctggtcccagagcattgc

SEQ ID NO: 7532090 - DNA, 22 bp, Homo sapiens
caggctggtcccagagcattgc

SEQ ID NO: 7532091 - DNA, 22 bp, Homo sapiens
caggctggtcccagagcattgc

SEQ ID NO: 7532092 - DNA, 22 bp, Homo sapiens
caggctggtcccagagcattgc

SEQ ID NO: 7532093 - DNA, 22 bp, Homo sapiens
caggctggtcccagagcattgc

SEQ ID NO: 7532094 - DNA, 22 bp, Homo sapiens
caggctggtcccagagcattgc

SEQ ID NO: 7532095 - DNA, 22 bp, Homo sapiens
caggctggtcccagagcattgc

SEQ ID NO: 7532096 - DNA, 22 bp, Homo sapiens
caggctggtcccagagcattgc

SEQ ID NO: 7532097 - DNA, 22 bp, Homo sapiens
tagacattttctcaacatctct

SEQ ID NO: 7532098 - DNA, 22 bp, Homo sapiens
tagacattttaagacatatacc

SEQ ID NO: 7532099 - DNA, 22 bp, Homo sapiens
caggctgtccaggctcctttgg

SEQ ID NO: 7532100 - DNA, 22 bp, Homo sapiens
caggctggtcccagagcattgc

SEQ ID NO: 7532101 - DNA, 22 bp, Homo sapiens
tagacattttaagacatatacc

SEQ ID NO: 7532102 - DNA, 22 bp, Homo sapiens
tagacattttctcaacatctct

SEQ ID NO: 7532103 - DNA, 22 bp, Homo sapiens
tagacattttctcaacatctct

SEQ ID NO: 7532104 - DNA, 22 bp, Homo sapiens
tagacattttctcaacatctct

SEQ ID NO: 7532105 - DNA, 22 bp, Homo sapiens
tagacattttctcaacatctct

SEQ ID NO: 7532106 - DNA, 22 bp, Homo sapiens
tagaccaagacagagctgcttt

SEQ ID NO: 7532107 - DNA, 22 bp, Homo sapiens
tagaccaagacaggaagtaaca

SEQ ID NO: 7532108 - DNA, 22 bp, Homo sapiens
tagaccagaacttgtcacctgg

SEQ ID NO: 7532109 - DNA, 22 bp, Homo sapiens
tagaggaactgcctttcttctg

SEQ ID NO: 7532110 - DNA, 22 bp, Homo sapiens
tagaggagaacacaaattatag

SEQ ID NO: 7532111 - DNA, 22 bp, Homo sapiens
tagaggagaacacaaattatag

SEQ ID NO: 7532112 - DNA, 22 bp, Homo sapiens
tagaggaaatttccaaggtgag

SEQ ID NO: 7532113 - DNA, 22 bp, Homo sapiens
tagaggaaccaggcaggctgag

SEQ ID NO: 7532114 - DNA, 22 bp, Homo sapiens
tagaggaaccaggcaggctgag

SEQ ID NO: 7532115 - DNA, 22 bp, Homo sapiens
tagaggaaccaggcaggctgag

SEQ ID NO: 7532116 - DNA, 22 bp, Homo sapiens
tagaggaaccaggcaggctgag

SEQ ID NO: 7532117 - DNA, 22 bp, Homo sapiens
tagaggaaccaggcaggctgag

SEQ ID NO: 7532118 - DNA, 19 bp, Homo sapiens
tagaggagaagggaagtgg

SEQ ID NO: 7532119 - DNA, 22 bp, Homo sapiens
tagagtgtaagctccttgaggg

SEQ ID NO: 7532120 - DNA, 19 bp, Homo sapiens
tagaggagaagggaagtgg

SEQ ID NO: 7532121 - DNA, 19 bp, Homo sapiens
tagaggagaagggaagtgg

SEQ ID NO: 7532122 - DNA, 19 bp, Homo sapiens
tagaggagaagggaagtgg

SEQ ID NO: 7532123 - DNA, 22 bp, Homo sapiens
tagataaattagaaagtttact

SEQ ID NO: 7532124 - DNA, 22 bp, Homo sapiens
tagataaattagaaagtttact

SEQ ID NO: 7532125 - DNA, 22 bp, Homo sapiens
tagataaattagaaagtttact

SEQ ID NO: 7532126 - DNA, 22 bp, Homo sapiens
tagataaattagaaagtttact

SEQ ID NO: 7532127 - DNA, 22 bp, Homo sapiens
tagataaaagggcaaagggcat

SEQ ID NO: 7532128 - DNA, 22 bp, Homo sapiens
tagagttatgtggctccacagg

SEQ ID NO: 7532129 - DNA, 22 bp, Homo sapiens
tagataaaagggcaaagggcat

SEQ ID NO: 7532130 - DNA, 22 bp, Homo sapiens
tagataaaagggcaaagggcat

SEQ ID NO: 7532131 - DNA, 22 bp, Homo sapiens
tagagttatatgatgtgctagt

SEQ ID NO: 7532132 - DNA, 22 bp, Homo sapiens
tagagtgttttgttaggcagca

SEQ ID NO: 7532133 - DNA, 22 bp, Homo sapiens
tagagtgttttgttaggcagca

SEQ ID NO: 7532134 - DNA, 22 bp, Homo sapiens
tagagtgtcataacagtgccca

SEQ ID NO: 7532135 - DNA, 22 bp, Homo sapiens
tagagtgtcataacagtgccca

SEQ ID NO: 7532136 - DNA, 22 bp, Homo sapiens
tagagtgtcataacagtgccca

SEQ ID NO: 7532137 - DNA, 22 bp, Homo sapiens
tagagtgtcctatctcccacgg

SEQ ID NO: 7532138 - DNA, 22 bp, Homo sapiens
tagagtgtccaacacataggag

SEQ ID NO: 7532139 - DNA, 22 bp, Homo sapiens
tagagctggaaaactgcaggta

SEQ ID NO: 7532140 - DNA, 22 bp, Homo sapiens
tagagctggaaaactgcaggta

SEQ ID NO: 7532141 - DNA, 22 bp, Homo sapiens
tagagctggaaaactgcaggta

SEQ ID NO: 7532142 - DNA, 22 bp, Homo sapiens
tagagctgctggactgtaacag

SEQ ID NO: 7532143 - DNA, 19 bp, Homo sapiens
tagagctgcttcctggcag

SEQ ID NO: 7532144 - DNA, 22 bp, Homo sapiens
tagagctggaatttgcagcaag

SEQ ID NO: 7532145 - DNA, 22 bp, Homo sapiens
tagagctggccgggacagctgg

SEQ ID NO: 7532146 - DNA, 22 bp, Homo sapiens
tagagctgggcagtgctctgag

SEQ ID NO: 7532147 - DNA, 22 bp, Homo sapiens
tagaggaaatttccaaggtgag

SEQ ID NO: 7532148 - DNA, 22 bp, Homo sapiens
tagaggaaatttccaaggtgag

SEQ ID NO: 7532149 - DNA, 22 bp, Homo sapiens
tagaggaaatttccaaggtgag

SEQ ID NO: 7532150 - DNA, 22 bp, Homo sapiens
tagaggaaatttccaaggtgag

SEQ ID NO: 7532151 - DNA, 22 bp, Homo sapiens
tagaggaaatttccaaggtgag

SEQ ID NO: 7532152 - DNA, 22 bp, Homo sapiens
tagagctgggcagtgctctgag

SEQ ID NO: 7532153 - DNA, 17 bp, Homo sapiens
tagagctggttcaggag

SEQ ID NO: 7532154 - DNA, 22 bp, Homo sapiens
cagtgggggtgaggccgaggta

SEQ ID NO: 7532155 - DNA, 22 bp, Homo sapiens
cagtgggggtgaggccgaggta

SEQ ID NO: 7532156 - DNA, 22 bp, Homo sapiens
cagtgggggtgaggccgaggta

SEQ ID NO: 7532157 - DNA, 22 bp, Homo sapiens
cagtgggggtgaggccgaggta

SEQ ID NO: 7532158 - DNA, 22 bp, Homo sapiens
cagtgggggtgaggccgaggta

SEQ ID NO: 7532159 - DNA, 22 bp, Homo sapiens
cagtggggtttctgtgggtgct

SEQ ID NO: 7532160 - DNA, 22 bp, Homo sapiens
cagtggggtttctgtgggtgct

SEQ ID NO: 7532161 - DNA, 22 bp, Homo sapiens
cagtggggtttctgtgggtgct

SEQ ID NO: 7532162 - DNA, 22 bp, Homo sapiens
cagtggggtttctgtgggtgct

SEQ ID NO: 7532163 - DNA, 22 bp, Homo sapiens
cagtggggtttctgtgggtgct

SEQ ID NO: 7532164 - DNA, 22 bp, Homo sapiens
cagtggggtttctgtgggtgct

SEQ ID NO: 7532165 - DNA, 22 bp, Homo sapiens
cagtgggtaaataagtgggtaa

SEQ ID NO: 7532166 - DNA, 22 bp, Homo sapiens
cagtgggtaggaaaggctcttc

SEQ ID NO: 7532167 - DNA, 22 bp, Homo sapiens
cagtgggtaggaaaggctcttc

SEQ ID NO: 7532168 - DNA, 22 bp, Homo sapiens
cagtgggtaggaaaggctcttc

SEQ ID NO: 7532169 - DNA, 22 bp, Homo sapiens
cagtgggtagtggggattagca

SEQ ID NO: 7532170 - DNA, 22 bp, Homo sapiens
cagtgggtcctgcgtctgccag

SEQ ID NO: 7532171 - DNA, 22 bp, Homo sapiens
cagtgggtatttactgattcct

SEQ ID NO: 7532172 - DNA, 22 bp, Homo sapiens
cagtgggtcctaagtacagttc

SEQ ID NO: 7532173 - DNA, 22 bp, Homo sapiens
cagtgggggggccatgctgcag

SEQ ID NO: 7532174 - DNA, 22 bp, Homo sapiens
cagtgggggggccatgctgcag

SEQ ID NO: 7532175 - DNA, 22 bp, Homo sapiens
cagtgggggggccatgctgcag

SEQ ID NO: 7532176 - DNA, 22 bp, Homo sapiens
cagtgggggggccatgctgcag

SEQ ID NO: 7532177 - DNA, 22 bp, Homo sapiens
cagtgggggtgaggccgaggta

SEQ ID NO: 7532178 - DNA, 22 bp, Homo sapiens
cagtggggggactgaggcctga

SEQ ID NO: 7532179 - DNA, 22 bp, Homo sapiens
cagtggggggactgaggcctga

SEQ ID NO: 7532180 - DNA, 22 bp, Homo sapiens
cagtggggggactgaggcctga

SEQ ID NO: 7532181 - DNA, 22 bp, Homo sapiens
cagtggggggactgaggcctga

SEQ ID NO: 7532182 - DNA, 22 bp, Homo sapiens
cagtggggggactgaggcctga

SEQ ID NO: 7532183 - DNA, 22 bp, Homo sapiens
cagtggggaggccaggatagaa

SEQ ID NO: 7532184 - DNA, 23 bp, Homo sapiens
cagtgggcttctaactgctcctg

SEQ ID NO: 7532185 - DNA, 22 bp, Homo sapiens
cagtggggaggccaggatagaa

SEQ ID NO: 7532186 - DNA, 22 bp, Homo sapiens
cagtggggaggccaggatagaa

SEQ ID NO: 7532187 - DNA, 23 bp, Homo sapiens
cagtgggcttctaactgctcctg

SEQ ID NO: 7532188 - DNA, 22 bp, Homo sapiens
cagtggggaggccaggatagaa

SEQ ID NO: 7532189 - DNA, 23 bp, Homo sapiens
cagtgggcttctaactgctcctg

SEQ ID NO: 7532190 - DNA, 23 bp, Homo sapiens
cagtgggcttctaactgctcctg

SEQ ID NO: 7532191 - DNA, 23 bp, Homo sapiens
cagtgggcttctaactgctcctg

SEQ ID NO: 7532192 - DNA, 22 bp, Homo sapiens
cagtgggaagggcagaggcttt

SEQ ID NO: 7532193 - DNA, 22 bp, Homo sapiens
cagtgggaagggcagaggcttt

SEQ ID NO: 7532194 - DNA, 22 bp, Homo sapiens
cagtgggaagggcagaggcttt

SEQ ID NO: 7532195 - DNA, 22 bp, Homo sapiens
cagtgggaagaatgcagcctcc

SEQ ID NO: 7532196 - DNA, 22 bp, Homo sapiens
cagtgggaaagtgaagagcatt

SEQ ID NO: 7532197 - DNA, 22 bp, Homo sapiens
cagtgggaaagtgaagagcatt

SEQ ID NO: 7532198 - DNA, 22 bp, Homo sapiens
cagtgggaatgaagtggaggcc

SEQ ID NO: 7532199 - DNA, 22 bp, Homo sapiens
cagtgggaatgaagtggaggcc

SEQ ID NO: 7532200 - DNA, 22 bp, Homo sapiens
cagtgggaatgaagtggaggcc

SEQ ID NO: 7532201 - DNA, 22 bp, Homo sapiens
cagtgggaagggcagaggcttt

SEQ ID NO: 7532202 - DNA, 22 bp, Homo sapiens
cagtgggacatgggcactgggc

SEQ ID NO: 7532203 - DNA, 22 bp, Homo sapiens
cagtgggacatgggcactgggc

SEQ ID NO: 7532204 - DNA, 22 bp, Homo sapiens
cagtgggacatgggcactgggc

SEQ ID NO: 7532205 - DNA, 22 bp, Homo sapiens
cagtgggacatgggcactgggc

SEQ ID NO: 7532206 - DNA, 22 bp, Homo sapiens
cagtgggatatgggggcagcat

SEQ ID NO: 7532207 - DNA, 22 bp, Homo sapiens
cagtgggatatgggggcagcat

SEQ ID NO: 7532208 - DNA, 22 bp, Homo sapiens
cagtgggatatgggggcagcat

SEQ ID NO: 7532209 - DNA, 22 bp, Homo sapiens
cagtgggatatgggggcagcat

SEQ ID NO: 7532210 - DNA, 22 bp, Homo sapiens
cagtgggatatgggggcagcat

SEQ ID NO: 7532211 - DNA, 22 bp, Homo sapiens
cagtgggacatgggcactgggc

SEQ ID NO: 7532212 - DNA, 22 bp, Homo sapiens
cagtgggagcaaatacactcat

SEQ ID NO: 7532213 - DNA, 23 bp, Homo sapiens
cagtgggaggactgagataaaac

SEQ ID NO: 7532214 - DNA, 23 bp, Homo sapiens
cagtgggaggactgagataaaac

SEQ ID NO: 7532215 - DNA, 21 bp, Homo sapiens
cagtgggctgctgcgctccag

SEQ ID NO: 7532216 - DNA, 21 bp, Homo sapiens
cagtgggctgctgcgctccag

SEQ ID NO: 7532217 - DNA, 21 bp, Homo sapiens
cagtgggctgctgcgctccag

SEQ ID NO: 7532218 - DNA, 22 bp, Homo sapiens
cagtgggctgtgatggattcac

SEQ ID NO: 7532219 - DNA, 22 bp, Homo sapiens
cagtgggctgtgatggattcac

SEQ ID NO: 7532220 - DNA, 23 bp, Homo sapiens
cagtgggcttctaactgctcctg

SEQ ID NO: 7532221 - DNA, 23 bp, Homo sapiens
cagtgggcttctaactgctcctg

SEQ ID NO: 7532222 - DNA, 22 bp, Homo sapiens
cagtgggattgggattggaacc

SEQ ID NO: 7532223 - DNA, 21 bp, Homo sapiens
cagtgggctgctgcgctccag

SEQ ID NO: 7532224 - DNA, 21 bp, Homo sapiens
cagtgccagccacaggacgcc

SEQ ID NO: 7532225 - DNA, 21 bp, Homo sapiens
cagtgccagccacaggacgcc

SEQ ID NO: 7532226 - DNA, 22 bp, Homo sapiens
cagtgccagaggtactagtgga

SEQ ID NO: 7532227 - DNA, 22 bp, Homo sapiens
cagtgccagaggtactagtgga

SEQ ID NO: 7532228 - DNA, 22 bp, Homo sapiens
cagtgccagaggtactagtgga

SEQ ID NO: 7532229 - DNA, 22 bp, Homo sapiens
cagtgccaaggatggcctggga

SEQ ID NO: 7532230 - DNA, 22 bp, Homo sapiens
cagtgccaaggctcttggtctg

SEQ ID NO: 7532231 - DNA, 22 bp, Homo sapiens
cagtgccacttaatgaggctgc

SEQ ID NO: 7532232 - DNA, 22 bp, Homo sapiens
cagtgccacttaatgaggctgc

SEQ ID NO: 7532233 - DNA, 22 bp, Homo sapiens
cagtgccacaggaatggccaat

SEQ ID NO: 7532234 - DNA, 22 bp, Homo sapiens
cagtgccacaggaatggccaat

SEQ ID NO: 7532235 - DNA, 22 bp, Homo sapiens
cagtgccatgtctgagccccta

SEQ ID NO: 7532236 - DNA, 22 bp, Homo sapiens
cagtgcccaaaggaacagaaag

SEQ ID NO: 7532237 - DNA, 22 bp, Homo sapiens
cagtgccatgtgagaaggggca

SEQ ID NO: 7532238 - DNA, 22 bp, Homo sapiens
cagtgcccaagatgtgccatgc

SEQ ID NO: 7532239 - DNA, 22 bp, Homo sapiens
cagtggcaggggaagcaggtgt

SEQ ID NO: 7532240 - DNA, 22 bp, Homo sapiens
cagtgcccaaaggaacagaaag

SEQ ID NO: 7532241 - DNA, 22 bp, Homo sapiens
cagtgcccaaaggaacagaaag

SEQ ID NO: 7532242 - DNA, 22 bp, Homo sapiens
cagtgccatgatgcagagcaat

SEQ ID NO: 7532243 - DNA, 22 bp, Homo sapiens
cagtgccatgatgcagagcaat

SEQ ID NO: 7532244 - DNA, 22 bp, Homo sapiens
cagtgccatgatgcagagcaat

SEQ ID NO: 7532245 - DNA, 22 bp, Homo sapiens
cagtgccatgatgcagagcaat

SEQ ID NO: 7532246 - DNA, 22 bp, Homo sapiens
cagtgccagggttgtgtaaatc

SEQ ID NO: 7532247 - DNA, 22 bp, Homo sapiens
cagtgccagggttgtgtaaatc

SEQ ID NO: 7532248 - DNA, 22 bp, Homo sapiens
cagtgccatattgaaagacatt

SEQ ID NO: 7532249 - DNA, 22 bp, Homo sapiens
cagtggcttacaatgaactaga

SEQ ID NO: 7532250 - DNA, 22 bp, Homo sapiens
cagtggcttaaataagattagg

SEQ ID NO: 7532251 - DNA, 22 bp, Homo sapiens
cagtggcttaaataagattagg

SEQ ID NO: 7532252 - DNA, 22 bp, Homo sapiens
cagtggctgtttctggaaggca

SEQ ID NO: 7532253 - DNA, 22 bp, Homo sapiens
cagtggctgtttctggaaggca

SEQ ID NO: 7532254 - DNA, 22 bp, Homo sapiens
cagtggcttacaatgaactaga

SEQ ID NO: 7532255 - DNA, 22 bp, Homo sapiens
cagtggcttctcatgtcattca

SEQ ID NO: 7532256 - DNA, 22 bp, Homo sapiens
cagtggcttctcatgtcattca

SEQ ID NO: 7532257 - DNA, 22 bp, Homo sapiens
cagtggcttcttcctagagcca

SEQ ID NO: 7532258 - DNA, 22 bp, Homo sapiens
cagtggcttcttcctagagcca

SEQ ID NO: 7532259 - DNA, 22 bp, Homo sapiens
cagtggcttcttcctagagcca

SEQ ID NO: 7532260 - DNA, 22 bp, Homo sapiens
cagtggcttcttcctagagcca

SEQ ID NO: 7532261 - DNA, 22 bp, Homo sapiens
cagtggcttcttcctagagcca

SEQ ID NO: 7532262 - DNA, 22 bp, Homo sapiens
cagtggcttcttcctagagcca

SEQ ID NO: 7532263 - DNA, 22 bp, Homo sapiens
cagtggctggttagggacagga

SEQ ID NO: 7532264 - DNA, 22 bp, Homo sapiens
cagtggctgtgaccagggacct

SEQ ID NO: 7532265 - DNA, 22 bp, Homo sapiens
cagtggctgtgaccagggacct

SEQ ID NO: 7532266 - DNA, 22 bp, Homo sapiens
cagtggctgtgaccagggacct

SEQ ID NO: 7532267 - DNA, 22 bp, Homo sapiens
cagtggcagttagaaaatattc

SEQ ID NO: 7532268 - DNA, 22 bp, Homo sapiens
cagtggcagttagaaaatattc

SEQ ID NO: 7532269 - DNA, 22 bp, Homo sapiens
cagtggcaggggaagcaggtgt

SEQ ID NO: 7532270 - DNA, 22 bp, Homo sapiens
cagtggcaggggaagcaggtgt

SEQ ID NO: 7532271 - DNA, 22 bp, Homo sapiens
cagtggcaggggaagcaggtgt

SEQ ID NO: 7532272 - DNA, 20 bp, Homo sapiens
cagtggctgataacaaatta

SEQ ID NO: 7532273 - DNA, 20 bp, Homo sapiens
cagtggctgataacaaatta

SEQ ID NO: 7532274 - DNA, 22 bp, Homo sapiens
cagtggcatacttggctgatat

SEQ ID NO: 7532275 - DNA, 21 bp, Homo sapiens
cagtggcagttcttgcctctg

SEQ ID NO: 7532276 - DNA, 21 bp, Homo sapiens
cagtggcagttcttgcctctg

SEQ ID NO: 7532277 - DNA, 22 bp, Homo sapiens
tcagagaaatgacaatatatag

SEQ ID NO: 7532278 - DNA, 22 bp, Homo sapiens
tcagagaaatgacaatatatag

SEQ ID NO: 7532279 - DNA, 22 bp, Homo sapiens
tcagagaaatgacaatatatag

SEQ ID NO: 7532280 - DNA, 22 bp, Homo sapiens
tcagagaaatgacaatatatag

SEQ ID NO: 7532281 - DNA, 22 bp, Homo sapiens
tcagagaaatgctgagctcatg

SEQ ID NO: 7532282 - DNA, 22 bp, Homo sapiens
tcagagaaatgctgagctcatg

SEQ ID NO: 7532283 - DNA, 22 bp, Homo sapiens
tcagagaaatgacaatatatag

SEQ ID NO: 7532284 - DNA, 22 bp, Homo sapiens
tcagagaaatgacaatatatag

SEQ ID NO: 7532285 - DNA, 22 bp, Homo sapiens
tcagagaaatgctgagctcatg

SEQ ID NO: 7532286 - DNA, 22 bp, Homo sapiens
tcagagaaatgaagtagggatt

SEQ ID NO: 7532287 - DNA, 22 bp, Homo sapiens
tcagagaaatgaagtagggatt

SEQ ID NO: 7532288 - DNA, 22 bp, Homo sapiens
tcagagaaataattgctgagtt

SEQ ID NO: 7532289 - DNA, 22 bp, Homo sapiens
tcagagaaaggccaaaatatca

SEQ ID NO: 7532290 - DNA, 22 bp, Homo sapiens
tcagagaaaggccaaaatatca

SEQ ID NO: 7532291 - DNA, 22 bp, Homo sapiens
tcagagaaaggccaaaatatca

SEQ ID NO: 7532292 - DNA, 22 bp, Homo sapiens
tcagagaaaggccaaaatatca

SEQ ID NO: 7532293 - DNA, 22 bp, Homo sapiens
tcagagaaaggccaaaatatca

SEQ ID NO: 7532294 - DNA, 22 bp, Homo sapiens
tcagagaaaggccaaaatatca

SEQ ID NO: 7532295 - DNA, 22 bp, Homo sapiens
tcagagaaataattgctgagtt

SEQ ID NO: 7532296 - DNA, 22 bp, Homo sapiens
tcagagaaataattgctgagtt

SEQ ID NO: 7532297 - DNA, 22 bp, Homo sapiens
tcagagaaataattgctgagtt

SEQ ID NO: 7532298 - DNA, 22 bp, Homo sapiens
tcagagaaataattgctgagtt

SEQ ID NO: 7532299 - DNA, 22 bp, Homo sapiens
tcagagaaataattgctgagtt

SEQ ID NO: 7532300 - DNA, 22 bp, Homo sapiens
cagtgtctccagatgctccaat

SEQ ID NO: 7532301 - DNA, 22 bp, Homo sapiens
cagtgtctcagtttcacttgaa

SEQ ID NO: 7532302 - DNA, 21 bp, Homo sapiens
tcagagaacccggcaggcaag

SEQ ID NO: 7532303 - DNA, 21 bp, Homo sapiens
tcagagaacccggcaggcaag

SEQ ID NO: 7532304 - DNA, 21 bp, Homo sapiens
tcagagaacccggcaggcaag

SEQ ID NO: 7532305 - DNA, 22 bp, Homo sapiens
tcagagaacacagaggtgatgt

SEQ ID NO: 7532306 - DNA, 22 bp, Homo sapiens
tcagagaacacagaggtgatgt

SEQ ID NO: 7532307 - DNA, 21 bp, Homo sapiens
tcagagaacccggcaggcaag

SEQ ID NO: 7532308 - DNA, 21 bp, Homo sapiens
tcagagaacccggcaggcaag

SEQ ID NO: 7532309 - DNA, 21 bp, Homo sapiens
tcagagaacccggcaggcaag

SEQ ID NO: 7532310 - DNA, 22 bp, Homo sapiens
tcagagaacacagaggtgatgt

SEQ ID NO: 7532311 - DNA, 22 bp, Homo sapiens
tcagagaacacagaggtgatgt

SEQ ID NO: 7532312 - DNA, 22 bp, Homo sapiens
tcagagaaatgctgagctcatg

SEQ ID NO: 7532313 - DNA, 22 bp, Homo sapiens
tcagagaaatgctgagctcatg

SEQ ID NO: 7532314 - DNA, 22 bp, Homo sapiens
tcagagaaatgctgagctcatg

SEQ ID NO: 7532315 - DNA, 22 bp, Homo sapiens
tcagagaaatgctgagctcatg

SEQ ID NO: 7532316 - DNA, 22 bp, Homo sapiens
tcagagaaatgctgagctcatg

SEQ ID NO: 7532317 - DNA, 22 bp, Homo sapiens
tcagagaacacagaggtgatgt

SEQ ID NO: 7532318 - DNA, 22 bp, Homo sapiens
tcagagaacacagaggtgatgt

SEQ ID NO: 7532319 - DNA, 22 bp, Homo sapiens
tcagagaacacagaggtgatgt

SEQ ID NO: 7532320 - DNA, 22 bp, Homo sapiens
tcagagaacacagaggtgatgt

SEQ ID NO: 7532321 - DNA, 22 bp, Homo sapiens
tcagagaacacagaggtgatgt

SEQ ID NO: 7532322 - DNA, 19 bp, Homo sapiens
tcagactgaaagtttagat

SEQ ID NO: 7532323 - DNA, 19 bp, Homo sapiens
tcagactgaaagtttagat

SEQ ID NO: 7532324 - DNA, 22 bp, Homo sapiens
tcagactgaaagatacacctct

SEQ ID NO: 7532325 - DNA, 22 bp, Homo sapiens
tcagactgaaagatacacctct

SEQ ID NO: 7532326 - DNA, 23 bp, Homo sapiens
tcagaagtgggatacaaagctga

SEQ ID NO: 7532327 - DNA, 23 bp, Homo sapiens
tcagaagtgggatacaaagctga

SEQ ID NO: 7532328 - DNA, 23 bp, Homo sapiens
tcagaagtgggatacaaagctga

SEQ ID NO: 7532329 - DNA, 20 bp, Homo sapiens
tcagaagtgcagctgcccct

SEQ ID NO: 7532330 - DNA, 22 bp, Homo sapiens
tcagaagtgctgtccttatccc

SEQ ID NO: 7532331 - DNA, 21 bp, Homo sapiens
tcagaagtgcagcccaggaat

SEQ ID NO: 7532332 - DNA, 20 bp, Homo sapiens
tcagaagtgcagctgcccct

SEQ ID NO: 7532333 - DNA, 22 bp, Homo sapiens
tcagactggcatctaagggctg

SEQ ID NO: 7532334 - DNA, 22 bp, Homo sapiens
tcagactggattttcacgtttt

SEQ ID NO: 7532335 - DNA, 22 bp, Homo sapiens
tcagactgcttagctcccagta

SEQ ID NO: 7532336 - DNA, 22 bp, Homo sapiens
tcagactgctgtccctgcctgg

SEQ ID NO: 7532337 - DNA, 22 bp, Homo sapiens
tcagactgatcatctatcagat

SEQ ID NO: 7532338 - DNA, 22 bp, Homo sapiens
tcagactgctgtccctgcctgg

SEQ ID NO: 7532339 - DNA, 22 bp, Homo sapiens
tcagactgcttagctcccagta

SEQ ID NO: 7532340 - DNA, 22 bp, Homo sapiens
tcagactgacggccgaggcaag

SEQ ID NO: 7532341 - DNA, 22 bp, Homo sapiens
tcagactgaccgaagcatctgg

SEQ ID NO: 7532342 - DNA, 22 bp, Homo sapiens
tcagactgaccgaagcatctgg

SEQ ID NO: 7532343 - DNA, 22 bp, Homo sapiens
tcagactgactagtcaatgaaa

SEQ ID NO: 7532344 - DNA, 22 bp, Homo sapiens
tcagactgactagtcaatgaaa

SEQ ID NO: 7532345 - DNA, 22 bp, Homo sapiens
tcagactgatcatctatcagat

SEQ ID NO: 7532346 - DNA, 21 bp, Homo sapiens
tcagacttgagctcttctaca

SEQ ID NO: 7532347 - DNA, 22 bp, Homo sapiens
tcagacttgactttgtaagttt

SEQ ID NO: 7532348 - DNA, 22 bp, Homo sapiens
tcagactttaaaggctaacagg

SEQ ID NO: 7532349 - DNA, 20 bp, Homo sapiens
tcagacttgattctatgcta

SEQ ID NO: 7532350 - DNA, 22 bp, Homo sapiens
tcagacttgcctttttataaaa

SEQ ID NO: 7532351 - DNA, 22 bp, Homo sapiens
tcagagaaaatggaaactttta

SEQ ID NO: 7532352 - DNA, 22 bp, Homo sapiens
tcagagaaaatggaaactttta

SEQ ID NO: 7532353 - DNA, 22 bp, Homo sapiens
tcagactgtttgcaccataggc

SEQ ID NO: 7532354 - DNA, 22 bp, Homo sapiens
tcagacttcagtttttagttgt

SEQ ID NO: 7532355 - DNA, 22 bp, Homo sapiens
tcagactgtttgcaccataggc

SEQ ID NO: 7532356 - DNA, 22 bp, Homo sapiens
tcagacttccactttgtgcact

SEQ ID NO: 7532357 - DNA, 22 bp, Homo sapiens
tcagacttctactttgcagagc

SEQ ID NO: 7532358 - DNA, 22 bp, Homo sapiens
tcagactgtgtcataagtaggt

SEQ ID NO: 7532359 - DNA, 22 bp, Homo sapiens
tcagactggtgaccctgaatct

SEQ ID NO: 7532360 - DNA, 22 bp, Homo sapiens
tcagactgtcttagctttatac

SEQ ID NO: 7532361 - DNA, 22 bp, Homo sapiens
tcagactggggctccctgagga

SEQ ID NO: 7532362 - DNA, 22 bp, Homo sapiens
tcagactggattttcacgtttt

SEQ ID NO: 7532363 - DNA, 22 bp, Homo sapiens
tcagactggggctccctgagga

SEQ ID NO: 7532364 - DNA, 22 bp, Homo sapiens
tcagactgggtttgcagccacc

SEQ ID NO: 7532365 - DNA, 22 bp, Homo sapiens
cagtgtctggttggctctacgt

SEQ ID NO: 7532366 - DNA, 22 bp, Homo sapiens
cagtgtctggttggctctacgt

SEQ ID NO: 7532367 - DNA, 22 bp, Homo sapiens
cagtgtctgggacagaaagtca

SEQ ID NO: 7532368 - DNA, 22 bp, Homo sapiens
cagtgtctgggacagaaagtca

SEQ ID NO: 7532369 - DNA, 22 bp, Homo sapiens
cagtgtctggttggctctacgt

SEQ ID NO: 7532370 - DNA, 18 bp, Homo sapiens
cagtgtcttggtaaaata

SEQ ID NO: 7532371 - DNA, 22 bp, Homo sapiens
cagtgtctttcagactcagaaa

SEQ ID NO: 7532372 - DNA, 22 bp, Homo sapiens
cagtgtctttcagactcagaaa

SEQ ID NO: 7532373 - DNA, 18 bp, Homo sapiens
cagtgtcttggtaaaata

SEQ ID NO: 7532374 - DNA, 22 bp, Homo sapiens
cagtgtcttatttgtagctcag

SEQ ID NO: 7532375 - DNA, 22 bp, Homo sapiens
cagtgtctccagatgctccaat

SEQ ID NO: 7532376 - DNA, 22 bp, Homo sapiens
cagtgtctgaaataacaccgga

SEQ ID NO: 7532377 - DNA, 22 bp, Homo sapiens
cagtgtctcccccaggttctgt

SEQ ID NO: 7532378 - DNA, 22 bp, Homo sapiens
cagtgtctccagatgctccaat

SEQ ID NO: 7532379 - DNA, 22 bp, Homo sapiens
cagtgtctgcctttctgtttgg

SEQ ID NO: 7532380 - DNA, 22 bp, Homo sapiens
cagtgtctgggacagaaagtca

SEQ ID NO: 7532381 - DNA, 22 bp, Homo sapiens
cagtgtctgggacagaaagtca

SEQ ID NO: 7532382 - DNA, 22 bp, Homo sapiens
cagtgtgacttctgagctgcca

SEQ ID NO: 7532383 - DNA, 22 bp, Homo sapiens
cagtgtgacttctgagctgcca

SEQ ID NO: 7532384 - DNA, 23 bp, Homo sapiens
cagtgtgacgaggtgaggcaggc

SEQ ID NO: 7532385 - DNA, 22 bp, Homo sapiens
cagtgtctttcagactcagaaa

SEQ ID NO: 7532386 - DNA, 23 bp, Homo sapiens
cagtgtgacgaggtgaggcaggc

SEQ ID NO: 7532387 - DNA, 23 bp, Homo sapiens
cagtgtgacgaggtgaggcaggc

SEQ ID NO: 7532388 - DNA, 22 bp, Homo sapiens
cagtgtctttcagactcagaaa

SEQ ID NO: 7532389 - DNA, 22 bp, Homo sapiens
cagtgtttccgtcagtatgtga

SEQ ID NO: 7532390 - DNA, 22 bp, Homo sapiens
cagtgtttccgtcagtatgtga

SEQ ID NO: 7532391 - DNA, 22 bp, Homo sapiens
cagtgtgaggaattagtgtcca

SEQ ID NO: 7532392 - DNA, 22 bp, Homo sapiens
cagtgtgcctgaatcaagtgtt

SEQ ID NO: 7532393 - DNA, 22 bp, Homo sapiens
cagtgtgcctgaatcaagtgtt

SEQ ID NO: 7532394 - DNA, 22 bp, Homo sapiens
cagtgtgcctgaatcaagtgtt

SEQ ID NO: 7532395 - DNA, 22 bp, Homo sapiens
cagtgtgaggaattagtgtcca

SEQ ID NO: 7532396 - DNA, 22 bp, Homo sapiens
cagtgtttgtggaattcaggtg

SEQ ID NO: 7532397 - DNA, 22 bp, Homo sapiens
cagtgtttgtggaattcaggtg

SEQ ID NO: 7532398 - DNA, 22 bp, Homo sapiens
cagtgtttgtggaattcaggtg

SEQ ID NO: 7532399 - DNA, 22 bp, Homo sapiens
cagtgtttgttgagaaaggcaa

SEQ ID NO: 7532400 - DNA, 22 bp, Homo sapiens
cagttaaaagaagtctatctta

SEQ ID NO: 7532401 - DNA, 22 bp, Homo sapiens
cagttaaaagaagtctatctta

SEQ ID NO: 7532402 - DNA, 22 bp, Homo sapiens
cagtgttttgagaagggcacgt

SEQ ID NO: 7532403 - DNA, 22 bp, Homo sapiens
cagtgttttgagaagggcacgt

SEQ ID NO: 7532404 - DNA, 22 bp, Homo sapiens
cagtgtttgtatagaatatgca

SEQ ID NO: 7532405 - DNA, 22 bp, Homo sapiens
cagtgtttgtatagaatatgca

SEQ ID NO: 7532406 - DNA, 22 bp, Homo sapiens
cagtgtttgcttaagttatatg

SEQ ID NO: 7532407 - DNA, 22 bp, Homo sapiens
cagtgtttgcttaagttatatg

SEQ ID NO: 7532408 - DNA, 22 bp, Homo sapiens
cagtgtttgcttaagttatatg

SEQ ID NO: 7532409 - DNA, 22 bp, Homo sapiens
cagtgtttctgtgcccagtggg

SEQ ID NO: 7532410 - DNA, 22 bp, Homo sapiens
cagtgtttctgagttccagctc

SEQ ID NO: 7532411 - DNA, 22 bp, Homo sapiens
cagtgtttctgagttccagctc

SEQ ID NO: 7532412 - DNA, 22 bp, Homo sapiens
cagttaaacagattgagtgtta

SEQ ID NO: 7532413 - DNA, 22 bp, Homo sapiens
cagttaaacagattgagtgtta

SEQ ID NO: 7532414 - DNA, 22 bp, Homo sapiens
cagttaaaatgtgctataagaa

SEQ ID NO: 7532415 - DNA, 22 bp, Homo sapiens
cagttaaacgggccatgtgagt

SEQ ID NO: 7532416 - DNA, 22 bp, Homo sapiens
cagttaaacgggccatgtgagt

SEQ ID NO: 7532417 - DNA, 22 bp, Homo sapiens
cagttaaacgggccatgtgagt

SEQ ID NO: 7532418 - DNA, 22 bp, Homo sapiens
cagttaaacagattgagtgtta

SEQ ID NO: 7532419 - DNA, 22 bp, Homo sapiens
cagttaaacgatgatggggtca

SEQ ID NO: 7532420 - DNA, 22 bp, Homo sapiens
cagttaaaaggtatgctaccaa

SEQ ID NO: 7532421 - DNA, 22 bp, Homo sapiens
cagttaaaatgtgctataagaa

SEQ ID NO: 7532422 - DNA, 22 bp, Homo sapiens
cagttaaaatgtgctataagaa

SEQ ID NO: 7532423 - DNA, 22 bp, Homo sapiens
cagttaaaatgtgctataagaa

SEQ ID NO: 7532424 - DNA, 22 bp, Homo sapiens
cagttaaaatgtgctataagaa

SEQ ID NO: 7532425 - DNA, 22 bp, Homo sapiens
cagttaaaagaagtctatctta

SEQ ID NO: 7532426 - DNA, 22 bp, Homo sapiens
cagttaaaagaagtctatctta

SEQ ID NO: 7532427 - DNA, 22 bp, Homo sapiens
cagttaaaagaagtctatctta

SEQ ID NO: 7532428 - DNA, 22 bp, Homo sapiens
cagttaaaaggtatgctaccaa

SEQ ID NO: 7532429 - DNA, 21 bp, Homo sapiens
tcagcagaatatgaactgcac

SEQ ID NO: 7532430 - DNA, 22 bp, Homo sapiens
tcagcagaatcttcctacacct

SEQ ID NO: 7532431 - DNA, 22 bp, Homo sapiens
tcagcagaatcttcctacacct

SEQ ID NO: 7532432 - DNA, 21 bp, Homo sapiens
tcagcagaatatgaactgcac

SEQ ID NO: 7532433 - DNA, 22 bp, Homo sapiens
tcagcagaagtatagaggccat

SEQ ID NO: 7532434 - DNA, 22 bp, Homo sapiens
tcagatgcctgtggggtctagg

SEQ ID NO: 7532435 - DNA, 22 bp, Homo sapiens
cagttaccagatcgcaggaggt

SEQ ID NO: 7532436 - DNA, 22 bp, Homo sapiens
tcagatgccaactgaacaacag

SEQ ID NO: 7532437 - DNA, 22 bp, Homo sapiens
tcagatgccctttgttttagac

SEQ ID NO: 7532438 - DNA, 22 bp, Homo sapiens
cagttactgtatgtcaaagact

SEQ ID NO: 7532439 - DNA, 22 bp, Homo sapiens
cagttactcaataattcttgcg

SEQ ID NO: 7532440 - DNA, 22 bp, Homo sapiens
cagttacattaataatgcacat

SEQ ID NO: 7532441 - DNA, 22 bp, Homo sapiens
cagttacatgctcatgtcatca

SEQ ID NO: 7532442 - DNA, 22 bp, Homo sapiens
cagttacatgctcatgtcatca

SEQ ID NO: 7532443 - DNA, 22 bp, Homo sapiens
cagttacatgctcatgtcatca

SEQ ID NO: 7532444 - DNA, 22 bp, Homo sapiens
cagttacatgctcatgtcatca

SEQ ID NO: 7532445 - DNA, 22 bp, Homo sapiens
cagttacatatttagtaggtta

SEQ ID NO: 7532446 - DNA, 22 bp, Homo sapiens
cagttacataaatgataaaatg

SEQ ID NO: 7532447 - DNA, 22 bp, Homo sapiens
cagttacataaatgataaaatg

SEQ ID NO: 7532448 - DNA, 22 bp, Homo sapiens
cagttacataaatgataaaatg

SEQ ID NO: 7532449 - DNA, 21 bp, Homo sapiens
cagttacagccaggacaaggc

SEQ ID NO: 7532450 - DNA, 21 bp, Homo sapiens
cagttacagccaggacaaggc

SEQ ID NO: 7532451 - DNA, 22 bp, Homo sapiens
cagttacagctgcaccagagcc

SEQ ID NO: 7532452 - DNA, 18 bp, Homo sapiens
cagttacaccttcattca

SEQ ID NO: 7532453 - DNA, 18 bp, Homo sapiens
cagttacaccttcattca

SEQ ID NO: 7532454 - DNA, 18 bp, Homo sapiens
cagttacaccttcattca

SEQ ID NO: 7532455 - DNA, 19 bp, Homo sapiens
cagttacagcagctaagac

SEQ ID NO: 7532456 - DNA, 19 bp, Homo sapiens
cagttacagcagctaagac

SEQ ID NO: 7532457 - DNA, 22 bp, Homo sapiens
cagttacagagccagttagaga

SEQ ID NO: 7532458 - DNA, 22 bp, Homo sapiens
cagttaaaggcccaatatctgg

SEQ ID NO: 7532459 - DNA, 22 bp, Homo sapiens
cagttaaaggcccaatatctgg

SEQ ID NO: 7532460 - DNA, 22 bp, Homo sapiens
cagttaaaggcccaatatctgg

SEQ ID NO: 7532461 - DNA, 22 bp, Homo sapiens
cagttaaaggcccaatatctgg

SEQ ID NO: 7532462 - DNA, 22 bp, Homo sapiens
cagttaaagtgcttatcacaga

SEQ ID NO: 7532463 - DNA, 22 bp, Homo sapiens
cagttaaaggcccaatatctgg

SEQ ID NO: 7532464 - DNA, 22 bp, Homo sapiens
cagttaaagtgcttatcacaga

SEQ ID NO: 7532465 - DNA, 22 bp, Homo sapiens
cagttaaacgggccatgtgagt

SEQ ID NO: 7532466 - DNA, 22 bp, Homo sapiens
cagttaaacgggccatgtgagt

SEQ ID NO: 7532467 - DNA, 22 bp, Homo sapiens
cagttaaacgggccatgtgagt

SEQ ID NO: 7532468 - DNA, 22 bp, Homo sapiens
cagttaaagctgcatgtgtcag

SEQ ID NO: 7532469 - DNA, 22 bp, Homo sapiens
cagttaaagctgcatgtgtcag

SEQ ID NO: 7532470 - DNA, 22 bp, Homo sapiens
cagttaaacgggccatgtgagt

SEQ ID NO: 7532471 - DNA, 22 bp, Homo sapiens
cagttaaagctgcatgtgtcag

SEQ ID NO: 7532472 - DNA, 22 bp, Homo sapiens
cagttaaagctgcatgtgtcag

SEQ ID NO: 7532473 - DNA, 22 bp, Homo sapiens
cagttaatgtcctatacaatag

SEQ ID NO: 7532474 - DNA, 22 bp, Homo sapiens
cagttaatgtcctatacaatag

SEQ ID NO: 7532475 - DNA, 22 bp, Homo sapiens
cagttaatgtcctatacaatag

SEQ ID NO: 7532476 - DNA, 22 bp, Homo sapiens
cagttaatgtcctatacaatag

SEQ ID NO: 7532477 - DNA, 22 bp, Homo sapiens
cagttaatcttgccattatatc

SEQ ID NO: 7532478 - DNA, 22 bp, Homo sapiens
cagttaatcttgccattatatc

SEQ ID NO: 7532479 - DNA, 22 bp, Homo sapiens
cagttaatcttgccattatatc

SEQ ID NO: 7532480 - DNA, 22 bp, Homo sapiens
cagttaactgagctctgtgaga

SEQ ID NO: 7532481 - DNA, 22 bp, Homo sapiens
cagttaactgattttataaagt

SEQ ID NO: 7532482 - DNA, 22 bp, Homo sapiens
cagttaaatttggctgttttct

SEQ ID NO: 7532483 - DNA, 22 bp, Homo sapiens
cagttaaatttggctgttttct

SEQ ID NO: 7532484 - DNA, 22 bp, Homo sapiens
cagttaaatttggctgttttct

SEQ ID NO: 7532485 - DNA, 22 bp, Homo sapiens
cagttaaatgatgtgccctaga

SEQ ID NO: 7532486 - DNA, 22 bp, Homo sapiens
cagttaaatgatgtgccctaga

SEQ ID NO: 7532487 - DNA, 22 bp, Homo sapiens
cagttaaatgatgtgccctaga

SEQ ID NO: 7532488 - DNA, 22 bp, Homo sapiens
cagttaaagtgcttatcacaga

SEQ ID NO: 7532489 - DNA, 22 bp, Homo sapiens
cagttaaagtgcttatcacaga

SEQ ID NO: 7532490 - DNA, 22 bp, Homo sapiens
cagttaaattctccagttacca

SEQ ID NO: 7532491 - DNA, 22 bp, Homo sapiens
cagttaaattctccagttacca

SEQ ID NO: 7532492 - DNA, 22 bp, Homo sapiens
tcagcagagcgagaccaagtca

SEQ ID NO: 7532493 - DNA, 22 bp, Homo sapiens
tcagcagagcgagaccaagtca

SEQ ID NO: 7532494 - DNA, 22 bp, Homo sapiens
tcagcagagcgagaccaagtca

SEQ ID NO: 7532495 - DNA, 22 bp, Homo sapiens
tcagcagactaggcagattact

SEQ ID NO: 7532496 - DNA, 22 bp, Homo sapiens
tcagcagactaggcagattact

SEQ ID NO: 7532497 - DNA, 22 bp, Homo sapiens
tcagcagactaggcagattact

SEQ ID NO: 7532498 - DNA, 22 bp, Homo sapiens
tcagcagactaggcagattact

SEQ ID NO: 7532499 - DNA, 22 bp, Homo sapiens
tcagcagaggagtgtcttgccc

SEQ ID NO: 7532500 - DNA, 22 bp, Homo sapiens
tcagcagagctcaggctccagc

SEQ ID NO: 7532501 - DNA, 22 bp, Homo sapiens
tcagcagagctcaggctccagc

SEQ ID NO: 7532502 - DNA, 22 bp, Homo sapiens
tcagcagagcgagaccaagtca

SEQ ID NO: 7532503 - DNA, 22 bp, Homo sapiens
tcagcagacattattttctggc

SEQ ID NO: 7532504 - DNA, 22 bp, Homo sapiens
tcagcagacagttagctatatt

SEQ ID NO: 7532505 - DNA, 22 bp, Homo sapiens
tcagcagacctgttatttggat

SEQ ID NO: 7532506 - DNA, 22 bp, Homo sapiens
tcagcagacctgttatttggat

SEQ ID NO: 7532507 - DNA, 22 bp, Homo sapiens
tcagcagaatgtggcatgtcac

SEQ ID NO: 7532508 - DNA, 22 bp, Homo sapiens
tcagcagacagttagctatatt

SEQ ID NO: 7532509 - DNA, 22 bp, Homo sapiens
tcagcagacagttagctatatt

SEQ ID NO: 7532510 - DNA, 22 bp, Homo sapiens
tcagcagacagttagctatatt

SEQ ID NO: 7532511 - DNA, 22 bp, Homo sapiens
tcagcagaatgtggcatgtcac

SEQ ID NO: 7532512 - DNA, 22 bp, Homo sapiens
tcagcagaatgtggcatgtcac

SEQ ID NO: 7532513 - DNA, 22 bp, Homo sapiens
tcagcagaatgtggcatgtcac

SEQ ID NO: 7532514 - DNA, 22 bp, Homo sapiens
tcagcagaggagtgtcttgccc

SEQ ID NO: 7532515 - DNA, 22 bp, Homo sapiens
tcagcagaggagtgtcttgccc

SEQ ID NO: 7532516 - DNA, 22 bp, Homo sapiens
tcagcagaggcagactctcctt

SEQ ID NO: 7532517 - DNA, 22 bp, Homo sapiens
tcagcagaggcagactctcctt

SEQ ID NO: 7532518 - DNA, 22 bp, Homo sapiens
tcagcagaggcagactctcctt

SEQ ID NO: 7532519 - DNA, 22 bp, Homo sapiens
tcagcagaggggaaggcatctg

SEQ ID NO: 7532520 - DNA, 22 bp, Homo sapiens
tcagcagaggggaaggcatctg

SEQ ID NO: 7532521 - DNA, 22 bp, Homo sapiens
tcagcagaggggaaggcatctg

SEQ ID NO: 7532522 - DNA, 22 bp, Homo sapiens
tcagcagaggggaaggcatctg

SEQ ID NO: 7532523 - DNA, 22 bp, Homo sapiens
tcagcagagtggaacattgtca

SEQ ID NO: 7532524 - DNA, 22 bp, Homo sapiens
tcagcagagtggaacattgtca

SEQ ID NO: 7532525 - DNA, 22 bp, Homo sapiens
tcagcagaggggaaggcatctg

SEQ ID NO: 7532526 - DNA, 22 bp, Homo sapiens
tcagcagatgggttgtgttggc

SEQ ID NO: 7532527 - DNA, 22 bp, Homo sapiens
tcagcagatgggttgtgttggc

SEQ ID NO: 7532528 - DNA, 19 bp, Homo sapiens
tcagcagattttgcaaaca

SEQ ID NO: 7532529 - DNA, 19 bp, Homo sapiens
tcagcagattttgcaaaca

SEQ ID NO: 7532530 - DNA, 22 bp, Homo sapiens
tcagcagatgtggtgaaaagtc

SEQ ID NO: 7532531 - DNA, 22 bp, Homo sapiens
tcagcagatgtggtgaaaagtc

SEQ ID NO: 7532532 - DNA, 22 bp, Homo sapiens
tcagcagatgatttccatacaa

SEQ ID NO: 7532533 - DNA, 22 bp, Homo sapiens
tcagcagatgatttccatacaa

SEQ ID NO: 7532534 - DNA, 22 bp, Homo sapiens
tcagcagatgatttccatacaa

SEQ ID NO: 7532535 - DNA, 22 bp, Homo sapiens
tcagcagatgatttccatacaa

SEQ ID NO: 7532536 - DNA, 22 bp, Homo sapiens
tcagcagagtttcatcttggga

SEQ ID NO: 7532537 - DNA, 22 bp, Homo sapiens
tcagcagagtttcatcttggga

SEQ ID NO: 7532538 - DNA, 22 bp, Homo sapiens
tcagcagagtttcatcttggga

SEQ ID NO: 7532539 - DNA, 21 bp, Homo sapiens
tcagcagcatctgcctagagt

SEQ ID NO: 7532540 - DNA, 21 bp, Homo sapiens
tcagcagcatctgcctagagt

SEQ ID NO: 7532541 - DNA, 21 bp, Homo sapiens
tcagcagcatctgcctagagt

SEQ ID NO: 7532542 - DNA, 22 bp, Homo sapiens
tcagcagcagctcagcatgttt

SEQ ID NO: 7532543 - DNA, 22 bp, Homo sapiens
tcagcagcagctcagcatgttt

SEQ ID NO: 7532544 - DNA, 22 bp, Homo sapiens
tcagcagcagctcagcatgttt

SEQ ID NO: 7532545 - DNA, 21 bp, Homo sapiens
tcagcagcatctgcctagagt

SEQ ID NO: 7532546 - DNA, 19 bp, Homo sapiens
tcagcagattttgcaaaca

SEQ ID NO: 7532547 - DNA, 19 bp, Homo sapiens
tcagcagcactgtgatttc

SEQ ID NO: 7532548 - DNA, 19 bp, Homo sapiens
tcagcagcactgtgatttc

SEQ ID NO: 7532549 - DNA, 23 bp, Homo sapiens
tcagcagcagaagtgctgggatg

SEQ ID NO: 7532550 - DNA, 19 bp, Homo sapiens
tcagcagcactgtgatttc

SEQ ID NO: 7532551 - DNA, 22 bp, Homo sapiens
tcagcagcagctcagcatgttt

SEQ ID NO: 7532552 - DNA, 22 bp, Homo sapiens
tcagcagcagctcagcatgttt

SEQ ID NO: 7532553 - DNA, 23 bp, Homo sapiens
tcagcagcagaagtgctgggatg

SEQ ID NO: 7532554 - DNA, 23 bp, Homo sapiens
tcagcagcagaagtgctgggatg

SEQ ID NO: 7532555 - DNA, 19 bp, Homo sapiens
cagtttaactaattttatc

SEQ ID NO: 7532556 - DNA, 19 bp, Homo sapiens
cagtttaactaattttatc

SEQ ID NO: 7532557 - DNA, 19 bp, Homo sapiens
cagtttaactaattttatc

SEQ ID NO: 7532558 - DNA, 22 bp, Homo sapiens
cagtttaacctatccattatgt

SEQ ID NO: 7532559 - DNA, 22 bp, Homo sapiens
cagtttaacctatccattatgt

SEQ ID NO: 7532560 - DNA, 22 bp, Homo sapiens
cagtttaacctatccattatgt

SEQ ID NO: 7532561 - DNA, 19 bp, Homo sapiens
cagtttaactaattttatc

SEQ ID NO: 7532562 - DNA, 19 bp, Homo sapiens
cagtttaactaattttatc

SEQ ID NO: 7532563 - DNA, 22 bp, Homo sapiens
cagtttaaggcaggacatggga

SEQ ID NO: 7532564 - DNA, 22 bp, Homo sapiens
cagtttaaggcaggacatggga

SEQ ID NO: 7532565 - DNA, 22 bp, Homo sapiens
cagtttaagacaagggggtgta

SEQ ID NO: 7532566 - DNA, 22 bp, Homo sapiens
cagtttaagacaagggggtgta

SEQ ID NO: 7532567 - DNA, 19 bp, Homo sapiens
cagtttaactaattttatc

SEQ ID NO: 7532568 - DNA, 20 bp, Homo sapiens
cagtttaactttgagcagtt

SEQ ID NO: 7532569 - DNA, 20 bp, Homo sapiens
cagtttaactttgagcagtt

SEQ ID NO: 7532570 - DNA, 22 bp, Homo sapiens
tcagcagccgcagctgactcag

SEQ ID NO: 7532571 - DNA, 22 bp, Homo sapiens
tcagcagccgcagctgactcag

SEQ ID NO: 7532572 - DNA, 21 bp, Homo sapiens
tcagcagcatctgcctagagt

SEQ ID NO: 7532573 - DNA, 22 bp, Homo sapiens
tcagcagccgcagctgactcag

SEQ ID NO: 7532574 - DNA, 22 bp, Homo sapiens
tcagcagccgcagctgactcag

SEQ ID NO: 7532575 - DNA, 22 bp, Homo sapiens
cagttgttcccagcaatgaaag

SEQ ID NO: 7532576 - DNA, 22 bp, Homo sapiens
cagttgttcccagcaatgaaag

SEQ ID NO: 7532577 - DNA, 22 bp, Homo sapiens
cagtttaaagaaggatgggagt

SEQ ID NO: 7532578 - DNA, 22 bp, Homo sapiens
cagtttaaagaaggatgggagt

SEQ ID NO: 7532579 - DNA, 22 bp, Homo sapiens
cagtttaaagaaggatgggagt

SEQ ID NO: 7532580 - DNA, 22 bp, Homo sapiens
cagttgttcccagcaatgaaag

SEQ ID NO: 7532581 - DNA, 22 bp, Homo sapiens
cagtttaaatgagtgactgcag

SEQ ID NO: 7532582 - DNA, 22 bp, Homo sapiens
cagtttaaatgagtgactgcag

SEQ ID NO: 7532583 - DNA, 22 bp, Homo sapiens
cagtttaacctatccattatgt

SEQ ID NO: 7532584 - DNA, 22 bp, Homo sapiens
cagtttaacctatccattatgt

SEQ ID NO: 7532585 - DNA, 22 bp, Homo sapiens
cataaaatggcttgttctttaa

SEQ ID NO: 7532586 - DNA, 22 bp, Homo sapiens
cataaaatggcttgttctttaa

SEQ ID NO: 7532587 - DNA, 22 bp, Homo sapiens
cataaaatggcttgttctttaa

SEQ ID NO: 7532588 - DNA, 22 bp, Homo sapiens
cataaaatggcttgttctttaa

SEQ ID NO: 7532589 - DNA, 22 bp, Homo sapiens
cataaaatggcttgttctttaa

SEQ ID NO: 7532590 - DNA, 22 bp, Homo sapiens
cataaaatggcttgttctttaa

SEQ ID NO: 7532591 - DNA, 22 bp, Homo sapiens
cataaaatggcttgttctttaa

SEQ ID NO: 7532592 - DNA, 22 bp, Homo sapiens
cataaactcttgagattcttgt

SEQ ID NO: 7532593 - DNA, 22 bp, Homo sapiens
cataaaatggcttgttctttaa

SEQ ID NO: 7532594 - DNA, 22 bp, Homo sapiens
cataaaatggcttgttctttaa

SEQ ID NO: 7532595 - DNA, 22 bp, Homo sapiens
tcaggaaagaagatgctcagtg

SEQ ID NO: 7532596 - DNA, 22 bp, Homo sapiens
tcaggaaactgtcaagtgggat

SEQ ID NO: 7532597 - DNA, 22 bp, Homo sapiens
tcaggaaactgtcaagtgggat

SEQ ID NO: 7532598 - DNA, 22 bp, Homo sapiens
tcaggaaactgtcaagtgggat

SEQ ID NO: 7532599 - DNA, 22 bp, Homo sapiens
tcaggaaagaagatgctcagtg

SEQ ID NO: 7532600 - DNA, 22 bp, Homo sapiens
tcaggaaagagtaatgtataca

SEQ ID NO: 7532601 - DNA, 22 bp, Homo sapiens
tcaggaaagagtaatgtataca

SEQ ID NO: 7532602 - DNA, 22 bp, Homo sapiens
tcaggaaagagtaatgtataca

SEQ ID NO: 7532603 - DNA, 22 bp, Homo sapiens
tcaggaaagagtaatgtataca

SEQ ID NO: 7532604 - DNA, 22 bp, Homo sapiens
tcaggaaagagtaatgtataca

SEQ ID NO: 7532605 - DNA, 21 bp, Homo sapiens
tcaggaaacacctcttaagga

SEQ ID NO: 7532606 - DNA, 21 bp, Homo sapiens
tcaggaaacacctcttaagga

SEQ ID NO: 7532607 - DNA, 22 bp, Homo sapiens
tcaggaaaatactgcttatcca

SEQ ID NO: 7532608 - DNA, 22 bp, Homo sapiens
tcaggaaaatactgcttatcca

SEQ ID NO: 7532609 - DNA, 22 bp, Homo sapiens
tcaggaaaatactgcttatcca

SEQ ID NO: 7532610 - DNA, 22 bp, Homo sapiens
tcaggaaaatactgcttatcca

SEQ ID NO: 7532611 - DNA, 22 bp, Homo sapiens
tcaggaaactacagttgaacta

SEQ ID NO: 7532612 - DNA, 22 bp, Homo sapiens
tcaggaaactacagttgaacta

SEQ ID NO: 7532613 - DNA, 22 bp, Homo sapiens
tcaggaaactacagttgaacta

SEQ ID NO: 7532614 - DNA, 21 bp, Homo sapiens
tcaggaaacacctcttaagga

SEQ ID NO: 7532615 - DNA, 21 bp, Homo sapiens
tcaggaaacacctcttaagga

SEQ ID NO: 7532616 - DNA, 22 bp, Homo sapiens
tcagcttttgtcagaaattgta

SEQ ID NO: 7532617 - DNA, 22 bp, Homo sapiens
tcagcttttgtcagaaattgta

SEQ ID NO: 7532618 - DNA, 22 bp, Homo sapiens
tcagcttttgtcagaaattgta

SEQ ID NO: 7532619 - DNA, 22 bp, Homo sapiens
tcagctttttacatgtgaaata

SEQ ID NO: 7532620 - DNA, 22 bp, Homo sapiens
tcagctttttacatgtgaaata

SEQ ID NO: 7532621 - DNA, 19 bp, Homo sapiens
cataaatgtacaagataca

SEQ ID NO: 7532622 - DNA, 19 bp, Homo sapiens
cataaatgtacaagataca

SEQ ID NO: 7532623 - DNA, 19 bp, Homo sapiens
cataaatgtacaagataca

SEQ ID NO: 7532624 - DNA, 19 bp, Homo sapiens
cataaatgtacaagataca

SEQ ID NO: 7532625 - DNA, 19 bp, Homo sapiens
cataaatgtacaagataca

SEQ ID NO: 7532626 - DNA, 22 bp, Homo sapiens
cataaagttttataggctcaaa

SEQ ID NO: 7532627 - DNA, 22 bp, Homo sapiens
cataaagttttataggctcaaa

SEQ ID NO: 7532628 - DNA, 22 bp, Homo sapiens
cataaagttttataggctcaaa

SEQ ID NO: 7532629 - DNA, 22 bp, Homo sapiens
cataaagtgtataagtgaagaa

SEQ ID NO: 7532630 - DNA, 22 bp, Homo sapiens
cataaagtgtataagtgaagaa

SEQ ID NO: 7532631 - DNA, 22 bp, Homo sapiens
cataaagtgtataagtgaagaa

SEQ ID NO: 7532632 - DNA, 22 bp, Homo sapiens
cataaagttaagctgtaagtat

SEQ ID NO: 7532633 - DNA, 22 bp, Homo sapiens
cataaagttaagctgtaagtat

SEQ ID NO: 7532634 - DNA, 22 bp, Homo sapiens
cataaagttaagctgtaagtat

SEQ ID NO: 7532635 - DNA, 22 bp, Homo sapiens
cataaattgtacccattccaac

SEQ ID NO: 7532636 - DNA, 22 bp, Homo sapiens
cataaattgtacccattccaac

SEQ ID NO: 7532637 - DNA, 22 bp, Homo sapiens
cataaattgtacccattccaac

SEQ ID NO: 7532638 - DNA, 22 bp, Homo sapiens
cataaattcagttctgcctctt

SEQ ID NO: 7532639 - DNA, 22 bp, Homo sapiens
cataaattcagttctgcctctt

SEQ ID NO: 7532640 - DNA, 22 bp, Homo sapiens
cataaattcagttctgcctctt

SEQ ID NO: 7532641 - DNA, 19 bp, Homo sapiens
cataaatgtacaagataca

SEQ ID NO: 7532642 - DNA, 19 bp, Homo sapiens
cataaatgtacaagataca

SEQ ID NO: 7532643 - DNA, 19 bp, Homo sapiens
cataaatgtacaagataca

SEQ ID NO: 7532644 - DNA, 22 bp, Homo sapiens
cataaagtagcagagcatgact

SEQ ID NO: 7532645 - DNA, 22 bp, Homo sapiens
cataaagtagcagagcatgact

SEQ ID NO: 7532646 - DNA, 22 bp, Homo sapiens
cataaagtagcagagcatgact

SEQ ID NO: 7532647 - DNA, 22 bp, Homo sapiens
cataaagtagcagagcatgact

SEQ ID NO: 7532648 - DNA, 22 bp, Homo sapiens
cataaagtaacatggaccttaa

SEQ ID NO: 7532649 - DNA, 22 bp, Homo sapiens
cataaagtagcagagcatgact

SEQ ID NO: 7532650 - DNA, 22 bp, Homo sapiens
cataaagtaaagatgtcttcca

SEQ ID NO: 7532651 - DNA, 22 bp, Homo sapiens
cataaagtaaagatgtcttcca

SEQ ID NO: 7532652 - DNA, 22 bp, Homo sapiens
cataaagtgctgggtttaggaa

SEQ ID NO: 7532653 - DNA, 22 bp, Homo sapiens
cataaagtctcataattcactt

SEQ ID NO: 7532654 - DNA, 22 bp, Homo sapiens
cataaagtctcataattcactt

SEQ ID NO: 7532655 - DNA, 22 bp, Homo sapiens
cataaagtctcataattcactt

SEQ ID NO: 7532656 - DNA, 22 bp, Homo sapiens
cataaagtcatgatctgagtat

SEQ ID NO: 7532657 - DNA, 22 bp, Homo sapiens
cataaagtaggcaagcattcca

SEQ ID NO: 7532658 - DNA, 22 bp, Homo sapiens
cataaagtaggcaagcattcca

SEQ ID NO: 7532659 - DNA, 22 bp, Homo sapiens
cataaagtaggcaagcattcca

SEQ ID NO: 7532660 - DNA, 22 bp, Homo sapiens
cataaagtatagatctgtgggt

SEQ ID NO: 7532661 - DNA, 22 bp, Homo sapiens
cataaagtatagatctgtgggt

SEQ ID NO: 7532662 - DNA, 22 bp, Homo sapiens
cataaagtcatgatctgagtat

SEQ ID NO: 7532663 - DNA, 22 bp, Homo sapiens
cataaagtcatgatctgagtat

SEQ ID NO: 7532664 - DNA, 22 bp, Homo sapiens
cagtttatagttgttatgtgtg

SEQ ID NO: 7532665 - DNA, 22 bp, Homo sapiens
cagtttatagttgttatgtgtg

SEQ ID NO: 7532666 - DNA, 22 bp, Homo sapiens
cagtttatagttgttatgtgtg

SEQ ID NO: 7532667 - DNA, 22 bp, Homo sapiens
cagtttagtgttgcatttggag

SEQ ID NO: 7532668 - DNA, 22 bp, Homo sapiens
cagtttatagctctagcagctt

SEQ ID NO: 7532669 - DNA, 22 bp, Homo sapiens
cagtttatagctctagcagctt

SEQ ID NO: 7532670 - DNA, 22 bp, Homo sapiens
cagtttatagctctagcagctt

SEQ ID NO: 7532671 - DNA, 22 bp, Homo sapiens
cagtttatagctctagcagctt

SEQ ID NO: 7532672 - DNA, 22 bp, Homo sapiens
cagtttagtgttgcatttggag

SEQ ID NO: 7532673 - DNA, 22 bp, Homo sapiens
cagtttagtgttgcatttggag

SEQ ID NO: 7532674 - DNA, 22 bp, Homo sapiens
cagtttatagctctagcagctt

SEQ ID NO: 7532675 - DNA, 22 bp, Homo sapiens
cagtttatatataagcacattg

SEQ ID NO: 7532676 - DNA, 22 bp, Homo sapiens
cagtttatatataagcacattg

SEQ ID NO: 7532677 - DNA, 22 bp, Homo sapiens
cagtttatatataagcacattg

SEQ ID NO: 7532678 - DNA, 22 bp, Homo sapiens
cagtttatatataagcacattg

SEQ ID NO: 7532679 - DNA, 22 bp, Homo sapiens
cagtttatatataagcacattg

SEQ ID NO: 7532680 - DNA, 22 bp, Homo sapiens
cagtttatatataagcacattg

SEQ ID NO: 7532681 - DNA, 22 bp, Homo sapiens
cagtttatatataagcacattg

SEQ ID NO: 7532682 - DNA, 22 bp, Homo sapiens
cagtttatatataagcacattg

SEQ ID NO: 7532683 - DNA, 22 bp, Homo sapiens
cagtttatatataagcacattg

SEQ ID NO: 7532684 - DNA, 22 bp, Homo sapiens
cagtttagaagaatcatgaaca

SEQ ID NO: 7532685 - DNA, 22 bp, Homo sapiens
cagtttagaagaatcatgaaca

SEQ ID NO: 7532686 - DNA, 22 bp, Homo sapiens
cagtttagcaaatttgtatcaa

SEQ ID NO: 7532687 - DNA, 22 bp, Homo sapiens
cagtttagcaaatttgtatcaa

SEQ ID NO: 7532688 - DNA, 22 bp, Homo sapiens
cagtttagcatttaccgtgatg

SEQ ID NO: 7532689 - DNA, 22 bp, Homo sapiens
cagtttagcatttaccgtgatg

SEQ ID NO: 7532690 - DNA, 22 bp, Homo sapiens
cagtttagtcctgccaccatgg

SEQ ID NO: 7532691 - DNA, 22 bp, Homo sapiens
cagtttagtaggtgatatcaat

SEQ ID NO: 7532692 - DNA, 22 bp, Homo sapiens
cagtttagtcctgccaccatgg

SEQ ID NO: 7532693 - DNA, 22 bp, Homo sapiens
cagtttagtaggtgatatcaat

SEQ ID NO: 7532694 - DNA, 22 bp, Homo sapiens
cagtttaggtcatccttgcttt

SEQ ID NO: 7532695 - DNA, 22 bp, Homo sapiens
cagtttaggtcatccttgcttt

SEQ ID NO: 7532696 - DNA, 22 bp, Homo sapiens
cagtttaggagagacgcgttct

SEQ ID NO: 7532697 - DNA, 22 bp, Homo sapiens
cagtttaggtcatccttgcttt

SEQ ID NO: 7532698 - DNA, 22 bp, Homo sapiens
cagtttagcatttaccgtgatg

SEQ ID NO: 7532699 - DNA, 22 bp, Homo sapiens
cagtttaggagagacgcgttct

SEQ ID NO: 7532700 - DNA, 22 bp, Homo sapiens
cagtttaggagagacgcgttct

SEQ ID NO: 7532701 - DNA, 22 bp, Homo sapiens
cagtttaggagagacgcgttct

SEQ ID NO: 7532702 - DNA, 22 bp, Homo sapiens
cagtttaagtagaactgagaat

SEQ ID NO: 7532703 - DNA, 22 bp, Homo sapiens
cagtttaagtagaactgagaat

SEQ ID NO: 7532704 - DNA, 22 bp, Homo sapiens
cagtttaaggcaggacatggga

SEQ ID NO: 7532705 - DNA, 22 bp, Homo sapiens
cagtttaagtagaactgagaat

SEQ ID NO: 7532706 - DNA, 22 bp, Homo sapiens
cagtttaagtagaactgagaat

SEQ ID NO: 7532707 - DNA, 22 bp, Homo sapiens
cagtttaagtagaactgagaat

SEQ ID NO: 7532708 - DNA, 22 bp, Homo sapiens
cagtttaagtgtgttgaaggta

SEQ ID NO: 7532709 - DNA, 22 bp, Homo sapiens
cagtttaagtgtgttgaaggta

SEQ ID NO: 7532710 - DNA, 21 bp, Homo sapiens
cagtttaataacaaagaagga

SEQ ID NO: 7532711 - DNA, 22 bp, Homo sapiens
cagtttaagtgtgttgaaggta

SEQ ID NO: 7532712 - DNA, 21 bp, Homo sapiens
cagtttaataacaaagaagga

SEQ ID NO: 7532713 - DNA, 21 bp, Homo sapiens
cagtttaataacaaagaagga

SEQ ID NO: 7532714 - DNA, 22 bp, Homo sapiens
tcagctgccccagtggccccag

SEQ ID NO: 7532715 - DNA, 22 bp, Homo sapiens
tcagctgccccagtggccccag

SEQ ID NO: 7532716 - DNA, 22 bp, Homo sapiens
tcagctttctcttctatcgata

SEQ ID NO: 7532717 - DNA, 22 bp, Homo sapiens
tcagctgccccagtggccccag

SEQ ID NO: 7532718 - DNA, 22 bp, Homo sapiens
tcagctgccccagtggccccag

SEQ ID NO: 7532719 - DNA, 22 bp, Homo sapiens
tcagctgcataagtcaccttgc

SEQ ID NO: 7532720 - DNA, 22 bp, Homo sapiens
tcagctgcataagtcaccttgc

SEQ ID NO: 7532721 - DNA, 22 bp, Homo sapiens
tcagctgcataagtcaccttgc

SEQ ID NO: 7532722 - DNA, 22 bp, Homo sapiens
tcagctttgcaagttagaaaat

SEQ ID NO: 7532723 - DNA, 22 bp, Homo sapiens
tcagctttgcaagttagaaaat

SEQ ID NO: 7532724 - DNA, 22 bp, Homo sapiens
tcagctttgcaagttagaaaat

SEQ ID NO: 7532725 - DNA, 22 bp, Homo sapiens
tcagctttgcaagttagaaaat

SEQ ID NO: 7532726 - DNA, 21 bp, Homo sapiens
tcagctttgcaactgcacatc

SEQ ID NO: 7532727 - DNA, 22 bp, Homo sapiens
tcagctttgatctcaggcaatc

SEQ ID NO: 7532728 - DNA, 22 bp, Homo sapiens
tcagctttgatctcaggcaatc

SEQ ID NO: 7532729 - DNA, 21 bp, Homo sapiens
tcagctttgcaactgcacatc

SEQ ID NO: 7532730 - DNA, 22 bp, Homo sapiens
tcagctttgggggtctcaggag

SEQ ID NO: 7532731 - DNA, 22 bp, Homo sapiens
tcagctttgccaccagctgtaa

SEQ ID NO: 7532732 - DNA, 22 bp, Homo sapiens
tcagctttgcaagttagaaaat

SEQ ID NO: 7532733 - DNA, 22 bp, Homo sapiens
tcagcttttaaaaacaagaagt

SEQ ID NO: 7532734 - DNA, 18 bp, Homo sapiens
tcagcttttgaaaaccaa

SEQ ID NO: 7532735 - DNA, 22 bp, Homo sapiens
tcagctttggtcacattgagtt

SEQ ID NO: 7532736 - DNA, 22 bp, Homo sapiens
tcagcttttaaaaacaagaagt

SEQ ID NO: 7532737 - DNA, 22 bp, Homo sapiens
tcagcttttaaaaacaagaagt

SEQ ID NO: 7532738 - DNA, 22 bp, Homo sapiens
tcacagttcatctgataaacta

SEQ ID NO: 7532739 - DNA, 22 bp, Homo sapiens
tcacagttctagaggtaagcag

SEQ ID NO: 7532740 - DNA, 22 bp, Homo sapiens
tcacagttcaactagttcagat

SEQ ID NO: 7532741 - DNA, 21 bp, Homo sapiens
tcacagttcaagatgaacccc

SEQ ID NO: 7532742 - DNA, 22 bp, Homo sapiens
tcacagttcaaaccccatatct

SEQ ID NO: 7532743 - DNA, 22 bp, Homo sapiens
tcacagttatagtctgtagaat

SEQ ID NO: 7532744 - DNA, 22 bp, Homo sapiens
tcacagttcaaaccccatatct

SEQ ID NO: 7532745 - DNA, 22 bp, Homo sapiens
tcacagttatgggccttggtca

SEQ ID NO: 7532746 - DNA, 22 bp, Homo sapiens
tcacagttatgggccttggtca

SEQ ID NO: 7532747 - DNA, 22 bp, Homo sapiens
tcacagttatagtctgtagaat

SEQ ID NO: 7532748 - DNA, 22 bp, Homo sapiens
tcacagttatagtctgtagaat

SEQ ID NO: 7532749 - DNA, 22 bp, Homo sapiens
tcacagttatagtctgtagaat

SEQ ID NO: 7532750 - DNA, 23 bp, Homo sapiens
tcacagttacttttgcatcaacc

SEQ ID NO: 7532751 - DNA, 22 bp, Homo sapiens
tcacagttgattgaaacacagc

SEQ ID NO: 7532752 - DNA, 22 bp, Homo sapiens
tcacagttgagcaggttgtgca

SEQ ID NO: 7532753 - DNA, 21 bp, Homo sapiens
tcacagttggccaggcattta

SEQ ID NO: 7532754 - DNA, 22 bp, Homo sapiens
tcacagttgattgaaacacagc

SEQ ID NO: 7532755 - DNA, 17 bp, Homo sapiens
tcacagttggtctcagt

SEQ ID NO: 7532756 - DNA, 17 bp, Homo sapiens
tcacagttggtctcagt

SEQ ID NO: 7532757 - DNA, 21 bp, Homo sapiens
tcacagttggccaggcattta

SEQ ID NO: 7532758 - DNA, 17 bp, Homo sapiens
tcacagttggtctcagt

SEQ ID NO: 7532759 - DNA, 22 bp, Homo sapiens
tcacagtttccataggtcagca

SEQ ID NO: 7532760 - DNA, 22 bp, Homo sapiens
cagtgcatatgattctgcagtt

SEQ ID NO: 7532761 - DNA, 22 bp, Homo sapiens
cagtgcatatgattctgcagtt

SEQ ID NO: 7532762 - DNA, 22 bp, Homo sapiens
cagtgcatatgattctgcagtt

SEQ ID NO: 7532763 - DNA, 22 bp, Homo sapiens
cagtgccaaggagaaggacagc

SEQ ID NO: 7532764 - DNA, 22 bp, Homo sapiens
cagtgccaagccacagatcact

SEQ ID NO: 7532765 - DNA, 22 bp, Homo sapiens
cagtgccaagccacagatcact

SEQ ID NO: 7532766 - DNA, 22 bp, Homo sapiens
cagtgccaagccacagatcact

SEQ ID NO: 7532767 - DNA, 22 bp, Homo sapiens
cagtgcatgaaacaatatgcag

SEQ ID NO: 7532768 - DNA, 22 bp, Homo sapiens
cagtgcatgaaacaatatgcag

SEQ ID NO: 7532769 - DNA, 20 bp, Homo sapiens
cagtgcattgcttctgattt

SEQ ID NO: 7532770 - DNA, 20 bp, Homo sapiens
cagtgcattgcttctgattt

SEQ ID NO: 7532771 - DNA, 22 bp, Homo sapiens
cagtgcatgtggcactctccag

SEQ ID NO: 7532772 - DNA, 22 bp, Homo sapiens
cagtgcatgtggcactctccag

SEQ ID NO: 7532773 - DNA, 22 bp, Homo sapiens
cagtgcatgtctgtgtggggat

SEQ ID NO: 7532774 - DNA, 22 bp, Homo sapiens
cagtgcatgcacacacatggta

SEQ ID NO: 7532775 - DNA, 20 bp, Homo sapiens
tcacaggagggaaggcaggt

SEQ ID NO: 7532776 - DNA, 20 bp, Homo sapiens
tcacaggagggaaggcaggt

SEQ ID NO: 7532777 - DNA, 20 bp, Homo sapiens
tcacaggagggaaggcaggt

SEQ ID NO: 7532778 - DNA, 22 bp, Homo sapiens
tcacaggaggactgaaagatat

SEQ ID NO: 7532779 - DNA, 22 bp, Homo sapiens
tcacaggaggactgaaagatat

SEQ ID NO: 7532780 - DNA, 22 bp, Homo sapiens
tcacaggaggactgaaagatat

SEQ ID NO: 7532781 - DNA, 20 bp, Homo sapiens
tcacaggagggaaggcaggt

SEQ ID NO: 7532782 - DNA, 20 bp, Homo sapiens
tcacaggagggaaggcaggt

SEQ ID NO: 7532783 - DNA, 22 bp, Homo sapiens
tcacaggagtcaaggaatagta

SEQ ID NO: 7532784 - DNA, 22 bp, Homo sapiens
tcacaggagtcaaggaatagta

SEQ ID NO: 7532785 - DNA, 22 bp, Homo sapiens
tcacaggagtcaaggaatagta

SEQ ID NO: 7532786 - DNA, 22 bp, Homo sapiens
tcacaggagtcaaggaatagta

SEQ ID NO: 7532787 - DNA, 22 bp, Homo sapiens
tcacaggagtcaaggaatagta

SEQ ID NO: 7532788 - DNA, 22 bp, Homo sapiens
tcacaggagtcaaggaatagta

SEQ ID NO: 7532789 - DNA, 22 bp, Homo sapiens
tcacagtgtggcaactcacaga

SEQ ID NO: 7532790 - DNA, 22 bp, Homo sapiens
tcacagtgtggcaactcacaga

SEQ ID NO: 7532791 - DNA, 22 bp, Homo sapiens
tcacagtgtggcaactcacaga

SEQ ID NO: 7532792 - DNA, 22 bp, Homo sapiens
tcacaggagggagagacaccca

SEQ ID NO: 7532793 - DNA, 22 bp, Homo sapiens
tcacaggagggagagacaccca

SEQ ID NO: 7532794 - DNA, 22 bp, Homo sapiens
tcacaggagggagagacaccca

SEQ ID NO: 7532795 - DNA, 22 bp, Homo sapiens
tcacaggagggagagacaccca

SEQ ID NO: 7532796 - DNA, 22 bp, Homo sapiens
tcacaggagggagagacaccca

SEQ ID NO: 7532797 - DNA, 22 bp, Homo sapiens
tcacagttaattgttggaatgt

SEQ ID NO: 7532798 - DNA, 22 bp, Homo sapiens
tcacagttaattgttggaatgt

SEQ ID NO: 7532799 - DNA, 22 bp, Homo sapiens
tcacagttaattgttggaatgt

SEQ ID NO: 7532800 - DNA, 22 bp, Homo sapiens
tcacagttaattgttggaatgt

SEQ ID NO: 7532801 - DNA, 22 bp, Homo sapiens
tcacagtgttggaatcagagct

SEQ ID NO: 7532802 - DNA, 22 bp, Homo sapiens
tcacagttactccttcagatga

SEQ ID NO: 7532803 - DNA, 22 bp, Homo sapiens
tcacagttactccttcagatga

SEQ ID NO: 7532804 - DNA, 23 bp, Homo sapiens
tcacagttacttttgcatcaacc

SEQ ID NO: 7532805 - DNA, 22 bp, Homo sapiens
tcacagtgtggcaactcacaga

SEQ ID NO: 7532806 - DNA, 22 bp, Homo sapiens
tcacagtgtggcaactcacaga

SEQ ID NO: 7532807 - DNA, 22 bp, Homo sapiens
tcacagtgtggcaactcacaga

SEQ ID NO: 7532808 - DNA, 22 bp, Homo sapiens
tcacagtgtggcaactcacaga

SEQ ID NO: 7532809 - DNA, 22 bp, Homo sapiens
tcacagtgtggcaactcacaga

SEQ ID NO: 7532810 - DNA, 22 bp, Homo sapiens
tcacagtgttggaatcagagct

SEQ ID NO: 7532811 - DNA, 22 bp, Homo sapiens
tcacagtgttggaatcagagct

SEQ ID NO: 7532812 - DNA, 22 bp, Homo sapiens
tcacagtgttaaacctttcttt

SEQ ID NO: 7532813 - DNA, 22 bp, Homo sapiens
tcacagtgtggcaactcacaga

SEQ ID NO: 7532814 - DNA, 22 bp, Homo sapiens
tcacagtgttaaacctttcttt

SEQ ID NO: 7532815 - DNA, 22 bp, Homo sapiens
tcacagtgttaaacctttcttt

SEQ ID NO: 7532816 - DNA, 22 bp, Homo sapiens
tcacagtgttggaatcagagct

SEQ ID NO: 7532817 - DNA, 22 bp, Homo sapiens
tcacagtgtggcaactcacaga

SEQ ID NO: 7532818 - DNA, 22 bp, Homo sapiens
tcacagtgttggaatcagagct

SEQ ID NO: 7532819 - DNA, 22 bp, Homo sapiens
tcacaggaccctgagggtggcg

SEQ ID NO: 7532820 - DNA, 22 bp, Homo sapiens
tcacaggaccctgagggtggcg

SEQ ID NO: 7532821 - DNA, 22 bp, Homo sapiens
tcacaggaccctgagggtggcg

SEQ ID NO: 7532822 - DNA, 22 bp, Homo sapiens
tcacaggaccctgagggtggcg

SEQ ID NO: 7532823 - DNA, 22 bp, Homo sapiens
tcacaggaccctgagggtggcg

SEQ ID NO: 7532824 - DNA, 22 bp, Homo sapiens
tcacaggagaatgtacttacca

SEQ ID NO: 7532825 - DNA, 22 bp, Homo sapiens
tcacaggagagctgatgctggt

SEQ ID NO: 7532826 - DNA, 22 bp, Homo sapiens
tcacaggagagctgatgctggt

SEQ ID NO: 7532827 - DNA, 22 bp, Homo sapiens
tcacaggagagctgatgctggt

SEQ ID NO: 7532828 - DNA, 22 bp, Homo sapiens
tcacaggagagctgatgctggt

SEQ ID NO: 7532829 - DNA, 22 bp, Homo sapiens
tcacaggagagctgatgctggt

SEQ ID NO: 7532830 - DNA, 22 bp, Homo sapiens
tcacaggagcccaggggagctg

SEQ ID NO: 7532831 - DNA, 22 bp, Homo sapiens
tcacaggagcccaggggagctg

SEQ ID NO: 7532832 - DNA, 22 bp, Homo sapiens
tcacaggagcccaggggagctg

SEQ ID NO: 7532833 - DNA, 22 bp, Homo sapiens
tcacaggagattatgtgtgcta

SEQ ID NO: 7532834 - DNA, 22 bp, Homo sapiens
tcacaggagattatgtgtgcta

SEQ ID NO: 7532835 - DNA, 22 bp, Homo sapiens
tcacaggagattatgtgtgcta

SEQ ID NO: 7532836 - DNA, 22 bp, Homo sapiens
tcacaggagattatgtgtgcta

SEQ ID NO: 7532837 - DNA, 22 bp, Homo sapiens
tcacaggaggaacctggcctgg

SEQ ID NO: 7532838 - DNA, 22 bp, Homo sapiens
tcacaggaggaacctggcctgg

SEQ ID NO: 7532839 - DNA, 22 bp, Homo sapiens
tcacaggagcccaggggagctg

SEQ ID NO: 7532840 - DNA, 22 bp, Homo sapiens
tcacaggaggaacctggcctgg

SEQ ID NO: 7532841 - DNA, 22 bp, Homo sapiens
tcacaggaggaacctggcctgg

SEQ ID NO: 7532842 - DNA, 22 bp, Homo sapiens
tcacaggaggaacctggcctgg

SEQ ID NO: 7532843 - DNA, 22 bp, Homo sapiens
tcacagctttgagcagagacca

SEQ ID NO: 7532844 - DNA, 22 bp, Homo sapiens
tcacaggaaccatcagagaaat

SEQ ID NO: 7532845 - DNA, 22 bp, Homo sapiens
tcacaggaaccatcagagaaat

SEQ ID NO: 7532846 - DNA, 22 bp, Homo sapiens
tcacagctttgagcagagacca

SEQ ID NO: 7532847 - DNA, 22 bp, Homo sapiens
tcacagctttgagcagagacca

SEQ ID NO: 7532848 - DNA, 22 bp, Homo sapiens
tcacagctttgagcagagacca

SEQ ID NO: 7532849 - DNA, 22 bp, Homo sapiens
tcacagctttgagcagagacca

SEQ ID NO: 7532850 - DNA, 22 bp, Homo sapiens
tcacaggaaccatcagagaaat

SEQ ID NO: 7532851 - DNA, 22 bp, Homo sapiens
tcacaggaaccatcagagaaat

SEQ ID NO: 7532852 - DNA, 22 bp, Homo sapiens
tcacaggaagaggtgtctatct

SEQ ID NO: 7532853 - DNA, 22 bp, Homo sapiens
tcacaggaaccatcagagaaat

SEQ ID NO: 7532854 - DNA, 22 bp, Homo sapiens
tcacaggaaccatcagagaaat

SEQ ID NO: 7532855 - DNA, 22 bp, Homo sapiens
tcacaggaagaggtgtctatct

SEQ ID NO: 7532856 - DNA, 22 bp, Homo sapiens
tcacaggaagaggtgtctatct

SEQ ID NO: 7532857 - DNA, 22 bp, Homo sapiens
tcacaggaagggtaaatattta

SEQ ID NO: 7532858 - DNA, 22 bp, Homo sapiens
tcacaggaagggtaaatattta

SEQ ID NO: 7532859 - DNA, 22 bp, Homo sapiens
tcacaggaagggtaaatattta

SEQ ID NO: 7532860 - DNA, 22 bp, Homo sapiens
tcacaggacagccttccacccg

SEQ ID NO: 7532861 - DNA, 22 bp, Homo sapiens
tcacaggacagccttccacccg

SEQ ID NO: 7532862 - DNA, 22 bp, Homo sapiens
tcacaggacagccttccacccg

SEQ ID NO: 7532863 - DNA, 22 bp, Homo sapiens
tcacaggaccctgagggtggcg

SEQ ID NO: 7532864 - DNA, 22 bp, Homo sapiens
tcacaggaccctgagggtggcg

SEQ ID NO: 7532865 - DNA, 22 bp, Homo sapiens
tcacaggaccctgagggtggcg

SEQ ID NO: 7532866 - DNA, 22 bp, Homo sapiens
tcacaggacagccttccacccg

SEQ ID NO: 7532867 - DNA, 22 bp, Homo sapiens
tcacaggacagccttccacccg

SEQ ID NO: 7532868 - DNA, 22 bp, Homo sapiens
tcacaggacagccttccacccg

SEQ ID NO: 7532869 - DNA, 22 bp, Homo sapiens
tcacagagaaaagctatcacaa

SEQ ID NO: 7532870 - DNA, 22 bp, Homo sapiens
tcacagagaaaagctatcacaa

SEQ ID NO: 7532871 - DNA, 22 bp, Homo sapiens
tcacagagaaaagctatcacaa

SEQ ID NO: 7532872 - DNA, 22 bp, Homo sapiens
tcacagagaaaagctatcacaa

SEQ ID NO: 7532873 - DNA, 22 bp, Homo sapiens
tcacagagaaaagctatcacaa

SEQ ID NO: 7532874 - DNA, 22 bp, Homo sapiens
tcacagactcttgattgtctaa

SEQ ID NO: 7532875 - DNA, 22 bp, Homo sapiens
tcacagactggtcagtcaactt

SEQ ID NO: 7532876 - DNA, 21 bp, Homo sapiens
tcacagactggtcagtgaggc

SEQ ID NO: 7532877 - DNA, 21 bp, Homo sapiens
tcacagactggtcagtgaggc

SEQ ID NO: 7532878 - DNA, 22 bp, Homo sapiens
tcacagctttgagcagagacca

SEQ ID NO: 7532879 - DNA, 22 bp, Homo sapiens
tcacagctttcagattgttccc

SEQ ID NO: 7532880 - DNA, 22 bp, Homo sapiens
tcacagctttcagattgttccc

SEQ ID NO: 7532881 - DNA, 22 bp, Homo sapiens
tcacagcttcttgcgggtctga

SEQ ID NO: 7532882 - DNA, 22 bp, Homo sapiens
tcacagcttcttgcgggtctga

SEQ ID NO: 7532883 - DNA, 22 bp, Homo sapiens
tcacagcttcttgcgggtctga

SEQ ID NO: 7532884 - DNA, 22 bp, Homo sapiens
tcacagctgttttgtccattaa

SEQ ID NO: 7532885 - DNA, 22 bp, Homo sapiens
tcacagctgttttgtccattaa

SEQ ID NO: 7532886 - DNA, 20 bp, Homo sapiens
tcacagctggctatgacagg

SEQ ID NO: 7532887 - DNA, 22 bp, Homo sapiens
tcacagctgttttgtccattaa

SEQ ID NO: 7532888 - DNA, 22 bp, Homo sapiens
tcacagctgttttgtccattaa

SEQ ID NO: 7532889 - DNA, 22 bp, Homo sapiens
tcacagagaactataatccatc

SEQ ID NO: 7532890 - DNA, 20 bp, Homo sapiens
tcacagctggctatgacagg

SEQ ID NO: 7532891 - DNA, 22 bp, Homo sapiens
tcacagctggggttttggcagc

SEQ ID NO: 7532892 - DNA, 22 bp, Homo sapiens
tcacagctggggttttggcagc

SEQ ID NO: 7532893 - DNA, 22 bp, Homo sapiens
tcacagagaactataatccatc

SEQ ID NO: 7532894 - DNA, 22 bp, Homo sapiens
tcacagagaaatgtggcacaaa

SEQ ID NO: 7532895 - DNA, 22 bp, Homo sapiens
tcacagagaactataatccatc

SEQ ID NO: 7532896 - DNA, 22 bp, Homo sapiens
tcacagagaactataatccatc

SEQ ID NO: 7532897 - DNA, 22 bp, Homo sapiens
tcacagagaaatgtggcacaaa

SEQ ID NO: 7532898 - DNA, 22 bp, Homo sapiens
tcacagagaaatgtggcacaaa

SEQ ID NO: 7532899 - DNA, 22 bp, Homo sapiens
tcacagagaaatgtggcacaaa

SEQ ID NO: 7532900 - DNA, 22 bp, Homo sapiens
tcacagagaaatgtggcacaaa

SEQ ID NO: 7532901 - DNA, 22 bp, Homo sapiens
tcacagagaaatgtggcacaaa

SEQ ID NO: 7532902 - DNA, 22 bp, Homo sapiens
tcacagagaaatgtggcacaaa

SEQ ID NO: 7532903 - DNA, 22 bp, Homo sapiens
tcacagagaaaagctatcacaa

SEQ ID NO: 7532904 - DNA, 22 bp, Homo sapiens
tcacagagaaaagctatcacaa

SEQ ID NO: 7532905 - DNA, 22 bp, Homo sapiens
tcaatgagaatagctttcctta

SEQ ID NO: 7532906 - DNA, 22 bp, Homo sapiens
tcaatgactggtccaaggtggc

SEQ ID NO: 7532907 - DNA, 22 bp, Homo sapiens
tcaatgacattgtatcagagtt

SEQ ID NO: 7532908 - DNA, 22 bp, Homo sapiens
tcacaaatatagtgagaaccag

SEQ ID NO: 7532909 - DNA, 22 bp, Homo sapiens
tcacaaatattttaacagtagg

SEQ ID NO: 7532910 - DNA, 22 bp, Homo sapiens
tcacaaatattttaacagtagg

SEQ ID NO: 7532911 - DNA, 22 bp, Homo sapiens
tcacaaatattttaacagtagg

SEQ ID NO: 7532912 - DNA, 22 bp, Homo sapiens
tcacaaatattttaacagtagg

SEQ ID NO: 7532913 - DNA, 22 bp, Homo sapiens
tcacaaatattttaacagtagg

SEQ ID NO: 7532914 - DNA, 22 bp, Homo sapiens
tcaatgaagagatttaaatcat

SEQ ID NO: 7532915 - DNA, 22 bp, Homo sapiens
tatttgaaagtgtacaaaaact

SEQ ID NO: 7532916 - DNA, 22 bp, Homo sapiens
tatttgaaagtgtacaaaaact

SEQ ID NO: 7532917 - DNA, 22 bp, Homo sapiens
tatttgaaagtgtacaaaaact

SEQ ID NO: 7532918 - DNA, 22 bp, Homo sapiens
tatttgaaagtgtacaaaaact

SEQ ID NO: 7532919 - DNA, 22 bp, Homo sapiens
tatttgaaagtgtacaaaaact

SEQ ID NO: 7532920 - DNA, 22 bp, Homo sapiens
tatttgaaagtgtacaaaaact

SEQ ID NO: 7532921 - DNA, 22 bp, Homo sapiens
tatttgaaagtgtacaaaaact

SEQ ID NO: 7532922 - DNA, 22 bp, Homo sapiens
tatttgaaagtgtacaaaaact

SEQ ID NO: 7532923 - DNA, 22 bp, Homo sapiens
tatttgaaagtgtacaaaaact

SEQ ID NO: 7532924 - DNA, 22 bp, Homo sapiens
tatttcttttcgtgacttattg

SEQ ID NO: 7532925 - DNA, 22 bp, Homo sapiens
tatttcttttcgtgacttattg

SEQ ID NO: 7532926 - DNA, 22 bp, Homo sapiens
tatttcttttcgtgacttattg

SEQ ID NO: 7532927 - DNA, 22 bp, Homo sapiens
tatttcttttcgtgacttattg

SEQ ID NO: 7532928 - DNA, 22 bp, Homo sapiens
tatttcttttcgtgacttattg

SEQ ID NO: 7532929 - DNA, 22 bp, Homo sapiens
tatttcttttcgtgacttattg

SEQ ID NO: 7532930 - DNA, 22 bp, Homo sapiens
tcacaacaggaaggaccagctg

SEQ ID NO: 7532931 - DNA, 22 bp, Homo sapiens
tcacaaatttcagctccctgaa

SEQ ID NO: 7532932 - DNA, 22 bp, Homo sapiens
tcacaaatgtttgcatgtgtct

SEQ ID NO: 7532933 - DNA, 22 bp, Homo sapiens
tcacaaatttcagctccctgaa

SEQ ID NO: 7532934 - DNA, 22 bp, Homo sapiens
tcacaaatgtttgcatgtgtct

SEQ ID NO: 7532935 - DNA, 22 bp, Homo sapiens
tcacaaatgtctcctgtcctgt

SEQ ID NO: 7532936 - DNA, 22 bp, Homo sapiens
tcacaaatgtttgcatgtgtct

SEQ ID NO: 7532937 - DNA, 22 bp, Homo sapiens
tcacaaatgtttgcatgtgtct

SEQ ID NO: 7532938 - DNA, 22 bp, Homo sapiens
tcacaaatcattttatctgtgt

SEQ ID NO: 7532939 - DNA, 22 bp, Homo sapiens
tcacaaatcattttatctgtgt

SEQ ID NO: 7532940 - DNA, 22 bp, Homo sapiens
tcacaaatcattttatctgtgt

SEQ ID NO: 7532941 - DNA, 22 bp, Homo sapiens
tcacaaatcattttatctgtgt

SEQ ID NO: 7532942 - DNA, 22 bp, Homo sapiens
tcacaaatcattttatctgtgt

SEQ ID NO: 7532943 - DNA, 22 bp, Homo sapiens
tcacaaatcgaagccttataat

SEQ ID NO: 7532944 - DNA, 22 bp, Homo sapiens
tcacaaatgaggaaatcgagca

SEQ ID NO: 7532945 - DNA, 22 bp, Homo sapiens
tcacaaatgaccatggttacta

SEQ ID NO: 7532946 - DNA, 22 bp, Homo sapiens
tcacaaatgaggaaatcgagca

SEQ ID NO: 7532947 - DNA, 20 bp, Homo sapiens
tcacaactccatcatttccc

SEQ ID NO: 7532948 - DNA, 22 bp, Homo sapiens
tcacaacaggaaggaccagctg

SEQ ID NO: 7532949 - DNA, 22 bp, Homo sapiens
tcacaacaggaaggaccagctg

SEQ ID NO: 7532950 - DNA, 22 bp, Homo sapiens
tcacaactgggtgtcttcatca

SEQ ID NO: 7532951 - DNA, 21 bp, Homo sapiens
tcacaactttgaatttcaata

SEQ ID NO: 7532952 - DNA, 22 bp, Homo sapiens
tcacaacttgaagctgatttaa

SEQ ID NO: 7532953 - DNA, 22 bp, Homo sapiens
tcacaactctttccatttaata

SEQ ID NO: 7532954 - DNA, 22 bp, Homo sapiens
tcacaactctttccatttaata

SEQ ID NO: 7532955 - DNA, 22 bp, Homo sapiens
tcacaagaatttgtagatgaaa

SEQ ID NO: 7532956 - DNA, 22 bp, Homo sapiens
tcacaagacagaaaacatttag

SEQ ID NO: 7532957 - DNA, 22 bp, Homo sapiens
tcacaagacagaaaacatttag

SEQ ID NO: 7532958 - DNA, 22 bp, Homo sapiens
tcacaagacaagacaaattgca

SEQ ID NO: 7532959 - DNA, 21 bp, Homo sapiens
tcacaactttgaatttcaata

SEQ ID NO: 7532960 - DNA, 22 bp, Homo sapiens
tcacaagaactttggagggata

SEQ ID NO: 7532961 - DNA, 22 bp, Homo sapiens
tcacaagaatttgtagatgaaa

SEQ ID NO: 7532962 - DNA, 22 bp, Homo sapiens
tcacaagaatttgtagatgaaa

SEQ ID NO: 7532963 - DNA, 22 bp, Homo sapiens
tcacaagaatttgtagatgaaa

SEQ ID NO: 7532964 - DNA, 22 bp, Homo sapiens
cagtgagaaaactaagacatta

SEQ ID NO: 7532965 - DNA, 22 bp, Homo sapiens
cagtgagaaaactaagacatta

SEQ ID NO: 7532966 - DNA, 22 bp, Homo sapiens
cagtgagaattcagtaggtact

SEQ ID NO: 7532967 - DNA, 22 bp, Homo sapiens
cagtgagaattcagtaggtact

SEQ ID NO: 7532968 - DNA, 22 bp, Homo sapiens
cagtgagaaaactaagacatta

SEQ ID NO: 7532969 - DNA, 22 bp, Homo sapiens
cagtgagagtatttgtgctaag

SEQ ID NO: 7532970 - DNA, 22 bp, Homo sapiens
cagtgagagtatttgtgctaag

SEQ ID NO: 7532971 - DNA, 22 bp, Homo sapiens
cagtgagaattcagtaggtact

SEQ ID NO: 7532972 - DNA, 22 bp, Homo sapiens
cagtgagagtatttgtgctaag

SEQ ID NO: 7532973 - DNA, 22 bp, Homo sapiens
cagtgagaccttctaaggtggt

SEQ ID NO: 7532974 - DNA, 22 bp, Homo sapiens
cagtgagagagaacgcattcat

SEQ ID NO: 7532975 - DNA, 22 bp, Homo sapiens
cagtgagagagaacgcattcat

SEQ ID NO: 7532976 - DNA, 22 bp, Homo sapiens
cagtgacgtaaactgcatgtgc

SEQ ID NO: 7532977 - DNA, 22 bp, Homo sapiens
cagtgacctaatattctgccac

SEQ ID NO: 7532978 - DNA, 22 bp, Homo sapiens
cagtgacgtaaactgcatgtgc

SEQ ID NO: 7532979 - DNA, 22 bp, Homo sapiens
cagtgacgtaaactgcatgtgc

SEQ ID NO: 7532980 - DNA, 22 bp, Homo sapiens
cagtgacgtaaactgcatgtgc

SEQ ID NO: 7532981 - DNA, 22 bp, Homo sapiens
cagtgacgtaaactgcatgtgc

SEQ ID NO: 7532982 - DNA, 22 bp, Homo sapiens
cagtgacgtaaactgcatgtgc

SEQ ID NO: 7532983 - DNA, 22 bp, Homo sapiens
cagtgacaggttccatgccgca

SEQ ID NO: 7532984 - DNA, 22 bp, Homo sapiens
cagtgacagcaagcagtgctgg

SEQ ID NO: 7532985 - DNA, 22 bp, Homo sapiens
cagtgacagcaagcagtgctgg

SEQ ID NO: 7532986 - DNA, 22 bp, Homo sapiens
cagtgacagcaagcagtgctgg

SEQ ID NO: 7532987 - DNA, 22 bp, Homo sapiens
cagtgacacgggctggcccacg

SEQ ID NO: 7532988 - DNA, 22 bp, Homo sapiens
cagtgacacgggctggcccacg

SEQ ID NO: 7532989 - DNA, 22 bp, Homo sapiens
cagtgacacccagtctggccca

SEQ ID NO: 7532990 - DNA, 22 bp, Homo sapiens
cagtgaagtttaaagtgtagat

SEQ ID NO: 7532991 - DNA, 22 bp, Homo sapiens
cagtgaatttagatgttggtgg

SEQ ID NO: 7532992 - DNA, 22 bp, Homo sapiens
cagtgaagtttaaagtgtagat

SEQ ID NO: 7532993 - DNA, 22 bp, Homo sapiens
cagtgaagtttaaagtgtagat

SEQ ID NO: 7532994 - DNA, 22 bp, Homo sapiens
cagtgaagtttaaagtgtagat

SEQ ID NO: 7532995 - DNA, 22 bp, Homo sapiens
cagtgaagttctactgaatggt

SEQ ID NO: 7532996 - DNA, 17 bp, Homo sapiens
cagtgaagagacattaa

SEQ ID NO: 7532997 - DNA, 22 bp, Homo sapiens
cagtgaagtgtggacgtcacca

SEQ ID NO: 7532998 - DNA, 22 bp, Homo sapiens
cagtgaagtgtggacgtcacca

SEQ ID NO: 7532999 - DNA, 22 bp, Homo sapiens
cagtgaagttctactgaatggt

SEQ ID NO: 7533000 - DNA, 22 bp, Homo sapiens
cagtgaagttctactgaatggt

SEQ ID NO: 7533001 - DNA, 22 bp, Homo sapiens
cagtgaagttctactgaatggt

SEQ ID NO: 7533002 - DNA, 22 bp, Homo sapiens
tcacaagagctggactgtcttt

SEQ ID NO: 7533003 - DNA, 22 bp, Homo sapiens
tcacaagagctggactgtcttt

SEQ ID NO: 7533004 - DNA, 17 bp, Homo sapiens
cagtgaagagacattaa

SEQ ID NO: 7533005 - DNA, 22 bp, Homo sapiens
cagtgaagtgtggacgtcacca

SEQ ID NO: 7533006 - DNA, 19 bp, Homo sapiens
tcacaagagagataaagtg

SEQ ID NO: 7533007 - DNA, 19 bp, Homo sapiens
tcacaagagagataaagtg

SEQ ID NO: 7533008 - DNA, 19 bp, Homo sapiens
tcacaagagagataaagtg

SEQ ID NO: 7533009 - DNA, 22 bp, Homo sapiens
tcacaagactgagcttgcttga

SEQ ID NO: 7533010 - DNA, 22 bp, Homo sapiens
tcacaagactgagcttgcttga

SEQ ID NO: 7533011 - DNA, 22 bp, Homo sapiens
tcacaagactgagcttgcttga

SEQ ID NO: 7533012 - DNA, 22 bp, Homo sapiens
tcacaagacagaaaacatttag

SEQ ID NO: 7533013 - DNA, 22 bp, Homo sapiens
tcacaagacagaaaacatttag

SEQ ID NO: 7533014 - DNA, 22 bp, Homo sapiens
tcacagactcttgattgtctaa

SEQ ID NO: 7533015 - DNA, 22 bp, Homo sapiens
tcacagactcttgattgtctaa

SEQ ID NO: 7533016 - DNA, 22 bp, Homo sapiens
tcacagactcaagggcatagga

SEQ ID NO: 7533017 - DNA, 22 bp, Homo sapiens
tcacagacgcctcccctcgcct

SEQ ID NO: 7533018 - DNA, 22 bp, Homo sapiens
tcacagacgcctcccctcgcct

SEQ ID NO: 7533019 - DNA, 22 bp, Homo sapiens
tcacacttcaaagggttagatc

SEQ ID NO: 7533020 - DNA, 18 bp, Homo sapiens
tcacacttcctttgggtc

SEQ ID NO: 7533021 - DNA, 22 bp, Homo sapiens
tcacacttcaaagggttagatc

SEQ ID NO: 7533022 - DNA, 22 bp, Homo sapiens
tcacagacctggtgggaggtgg

SEQ ID NO: 7533023 - DNA, 22 bp, Homo sapiens
tcacactttccatggctgttaa

SEQ ID NO: 7533024 - DNA, 22 bp, Homo sapiens
cagtgagataccacagagcaaa

SEQ ID NO: 7533025 - DNA, 22 bp, Homo sapiens
cagtgagagtatttgtgctaag

SEQ ID NO: 7533026 - DNA, 22 bp, Homo sapiens
cagtgagataccacagagcaaa

SEQ ID NO: 7533027 - DNA, 22 bp, Homo sapiens
cagtgagataccacagagcaaa

SEQ ID NO: 7533028 - DNA, 22 bp, Homo sapiens
cagtgagataccacagagcaaa

SEQ ID NO: 7533029 - DNA, 22 bp, Homo sapiens
cagtgagataccacagagcaaa

SEQ ID NO: 7533030 - DNA, 22 bp, Homo sapiens
cagtgagctcctgtctgtccct

SEQ ID NO: 7533031 - DNA, 22 bp, Homo sapiens
cagtgagcacggccagagggga

SEQ ID NO: 7533032 - DNA, 22 bp, Homo sapiens
cagtgagataccacagagcaaa

SEQ ID NO: 7533033 - DNA, 22 bp, Homo sapiens
cagtgagataccacagagcaaa

SEQ ID NO: 7533034 - DNA, 22 bp, Homo sapiens
cagtgaggaagctgtctggacc

SEQ ID NO: 7533035 - DNA, 22 bp, Homo sapiens
cagtgaggaagctgtctggacc

SEQ ID NO: 7533036 - DNA, 22 bp, Homo sapiens
cagtgaggaagctgtctggacc

SEQ ID NO: 7533037 - DNA, 22 bp, Homo sapiens
cagtgagctcctgtctgtccct

SEQ ID NO: 7533038 - DNA, 22 bp, Homo sapiens
cagtgaggaagctgtctggacc

SEQ ID NO: 7533039 - DNA, 22 bp, Homo sapiens
tcacacttatcccactcagtca

SEQ ID NO: 7533040 - DNA, 22 bp, Homo sapiens
tcacacttagagcgaattgttt

SEQ ID NO: 7533041 - DNA, 22 bp, Homo sapiens
cagtgaggaagctgtctggacc

SEQ ID NO: 7533042 - DNA, 22 bp, Homo sapiens
cagtgaggaagctgtctggacc

SEQ ID NO: 7533043 - DNA, 22 bp, Homo sapiens
cagtgaggaagctgtctggacc

SEQ ID NO: 7533044 - DNA, 18 bp, Homo sapiens
cagtataaccagcaactc

SEQ ID NO: 7533045 - DNA, 22 bp, Homo sapiens
cagtataagagtgaggaagggc

SEQ ID NO: 7533046 - DNA, 22 bp, Homo sapiens
cagtataagagtgaggaagggc

SEQ ID NO: 7533047 - DNA, 18 bp, Homo sapiens
cagtataaccagcaactc

SEQ ID NO: 7533048 - DNA, 21 bp, Homo sapiens
cagtataacgttgggctcttc

SEQ ID NO: 7533049 - DNA, 21 bp, Homo sapiens
cagtataacgttgggctcttc

SEQ ID NO: 7533050 - DNA, 18 bp, Homo sapiens
cagtataaccagcaactc

SEQ ID NO: 7533051 - DNA, 18 bp, Homo sapiens
cagtataaccagcaactc

SEQ ID NO: 7533052 - DNA, 22 bp, Homo sapiens
cagtagttattagttgccactg

SEQ ID NO: 7533053 - DNA, 23 bp, Homo sapiens
cagtataatgtatggatggggca

SEQ ID NO: 7533054 - DNA, 23 bp, Homo sapiens
cagtataatgtatggatggggca

SEQ ID NO: 7533055 - DNA, 22 bp, Homo sapiens
cagtataagagtgaggaagggc

SEQ ID NO: 7533056 - DNA, 22 bp, Homo sapiens
cagtataatgccccctgtgggg

SEQ ID NO: 7533057 - DNA, 22 bp, Homo sapiens
cagtatacgactaacgcatgac

SEQ ID NO: 7533058 - DNA, 22 bp, Homo sapiens
cagtagtgttgctgagtgtcag

SEQ ID NO: 7533059 - DNA, 22 bp, Homo sapiens
cagtagtggtctatcactggag

SEQ ID NO: 7533060 - DNA, 22 bp, Homo sapiens
cagtagtgttgctgagtgtcag

SEQ ID NO: 7533061 - DNA, 22 bp, Homo sapiens
cagtagtggtctatcactggag

SEQ ID NO: 7533062 - DNA, 22 bp, Homo sapiens
cagtagtggggagcccagtgtc

SEQ ID NO: 7533063 - DNA, 22 bp, Homo sapiens
cagtagtggtctatcactggag

SEQ ID NO: 7533064 - DNA, 22 bp, Homo sapiens
cagtagtggggagcccagtgtc

SEQ ID NO: 7533065 - DNA, 17 bp, Homo sapiens
cagtagtggcactggag

SEQ ID NO: 7533066 - DNA, 22 bp, Homo sapiens
cagtagtggaagggagagaaaa

SEQ ID NO: 7533067 - DNA, 17 bp, Homo sapiens
cagtagtggcactggag

SEQ ID NO: 7533068 - DNA, 17 bp, Homo sapiens
cagtagtggcactggag

SEQ ID NO: 7533069 - DNA, 22 bp, Homo sapiens
cagtagtggaagggagagaaaa

SEQ ID NO: 7533070 - DNA, 22 bp, Homo sapiens
cagtagtggaagggagagaaaa

SEQ ID NO: 7533071 - DNA, 22 bp, Homo sapiens
cagtagtggaagggagagaaaa

SEQ ID NO: 7533072 - DNA, 22 bp, Homo sapiens
cagtaggcaggttgtcttctta

SEQ ID NO: 7533073 - DNA, 22 bp, Homo sapiens
cagtagggaatgtgggaggctg

SEQ ID NO: 7533074 - DNA, 22 bp, Homo sapiens
cagtaggaaggatgcagaaaaa

SEQ ID NO: 7533075 - DNA, 22 bp, Homo sapiens
cagtaggaaggatgcagaaaaa

SEQ ID NO: 7533076 - DNA, 22 bp, Homo sapiens
cagtagcttcagttgaggcctg

SEQ ID NO: 7533077 - DNA, 22 bp, Homo sapiens
cagtagcttacttttcttgatc

SEQ ID NO: 7533078 - DNA, 22 bp, Homo sapiens
cagtagcttgcttaggctttta

SEQ ID NO: 7533079 - DNA, 22 bp, Homo sapiens
cagtagctaaattattttcatg

SEQ ID NO: 7533080 - DNA, 22 bp, Homo sapiens
cagtagctgtctagccttatgg

SEQ ID NO: 7533081 - DNA, 22 bp, Homo sapiens
cagtagtctttttcctcctaga

SEQ ID NO: 7533082 - DNA, 22 bp, Homo sapiens
cagtaggggttctttaagttgt

SEQ ID NO: 7533083 - DNA, 22 bp, Homo sapiens
cagtagggaatgtgggaggctg

SEQ ID NO: 7533084 - DNA, 22 bp, Homo sapiens
cagtagggaatgtgggaggctg

SEQ ID NO: 7533085 - DNA, 22 bp, Homo sapiens
cagtagggaatgtgggaggctg

SEQ ID NO: 7533086 - DNA, 22 bp, Homo sapiens
cagtaggaaggatgcagaaaaa

SEQ ID NO: 7533087 - DNA, 22 bp, Homo sapiens
cagtagtgaaaagcagcccagc

SEQ ID NO: 7533088 - DNA, 22 bp, Homo sapiens
cagtagtgaaaagcagcccagc

SEQ ID NO: 7533089 - DNA, 22 bp, Homo sapiens
cagtagtgaaaagcagcccagc

SEQ ID NO: 7533090 - DNA, 22 bp, Homo sapiens
cagtagtctttttcctcctaga

SEQ ID NO: 7533091 - DNA, 22 bp, Homo sapiens
cagtagtagttaaactgtgtat

SEQ ID NO: 7533092 - DNA, 21 bp, Homo sapiens
cagtagtgcgtcgcagaggac

SEQ ID NO: 7533093 - DNA, 21 bp, Homo sapiens
cagtagtgaggtatttgccaa

SEQ ID NO: 7533094 - DNA, 21 bp, Homo sapiens
cagtagtgcgtcgcagaggac

SEQ ID NO: 7533095 - DNA, 21 bp, Homo sapiens
cagtagtgaggtatttgccaa

SEQ ID NO: 7533096 - DNA, 21 bp, Homo sapiens
cagtagtgcgtcgcagaggac

SEQ ID NO: 7533097 - DNA, 22 bp, Homo sapiens
cagtagccactagacacatgta

SEQ ID NO: 7533098 - DNA, 22 bp, Homo sapiens
cagtagcatgtaataaagacag

SEQ ID NO: 7533099 - DNA, 22 bp, Homo sapiens
tatttccagaggagtatagaag

SEQ ID NO: 7533100 - DNA, 22 bp, Homo sapiens
cagtagcatgtaataaagacag

SEQ ID NO: 7533101 - DNA, 22 bp, Homo sapiens
cagtagcatgcttatcttttga

SEQ ID NO: 7533102 - DNA, 22 bp, Homo sapiens
tatttccacctattattttctg

SEQ ID NO: 7533103 - DNA, 22 bp, Homo sapiens
tatttccacctattattttctg

SEQ ID NO: 7533104 - DNA, 22 bp, Homo sapiens
tatttccacctattattttctg

SEQ ID NO: 7533105 - DNA, 22 bp, Homo sapiens
tatttccagaggagtatagaag

SEQ ID NO: 7533106 - DNA, 22 bp, Homo sapiens
tatttccacttaggtgcctgtt

SEQ ID NO: 7533107 - DNA, 22 bp, Homo sapiens
tatttccacttaggtgcctgtt

SEQ ID NO: 7533108 - DNA, 22 bp, Homo sapiens
tatttccaagctgaatccaatg

SEQ ID NO: 7533109 - DNA, 22 bp, Homo sapiens
tatttccaagctgaatccaatg

SEQ ID NO: 7533110 - DNA, 22 bp, Homo sapiens
tatttccacaccttttgaatct

SEQ ID NO: 7533111 - DNA, 22 bp, Homo sapiens
tatttccacaccttttgaatct

SEQ ID NO: 7533112 - DNA, 22 bp, Homo sapiens
tatttccacaccttttgaatct

SEQ ID NO: 7533113 - DNA, 22 bp, Homo sapiens
tatttccaccctcagtaaggaa

SEQ ID NO: 7533114 - DNA, 22 bp, Homo sapiens
tatttccaccctcagtaaggaa

SEQ ID NO: 7533115 - DNA, 22 bp, Homo sapiens
tatttccaccctcagtaaggaa

SEQ ID NO: 7533116 - DNA, 22 bp, Homo sapiens
tatttccaaaagcctattatga

SEQ ID NO: 7533117 - DNA, 22 bp, Homo sapiens
tatttccaaaagcctattatga

SEQ ID NO: 7533118 - DNA, 22 bp, Homo sapiens
tatttccaaaagcctattatga

SEQ ID NO: 7533119 - DNA, 21 bp, Homo sapiens
tatttccaaccctttatcctt

SEQ ID NO: 7533120 - DNA, 21 bp, Homo sapiens
tatttccaaccctttatcctt

SEQ ID NO: 7533121 - DNA, 22 bp, Homo sapiens
tatttccaaaagcctattatga

SEQ ID NO: 7533122 - DNA, 22 bp, Homo sapiens
tatttccaaaagcctattatga

SEQ ID NO: 7533123 - DNA, 22 bp, Homo sapiens
tatttccaaaagcctattatga

SEQ ID NO: 7533124 - DNA, 22 bp, Homo sapiens
tatttccaagctgaatccaatg

SEQ ID NO: 7533125 - DNA, 22 bp, Homo sapiens
tatttccaagctgaatccaatg

SEQ ID NO: 7533126 - DNA, 22 bp, Homo sapiens
cagtccagagcccaccagagga

SEQ ID NO: 7533127 - DNA, 22 bp, Homo sapiens
cagtccagagcccaccagagga

SEQ ID NO: 7533128 - DNA, 18 bp, Homo sapiens
cagtcccaaaccttagga

SEQ ID NO: 7533129 - DNA, 22 bp, Homo sapiens
cagtatatgctctttcatcaaa

SEQ ID NO: 7533130 - DNA, 22 bp, Homo sapiens
cagtatatgctctttcatcaaa

SEQ ID NO: 7533131 - DNA, 22 bp, Homo sapiens
cagtatatgctctttcatcaaa

SEQ ID NO: 7533132 - DNA, 20 bp, Homo sapiens
cagtccactggagttcctac

SEQ ID NO: 7533133 - DNA, 20 bp, Homo sapiens
cagtccactggagttcctac

SEQ ID NO: 7533134 - DNA, 20 bp, Homo sapiens
cagtccactggagttcctac

SEQ ID NO: 7533135 - DNA, 20 bp, Homo sapiens
cagtccactggagttcctac

SEQ ID NO: 7533136 - DNA, 19 bp, Homo sapiens
cagtcccaaattcttgtca

SEQ ID NO: 7533137 - DNA, 19 bp, Homo sapiens
cagtcccaaattcttgtca

SEQ ID NO: 7533138 - DNA, 22 bp, Homo sapiens
cagtcccaaggaggaagcagtc

SEQ ID NO: 7533139 - DNA, 22 bp, Homo sapiens
cagtcccaaggaggaagcagtc

SEQ ID NO: 7533140 - DNA, 22 bp, Homo sapiens
cagtcccaaggaggaagcagtc

SEQ ID NO: 7533141 - DNA, 19 bp, Homo sapiens
cagtcccaaattcttgtca

SEQ ID NO: 7533142 - DNA, 19 bp, Homo sapiens
cagtcccaaattcttgtca

SEQ ID NO: 7533143 - DNA, 22 bp, Homo sapiens
cagtcccaaggaggaagcagtc

SEQ ID NO: 7533144 - DNA, 22 bp, Homo sapiens
cagtcccaaggaggaagcagtc

SEQ ID NO: 7533145 - DNA, 22 bp, Homo sapiens
cagtcccaaggaggaagcagtc

SEQ ID NO: 7533146 - DNA, 22 bp, Homo sapiens
cagtcccaccaggatcgctctt

SEQ ID NO: 7533147 - DNA, 22 bp, Homo sapiens
cagtcccacaagatctccacaa

SEQ ID NO: 7533148 - DNA, 22 bp, Homo sapiens
cagtcccacaagatctccacaa

SEQ ID NO: 7533149 - DNA, 22 bp, Homo sapiens
cagtcccaccaggatcgctctt

SEQ ID NO: 7533150 - DNA, 22 bp, Homo sapiens
cagtcccacaagatctccacaa

SEQ ID NO: 7533151 - DNA, 22 bp, Homo sapiens
cagtcccacaagatctccacaa

SEQ ID NO: 7533152 - DNA, 22 bp, Homo sapiens
cagtcccactagtgccaatacc

SEQ ID NO: 7533153 - DNA, 22 bp, Homo sapiens
cagtcccactagtgccaatacc

SEQ ID NO: 7533154 - DNA, 22 bp, Homo sapiens
cagtcccactagtgccaatacc

SEQ ID NO: 7533155 - DNA, 22 bp, Homo sapiens
cagtcccaccaggatcgctctt

SEQ ID NO: 7533156 - DNA, 22 bp, Homo sapiens
cagtcccaaggaggaagcagtc

SEQ ID NO: 7533157 - DNA, 20 bp, Homo sapiens
cagtcccaatccagggccag

SEQ ID NO: 7533158 - DNA, 20 bp, Homo sapiens
cagtcccaatccagggccag

SEQ ID NO: 7533159 - DNA, 20 bp, Homo sapiens
cagtcccaatccagggccag

SEQ ID NO: 7533160 - DNA, 20 bp, Homo sapiens
cagtcccaatccagggccag

SEQ ID NO: 7533161 - DNA, 20 bp, Homo sapiens
cagtcccaatccagggccag

SEQ ID NO: 7533162 - DNA, 20 bp, Homo sapiens
cagtcccaatccagggccag

SEQ ID NO: 7533163 - DNA, 20 bp, Homo sapiens
cagtcccaatccagggccag

SEQ ID NO: 7533164 - DNA, 20 bp, Homo sapiens
cagtcccaatccagggccag

SEQ ID NO: 7533165 - DNA, 20 bp, Homo sapiens
cagtcccaatccagggccag

SEQ ID NO: 7533166 - DNA, 20 bp, Homo sapiens
cagtcccaatccagggccag

SEQ ID NO: 7533167 - DNA, 20 bp, Homo sapiens
cagtcccaatccagggccag

SEQ ID NO: 7533168 - DNA, 22 bp, Homo sapiens
tatttcttgttccctccaagtt

SEQ ID NO: 7533169 - DNA, 22 bp, Homo sapiens
tatttcttgttccctccaagtt

SEQ ID NO: 7533170 - DNA, 22 bp, Homo sapiens
tatttcttgttccctccaagtt

SEQ ID NO: 7533171 - DNA, 22 bp, Homo sapiens
tatttcttgttccctccaagtt

SEQ ID NO: 7533172 - DNA, 22 bp, Homo sapiens
cagtcccagacccagaaggtgg

SEQ ID NO: 7533173 - DNA, 22 bp, Homo sapiens
cagtcccagacccagaaggtgg

SEQ ID NO: 7533174 - DNA, 22 bp, Homo sapiens
cagtcccagacccagaaggtgg

SEQ ID NO: 7533175 - DNA, 22 bp, Homo sapiens
cagtcccagacccagaaggtgg

SEQ ID NO: 7533176 - DNA, 22 bp, Homo sapiens
cagtcccagaagagcctgggag

SEQ ID NO: 7533177 - DNA, 22 bp, Homo sapiens
cagtcccagaagagcctgggag

SEQ ID NO: 7533178 - DNA, 22 bp, Homo sapiens
cagtcccagaagagcctgggag

SEQ ID NO: 7533179 - DNA, 22 bp, Homo sapiens
cagtcccagaagagcctgggag

SEQ ID NO: 7533180 - DNA, 22 bp, Homo sapiens
cagtcccagaagagcctgggag

SEQ ID NO: 7533181 - DNA, 22 bp, Homo sapiens
cagtcccactagtgccaatacc

SEQ ID NO: 7533182 - DNA, 22 bp, Homo sapiens
cagtcccagaagagcctgggag

SEQ ID NO: 7533183 - DNA, 22 bp, Homo sapiens
cagtcccagaagagcctgggag

SEQ ID NO: 7533184 - DNA, 22 bp, Homo sapiens
cagtcccagacatagtaaggga

SEQ ID NO: 7533185 - DNA, 22 bp, Homo sapiens
cagtcccagacatagtaaggga

SEQ ID NO: 7533186 - DNA, 22 bp, Homo sapiens
cagtcccagacatagtaaggga

SEQ ID NO: 7533187 - DNA, 22 bp, Homo sapiens
cagtcccagacatagtaaggga

SEQ ID NO: 7533188 - DNA, 22 bp, Homo sapiens
tatttctttcaggtatgtgttg

SEQ ID NO: 7533189 - DNA, 22 bp, Homo sapiens
tatttctttcaggtatgtgttg

SEQ ID NO: 7533190 - DNA, 22 bp, Homo sapiens
tatttctttcaggtatgtgttg

SEQ ID NO: 7533191 - DNA, 22 bp, Homo sapiens
tatttctttcaggtatgtgttg

SEQ ID NO: 7533192 - DNA, 22 bp, Homo sapiens
tatttctttcaggtatgtgttg

SEQ ID NO: 7533193 - DNA, 22 bp, Homo sapiens
tatttctttcaggtatgtgttg

SEQ ID NO: 7533194 - DNA, 22 bp, Homo sapiens
tatttctttcaggtatgtgttg

SEQ ID NO: 7533195 - DNA, 22 bp, Homo sapiens
tatttctttcaggtatgtgttg

SEQ ID NO: 7533196 - DNA, 22 bp, Homo sapiens
tatttctttcaggtatgtgttg

SEQ ID NO: 7533197 - DNA, 22 bp, Homo sapiens
tatttctttcaggtatgtgttg

SEQ ID NO: 7533198 - DNA, 22 bp, Homo sapiens
tatttctttcaggtatgtgttg

SEQ ID NO: 7533199 - DNA, 21 bp, Homo sapiens
tatttctttgactctctccct

SEQ ID NO: 7533200 - DNA, 21 bp, Homo sapiens
tatttctttgactctctccct

SEQ ID NO: 7533201 - DNA, 21 bp, Homo sapiens
tatttctttgactctctccct

SEQ ID NO: 7533202 - DNA, 21 bp, Homo sapiens
tatttctttgactctctccct

SEQ ID NO: 7533203 - DNA, 22 bp, Homo sapiens
tatttctttcaggtatgtgttg

SEQ ID NO: 7533204 - DNA, 22 bp, Homo sapiens
tatttcttttcgtgacttattg

SEQ ID NO: 7533205 - DNA, 22 bp, Homo sapiens
tatttcttttcgtgacttattg

SEQ ID NO: 7533206 - DNA, 22 bp, Homo sapiens
caggttcccttgcagctaagtg

SEQ ID NO: 7533207 - DNA, 22 bp, Homo sapiens
caggttctatactgaataattt

SEQ ID NO: 7533208 - DNA, 22 bp, Homo sapiens
caggttctgaggatggtgcctg

SEQ ID NO: 7533209 - DNA, 22 bp, Homo sapiens
caggttctgccatttacttgta

SEQ ID NO: 7533210 - DNA, 22 bp, Homo sapiens
caggttctggagatgcagagat

SEQ ID NO: 7533211 - DNA, 22 bp, Homo sapiens
caggttctgggtcctgggtcct

SEQ ID NO: 7533212 - DNA, 22 bp, Homo sapiens
caggttctggggctccactgtg

SEQ ID NO: 7533213 - DNA, 22 bp, Homo sapiens
caggttctggagatgcagagat

SEQ ID NO: 7533214 - DNA, 22 bp, Homo sapiens
caggttctggggctccactgtg

SEQ ID NO: 7533215 - DNA, 22 bp, Homo sapiens
caggttcttaacttgttcttcc

SEQ ID NO: 7533216 - DNA, 22 bp, Homo sapiens
caggttcttaagtaacagcaca

SEQ ID NO: 7533217 - DNA, 22 bp, Homo sapiens
caggttcttgaagccttctggc

SEQ ID NO: 7533218 - DNA, 22 bp, Homo sapiens
caggttgggctgcgaggaggag

SEQ ID NO: 7533219 - DNA, 22 bp, Homo sapiens
caggttgggctgcgaggaggag

SEQ ID NO: 7533220 - DNA, 22 bp, Homo sapiens
caggttgggctgcgaggaggag

SEQ ID NO: 7533221 - DNA, 22 bp, Homo sapiens
caggttggggacttaggatgac

SEQ ID NO: 7533222 - DNA, 22 bp, Homo sapiens
caggttggggacttaggatgac

SEQ ID NO: 7533223 - DNA, 22 bp, Homo sapiens
caggttgggctgcgaggaggag

SEQ ID NO: 7533224 - DNA, 22 bp, Homo sapiens
caggttcttgtttcaaacagac

SEQ ID NO: 7533225 - DNA, 22 bp, Homo sapiens
caggttgggatcggttgcaatg

SEQ ID NO: 7533226 - DNA, 22 bp, Homo sapiens
caggttgaaagtggaggagcta

SEQ ID NO: 7533227 - DNA, 22 bp, Homo sapiens
caggttgggatcggttgcaatg

SEQ ID NO: 7533228 - DNA, 22 bp, Homo sapiens
caggtttctagttctaagaata

SEQ ID NO: 7533229 - DNA, 22 bp, Homo sapiens
caggtttagttccacacagctc

SEQ ID NO: 7533230 - DNA, 22 bp, Homo sapiens
caggtttcattggcagcttcat

SEQ ID NO: 7533231 - DNA, 22 bp, Homo sapiens
caggtttacaaagtaaagtgtg

SEQ ID NO: 7533232 - DNA, 22 bp, Homo sapiens
caggtttacaaagtaaagtgtg

SEQ ID NO: 7533233 - DNA, 22 bp, Homo sapiens
caggtttagttccacacagctc

SEQ ID NO: 7533234 - DNA, 22 bp, Homo sapiens
caggttggtcggcaagtacaca

SEQ ID NO: 7533235 - DNA, 22 bp, Homo sapiens
caggttggtcggcaagtacaca

SEQ ID NO: 7533236 - DNA, 22 bp, Homo sapiens
tatttcagtcacttcttctctg

SEQ ID NO: 7533237 - DNA, 22 bp, Homo sapiens
tatttcagtcacttcttctctg

SEQ ID NO: 7533238 - DNA, 22 bp, Homo sapiens
tatttcaggtatggtgtgaaat

SEQ ID NO: 7533239 - DNA, 21 bp, Homo sapiens
caggtttgctatggagcagcc

SEQ ID NO: 7533240 - DNA, 21 bp, Homo sapiens
caggtttgctatggagcagcc

SEQ ID NO: 7533241 - DNA, 22 bp, Homo sapiens
caggtttcattggcagcttcat

SEQ ID NO: 7533242 - DNA, 22 bp, Homo sapiens
cagtaaaaatgttgtcaaggca

SEQ ID NO: 7533243 - DNA, 22 bp, Homo sapiens
cagtaaaaatgttgtcaaggca

SEQ ID NO: 7533244 - DNA, 22 bp, Homo sapiens
tatttataacagtgagaacggg

SEQ ID NO: 7533245 - DNA, 22 bp, Homo sapiens
tatttataacagtgagaacggg

SEQ ID NO: 7533246 - DNA, 22 bp, Homo sapiens
tatttataacagtgagaacggg

SEQ ID NO: 7533247 - DNA, 22 bp, Homo sapiens
tatttataacagtgagaacggg

SEQ ID NO: 7533248 - DNA, 22 bp, Homo sapiens
tatttcatgtgcaccataattc

SEQ ID NO: 7533249 - DNA, 22 bp, Homo sapiens
tatttcatgtgcaccataattc

SEQ ID NO: 7533250 - DNA, 22 bp, Homo sapiens
tatttcatgtgcaccataattc

SEQ ID NO: 7533251 - DNA, 22 bp, Homo sapiens
tatttcatctggaacaaggtaa

SEQ ID NO: 7533252 - DNA, 22 bp, Homo sapiens
tatttcatctggaacaaggtaa

SEQ ID NO: 7533253 - DNA, 22 bp, Homo sapiens
tatttcatctggaacaaggtaa

SEQ ID NO: 7533254 - DNA, 22 bp, Homo sapiens
tatttcatctggaacaaggtaa

SEQ ID NO: 7533255 - DNA, 22 bp, Homo sapiens
tatttcattctttatcaggagc

SEQ ID NO: 7533256 - DNA, 22 bp, Homo sapiens
tatttcattctttatcaggagc

SEQ ID NO: 7533257 - DNA, 22 bp, Homo sapiens
tatttcattctttatcaggagc

SEQ ID NO: 7533258 - DNA, 22 bp, Homo sapiens
tatttcattctttatcaggagc

SEQ ID NO: 7533259 - DNA, 22 bp, Homo sapiens
tatttcattctttatcaggagc

SEQ ID NO: 7533260 - DNA, 22 bp, Homo sapiens
tatttccaaaaaggccatattc

SEQ ID NO: 7533261 - DNA, 22 bp, Homo sapiens
tatttccaaaaaggccatattc

SEQ ID NO: 7533262 - DNA, 22 bp, Homo sapiens
tatttccaaaaaggccatattc

SEQ ID NO: 7533263 - DNA, 22 bp, Homo sapiens
cagggtgggcacccagcctcca

SEQ ID NO: 7533264 - DNA, 22 bp, Homo sapiens
cagggtgggcacccagcctcca

SEQ ID NO: 7533265 - DNA, 22 bp, Homo sapiens
cagggtggccctgtggtctcat

SEQ ID NO: 7533266 - DNA, 22 bp, Homo sapiens
cagggtgggcacccagcctcca

SEQ ID NO: 7533267 - DNA, 22 bp, Homo sapiens
cagggtgggcacccagcctcca

SEQ ID NO: 7533268 - DNA, 22 bp, Homo sapiens
cagggtgggcacccagcctcca

SEQ ID NO: 7533269 - DNA, 22 bp, Homo sapiens
cagggtgggcacccagcctcca

SEQ ID NO: 7533270 - DNA, 22 bp, Homo sapiens
cagggtgggcacccagcctcca

SEQ ID NO: 7533271 - DNA, 22 bp, Homo sapiens
cagggtggccctgtggtctcat

SEQ ID NO: 7533272 - DNA, 22 bp, Homo sapiens
cagggtggccctgtggtctcat

SEQ ID NO: 7533273 - DNA, 22 bp, Homo sapiens
cagggtggccctgtggtctcat

SEQ ID NO: 7533274 - DNA, 22 bp, Homo sapiens
cagggtggccctgtggtctcat

SEQ ID NO: 7533275 - DNA, 22 bp, Homo sapiens
cagggtggccctgtggtctcat

SEQ ID NO: 7533276 - DNA, 22 bp, Homo sapiens
cagggtggccctgtggtctcat

SEQ ID NO: 7533277 - DNA, 22 bp, Homo sapiens
cagggtggccctgtggtctcat

SEQ ID NO: 7533278 - DNA, 22 bp, Homo sapiens
cagggtggccctgtggtctcat

SEQ ID NO: 7533279 - DNA, 22 bp, Homo sapiens
cagggtggggaaatagcgccct

SEQ ID NO: 7533280 - DNA, 22 bp, Homo sapiens
cagggtggggaaatagcgccct

SEQ ID NO: 7533281 - DNA, 22 bp, Homo sapiens
caggtggtcaggcagatgggct

SEQ ID NO: 7533282 - DNA, 22 bp, Homo sapiens
cagggtggggaaatagcgccct

SEQ ID NO: 7533283 - DNA, 22 bp, Homo sapiens
cagggtggggaaatagcgccct

SEQ ID NO: 7533284 - DNA, 22 bp, Homo sapiens
cagggtggggaaatagcgccct

SEQ ID NO: 7533285 - DNA, 22 bp, Homo sapiens
cagggtggggaaatagcgccct

SEQ ID NO: 7533286 - DNA, 22 bp, Homo sapiens
caggtgttatacatgaaattta

SEQ ID NO: 7533287 - DNA, 22 bp, Homo sapiens
caggtggtcaggcagatgggct

SEQ ID NO: 7533288 - DNA, 22 bp, Homo sapiens
caggtgtgccgggagcagtttg

SEQ ID NO: 7533289 - DNA, 22 bp, Homo sapiens
caggtgtctaattctcaccccc

SEQ ID NO: 7533290 - DNA, 22 bp, Homo sapiens
caggtgtgccgggagcagtttg

SEQ ID NO: 7533291 - DNA, 22 bp, Homo sapiens
caggtggtcaggcagatgggct

SEQ ID NO: 7533292 - DNA, 22 bp, Homo sapiens
caggttcccaggtccagggctt

SEQ ID NO: 7533293 - DNA, 22 bp, Homo sapiens
caggttcccaggtccagggctt

SEQ ID NO: 7533294 - DNA, 22 bp, Homo sapiens
caggttccagttgcagggactt

SEQ ID NO: 7533295 - DNA, 22 bp, Homo sapiens
caggttccctagcagcaaagcc

SEQ ID NO: 7533296 - DNA, 22 bp, Homo sapiens
caggttccagttgcagggactt

SEQ ID NO: 7533297 - DNA, 22 bp, Homo sapiens
caggttcccaggtccagggctt

SEQ ID NO: 7533298 - DNA, 22 bp, Homo sapiens
caggttccctagcagcaaagcc

SEQ ID NO: 7533299 - DNA, 22 bp, Homo sapiens
caggttcccttgcagctaagtg

SEQ ID NO: 7533300 - DNA, 22 bp, Homo sapiens
caggttcagcaggaggcatccc

SEQ ID NO: 7533301 - DNA, 22 bp, Homo sapiens
caggttatctggattaatatca

SEQ ID NO: 7533302 - DNA, 22 bp, Homo sapiens
caggttcagcaggaggcatccc

SEQ ID NO: 7533303 - DNA, 22 bp, Homo sapiens
caggttcagcaggaggcatccc

SEQ ID NO: 7533304 - DNA, 22 bp, Homo sapiens
caggttacaatgaaaccattaa

SEQ ID NO: 7533305 - DNA, 22 bp, Homo sapiens
caggtgttggaagggcagtggg

SEQ ID NO: 7533306 - DNA, 22 bp, Homo sapiens
caggtgttggaagggcagtggg

SEQ ID NO: 7533307 - DNA, 22 bp, Homo sapiens
caggtgttgggagaagagataa

SEQ ID NO: 7533308 - DNA, 22 bp, Homo sapiens
caggtgttgggagaagagataa

SEQ ID NO: 7533309 - DNA, 22 bp, Homo sapiens
caggtgttgtctaaagcttcag

SEQ ID NO: 7533310 - DNA, 22 bp, Homo sapiens
caggtgtttaggtttcatggat

SEQ ID NO: 7533311 - DNA, 22 bp, Homo sapiens
caggtgtttcctgaagttgatg

SEQ ID NO: 7533312 - DNA, 22 bp, Homo sapiens
caggtgtttcaaatgtgaaact

SEQ ID NO: 7533313 - DNA, 21 bp, Homo sapiens
tcatgaagcatcacttctgcc

SEQ ID NO: 7533314 - DNA, 22 bp, Homo sapiens
tcatgaacttcctagccagact

SEQ ID NO: 7533315 - DNA, 22 bp, Homo sapiens
tcatgaacatctcaaataacca

SEQ ID NO: 7533316 - DNA, 22 bp, Homo sapiens
tcatcataatatggaatcttgt

SEQ ID NO: 7533317 - DNA, 22 bp, Homo sapiens
tcatcatcactctggcaagcat

SEQ ID NO: 7533318 - DNA, 22 bp, Homo sapiens
tcatcatcattctcccccactt

SEQ ID NO: 7533319 - DNA, 22 bp, Homo sapiens
tcatcatccttttttgaagagt

SEQ ID NO: 7533320 - DNA, 22 bp, Homo sapiens
tcatcagtgtccttatcactta

SEQ ID NO: 7533321 - DNA, 22 bp, Homo sapiens
tcatcagtttagaaaaaatatg

SEQ ID NO: 7533322 - DNA, 22 bp, Homo sapiens
tcatcagtttagaaaaaatatg

SEQ ID NO: 7533323 - DNA, 22 bp, Homo sapiens
cataacacctgatggcaatgat

SEQ ID NO: 7533324 - DNA, 22 bp, Homo sapiens
cataacagtggcttcagcaagt

SEQ ID NO: 7533325 - DNA, 22 bp, Homo sapiens
cataacagtggcttcagcaagt

SEQ ID NO: 7533326 - DNA, 22 bp, Homo sapiens
cataacagtggcttcagcaagt

SEQ ID NO: 7533327 - DNA, 22 bp, Homo sapiens
tcatgaatattgaatgcttcat

SEQ ID NO: 7533328 - DNA, 22 bp, Homo sapiens
tcatgaatattgaatgcttcat

SEQ ID NO: 7533329 - DNA, 22 bp, Homo sapiens
tcatgaagtccaaactaaagca

SEQ ID NO: 7533330 - DNA, 22 bp, Homo sapiens
tcatgaagtccaaactaaagca

SEQ ID NO: 7533331 - DNA, 20 bp, Homo sapiens
tcatgaagcctacaaacatc

SEQ ID NO: 7533332 - DNA, 20 bp, Homo sapiens
tcatgaagcctacaaacatc

SEQ ID NO: 7533333 - DNA, 20 bp, Homo sapiens
tcatgaagcctacaaacatc

SEQ ID NO: 7533334 - DNA, 22 bp, Homo sapiens
tcatgacaactatattattcca

SEQ ID NO: 7533335 - DNA, 19 bp, Homo sapiens
tcatgacaaaacaggcgct

SEQ ID NO: 7533336 - DNA, 22 bp, Homo sapiens
tcatgaagtccaaactaaagca

SEQ ID NO: 7533337 - DNA, 22 bp, Homo sapiens
tcatgaatcgtggaatgattta

SEQ ID NO: 7533338 - DNA, 22 bp, Homo sapiens
tcatgaatcgtggaatgattta

SEQ ID NO: 7533339 - DNA, 22 bp, Homo sapiens
tcatgacatctgttaggtttat

SEQ ID NO: 7533340 - DNA, 22 bp, Homo sapiens
tcatgacataaacctgtggggt

SEQ ID NO: 7533341 - DNA, 22 bp, Homo sapiens
tcatgacatgtgaattgaatat

SEQ ID NO: 7533342 - DNA, 22 bp, Homo sapiens
tcatgacatctgtttatctcaa

SEQ ID NO: 7533343 - DNA, 22 bp, Homo sapiens
tcatgacatggacatgattgta

SEQ ID NO: 7533344 - DNA, 22 bp, Homo sapiens
tcatgacatggacatgattgta

SEQ ID NO: 7533345 - DNA, 22 bp, Homo sapiens
tcatgacaggtgagtttttagg

SEQ ID NO: 7533346 - DNA, 22 bp, Homo sapiens
tcatgacagaggagctggaatg

SEQ ID NO: 7533347 - DNA, 22 bp, Homo sapiens
tcatgacagccagagctctgac

SEQ ID NO: 7533348 - DNA, 22 bp, Homo sapiens
tcatgacaacttgcacagtttt

SEQ ID NO: 7533349 - DNA, 22 bp, Homo sapiens
tcatgacaatggtagcctgtta

SEQ ID NO: 7533350 - DNA, 22 bp, Homo sapiens
tcatgacactgggacaggagag

SEQ ID NO: 7533351 - DNA, 22 bp, Homo sapiens
tcatgacagaagtggtcatatt

SEQ ID NO: 7533352 - DNA, 22 bp, Homo sapiens
tcatgcaacaacacattctggc

SEQ ID NO: 7533353 - DNA, 22 bp, Homo sapiens
tcatgcaacaacacattctggc

SEQ ID NO: 7533354 - DNA, 22 bp, Homo sapiens
tcatgcaacgatcctccaaatg

SEQ ID NO: 7533355 - DNA, 22 bp, Homo sapiens
tcatgcaacgatcctccaaatg

SEQ ID NO: 7533356 - DNA, 22 bp, Homo sapiens
tcatgcaacggctcgctgagcc

SEQ ID NO: 7533357 - DNA, 22 bp, Homo sapiens
tcatgcaacggctcgctgagcc

SEQ ID NO: 7533358 - DNA, 22 bp, Homo sapiens
tcatgcaaatactgttccagaa

SEQ ID NO: 7533359 - DNA, 22 bp, Homo sapiens
tcatgcaaatactgttccagaa

SEQ ID NO: 7533360 - DNA, 22 bp, Homo sapiens
tcatgcaaatactgttccagaa

SEQ ID NO: 7533361 - DNA, 22 bp, Homo sapiens
tcatgcaaagccaattccagct

SEQ ID NO: 7533362 - DNA, 22 bp, Homo sapiens
tcatgcaaagccaattccagct

SEQ ID NO: 7533363 - DNA, 18 bp, Homo sapiens
tcatgcaaacgcttcata

SEQ ID NO: 7533364 - DNA, 18 bp, Homo sapiens
tcatgcaaacgcttcata

SEQ ID NO: 7533365 - DNA, 22 bp, Homo sapiens
tcatgcaaagccaattccagct

SEQ ID NO: 7533366 - DNA, 22 bp, Homo sapiens
tcatgcaaagccaattccagct

SEQ ID NO: 7533367 - DNA, 22 bp, Homo sapiens
tcatgcaaaagacttgaacttt

SEQ ID NO: 7533368 - DNA, 22 bp, Homo sapiens
tcatgcaaaagacttgaacttt

SEQ ID NO: 7533369 - DNA, 22 bp, Homo sapiens
tcatgcaaaagacttgaacttt

SEQ ID NO: 7533370 - DNA, 22 bp, Homo sapiens
tcatgcaaactctagtccttta

SEQ ID NO: 7533371 - DNA, 22 bp, Homo sapiens
tcatgcaaactctagtccttta

SEQ ID NO: 7533372 - DNA, 22 bp, Homo sapiens
tcatgcaaggctgaaacatggt

SEQ ID NO: 7533373 - DNA, 22 bp, Homo sapiens
tcatgcaaggctgaaacatggt

SEQ ID NO: 7533374 - DNA, 22 bp, Homo sapiens
tcatgcaaggctgaaacatggt

SEQ ID NO: 7533375 - DNA, 22 bp, Homo sapiens
tcatgcaaggctgaaacatggt

SEQ ID NO: 7533376 - DNA, 19 bp, Homo sapiens
tcatgcaatcagtgaactg

SEQ ID NO: 7533377 - DNA, 19 bp, Homo sapiens
tcatgcaatcagtgaactg

SEQ ID NO: 7533378 - DNA, 22 bp, Homo sapiens
tcatgcaagaataataggaagg

SEQ ID NO: 7533379 - DNA, 22 bp, Homo sapiens
tcatgcaagaataataggaagg

SEQ ID NO: 7533380 - DNA, 20 bp, Homo sapiens
tcatgcaagattcataaagg

SEQ ID NO: 7533381 - DNA, 20 bp, Homo sapiens
tcatgcaagattcataaagg

SEQ ID NO: 7533382 - DNA, 20 bp, Homo sapiens
tcatgcaagattcataaagg

SEQ ID NO: 7533383 - DNA, 22 bp, Homo sapiens
tcatgcaagcaggcactgggaa

SEQ ID NO: 7533384 - DNA, 22 bp, Homo sapiens
tcatgcaagcaggcactgggaa

SEQ ID NO: 7533385 - DNA, 18 bp, Homo sapiens
tcatgaggtagaggctgg

SEQ ID NO: 7533386 - DNA, 18 bp, Homo sapiens
tcatgaggtagaggctgg

SEQ ID NO: 7533387 - DNA, 22 bp, Homo sapiens
tcatgaggatttactagactag

SEQ ID NO: 7533388 - DNA, 22 bp, Homo sapiens
tcatgaggatttactagactag

SEQ ID NO: 7533389 - DNA, 22 bp, Homo sapiens
tcatgacatgtgaattgaatat

SEQ ID NO: 7533390 - DNA, 22 bp, Homo sapiens
tcatgacattcaggtgctacat

SEQ ID NO: 7533391 - DNA, 22 bp, Homo sapiens
tcatgagtctgcaaattatgga

SEQ ID NO: 7533392 - DNA, 18 bp, Homo sapiens
tcatgaggtagaggctgg

SEQ ID NO: 7533393 - DNA, 22 bp, Homo sapiens
tcatgagtggattaatatggct

SEQ ID NO: 7533394 - DNA, 22 bp, Homo sapiens
tcatgattggaatggaatatgt

SEQ ID NO: 7533395 - DNA, 22 bp, Homo sapiens
tcatgattcttctaccacagca

SEQ ID NO: 7533396 - DNA, 22 bp, Homo sapiens
tcatgatttttctttacagttg

SEQ ID NO: 7533397 - DNA, 22 bp, Homo sapiens
tcatgattaacatttccaagca

SEQ ID NO: 7533398 - DNA, 22 bp, Homo sapiens
tcatgagtttaaggtttaggct

SEQ ID NO: 7533399 - DNA, 22 bp, Homo sapiens
tcatgataatacaggccttcta

SEQ ID NO: 7533400 - DNA, 22 bp, Homo sapiens
tcatgatacccaagtacctaga

SEQ ID NO: 7533401 - DNA, 22 bp, Homo sapiens
tcatgatacccaagtacctaga

SEQ ID NO: 7533402 - DNA, 22 bp, Homo sapiens
tcatgcactatagtgtttgaca

SEQ ID NO: 7533403 - DNA, 22 bp, Homo sapiens
tcatgcactatagtgtttgaca

SEQ ID NO: 7533404 - DNA, 22 bp, Homo sapiens
tcatgcactacataacgatgtt

SEQ ID NO: 7533405 - DNA, 19 bp, Homo sapiens
tcatgcactttgatgtaac

SEQ ID NO: 7533406 - DNA, 22 bp, Homo sapiens
tcatgcacagctcttagcacca

SEQ ID NO: 7533407 - DNA, 22 bp, Homo sapiens
tcatgcacatgtgtcaccatca

SEQ ID NO: 7533408 - DNA, 22 bp, Homo sapiens
tcatgcacctctccatgtcccc

SEQ ID NO: 7533409 - DNA, 22 bp, Homo sapiens
tcatgcacctctccatgtcccc

SEQ ID NO: 7533410 - DNA, 22 bp, Homo sapiens
tcatgcaatctcttgttcagga

SEQ ID NO: 7533411 - DNA, 22 bp, Homo sapiens
tcatgcaatctcttgttcagga

SEQ ID NO: 7533412 - DNA, 22 bp, Homo sapiens
tcatgcaatgttagtttgaaag

SEQ ID NO: 7533413 - DNA, 22 bp, Homo sapiens
tcatgcaatgttagtttgaaag

SEQ ID NO: 7533414 - DNA, 22 bp, Homo sapiens
tcatgcaatctcttgttcagga

SEQ ID NO: 7533415 - DNA, 22 bp, Homo sapiens
tcatgcaatgagtcaggaggca

SEQ ID NO: 7533416 - DNA, 22 bp, Homo sapiens
tcatgcaatgagtcaggaggca

SEQ ID NO: 7533417 - DNA, 22 bp, Homo sapiens
tcatgcaatgagtcaggaggca

SEQ ID NO: 7533418 - DNA, 22 bp, Homo sapiens
catctttggagaaacttccgtt

SEQ ID NO: 7533419 - DNA, 20 bp, Homo sapiens
catctttggcaggactcctt

SEQ ID NO: 7533420 - DNA, 22 bp, Homo sapiens
catctttggagaaacttccgtt

SEQ ID NO: 7533421 - DNA, 19 bp, Homo sapiens
catctttggtcacctagtc

SEQ ID NO: 7533422 - DNA, 19 bp, Homo sapiens
catctttggtcacctagtc

SEQ ID NO: 7533423 - DNA, 22 bp, Homo sapiens
catctttgggctgcatggaagg

SEQ ID NO: 7533424 - DNA, 19 bp, Homo sapiens
catctttggtcacctagtc

SEQ ID NO: 7533425 - DNA, 19 bp, Homo sapiens
catctttggtcacctagtc

SEQ ID NO: 7533426 - DNA, 19 bp, Homo sapiens
tcatgcactttgatgtaac

SEQ ID NO: 7533427 - DNA, 22 bp, Homo sapiens
catctttgtaacttccacataa

SEQ ID NO: 7533428 - DNA, 22 bp, Homo sapiens
catctttgtaacttccacataa

SEQ ID NO: 7533429 - DNA, 22 bp, Homo sapiens
catctttgtaacttccacataa

SEQ ID NO: 7533430 - DNA, 22 bp, Homo sapiens
catctttggttttctatatgcc

SEQ ID NO: 7533431 - DNA, 22 bp, Homo sapiens
catctttggttttctatatgcc

SEQ ID NO: 7533432 - DNA, 22 bp, Homo sapiens
catctttgttctgtaaactttt

SEQ ID NO: 7533433 - DNA, 22 bp, Homo sapiens
catctttgttctgtaaactttt

SEQ ID NO: 7533434 - DNA, 22 bp, Homo sapiens
catctttgttctgtaaactttt

SEQ ID NO: 7533435 - DNA, 22 bp, Homo sapiens
catctttgtaacttccacataa

SEQ ID NO: 7533436 - DNA, 22 bp, Homo sapiens
catctttgttctgtaaactttt

SEQ ID NO: 7533437 - DNA, 22 bp, Homo sapiens
catctttgttttggatataatc

SEQ ID NO: 7533438 - DNA, 22 bp, Homo sapiens
catctttgtttcatctgtccag

SEQ ID NO: 7533439 - DNA, 22 bp, Homo sapiens
catctttgttttggatataatc

SEQ ID NO: 7533440 - DNA, 22 bp, Homo sapiens
catcttttggcctattctgagg

SEQ ID NO: 7533441 - DNA, 22 bp, Homo sapiens
catcttttggcctattctgagg

SEQ ID NO: 7533442 - DNA, 22 bp, Homo sapiens
catcttttggcctattctgagg

SEQ ID NO: 7533443 - DNA, 22 bp, Homo sapiens
catcttttcagaagccattctg

SEQ ID NO: 7533444 - DNA, 22 bp, Homo sapiens
catctttgttttggatataatc

SEQ ID NO: 7533445 - DNA, 22 bp, Homo sapiens
catcttttcagaagccattctg

SEQ ID NO: 7533446 - DNA, 22 bp, Homo sapiens
catcttttcagaagccattctg

SEQ ID NO: 7533447 - DNA, 22 bp, Homo sapiens
catgaaaaatttactgttaaca

SEQ ID NO: 7533448 - DNA, 22 bp, Homo sapiens
catgaaaaatttactgttaaca

SEQ ID NO: 7533449 - DNA, 19 bp, Homo sapiens
tcatgtctctcatctgtga

SEQ ID NO: 7533450 - DNA, 22 bp, Homo sapiens
tcatgtctgggagcagactcca

SEQ ID NO: 7533451 - DNA, 22 bp, Homo sapiens
tcatgtctgggagcagactcca

SEQ ID NO: 7533452 - DNA, 22 bp, Homo sapiens
tcatgtcttctgtgatgtccaa

SEQ ID NO: 7533453 - DNA, 22 bp, Homo sapiens
tcatgtcttctgtgatgtccaa

SEQ ID NO: 7533454 - DNA, 22 bp, Homo sapiens
catgaaaaatttactgttaaca

SEQ ID NO: 7533455 - DNA, 22 bp, Homo sapiens
catgaaaaatttactgttaaca

SEQ ID NO: 7533456 - DNA, 22 bp, Homo sapiens
catgaaaaatttactgttaaca

SEQ ID NO: 7533457 - DNA, 22 bp, Homo sapiens
catgaaaaatttactgttaaca

SEQ ID NO: 7533458 - DNA, 22 bp, Homo sapiens
catgaaaaatttactgttaaca

SEQ ID NO: 7533459 - DNA, 22 bp, Homo sapiens
catcttttggcctattctgagg

SEQ ID NO: 7533460 - DNA, 22 bp, Homo sapiens
catcttttggcctattctgagg

SEQ ID NO: 7533461 - DNA, 22 bp, Homo sapiens
catgaaaaatttactgttaaca

SEQ ID NO: 7533462 - DNA, 22 bp, Homo sapiens
tcattcattcatccagcttgag

SEQ ID NO: 7533463 - DNA, 20 bp, Homo sapiens
tcattccaaatagttcagca

SEQ ID NO: 7533464 - DNA, 20 bp, Homo sapiens
tcattccaaatagttcagca

SEQ ID NO: 7533465 - DNA, 23 bp, Homo sapiens
tcattccacaaatacttatctag

SEQ ID NO: 7533466 - DNA, 22 bp, Homo sapiens
tcattcatgaggtgctagtgct

SEQ ID NO: 7533467 - DNA, 22 bp, Homo sapiens
tcattcatgaggtgctagtgct

SEQ ID NO: 7533468 - DNA, 22 bp, Homo sapiens
tcattcatctggtgttagtcct

SEQ ID NO: 7533469 - DNA, 22 bp, Homo sapiens
tcattcatcagttggtagagat

SEQ ID NO: 7533470 - DNA, 22 bp, Homo sapiens
tcatgtgacaggcactgttctg

SEQ ID NO: 7533471 - DNA, 22 bp, Homo sapiens
tcatgtggcaaatatttctgag

SEQ ID NO: 7533472 - DNA, 22 bp, Homo sapiens
tcatttatgcaggaatggcata

SEQ ID NO: 7533473 - DNA, 22 bp, Homo sapiens
tcatttatgcaggaatggcata

SEQ ID NO: 7533474 - DNA, 22 bp, Homo sapiens
tcatttatgcaggaatggcata

SEQ ID NO: 7533475 - DNA, 22 bp, Homo sapiens
tcatttatgcaggaatggcata

SEQ ID NO: 7533476 - DNA, 22 bp, Homo sapiens
tcatttatgcaggaatggcata

SEQ ID NO: 7533477 - DNA, 22 bp, Homo sapiens
tcatttatgcaggaatggcata

SEQ ID NO: 7533478 - DNA, 22 bp, Homo sapiens
tcatttatgcaggaatggcata

SEQ ID NO: 7533479 - DNA, 19 bp, Homo sapiens
tcattgaacataattactt

SEQ ID NO: 7533480 - DNA, 22 bp, Homo sapiens
tcatttatcgctgccttttaaa

SEQ ID NO: 7533481 - DNA, 22 bp, Homo sapiens
tcatttatcgctgccttttaaa

SEQ ID NO: 7533482 - DNA, 22 bp, Homo sapiens
tcatttatcgctgccttttaaa

SEQ ID NO: 7533483 - DNA, 22 bp, Homo sapiens
tcatttatcgctgccttttaaa

SEQ ID NO: 7533484 - DNA, 22 bp, Homo sapiens
tcatttatcgctgccttttaaa

SEQ ID NO: 7533485 - DNA, 22 bp, Homo sapiens
tcatttatcgctgccttttaaa

SEQ ID NO: 7533486 - DNA, 22 bp, Homo sapiens
tcatttatgtctttgccatcca

SEQ ID NO: 7533487 - DNA, 22 bp, Homo sapiens
tcatttatgtctttgccatcca

SEQ ID NO: 7533488 - DNA, 22 bp, Homo sapiens
tcatttatgtctttgccatcca

SEQ ID NO: 7533489 - DNA, 22 bp, Homo sapiens
tcatttatgtctttgccatcca

SEQ ID NO: 7533490 - DNA, 22 bp, Homo sapiens
tcatttatgcaggaatggcata

SEQ ID NO: 7533491 - DNA, 21 bp, Homo sapiens
tcatttattgagaaatgactg

SEQ ID NO: 7533492 - DNA, 21 bp, Homo sapiens
tcatttattgagaaatgactg

SEQ ID NO: 7533493 - DNA, 21 bp, Homo sapiens
tcatttattgagaaatgactg

SEQ ID NO: 7533494 - DNA, 21 bp, Homo sapiens
tcatttattgagaaatgactg

SEQ ID NO: 7533495 - DNA, 22 bp, Homo sapiens
tcatttatgtctttgccatcca

SEQ ID NO: 7533496 - DNA, 21 bp, Homo sapiens
tcatttattgagaaatgactg

SEQ ID NO: 7533497 - DNA, 21 bp, Homo sapiens
tcatttattgagaaatgactg

SEQ ID NO: 7533498 - DNA, 21 bp, Homo sapiens
tcatttattgagaaatgactg

SEQ ID NO: 7533499 - DNA, 21 bp, Homo sapiens
tcatttattgagaaatgactg

SEQ ID NO: 7533500 - DNA, 21 bp, Homo sapiens
tcatttattgagaaatgactg

SEQ ID NO: 7533501 - DNA, 21 bp, Homo sapiens
tcatttattgagaaatgactg

SEQ ID NO: 7533502 - DNA, 21 bp, Homo sapiens
tcatttattgagaaatgactg

SEQ ID NO: 7533503 - DNA, 21 bp, Homo sapiens
tcatttattgagaaatgactg

SEQ ID NO: 7533504 - DNA, 22 bp, Homo sapiens
tcattctggatgactttctaga

SEQ ID NO: 7533505 - DNA, 22 bp, Homo sapiens
tcattctgcatcactcttgctc

SEQ ID NO: 7533506 - DNA, 22 bp, Homo sapiens
tcattctctgggatgcagtttg

SEQ ID NO: 7533507 - DNA, 22 bp, Homo sapiens
tcattctgcatcactcttgctc

SEQ ID NO: 7533508 - DNA, 22 bp, Homo sapiens
tcattgaaaactcagcatctac

SEQ ID NO: 7533509 - DNA, 22 bp, Homo sapiens
tcattgaaaactcagcatctac

SEQ ID NO: 7533510 - DNA, 22 bp, Homo sapiens
tcattgaaagtgcctcctcgga

SEQ ID NO: 7533511 - DNA, 22 bp, Homo sapiens
tcattctttaccaagttgtcac

SEQ ID NO: 7533512 - DNA, 22 bp, Homo sapiens
tcattctttaccaagttgtcac

SEQ ID NO: 7533513 - DNA, 22 bp, Homo sapiens
tcattcttgcgtatgccatggt

SEQ ID NO: 7533514 - DNA, 22 bp, Homo sapiens
tcattctcagactcttggcctc

SEQ ID NO: 7533515 - DNA, 22 bp, Homo sapiens
tcattcggcaatagtgtgttag

SEQ ID NO: 7533516 - DNA, 22 bp, Homo sapiens
tcattctctgggatgcagtttg

SEQ ID NO: 7533517 - DNA, 22 bp, Homo sapiens
tcattcctttacagttgatcct

SEQ ID NO: 7533518 - DNA, 22 bp, Homo sapiens
tcattccttatccgtatctttt

SEQ ID NO: 7533519 - DNA, 22 bp, Homo sapiens
tcattccttatccgtatctttt

SEQ ID NO: 7533520 - DNA, 22 bp, Homo sapiens
tcattctcagactcttggcctc

SEQ ID NO: 7533521 - DNA, 22 bp, Homo sapiens
tcattcctttacagttgatcct

SEQ ID NO: 7533522 - DNA, 22 bp, Homo sapiens
tcattcctccagcgggagtcca

SEQ ID NO: 7533523 - DNA, 22 bp, Homo sapiens
tcattcctccagcgggagtcca

SEQ ID NO: 7533524 - DNA, 22 bp, Homo sapiens
tcattcctcaggaagggattta

SEQ ID NO: 7533525 - DNA, 22 bp, Homo sapiens
tcattcctcaggaagggattta

SEQ ID NO: 7533526 - DNA, 22 bp, Homo sapiens
tcattccttaacattcatttgc

SEQ ID NO: 7533527 - DNA, 22 bp, Homo sapiens
tcattcctccagcgggagtcca

SEQ ID NO: 7533528 - DNA, 22 bp, Homo sapiens
tcattccttaacattcatttgc

SEQ ID NO: 7533529 - DNA, 22 bp, Homo sapiens
tcattccatttccagctctgaa

SEQ ID NO: 7533530 - DNA, 22 bp, Homo sapiens
tcattccatttccagctctgaa

SEQ ID NO: 7533531 - DNA, 22 bp, Homo sapiens
tcattccctcattgttcactgg

SEQ ID NO: 7533532 - DNA, 22 bp, Homo sapiens
tcattccctccagctgtggcta

SEQ ID NO: 7533533 - DNA, 22 bp, Homo sapiens
tccacatggctgggaggcctca

SEQ ID NO: 7533534 - DNA, 22 bp, Homo sapiens
tccacatgacttctaataactg

SEQ ID NO: 7533535 - DNA, 22 bp, Homo sapiens
tccacattagaatgttttctca

SEQ ID NO: 7533536 - DNA, 22 bp, Homo sapiens
tccacattatgtttctcctttc

SEQ ID NO: 7533537 - DNA, 22 bp, Homo sapiens
tccacattatgtttctcctttc

SEQ ID NO: 7533538 - DNA, 22 bp, Homo sapiens
tccacattatgtttctcctttc

SEQ ID NO: 7533539 - DNA, 22 bp, Homo sapiens
tccacatgaccattgtgctcct

SEQ ID NO: 7533540 - DNA, 22 bp, Homo sapiens
tccacatgacttctaataactg

SEQ ID NO: 7533541 - DNA, 22 bp, Homo sapiens
tccacatctctcgccaaccaat

SEQ ID NO: 7533542 - DNA, 20 bp, Homo sapiens
tccacatcttttgagatgtg

SEQ ID NO: 7533543 - DNA, 22 bp, Homo sapiens
tccacatgaccattgtgctcct

SEQ ID NO: 7533544 - DNA, 22 bp, Homo sapiens
tccacattctctgttacagata

SEQ ID NO: 7533545 - DNA, 22 bp, Homo sapiens
tccagaccaaggaaggctgggc

SEQ ID NO: 7533546 - DNA, 22 bp, Homo sapiens
tccagaccatggatggctgcaa

SEQ ID NO: 7533547 - DNA, 22 bp, Homo sapiens
tccagaccatggatggctgcaa

SEQ ID NO: 7533548 - DNA, 22 bp, Homo sapiens
tccacatagtcattaatttctg

SEQ ID NO: 7533549 - DNA, 22 bp, Homo sapiens
tccacatcaagggcagagaggt

SEQ ID NO: 7533550 - DNA, 22 bp, Homo sapiens
tccacatagagcttagaagcaa

SEQ ID NO: 7533551 - DNA, 22 bp, Homo sapiens
tccacatcaagggcagagaggt

SEQ ID NO: 7533552 - DNA, 14 bp, Homo sapiens
tccacatcagcagt

SEQ ID NO: 7533553 - DNA, 22 bp, Homo sapiens
tccacatccattgcttgacttt

SEQ ID NO: 7533554 - DNA, 22 bp, Homo sapiens
tccacatccattgcttgacttt

SEQ ID NO: 7533555 - DNA, 22 bp, Homo sapiens
tccacatctaggtttgtcaaca

SEQ ID NO: 7533556 - DNA, 22 bp, Homo sapiens
tccacatctctcgccaaccaat

SEQ ID NO: 7533557 - DNA, 22 bp, Homo sapiens
tccacagtggttgaactagtaa

SEQ ID NO: 7533558 - DNA, 22 bp, Homo sapiens
tccacagtggttgaactagtaa

SEQ ID NO: 7533559 - DNA, 22 bp, Homo sapiens
tccacagtggtggaattgttca

SEQ ID NO: 7533560 - DNA, 19 bp, Homo sapiens
tccacagtggttgaactag

SEQ ID NO: 7533561 - DNA, 22 bp, Homo sapiens
tccacagtggttgaactagttt

SEQ ID NO: 7533562 - DNA, 22 bp, Homo sapiens
tccacagtggttgaactagttt

SEQ ID NO: 7533563 - DNA, 22 bp, Homo sapiens
tccacagtggttgaactagtaa

SEQ ID NO: 7533564 - DNA, 22 bp, Homo sapiens
tccacagtggttgaactagttt

SEQ ID NO: 7533565 - DNA, 22 bp, Homo sapiens
tccacagttttgccactagctg

SEQ ID NO: 7533566 - DNA, 22 bp, Homo sapiens
tccacagttttgccactagctg

SEQ ID NO: 7533567 - DNA, 22 bp, Homo sapiens
tccacagttttgccactagctg

SEQ ID NO: 7533568 - DNA, 22 bp, Homo sapiens
tccacatagagcttagaagcaa

SEQ ID NO: 7533569 - DNA, 22 bp, Homo sapiens
tccacaggtcctctttgcaaag

SEQ ID NO: 7533570 - DNA, 22 bp, Homo sapiens
tccacaggtcctctttgcaaag

SEQ ID NO: 7533571 - DNA, 22 bp, Homo sapiens
tccacaggtccggcatgaacag

SEQ ID NO: 7533572 - DNA, 22 bp, Homo sapiens
tccacaggtccggcatgaacag

SEQ ID NO: 7533573 - DNA, 22 bp, Homo sapiens
tccacaggtccggcatgaacag

SEQ ID NO: 7533574 - DNA, 22 bp, Homo sapiens
tccacaggtcagggagataggc

SEQ ID NO: 7533575 - DNA, 22 bp, Homo sapiens
tccacaggtcagggagataggc

SEQ ID NO: 7533576 - DNA, 22 bp, Homo sapiens
tccacaggtccggcatgaacag

SEQ ID NO: 7533577 - DNA, 22 bp, Homo sapiens
tccacaggtccggcatgaacag

SEQ ID NO: 7533578 - DNA, 22 bp, Homo sapiens
tccacaggtcctctttgcaaag

SEQ ID NO: 7533579 - DNA, 22 bp, Homo sapiens
tccacagtctatttttagtcta

SEQ ID NO: 7533580 - DNA, 22 bp, Homo sapiens
tccacagtggtggaattgttca

SEQ ID NO: 7533581 - DNA, 22 bp, Homo sapiens
tccacagtctatttttagtcta

SEQ ID NO: 7533582 - DNA, 22 bp, Homo sapiens
tccacaggtatgaggccccacc

SEQ ID NO: 7533583 - DNA, 22 bp, Homo sapiens
tccacagggcctttctggtgtg

SEQ ID NO: 7533584 - DNA, 22 bp, Homo sapiens
tccacaggtatgaggccccacc

SEQ ID NO: 7533585 - DNA, 22 bp, Homo sapiens
tccacaggtatgaggccccacc

SEQ ID NO: 7533586 - DNA, 22 bp, Homo sapiens
tccacaggtatgaggccccacc

SEQ ID NO: 7533587 - DNA, 22 bp, Homo sapiens
tccacaggtatgaggccccacc

SEQ ID NO: 7533588 - DNA, 22 bp, Homo sapiens
tccacaggtcagggagataggc

SEQ ID NO: 7533589 - DNA, 22 bp, Homo sapiens
tccacaggtatttctccttgct

SEQ ID NO: 7533590 - DNA, 22 bp, Homo sapiens
tccacaggtatttctccttgct

SEQ ID NO: 7533591 - DNA, 22 bp, Homo sapiens
tccacaggtatttctccttgct

SEQ ID NO: 7533592 - DNA, 22 bp, Homo sapiens
tccacaggtatttctccttgct

SEQ ID NO: 7533593 - DNA, 22 bp, Homo sapiens
tccacaggtatttctccttgct

SEQ ID NO: 7533594 - DNA, 22 bp, Homo sapiens
tcatttatttgactttggagtg

SEQ ID NO: 7533595 - DNA, 22 bp, Homo sapiens
tcatttatttgactttggagtg

SEQ ID NO: 7533596 - DNA, 22 bp, Homo sapiens
tcatttatttgactttggagtg

SEQ ID NO: 7533597 - DNA, 17 bp, Homo sapiens
tccaagccagcttgcct

SEQ ID NO: 7533598 - DNA, 22 bp, Homo sapiens
tcatttatttgactttggagtg

SEQ ID NO: 7533599 - DNA, 22 bp, Homo sapiens
tcatttatttgactttggagtg

SEQ ID NO: 7533600 - DNA, 22 bp, Homo sapiens
tcatttatttataccattgcct

SEQ ID NO: 7533601 - DNA, 22 bp, Homo sapiens
tcatttatttataccattgcct

SEQ ID NO: 7533602 - DNA, 22 bp, Homo sapiens
tcatttatttataccattgcct

SEQ ID NO: 7533603 - DNA, 21 bp, Homo sapiens
tccaagccttcaacacattca

SEQ ID NO: 7533604 - DNA, 22 bp, Homo sapiens
tccacagggcctttctggtgtg

SEQ ID NO: 7533605 - DNA, 22 bp, Homo sapiens
tccacagggcctttctggtgtg

SEQ ID NO: 7533606 - DNA, 22 bp, Homo sapiens
tccacagggcctttctggtgtg

SEQ ID NO: 7533607 - DNA, 22 bp, Homo sapiens
catgtgtgtggacgagcgtggc

SEQ ID NO: 7533608 - DNA, 22 bp, Homo sapiens
catgtgtgtggacgagcgtggc

SEQ ID NO: 7533609 - DNA, 22 bp, Homo sapiens
catgtgtgtgagggaaacatgt

SEQ ID NO: 7533610 - DNA, 22 bp, Homo sapiens
catgtgtgtggacgagcgtggc

SEQ ID NO: 7533611 - DNA, 22 bp, Homo sapiens
catgtgtgtctccaccagctgc

SEQ ID NO: 7533612 - DNA, 22 bp, Homo sapiens
catgtgtgtctccaccagctgc

SEQ ID NO: 7533613 - DNA, 22 bp, Homo sapiens
catgtgtgtccatgtgactaag

SEQ ID NO: 7533614 - DNA, 21 bp, Homo sapiens
catgtgtcattggagagcaat

SEQ ID NO: 7533615 - DNA, 21 bp, Homo sapiens
catgtgtcattggagagcaat

SEQ ID NO: 7533616 - DNA, 22 bp, Homo sapiens
catgtgttgtctcatttaatcc

SEQ ID NO: 7533617 - DNA, 22 bp, Homo sapiens
catgtgttaatctttctgcaaa

SEQ ID NO: 7533618 - DNA, 18 bp, Homo sapiens
catgtgttctacatcagt

SEQ ID NO: 7533619 - DNA, 23 bp, Homo sapiens
catgtgtgtgtgaagaaggcgac

SEQ ID NO: 7533620 - DNA, 22 bp, Homo sapiens
catgtgtgtggctgacaatttt

SEQ ID NO: 7533621 - DNA, 22 bp, Homo sapiens
catgtgtgtggctgacaatttt

SEQ ID NO: 7533622 - DNA, 23 bp, Homo sapiens
catgtgtgtgtgaagaaggcgac

SEQ ID NO: 7533623 - DNA, 22 bp, Homo sapiens
catgttaaaatatacattctga

SEQ ID NO: 7533624 - DNA, 22 bp, Homo sapiens
catgtgtttcgagactgttgag

SEQ ID NO: 7533625 - DNA, 22 bp, Homo sapiens
catgtgttttgtcatttcaata

SEQ ID NO: 7533626 - DNA, 22 bp, Homo sapiens
catgtgttttgtcatttcaata

SEQ ID NO: 7533627 - DNA, 22 bp, Homo sapiens
catgttaaattgagtttgcaat

SEQ ID NO: 7533628 - DNA, 22 bp, Homo sapiens
catgttaaattgagtttgcaat

SEQ ID NO: 7533629 - DNA, 22 bp, Homo sapiens
catgttaaattgagtttgcaat

SEQ ID NO: 7533630 - DNA, 22 bp, Homo sapiens
catgttaaaatatacattctga

SEQ ID NO: 7533631 - DNA, 18 bp, Homo sapiens
tccaggctccaggctaac

SEQ ID NO: 7533632 - DNA, 22 bp, Homo sapiens
tccaggctcagtcaagcacttc

SEQ ID NO: 7533633 - DNA, 18 bp, Homo sapiens
tccaggctccaggctaac

SEQ ID NO: 7533634 - DNA, 22 bp, Homo sapiens
tccaggctcagtcaagcacttc

SEQ ID NO: 7533635 - DNA, 18 bp, Homo sapiens
tccaggctccaggctaac

SEQ ID NO: 7533636 - DNA, 18 bp, Homo sapiens
tccaggctccaggctaac

SEQ ID NO: 7533637 - DNA, 18 bp, Homo sapiens
tccaggctccaggctaac

SEQ ID NO: 7533638 - DNA, 18 bp, Homo sapiens
tccaggctccaggctaac

SEQ ID NO: 7533639 - DNA, 18 bp, Homo sapiens
tccaggctccaggctaac

SEQ ID NO: 7533640 - DNA, 19 bp, Homo sapiens
tccaggctccattggcaga

SEQ ID NO: 7533641 - DNA, 19 bp, Homo sapiens
tccaggctccattggcaga

SEQ ID NO: 7533642 - DNA, 19 bp, Homo sapiens
tccaggctccattggcaga

SEQ ID NO: 7533643 - DNA, 19 bp, Homo sapiens
tccaggctccattggcaga

SEQ ID NO: 7533644 - DNA, 19 bp, Homo sapiens
tccaggctccattggcaga

SEQ ID NO: 7533645 - DNA, 22 bp, Homo sapiens
tccaggctcccctgcgtgctcc

SEQ ID NO: 7533646 - DNA, 22 bp, Homo sapiens
tccaggctcccctgcgtgctcc

SEQ ID NO: 7533647 - DNA, 22 bp, Homo sapiens
tccaggctcccctgcgtgctcc

SEQ ID NO: 7533648 - DNA, 22 bp, Homo sapiens
tccaggctcccctgcgtgctcc

SEQ ID NO: 7533649 - DNA, 22 bp, Homo sapiens
tccaggctcccctgcgtgctcc

SEQ ID NO: 7533650 - DNA, 19 bp, Homo sapiens
tccaggctccattggcaga

SEQ ID NO: 7533651 - DNA, 22 bp, Homo sapiens
tccaggctcccctgcgtgctcc

SEQ ID NO: 7533652 - DNA, 22 bp, Homo sapiens
tccaggctcccctgcgtgctcc

SEQ ID NO: 7533653 - DNA, 22 bp, Homo sapiens
tccaggctccctcaggatgcac

SEQ ID NO: 7533654 - DNA, 22 bp, Homo sapiens
tccaggctccctcaggatgcac

SEQ ID NO: 7533655 - DNA, 22 bp, Homo sapiens
tccaggctccctcaggatgcac

SEQ ID NO: 7533656 - DNA, 22 bp, Homo sapiens
tccaggctccctcaggatgcac

SEQ ID NO: 7533657 - DNA, 22 bp, Homo sapiens
tccaggctccctcaggatgcac

SEQ ID NO: 7533658 - DNA, 22 bp, Homo sapiens
tccaggctcccctgcgtgctcc

SEQ ID NO: 7533659 - DNA, 22 bp, Homo sapiens
tccaggctcccctgcgtgctcc

SEQ ID NO: 7533660 - DNA, 22 bp, Homo sapiens
tccaggctccctcaggatgcac

SEQ ID NO: 7533661 - DNA, 22 bp, Homo sapiens
tccaggctccctcaggatgcac

SEQ ID NO: 7533662 - DNA, 22 bp, Homo sapiens
tccaggctccctcaggatgcac

SEQ ID NO: 7533663 - DNA, 20 bp, Homo sapiens
tccaggctcctccacttagt

SEQ ID NO: 7533664 - DNA, 20 bp, Homo sapiens
tccaggctcctccacttagt

SEQ ID NO: 7533665 - DNA, 20 bp, Homo sapiens
tccaggctcctccacttagt

SEQ ID NO: 7533666 - DNA, 22 bp, Homo sapiens
tccaggccccactgaagcccct

SEQ ID NO: 7533667 - DNA, 22 bp, Homo sapiens
tccaggccccactgaagcccct

SEQ ID NO: 7533668 - DNA, 22 bp, Homo sapiens
tccaggccccactgaagcccct

SEQ ID NO: 7533669 - DNA, 22 bp, Homo sapiens
tccaggccccactgaagcccct

SEQ ID NO: 7533670 - DNA, 22 bp, Homo sapiens
tccaggcccatggagcagagct

SEQ ID NO: 7533671 - DNA, 22 bp, Homo sapiens
tccaggcccatggagcagagct

SEQ ID NO: 7533672 - DNA, 22 bp, Homo sapiens
tccaggcccatggagcagagct

SEQ ID NO: 7533673 - DNA, 22 bp, Homo sapiens
tccaggcccatggagcagagct

SEQ ID NO: 7533674 - DNA, 22 bp, Homo sapiens
tccaggcccatagacacttctc

SEQ ID NO: 7533675 - DNA, 20 bp, Homo sapiens
tccaggcagctcagagtgtc

SEQ ID NO: 7533676 - DNA, 20 bp, Homo sapiens
tccaggcagctcagagtgtc

SEQ ID NO: 7533677 - DNA, 22 bp, Homo sapiens
tccaggcccatggagcagagct

SEQ ID NO: 7533678 - DNA, 22 bp, Homo sapiens
tccaggcccatggagcagagct

SEQ ID NO: 7533679 - DNA, 22 bp, Homo sapiens
tccaggcccatggagcagagct

SEQ ID NO: 7533680 - DNA, 22 bp, Homo sapiens
tccaggcccatggagcagagct

SEQ ID NO: 7533681 - DNA, 20 bp, Homo sapiens
tccaggcagctcagagtgtc

SEQ ID NO: 7533682 - DNA, 20 bp, Homo sapiens
tccaggcagctcagagtgtc

SEQ ID NO: 7533683 - DNA, 20 bp, Homo sapiens
tccaggcagctcagagtgtc

SEQ ID NO: 7533684 - DNA, 20 bp, Homo sapiens
tccaggcagctcagagtgtc

SEQ ID NO: 7533685 - DNA, 20 bp, Homo sapiens
tccaggcagctcagagtgtc

SEQ ID NO: 7533686 - DNA, 20 bp, Homo sapiens
tccagctgggaacagctgat

SEQ ID NO: 7533687 - DNA, 22 bp, Homo sapiens
tccaggcagcccttcctgactc

SEQ ID NO: 7533688 - DNA, 22 bp, Homo sapiens
tccaggcagcccttcctgactc

SEQ ID NO: 7533689 - DNA, 22 bp, Homo sapiens
tccaggcagcccttcctgactc

SEQ ID NO: 7533690 - DNA, 20 bp, Homo sapiens
tccagctgggaacagctgat

SEQ ID NO: 7533691 - DNA, 20 bp, Homo sapiens
tccagctgggaacagctgat

SEQ ID NO: 7533692 - DNA, 22 bp, Homo sapiens
tccagctggcttcggaagtgga

SEQ ID NO: 7533693 - DNA, 22 bp, Homo sapiens
tccagctggcttcggaagtgga

SEQ ID NO: 7533694 - DNA, 22 bp, Homo sapiens
tccagctggcttcggaagtgga

SEQ ID NO: 7533695 - DNA, 22 bp, Homo sapiens
tccagctggcctaacttcaggg

SEQ ID NO: 7533696 - DNA, 22 bp, Homo sapiens
tccagctggcctaacttcaggg

SEQ ID NO: 7533697 - DNA, 22 bp, Homo sapiens
tccagctggcccggccatgaat

SEQ ID NO: 7533698 - DNA, 22 bp, Homo sapiens
tccagctggcccggccatgaat

SEQ ID NO: 7533699 - DNA, 22 bp, Homo sapiens
tccagctggcccggccatgaat

SEQ ID NO: 7533700 - DNA, 22 bp, Homo sapiens
tccagctggcccggccatgaat

SEQ ID NO: 7533701 - DNA, 22 bp, Homo sapiens
tccagctggcctaacttcaggg

SEQ ID NO: 7533702 - DNA, 22 bp, Homo sapiens
tccaggccccactgaagcccct

SEQ ID NO: 7533703 - DNA, 22 bp, Homo sapiens
tccaggccccagaccgtactgc

SEQ ID NO: 7533704 - DNA, 22 bp, Homo sapiens
tccaggccccagaccgtactgc

SEQ ID NO: 7533705 - DNA, 22 bp, Homo sapiens
tccaggccccagaccgtactgc

SEQ ID NO: 7533706 - DNA, 22 bp, Homo sapiens
tccaggccccagaccgtactgc

SEQ ID NO: 7533707 - DNA, 22 bp, Homo sapiens
tccaggccccagaccgtactgc

SEQ ID NO: 7533708 - DNA, 22 bp, Homo sapiens
tccaggccccccacgctaatgg

SEQ ID NO: 7533709 - DNA, 22 bp, Homo sapiens
tccaggccccagcaccttggga

SEQ ID NO: 7533710 - DNA, 22 bp, Homo sapiens
tccaggccccccacgctaatgg

SEQ ID NO: 7533711 - DNA, 22 bp, Homo sapiens
tccaggccccccacgctaatgg

SEQ ID NO: 7533712 - DNA, 22 bp, Homo sapiens
tccaggccccagcaccttggga

SEQ ID NO: 7533713 - DNA, 22 bp, Homo sapiens
tccaggccccagcaccttggga

SEQ ID NO: 7533714 - DNA, 22 bp, Homo sapiens
tccaggccccagcaccttggga

SEQ ID NO: 7533715 - DNA, 22 bp, Homo sapiens
tccaggcccgagatgggctgga

SEQ ID NO: 7533716 - DNA, 22 bp, Homo sapiens
tccaggcccctgcctgggcctg

SEQ ID NO: 7533717 - DNA, 22 bp, Homo sapiens
tccaggcccctgcctgggcctg

SEQ ID NO: 7533718 - DNA, 22 bp, Homo sapiens
tccaggcccctgcctgggcctg

SEQ ID NO: 7533719 - DNA, 22 bp, Homo sapiens
tccaggcccctgcctgggcctg

SEQ ID NO: 7533720 - DNA, 22 bp, Homo sapiens
tccaggcccctgcctgggcctg

SEQ ID NO: 7533721 - DNA, 22 bp, Homo sapiens
tccaggcccctgcctgggcctg

SEQ ID NO: 7533722 - DNA, 22 bp, Homo sapiens
tccaggcccctgcctgggcctg

SEQ ID NO: 7533723 - DNA, 22 bp, Homo sapiens
tccaggcccgagatgggctgga

SEQ ID NO: 7533724 - DNA, 22 bp, Homo sapiens
tccaggctcagtcaagcacttc

SEQ ID NO: 7533725 - DNA, 22 bp, Homo sapiens
tccaggctcagtcaagcacttc

SEQ ID NO: 7533726 - DNA, 22 bp, Homo sapiens
tccaggcccgagatgggctgga

SEQ ID NO: 7533727 - DNA, 22 bp, Homo sapiens
tccaggcccgagatgggctgga

SEQ ID NO: 7533728 - DNA, 22 bp, Homo sapiens
tccaggcccgagatgggctgga

SEQ ID NO: 7533729 - DNA, 22 bp, Homo sapiens
tccaggcccgagatgggctgga

SEQ ID NO: 7533730 - DNA, 22 bp, Homo sapiens
tccaggcccgagatgggctgga

SEQ ID NO: 7533731 - DNA, 22 bp, Homo sapiens
tccaggcccgagatgggctgga

SEQ ID NO: 7533732 - DNA, 22 bp, Homo sapiens
tccagactgcttctaggatgag

SEQ ID NO: 7533733 - DNA, 22 bp, Homo sapiens
tccagactgccctgcacatgtg

SEQ ID NO: 7533734 - DNA, 22 bp, Homo sapiens
tccagactgccctgcacatgtg

SEQ ID NO: 7533735 - DNA, 22 bp, Homo sapiens
tccagactggggccatgtctgc

SEQ ID NO: 7533736 - DNA, 22 bp, Homo sapiens
tccagactggggccatgtctgc

SEQ ID NO: 7533737 - DNA, 22 bp, Homo sapiens
tccagactggggccatgtctgc

SEQ ID NO: 7533738 - DNA, 22 bp, Homo sapiens
tccagactgttcacattggcat

SEQ ID NO: 7533739 - DNA, 22 bp, Homo sapiens
tccagactgttcacattggcat

SEQ ID NO: 7533740 - DNA, 19 bp, Homo sapiens
tccagactgtccaggctat

SEQ ID NO: 7533741 - DNA, 22 bp, Homo sapiens
tccagactcactcatgtgacta

SEQ ID NO: 7533742 - DNA, 22 bp, Homo sapiens
tccagactcactcatgtgacta

SEQ ID NO: 7533743 - DNA, 22 bp, Homo sapiens
tccagacctagggcaccccagt

SEQ ID NO: 7533744 - DNA, 22 bp, Homo sapiens
tccagactcactcatgtgacta

SEQ ID NO: 7533745 - DNA, 23 bp, Homo sapiens
tccagactctaaagccctccaca

SEQ ID NO: 7533746 - DNA, 23 bp, Homo sapiens
tccagactctaaagccctccaca

SEQ ID NO: 7533747 - DNA, 22 bp, Homo sapiens
tccagactctgtcacttcctag

SEQ ID NO: 7533748 - DNA, 22 bp, Homo sapiens
tccagactctgtcacttcctag

SEQ ID NO: 7533749 - DNA, 22 bp, Homo sapiens
tccagactctttaagttcattt

SEQ ID NO: 7533750 - DNA, 22 bp, Homo sapiens
tccagactctttaagttcattt

SEQ ID NO: 7533751 - DNA, 22 bp, Homo sapiens
tccagactgccctgcacatgtg

SEQ ID NO: 7533752 - DNA, 22 bp, Homo sapiens
tccagactgccctgcacatgtg

SEQ ID NO: 7533753 - DNA, 22 bp, Homo sapiens
tccagagaattctacgcagtgc

SEQ ID NO: 7533754 - DNA, 22 bp, Homo sapiens
tccagagacttgcatgtgcttg

SEQ ID NO: 7533755 - DNA, 22 bp, Homo sapiens
tccagagacttgcatgtgcttg

SEQ ID NO: 7533756 - DNA, 22 bp, Homo sapiens
tccagagacttgcatgtgcttg

SEQ ID NO: 7533757 - DNA, 22 bp, Homo sapiens
tccagagacttgcatgtgcttg

SEQ ID NO: 7533758 - DNA, 22 bp, Homo sapiens
tccagagacttgcatgtgcttg

SEQ ID NO: 7533759 - DNA, 22 bp, Homo sapiens
tccagagacttgcatgtgcttg

SEQ ID NO: 7533760 - DNA, 22 bp, Homo sapiens
tccagagagaaaaacaagcttt

SEQ ID NO: 7533761 - DNA, 22 bp, Homo sapiens
tccagagagaaaaacaagcttt

SEQ ID NO: 7533762 - DNA, 22 bp, Homo sapiens
tccagagagaaaaacaagcttt

SEQ ID NO: 7533763 - DNA, 22 bp, Homo sapiens
tccagagagaaaaacaagcttt

SEQ ID NO: 7533764 - DNA, 22 bp, Homo sapiens
tccagagaacgatgaaagctgg

SEQ ID NO: 7533765 - DNA, 22 bp, Homo sapiens
tccagagaacgatgaaagctgg

SEQ ID NO: 7533766 - DNA, 22 bp, Homo sapiens
tccagagaacgatgaaagctgg

SEQ ID NO: 7533767 - DNA, 22 bp, Homo sapiens
tccagagaattctacgcagtgc

SEQ ID NO: 7533768 - DNA, 22 bp, Homo sapiens
tccagagaattctacgcagtgc

SEQ ID NO: 7533769 - DNA, 22 bp, Homo sapiens
tccagagaattctacgcagtgc

SEQ ID NO: 7533770 - DNA, 22 bp, Homo sapiens
tccagagaattctacgcagtgc

SEQ ID NO: 7533771 - DNA, 22 bp, Homo sapiens
tccagagaaatctagtcttaca

SEQ ID NO: 7533772 - DNA, 22 bp, Homo sapiens
tccagagaaatctagtcttaca

SEQ ID NO: 7533773 - DNA, 22 bp, Homo sapiens
tccagagaacgatgaaagctgg

SEQ ID NO: 7533774 - DNA, 22 bp, Homo sapiens
tccagagaacgatgaaagctgg

SEQ ID NO: 7533775 - DNA, 22 bp, Homo sapiens
tccagagaacgatgaaagctgg

SEQ ID NO: 7533776 - DNA, 22 bp, Homo sapiens
tccagagaacgatgaaagctgg

SEQ ID NO: 7533777 - DNA, 22 bp, Homo sapiens
tccagagaacgatgaaagctgg

SEQ ID NO: 7533778 - DNA, 22 bp, Homo sapiens
tccagagaacgatgaaagctgg

SEQ ID NO: 7533779 - DNA, 22 bp, Homo sapiens
tccagagagatagtggctaata

SEQ ID NO: 7533780 - DNA, 22 bp, Homo sapiens
tccagagagatagtggctaata

SEQ ID NO: 7533781 - DNA, 22 bp, Homo sapiens
tccagagagaaaaacaagcttt

SEQ ID NO: 7533782 - DNA, 22 bp, Homo sapiens
tccagagagaaaaacaagcttt

SEQ ID NO: 7533783 - DNA, 22 bp, Homo sapiens
tccagagagatagtggctaata

SEQ ID NO: 7533784 - DNA, 22 bp, Homo sapiens
tccagagagccacggacagggg

SEQ ID NO: 7533785 - DNA, 22 bp, Homo sapiens
tccagagagccacggacagggg

SEQ ID NO: 7533786 - DNA, 22 bp, Homo sapiens
tccagagagccacggacagggg

SEQ ID NO: 7533787 - DNA, 22 bp, Homo sapiens
tccagagagccacggacagggg

SEQ ID NO: 7533788 - DNA, 22 bp, Homo sapiens
tccagagagccacggacagggg

SEQ ID NO: 7533789 - DNA, 22 bp, Homo sapiens
tccagagagccacggacagggg

SEQ ID NO: 7533790 - DNA, 22 bp, Homo sapiens
tccagagaggcatatttacaag

SEQ ID NO: 7533791 - DNA, 22 bp, Homo sapiens
tccagagaggcatatttacaag

SEQ ID NO: 7533792 - DNA, 22 bp, Homo sapiens
tccagagaggcatatttacaag

SEQ ID NO: 7533793 - DNA, 22 bp, Homo sapiens
tccagcccagctcctctcagaa

SEQ ID NO: 7533794 - DNA, 17 bp, Homo sapiens
tccagagaggcttccct

SEQ ID NO: 7533795 - DNA, 17 bp, Homo sapiens
tccagagaggcttccct

SEQ ID NO: 7533796 - DNA, 22 bp, Homo sapiens
tccagcccagctcctctcagaa

SEQ ID NO: 7533797 - DNA, 22 bp, Homo sapiens
tccagcccagctgtccccttca

SEQ ID NO: 7533798 - DNA, 17 bp, Homo sapiens
tccagagaggcttccct

SEQ ID NO: 7533799 - DNA, 22 bp, Homo sapiens
tccagcccagctgtccccttca

SEQ ID NO: 7533800 - DNA, 22 bp, Homo sapiens
tccagcccagctgtccccttca

SEQ ID NO: 7533801 - DNA, 22 bp, Homo sapiens
tccagcccaggctggagtgtag

SEQ ID NO: 7533802 - DNA, 22 bp, Homo sapiens
tccagccctgtggcttccaccc

SEQ ID NO: 7533803 - DNA, 22 bp, Homo sapiens
tccagcccagctgtccccttca

SEQ ID NO: 7533804 - DNA, 19 bp, Homo sapiens
tccagccctgttccctttt

SEQ ID NO: 7533805 - DNA, 22 bp, Homo sapiens
tccagcctaatgttcttcccac

SEQ ID NO: 7533806 - DNA, 22 bp, Homo sapiens
tccagccctgtgtctgggagag

SEQ ID NO: 7533807 - DNA, 22 bp, Homo sapiens
tccagccctgtgtctgggagag

SEQ ID NO: 7533808 - DNA, 19 bp, Homo sapiens
tccagccctgttccctttt

SEQ ID NO: 7533809 - DNA, 19 bp, Homo sapiens
tccagccctgttccctttt

SEQ ID NO: 7533810 - DNA, 22 bp, Homo sapiens
tccagccctgtgtctgggagag

SEQ ID NO: 7533811 - DNA, 22 bp, Homo sapiens
tccagccctgtgtctgggagag

SEQ ID NO: 7533812 - DNA, 22 bp, Homo sapiens
tccagccctgtggcttccaccc

SEQ ID NO: 7533813 - DNA, 22 bp, Homo sapiens
tccagccctgtgtctgggagag

SEQ ID NO: 7533814 - DNA, 22 bp, Homo sapiens
tccagccctgtgtctgggagag

SEQ ID NO: 7533815 - DNA, 22 bp, Homo sapiens
tccagccctgtggcttccaccc

SEQ ID NO: 7533816 - DNA, 22 bp, Homo sapiens
tccagccctgtggcttccaccc

SEQ ID NO: 7533817 - DNA, 17 bp, Homo sapiens
tccagcctcctctgctg

SEQ ID NO: 7533818 - DNA, 17 bp, Homo sapiens
tccagcctcctctgctg

SEQ ID NO: 7533819 - DNA, 17 bp, Homo sapiens
tccagcctcctctgctg

SEQ ID NO: 7533820 - DNA, 22 bp, Homo sapiens
tccagcctcctatttaccctaa

SEQ ID NO: 7533821 - DNA, 22 bp, Homo sapiens
tccagcctcctatttaccctaa

SEQ ID NO: 7533822 - DNA, 22 bp, Homo sapiens
tccagcctcctatttaccctaa

SEQ ID NO: 7533823 - DNA, 22 bp, Homo sapiens
tccagcctcctatttaccctaa

SEQ ID NO: 7533824 - DNA, 17 bp, Homo sapiens
tccagcctcctctgctg

SEQ ID NO: 7533825 - DNA, 17 bp, Homo sapiens
tccagcctcctctgctg

SEQ ID NO: 7533826 - DNA, 17 bp, Homo sapiens
tccagcctcctctgctg

SEQ ID NO: 7533827 - DNA, 22 bp, Homo sapiens
tccagctcttgttgcccactgc

SEQ ID NO: 7533828 - DNA, 22 bp, Homo sapiens
tccagctcttcagttctgcaaa

SEQ ID NO: 7533829 - DNA, 23 bp, Homo sapiens
tccagcctcttgctctcacatgc

SEQ ID NO: 7533830 - DNA, 22 bp, Homo sapiens
tccagctcttcagttctgcaaa

SEQ ID NO: 7533831 - DNA, 17 bp, Homo sapiens
tccagcctcctctgctg

SEQ ID NO: 7533832 - DNA, 22 bp, Homo sapiens
tccagcctcatttctcctgctt

SEQ ID NO: 7533833 - DNA, 22 bp, Homo sapiens
tccagcctcatttctcctgctt

SEQ ID NO: 7533834 - DNA, 22 bp, Homo sapiens
tccagcctcatttctcctgctt

SEQ ID NO: 7533835 - DNA, 22 bp, Homo sapiens
tccagcctcatttctcctgctt

SEQ ID NO: 7533836 - DNA, 22 bp, Homo sapiens
tccagcctcatttctcctgctt

SEQ ID NO: 7533837 - DNA, 22 bp, Homo sapiens
tccagccgtcacagccacattc

SEQ ID NO: 7533838 - DNA, 22 bp, Homo sapiens
tccagcctcatttctcctgctt

SEQ ID NO: 7533839 - DNA, 22 bp, Homo sapiens
tccagcctcatttctcctgctt

SEQ ID NO: 7533840 - DNA, 22 bp, Homo sapiens
tccagcctcatttctcctgctt

SEQ ID NO: 7533841 - DNA, 22 bp, Homo sapiens
tccagcctaggggaacagctgc

SEQ ID NO: 7533842 - DNA, 22 bp, Homo sapiens
tccagcctaggggaacagctgc

SEQ ID NO: 7533843 - DNA, 22 bp, Homo sapiens
tccagcctaggggaacagctgc

SEQ ID NO: 7533844 - DNA, 22 bp, Homo sapiens
tccagcctaggggaacagctgc

SEQ ID NO: 7533845 - DNA, 22 bp, Homo sapiens
tccagcctaggggaacagctgc

SEQ ID NO: 7533846 - DNA, 22 bp, Homo sapiens
tccagcctaatgttcttcccac

SEQ ID NO: 7533847 - DNA, 22 bp, Homo sapiens
tccagcctaatgttcttcccac

SEQ ID NO: 7533848 - DNA, 22 bp, Homo sapiens
tccagcctaatgttcttcccac

SEQ ID NO: 7533849 - DNA, 20 bp, Homo sapiens
tccagctgacattctctttc

SEQ ID NO: 7533850 - DNA, 20 bp, Homo sapiens
tccagctgacattctctttc

SEQ ID NO: 7533851 - DNA, 20 bp, Homo sapiens
tccagctgacattctctttc

SEQ ID NO: 7533852 - DNA, 22 bp, Homo sapiens
tccagctgaggtggcctctgtg

SEQ ID NO: 7533853 - DNA, 22 bp, Homo sapiens
tccagctgaggtggcctctgtg

SEQ ID NO: 7533854 - DNA, 22 bp, Homo sapiens
tccagctgaggtggcctctgtg

SEQ ID NO: 7533855 - DNA, 22 bp, Homo sapiens
tccagctgcaaggggcacagct

SEQ ID NO: 7533856 - DNA, 22 bp, Homo sapiens
tccagctgaggtggcctctgtg

SEQ ID NO: 7533857 - DNA, 22 bp, Homo sapiens
tccagctgcaaggggcacagct

SEQ ID NO: 7533858 - DNA, 22 bp, Homo sapiens
tccagctgcaaggggcacagct

SEQ ID NO: 7533859 - DNA, 22 bp, Homo sapiens
tccagctgacatctcctgaggg

SEQ ID NO: 7533860 - DNA, 22 bp, Homo sapiens
tccagctgacatctcctgaggg

SEQ ID NO: 7533861 - DNA, 22 bp, Homo sapiens
tccagctgacatctcctgaggg

SEQ ID NO: 7533862 - DNA, 22 bp, Homo sapiens
tccagctgacacttaaggggag

SEQ ID NO: 7533863 - DNA, 22 bp, Homo sapiens
tccagctgacagttcaaaatga

SEQ ID NO: 7533864 - DNA, 22 bp, Homo sapiens
tccagctgacagttcaaaatga

SEQ ID NO: 7533865 - DNA, 22 bp, Homo sapiens
tccagctcttgttgcccactgc

SEQ ID NO: 7533866 - DNA, 22 bp, Homo sapiens
tccagctcttgttgcccactgc

SEQ ID NO: 7533867 - DNA, 22 bp, Homo sapiens
tccagctcttgttgcccactgc

SEQ ID NO: 7533868 - DNA, 22 bp, Homo sapiens
tccagctcttgttgcccactgc

SEQ ID NO: 7533869 - DNA, 22 bp, Homo sapiens
tccagctcttgttgcccactgc

SEQ ID NO: 7533870 - DNA, 22 bp, Homo sapiens
tccagctcttgttgcccactgc

SEQ ID NO: 7533871 - DNA, 22 bp, Homo sapiens
tccagctgacacttaaggggag

SEQ ID NO: 7533872 - DNA, 22 bp, Homo sapiens
tccagctgacacttaaggggag

SEQ ID NO: 7533873 - DNA, 22 bp, Homo sapiens
tccagctgccaaccgggccccg

SEQ ID NO: 7533874 - DNA, 22 bp, Homo sapiens
tccagctgccaaccgggccccg

SEQ ID NO: 7533875 - DNA, 22 bp, Homo sapiens
tccagctgctgacccagtagcc

SEQ ID NO: 7533876 - DNA, 22 bp, Homo sapiens
tccagctgctagctagatgcaa

SEQ ID NO: 7533877 - DNA, 22 bp, Homo sapiens
tccagctgctagctagatgcaa

SEQ ID NO: 7533878 - DNA, 22 bp, Homo sapiens
tccagctgctagctagatgcaa

SEQ ID NO: 7533879 - DNA, 22 bp, Homo sapiens
tccagctgctgacccagtagcc

SEQ ID NO: 7533880 - DNA, 22 bp, Homo sapiens
tccagctgctgccagccaagct

SEQ ID NO: 7533881 - DNA, 22 bp, Homo sapiens
tccagctgctgccagccaagct

SEQ ID NO: 7533882 - DNA, 22 bp, Homo sapiens
tccagctgcaaggggcacagct

SEQ ID NO: 7533883 - DNA, 22 bp, Homo sapiens
tccagctgcaaggggcacagct

SEQ ID NO: 7533884 - DNA, 22 bp, Homo sapiens
tccagctgcaaggggcacagct

SEQ ID NO: 7533885 - DNA, 21 bp, Homo sapiens
tccagctgcacaagcatgggg

SEQ ID NO: 7533886 - DNA, 21 bp, Homo sapiens
tccagctgcacaagcatgggg

SEQ ID NO: 7533887 - DNA, 21 bp, Homo sapiens
tccagctgcacaagcatgggg

SEQ ID NO: 7533888 - DNA, 21 bp, Homo sapiens
tccagctgcacaagcatgggg

SEQ ID NO: 7533889 - DNA, 21 bp, Homo sapiens
tccagctgcacaagcatgggg

SEQ ID NO: 7533890 - DNA, 21 bp, Homo sapiens
tccagctgcacaagcatgggg

SEQ ID NO: 7533891 - DNA, 23 bp, Homo sapiens
tccagctgcagtgggatggggaa

SEQ ID NO: 7533892 - DNA, 23 bp, Homo sapiens
tccagctgcagtgggatggggaa

SEQ ID NO: 7533893 - DNA, 23 bp, Homo sapiens
tccagctgcagtgggatggggaa

SEQ ID NO: 7533894 - DNA, 22 bp, Homo sapiens
tcctcagggaagatgagcctca

SEQ ID NO: 7533895 - DNA, 22 bp, Homo sapiens
tcctcagggaagatgagcctca

SEQ ID NO: 7533896 - DNA, 22 bp, Homo sapiens
tcctcagggaagatgagcctca

SEQ ID NO: 7533897 - DNA, 22 bp, Homo sapiens
tcctcagggaagatgagcctca

SEQ ID NO: 7533898 - DNA, 22 bp, Homo sapiens
catttggaaagagactagagaa

SEQ ID NO: 7533899 - DNA, 22 bp, Homo sapiens
tcctcagggaagatgagcctca

SEQ ID NO: 7533900 - DNA, 22 bp, Homo sapiens
tcctcagggaagatgagcctca

SEQ ID NO: 7533901 - DNA, 22 bp, Homo sapiens
tcctcaggctgcctggaagact

SEQ ID NO: 7533902 - DNA, 22 bp, Homo sapiens
tcctcaggctgcctggaagact

SEQ ID NO: 7533903 - DNA, 22 bp, Homo sapiens
catttggaccaaaatagccaac

SEQ ID NO: 7533904 - DNA, 22 bp, Homo sapiens
catttggaaagagactagagaa

SEQ ID NO: 7533905 - DNA, 22 bp, Homo sapiens
catttggaccaaaatagccaac

SEQ ID NO: 7533906 - DNA, 22 bp, Homo sapiens
catttggaccaaaatagccaac

SEQ ID NO: 7533907 - DNA, 22 bp, Homo sapiens
catttggattttgaagagagta

SEQ ID NO: 7533908 - DNA, 22 bp, Homo sapiens
catttggaccaaaatagccaac

SEQ ID NO: 7533909 - DNA, 22 bp, Homo sapiens
catttggattttgaagagagta

SEQ ID NO: 7533910 - DNA, 22 bp, Homo sapiens
catttggccattccagtcacat

SEQ ID NO: 7533911 - DNA, 22 bp, Homo sapiens
catttggattttgaagagagta

SEQ ID NO: 7533912 - DNA, 20 bp, Homo sapiens
catttgggatcatgaggttt

SEQ ID NO: 7533913 - DNA, 20 bp, Homo sapiens
catttgggatcatgaggttt

SEQ ID NO: 7533914 - DNA, 22 bp, Homo sapiens
catttggtggctacagagtaac

SEQ ID NO: 7533915 - DNA, 22 bp, Homo sapiens
catttggtgttaggcatgttaa

SEQ ID NO: 7533916 - DNA, 22 bp, Homo sapiens
catttggtggctacagagtaac

SEQ ID NO: 7533917 - DNA, 22 bp, Homo sapiens
catttgtacagaacagctttat

SEQ ID NO: 7533918 - DNA, 22 bp, Homo sapiens
catttgtacagaacagctttat

SEQ ID NO: 7533919 - DNA, 22 bp, Homo sapiens
catttgtacagaacagctttat

SEQ ID NO: 7533920 - DNA, 22 bp, Homo sapiens
catttgtacagaacagctttat

SEQ ID NO: 7533921 - DNA, 22 bp, Homo sapiens
catttgtacagaacagctttat

SEQ ID NO: 7533922 - DNA, 22 bp, Homo sapiens
catttgtagctatttactgtat

SEQ ID NO: 7533923 - DNA, 22 bp, Homo sapiens
catttgtagctatttactgtat

SEQ ID NO: 7533924 - DNA, 22 bp, Homo sapiens
catttgtaggatgcttcttgtt

SEQ ID NO: 7533925 - DNA, 22 bp, Homo sapiens
catttgtagagtaggaaagagt

SEQ ID NO: 7533926 - DNA, 22 bp, Homo sapiens
catttgtacatgttgtcttctt

SEQ ID NO: 7533927 - DNA, 22 bp, Homo sapiens
catttgtacatgttgtcttctt

SEQ ID NO: 7533928 - DNA, 22 bp, Homo sapiens
catttgtacagaacagctttat

SEQ ID NO: 7533929 - DNA, 22 bp, Homo sapiens
catttgtagagtaggaaagagt

SEQ ID NO: 7533930 - DNA, 22 bp, Homo sapiens
catttgtactgttcaatgtcat

SEQ ID NO: 7533931 - DNA, 22 bp, Homo sapiens
catttgtatcatatgtatctta

SEQ ID NO: 7533932 - DNA, 22 bp, Homo sapiens
catttgtatcatatgtatctta

SEQ ID NO: 7533933 - DNA, 22 bp, Homo sapiens
catttgtatcatatgtatctta

SEQ ID NO: 7533934 - DNA, 22 bp, Homo sapiens
catttgtatagtgcttagacca

SEQ ID NO: 7533935 - DNA, 22 bp, Homo sapiens
catttgtatagtgcttagacca

SEQ ID NO: 7533936 - DNA, 22 bp, Homo sapiens
catttgtagttaaaaatgtctc

SEQ ID NO: 7533937 - DNA, 22 bp, Homo sapiens
catttgtagttaaaaatgtctc

SEQ ID NO: 7533938 - DNA, 22 bp, Homo sapiens
catttgtagttaaaaatgtctc

SEQ ID NO: 7533939 - DNA, 22 bp, Homo sapiens
catttgtagttaaaaatgtctc

SEQ ID NO: 7533940 - DNA, 22 bp, Homo sapiens
catttgtagtatctgtttatat

SEQ ID NO: 7533941 - DNA, 22 bp, Homo sapiens
catttgtagttaaaaatgtctc

SEQ ID NO: 7533942 - DNA, 22 bp, Homo sapiens
catttgtagtatctgtttatat

SEQ ID NO: 7533943 - DNA, 22 bp, Homo sapiens
catttgtagtatctgtttatat

SEQ ID NO: 7533944 - DNA, 22 bp, Homo sapiens
catttgtagtatctgtttatat

SEQ ID NO: 7533945 - DNA, 22 bp, Homo sapiens
catttgtaggatgcttcttgtt

SEQ ID NO: 7533946 - DNA, 22 bp, Homo sapiens
catttgtaggatgcttcttgtt

SEQ ID NO: 7533947 - DNA, 22 bp, Homo sapiens
catttgtagtatctgtttatat

SEQ ID NO: 7533948 - DNA, 22 bp, Homo sapiens
catttgtagtatctgtttatat

SEQ ID NO: 7533949 - DNA, 22 bp, Homo sapiens
catttgtaggatgcttcttgtt

SEQ ID NO: 7533950 - DNA, 22 bp, Homo sapiens
tcctctccatattttctgattt

SEQ ID NO: 7533951 - DNA, 21 bp, Homo sapiens
tcctctccatgatctgtttgt

SEQ ID NO: 7533952 - DNA, 21 bp, Homo sapiens
tcctctccatgatctgtttgt

SEQ ID NO: 7533953 - DNA, 21 bp, Homo sapiens
tcctctccatgatctgtttgt

SEQ ID NO: 7533954 - DNA, 22 bp, Homo sapiens
tcctctccatattttctgattt

SEQ ID NO: 7533955 - DNA, 22 bp, Homo sapiens
tcctcccctcagggcaacggat

SEQ ID NO: 7533956 - DNA, 22 bp, Homo sapiens
tcctcccctcagggcaacggat

SEQ ID NO: 7533957 - DNA, 22 bp, Homo sapiens
tcctcccctcagggcaacggat

SEQ ID NO: 7533958 - DNA, 22 bp, Homo sapiens
tcctcccctcagggcaacggat

SEQ ID NO: 7533959 - DNA, 22 bp, Homo sapiens
tcctcccctcagggcaacggat

SEQ ID NO: 7533960 - DNA, 22 bp, Homo sapiens
tcctcccctcagggcaacggat

SEQ ID NO: 7533961 - DNA, 22 bp, Homo sapiens
tcctcccctcagggcaacggat

SEQ ID NO: 7533962 - DNA, 17 bp, Homo sapiens
tcctccccgcagttgca

SEQ ID NO: 7533963 - DNA, 17 bp, Homo sapiens
tcctccccgcagttgca

SEQ ID NO: 7533964 - DNA, 17 bp, Homo sapiens
tcctccccgcagttgca

SEQ ID NO: 7533965 - DNA, 22 bp, Homo sapiens
catttgtatgttcctccttagg

SEQ ID NO: 7533966 - DNA, 17 bp, Homo sapiens
tcctccccgcagttgca

SEQ ID NO: 7533967 - DNA, 22 bp, Homo sapiens
catttgtatgttcctccttagg

SEQ ID NO: 7533968 - DNA, 20 bp, Homo sapiens
tccctaggcaggagggcact

SEQ ID NO: 7533969 - DNA, 22 bp, Homo sapiens
tccctaggagaattgccgcagc

SEQ ID NO: 7533970 - DNA, 22 bp, Homo sapiens
tccctaggtcctagtcacagta

SEQ ID NO: 7533971 - DNA, 22 bp, Homo sapiens
tccctaggtcctagtcacagta

SEQ ID NO: 7533972 - DNA, 22 bp, Homo sapiens
tccctagtcgcatctgtggaga

SEQ ID NO: 7533973 - DNA, 22 bp, Homo sapiens
tccctagtcgcatctgtggaga

SEQ ID NO: 7533974 - DNA, 22 bp, Homo sapiens
tccctagtcgcatctgtggaga

SEQ ID NO: 7533975 - DNA, 22 bp, Homo sapiens
tccctagtcgcatctgtggaga

SEQ ID NO: 7533976 - DNA, 22 bp, Homo sapiens
tccctagtagacccagatcatt

SEQ ID NO: 7533977 - DNA, 22 bp, Homo sapiens
tccctcacctagtctttgactc

SEQ ID NO: 7533978 - DNA, 22 bp, Homo sapiens
tccctcaatgtgggtcaagacc

SEQ ID NO: 7533979 - DNA, 22 bp, Homo sapiens
tccctcactggttctgcatccc

SEQ ID NO: 7533980 - DNA, 22 bp, Homo sapiens
tccctcactggttctgcatccc

SEQ ID NO: 7533981 - DNA, 22 bp, Homo sapiens
tccctagtcgcatctgtggaga

SEQ ID NO: 7533982 - DNA, 22 bp, Homo sapiens
tccctagtcgcatctgtggaga

SEQ ID NO: 7533983 - DNA, 22 bp, Homo sapiens
tccctaggtcctagtcacagta

SEQ ID NO: 7533984 - DNA, 22 bp, Homo sapiens
tccctagtcgcatctgtggaga

SEQ ID NO: 7533985 - DNA, 22 bp, Homo sapiens
tccctcactggttctgcatccc

SEQ ID NO: 7533986 - DNA, 22 bp, Homo sapiens
tccctcactggttctgcatccc

SEQ ID NO: 7533987 - DNA, 22 bp, Homo sapiens
tccctcactggttctgcatccc

SEQ ID NO: 7533988 - DNA, 22 bp, Homo sapiens
tccctcagaaattctctctgaa

SEQ ID NO: 7533989 - DNA, 22 bp, Homo sapiens
tccctcactggttctgcatccc

SEQ ID NO: 7533990 - DNA, 22 bp, Homo sapiens
tccctcagaaattctctctgaa

SEQ ID NO: 7533991 - DNA, 22 bp, Homo sapiens
tccctcagaaattctctctgaa

SEQ ID NO: 7533992 - DNA, 22 bp, Homo sapiens
tccctcagaaattctctctgaa

SEQ ID NO: 7533993 - DNA, 22 bp, Homo sapiens
tccctcagaaattctctctgaa

SEQ ID NO: 7533994 - DNA, 22 bp, Homo sapiens
tcctcagcattagcacagacat

SEQ ID NO: 7533995 - DNA, 18 bp, Homo sapiens
tcctcagcctcacctagc

SEQ ID NO: 7533996 - DNA, 22 bp, Homo sapiens
tcctagaagatggatcagagaa

SEQ ID NO: 7533997 - DNA, 22 bp, Homo sapiens
tcctagaaggatcattctagtg

SEQ ID NO: 7533998 - DNA, 22 bp, Homo sapiens
tcctagaagatggatcagagaa

SEQ ID NO: 7533999 - DNA, 22 bp, Homo sapiens
tccctcagaaattctctctgaa

SEQ ID NO: 7534000 - DNA, 22 bp, Homo sapiens
tccctcagaaattctctctgaa

SEQ ID NO: 7534001 - DNA, 22 bp, Homo sapiens
tcctcaggagagctcctatgcc

SEQ ID NO: 7534002 - DNA, 22 bp, Homo sapiens
tcctcaggagagctcctatgcc

SEQ ID NO: 7534003 - DNA, 22 bp, Homo sapiens
tcctcaggagagctcctatgcc

SEQ ID NO: 7534004 - DNA, 22 bp, Homo sapiens
tcctcagcttttatttcacttg

SEQ ID NO: 7534005 - DNA, 22 bp, Homo sapiens
tcctcagcttttatttcacttg

SEQ ID NO: 7534006 - DNA, 18 bp, Homo sapiens
tcctcagcctcacctagc

SEQ ID NO: 7534007 - DNA, 22 bp, Homo sapiens
tcctcaggatctaggagtgctt

SEQ ID NO: 7534008 - DNA, 22 bp, Homo sapiens
tcctcaggatctaggagtgctt

SEQ ID NO: 7534009 - DNA, 22 bp, Homo sapiens
tcctcaggagagctcctatgcc

SEQ ID NO: 7534010 - DNA, 22 bp, Homo sapiens
tcctcaggatctaggagtgctt

SEQ ID NO: 7534011 - DNA, 22 bp, Homo sapiens
tcctcaggatctaggagtgctt

SEQ ID NO: 7534012 - DNA, 22 bp, Homo sapiens
tcctcaggagagctcctatgcc

SEQ ID NO: 7534013 - DNA, 22 bp, Homo sapiens
tcctcaggatctaggagtgctt

SEQ ID NO: 7534014 - DNA, 22 bp, Homo sapiens
tcctcaggatctaggagtgctt

SEQ ID NO: 7534015 - DNA, 22 bp, Homo sapiens
tcctcaggatctaggagtgctt

SEQ ID NO: 7534016 - DNA, 22 bp, Homo sapiens
tcctcaggatctaggagtgctt

SEQ ID NO: 7534017 - DNA, 22 bp, Homo sapiens
tcctcaggatgtggggtagaat

SEQ ID NO: 7534018 - DNA, 22 bp, Homo sapiens
tcctcaggatgtggggtagaat

SEQ ID NO: 7534019 - DNA, 22 bp, Homo sapiens
tcctcaggatgtggggtagaat

SEQ ID NO: 7534020 - DNA, 22 bp, Homo sapiens
tcctcaggatgtggggtagaat

SEQ ID NO: 7534021 - DNA, 22 bp, Homo sapiens
tcctcaggatgtggggtagaat

SEQ ID NO: 7534022 - DNA, 22 bp, Homo sapiens
tcctcaggatgtggagtagaat

SEQ ID NO: 7534023 - DNA, 22 bp, Homo sapiens
tcctcaggatgtggagtagaat

SEQ ID NO: 7534024 - DNA, 22 bp, Homo sapiens
tcctcaggatctaggagtgctt

SEQ ID NO: 7534025 - DNA, 22 bp, Homo sapiens
tcctcaggatgtggagtagaat

SEQ ID NO: 7534026 - DNA, 22 bp, Homo sapiens
tcctcaggatgtggagtagaat

SEQ ID NO: 7534027 - DNA, 22 bp, Homo sapiens
tcctcaggctgcctggaagact

SEQ ID NO: 7534028 - DNA, 22 bp, Homo sapiens
tcctcaggctgcctggaagact

SEQ ID NO: 7534029 - DNA, 22 bp, Homo sapiens
tcctcaggctgcctggaagact

SEQ ID NO: 7534030 - DNA, 22 bp, Homo sapiens
tcctcaggctgcctggaagact

SEQ ID NO: 7534031 - DNA, 22 bp, Homo sapiens
tcctcaggcggtgaggaggggc

SEQ ID NO: 7534032 - DNA, 22 bp, Homo sapiens
tcctcaggcggtgaggaggggc

SEQ ID NO: 7534033 - DNA, 22 bp, Homo sapiens
tcctcaggcggtgaggaggggc

SEQ ID NO: 7534034 - DNA, 22 bp, Homo sapiens
tcctcaggcggtgaggaggggc

SEQ ID NO: 7534035 - DNA, 22 bp, Homo sapiens
tcctcaggcggtgaggaggggc

SEQ ID NO: 7534036 - DNA, 22 bp, Homo sapiens
tcctcaggcggtgaggaggggc

SEQ ID NO: 7534037 - DNA, 22 bp, Homo sapiens
tcctcaggcggtgaggaggggc

SEQ ID NO: 7534038 - DNA, 22 bp, Homo sapiens
tcctcaggcggtgaggaggggc

SEQ ID NO: 7534039 - DNA, 22 bp, Homo sapiens
cattgcaacttcaaactcctgg

SEQ ID NO: 7534040 - DNA, 22 bp, Homo sapiens
cattgcaacttcaaactcctgg

SEQ ID NO: 7534041 - DNA, 22 bp, Homo sapiens
cattgcaacttcaaactcctgg

SEQ ID NO: 7534042 - DNA, 22 bp, Homo sapiens
cattgcaacttcaaactcctgg

SEQ ID NO: 7534043 - DNA, 22 bp, Homo sapiens
cattgcaacttcaaactcctgg

SEQ ID NO: 7534044 - DNA, 22 bp, Homo sapiens
cattgattatggaaagcagtgg

SEQ ID NO: 7534045 - DNA, 22 bp, Homo sapiens
cattgagagaatcacatagaag

SEQ ID NO: 7534046 - DNA, 22 bp, Homo sapiens
cattgagcgaccctgcatgact

SEQ ID NO: 7534047 - DNA, 22 bp, Homo sapiens
cattgattatggaaagcagtgg

SEQ ID NO: 7534048 - DNA, 21 bp, Homo sapiens
cattgagataggagagattgt

SEQ ID NO: 7534049 - DNA, 22 bp, Homo sapiens
cattgagaggctgcctgcctga

SEQ ID NO: 7534050 - DNA, 22 bp, Homo sapiens
cattgagagtgacttggacaat

SEQ ID NO: 7534051 - DNA, 22 bp, Homo sapiens
cattgagagaatcacatagaag

SEQ ID NO: 7534052 - DNA, 22 bp, Homo sapiens
cattgagagaatcacatagaag

SEQ ID NO: 7534053 - DNA, 22 bp, Homo sapiens
cattgacatcaggcttggccaa

SEQ ID NO: 7534054 - DNA, 22 bp, Homo sapiens
cattgacatcaggcttggccaa

SEQ ID NO: 7534055 - DNA, 22 bp, Homo sapiens
cattgacagttctttaagttgc

SEQ ID NO: 7534056 - DNA, 22 bp, Homo sapiens
cattgagaatctgggctacagc

SEQ ID NO: 7534057 - DNA, 22 bp, Homo sapiens
cattgagaatctgggctacagc

SEQ ID NO: 7534058 - DNA, 22 bp, Homo sapiens
cattgacttacctagtatcacc

SEQ ID NO: 7534059 - DNA, 22 bp, Homo sapiens
cattgagaatctgggctacagc

SEQ ID NO: 7534060 - DNA, 22 bp, Homo sapiens
cattgcaccacattgcatccct

SEQ ID NO: 7534061 - DNA, 22 bp, Homo sapiens
cattgcaccacattgcatccct

SEQ ID NO: 7534062 - DNA, 22 bp, Homo sapiens
cattgcacaccagcctgggcaa

SEQ ID NO: 7534063 - DNA, 22 bp, Homo sapiens
cattgcaacttcaaactcctgg

SEQ ID NO: 7534064 - DNA, 22 bp, Homo sapiens
cattgcaacttcaaactcctgg

SEQ ID NO: 7534065 - DNA, 22 bp, Homo sapiens
cattgcaacttcaaactcctgg

SEQ ID NO: 7534066 - DNA, 22 bp, Homo sapiens
tcccagggtcctcttctggaat

SEQ ID NO: 7534067 - DNA, 22 bp, Homo sapiens
tcccagggtcctcttctggaat

SEQ ID NO: 7534068 - DNA, 22 bp, Homo sapiens
tcccagggtcctcttctggaat

SEQ ID NO: 7534069 - DNA, 22 bp, Homo sapiens
tcccagggtcctcttctggaat

SEQ ID NO: 7534070 - DNA, 22 bp, Homo sapiens
tccccactcctgggcagatgcg

SEQ ID NO: 7534071 - DNA, 22 bp, Homo sapiens
tcccagggtcctcttctggaat

SEQ ID NO: 7534072 - DNA, 22 bp, Homo sapiens
tcccagggtcctcttctggaat

SEQ ID NO: 7534073 - DNA, 22 bp, Homo sapiens
cattgaaatatggaaactgatg

SEQ ID NO: 7534074 - DNA, 22 bp, Homo sapiens
cattgaaatatggaaactgatg

SEQ ID NO: 7534075 - DNA, 22 bp, Homo sapiens
cattgaaatatggaaactgatg

SEQ ID NO: 7534076 - DNA, 22 bp, Homo sapiens
cattgaaatatggaaactgatg

SEQ ID NO: 7534077 - DNA, 22 bp, Homo sapiens
cattgaaatatggaaactgatg

SEQ ID NO: 7534078 - DNA, 22 bp, Homo sapiens
cattgaaatatggaaactgatg

SEQ ID NO: 7534079 - DNA, 22 bp, Homo sapiens
cattgaataatgtccttgcaaa

SEQ ID NO: 7534080 - DNA, 18 bp, Homo sapiens
cattgacagtatatcttt

SEQ ID NO: 7534081 - DNA, 22 bp, Homo sapiens
cattgaaagagataaagccttt

SEQ ID NO: 7534082 - DNA, 22 bp, Homo sapiens
cattgaaatatggaaactgatg

SEQ ID NO: 7534083 - DNA, 22 bp, Homo sapiens
cattgaaatatggaaactgatg

SEQ ID NO: 7534084 - DNA, 22 bp, Homo sapiens
cattgaaagagataaagccttt

SEQ ID NO: 7534085 - DNA, 22 bp, Homo sapiens
cattgaaagagataaagccttt

SEQ ID NO: 7534086 - DNA, 22 bp, Homo sapiens
cattgaaagagataaagccttt

SEQ ID NO: 7534087 - DNA, 22 bp, Homo sapiens
cattgaaacctaacataggctg

SEQ ID NO: 7534088 - DNA, 22 bp, Homo sapiens
cattgaaacctaacataggctg

SEQ ID NO: 7534089 - DNA, 22 bp, Homo sapiens
cattgaaacctaacataggctg

SEQ ID NO: 7534090 - DNA, 22 bp, Homo sapiens
cattgaaacctaacataggctg

SEQ ID NO: 7534091 - DNA, 22 bp, Homo sapiens
cattgaaacagatgtacccatg

SEQ ID NO: 7534092 - DNA, 22 bp, Homo sapiens
cattgaaacctaacataggctg

SEQ ID NO: 7534093 - DNA, 22 bp, Homo sapiens
cattgaaacctaacataggctg

SEQ ID NO: 7534094 - DNA, 22 bp, Homo sapiens
tcccaggaggtgcttcctagga

SEQ ID NO: 7534095 - DNA, 22 bp, Homo sapiens
tcccaggaggtgcttcctagga

SEQ ID NO: 7534096 - DNA, 22 bp, Homo sapiens
tcccaggaggtgcttcctagga

SEQ ID NO: 7534097 - DNA, 22 bp, Homo sapiens
tcccaggaggtgcttcctagga

SEQ ID NO: 7534098 - DNA, 22 bp, Homo sapiens
tcccaggaggtgcttcctagga

SEQ ID NO: 7534099 - DNA, 16 bp, Homo sapiens
tcccaggaggcggaac

SEQ ID NO: 7534100 - DNA, 16 bp, Homo sapiens
tcccaggaggcggaac

SEQ ID NO: 7534101 - DNA, 16 bp, Homo sapiens
tcccaggaggcggaac

SEQ ID NO: 7534102 - DNA, 22 bp, Homo sapiens
tcccaggagcaccttttgagcc

SEQ ID NO: 7534103 - DNA, 16 bp, Homo sapiens
tcccaggaggcggaac

SEQ ID NO: 7534104 - DNA, 22 bp, Homo sapiens
cattgaaaaacgttgactgagt

SEQ ID NO: 7534105 - DNA, 22 bp, Homo sapiens
cattgaaaaacgttgactgagt

SEQ ID NO: 7534106 - DNA, 22 bp, Homo sapiens
cattgaaaaacgttgactgagt

SEQ ID NO: 7534107 - DNA, 22 bp, Homo sapiens
cattgaaaaacgttgactgagt

SEQ ID NO: 7534108 - DNA, 22 bp, Homo sapiens
cattgaaaaacgttgactgagt

SEQ ID NO: 7534109 - DNA, 22 bp, Homo sapiens
cattgaaaatgttgcaggctgt

SEQ ID NO: 7534110 - DNA, 22 bp, Homo sapiens
tcccaggaggtgcttcctagga

SEQ ID NO: 7534111 - DNA, 22 bp, Homo sapiens
tcccaggatctgagggcagaga

SEQ ID NO: 7534112 - DNA, 22 bp, Homo sapiens
tcccaggatctgagggcagaga

SEQ ID NO: 7534113 - DNA, 22 bp, Homo sapiens
tcccaggatctgagggcagaga

SEQ ID NO: 7534114 - DNA, 22 bp, Homo sapiens
tccccactgggcctcctctttc

SEQ ID NO: 7534115 - DNA, 22 bp, Homo sapiens
tccccactgggcctcctctttc

SEQ ID NO: 7534116 - DNA, 22 bp, Homo sapiens
tccccactgggcctcctctttc

SEQ ID NO: 7534117 - DNA, 22 bp, Homo sapiens
tccccactctctcctggagctt

SEQ ID NO: 7534118 - DNA, 22 bp, Homo sapiens
tccccactctctcctggagctt

SEQ ID NO: 7534119 - DNA, 22 bp, Homo sapiens
tccccactctgggccaccacaa

SEQ ID NO: 7534120 - DNA, 22 bp, Homo sapiens
tccccagacagcgggaggcctg

SEQ ID NO: 7534121 - DNA, 22 bp, Homo sapiens
tccccagacagcgggaggcctg

SEQ ID NO: 7534122 - DNA, 22 bp, Homo sapiens
tccccagacagcgggaggcctg

SEQ ID NO: 7534123 - DNA, 22 bp, Homo sapiens
tccccagacagcgggaggcctg

SEQ ID NO: 7534124 - DNA, 22 bp, Homo sapiens
tccccagacagcgggaggcctg

SEQ ID NO: 7534125 - DNA, 22 bp, Homo sapiens
tccccagaggaatatgagattg

SEQ ID NO: 7534126 - DNA, 22 bp, Homo sapiens
tccccagacagcgggaggcctg

SEQ ID NO: 7534127 - DNA, 22 bp, Homo sapiens
tccccagaggtgaggcagcttt

SEQ ID NO: 7534128 - DNA, 22 bp, Homo sapiens
tccccagaggaatatgagattg

SEQ ID NO: 7534129 - DNA, 22 bp, Homo sapiens
tccccagagggctgtttaggcc

SEQ ID NO: 7534130 - DNA, 22 bp, Homo sapiens
tccccagaggaatatgagattg

SEQ ID NO: 7534131 - DNA, 22 bp, Homo sapiens
tccccagagggctgtttaggcc

SEQ ID NO: 7534132 - DNA, 22 bp, Homo sapiens
tccccagaggtgaggcagcttt

SEQ ID NO: 7534133 - DNA, 22 bp, Homo sapiens
tccccagaggtgaggcagcttt

SEQ ID NO: 7534134 - DNA, 19 bp, Homo sapiens
tccccagcacctctgagtc

SEQ ID NO: 7534135 - DNA, 19 bp, Homo sapiens
tccccagcacctctgagtc

SEQ ID NO: 7534136 - DNA, 19 bp, Homo sapiens
tccccagcacctctgagtc

SEQ ID NO: 7534137 - DNA, 19 bp, Homo sapiens
tccccagcacctctgagtc

SEQ ID NO: 7534138 - DNA, 19 bp, Homo sapiens
tccccagcacctctgagtc

SEQ ID NO: 7534139 - DNA, 22 bp, Homo sapiens
tccccagattcatgtctgctgt

SEQ ID NO: 7534140 - DNA, 22 bp, Homo sapiens
tccccagattcatgtctgctgt

SEQ ID NO: 7534141 - DNA, 22 bp, Homo sapiens
tccccagattcatgtctgctgt

SEQ ID NO: 7534142 - DNA, 22 bp, Homo sapiens
tccccagattcatgtctgctgt

SEQ ID NO: 7534143 - DNA, 22 bp, Homo sapiens
tccccagattcatgtctgctgt

SEQ ID NO: 7534144 - DNA, 22 bp, Homo sapiens
tccccagatggccagctacatg

SEQ ID NO: 7534145 - DNA, 22 bp, Homo sapiens
tccccagatggccagctacatg

SEQ ID NO: 7534146 - DNA, 22 bp, Homo sapiens
tccccagatggccagctacatg

SEQ ID NO: 7534147 - DNA, 22 bp, Homo sapiens
tccccagatggccagctacatg

SEQ ID NO: 7534148 - DNA, 22 bp, Homo sapiens
tccccagaggtgaggcagcttt

SEQ ID NO: 7534149 - DNA, 22 bp, Homo sapiens
tccccagaggtgaggcagcttt

SEQ ID NO: 7534150 - DNA, 22 bp, Homo sapiens
tccccagatgacatcaaaaggc

SEQ ID NO: 7534151 - DNA, 22 bp, Homo sapiens
tccccagaggtgaggcagcttt

SEQ ID NO: 7534152 - DNA, 22 bp, Homo sapiens
tccccagatggccagctacatg

SEQ ID NO: 7534153 - DNA, 22 bp, Homo sapiens
tccccagatggccagctacatg

SEQ ID NO: 7534154 - DNA, 22 bp, Homo sapiens
tccccagatgacatcaaaaggc

SEQ ID NO: 7534155 - DNA, 22 bp, Homo sapiens
tccccagatgacatcaaaaggc

SEQ ID NO: 7534156 - DNA, 22 bp, Homo sapiens
tccccagatggccagctacatg

SEQ ID NO: 7534157 - DNA, 22 bp, Homo sapiens
tccccaggaaattctgattctt

SEQ ID NO: 7534158 - DNA, 22 bp, Homo sapiens
tccccagcttgctacttctgct

SEQ ID NO: 7534159 - DNA, 22 bp, Homo sapiens
tccccaggaaattctgattctt

SEQ ID NO: 7534160 - DNA, 22 bp, Homo sapiens
tcccggcgctgggaggtgggtc

SEQ ID NO: 7534161 - DNA, 22 bp, Homo sapiens
tcccggcgctgggaggtgggtc

SEQ ID NO: 7534162 - DNA, 22 bp, Homo sapiens
tcccgtcttgctgttgtctgcg

SEQ ID NO: 7534163 - DNA, 22 bp, Homo sapiens
tcccgtcttgctgttgtctgcg

SEQ ID NO: 7534164 - DNA, 22 bp, Homo sapiens
tcccgtaggttgctgtagtcgg

SEQ ID NO: 7534165 - DNA, 22 bp, Homo sapiens
tcccgttgatgacggtgcatcc

SEQ ID NO: 7534166 - DNA, 22 bp, Homo sapiens
tccctactgttagggactcagc

SEQ ID NO: 7534167 - DNA, 22 bp, Homo sapiens
tccctaaactctgaactgattc

SEQ ID NO: 7534168 - DNA, 22 bp, Homo sapiens
tccctactgttagggactcagc

SEQ ID NO: 7534169 - DNA, 22 bp, Homo sapiens
tccctagaggtcttcacaagat

SEQ ID NO: 7534170 - DNA, 22 bp, Homo sapiens
tccctaggagaattgccgcagc

SEQ ID NO: 7534171 - DNA, 20 bp, Homo sapiens
tccctaggcaggagggcact

SEQ ID NO: 7534172 - DNA, 22 bp, Homo sapiens
tccctaggaccccaccttccgc

SEQ ID NO: 7534173 - DNA, 22 bp, Homo sapiens
tccctagcttatttgtgctcta

SEQ ID NO: 7534174 - DNA, 22 bp, Homo sapiens
tccctagcttccgggggctgcc

SEQ ID NO: 7534175 - DNA, 22 bp, Homo sapiens
tccccagcttgctacttctgct

SEQ ID NO: 7534176 - DNA, 22 bp, Homo sapiens
tccccagcttgctacttctgct

SEQ ID NO: 7534177 - DNA, 22 bp, Homo sapiens
tccccagctctgtgcttccact

SEQ ID NO: 7534178 - DNA, 22 bp, Homo sapiens
tccccagccgtgaaggagagga

SEQ ID NO: 7534179 - DNA, 22 bp, Homo sapiens
tccccagccgtgaaggagagga

SEQ ID NO: 7534180 - DNA, 22 bp, Homo sapiens
tccccagctctgtgcttccact

SEQ ID NO: 7534181 - DNA, 22 bp, Homo sapiens
tccccagcattgagggtctctc

SEQ ID NO: 7534182 - DNA, 22 bp, Homo sapiens
tccccagcattgagggtctctc

SEQ ID NO: 7534183 - DNA, 22 bp, Homo sapiens
tccccagcattgagggtctctc

SEQ ID NO: 7534184 - DNA, 22 bp, Homo sapiens
tccccagccgtgaaggagagga

SEQ ID NO: 7534185 - DNA, 22 bp, Homo sapiens
tccccagcattgagggtctctc

SEQ ID NO: 7534186 - DNA, 22 bp, Homo sapiens
tccccagccgtgaaggagagga

SEQ ID NO: 7534187 - DNA, 22 bp, Homo sapiens
tccccagccgtgaaggagagga

SEQ ID NO: 7534188 - DNA, 22 bp, Homo sapiens
tcccaggacatgggctctgctc

SEQ ID NO: 7534189 - DNA, 22 bp, Homo sapiens
tcccaggacatgggctctgctc

SEQ ID NO: 7534190 - DNA, 22 bp, Homo sapiens
tcccaggacaggccacatggaa

SEQ ID NO: 7534191 - DNA, 22 bp, Homo sapiens
tcccaggacaggccacatggaa

SEQ ID NO: 7534192 - DNA, 22 bp, Homo sapiens
tcccaggacaggccacatggaa

SEQ ID NO: 7534193 - DNA, 22 bp, Homo sapiens
tcccaggacatgggctctgctc

SEQ ID NO: 7534194 - DNA, 22 bp, Homo sapiens
tcccaggacatgggctctgctc

SEQ ID NO: 7534195 - DNA, 22 bp, Homo sapiens
tcccaggacatgggctctgctc

SEQ ID NO: 7534196 - DNA, 22 bp, Homo sapiens
tcccaggacatgggctctgctc

SEQ ID NO: 7534197 - DNA, 22 bp, Homo sapiens
tcccaggacatgggctctgctc

SEQ ID NO: 7534198 - DNA, 22 bp, Homo sapiens
tcccaggacccaggcattcaca

SEQ ID NO: 7534199 - DNA, 22 bp, Homo sapiens
tcccaggacccaggcattcaca

SEQ ID NO: 7534200 - DNA, 22 bp, Homo sapiens
tcccaggacttccagttggagg

SEQ ID NO: 7534201 - DNA, 22 bp, Homo sapiens
tcccaggacccaggcattcaca

SEQ ID NO: 7534202 - DNA, 22 bp, Homo sapiens
tcccaggaatgtctgaaagtga

SEQ ID NO: 7534203 - DNA, 22 bp, Homo sapiens
tcccaggacccaggcattcaca

SEQ ID NO: 7534204 - DNA, 22 bp, Homo sapiens
tcccaggagcaccttttgagcc

SEQ ID NO: 7534205 - DNA, 22 bp, Homo sapiens
tcccaggagcaccttttgagcc

SEQ ID NO: 7534206 - DNA, 22 bp, Homo sapiens
tcccaggacttccagttggagg

SEQ ID NO: 7534207 - DNA, 22 bp, Homo sapiens
tcccaggacttccagttggagg

SEQ ID NO: 7534208 - DNA, 22 bp, Homo sapiens
tcccaggacttccagttggagg

SEQ ID NO: 7534209 - DNA, 22 bp, Homo sapiens
tcccagcccaggtatgatgata

SEQ ID NO: 7534210 - DNA, 22 bp, Homo sapiens
tcccaggaatccgtcctctaga

SEQ ID NO: 7534211 - DNA, 22 bp, Homo sapiens
tcccaggaatccgtcctctaga

SEQ ID NO: 7534212 - DNA, 23 bp, Homo sapiens
tcccaggaatctgcatttttaac

SEQ ID NO: 7534213 - DNA, 23 bp, Homo sapiens
tcccaggaatctgcatttttaac

SEQ ID NO: 7534214 - DNA, 23 bp, Homo sapiens
tcccaggaatctgcatttttaac

SEQ ID NO: 7534215 - DNA, 22 bp, Homo sapiens
tcccaggaattgaagccagtgt

SEQ ID NO: 7534216 - DNA, 22 bp, Homo sapiens
tcccaggaattgaagccagtgt

SEQ ID NO: 7534217 - DNA, 22 bp, Homo sapiens
tcccaggaatgtctgaaagtga

SEQ ID NO: 7534218 - DNA, 22 bp, Homo sapiens
tcccaggaatgtctgaaagtga

SEQ ID NO: 7534219 - DNA, 22 bp, Homo sapiens
tcccaggacaggccacatggaa

SEQ ID NO: 7534220 - DNA, 22 bp, Homo sapiens
tcccaggacaggccacatggaa

SEQ ID NO: 7534221 - DNA, 22 bp, Homo sapiens
tcccaggaattgaagccagtgt

SEQ ID NO: 7534222 - DNA, 22 bp, Homo sapiens
tcccaggaattgaagccagtgt

SEQ ID NO: 7534223 - DNA, 22 bp, Homo sapiens
tcccaggaattgaagccagtgt

SEQ ID NO: 7534224 - DNA, 22 bp, Homo sapiens
tcccaggaattgaagccagtgt

SEQ ID NO: 7534225 - DNA, 22 bp, Homo sapiens
tcccaggacaggccacatggaa

SEQ ID NO: 7534226 - DNA, 22 bp, Homo sapiens
tcccaggacaggccacatggaa

SEQ ID NO: 7534227 - DNA, 22 bp, Homo sapiens
tcccaggacaggccacatggaa

SEQ ID NO: 7534228 - DNA, 22 bp, Homo sapiens
tcccagccacagtttccacctg

SEQ ID NO: 7534229 - DNA, 22 bp, Homo sapiens
tcccagccacagtttccacctg

SEQ ID NO: 7534230 - DNA, 22 bp, Homo sapiens
tcccagccacagtttccacctg

SEQ ID NO: 7534231 - DNA, 22 bp, Homo sapiens
tcccagccacagtttccacctg

SEQ ID NO: 7534232 - DNA, 22 bp, Homo sapiens
tcccagccacagtttccacctg

SEQ ID NO: 7534233 - DNA, 22 bp, Homo sapiens
tcccagccaggctctaccactt

SEQ ID NO: 7534234 - DNA, 22 bp, Homo sapiens
tcccagccaggctctaccactt

SEQ ID NO: 7534235 - DNA, 22 bp, Homo sapiens
tcccagccaggctctaccactt

SEQ ID NO: 7534236 - DNA, 22 bp, Homo sapiens
tcccagccaggctctaccactt

SEQ ID NO: 7534237 - DNA, 22 bp, Homo sapiens
tcccagccaggctctaccactt

SEQ ID NO: 7534238 - DNA, 22 bp, Homo sapiens
tcccagcccagatttgtgtgac

SEQ ID NO: 7534239 - DNA, 22 bp, Homo sapiens
tcccagcccagatttgtgtgac

SEQ ID NO: 7534240 - DNA, 22 bp, Homo sapiens
tcccagcccagacttctccagt

SEQ ID NO: 7534241 - DNA, 22 bp, Homo sapiens
tcccagcccaggtatgatgata

SEQ ID NO: 7534242 - DNA, 22 bp, Homo sapiens
tcccagcccagatttgtgtgac

SEQ ID NO: 7534243 - DNA, 22 bp, Homo sapiens
tcccagcccaggtatgatgata

SEQ ID NO: 7534244 - DNA, 22 bp, Homo sapiens
tcccagcccaggtatgatgata

SEQ ID NO: 7534245 - DNA, 22 bp, Homo sapiens
tcccagcccagatttgtgtgac

SEQ ID NO: 7534246 - DNA, 22 bp, Homo sapiens
tcccagcccagacttctccagt

SEQ ID NO: 7534247 - DNA, 22 bp, Homo sapiens
tcccagcccagacttctccagt

SEQ ID NO: 7534248 - DNA, 22 bp, Homo sapiens
tcccagcccagacttctccagt

SEQ ID NO: 7534249 - DNA, 22 bp, Homo sapiens
tcccagcccagacttctccagt

SEQ ID NO: 7534250 - DNA, 22 bp, Homo sapiens
tcccagcccagacttctccagt

SEQ ID NO: 7534251 - DNA, 22 bp, Homo sapiens
tcccagccattcctttaggtgt

SEQ ID NO: 7534252 - DNA, 22 bp, Homo sapiens
tcccagccattcctttaggtgt

SEQ ID NO: 7534253 - DNA, 22 bp, Homo sapiens
tcccagccattcctttaggtgt

SEQ ID NO: 7534254 - DNA, 22 bp, Homo sapiens
tcccagccattcctttaggtgt

SEQ ID NO: 7534255 - DNA, 22 bp, Homo sapiens
tcccagagcctctgccactctg

SEQ ID NO: 7534256 - DNA, 22 bp, Homo sapiens
tcccagagcctctgccactctg

SEQ ID NO: 7534257 - DNA, 22 bp, Homo sapiens
tcccagagcccaagttggagag

SEQ ID NO: 7534258 - DNA, 22 bp, Homo sapiens
tcccagagcctctgccactctg

SEQ ID NO: 7534259 - DNA, 22 bp, Homo sapiens
tcccagagcctctgccactctg

SEQ ID NO: 7534260 - DNA, 22 bp, Homo sapiens
tcccagagcctctgccactctg

SEQ ID NO: 7534261 - DNA, 22 bp, Homo sapiens
tcccagagctctgacaccagct

SEQ ID NO: 7534262 - DNA, 22 bp, Homo sapiens
tcccagagctctgacaccagct

SEQ ID NO: 7534263 - DNA, 22 bp, Homo sapiens
tcccagagctctgacaccagct

SEQ ID NO: 7534264 - DNA, 22 bp, Homo sapiens
tcccagagctctgacaccagct

SEQ ID NO: 7534265 - DNA, 22 bp, Homo sapiens
tcccagagctctgacaccagct

SEQ ID NO: 7534266 - DNA, 22 bp, Homo sapiens
tcccagagctctgacaccagct

SEQ ID NO: 7534267 - DNA, 22 bp, Homo sapiens
tcccagagctctggaggttgga

SEQ ID NO: 7534268 - DNA, 22 bp, Homo sapiens
tcccagagctctggaggttgga

SEQ ID NO: 7534269 - DNA, 22 bp, Homo sapiens
tcccagagctctggaggttgga

SEQ ID NO: 7534270 - DNA, 22 bp, Homo sapiens
tcccagagctctgacaccagct

SEQ ID NO: 7534271 - DNA, 22 bp, Homo sapiens
tcccagagctctgacaccagct

SEQ ID NO: 7534272 - DNA, 22 bp, Homo sapiens
tcccagagctctggaggttgga

SEQ ID NO: 7534273 - DNA, 22 bp, Homo sapiens
tcccagagctctggaggttgga

SEQ ID NO: 7534274 - DNA, 22 bp, Homo sapiens
tcccagagctgataagccttta

SEQ ID NO: 7534275 - DNA, 22 bp, Homo sapiens
tcccagagctgataagccttta

SEQ ID NO: 7534276 - DNA, 22 bp, Homo sapiens
tcccagagctctggaggttgga

SEQ ID NO: 7534277 - DNA, 22 bp, Homo sapiens
tcccagagctgataagccttta

SEQ ID NO: 7534278 - DNA, 22 bp, Homo sapiens
tcccagagctctggaggttgga

SEQ ID NO: 7534279 - DNA, 22 bp, Homo sapiens
tcccagagctctggaggttgga

SEQ ID NO: 7534280 - DNA, 22 bp, Homo sapiens
tcccagccacaggtgtagccct

SEQ ID NO: 7534281 - DNA, 22 bp, Homo sapiens
tcccagccacaggtgtagccct

SEQ ID NO: 7534282 - DNA, 22 bp, Homo sapiens
tcccagaggactgttggtgcta

SEQ ID NO: 7534283 - DNA, 22 bp, Homo sapiens
tcccagaggactgttggtgcta

SEQ ID NO: 7534284 - DNA, 22 bp, Homo sapiens
tcccagaggactgttggtgcta

SEQ ID NO: 7534285 - DNA, 22 bp, Homo sapiens
tcccagaggactgttggtgcta

SEQ ID NO: 7534286 - DNA, 22 bp, Homo sapiens
tcccagaggaaatggcagctga

SEQ ID NO: 7534287 - DNA, 22 bp, Homo sapiens
tcccagaggaaatggcagctga

SEQ ID NO: 7534288 - DNA, 22 bp, Homo sapiens
tcccagaggaaatggcagctga

SEQ ID NO: 7534289 - DNA, 22 bp, Homo sapiens
tcccagaggaaatggcagctga

SEQ ID NO: 7534290 - DNA, 22 bp, Homo sapiens
tcccagaggaaatggcagctga

SEQ ID NO: 7534291 - DNA, 22 bp, Homo sapiens
tcccagaggaaatggcagctga

SEQ ID NO: 7534292 - DNA, 22 bp, Homo sapiens
tcccagaggaaatggcagctga

SEQ ID NO: 7534293 - DNA, 22 bp, Homo sapiens
tcccagaggaaatggcagctga

SEQ ID NO: 7534294 - DNA, 22 bp, Homo sapiens
tcccagaggaaatggcagctga

SEQ ID NO: 7534295 - DNA, 22 bp, Homo sapiens
tcccagagctgataagccttta

SEQ ID NO: 7534296 - DNA, 22 bp, Homo sapiens
tcccagagctgataagccttta

SEQ ID NO: 7534297 - DNA, 22 bp, Homo sapiens
tcccagagcccaagttggagag

SEQ ID NO: 7534298 - DNA, 22 bp, Homo sapiens
tcccagagcccaagttggagag

SEQ ID NO: 7534299 - DNA, 22 bp, Homo sapiens
tcccagagcccaagttggagag

SEQ ID NO: 7534300 - DNA, 22 bp, Homo sapiens
tcccagagcccaagttggagag

SEQ ID NO: 7534301 - DNA, 22 bp, Homo sapiens
tcccagagcccaagttggagag

SEQ ID NO: 7534302 - DNA, 22 bp, Homo sapiens
tcccagagcccaagttggagag

SEQ ID NO: 7534303 - DNA, 22 bp, Homo sapiens
tcccagagcccaagttggagag

SEQ ID NO: 7534304 - DNA, 22 bp, Homo sapiens
tcccagagcccaagttggagag

SEQ ID NO: 7534305 - DNA, 22 bp, Homo sapiens
tcccagagcctctgccactctg

SEQ ID NO: 7534306 - DNA, 22 bp, Homo sapiens
tcccagagcctctgccactctg

SEQ ID NO: 7534307 - DNA, 22 bp, Homo sapiens
tcccagagcctctgccactctg

SEQ ID NO: 7534308 - DNA, 22 bp, Homo sapiens
tcccactgagcatatgcagatg

SEQ ID NO: 7534309 - DNA, 20 bp, Homo sapiens
tcccactcttgtgttttcag

SEQ ID NO: 7534310 - DNA, 22 bp, Homo sapiens
tcccactgagcccctgctggtg

SEQ ID NO: 7534311 - DNA, 22 bp, Homo sapiens
tcccactgagcatatgcagatg

SEQ ID NO: 7534312 - DNA, 22 bp, Homo sapiens
tcccactgagcatatgcagatg

SEQ ID NO: 7534313 - DNA, 22 bp, Homo sapiens
cattcatttatgaaatatctat

SEQ ID NO: 7534314 - DNA, 22 bp, Homo sapiens
cattcatttatgaaatatctat

SEQ ID NO: 7534315 - DNA, 21 bp, Homo sapiens
tcccactctaaatggactgaa

SEQ ID NO: 7534316 - DNA, 22 bp, Homo sapiens
cattcatttactttcaacagct

SEQ ID NO: 7534317 - DNA, 22 bp, Homo sapiens
cattcatttactttcaacagct

SEQ ID NO: 7534318 - DNA, 22 bp, Homo sapiens
cattcatttactttcaacagct

SEQ ID NO: 7534319 - DNA, 22 bp, Homo sapiens
cattcattctgtaagtaactat

SEQ ID NO: 7534320 - DNA, 22 bp, Homo sapiens
cattcattcagcaactgttatt

SEQ ID NO: 7534321 - DNA, 22 bp, Homo sapiens
cattcattcacattttgtctat

SEQ ID NO: 7534322 - DNA, 22 bp, Homo sapiens
cattcattcagcaactgttatt

SEQ ID NO: 7534323 - DNA, 22 bp, Homo sapiens
cattcattcagcaactgttatt

SEQ ID NO: 7534324 - DNA, 22 bp, Homo sapiens
cattcattcacattttgtctat

SEQ ID NO: 7534325 - DNA, 22 bp, Homo sapiens
cattcattcacattttgtctat

SEQ ID NO: 7534326 - DNA, 22 bp, Homo sapiens
catgttcatcagatcaattgta

SEQ ID NO: 7534327 - DNA, 22 bp, Homo sapiens
catgttcatcagatcaattgta

SEQ ID NO: 7534328 - DNA, 22 bp, Homo sapiens
catgttcagtgacagttattga

SEQ ID NO: 7534329 - DNA, 22 bp, Homo sapiens
catgttcaaataagtagtttct

SEQ ID NO: 7534330 - DNA, 22 bp, Homo sapiens
catgttcacctgtggcactagt

SEQ ID NO: 7534331 - DNA, 22 bp, Homo sapiens
catgttcacctgtggcactagt

SEQ ID NO: 7534332 - DNA, 22 bp, Homo sapiens
catgttcagtgacagttattga

SEQ ID NO: 7534333 - DNA, 22 bp, Homo sapiens
catgttcagtgacagttattga

SEQ ID NO: 7534334 - DNA, 22 bp, Homo sapiens
catgttctaatattgtgacata

SEQ ID NO: 7534335 - DNA, 22 bp, Homo sapiens
catgttctaatattgtgacata

SEQ ID NO: 7534336 - DNA, 22 bp, Homo sapiens
catgttggcactgtctctgcct

SEQ ID NO: 7534337 - DNA, 22 bp, Homo sapiens
catgttggcactgtctctgcct

SEQ ID NO: 7534338 - DNA, 22 bp, Homo sapiens
catgttggcaaggatacagcag

SEQ ID NO: 7534339 - DNA, 22 bp, Homo sapiens
catgttggctgaggctgtattt

SEQ ID NO: 7534340 - DNA, 22 bp, Homo sapiens
catgttgaatggccttgatttt

SEQ ID NO: 7534341 - DNA, 22 bp, Homo sapiens
catgttctcttaatgttaacta

SEQ ID NO: 7534342 - DNA, 22 bp, Homo sapiens
catgttctcttaatgttaacta

SEQ ID NO: 7534343 - DNA, 22 bp, Homo sapiens
catgttaatgaatttttgcagt

SEQ ID NO: 7534344 - DNA, 22 bp, Homo sapiens
catgttaatgaatttttgcagt

SEQ ID NO: 7534345 - DNA, 19 bp, Homo sapiens
catgttatgctgtagtatc

SEQ ID NO: 7534346 - DNA, 19 bp, Homo sapiens
catgttatgctgtagtatc

SEQ ID NO: 7534347 - DNA, 22 bp, Homo sapiens
catgttatttatccattaaaca

SEQ ID NO: 7534348 - DNA, 22 bp, Homo sapiens
catgttatttatccattaaaca

SEQ ID NO: 7534349 - DNA, 19 bp, Homo sapiens
catgttatgctgtagtatc

SEQ ID NO: 7534350 - DNA, 22 bp, Homo sapiens
catgttcaaataagtagtttct

SEQ ID NO: 7534351 - DNA, 22 bp, Homo sapiens
catgttcaaataagtagtttct

SEQ ID NO: 7534352 - DNA, 22 bp, Homo sapiens
catgttaagtgtttgataacca

SEQ ID NO: 7534353 - DNA, 22 bp, Homo sapiens
catgttaagtgtttgataacca

SEQ ID NO: 7534354 - DNA, 22 bp, Homo sapiens
catgttaagtgtttgataacca

SEQ ID NO: 7534355 - DNA, 22 bp, Homo sapiens
catgttaatatgcattgagtac

SEQ ID NO: 7534356 - DNA, 22 bp, Homo sapiens
catgttaatatgcattgagtac

SEQ ID NO: 7534357 - DNA, 22 bp, Homo sapiens
catgttaactaagattaactat

SEQ ID NO: 7534358 - DNA, 22 bp, Homo sapiens
catgttaagtgtttgataacca

SEQ ID NO: 7534359 - DNA, 22 bp, Homo sapiens
catgttaagtgtttgataacca

SEQ ID NO: 7534360 - DNA, 22 bp, Homo sapiens
catgttaactaagattaactat

SEQ ID NO: 7534361 - DNA, 22 bp, Homo sapiens
catgttgtatcattctgttcct

SEQ ID NO: 7534362 - DNA, 22 bp, Homo sapiens
catgttgtattctttggctggt

SEQ ID NO: 7534363 - DNA, 22 bp, Homo sapiens
catgttgtattctttggctggt

SEQ ID NO: 7534364 - DNA, 22 bp, Homo sapiens
catgttgtgaaggaaaatgggc

SEQ ID NO: 7534365 - DNA, 22 bp, Homo sapiens
catgtttaattgcgatgtttga

SEQ ID NO: 7534366 - DNA, 22 bp, Homo sapiens
catgtttaattgcgatgtttga

SEQ ID NO: 7534367 - DNA, 22 bp, Homo sapiens
catgtttaattgcgatgtttga

SEQ ID NO: 7534368 - DNA, 22 bp, Homo sapiens
catgtttaattgcgatgtttga

SEQ ID NO: 7534369 - DNA, 22 bp, Homo sapiens
catgtttactaccaggagaatg

SEQ ID NO: 7534370 - DNA, 22 bp, Homo sapiens
catgtttactaccaggagaatg

SEQ ID NO: 7534371 - DNA, 22 bp, Homo sapiens
catgtttaattgcgatgtttga

SEQ ID NO: 7534372 - DNA, 22 bp, Homo sapiens
catgtttaattgcgatgtttga

SEQ ID NO: 7534373 - DNA, 22 bp, Homo sapiens
catgtttaattgcgatgtttga

SEQ ID NO: 7534374 - DNA, 22 bp, Homo sapiens
catgttggtgtgctgcacccgt

SEQ ID NO: 7534375 - DNA, 22 bp, Homo sapiens
catgttgtatcattctgttcct

SEQ ID NO: 7534376 - DNA, 22 bp, Homo sapiens
catgttgtagtatcataatggt

SEQ ID NO: 7534377 - DNA, 22 bp, Homo sapiens
catgttggcttgtcacaatgaa

SEQ ID NO: 7534378 - DNA, 22 bp, Homo sapiens
catgttgggaatcagctgagag

SEQ ID NO: 7534379 - DNA, 22 bp, Homo sapiens
catgttggtgtgctgcacccat

SEQ ID NO: 7534380 - DNA, 22 bp, Homo sapiens
catgttgggcatgcatatgtgt

SEQ ID NO: 7534381 - DNA, 22 bp, Homo sapiens
catgttgggaatcagctgagag

SEQ ID NO: 7534382 - DNA, 22 bp, Homo sapiens
catgttttctaggctttcacaa

SEQ ID NO: 7534383 - DNA, 22 bp, Homo sapiens
catgtttgtaggtcctgcttgc

SEQ ID NO: 7534384 - DNA, 22 bp, Homo sapiens
cattatattacagcactgttaa

SEQ ID NO: 7534385 - DNA, 22 bp, Homo sapiens
catgtttgtacaaaggtacaca

SEQ ID NO: 7534386 - DNA, 22 bp, Homo sapiens
catgtttgtaggtcctgcttgc

SEQ ID NO: 7534387 - DNA, 22 bp, Homo sapiens
catgtttgtacaaaggtacaca

SEQ ID NO: 7534388 - DNA, 22 bp, Homo sapiens
catgtttgtacaaaggtacaca

SEQ ID NO: 7534389 - DNA, 22 bp, Homo sapiens
catgtttctgagaaaagtagga

SEQ ID NO: 7534390 - DNA, 22 bp, Homo sapiens
catgtttctgagaaaagtagga

SEQ ID NO: 7534391 - DNA, 22 bp, Homo sapiens
catgtttctgagaaaagtagga

SEQ ID NO: 7534392 - DNA, 22 bp, Homo sapiens
catgtttctgagaaaagtagga

SEQ ID NO: 7534393 - DNA, 22 bp, Homo sapiens
catgtttactaccaggagaatg

SEQ ID NO: 7534394 - DNA, 22 bp, Homo sapiens
catgtttctgatgcagctttta

SEQ ID NO: 7534395 - DNA, 22 bp, Homo sapiens
catgtttctgatgcagctttta

SEQ ID NO: 7534396 - DNA, 22 bp, Homo sapiens
cattcaaaggcatgtcctattt

SEQ ID NO: 7534397 - DNA, 22 bp, Homo sapiens
cattcaaaggcatgtcctattt

SEQ ID NO: 7534398 - DNA, 22 bp, Homo sapiens
cattatctcttctatatgctag

SEQ ID NO: 7534399 - DNA, 22 bp, Homo sapiens
cattatccaacagcactttcca

SEQ ID NO: 7534400 - DNA, 22 bp, Homo sapiens
cattatctcagttgaacttatg

SEQ ID NO: 7534401 - DNA, 22 bp, Homo sapiens
cattatattttactgcatggga

SEQ ID NO: 7534402 - DNA, 22 bp, Homo sapiens
cattatattttactgcatggga

SEQ ID NO: 7534403 - DNA, 22 bp, Homo sapiens
cattatattacagcactgttaa

SEQ ID NO: 7534404 - DNA, 22 bp, Homo sapiens
cattatattacagcactgttaa

SEQ ID NO: 7534405 - DNA, 22 bp, Homo sapiens
cattcaagagtggacataatgc

SEQ ID NO: 7534406 - DNA, 22 bp, Homo sapiens
cattcaagagtggacataatgc

SEQ ID NO: 7534407 - DNA, 22 bp, Homo sapiens
cattcaaattaagattttgtta

SEQ ID NO: 7534408 - DNA, 22 bp, Homo sapiens
cattcaaattaagattttgtta

SEQ ID NO: 7534409 - DNA, 22 bp, Homo sapiens
cattcaaattaagattttgtta

SEQ ID NO: 7534410 - DNA, 22 bp, Homo sapiens
cattcaaatgtgccactgtcct

SEQ ID NO: 7534411 - DNA, 22 bp, Homo sapiens
cattcaaatgtgccactgtcct

SEQ ID NO: 7534412 - DNA, 22 bp, Homo sapiens
cattcaaatgtgccactgtcct

SEQ ID NO: 7534413 - DNA, 22 bp, Homo sapiens
cattcaaatgtgccactgtcct

SEQ ID NO: 7534414 - DNA, 22 bp, Homo sapiens
cattcacaaaaccacatgccat

SEQ ID NO: 7534415 - DNA, 22 bp, Homo sapiens
cattcacaaaaccacatgccat

SEQ ID NO: 7534416 - DNA, 22 bp, Homo sapiens
cattcacaaagctgattgatgg

SEQ ID NO: 7534417 - DNA, 22 bp, Homo sapiens
cattcacaaagctgattgatgg

SEQ ID NO: 7534418 - DNA, 22 bp, Homo sapiens
cattcacaaaaccacatgccat

SEQ ID NO: 7534419 - DNA, 22 bp, Homo sapiens
cattcacaaaaccacatgccat

SEQ ID NO: 7534420 - DNA, 22 bp, Homo sapiens
cattcacaaaaccacatgccat

SEQ ID NO: 7534421 - DNA, 22 bp, Homo sapiens
cattcaagagtggacataatgc

SEQ ID NO: 7534422 - DNA, 22 bp, Homo sapiens
cattcacaaaaccacatgccat

SEQ ID NO: 7534423 - DNA, 22 bp, Homo sapiens
cattcacaaaaccacatgccat

SEQ ID NO: 7534424 - DNA, 22 bp, Homo sapiens
cattcacaaaaccacatgccat

SEQ ID NO: 7534425 - DNA, 22 bp, Homo sapiens
cattcacagagggggaagcatc

SEQ ID NO: 7534426 - DNA, 22 bp, Homo sapiens
cattcacaatggattgcttcaa

SEQ ID NO: 7534427 - DNA, 22 bp, Homo sapiens
cattcacaatggattgcttcaa

SEQ ID NO: 7534428 - DNA, 22 bp, Homo sapiens
cattcacagcaggtcagctgaa

SEQ ID NO: 7534429 - DNA, 22 bp, Homo sapiens
cattcacagcaggtcagctgaa

SEQ ID NO: 7534430 - DNA, 22 bp, Homo sapiens
cattcacagagggggaagcatc

SEQ ID NO: 7534431 - DNA, 22 bp, Homo sapiens
cattcacagagggggaagcatc

SEQ ID NO: 7534432 - DNA, 22 bp, Homo sapiens
cattcacaactgagcattgttg

SEQ ID NO: 7534433 - DNA, 22 bp, Homo sapiens
cattcacaactgagcattgttg

SEQ ID NO: 7534434 - DNA, 22 bp, Homo sapiens
cattcacaatagttgaaaggtg

SEQ ID NO: 7534435 - DNA, 22 bp, Homo sapiens
cattcacaatggattgcttcaa

SEQ ID NO: 7534436 - DNA, 22 bp, Homo sapiens
cattcacaatggattgcttcaa

SEQ ID NO: 7534437 - DNA, 22 bp, Homo sapiens
cattcacaatagttgaaaggtg

SEQ ID NO: 7534438 - DNA, 22 bp, Homo sapiens
cattcacaatagttgaaaggtg

SEQ ID NO: 7534439 - DNA, 22 bp, Homo sapiens
cattcactcagcgatgccagta

SEQ ID NO: 7534440 - DNA, 22 bp, Homo sapiens
cattcactcagcgatgccagta

SEQ ID NO: 7534441 - DNA, 22 bp, Homo sapiens
cattcacattcttcttactgtt

SEQ ID NO: 7534442 - DNA, 22 bp, Homo sapiens
cattcaggtacactcagtgcta

SEQ ID NO: 7534443 - DNA, 17 bp, Homo sapiens
cattcagagtaattaca

SEQ ID NO: 7534444 - DNA, 17 bp, Homo sapiens
cattcagagtaattaca

SEQ ID NO: 7534445 - DNA, 22 bp, Homo sapiens
cattcagagctttcttatcata

SEQ ID NO: 7534446 - DNA, 22 bp, Homo sapiens
cattcagagctttcttatcata

SEQ ID NO: 7534447 - DNA, 22 bp, Homo sapiens
cattcagagctttcttatcata

SEQ ID NO: 7534448 - DNA, 22 bp, Homo sapiens
cattcagagctttcttatcata

SEQ ID NO: 7534449 - DNA, 22 bp, Homo sapiens
cattcacatcttgttccatcac

SEQ ID NO: 7534450 - DNA, 22 bp, Homo sapiens
cattcacatcttgttccatcac

SEQ ID NO: 7534451 - DNA, 22 bp, Homo sapiens
cattcacatcttgttccatcac

SEQ ID NO: 7534452 - DNA, 21 bp, Homo sapiens
cattcacagtctggctcttga

SEQ ID NO: 7534453 - DNA, 22 bp, Homo sapiens
cattcacatcttgttccatcac

SEQ ID NO: 7534454 - DNA, 22 bp, Homo sapiens
cattcacatcttgttccatcac

SEQ ID NO: 7534455 - DNA, 22 bp, Homo sapiens
cattcacattcttcttactgtt

SEQ ID NO: 7534456 - DNA, 22 bp, Homo sapiens
cattcacattcttcttactgtt

SEQ ID NO: 7534457 - DNA, 22 bp, Homo sapiens
cattcattcacattttgtctat

SEQ ID NO: 7534458 - DNA, 22 bp, Homo sapiens
cattcattagaatagatatgta

SEQ ID NO: 7534459 - DNA, 22 bp, Homo sapiens
cattcattacactcataaggtt

SEQ ID NO: 7534460 - DNA, 22 bp, Homo sapiens
cattcataggaggagatgatta

SEQ ID NO: 7534461 - DNA, 22 bp, Homo sapiens
cattcatatttgcagtatacct

SEQ ID NO: 7534462 - DNA, 22 bp, Homo sapiens
cattcatatttgcagtatacct

SEQ ID NO: 7534463 - DNA, 22 bp, Homo sapiens
cattcataagactttgctcttg

SEQ ID NO: 7534464 - DNA, 22 bp, Homo sapiens
cattcatacaagtttgtttcat

SEQ ID NO: 7534465 - DNA, 22 bp, Homo sapiens
cattcatacaagtttgtttcat

SEQ ID NO: 7534466 - DNA, 22 bp, Homo sapiens
cattcataagtttttgtgctgg

SEQ ID NO: 7534467 - DNA, 22 bp, Homo sapiens
cattcataggaagaaaatgggc

SEQ ID NO: 7534468 - DNA, 22 bp, Homo sapiens
cattcagtcatgctggttttga

SEQ ID NO: 7534469 - DNA, 22 bp, Homo sapiens
cattcagtcatgctggttttga

SEQ ID NO: 7534470 - DNA, 22 bp, Homo sapiens
cattcagtggagtattattcag

SEQ ID NO: 7534471 - DNA, 22 bp, Homo sapiens
cattcataagactttgctcttg

SEQ ID NO: 7534472 - DNA, 22 bp, Homo sapiens
ccagcagcagcgtccaaggaga

SEQ ID NO: 7534473 - DNA, 22 bp, Homo sapiens
ccagcagcaggccaggccctcc

SEQ ID NO: 7534474 - DNA, 22 bp, Homo sapiens
ccagcagcagcgtccaaggaga

SEQ ID NO: 7534475 - DNA, 22 bp, Homo sapiens
ccagcagcaggccaggccctcc

SEQ ID NO: 7534476 - DNA, 22 bp, Homo sapiens
ccagcagcaggccaggccctcc

SEQ ID NO: 7534477 - DNA, 22 bp, Homo sapiens
ccagcagcaggccaggccctcc

SEQ ID NO: 7534478 - DNA, 22 bp, Homo sapiens
ccagcagagttggtttctggta

SEQ ID NO: 7534479 - DNA, 22 bp, Homo sapiens
ccagcagagtggggtttagagt

SEQ ID NO: 7534480 - DNA, 22 bp, Homo sapiens
ccagcagagtggggtttagagt

SEQ ID NO: 7534481 - DNA, 22 bp, Homo sapiens
ccagcagagtctaggaaggagg

SEQ ID NO: 7534482 - DNA, 22 bp, Homo sapiens
ccagcagagtctaggaaggagg

SEQ ID NO: 7534483 - DNA, 22 bp, Homo sapiens
ccagcagagttggtttctggta

SEQ ID NO: 7534484 - DNA, 22 bp, Homo sapiens
ccagcagagttggtttctggta

SEQ ID NO: 7534485 - DNA, 22 bp, Homo sapiens
ccagcagcagcgtccaaggaga

SEQ ID NO: 7534486 - DNA, 22 bp, Homo sapiens
ccagcagcagcgtccaaggaga

SEQ ID NO: 7534487 - DNA, 22 bp, Homo sapiens
ccagcagcagcgtccaaggaga

SEQ ID NO: 7534488 - DNA, 22 bp, Homo sapiens
ccagcagcagcgtccaaggaga

SEQ ID NO: 7534489 - DNA, 22 bp, Homo sapiens
ccagcagagtatcaatgtattt

SEQ ID NO: 7534490 - DNA, 22 bp, Homo sapiens
ccagcagagtatcaatgtattt

SEQ ID NO: 7534491 - DNA, 22 bp, Homo sapiens
ccagcagagggtcttggccatt

SEQ ID NO: 7534492 - DNA, 22 bp, Homo sapiens
ccagcagagggtcttggccatt

SEQ ID NO: 7534493 - DNA, 22 bp, Homo sapiens
ccagcagagggtcttggccatt

SEQ ID NO: 7534494 - DNA, 22 bp, Homo sapiens
ccagcagagtctaggaaggagg

SEQ ID NO: 7534495 - DNA, 22 bp, Homo sapiens
ccagcagagtatcaatgtattt

SEQ ID NO: 7534496 - DNA, 22 bp, Homo sapiens
ccagcagagtctaggaaggagg

SEQ ID NO: 7534497 - DNA, 22 bp, Homo sapiens
ccagcagagtctaggaaggagg

SEQ ID NO: 7534498 - DNA, 22 bp, Homo sapiens
ccagcagaggggcggagtgcag

SEQ ID NO: 7534499 - DNA, 22 bp, Homo sapiens
ccagcactgctctcagactgag

SEQ ID NO: 7534500 - DNA, 22 bp, Homo sapiens
ccagcagagggtcttggccatt

SEQ ID NO: 7534501 - DNA, 22 bp, Homo sapiens
ccagcagagggtcttggccatt

SEQ ID NO: 7534502 - DNA, 22 bp, Homo sapiens
ccagcactgctctcagactgag

SEQ ID NO: 7534503 - DNA, 22 bp, Homo sapiens
ccagcactgctctcagactgag

SEQ ID NO: 7534504 - DNA, 22 bp, Homo sapiens
ccagcactgctctcagactgag

SEQ ID NO: 7534505 - DNA, 22 bp, Homo sapiens
ccagcactgctctcagactgag

SEQ ID NO: 7534506 - DNA, 22 bp, Homo sapiens
ccagcagcatcctgcagcactt

SEQ ID NO: 7534507 - DNA, 22 bp, Homo sapiens
ccagcagcaggccaggccctcc

SEQ ID NO: 7534508 - DNA, 22 bp, Homo sapiens
ccagcagcaggccaggccctcc

SEQ ID NO: 7534509 - DNA, 22 bp, Homo sapiens
ccagcagcaggccaggccctcc

SEQ ID NO: 7534510 - DNA, 22 bp, Homo sapiens
ccagcagcatcctgcagcactt

SEQ ID NO: 7534511 - DNA, 22 bp, Homo sapiens
ccagcagcatcctgcagcactt

SEQ ID NO: 7534512 - DNA, 22 bp, Homo sapiens
ccagcagcatcctgcagcactt

SEQ ID NO: 7534513 - DNA, 22 bp, Homo sapiens
ccagcagcatcctgcagcactt

SEQ ID NO: 7534514 - DNA, 22 bp, Homo sapiens
ccagcagcatcctgcagcactt

SEQ ID NO: 7534515 - DNA, 22 bp, Homo sapiens
ccagcagccagagaaggacctc

SEQ ID NO: 7534516 - DNA, 22 bp, Homo sapiens
ccagcagccagagaaggacctc

SEQ ID NO: 7534517 - DNA, 22 bp, Homo sapiens
ccagcagccagagaaggacctc

SEQ ID NO: 7534518 - DNA, 22 bp, Homo sapiens
ccagcagccagagaaggacctc

SEQ ID NO: 7534519 - DNA, 22 bp, Homo sapiens
ccagcagccaccttctcgaaat

SEQ ID NO: 7534520 - DNA, 22 bp, Homo sapiens
ccagcagccaccttctcgaaat

SEQ ID NO: 7534521 - DNA, 22 bp, Homo sapiens
ccagcagccaccttctcgaaat

SEQ ID NO: 7534522 - DNA, 22 bp, Homo sapiens
ccagcagcatcctgcagcactt

SEQ ID NO: 7534523 - DNA, 22 bp, Homo sapiens
ccagcagcgatagggtgagtgc

SEQ ID NO: 7534524 - DNA, 22 bp, Homo sapiens
ccagcagcgatagggtgagtgc

SEQ ID NO: 7534525 - DNA, 22 bp, Homo sapiens
ccagcagcgatagggtgagtgc

SEQ ID NO: 7534526 - DNA, 22 bp, Homo sapiens
ccagcagcgatagggtgagtgc

SEQ ID NO: 7534527 - DNA, 22 bp, Homo sapiens
ccagcagccctcttccaagact

SEQ ID NO: 7534528 - DNA, 22 bp, Homo sapiens
ccagcagccctcttccaagact

SEQ ID NO: 7534529 - DNA, 22 bp, Homo sapiens
ccagcagccctcttccaagact

SEQ ID NO: 7534530 - DNA, 22 bp, Homo sapiens
ccagcagccctcttccaagact

SEQ ID NO: 7534531 - DNA, 22 bp, Homo sapiens
ccagcagcccctcaatgatctg

SEQ ID NO: 7534532 - DNA, 22 bp, Homo sapiens
ccagcagccctcttccaagact

SEQ ID NO: 7534533 - DNA, 22 bp, Homo sapiens
ccagcagcccacaggcgtccct

SEQ ID NO: 7534534 - DNA, 22 bp, Homo sapiens
ccagcagcccacaggcgtccct

SEQ ID NO: 7534535 - DNA, 22 bp, Homo sapiens
ccagcagcccacaggcgtccct

SEQ ID NO: 7534536 - DNA, 22 bp, Homo sapiens
ccagcagcccacaggcgtccct

SEQ ID NO: 7534537 - DNA, 22 bp, Homo sapiens
ccagcagcccacaggcgtccct

SEQ ID NO: 7534538 - DNA, 22 bp, Homo sapiens
ccagcagcccacaggcgtccct

SEQ ID NO: 7534539 - DNA, 22 bp, Homo sapiens
ccagcagcccacaggcgtccct

SEQ ID NO: 7534540 - DNA, 22 bp, Homo sapiens
ccagcagcccacaggcgtccct

SEQ ID NO: 7534541 - DNA, 22 bp, Homo sapiens
ccagcagcccctcaatgatctg

SEQ ID NO: 7534542 - DNA, 22 bp, Homo sapiens
ccagcagcccctcaatgatctg

SEQ ID NO: 7534543 - DNA, 22 bp, Homo sapiens
ccagcagctgacaccagtccca

SEQ ID NO: 7534544 - DNA, 22 bp, Homo sapiens
ccagcagctgacaccagtccca

SEQ ID NO: 7534545 - DNA, 22 bp, Homo sapiens
ccagcagctgacaccagtccca

SEQ ID NO: 7534546 - DNA, 22 bp, Homo sapiens
ccagcagctgacaccagtccca

SEQ ID NO: 7534547 - DNA, 22 bp, Homo sapiens
ccagcagctgacaccagtccca

SEQ ID NO: 7534548 - DNA, 22 bp, Homo sapiens
ccagcagctgacaccagtccca

SEQ ID NO: 7534549 - DNA, 22 bp, Homo sapiens
ccagcagctgacaccagtccca

SEQ ID NO: 7534550 - DNA, 22 bp, Homo sapiens
ccagcagctgcaaagcctgggt

SEQ ID NO: 7534551 - DNA, 22 bp, Homo sapiens
ccagcagctgcaaagcctgggt

SEQ ID NO: 7534552 - DNA, 22 bp, Homo sapiens
ccagcagctgcaaagcctgggt

SEQ ID NO: 7534553 - DNA, 22 bp, Homo sapiens
ccagcagctgcaaagcctgggt

SEQ ID NO: 7534554 - DNA, 22 bp, Homo sapiens
ccagcagctgacaccagtccca

SEQ ID NO: 7534555 - DNA, 22 bp, Homo sapiens
ccagcagctgcaaagcctgggt

SEQ ID NO: 7534556 - DNA, 22 bp, Homo sapiens
ccagcagctgcaaagcctgggt

SEQ ID NO: 7534557 - DNA, 22 bp, Homo sapiens
ccagcagctgcaaagcctgggt

SEQ ID NO: 7534558 - DNA, 22 bp, Homo sapiens
ccagcagctgcaaagcctgggt

SEQ ID NO: 7534559 - DNA, 22 bp, Homo sapiens
ccagcagctgcaaagcctgggt

SEQ ID NO: 7534560 - DNA, 22 bp, Homo sapiens
ccagcagctgcaaagcctgggt

SEQ ID NO: 7534561 - DNA, 22 bp, Homo sapiens
ccagcagctgctatgtggtttt

SEQ ID NO: 7534562 - DNA, 22 bp, Homo sapiens
ccagcagctgctatgtggtttt

SEQ ID NO: 7534563 - DNA, 22 bp, Homo sapiens
ccagcagctgctatgtggtttt

SEQ ID NO: 7534564 - DNA, 22 bp, Homo sapiens
ccagcagctgctatgtggtttt

SEQ ID NO: 7534565 - DNA, 22 bp, Homo sapiens
ccagcagctgcaaagcctgggt

SEQ ID NO: 7534566 - DNA, 22 bp, Homo sapiens
ccagcagctccctcagggtccg

SEQ ID NO: 7534567 - DNA, 22 bp, Homo sapiens
ccagcagctccctcagggtccg

SEQ ID NO: 7534568 - DNA, 22 bp, Homo sapiens
ccagcagctccctcagggtccg

SEQ ID NO: 7534569 - DNA, 22 bp, Homo sapiens
ccagcagctccctcagggtccg

SEQ ID NO: 7534570 - DNA, 22 bp, Homo sapiens
ccagcagctcagctactggtca

SEQ ID NO: 7534571 - DNA, 22 bp, Homo sapiens
ccagcagctccctcagggtccg

SEQ ID NO: 7534572 - DNA, 22 bp, Homo sapiens
ccagcagctccctcagggtccg

SEQ ID NO: 7534573 - DNA, 22 bp, Homo sapiens
ccagcagctccctcagggtccg

SEQ ID NO: 7534574 - DNA, 22 bp, Homo sapiens
ccagcagctccctcagggtccg

SEQ ID NO: 7534575 - DNA, 22 bp, Homo sapiens
ccagcagctccctcagggtccg

SEQ ID NO: 7534576 - DNA, 22 bp, Homo sapiens
ccagcagctccctcagggtccg

SEQ ID NO: 7534577 - DNA, 21 bp, Homo sapiens
ccagcagctcaaggatctctt

SEQ ID NO: 7534578 - DNA, 21 bp, Homo sapiens
ccagcagctcaaggatctctt

SEQ ID NO: 7534579 - DNA, 21 bp, Homo sapiens
ccagcagctcaaggatctctt

SEQ ID NO: 7534580 - DNA, 22 bp, Homo sapiens
ccagcagcgatagggtgagtgc

SEQ ID NO: 7534581 - DNA, 22 bp, Homo sapiens
ccagcagcgatagggtgagtgc

SEQ ID NO: 7534582 - DNA, 22 bp, Homo sapiens
ccagcagctcagctactggtca

SEQ ID NO: 7534583 - DNA, 22 bp, Homo sapiens
ccagcagctcagctactggtca

SEQ ID NO: 7534584 - DNA, 22 bp, Homo sapiens
ccagcagctcagctactggtca

SEQ ID NO: 7534585 - DNA, 22 bp, Homo sapiens
ccagcagctcagctactggtca

SEQ ID NO: 7534586 - DNA, 22 bp, Homo sapiens
ccagcagctcagctactggtca

SEQ ID NO: 7534587 - DNA, 21 bp, Homo sapiens
ccagcagctcaaggatctctt

SEQ ID NO: 7534588 - DNA, 22 bp, Homo sapiens
ccagcagggcagtgccctggac

SEQ ID NO: 7534589 - DNA, 22 bp, Homo sapiens
ccagcaggggaatatttttagg

SEQ ID NO: 7534590 - DNA, 22 bp, Homo sapiens
ccagcagggcagtgccctggac

SEQ ID NO: 7534591 - DNA, 22 bp, Homo sapiens
ccagcagggaaaaacccaccaa

SEQ ID NO: 7534592 - DNA, 22 bp, Homo sapiens
ccagcagggcagtgccctggac

SEQ ID NO: 7534593 - DNA, 22 bp, Homo sapiens
ccagcagggcagtgccctggac

SEQ ID NO: 7534594 - DNA, 22 bp, Homo sapiens
ccagcagggcagtgccctggac

SEQ ID NO: 7534595 - DNA, 22 bp, Homo sapiens
ccagcagggcagtgccctggac

SEQ ID NO: 7534596 - DNA, 22 bp, Homo sapiens
ccagcagggaaaaacccaccaa

SEQ ID NO: 7534597 - DNA, 22 bp, Homo sapiens
ccagcagggcagtgccctggac

SEQ ID NO: 7534598 - DNA, 22 bp, Homo sapiens
ccagcagggcagtgccctggac

SEQ ID NO: 7534599 - DNA, 22 bp, Homo sapiens
ccagcagggcagtgccctggac

SEQ ID NO: 7534600 - DNA, 22 bp, Homo sapiens
ccagcagggcagtgccctggac

SEQ ID NO: 7534601 - DNA, 22 bp, Homo sapiens
ccagcagctttattggctctcc

SEQ ID NO: 7534602 - DNA, 22 bp, Homo sapiens
ccagcagctttattggctctcc

SEQ ID NO: 7534603 - DNA, 22 bp, Homo sapiens
ccagcagctttattggctctcc

SEQ ID NO: 7534604 - DNA, 22 bp, Homo sapiens
ccagcagctttattggctctcc

SEQ ID NO: 7534605 - DNA, 22 bp, Homo sapiens
ccagcagctttattggctctcc

SEQ ID NO: 7534606 - DNA, 22 bp, Homo sapiens
ccagcagggaaaaacccaccaa

SEQ ID NO: 7534607 - DNA, 19 bp, Homo sapiens
ccagcagctttgattctct

SEQ ID NO: 7534608 - DNA, 22 bp, Homo sapiens
ccagcagctttattggctctcc

SEQ ID NO: 7534609 - DNA, 22 bp, Homo sapiens
ccagcagctttattggctctcc

SEQ ID NO: 7534610 - DNA, 22 bp, Homo sapiens
ccagcagctttattggctctcc

SEQ ID NO: 7534611 - DNA, 22 bp, Homo sapiens
ccagcagctgtggctttgcctc

SEQ ID NO: 7534612 - DNA, 22 bp, Homo sapiens
ccagcagctttattggctctcc

SEQ ID NO: 7534613 - DNA, 22 bp, Homo sapiens
ccagcagctttattggctctcc

SEQ ID NO: 7534614 - DNA, 22 bp, Homo sapiens
ccagcagctttattggctctcc

SEQ ID NO: 7534615 - DNA, 22 bp, Homo sapiens
ccagcagctgctatgtggtttt

SEQ ID NO: 7534616 - DNA, 22 bp, Homo sapiens
ccagcagctgtggctttgcctc

SEQ ID NO: 7534617 - DNA, 22 bp, Homo sapiens
ccagcagctgtggctttgcctc

SEQ ID NO: 7534618 - DNA, 22 bp, Homo sapiens
ccagcagctgtggctttgcctc

SEQ ID NO: 7534619 - DNA, 22 bp, Homo sapiens
ccagcagctgtggctttgcctc

SEQ ID NO: 7534620 - DNA, 22 bp, Homo sapiens
tctctgcccatcctcagtccac

SEQ ID NO: 7534621 - DNA, 22 bp, Homo sapiens
tctctgcccatcctcagtccac

SEQ ID NO: 7534622 - DNA, 22 bp, Homo sapiens
tctctgcccatcctcagtccac

SEQ ID NO: 7534623 - DNA, 22 bp, Homo sapiens
tctctgcccatgagcaatctgc

SEQ ID NO: 7534624 - DNA, 22 bp, Homo sapiens
tctctgggaatgggcctgggta

SEQ ID NO: 7534625 - DNA, 22 bp, Homo sapiens
tctctgggaatgggcctgggta

SEQ ID NO: 7534626 - DNA, 22 bp, Homo sapiens
tctctgggaattcacaagccct

SEQ ID NO: 7534627 - DNA, 22 bp, Homo sapiens
tctctgggaattcacaagccct

SEQ ID NO: 7534628 - DNA, 22 bp, Homo sapiens
tctctgggaattcacaagccct

SEQ ID NO: 7534629 - DNA, 22 bp, Homo sapiens
tctctgggaattcacaagccct

SEQ ID NO: 7534630 - DNA, 22 bp, Homo sapiens
tctctgccaccatgagatgggc

SEQ ID NO: 7534631 - DNA, 22 bp, Homo sapiens
tctctgccacagcttctgcctt

SEQ ID NO: 7534632 - DNA, 22 bp, Homo sapiens
tctctgccacagcttctgcctt

SEQ ID NO: 7534633 - DNA, 23 bp, Homo sapiens
tctctgcatgtcctgagcacatc

SEQ ID NO: 7534634 - DNA, 23 bp, Homo sapiens
tctctgcatgtcctgagcacatc

SEQ ID NO: 7534635 - DNA, 22 bp, Homo sapiens
tctctgccacagcttctgcctt

SEQ ID NO: 7534636 - DNA, 22 bp, Homo sapiens
tctctgcccatcctcagtccac

SEQ ID NO: 7534637 - DNA, 22 bp, Homo sapiens
tctctgcccatcctcagtccac

SEQ ID NO: 7534638 - DNA, 22 bp, Homo sapiens
tctctgcccatcctcagtccac

SEQ ID NO: 7534639 - DNA, 22 bp, Homo sapiens
tctctgcccatcctcagtccac

SEQ ID NO: 7534640 - DNA, 22 bp, Homo sapiens
tctctgcccatcctcagtccac

SEQ ID NO: 7534641 - DNA, 22 bp, Homo sapiens
tctctgcccaagtttctcaagt

SEQ ID NO: 7534642 - DNA, 22 bp, Homo sapiens
tctctgggacactgggtcagtt

SEQ ID NO: 7534643 - DNA, 22 bp, Homo sapiens
tctctgggacactgggtcagtt

SEQ ID NO: 7534644 - DNA, 22 bp, Homo sapiens
tctctgggaattttttggacat

SEQ ID NO: 7534645 - DNA, 22 bp, Homo sapiens
tctctgggaattttttggacat

SEQ ID NO: 7534646 - DNA, 22 bp, Homo sapiens
tctctgggaattttttggacat

SEQ ID NO: 7534647 - DNA, 22 bp, Homo sapiens
tctctgggagccaggatgacac

SEQ ID NO: 7534648 - DNA, 22 bp, Homo sapiens
tctctgggagccaggatgacac

SEQ ID NO: 7534649 - DNA, 22 bp, Homo sapiens
tctctgggagcaattgtttgct

SEQ ID NO: 7534650 - DNA, 22 bp, Homo sapiens
tctctgggagccaggatgacac

SEQ ID NO: 7534651 - DNA, 22 bp, Homo sapiens
tctctgggacactgggtcagtt

SEQ ID NO: 7534652 - DNA, 22 bp, Homo sapiens
tctctgggacactgggtcagtt

SEQ ID NO: 7534653 - DNA, 22 bp, Homo sapiens
tctctgggacactgggtcagtt

SEQ ID NO: 7534654 - DNA, 22 bp, Homo sapiens
tctctgggagcaattgtttgct

SEQ ID NO: 7534655 - DNA, 21 bp, Homo sapiens
tctctgggaggacttgtgaga

SEQ ID NO: 7534656 - DNA, 21 bp, Homo sapiens
tctctgggaggacttgtgaga

SEQ ID NO: 7534657 - DNA, 22 bp, Homo sapiens
tctctgggagccaggatgacac

SEQ ID NO: 7534658 - DNA, 21 bp, Homo sapiens
tctctgggaggacttgtgaga

SEQ ID NO: 7534659 - DNA, 22 bp, Homo sapiens
tctctgggagttgagcagcagc

SEQ ID NO: 7534660 - DNA, 22 bp, Homo sapiens
tctctgggagttgagcagcagc

SEQ ID NO: 7534661 - DNA, 22 bp, Homo sapiens
tctctgggagttgagcagcagc

SEQ ID NO: 7534662 - DNA, 22 bp, Homo sapiens
tctctgggagttgagcagcagc

SEQ ID NO: 7534663 - DNA, 22 bp, Homo sapiens
tctctgggagttgagcagcagc

SEQ ID NO: 7534664 - DNA, 22 bp, Homo sapiens
tctctgggagttgagcagcagc

SEQ ID NO: 7534665 - DNA, 17 bp, Homo sapiens
tctcctggctctatcag

SEQ ID NO: 7534666 - DNA, 23 bp, Homo sapiens
tctcctggctgcactgtggccac

SEQ ID NO: 7534667 - DNA, 23 bp, Homo sapiens
tctcctggctgcactgtggccac

SEQ ID NO: 7534668 - DNA, 23 bp, Homo sapiens
tctcctggctgcactgtggccac

SEQ ID NO: 7534669 - DNA, 22 bp, Homo sapiens
tctcctggctctaaaaggctgt

SEQ ID NO: 7534670 - DNA, 17 bp, Homo sapiens
tctcctggctctatcag

SEQ ID NO: 7534671 - DNA, 17 bp, Homo sapiens
tctcctggctctatcag

SEQ ID NO: 7534672 - DNA, 22 bp, Homo sapiens
tctcctggctctaaaaggctgt

SEQ ID NO: 7534673 - DNA, 22 bp, Homo sapiens
tctcctggctctaaaaggctgt

SEQ ID NO: 7534674 - DNA, 22 bp, Homo sapiens
tctcctggctctaaaaggctgt

SEQ ID NO: 7534675 - DNA, 22 bp, Homo sapiens
tctcctggctctaaaaggctgt

SEQ ID NO: 7534676 - DNA, 22 bp, Homo sapiens
tctcctggccgggctgtcccct

SEQ ID NO: 7534677 - DNA, 22 bp, Homo sapiens
tctcctggccgggctgtcccct

SEQ ID NO: 7534678 - DNA, 22 bp, Homo sapiens
tctcctggccgggctgtcccct

SEQ ID NO: 7534679 - DNA, 22 bp, Homo sapiens
tctcctggcctttaggttaagg

SEQ ID NO: 7534680 - DNA, 22 bp, Homo sapiens
tctcctggcctttaggttaagg

SEQ ID NO: 7534681 - DNA, 22 bp, Homo sapiens
tctcctggctcaccaggctgga

SEQ ID NO: 7534682 - DNA, 22 bp, Homo sapiens
tctcctggctcaccaggctgga

SEQ ID NO: 7534683 - DNA, 22 bp, Homo sapiens
tctcctggctcaccaggctgga

SEQ ID NO: 7534684 - DNA, 22 bp, Homo sapiens
tctcctggctcaccaggctgga

SEQ ID NO: 7534685 - DNA, 22 bp, Homo sapiens
tctcctggctcaccaggctgga

SEQ ID NO: 7534686 - DNA, 22 bp, Homo sapiens
tctcctggctcaccaggctgga

SEQ ID NO: 7534687 - DNA, 22 bp, Homo sapiens
tctcctggctcaccaggctgga

SEQ ID NO: 7534688 - DNA, 20 bp, Homo sapiens
tctctgagtttcctaatttg

SEQ ID NO: 7534689 - DNA, 22 bp, Homo sapiens
tctctgagttttaaggatgatg

SEQ ID NO: 7534690 - DNA, 22 bp, Homo sapiens
tctctgagttttaaggatgatg

SEQ ID NO: 7534691 - DNA, 22 bp, Homo sapiens
tctctgagttttaaggatgatg

SEQ ID NO: 7534692 - DNA, 22 bp, Homo sapiens
tctctgagttgtaaaaaatagt

SEQ ID NO: 7534693 - DNA, 23 bp, Homo sapiens
tctctgagttgtactttcccttg

SEQ ID NO: 7534694 - DNA, 23 bp, Homo sapiens
tctctgagttgtactttcccttg

SEQ ID NO: 7534695 - DNA, 22 bp, Homo sapiens
tctctcttgtcaccccatctgc

SEQ ID NO: 7534696 - DNA, 23 bp, Homo sapiens
tctcctggctgcactgtggccac

SEQ ID NO: 7534697 - DNA, 22 bp, Homo sapiens
tctcctgggaggacaaggaagg

SEQ ID NO: 7534698 - DNA, 22 bp, Homo sapiens
tctctgagttctcctccagccc

SEQ ID NO: 7534699 - DNA, 22 bp, Homo sapiens
tctctgagttctcctccagccc

SEQ ID NO: 7534700 - DNA, 22 bp, Homo sapiens
tctctcttgtcaccccatctgc

SEQ ID NO: 7534701 - DNA, 22 bp, Homo sapiens
tctctcttgtcaccccatctgc

SEQ ID NO: 7534702 - DNA, 22 bp, Homo sapiens
tctctcttgtcaccccatctgc

SEQ ID NO: 7534703 - DNA, 20 bp, Homo sapiens
tctctgcagcagaggctggg

SEQ ID NO: 7534704 - DNA, 19 bp, Homo sapiens
tctctgcagcgcgcccggc

SEQ ID NO: 7534705 - DNA, 22 bp, Homo sapiens
tctctgcagctaagaaattaat

SEQ ID NO: 7534706 - DNA, 22 bp, Homo sapiens
tctctgcagtcttgggcaggca

SEQ ID NO: 7534707 - DNA, 22 bp, Homo sapiens
tctctgcatcccagggctcagc

SEQ ID NO: 7534708 - DNA, 22 bp, Homo sapiens
tctctgcatccccagggctctc

SEQ ID NO: 7534709 - DNA, 22 bp, Homo sapiens
tctctgcatgacccaaggctga

SEQ ID NO: 7534710 - DNA, 22 bp, Homo sapiens
tctctgcacagaagtagatagc

SEQ ID NO: 7534711 - DNA, 22 bp, Homo sapiens
tctctgcacagaagtagatagc

SEQ ID NO: 7534712 - DNA, 22 bp, Homo sapiens
tctctgcacttgcacataagct

SEQ ID NO: 7534713 - DNA, 22 bp, Homo sapiens
tctctgcacttgcacataagct

SEQ ID NO: 7534714 - DNA, 22 bp, Homo sapiens
tctctgcaagatgagaaatatt

SEQ ID NO: 7534715 - DNA, 22 bp, Homo sapiens
tctctgatgattggaagcttag

SEQ ID NO: 7534716 - DNA, 22 bp, Homo sapiens
tctctgatgattggaagcttag

SEQ ID NO: 7534717 - DNA, 22 bp, Homo sapiens
tctctgatgattggaagcttag

SEQ ID NO: 7534718 - DNA, 22 bp, Homo sapiens
tctctgatgacctatgatgttg

SEQ ID NO: 7534719 - DNA, 22 bp, Homo sapiens
tctctgtgtgttggctgtatat

SEQ ID NO: 7534720 - DNA, 22 bp, Homo sapiens
tctctgtgtgttggctgtatat

SEQ ID NO: 7534721 - DNA, 22 bp, Homo sapiens
tctctgtgtgtgtgacagcatt

SEQ ID NO: 7534722 - DNA, 22 bp, Homo sapiens
tctctgtgtgtgtgacagcatt

SEQ ID NO: 7534723 - DNA, 22 bp, Homo sapiens
tctctgtgttccctgttttctc

SEQ ID NO: 7534724 - DNA, 22 bp, Homo sapiens
tctctgtgtgttggctgtatat

SEQ ID NO: 7534725 - DNA, 22 bp, Homo sapiens
tctctgtgttccctgttttctc

SEQ ID NO: 7534726 - DNA, 22 bp, Homo sapiens
tctctgtgtgttggctgtatat

SEQ ID NO: 7534727 - DNA, 22 bp, Homo sapiens
tctctgtgtgttggctgtatat

SEQ ID NO: 7534728 - DNA, 22 bp, Homo sapiens
tctctgtgtgttggctgtatat

SEQ ID NO: 7534729 - DNA, 22 bp, Homo sapiens
tctctgttcatggcactatgtc

SEQ ID NO: 7534730 - DNA, 22 bp, Homo sapiens
tctcttaaaagattttaatgac

SEQ ID NO: 7534731 - DNA, 22 bp, Homo sapiens
tctcttaaaagagtaatagaga

SEQ ID NO: 7534732 - DNA, 22 bp, Homo sapiens
tctcttaaaagattttaatgac

SEQ ID NO: 7534733 - DNA, 22 bp, Homo sapiens
tctctgtgttccctgttttctc

SEQ ID NO: 7534734 - DNA, 22 bp, Homo sapiens
tctctgttcatggcactatgtc

SEQ ID NO: 7534735 - DNA, 22 bp, Homo sapiens
tctctgttcatggcactatgtc

SEQ ID NO: 7534736 - DNA, 22 bp, Homo sapiens
tctctgttcatggcactatgtc

SEQ ID NO: 7534737 - DNA, 22 bp, Homo sapiens
tctcttaaaggtcttcagctga

SEQ ID NO: 7534738 - DNA, 22 bp, Homo sapiens
tctcttaaatacttcacatctc

SEQ ID NO: 7534739 - DNA, 22 bp, Homo sapiens
tctcttaactggttcagcaatt

SEQ ID NO: 7534740 - DNA, 22 bp, Homo sapiens
tctgaaatgaactcttgaactt

SEQ ID NO: 7534741 - DNA, 22 bp, Homo sapiens
tctgaaatgacctttccccact

SEQ ID NO: 7534742 - DNA, 22 bp, Homo sapiens
tctgaaatgacctttccccact

SEQ ID NO: 7534743 - DNA, 22 bp, Homo sapiens
ccagcaggtgtagggctcatgg

SEQ ID NO: 7534744 - DNA, 22 bp, Homo sapiens
ccagcaggtgtagggctcatgg

SEQ ID NO: 7534745 - DNA, 22 bp, Homo sapiens
ccagcagggttggtttcttctg

SEQ ID NO: 7534746 - DNA, 22 bp, Homo sapiens
ccagcaggtgtagggctcatgg

SEQ ID NO: 7534747 - DNA, 22 bp, Homo sapiens
ccagcaggtgtagggctcatgg

SEQ ID NO: 7534748 - DNA, 22 bp, Homo sapiens
ccagcagggttggtttcttctg

SEQ ID NO: 7534749 - DNA, 22 bp, Homo sapiens
ccagcaggggaatatttttagg

SEQ ID NO: 7534750 - DNA, 22 bp, Homo sapiens
ccagcagggttggtttcttctg

SEQ ID NO: 7534751 - DNA, 22 bp, Homo sapiens
ccagcaggtgtagggctcatgg

SEQ ID NO: 7534752 - DNA, 22 bp, Homo sapiens
ccagcaggtgtagggctcatgg

SEQ ID NO: 7534753 - DNA, 22 bp, Homo sapiens
ccagcagggttggtttcttctg

SEQ ID NO: 7534754 - DNA, 22 bp, Homo sapiens
ccagcaggtgtagggctcatgg

SEQ ID NO: 7534755 - DNA, 22 bp, Homo sapiens
ccagcaggtgtagggctcatgg

SEQ ID NO: 7534756 - DNA, 19 bp, Homo sapiens
ccagcaggttcatttcagg

SEQ ID NO: 7534757 - DNA, 22 bp, Homo sapiens
ccagcaggtgtagggctcatgg

SEQ ID NO: 7534758 - DNA, 22 bp, Homo sapiens
ccagcaggtgtagggctcatgg

SEQ ID NO: 7534759 - DNA, 22 bp, Homo sapiens
ccagcaggtgtagggctcatgg

SEQ ID NO: 7534760 - DNA, 19 bp, Homo sapiens
ccagcaggttcatttcagg

SEQ ID NO: 7534761 - DNA, 19 bp, Homo sapiens
ccagcaggttcatttcagg

SEQ ID NO: 7534762 - DNA, 22 bp, Homo sapiens
ccagcatcagcacccaaggagc

SEQ ID NO: 7534763 - DNA, 22 bp, Homo sapiens
ccagcatcagcattgtcttagg

SEQ ID NO: 7534764 - DNA, 22 bp, Homo sapiens
ccagcatcagcacccaaggagc

SEQ ID NO: 7534765 - DNA, 22 bp, Homo sapiens
ccagcatcagcacccaaggagc

SEQ ID NO: 7534766 - DNA, 22 bp, Homo sapiens
tctctgtgtgggagatcttttt

SEQ ID NO: 7534767 - DNA, 22 bp, Homo sapiens
tctctgtgtgccttcatctgcc

SEQ ID NO: 7534768 - DNA, 22 bp, Homo sapiens
tctctgtgtgccttcatctgcc

SEQ ID NO: 7534769 - DNA, 22 bp, Homo sapiens
tctctgtgtgccttcatctgcc

SEQ ID NO: 7534770 - DNA, 19 bp, Homo sapiens
ccagcaggttcatttcagg

SEQ ID NO: 7534771 - DNA, 23 bp, Homo sapiens
tctctgtgtgcctcagtttcttc

SEQ ID NO: 7534772 - DNA, 22 bp, Homo sapiens
tctctgtgtgccttcatctgcc

SEQ ID NO: 7534773 - DNA, 22 bp, Homo sapiens
tctctgtgtgccttcatctgcc

SEQ ID NO: 7534774 - DNA, 18 bp, Homo sapiens
ccagcatgccagaggctg

SEQ ID NO: 7534775 - DNA, 18 bp, Homo sapiens
ccagcatgccagaggctg

SEQ ID NO: 7534776 - DNA, 22 bp, Homo sapiens
ccagcatgctcagtctaaattg

SEQ ID NO: 7534777 - DNA, 18 bp, Homo sapiens
ccagcatgccagaggctg

SEQ ID NO: 7534778 - DNA, 18 bp, Homo sapiens
ccagcatgccagaggctg

SEQ ID NO: 7534779 - DNA, 22 bp, Homo sapiens
ccagcatctatgtgctgttgat

SEQ ID NO: 7534780 - DNA, 22 bp, Homo sapiens
ccagcatctgtcctttccctca

SEQ ID NO: 7534781 - DNA, 22 bp, Homo sapiens
ccagcatctatgtgctgttgat

SEQ ID NO: 7534782 - DNA, 22 bp, Homo sapiens
ccagcatctaacgctcctggga

SEQ ID NO: 7534783 - DNA, 22 bp, Homo sapiens
ccagcatctaacgctcctggga

SEQ ID NO: 7534784 - DNA, 22 bp, Homo sapiens
ccagcatctaacgctcctggga

SEQ ID NO: 7534785 - DNA, 22 bp, Homo sapiens
ccagcatctaacgctcctggga

SEQ ID NO: 7534786 - DNA, 22 bp, Homo sapiens
ccagcatcgacttcctgcctga

SEQ ID NO: 7534787 - DNA, 22 bp, Homo sapiens
ccagcatcgacttcctgcctga

SEQ ID NO: 7534788 - DNA, 22 bp, Homo sapiens
ccagcatcgacttcctgcctga

SEQ ID NO: 7534789 - DNA, 22 bp, Homo sapiens
ccagcatcgacttcctgcctga

SEQ ID NO: 7534790 - DNA, 22 bp, Homo sapiens
ccagcatcgacttcctgcctga

SEQ ID NO: 7534791 - DNA, 22 bp, Homo sapiens
tctgaatttagtgattagcttt

SEQ ID NO: 7534792 - DNA, 22 bp, Homo sapiens
tctgaatttagtgattagcttt

SEQ ID NO: 7534793 - DNA, 20 bp, Homo sapiens
tctgaattgagtgaatgtct

SEQ ID NO: 7534794 - DNA, 22 bp, Homo sapiens
tctgaattctgacaatttgaat

SEQ ID NO: 7534795 - DNA, 22 bp, Homo sapiens
tctgaattcttagaattaaagg

SEQ ID NO: 7534796 - DNA, 22 bp, Homo sapiens
tctgaattcttagaattaaagg

SEQ ID NO: 7534797 - DNA, 20 bp, Homo sapiens
tctgaattgagtgaatgtct

SEQ ID NO: 7534798 - DNA, 20 bp, Homo sapiens
tctgaattgagtgaatgtct

SEQ ID NO: 7534799 - DNA, 22 bp, Homo sapiens
ccagcatcctcagctcacttct

SEQ ID NO: 7534800 - DNA, 22 bp, Homo sapiens
ccagcatcctcagctcacttct

SEQ ID NO: 7534801 - DNA, 22 bp, Homo sapiens
ccagcatccctggggttggcca

SEQ ID NO: 7534802 - DNA, 22 bp, Homo sapiens
ccagcatccatgctccctcggg

SEQ ID NO: 7534803 - DNA, 22 bp, Homo sapiens
ccagcatccatgctccctcggg

SEQ ID NO: 7534804 - DNA, 22 bp, Homo sapiens
ccagcatccctggggttggcca

SEQ ID NO: 7534805 - DNA, 22 bp, Homo sapiens
tctgaatttcccaaggctatct

SEQ ID NO: 7534806 - DNA, 22 bp, Homo sapiens
tctgaatttgcattttaacaag

SEQ ID NO: 7534807 - DNA, 22 bp, Homo sapiens
ccagcatcagtcagattttgct

SEQ ID NO: 7534808 - DNA, 22 bp, Homo sapiens
ccagcatccatgctccctcggg

SEQ ID NO: 7534809 - DNA, 22 bp, Homo sapiens
ccagcatccatgctccctcggg

SEQ ID NO: 7534810 - DNA, 19 bp, Homo sapiens
tctgaagtccagggcatac

SEQ ID NO: 7534811 - DNA, 19 bp, Homo sapiens
tctgaagtccagggcatac

SEQ ID NO: 7534812 - DNA, 22 bp, Homo sapiens
tctgaaggtttgattggagcta

SEQ ID NO: 7534813 - DNA, 22 bp, Homo sapiens
tctgaataatgtccttgtatca

SEQ ID NO: 7534814 - DNA, 22 bp, Homo sapiens
tctgaataatgtccttgtatca

SEQ ID NO: 7534815 - DNA, 22 bp, Homo sapiens
tctgaataatgtccttgtatca

SEQ ID NO: 7534816 - DNA, 22 bp, Homo sapiens
tctgaagttcttaaattagttt

SEQ ID NO: 7534817 - DNA, 22 bp, Homo sapiens
tctgaagtgatcatcatttctc

SEQ ID NO: 7534818 - DNA, 22 bp, Homo sapiens
tctgaagttcttaaattagttt

SEQ ID NO: 7534819 - DNA, 22 bp, Homo sapiens
tctgaatagttctattttaaag

SEQ ID NO: 7534820 - DNA, 22 bp, Homo sapiens
tctgaatagtatattgaaagca

SEQ ID NO: 7534821 - DNA, 22 bp, Homo sapiens
tctgaatagtatattgaaagca

SEQ ID NO: 7534822 - DNA, 22 bp, Homo sapiens
tctgaatagtatattgaaagca

SEQ ID NO: 7534823 - DNA, 22 bp, Homo sapiens
tctgaatagagagaggtccttt

SEQ ID NO: 7534824 - DNA, 22 bp, Homo sapiens
tctgaatatgtttatcatctct

SEQ ID NO: 7534825 - DNA, 22 bp, Homo sapiens
tctgaatagttctattttaaag

SEQ ID NO: 7534826 - DNA, 22 bp, Homo sapiens
tctgaatatgtttatcatctct

SEQ ID NO: 7534827 - DNA, 22 bp, Homo sapiens
tctgaatatgtttatcatctct

SEQ ID NO: 7534828 - DNA, 19 bp, Homo sapiens
tctgaattatttatgtacc

SEQ ID NO: 7534829 - DNA, 22 bp, Homo sapiens
tctgaattcagtatggtctttc

SEQ ID NO: 7534830 - DNA, 22 bp, Homo sapiens
tctgaattctgacaatttgaat

SEQ ID NO: 7534831 - DNA, 22 bp, Homo sapiens
tctgaattctgacaatttgaat

SEQ ID NO: 7534832 - DNA, 22 bp, Homo sapiens
tctgaattaatcatgcctcttt

SEQ ID NO: 7534833 - DNA, 19 bp, Homo sapiens
tctgaattatttatgtacc

SEQ ID NO: 7534834 - DNA, 19 bp, Homo sapiens
tctgaattatttatgtacc

SEQ ID NO: 7534835 - DNA, 23 bp, Homo sapiens
tctgaattatctcattttcagag

SEQ ID NO: 7534836 - DNA, 22 bp, Homo sapiens
tctgaattaggggttttcaggt

SEQ ID NO: 7534837 - DNA, 22 bp, Homo sapiens
tctgaatcacagtcattcagct

SEQ ID NO: 7534838 - DNA, 22 bp, Homo sapiens
tctgaatcgttcccatgcagga

SEQ ID NO: 7534839 - DNA, 18 bp, Homo sapiens
tctgaatattatgcagtg

SEQ ID NO: 7534840 - DNA, 18 bp, Homo sapiens
tctgaatattatgcagtg

SEQ ID NO: 7534841 - DNA, 22 bp, Homo sapiens
tctgaattaaaccctttgtgcc

SEQ ID NO: 7534842 - DNA, 22 bp, Homo sapiens
tctgaatgttaggaaactttct

SEQ ID NO: 7534843 - DNA, 22 bp, Homo sapiens
tctgaatgttaggaaactttct

SEQ ID NO: 7534844 - DNA, 22 bp, Homo sapiens
tctgaatgtatcgaattgaggc

SEQ ID NO: 7534845 - DNA, 22 bp, Homo sapiens
ccagccctgtttatgtgtcact

SEQ ID NO: 7534846 - DNA, 22 bp, Homo sapiens
ccagccctgtttatgtgtcact

SEQ ID NO: 7534847 - DNA, 22 bp, Homo sapiens
ccagccctgtttatgtgtcact

SEQ ID NO: 7534848 - DNA, 19 bp, Homo sapiens
ccagccctgtcacttcttg

SEQ ID NO: 7534849 - DNA, 19 bp, Homo sapiens
ccagccctgtcacttcttg

SEQ ID NO: 7534850 - DNA, 22 bp, Homo sapiens
ccagccctgtttatgtgtcact

SEQ ID NO: 7534851 - DNA, 22 bp, Homo sapiens
ccagccctgtttatgtgtcact

SEQ ID NO: 7534852 - DNA, 22 bp, Homo sapiens
ccagcccttagataaacctggc

SEQ ID NO: 7534853 - DNA, 22 bp, Homo sapiens
ccagcccttagataaacctggc

SEQ ID NO: 7534854 - DNA, 22 bp, Homo sapiens
ccagcccttcccaactggccag

SEQ ID NO: 7534855 - DNA, 22 bp, Homo sapiens
ccagcccttcccaactggccag

SEQ ID NO: 7534856 - DNA, 22 bp, Homo sapiens
ccagccctgtaaggatgaggca

SEQ ID NO: 7534857 - DNA, 22 bp, Homo sapiens
ccagccctgtaaggatgaggca

SEQ ID NO: 7534858 - DNA, 22 bp, Homo sapiens
ccagccctgcctctcagggccc

SEQ ID NO: 7534859 - DNA, 22 bp, Homo sapiens
ccagccctgtaaggatgaggca

SEQ ID NO: 7534860 - DNA, 22 bp, Homo sapiens
ccagccctgtaaggatgaggca

SEQ ID NO: 7534861 - DNA, 22 bp, Homo sapiens
ccagccctgtaaggatgaggca

SEQ ID NO: 7534862 - DNA, 22 bp, Homo sapiens
ccagccctgtcaccaactggag

SEQ ID NO: 7534863 - DNA, 22 bp, Homo sapiens
ccagccctgtcaccaactggag

SEQ ID NO: 7534864 - DNA, 22 bp, Homo sapiens
ccagccctgtcaccaactggag

SEQ ID NO: 7534865 - DNA, 22 bp, Homo sapiens
ccagccctgtcaccaactggag

SEQ ID NO: 7534866 - DNA, 22 bp, Homo sapiens
ccagccctgtcaccaactggag

SEQ ID NO: 7534867 - DNA, 22 bp, Homo sapiens
ccagccctgtcaccaactggag

SEQ ID NO: 7534868 - DNA, 22 bp, Homo sapiens
ccagccctgtcaccaactggag

SEQ ID NO: 7534869 - DNA, 19 bp, Homo sapiens
ccagccctgtcacttcttg

SEQ ID NO: 7534870 - DNA, 22 bp, Homo sapiens
ccagccctgtcaccaactggag

SEQ ID NO: 7534871 - DNA, 22 bp, Homo sapiens
ccagccctgtcaccaactggag

SEQ ID NO: 7534872 - DNA, 22 bp, Homo sapiens
ccagccacagcttccagctcct

SEQ ID NO: 7534873 - DNA, 22 bp, Homo sapiens
ccagccacagcttccagctcct

SEQ ID NO: 7534874 - DNA, 22 bp, Homo sapiens
ccagcatttgcttaatttggag

SEQ ID NO: 7534875 - DNA, 22 bp, Homo sapiens
ccagccacagcttccagctcct

SEQ ID NO: 7534876 - DNA, 22 bp, Homo sapiens
ccagccacagcttccagctcct

SEQ ID NO: 7534877 - DNA, 22 bp, Homo sapiens
ccagcatttgcttctggtgggg

SEQ ID NO: 7534878 - DNA, 22 bp, Homo sapiens
ccagcatttgcatggtgttaaa

SEQ ID NO: 7534879 - DNA, 22 bp, Homo sapiens
ccagcatttgcttaatttggag

SEQ ID NO: 7534880 - DNA, 20 bp, Homo sapiens
ccagcatgtacacatgtgga

SEQ ID NO: 7534881 - DNA, 22 bp, Homo sapiens
ccagcatggcacctgagatgag

SEQ ID NO: 7534882 - DNA, 20 bp, Homo sapiens
ccagcatgtacacatgtgga

SEQ ID NO: 7534883 - DNA, 20 bp, Homo sapiens
ccagcatgtacacatgtgga

SEQ ID NO: 7534884 - DNA, 22 bp, Homo sapiens
ccagccaccgcttgtttgcact

SEQ ID NO: 7534885 - DNA, 22 bp, Homo sapiens
ccagccacgaagctcccttcat

SEQ ID NO: 7534886 - DNA, 22 bp, Homo sapiens
ccagccacagcttccagctcct

SEQ ID NO: 7534887 - DNA, 22 bp, Homo sapiens
ccagccaccgcttgtttgcact

SEQ ID NO: 7534888 - DNA, 22 bp, Homo sapiens
ccagccacagcttccagctcct

SEQ ID NO: 7534889 - DNA, 22 bp, Homo sapiens
ccagccctcactgaggcctctc

SEQ ID NO: 7534890 - DNA, 22 bp, Homo sapiens
ccagccctcactgaggcctctc

SEQ ID NO: 7534891 - DNA, 22 bp, Homo sapiens
ccagccctcactgaggcctctc

SEQ ID NO: 7534892 - DNA, 22 bp, Homo sapiens
ccagccctgcctctcagggccc

SEQ ID NO: 7534893 - DNA, 22 bp, Homo sapiens
ccagccctgcctctcagggccc

SEQ ID NO: 7534894 - DNA, 22 bp, Homo sapiens
ccagccctgcctctcagggccc

SEQ ID NO: 7534895 - DNA, 22 bp, Homo sapiens
ccagccctgcctctcagggccc

SEQ ID NO: 7534896 - DNA, 22 bp, Homo sapiens
ccagccctgcctctcagggccc

SEQ ID NO: 7534897 - DNA, 19 bp, Homo sapiens
tctgcagaaggcatacatg

SEQ ID NO: 7534898 - DNA, 22 bp, Homo sapiens
tctgcagaagtggctgggccac

SEQ ID NO: 7534899 - DNA, 22 bp, Homo sapiens
tctgcagaagtggctgggccac

SEQ ID NO: 7534900 - DNA, 19 bp, Homo sapiens
tctgcagaaggcatacatg

SEQ ID NO: 7534901 - DNA, 22 bp, Homo sapiens
tctgcagaagtggctgggccac

SEQ ID NO: 7534902 - DNA, 22 bp, Homo sapiens
tctgcagaattcgaggaagaaa

SEQ ID NO: 7534903 - DNA, 22 bp, Homo sapiens
tctgcagaattcgaggaagaaa

SEQ ID NO: 7534904 - DNA, 22 bp, Homo sapiens
tctgcagaagctcactaaatcc

SEQ ID NO: 7534905 - DNA, 22 bp, Homo sapiens
tctgcagaagctcactaaatcc

SEQ ID NO: 7534906 - DNA, 22 bp, Homo sapiens
tctgcagaaggaatcagctgag

SEQ ID NO: 7534907 - DNA, 22 bp, Homo sapiens
tctgcagaaggaatcagctgag

SEQ ID NO: 7534908 - DNA, 22 bp, Homo sapiens
tctgcagaagctcactaaatcc

SEQ ID NO: 7534909 - DNA, 22 bp, Homo sapiens
tctgcagaagccatggccttgc

SEQ ID NO: 7534910 - DNA, 22 bp, Homo sapiens
tctgatattggggtcagagtag

SEQ ID NO: 7534911 - DNA, 22 bp, Homo sapiens
tctgcagaaggaatcagctgag

SEQ ID NO: 7534912 - DNA, 22 bp, Homo sapiens
tctgcagaaggaatcagctgag

SEQ ID NO: 7534913 - DNA, 22 bp, Homo sapiens
tctgcagaaggaatcagctgag

SEQ ID NO: 7534914 - DNA, 19 bp, Homo sapiens
tctgcagaaggcatacatg

SEQ ID NO: 7534915 - DNA, 19 bp, Homo sapiens
tctgcagaaggcatacatg

SEQ ID NO: 7534916 - DNA, 22 bp, Homo sapiens
tctgcagaaggaatcagctgag

SEQ ID NO: 7534917 - DNA, 22 bp, Homo sapiens
tctgcagaaggaatcagctgag

SEQ ID NO: 7534918 - DNA, 22 bp, Homo sapiens
tctgatataaaagtgacattca

SEQ ID NO: 7534919 - DNA, 22 bp, Homo sapiens
tctgagagtctctgaggcagat

SEQ ID NO: 7534920 - DNA, 22 bp, Homo sapiens
tctgagagtctctgaggcagat

SEQ ID NO: 7534921 - DNA, 22 bp, Homo sapiens
tctgagagtctctgaggcagat

SEQ ID NO: 7534922 - DNA, 22 bp, Homo sapiens
tctgagagtctctgaggcagat

SEQ ID NO: 7534923 - DNA, 22 bp, Homo sapiens
tctgagagtctctgaggcagat

SEQ ID NO: 7534924 - DNA, 22 bp, Homo sapiens
tctgatatcgcactaaactctg

SEQ ID NO: 7534925 - DNA, 22 bp, Homo sapiens
tctgatatcgcactaaactctg

SEQ ID NO: 7534926 - DNA, 22 bp, Homo sapiens
tctgatatgaatgtctagctct

SEQ ID NO: 7534927 - DNA, 22 bp, Homo sapiens
tctgatatgaatgtctagctct

SEQ ID NO: 7534928 - DNA, 22 bp, Homo sapiens
tctgagagtacgggctgcgcgc

SEQ ID NO: 7534929 - DNA, 22 bp, Homo sapiens
tctgagagtacgggctgcgcgc

SEQ ID NO: 7534930 - DNA, 22 bp, Homo sapiens
tctgagagtacgggctgcgcgc

SEQ ID NO: 7534931 - DNA, 22 bp, Homo sapiens
tctgagagtagagctgcctctt

SEQ ID NO: 7534932 - DNA, 22 bp, Homo sapiens
tctgagagtccatctccaagcc

SEQ ID NO: 7534933 - DNA, 22 bp, Homo sapiens
tctgagagtccatctccaagcc

SEQ ID NO: 7534934 - DNA, 22 bp, Homo sapiens
tctgagagtctctgaggcagat

SEQ ID NO: 7534935 - DNA, 22 bp, Homo sapiens
tctgagagtctctgaggcagat

SEQ ID NO: 7534936 - DNA, 22 bp, Homo sapiens
tctgagagctgccatctcattt

SEQ ID NO: 7534937 - DNA, 22 bp, Homo sapiens
tctgagagctgccatctcattt

SEQ ID NO: 7534938 - DNA, 22 bp, Homo sapiens
tctgagagctgccatctcattt

SEQ ID NO: 7534939 - DNA, 22 bp, Homo sapiens
tctgagagctctggggcccctt

SEQ ID NO: 7534940 - DNA, 22 bp, Homo sapiens
tctgagagcctctagcctaagt

SEQ ID NO: 7534941 - DNA, 22 bp, Homo sapiens
tctgagagcctctagcctaagt

SEQ ID NO: 7534942 - DNA, 22 bp, Homo sapiens
tctgagagcctctagcctaagt

SEQ ID NO: 7534943 - DNA, 22 bp, Homo sapiens
tctgagagctgtagaagcctat

SEQ ID NO: 7534944 - DNA, 22 bp, Homo sapiens
tctgagagctgtagaagcctat

SEQ ID NO: 7534945 - DNA, 22 bp, Homo sapiens
tctgagaggattcctgtcccga

SEQ ID NO: 7534946 - DNA, 22 bp, Homo sapiens
tctgagaggcatctgcacttct

SEQ ID NO: 7534947 - DNA, 22 bp, Homo sapiens
tctgagaggcatctgcacttct

SEQ ID NO: 7534948 - DNA, 22 bp, Homo sapiens
tctgagaggcatctgcacttct

SEQ ID NO: 7534949 - DNA, 22 bp, Homo sapiens
tctgagaggcagaccttcctaa

SEQ ID NO: 7534950 - DNA, 22 bp, Homo sapiens
tctgagaggcagaccttcctaa

SEQ ID NO: 7534951 - DNA, 22 bp, Homo sapiens
tctgagaggcagaccttcctaa

SEQ ID NO: 7534952 - DNA, 22 bp, Homo sapiens
tctgagaggttaagcaatttga

SEQ ID NO: 7534953 - DNA, 22 bp, Homo sapiens
tctgagaggtgaattcagcaaa

SEQ ID NO: 7534954 - DNA, 22 bp, Homo sapiens
tctgagaggttaagcaatttga

SEQ ID NO: 7534955 - DNA, 22 bp, Homo sapiens
tctgagaggtgaattcagcaaa

SEQ ID NO: 7534956 - DNA, 22 bp, Homo sapiens
tctgagaggtgaattcagcaaa

SEQ ID NO: 7534957 - DNA, 22 bp, Homo sapiens
tctgagaggtgaattcagcaaa

SEQ ID NO: 7534958 - DNA, 22 bp, Homo sapiens
tctgagagcaaggcattagcag

SEQ ID NO: 7534959 - DNA, 21 bp, Homo sapiens
tctgagagcaactgcccttta

SEQ ID NO: 7534960 - DNA, 21 bp, Homo sapiens
tctgagagcaactgcccttta

SEQ ID NO: 7534961 - DNA, 22 bp, Homo sapiens
ccagcccttcccaactggccag

SEQ ID NO: 7534962 - DNA, 22 bp, Homo sapiens
ccagcccttcccaactggccag

SEQ ID NO: 7534963 - DNA, 22 bp, Homo sapiens
tctgagagatacaaggaggcaa

SEQ ID NO: 7534964 - DNA, 22 bp, Homo sapiens
tctgagagatacaaggaggcaa

SEQ ID NO: 7534965 - DNA, 22 bp, Homo sapiens
tctgagagcaaggcattagcag

SEQ ID NO: 7534966 - DNA, 22 bp, Homo sapiens
tctgagagcaggaggagctgct

SEQ ID NO: 7534967 - DNA, 22 bp, Homo sapiens
tctgagagcaggaggagctgct

SEQ ID NO: 7534968 - DNA, 22 bp, Homo sapiens
tctgagagcaggaggagctgct

SEQ ID NO: 7534969 - DNA, 22 bp, Homo sapiens
tctgagagcatcactggggtac

SEQ ID NO: 7534970 - DNA, 22 bp, Homo sapiens
tctgagagccactgaacagcaa

SEQ ID NO: 7534971 - DNA, 22 bp, Homo sapiens
tctatattccagatacagatta

SEQ ID NO: 7534972 - DNA, 22 bp, Homo sapiens
tctatattccagatacagatta

SEQ ID NO: 7534973 - DNA, 22 bp, Homo sapiens
tctatattccagatacagatta

SEQ ID NO: 7534974 - DNA, 18 bp, Homo sapiens
tctatatggacatagaga

SEQ ID NO: 7534975 - DNA, 22 bp, Homo sapiens
tctatattccagatacagatta

SEQ ID NO: 7534976 - DNA, 22 bp, Homo sapiens
tctatattccagatacagatta

SEQ ID NO: 7534977 - DNA, 22 bp, Homo sapiens
tctcaaatgtaaagcatgattt

SEQ ID NO: 7534978 - DNA, 22 bp, Homo sapiens
tctcaaatgtaaagcatgattt

SEQ ID NO: 7534979 - DNA, 22 bp, Homo sapiens
tctcaaattcccttttcctcct

SEQ ID NO: 7534980 - DNA, 22 bp, Homo sapiens
tctcaaattcccttttcctcct

SEQ ID NO: 7534981 - DNA, 22 bp, Homo sapiens
tctcaaatgtaaagcatgattt

SEQ ID NO: 7534982 - DNA, 16 bp, Homo sapiens
ccacctgcagctctca

SEQ ID NO: 7534983 - DNA, 16 bp, Homo sapiens
ccacctgcagctctca

SEQ ID NO: 7534984 - DNA, 16 bp, Homo sapiens
ccacctgcagctctca

SEQ ID NO: 7534985 - DNA, 16 bp, Homo sapiens
ccacctgcagctctca

SEQ ID NO: 7534986 - DNA, 16 bp, Homo sapiens
ccacctgcagctctca

SEQ ID NO: 7534987 - DNA, 16 bp, Homo sapiens
ccacctgcagctctca

SEQ ID NO: 7534988 - DNA, 22 bp, Homo sapiens
ccacctgagataagagagctca

SEQ ID NO: 7534989 - DNA, 22 bp, Homo sapiens
ccacctgagataagagagctca

SEQ ID NO: 7534990 - DNA, 22 bp, Homo sapiens
ccacctgagataagagagctca

SEQ ID NO: 7534991 - DNA, 22 bp, Homo sapiens
ccacctgagataagagagctca

SEQ ID NO: 7534992 - DNA, 22 bp, Homo sapiens
tctatatcttggctgctgtgaa

SEQ ID NO: 7534993 - DNA, 16 bp, Homo sapiens
ccacctgcagctctca

SEQ ID NO: 7534994 - DNA, 22 bp, Homo sapiens
tctatataacctccacttctac

SEQ ID NO: 7534995 - DNA, 22 bp, Homo sapiens
tctatattatacatccaggatt

SEQ ID NO: 7534996 - DNA, 22 bp, Homo sapiens
tctatattatacatccaggatt

SEQ ID NO: 7534997 - DNA, 22 bp, Homo sapiens
ccacctcctaggcctggagaag

SEQ ID NO: 7534998 - DNA, 22 bp, Homo sapiens
ccacctcctcggccatgtgacg

SEQ ID NO: 7534999 - DNA, 22 bp, Homo sapiens
ccacctcctcggccatgtgacg

SEQ ID NO: 7535000 - DNA, 22 bp, Homo sapiens
ccacctcctcggccatgtgacg

SEQ ID NO: 7535001 - DNA, 22 bp, Homo sapiens
ccacctcctcggccatgtgacg

SEQ ID NO: 7535002 - DNA, 22 bp, Homo sapiens
ccacctctcagggtttcctaat

SEQ ID NO: 7535003 - DNA, 22 bp, Homo sapiens
ccacctctcagggtttcctaat

SEQ ID NO: 7535004 - DNA, 22 bp, Homo sapiens
ccacctcctcggccatgtgacg

SEQ ID NO: 7535005 - DNA, 22 bp, Homo sapiens
ccacctcctcggccatgtgacg

SEQ ID NO: 7535006 - DNA, 22 bp, Homo sapiens
ccacctcctcggccatgtgacg

SEQ ID NO: 7535007 - DNA, 22 bp, Homo sapiens
ccacctccacctattgccagcc

SEQ ID NO: 7535008 - DNA, 22 bp, Homo sapiens
ccacctccacctattgccagcc

SEQ ID NO: 7535009 - DNA, 22 bp, Homo sapiens
ccacctcctaggcctggagaag

SEQ ID NO: 7535010 - DNA, 22 bp, Homo sapiens
ccacctcctaggcctggagaag

SEQ ID NO: 7535011 - DNA, 22 bp, Homo sapiens
ccacctcctaggcctggagaag

SEQ ID NO: 7535012 - DNA, 22 bp, Homo sapiens
ccacctcctaggcctggagaag

SEQ ID NO: 7535013 - DNA, 22 bp, Homo sapiens
ccacctcctaggcctggagaag

SEQ ID NO: 7535014 - DNA, 22 bp, Homo sapiens
ccacctccacctattgccagcc

SEQ ID NO: 7535015 - DNA, 22 bp, Homo sapiens
ccacctccacctattgccagcc

SEQ ID NO: 7535016 - DNA, 22 bp, Homo sapiens
ccacctccacctattgccagcc

SEQ ID NO: 7535017 - DNA, 22 bp, Homo sapiens
ccacctccacctattgccagcc

SEQ ID NO: 7535018 - DNA, 22 bp, Homo sapiens
ccacctccacctattgccagcc

SEQ ID NO: 7535019 - DNA, 22 bp, Homo sapiens
tctcaagactggttttcacagc

SEQ ID NO: 7535020 - DNA, 22 bp, Homo sapiens
tctcaagagggaggcaatcatg

SEQ ID NO: 7535021 - DNA, 22 bp, Homo sapiens
tctcaagagggaggcaatcatg

SEQ ID NO: 7535022 - DNA, 22 bp, Homo sapiens
tctcaagagggaggcaatcatg

SEQ ID NO: 7535023 - DNA, 21 bp, Homo sapiens
tctcaacttttctctttgggc

SEQ ID NO: 7535024 - DNA, 22 bp, Homo sapiens
tctcaactaatggtgcaagatg

SEQ ID NO: 7535025 - DNA, 22 bp, Homo sapiens
tctcaactttgagaaacattgt

SEQ ID NO: 7535026 - DNA, 22 bp, Homo sapiens
tctcaagctactaccttggatc

SEQ ID NO: 7535027 - DNA, 23 bp, Homo sapiens
tctcaagaggaagcagggctcat

SEQ ID NO: 7535028 - DNA, 23 bp, Homo sapiens
tctcaagccagaccaggcctcgc

SEQ ID NO: 7535029 - DNA, 22 bp, Homo sapiens
tctcaagatctcaagatggccc

SEQ ID NO: 7535030 - DNA, 22 bp, Homo sapiens
tctcaagcttgttggtatgttt

SEQ ID NO: 7535031 - DNA, 22 bp, Homo sapiens
tctcaagcttgttggtatgttt

SEQ ID NO: 7535032 - DNA, 22 bp, Homo sapiens
tctcaagcttgttggtatgttt

SEQ ID NO: 7535033 - DNA, 22 bp, Homo sapiens
tctcaagcttgttggtatgttt

SEQ ID NO: 7535034 - DNA, 22 bp, Homo sapiens
tctcaagcttgttggtatgttt

SEQ ID NO: 7535035 - DNA, 22 bp, Homo sapiens
tctcaaatttgttagataaaat

SEQ ID NO: 7535036 - DNA, 22 bp, Homo sapiens
tctcaaatttgttagataaaat

SEQ ID NO: 7535037 - DNA, 22 bp, Homo sapiens
tctcaaatttgttagataaaat

SEQ ID NO: 7535038 - DNA, 22 bp, Homo sapiens
tctcaaatttgttagataaaat

SEQ ID NO: 7535039 - DNA, 22 bp, Homo sapiens
tctcaacaccacttgctgaaga

SEQ ID NO: 7535040 - DNA, 22 bp, Homo sapiens
tctcaaatttgttagataaaat

SEQ ID NO: 7535041 - DNA, 22 bp, Homo sapiens
tctcaaatttgctggaccagta

SEQ ID NO: 7535042 - DNA, 22 bp, Homo sapiens
tctcaaatttgctggaccagta

SEQ ID NO: 7535043 - DNA, 22 bp, Homo sapiens
tctcaaatttatacagagttca

SEQ ID NO: 7535044 - DNA, 22 bp, Homo sapiens
tctcaaatttgctggaccagta

SEQ ID NO: 7535045 - DNA, 22 bp, Homo sapiens
tctcaaatttatacagagttca

SEQ ID NO: 7535046 - DNA, 22 bp, Homo sapiens
tctcaaatttgttagataaaat

SEQ ID NO: 7535047 - DNA, 22 bp, Homo sapiens
tctcaaatttatacagagttca

SEQ ID NO: 7535048 - DNA, 22 bp, Homo sapiens
tctcaaatttatacagagttca

SEQ ID NO: 7535049 - DNA, 22 bp, Homo sapiens
tctcaaatttatacagagttca

SEQ ID NO: 7535050 - DNA, 20 bp, Homo sapiens
tctcagtttctagagtcagg

SEQ ID NO: 7535051 - DNA, 20 bp, Homo sapiens
tctcagtttctagagtcagg

SEQ ID NO: 7535052 - DNA, 22 bp, Homo sapiens
tctcagtttctcattataaaag

SEQ ID NO: 7535053 - DNA, 22 bp, Homo sapiens
tctcagtttctcattataaaag

SEQ ID NO: 7535054 - DNA, 22 bp, Homo sapiens
tctcagtttctcattataaaag

SEQ ID NO: 7535055 - DNA, 20 bp, Homo sapiens
tctcagtttctagagtcagg

SEQ ID NO: 7535056 - DNA, 20 bp, Homo sapiens
tctcagtttctagagtcagg

SEQ ID NO: 7535057 - DNA, 22 bp, Homo sapiens
tctccacaagctttctcctttt

SEQ ID NO: 7535058 - DNA, 22 bp, Homo sapiens
tctccacaagctttctcctttt

SEQ ID NO: 7535059 - DNA, 22 bp, Homo sapiens
tctccacaagtgttgagagtac

SEQ ID NO: 7535060 - DNA, 22 bp, Homo sapiens
tctccacaagtgttgagagtac

SEQ ID NO: 7535061 - DNA, 22 bp, Homo sapiens
tctccacaagtgttgagagtac

SEQ ID NO: 7535062 - DNA, 22 bp, Homo sapiens
tctcagtttcctcatatgtaaa

SEQ ID NO: 7535063 - DNA, 22 bp, Homo sapiens
tctcagtttcctcatatgtaaa

SEQ ID NO: 7535064 - DNA, 22 bp, Homo sapiens
tctcagtttcctcatatgtaaa

SEQ ID NO: 7535065 - DNA, 22 bp, Homo sapiens
ccagaaaactctacatgcttgt

SEQ ID NO: 7535066 - DNA, 22 bp, Homo sapiens
ccagaaaactctacatgcttgt

SEQ ID NO: 7535067 - DNA, 22 bp, Homo sapiens
ccagaaaactctacatgcttgt

SEQ ID NO: 7535068 - DNA, 22 bp, Homo sapiens
ccagaaaaatcctcccttgtcc

SEQ ID NO: 7535069 - DNA, 22 bp, Homo sapiens
ccagaaaaatcctcccttgtcc

SEQ ID NO: 7535070 - DNA, 22 bp, Homo sapiens
ccagaaaaatcctcccttgtcc

SEQ ID NO: 7535071 - DNA, 22 bp, Homo sapiens
ccacttttttctccatctctga

SEQ ID NO: 7535072 - DNA, 22 bp, Homo sapiens
tctccacagtcccacctcgctt

SEQ ID NO: 7535073 - DNA, 22 bp, Homo sapiens
tctccacagtcccacctcgctt

SEQ ID NO: 7535074 - DNA, 22 bp, Homo sapiens
tctccacagaaggttccaggcc

SEQ ID NO: 7535075 - DNA, 20 bp, Homo sapiens
tctccaccacagagagcaga

SEQ ID NO: 7535076 - DNA, 22 bp, Homo sapiens
tctccactattttctagctctt

SEQ ID NO: 7535077 - DNA, 22 bp, Homo sapiens
tctccactattttctagctctt

SEQ ID NO: 7535078 - DNA, 22 bp, Homo sapiens
tctccacgtgatggagtccagg

SEQ ID NO: 7535079 - DNA, 22 bp, Homo sapiens
tctccacactttctctcccagg

SEQ ID NO: 7535080 - DNA, 22 bp, Homo sapiens
tctccacactttctctcccagg

SEQ ID NO: 7535081 - DNA, 22 bp, Homo sapiens
tctccacactttctctcccagg

SEQ ID NO: 7535082 - DNA, 22 bp, Homo sapiens
tctccacactttctctcccagg

SEQ ID NO: 7535083 - DNA, 22 bp, Homo sapiens
tctccacaccagaaggagctga

SEQ ID NO: 7535084 - DNA, 22 bp, Homo sapiens
tctccacaccagaaggagctga

SEQ ID NO: 7535085 - DNA, 22 bp, Homo sapiens
tctccacaccagaaggagctga

SEQ ID NO: 7535086 - DNA, 22 bp, Homo sapiens
tctccacaccagaaggagctga

SEQ ID NO: 7535087 - DNA, 22 bp, Homo sapiens
tctccacaccagaaggagctga

SEQ ID NO: 7535088 - DNA, 19 bp, Homo sapiens
ccactttgcagatagtgag

SEQ ID NO: 7535089 - DNA, 22 bp, Homo sapiens
ccacttgtcagagtttctctgc

SEQ ID NO: 7535090 - DNA, 22 bp, Homo sapiens
ccactttgagaagctgatgaaa

SEQ ID NO: 7535091 - DNA, 22 bp, Homo sapiens
ccactttctgagggaacagcag

SEQ ID NO: 7535092 - DNA, 22 bp, Homo sapiens
ccactttgaaccactgaggtgg

SEQ ID NO: 7535093 - DNA, 22 bp, Homo sapiens
ccactttgaaccactgaggtgg

SEQ ID NO: 7535094 - DNA, 22 bp, Homo sapiens
ccacttgtgaaataatcaaata

SEQ ID NO: 7535095 - DNA, 22 bp, Homo sapiens
ccacttgtgaaataatcaaata

SEQ ID NO: 7535096 - DNA, 22 bp, Homo sapiens
ccactttctgagggaacagcag

SEQ ID NO: 7535097 - DNA, 22 bp, Homo sapiens
ccacttgcaaaagagaaagtta

SEQ ID NO: 7535098 - DNA, 22 bp, Homo sapiens
ccacttgacattttcattaaga

SEQ ID NO: 7535099 - DNA, 22 bp, Homo sapiens
ccacttgacaataaactgagct

SEQ ID NO: 7535100 - DNA, 22 bp, Homo sapiens
ccacttgaattttagtggtttt

SEQ ID NO: 7535101 - DNA, 22 bp, Homo sapiens
ccacttgacattttcattaaga

SEQ ID NO: 7535102 - DNA, 22 bp, Homo sapiens
ccacttgaattttagtggtttt

SEQ ID NO: 7535103 - DNA, 22 bp, Homo sapiens
ccacttgaatcaaattcttagg

SEQ ID NO: 7535104 - DNA, 22 bp, Homo sapiens
ccacttgaatcaaattcttagg

SEQ ID NO: 7535105 - DNA, 22 bp, Homo sapiens
tctcaagcttgttggtatgttt

SEQ ID NO: 7535106 - DNA, 22 bp, Homo sapiens
ccacttgaaatatctttgttct

SEQ ID NO: 7535107 - DNA, 22 bp, Homo sapiens
ccacttgaaatatctttgttct

SEQ ID NO: 7535108 - DNA, 22 bp, Homo sapiens
ccacttgaaacttagtggcata

SEQ ID NO: 7535109 - DNA, 22 bp, Homo sapiens
ccacttttcactaagatgaatt

SEQ ID NO: 7535110 - DNA, 22 bp, Homo sapiens
ccacttttcactaagatgaatt

SEQ ID NO: 7535111 - DNA, 22 bp, Homo sapiens
ccacttttctacccactgtgac

SEQ ID NO: 7535112 - DNA, 22 bp, Homo sapiens
ccacttttctacccactgtgac

SEQ ID NO: 7535113 - DNA, 22 bp, Homo sapiens
ccacttttctacccactgtgac

SEQ ID NO: 7535114 - DNA, 22 bp, Homo sapiens
ccacttttcactaagatgaatt

SEQ ID NO: 7535115 - DNA, 19 bp, Homo sapiens
ccactttgcttctctgggt

SEQ ID NO: 7535116 - DNA, 22 bp, Homo sapiens
ccacttttgggaacagtgagta

SEQ ID NO: 7535117 - DNA, 22 bp, Homo sapiens
ccactttttagagaacaaaact

SEQ ID NO: 7535118 - DNA, 22 bp, Homo sapiens
ccactttttagagaacaaaact

SEQ ID NO: 7535119 - DNA, 22 bp, Homo sapiens
ccactttttagagaacaaaact

SEQ ID NO: 7535120 - DNA, 22 bp, Homo sapiens
ccacttttgggaacagtgagta

SEQ ID NO: 7535121 - DNA, 22 bp, Homo sapiens
ccacttttgggaacagtgagta

SEQ ID NO: 7535122 - DNA, 22 bp, Homo sapiens
ccacttttttctccatctctga

SEQ ID NO: 7535123 - DNA, 22 bp, Homo sapiens
ccacttttttctccatctctga

SEQ ID NO: 7535124 - DNA, 22 bp, Homo sapiens
ccacttttttctccatctctga

SEQ ID NO: 7535125 - DNA, 22 bp, Homo sapiens
ccacttttttctccatctctga

SEQ ID NO: 7535126 - DNA, 22 bp, Homo sapiens
ccacttttttctccatctctga

SEQ ID NO: 7535127 - DNA, 22 bp, Homo sapiens
ccactttttcagtgtgcatgca

SEQ ID NO: 7535128 - DNA, 22 bp, Homo sapiens
ccactttttcagtgtgcatgca

SEQ ID NO: 7535129 - DNA, 20 bp, Homo sapiens
tctccctgcccatctcagat

SEQ ID NO: 7535130 - DNA, 20 bp, Homo sapiens
tctccctgcccatctcagat

SEQ ID NO: 7535131 - DNA, 20 bp, Homo sapiens
tctccctgcccatctcagat

SEQ ID NO: 7535132 - DNA, 20 bp, Homo sapiens
tctccctgcccatctcagat

SEQ ID NO: 7535133 - DNA, 20 bp, Homo sapiens
tctccctgcccatctcagat

SEQ ID NO: 7535134 - DNA, 20 bp, Homo sapiens
tctccctgcccatctcagat

SEQ ID NO: 7535135 - DNA, 20 bp, Homo sapiens
tctccctgcccatctcagat

SEQ ID NO: 7535136 - DNA, 20 bp, Homo sapiens
tctccctgcccatctcagat

SEQ ID NO: 7535137 - DNA, 23 bp, Homo sapiens
tctccctgaggttgttagcatta

SEQ ID NO: 7535138 - DNA, 23 bp, Homo sapiens
tctccctgaggttgttagcatta

SEQ ID NO: 7535139 - DNA, 23 bp, Homo sapiens
tctccctgaggttgttagcatta

SEQ ID NO: 7535140 - DNA, 22 bp, Homo sapiens
tctccctctttgtctgctttgg

SEQ ID NO: 7535141 - DNA, 22 bp, Homo sapiens
tctccctctttgtctgctttgg

SEQ ID NO: 7535142 - DNA, 22 bp, Homo sapiens
tctccctctttgtctgctttgg

SEQ ID NO: 7535143 - DNA, 22 bp, Homo sapiens
tctccctctttgtctgctttgg

SEQ ID NO: 7535144 - DNA, 22 bp, Homo sapiens
tctccctctttgtctgctttgg

SEQ ID NO: 7535145 - DNA, 22 bp, Homo sapiens
tctccgtgccgtgggaggctcc

SEQ ID NO: 7535146 - DNA, 22 bp, Homo sapiens
tctcctggccgggctgtcccct

SEQ ID NO: 7535147 - DNA, 22 bp, Homo sapiens
tctcctggccctgtcgccatct

SEQ ID NO: 7535148 - DNA, 16 bp, Homo sapiens
tctcccttgtcacctg

SEQ ID NO: 7535149 - DNA, 22 bp, Homo sapiens
tctccgatcacaggttttcaat

SEQ ID NO: 7535150 - DNA, 22 bp, Homo sapiens
tctccgatcacaggttttcaat

SEQ ID NO: 7535151 - DNA, 22 bp, Homo sapiens
tctccgggtgcatgtgtgtgcc

SEQ ID NO: 7535152 - DNA, 22 bp, Homo sapiens
tctccctggagccctgaagcat

SEQ ID NO: 7535153 - DNA, 22 bp, Homo sapiens
tctccctggagccctgaagcat

SEQ ID NO: 7535154 - DNA, 22 bp, Homo sapiens
tctccctgtggaggacccctta

SEQ ID NO: 7535155 - DNA, 22 bp, Homo sapiens
tctccctgtggaggacccctta

SEQ ID NO: 7535156 - DNA, 16 bp, Homo sapiens
tctccctgttctccaa

SEQ ID NO: 7535157 - DNA, 22 bp, Homo sapiens
tctccctgtttgctacgctatc

SEQ ID NO: 7535158 - DNA, 22 bp, Homo sapiens
tctcccttggtcacagattcct

SEQ ID NO: 7535159 - DNA, 22 bp, Homo sapiens
tctcccttggtcacagattcct

SEQ ID NO: 7535160 - DNA, 22 bp, Homo sapiens
tctccctctcagatttattcac

SEQ ID NO: 7535161 - DNA, 22 bp, Homo sapiens
tctccctctcagatttattcac

SEQ ID NO: 7535162 - DNA, 22 bp, Homo sapiens
tctccctctcagatttattcac

SEQ ID NO: 7535163 - DNA, 22 bp, Homo sapiens
tctccctctgtaagatcagggg

SEQ ID NO: 7535164 - DNA, 22 bp, Homo sapiens
tctccctctgtaagatcagggg

SEQ ID NO: 7535165 - DNA, 22 bp, Homo sapiens
tctccctctgtaagatcagggg

SEQ ID NO: 7535166 - DNA, 22 bp, Homo sapiens
tctccctctttgtctgctttgg

SEQ ID NO: 7535167 - DNA, 22 bp, Homo sapiens
tctccctctttgtctgctttgg

SEQ ID NO: 7535168 - DNA, 22 bp, Homo sapiens
tctccctctttgtctgctttgg

SEQ ID NO: 7535169 - DNA, 22 bp, Homo sapiens
tctccctctgtaagatcagggg

SEQ ID NO: 7535170 - DNA, 22 bp, Homo sapiens
tctccctctgtaagatcagggg

SEQ ID NO: 7535171 - DNA, 22 bp, Homo sapiens
tctccctctcagatttattcac

SEQ ID NO: 7535172 - DNA, 22 bp, Homo sapiens
tctccctctcagatttattcac

SEQ ID NO: 7535173 - DNA, 22 bp, Homo sapiens
tctccctcattcctgcttccat

SEQ ID NO: 7535174 - DNA, 22 bp, Homo sapiens
tctccctcattcctgcttccat

SEQ ID NO: 7535175 - DNA, 22 bp, Homo sapiens
tctccctcattcctgcttccat

SEQ ID NO: 7535176 - DNA, 22 bp, Homo sapiens
tctcccacggtacaggataaac

SEQ ID NO: 7535177 - DNA, 22 bp, Homo sapiens
tctcccacggtacaggataaac

SEQ ID NO: 7535178 - DNA, 22 bp, Homo sapiens
tctcccacagtctcccatggct

SEQ ID NO: 7535179 - DNA, 22 bp, Homo sapiens
tctcccacagtctcccatggct

SEQ ID NO: 7535180 - DNA, 22 bp, Homo sapiens
ccagagaggccaaggtcgtggt

SEQ ID NO: 7535181 - DNA, 22 bp, Homo sapiens
ccagagaggccttggcaagaca

SEQ ID NO: 7535182 - DNA, 22 bp, Homo sapiens
ccagagaggccaaggtcgtggt

SEQ ID NO: 7535183 - DNA, 22 bp, Homo sapiens
ccagagaggccttggcaagaca

SEQ ID NO: 7535184 - DNA, 22 bp, Homo sapiens
ccagagaggccttggcaagaca

SEQ ID NO: 7535185 - DNA, 22 bp, Homo sapiens
ccagagaggccttggcaagaca

SEQ ID NO: 7535186 - DNA, 22 bp, Homo sapiens
ccagagaggccttggcaagaca

SEQ ID NO: 7535187 - DNA, 22 bp, Homo sapiens
ccagagaggccttggcaagaca

SEQ ID NO: 7535188 - DNA, 22 bp, Homo sapiens
ccagagaggccaaggtcgtggt

SEQ ID NO: 7535189 - DNA, 22 bp, Homo sapiens
ccagagaggccaaggtcgtggt

SEQ ID NO: 7535190 - DNA, 22 bp, Homo sapiens
ccagagaggccaaggtcgtggt

SEQ ID NO: 7535191 - DNA, 22 bp, Homo sapiens
ccagagaggccaaggtcgtggt

SEQ ID NO: 7535192 - DNA, 22 bp, Homo sapiens
ccagagaggccaaggtcgtggt

SEQ ID NO: 7535193 - DNA, 22 bp, Homo sapiens
ccagagaggcaaaactccttcc

SEQ ID NO: 7535194 - DNA, 22 bp, Homo sapiens
ccagagaggccaaggtcgtggt

SEQ ID NO: 7535195 - DNA, 22 bp, Homo sapiens
ccagagaggcaaaactccttcc

SEQ ID NO: 7535196 - DNA, 22 bp, Homo sapiens
tctccactctgagtgcctttca

SEQ ID NO: 7535197 - DNA, 18 bp, Homo sapiens
tctccacttctgtgagaa

SEQ ID NO: 7535198 - DNA, 18 bp, Homo sapiens
tctccacttctgtgagaa

SEQ ID NO: 7535199 - DNA, 22 bp, Homo sapiens
tctccactctgagtgcctttca

SEQ ID NO: 7535200 - DNA, 22 bp, Homo sapiens
tctccactctgagtgcctttca

SEQ ID NO: 7535201 - DNA, 22 bp, Homo sapiens
tctccagaaatggggctgggga

SEQ ID NO: 7535202 - DNA, 18 bp, Homo sapiens
tctccacttctgtgagaa

SEQ ID NO: 7535203 - DNA, 22 bp, Homo sapiens
tctccagaaatggggctgggga

SEQ ID NO: 7535204 - DNA, 22 bp, Homo sapiens
tctccagaggtcccttgtctct

SEQ ID NO: 7535205 - DNA, 22 bp, Homo sapiens
tctccagaaatggggctgggga

SEQ ID NO: 7535206 - DNA, 20 bp, Homo sapiens
tctccagatgcagatgacat

SEQ ID NO: 7535207 - DNA, 20 bp, Homo sapiens
tctccagatgcagatgacat

SEQ ID NO: 7535208 - DNA, 20 bp, Homo sapiens
tctccagatgcagatgacat

SEQ ID NO: 7535209 - DNA, 21 bp, Homo sapiens
tctccagagtgggaggaaatc

SEQ ID NO: 7535210 - DNA, 22 bp, Homo sapiens
tctccagaggtcccttgtctct

SEQ ID NO: 7535211 - DNA, 21 bp, Homo sapiens
tctccagagtgggaggaaatc

SEQ ID NO: 7535212 - DNA, 22 bp, Homo sapiens
tctccaggaaccatcatggtaa

SEQ ID NO: 7535213 - DNA, 22 bp, Homo sapiens
tctccaggaaagacactggact

SEQ ID NO: 7535214 - DNA, 19 bp, Homo sapiens
tctccagctttgggctttt

SEQ ID NO: 7535215 - DNA, 19 bp, Homo sapiens
tctccagctttgggctttt

SEQ ID NO: 7535216 - DNA, 22 bp, Homo sapiens
tctccaggaaagacactggact

SEQ ID NO: 7535217 - DNA, 22 bp, Homo sapiens
tctccaggaagccctccctgac

SEQ ID NO: 7535218 - DNA, 22 bp, Homo sapiens
tctccaggaagccctccctgac

SEQ ID NO: 7535219 - DNA, 22 bp, Homo sapiens
tctccaggaagccctccctgac

SEQ ID NO: 7535220 - DNA, 22 bp, Homo sapiens
ccagagagagaggtcaatggca

SEQ ID NO: 7535221 - DNA, 21 bp, Homo sapiens
ccagagagagggaagtgggtt

SEQ ID NO: 7535222 - DNA, 21 bp, Homo sapiens
ccagagagagggaagtgggtt

SEQ ID NO: 7535223 - DNA, 21 bp, Homo sapiens
ccagagagagggaagtgggtt

SEQ ID NO: 7535224 - DNA, 22 bp, Homo sapiens
tctccaggaagccctccctgac

SEQ ID NO: 7535225 - DNA, 22 bp, Homo sapiens
tctccaggaaccatcatggtaa

SEQ ID NO: 7535226 - DNA, 22 bp, Homo sapiens
ccagagagctacaaggcataaa

SEQ ID NO: 7535227 - DNA, 22 bp, Homo sapiens
ccagagagctacaaggcataaa

SEQ ID NO: 7535228 - DNA, 22 bp, Homo sapiens
ccagagagctacaaggcataaa

SEQ ID NO: 7535229 - DNA, 22 bp, Homo sapiens
ccagagagctacaaggcataaa

SEQ ID NO: 7535230 - DNA, 19 bp, Homo sapiens
ccagagagctaggtacaga

SEQ ID NO: 7535231 - DNA, 19 bp, Homo sapiens
ccagagagctaggtacaga

SEQ ID NO: 7535232 - DNA, 19 bp, Homo sapiens
ccagagagctaggtacaga

SEQ ID NO: 7535233 - DNA, 22 bp, Homo sapiens
ccagagagctacaaggcataaa

SEQ ID NO: 7535234 - DNA, 22 bp, Homo sapiens
ccagagagctacaaggcataaa

SEQ ID NO: 7535235 - DNA, 22 bp, Homo sapiens
ccagagagctacaaggcataaa

SEQ ID NO: 7535236 - DNA, 22 bp, Homo sapiens
ccagagagctacaaggcataaa

SEQ ID NO: 7535237 - DNA, 19 bp, Homo sapiens
ccagagagctaggtacaga

SEQ ID NO: 7535238 - DNA, 19 bp, Homo sapiens
ccagagagctaggtacaga

SEQ ID NO: 7535239 - DNA, 19 bp, Homo sapiens
ccagagagctaggtacaga

SEQ ID NO: 7535240 - DNA, 22 bp, Homo sapiens
ccagagaggcaaaactccttcc

SEQ ID NO: 7535241 - DNA, 22 bp, Homo sapiens
ccagagaggcaaaactccttcc

SEQ ID NO: 7535242 - DNA, 22 bp, Homo sapiens
ccagagaggcaaaactccttcc

SEQ ID NO: 7535243 - DNA, 19 bp, Homo sapiens
ccagagagctaggtacaga

SEQ ID NO: 7535244 - DNA, 19 bp, Homo sapiens
ccagagagctaggtacaga

SEQ ID NO: 7535245 - DNA, 19 bp, Homo sapiens
ccagagagctaggtacaga

SEQ ID NO: 7535246 - DNA, 21 bp, Homo sapiens
ccagagagagggaagtgggtt

SEQ ID NO: 7535247 - DNA, 21 bp, Homo sapiens
ccagagagagggaagtgggtt

SEQ ID NO: 7535248 - DNA, 21 bp, Homo sapiens
ccagagagagggaagtgggtt

SEQ ID NO: 7535249 - DNA, 21 bp, Homo sapiens
ccagagagagggaagtgggtt

SEQ ID NO: 7535250 - DNA, 21 bp, Homo sapiens
ccagagagagggaagtgggtt

SEQ ID NO: 7535251 - DNA, 22 bp, Homo sapiens
ccagagagagtactgggctctg

SEQ ID NO: 7535252 - DNA, 22 bp, Homo sapiens
ccagagagagtactgggctctg

SEQ ID NO: 7535253 - DNA, 21 bp, Homo sapiens
ccagagagagggaagtgggtt

SEQ ID NO: 7535254 - DNA, 22 bp, Homo sapiens
ccagagagagtactgggctctg

SEQ ID NO: 7535255 - DNA, 22 bp, Homo sapiens
ccagagagagtactgggctctg

SEQ ID NO: 7535256 - DNA, 22 bp, Homo sapiens
ccagagagagtactgggctctg

SEQ ID NO: 7535257 - DNA, 22 bp, Homo sapiens
ccagagagagtactgggctctg

SEQ ID NO: 7535258 - DNA, 22 bp, Homo sapiens
ccagagagctacaaggcataaa

SEQ ID NO: 7535259 - DNA, 22 bp, Homo sapiens
ccagagagctacaaggcataaa

SEQ ID NO: 7535260 - DNA, 22 bp, Homo sapiens
ccagagagctacaaggcataaa

SEQ ID NO: 7535261 - DNA, 22 bp, Homo sapiens
ccagagagctacaaggcataaa

SEQ ID NO: 7535262 - DNA, 22 bp, Homo sapiens
ccagagagattgcttctaaaga

SEQ ID NO: 7535263 - DNA, 22 bp, Homo sapiens
ccagagagattgcttctaaaga

SEQ ID NO: 7535264 - DNA, 22 bp, Homo sapiens
ccagagagagtactgggctctg

SEQ ID NO: 7535265 - DNA, 22 bp, Homo sapiens
ccagagagagtactgggctctg

SEQ ID NO: 7535266 - DNA, 22 bp, Homo sapiens
ccagagagagtactgggctctg

SEQ ID NO: 7535267 - DNA, 21 bp, Homo sapiens
ccacattctcattctgactgc

SEQ ID NO: 7535268 - DNA, 21 bp, Homo sapiens
ccacattctcattctgactgc

SEQ ID NO: 7535269 - DNA, 21 bp, Homo sapiens
ccacattctcattctgactgc

SEQ ID NO: 7535270 - DNA, 22 bp, Homo sapiens
ccacattgactgtctgtagatt

SEQ ID NO: 7535271 - DNA, 22 bp, Homo sapiens
ccacattgactgtctgtagatt

SEQ ID NO: 7535272 - DNA, 22 bp, Homo sapiens
ccacattcagtccaggcttgga

SEQ ID NO: 7535273 - DNA, 22 bp, Homo sapiens
ccacattcatcagttgttaatg

SEQ ID NO: 7535274 - DNA, 22 bp, Homo sapiens
ccacattcagtccaggcttgga

SEQ ID NO: 7535275 - DNA, 22 bp, Homo sapiens
ccacattcaccagctgcacgac

SEQ ID NO: 7535276 - DNA, 22 bp, Homo sapiens
ccacattcactcatttcattgt

SEQ ID NO: 7535277 - DNA, 22 bp, Homo sapiens
ccacattcactcatttcattgt

SEQ ID NO: 7535278 - DNA, 22 bp, Homo sapiens
ccacatgtgcactgctgtatgg

SEQ ID NO: 7535279 - DNA, 22 bp, Homo sapiens
ccacatttactgatgtatgtat

SEQ ID NO: 7535280 - DNA, 22 bp, Homo sapiens
ccacatttactgatgtatgtat

SEQ ID NO: 7535281 - DNA, 22 bp, Homo sapiens
ccacatttactggatgctcagg

SEQ ID NO: 7535282 - DNA, 22 bp, Homo sapiens
ccacatttactggatgctcagg

SEQ ID NO: 7535283 - DNA, 22 bp, Homo sapiens
ccacatttactggatgctcagg

SEQ ID NO: 7535284 - DNA, 22 bp, Homo sapiens
ccacatttggagaagatacttt

SEQ ID NO: 7535285 - DNA, 22 bp, Homo sapiens
ccacatttggagaagatacttt

SEQ ID NO: 7535286 - DNA, 22 bp, Homo sapiens
ccacatttcttcacttgtccca

SEQ ID NO: 7535287 - DNA, 22 bp, Homo sapiens
ccacatttactggatgctcagg

SEQ ID NO: 7535288 - DNA, 22 bp, Homo sapiens
ccacatttactggatgctcagg

SEQ ID NO: 7535289 - DNA, 22 bp, Homo sapiens
ccacatttcttcacttgtccca

SEQ ID NO: 7535290 - DNA, 23 bp, Homo sapiens
ccacatggcaagatgatgcattc

SEQ ID NO: 7535291 - DNA, 22 bp, Homo sapiens
ccacatggatagatagggacat

SEQ ID NO: 7535292 - DNA, 22 bp, Homo sapiens
ccacatggatagatagggacat

SEQ ID NO: 7535293 - DNA, 23 bp, Homo sapiens
ccacatggcaagatgatgcattc

SEQ ID NO: 7535294 - DNA, 23 bp, Homo sapiens
ccacatggcaagatgatgcattc

SEQ ID NO: 7535295 - DNA, 22 bp, Homo sapiens
ccacatggagcaggaggtgggg

SEQ ID NO: 7535296 - DNA, 22 bp, Homo sapiens
ccacatggagcaggaggtgggg

SEQ ID NO: 7535297 - DNA, 20 bp, Homo sapiens
ccacatggaagtttgagacc

SEQ ID NO: 7535298 - DNA, 22 bp, Homo sapiens
ccacatggagcaggaggtgggg

SEQ ID NO: 7535299 - DNA, 22 bp, Homo sapiens
ccacatggagcaggaggtgggg

SEQ ID NO: 7535300 - DNA, 19 bp, Homo sapiens
ccacatggctggatgacag

SEQ ID NO: 7535301 - DNA, 19 bp, Homo sapiens
ccacatggctggatgacag

SEQ ID NO: 7535302 - DNA, 22 bp, Homo sapiens
ccacatggatagatagggacat

SEQ ID NO: 7535303 - DNA, 23 bp, Homo sapiens
ccacatggcaagatgatgcattc

SEQ ID NO: 7535304 - DNA, 19 bp, Homo sapiens
ccacatggctggatgacag

SEQ ID NO: 7535305 - DNA, 22 bp, Homo sapiens
ccacatgtgcactgctgtatgg

SEQ ID NO: 7535306 - DNA, 21 bp, Homo sapiens
ccacatggtgaaaccctatct

SEQ ID NO: 7535307 - DNA, 22 bp, Homo sapiens
ccacatgtgcactgctgtatgg

SEQ ID NO: 7535308 - DNA, 22 bp, Homo sapiens
ccacatgtgcactgctgtatgg

SEQ ID NO: 7535309 - DNA, 21 bp, Homo sapiens
ccacatggtgaaaccctatct

SEQ ID NO: 7535310 - DNA, 22 bp, Homo sapiens
ccacatctgcatttaatgtata

SEQ ID NO: 7535311 - DNA, 22 bp, Homo sapiens
ccacatctgttcttagttctga

SEQ ID NO: 7535312 - DNA, 22 bp, Homo sapiens
ccacatctgttcttagttctga

SEQ ID NO: 7535313 - DNA, 22 bp, Homo sapiens
ccacagtgcctggaattctgca

SEQ ID NO: 7535314 - DNA, 22 bp, Homo sapiens
ccacagtgcctggaattctgca

SEQ ID NO: 7535315 - DNA, 22 bp, Homo sapiens
ccacagtgcctggaattctgca

SEQ ID NO: 7535316 - DNA, 22 bp, Homo sapiens
ccacatctcttgatgtacctac

SEQ ID NO: 7535317 - DNA, 22 bp, Homo sapiens
ccacatgctctctctccaggtt

SEQ ID NO: 7535318 - DNA, 22 bp, Homo sapiens
ccacatgctctctctccaggtt

SEQ ID NO: 7535319 - DNA, 22 bp, Homo sapiens
ccacatgctctctctccaggtt

SEQ ID NO: 7535320 - DNA, 22 bp, Homo sapiens
ccacatgctcaccaagtccctg

SEQ ID NO: 7535321 - DNA, 22 bp, Homo sapiens
ccacatgatgaggaagctgaac

SEQ ID NO: 7535322 - DNA, 22 bp, Homo sapiens
ccacatgatgaggaagctgaac

SEQ ID NO: 7535323 - DNA, 22 bp, Homo sapiens
ccacatgatgaggaagctgaac

SEQ ID NO: 7535324 - DNA, 22 bp, Homo sapiens
tcctgaccactaggaccaggct

SEQ ID NO: 7535325 - DNA, 22 bp, Homo sapiens
tcctgaccattccttgtctcca

SEQ ID NO: 7535326 - DNA, 20 bp, Homo sapiens
tcctgaatttcctttctgct

SEQ ID NO: 7535327 - DNA, 22 bp, Homo sapiens
tcctgaccacactgccttctgc

SEQ ID NO: 7535328 - DNA, 22 bp, Homo sapiens
tcctgaccacactgccttctgc

SEQ ID NO: 7535329 - DNA, 22 bp, Homo sapiens
tcctgacctcttgctctgacct

SEQ ID NO: 7535330 - DNA, 22 bp, Homo sapiens
tcctgaccattccttgtctcca

SEQ ID NO: 7535331 - DNA, 22 bp, Homo sapiens
tcctgacccaccaagtctgtaa

SEQ ID NO: 7535332 - DNA, 22 bp, Homo sapiens
tcctgacccaccaagtctgtaa

SEQ ID NO: 7535333 - DNA, 22 bp, Homo sapiens
tcctgacctcttgctctgacct

SEQ ID NO: 7535334 - DNA, 22 bp, Homo sapiens
tcctgacctgaactggggtctt

SEQ ID NO: 7535335 - DNA, 22 bp, Homo sapiens
tcctgactccaggtcctgtgtg

SEQ ID NO: 7535336 - DNA, 22 bp, Homo sapiens
tcctgactctggtgtcctctac

SEQ ID NO: 7535337 - DNA, 22 bp, Homo sapiens
ccacagtgatccctgcctgcga

SEQ ID NO: 7535338 - DNA, 22 bp, Homo sapiens
ccacagtgattcacttttgaag

SEQ ID NO: 7535339 - DNA, 22 bp, Homo sapiens
ccacagtgattcacttttgaag

SEQ ID NO: 7535340 - DNA, 22 bp, Homo sapiens
ccacagtgatccctgcctgcga

SEQ ID NO: 7535341 - DNA, 22 bp, Homo sapiens
ccacagtgatccctgcctgcga

SEQ ID NO: 7535342 - DNA, 22 bp, Homo sapiens
ccacagtgatccctgcctgcga

SEQ ID NO: 7535343 - DNA, 19 bp, Homo sapiens
tcctctgaaggttctttta

SEQ ID NO: 7535344 - DNA, 22 bp, Homo sapiens
tcctctgaaggttccgagggag

SEQ ID NO: 7535345 - DNA, 22 bp, Homo sapiens
tcctctgaattcgctctgtgat

SEQ ID NO: 7535346 - DNA, 22 bp, Homo sapiens
tcctctgaatgctgttgaagaa

SEQ ID NO: 7535347 - DNA, 22 bp, Homo sapiens
tcctctgaatgtacttcataat

SEQ ID NO: 7535348 - DNA, 22 bp, Homo sapiens
tcctctgactcacagcctgggg

SEQ ID NO: 7535349 - DNA, 22 bp, Homo sapiens
tcctctgacaccttgtgcagtg

SEQ ID NO: 7535350 - DNA, 22 bp, Homo sapiens
tcctctgacttctggttgagtt

SEQ ID NO: 7535351 - DNA, 22 bp, Homo sapiens
tcctctgacttctggttgagtt

SEQ ID NO: 7535352 - DNA, 22 bp, Homo sapiens
tcctctgaaatctagattgtga

SEQ ID NO: 7535353 - DNA, 22 bp, Homo sapiens
tcctctgaagaaaaggagcagg

SEQ ID NO: 7535354 - DNA, 22 bp, Homo sapiens
tcctctgaagaaaaggagcagg

SEQ ID NO: 7535355 - DNA, 22 bp, Homo sapiens
tcctctgaaatgtgtgttcggc

SEQ ID NO: 7535356 - DNA, 22 bp, Homo sapiens
tcctctgaagaaaaggagcagg

SEQ ID NO: 7535357 - DNA, 22 bp, Homo sapiens
tcctctgaagaaaaggagcagg

SEQ ID NO: 7535358 - DNA, 22 bp, Homo sapiens
tcctctgaaggttccgagggag

SEQ ID NO: 7535359 - DNA, 22 bp, Homo sapiens
tcctctgaagaaaaggagcagg

SEQ ID NO: 7535360 - DNA, 18 bp, Homo sapiens
tcctctctttccccaggg

SEQ ID NO: 7535361 - DNA, 18 bp, Homo sapiens
tcctctctttccccaggg

SEQ ID NO: 7535362 - DNA, 18 bp, Homo sapiens
tcctctctttccccaggg

SEQ ID NO: 7535363 - DNA, 18 bp, Homo sapiens
tcctctctttccccaggg

SEQ ID NO: 7535364 - DNA, 22 bp, Homo sapiens
tcctctccatgtctcacgccac

SEQ ID NO: 7535365 - DNA, 22 bp, Homo sapiens
tcctctccatgtctcacgccac

SEQ ID NO: 7535366 - DNA, 21 bp, Homo sapiens
tcctctccatgatctgtttgt

SEQ ID NO: 7535367 - DNA, 22 bp, Homo sapiens
tcctctccatgtctcacgccac

SEQ ID NO: 7535368 - DNA, 22 bp, Homo sapiens
tcctctccatgtctcacgccac

SEQ ID NO: 7535369 - DNA, 22 bp, Homo sapiens
tcctctccatgtctcacgccac

SEQ ID NO: 7535370 - DNA, 22 bp, Homo sapiens
tcctctccatgtctcacgccac

SEQ ID NO: 7535371 - DNA, 22 bp, Homo sapiens
tcctctctgcactggccctgcc

SEQ ID NO: 7535372 - DNA, 22 bp, Homo sapiens
tcctctctgcactggccctgcc

SEQ ID NO: 7535373 - DNA, 22 bp, Homo sapiens
tcctctctgcactggccctgcc

SEQ ID NO: 7535374 - DNA, 22 bp, Homo sapiens
tcctctctgcactggccctgcc

SEQ ID NO: 7535375 - DNA, 22 bp, Homo sapiens
tcctctctgcactggccctgcc

SEQ ID NO: 7535376 - DNA, 18 bp, Homo sapiens
tcctctctttccccaggg

SEQ ID NO: 7535377 - DNA, 18 bp, Homo sapiens
tcctctctttccccaggg

SEQ ID NO: 7535378 - DNA, 22 bp, Homo sapiens
tcctctctgcactggccctgcc

SEQ ID NO: 7535379 - DNA, 18 bp, Homo sapiens
tcctctctttccccaggg

SEQ ID NO: 7535380 - DNA, 18 bp, Homo sapiens
tcctctctttccccaggg

SEQ ID NO: 7535381 - DNA, 18 bp, Homo sapiens
tcctctctttccccaggg

SEQ ID NO: 7535382 - DNA, 21 bp, Homo sapiens
tcctctgcagtgaggtggcct

SEQ ID NO: 7535383 - DNA, 22 bp, Homo sapiens
tcctctgccaaagggagttgcc

SEQ ID NO: 7535384 - DNA, 22 bp, Homo sapiens
tcctctgccaaagggagttgcc

SEQ ID NO: 7535385 - DNA, 22 bp, Homo sapiens
tcctgaagtattgtttgagtaa

SEQ ID NO: 7535386 - DNA, 22 bp, Homo sapiens
tcctgaagtcacaggctctgag

SEQ ID NO: 7535387 - DNA, 22 bp, Homo sapiens
tcctgaagtatgggtatggagt

SEQ ID NO: 7535388 - DNA, 22 bp, Homo sapiens
tcctgaagtatgggtatggagt

SEQ ID NO: 7535389 - DNA, 22 bp, Homo sapiens
tcctctgagtaaagaagattgc

SEQ ID NO: 7535390 - DNA, 21 bp, Homo sapiens
tcctctgatcctggatccgca

SEQ ID NO: 7535391 - DNA, 21 bp, Homo sapiens
tcctctgatcctggatccgca

SEQ ID NO: 7535392 - DNA, 22 bp, Homo sapiens
tcctctgatttgattacctagt

SEQ ID NO: 7535393 - DNA, 21 bp, Homo sapiens
tcctctgcagtgaggtggcct

SEQ ID NO: 7535394 - DNA, 21 bp, Homo sapiens
tcctctgcagtgaggtggcct

SEQ ID NO: 7535395 - DNA, 21 bp, Homo sapiens
tcctctgcagtgaggtggcct

SEQ ID NO: 7535396 - DNA, 22 bp, Homo sapiens
tcctctgagcctcagtttctca

SEQ ID NO: 7535397 - DNA, 22 bp, Homo sapiens
tcctctgagcctcagtttctca

SEQ ID NO: 7535398 - DNA, 22 bp, Homo sapiens
tcctctgagctcaaaatccagc

SEQ ID NO: 7535399 - DNA, 22 bp, Homo sapiens
tcctctgagtaaagaagattgc

SEQ ID NO: 7535400 - DNA, 22 bp, Homo sapiens
tcctgaattgttgagaagcagc

SEQ ID NO: 7535401 - DNA, 22 bp, Homo sapiens
tcctgaatttcccagcatgaac

SEQ ID NO: 7535402 - DNA, 22 bp, Homo sapiens
tcctgaattcctctttgcatcc

SEQ ID NO: 7535403 - DNA, 22 bp, Homo sapiens
tcctgaattgaactcagttaat

SEQ ID NO: 7535404 - DNA, 22 bp, Homo sapiens
tcctgaattgaactcagttaat

SEQ ID NO: 7535405 - DNA, 22 bp, Homo sapiens
tcctgaattcctctttgcatcc

SEQ ID NO: 7535406 - DNA, 22 bp, Homo sapiens
tcctgaatgagttgatcacaat

SEQ ID NO: 7535407 - DNA, 22 bp, Homo sapiens
tcctgaatccaggagagtaggg

SEQ ID NO: 7535408 - DNA, 22 bp, Homo sapiens
tcctgaataaattagctgtcac

SEQ ID NO: 7535409 - DNA, 22 bp, Homo sapiens
tcctgaagtcacaggctctgag

SEQ ID NO: 7535410 - DNA, 22 bp, Homo sapiens
tcctgaagtcacaggctctgag

SEQ ID NO: 7535411 - DNA, 22 bp, Homo sapiens
tcgcgcccccaagcgtcattgg

SEQ ID NO: 7535412 - DNA, 22 bp, Homo sapiens
tcctttccatgcttctagaggc

SEQ ID NO: 7535413 - DNA, 22 bp, Homo sapiens
tcgcgcagtgcacggcactggg

SEQ ID NO: 7535414 - DNA, 22 bp, Homo sapiens
tcgctgaggctgcacggctgcc

SEQ ID NO: 7535415 - DNA, 22 bp, Homo sapiens
tcgctgaggctgcacggctgcc

SEQ ID NO: 7535416 - DNA, 22 bp, Homo sapiens
tcgctgcatgaagccaggccag

SEQ ID NO: 7535417 - DNA, 22 bp, Homo sapiens
tcgctgcatgaagccaggccag

SEQ ID NO: 7535418 - DNA, 22 bp, Homo sapiens
tcgctggcctggaggggagcca

SEQ ID NO: 7535419 - DNA, 22 bp, Homo sapiens
tcgctgaggctgcacggctgcc

SEQ ID NO: 7535420 - DNA, 22 bp, Homo sapiens
tcgctgaggctgcacggctgcc

SEQ ID NO: 7535421 - DNA, 22 bp, Homo sapiens
tcgctgaccccccagctctatc

SEQ ID NO: 7535422 - DNA, 22 bp, Homo sapiens
tcgctgacggtcgcggtgtccc

SEQ ID NO: 7535423 - DNA, 22 bp, Homo sapiens
tcgctcaggcttgagtgtagtg

SEQ ID NO: 7535424 - DNA, 22 bp, Homo sapiens
ccaccaggacagccctgagggg

SEQ ID NO: 7535425 - DNA, 22 bp, Homo sapiens
ccaccaggacagccctgagggg

SEQ ID NO: 7535426 - DNA, 22 bp, Homo sapiens
ccaccaggacagccctgagggg

SEQ ID NO: 7535427 - DNA, 18 bp, Homo sapiens
tcctttcaccccttctct

SEQ ID NO: 7535428 - DNA, 22 bp, Homo sapiens
ccaccaggacagccctgagggg

SEQ ID NO: 7535429 - DNA, 22 bp, Homo sapiens
ccaccaggacagccctgagggg

SEQ ID NO: 7535430 - DNA, 22 bp, Homo sapiens
ccaccagctttggcggtgacag

SEQ ID NO: 7535431 - DNA, 22 bp, Homo sapiens
tcctttccagcctcacctcagc

SEQ ID NO: 7535432 - DNA, 22 bp, Homo sapiens
tcctttccagcctcacctcagc

SEQ ID NO: 7535433 - DNA, 22 bp, Homo sapiens
tcctttccagcctcacctcagc

SEQ ID NO: 7535434 - DNA, 22 bp, Homo sapiens
tcctttccagcctcacctcagc

SEQ ID NO: 7535435 - DNA, 22 bp, Homo sapiens
ccaccagcttcagcagccgcgg

SEQ ID NO: 7535436 - DNA, 22 bp, Homo sapiens
ccaccagctttgccaccctgct

SEQ ID NO: 7535437 - DNA, 22 bp, Homo sapiens
ccaccagctttgccaccctgct

SEQ ID NO: 7535438 - DNA, 22 bp, Homo sapiens
ccaccagctttgccaccctgct

SEQ ID NO: 7535439 - DNA, 22 bp, Homo sapiens
ccaccagctttgccaccctgct

SEQ ID NO: 7535440 - DNA, 22 bp, Homo sapiens
ccaccagctttgccaccctgct

SEQ ID NO: 7535441 - DNA, 22 bp, Homo sapiens
ccaccagctttgccaccctgct

SEQ ID NO: 7535442 - DNA, 22 bp, Homo sapiens
ccaccagctttggcggtgacag

SEQ ID NO: 7535443 - DNA, 22 bp, Homo sapiens
ccaccagctttggcggtgacag

SEQ ID NO: 7535444 - DNA, 22 bp, Homo sapiens
ccaccagctttggcggtgacag

SEQ ID NO: 7535445 - DNA, 22 bp, Homo sapiens
ccaccagagggcagactgtgat

SEQ ID NO: 7535446 - DNA, 22 bp, Homo sapiens
ccaccagatttactttactatt

SEQ ID NO: 7535447 - DNA, 22 bp, Homo sapiens
ccaccagagcttcgtggcttaa

SEQ ID NO: 7535448 - DNA, 22 bp, Homo sapiens
ccaccagagggcagactgtgat

SEQ ID NO: 7535449 - DNA, 22 bp, Homo sapiens
ccaccagaccaccaagagcaac

SEQ ID NO: 7535450 - DNA, 22 bp, Homo sapiens
ccaccagcttcagcagccgcgg

SEQ ID NO: 7535451 - DNA, 22 bp, Homo sapiens
ccaccagcttcagcagccgcgg

SEQ ID NO: 7535452 - DNA, 22 bp, Homo sapiens
ccaccagcttcagcagccgcgg

SEQ ID NO: 7535453 - DNA, 22 bp, Homo sapiens
ccaccagcttcagcagccgcgg

SEQ ID NO: 7535454 - DNA, 22 bp, Homo sapiens
ccaccagctgcatatgcacgta

SEQ ID NO: 7535455 - DNA, 22 bp, Homo sapiens
ccaccagcttcagcagccgcgg

SEQ ID NO: 7535456 - DNA, 22 bp, Homo sapiens
ccaccagcttcagcagccgcgg

SEQ ID NO: 7535457 - DNA, 22 bp, Homo sapiens
ccaccagctgcatatgcacgta

SEQ ID NO: 7535458 - DNA, 22 bp, Homo sapiens
ccaccagctgcatatgcacgta

SEQ ID NO: 7535459 - DNA, 22 bp, Homo sapiens
ccaccagcagtgtgcaaggatt

SEQ ID NO: 7535460 - DNA, 22 bp, Homo sapiens
ccaccagcagtgtgcaaggatt

SEQ ID NO: 7535461 - DNA, 22 bp, Homo sapiens
ccaccaagtcccactataattt

SEQ ID NO: 7535462 - DNA, 22 bp, Homo sapiens
ccaccacatttgcctagacttt

SEQ ID NO: 7535463 - DNA, 22 bp, Homo sapiens
ccacatttttgatactctcact

SEQ ID NO: 7535464 - DNA, 22 bp, Homo sapiens
ccacatttttgatactctcact

SEQ ID NO: 7535465 - DNA, 22 bp, Homo sapiens
ccacatttttgatactctcact

SEQ ID NO: 7535466 - DNA, 22 bp, Homo sapiens
ccacattttgctttgcctaggt

SEQ ID NO: 7535467 - DNA, 22 bp, Homo sapiens
ccacattttgctttgcctaggt

SEQ ID NO: 7535468 - DNA, 22 bp, Homo sapiens
ccacattttgctttgcctaggt

SEQ ID NO: 7535469 - DNA, 22 bp, Homo sapiens
ccacatttggagaagatacttt

SEQ ID NO: 7535470 - DNA, 20 bp, Homo sapiens
ccacattttactgtttgcca

SEQ ID NO: 7535471 - DNA, 22 bp, Homo sapiens
ccacatttggagaagatacttt

SEQ ID NO: 7535472 - DNA, 22 bp, Homo sapiens
ccaccagaagctgggagaagct

SEQ ID NO: 7535473 - DNA, 22 bp, Homo sapiens
ccaccagaccaccaagagcaac

SEQ ID NO: 7535474 - DNA, 22 bp, Homo sapiens
ccaccagaagctgggagaagct

SEQ ID NO: 7535475 - DNA, 22 bp, Homo sapiens
ccaccactgaggcacaggagcc

SEQ ID NO: 7535476 - DNA, 22 bp, Homo sapiens
ccaccacatttgcctagacttt

SEQ ID NO: 7535477 - DNA, 22 bp, Homo sapiens
ccaccacatttgcctagacttt

SEQ ID NO: 7535478 - DNA, 22 bp, Homo sapiens
ccaccactgaggcacaggagcc

SEQ ID NO: 7535479 - DNA, 22 bp, Homo sapiens
tcggaaggggccgcgctcggac

SEQ ID NO: 7535480 - DNA, 22 bp, Homo sapiens
tcggaaccgacctgggagctgg

SEQ ID NO: 7535481 - DNA, 22 bp, Homo sapiens
tcggaagttagagtgtgttatt

SEQ ID NO: 7535482 - DNA, 22 bp, Homo sapiens
tcggaatgtagtaaatctttct

SEQ ID NO: 7535483 - DNA, 22 bp, Homo sapiens
tcgcttgaacccaggaagtgga

SEQ ID NO: 7535484 - DNA, 22 bp, Homo sapiens
tcgctgtgaaaaccttggacaa

SEQ ID NO: 7535485 - DNA, 22 bp, Homo sapiens
tcgcttgaacccaggaagtgga

SEQ ID NO: 7535486 - DNA, 22 bp, Homo sapiens
tcgcttcacaccatcagcgagg

SEQ ID NO: 7535487 - DNA, 22 bp, Homo sapiens
tcgcttcatccgtgaagccaaa

SEQ ID NO: 7535488 - DNA, 22 bp, Homo sapiens
tcggagcgtcactggctggagg

SEQ ID NO: 7535489 - DNA, 22 bp, Homo sapiens
tcggagcgtcactggctggagg

SEQ ID NO: 7535490 - DNA, 22 bp, Homo sapiens
tcggagagttggaagtagcaga

SEQ ID NO: 7535491 - DNA, 22 bp, Homo sapiens
tcggagagttggaagtagcaga

SEQ ID NO: 7535492 - DNA, 22 bp, Homo sapiens
tcggagcgtcactggctggagg

SEQ ID NO: 7535493 - DNA, 22 bp, Homo sapiens
tcggagcgtcactggctggagg

SEQ ID NO: 7535494 - DNA, 22 bp, Homo sapiens
tcggagagttggaagtagcaga

SEQ ID NO: 7535495 - DNA, 22 bp, Homo sapiens
tcggagagttcatgaagacccg

SEQ ID NO: 7535496 - DNA, 22 bp, Homo sapiens
tcggagagctcacagctgtggc

SEQ ID NO: 7535497 - DNA, 22 bp, Homo sapiens
tcggagtgaatcttcacaatgt

SEQ ID NO: 7535498 - DNA, 22 bp, Homo sapiens
tcggagctgtagatgaaaccct

SEQ ID NO: 7535499 - DNA, 22 bp, Homo sapiens
tcggagctgtagatgaaaccct

SEQ ID NO: 7535500 - DNA, 22 bp, Homo sapiens
tcgggccataggctaggtccct

SEQ ID NO: 7535501 - DNA, 20 bp, Homo sapiens
tcggctggacactgtgcact

SEQ ID NO: 7535502 - DNA, 20 bp, Homo sapiens
tcggctggacactgtgcact

SEQ ID NO: 7535503 - DNA, 22 bp, Homo sapiens
tcggccacggggtttcctccaa

SEQ ID NO: 7535504 - DNA, 22 bp, Homo sapiens
tcggcgcgcccagtcgatgggg

SEQ ID NO: 7535505 - DNA, 22 bp, Homo sapiens
tcggcgctggaacgcagtagct

SEQ ID NO: 7535506 - DNA, 22 bp, Homo sapiens
tcggctcatccaagatcaagca

SEQ ID NO: 7535507 - DNA, 22 bp, Homo sapiens
tcgggctcgctctcctagcgga

SEQ ID NO: 7535508 - DNA, 22 bp, Homo sapiens
tcgggctcgctctcctagcgga

SEQ ID NO: 7535509 - DNA, 22 bp, Homo sapiens
tcggggatgggagagagctcca

SEQ ID NO: 7535510 - DNA, 22 bp, Homo sapiens
tcggggcgcacctgccctttca

SEQ ID NO: 7535511 - DNA, 22 bp, Homo sapiens
tcgggggcttgaggatcaaatg

SEQ ID NO: 7535512 - DNA, 22 bp, Homo sapiens
tcggggtctttgacacgctctg

SEQ ID NO: 7535513 - DNA, 22 bp, Homo sapiens
tcggggtctttgacacgctctg

SEQ ID NO: 7535514 - DNA, 23 bp, Homo sapiens
tcggtgggcgtggaggccgaggc

SEQ ID NO: 7535515 - DNA, 22 bp, Homo sapiens
tcggggtctttgacacgctctg

SEQ ID NO: 7535516 - DNA, 22 bp, Homo sapiens
tcgggtgcttttagatatgtag

SEQ ID NO: 7535517 - DNA, 22 bp, Homo sapiens
tcggggtctttgacacgctctg

SEQ ID NO: 7535518 - DNA, 22 bp, Homo sapiens
ccaccgctgaaggcactggcat

SEQ ID NO: 7535519 - DNA, 22 bp, Homo sapiens
ccaccgctgaaggcactggcat

SEQ ID NO: 7535520 - DNA, 22 bp, Homo sapiens
ccaccgccatggcgttgtacag

SEQ ID NO: 7535521 - DNA, 22 bp, Homo sapiens
ccaccggtcaacctgcagattg

SEQ ID NO: 7535522 - DNA, 22 bp, Homo sapiens
ccaccgccatggcgttgtacag

SEQ ID NO: 7535523 - DNA, 22 bp, Homo sapiens
ccacccttgggttcggaggccg

SEQ ID NO: 7535524 - DNA, 22 bp, Homo sapiens
ccacccttgggttcggaggccg

SEQ ID NO: 7535525 - DNA, 22 bp, Homo sapiens
ccacccttgggttcggaggccg

SEQ ID NO: 7535526 - DNA, 22 bp, Homo sapiens
ccacccttccattcttcctctt

SEQ ID NO: 7535527 - DNA, 22 bp, Homo sapiens
ccacccttgggttcggaggccg

SEQ ID NO: 7535528 - DNA, 22 bp, Homo sapiens
ccacccttgggttcggaggccg

SEQ ID NO: 7535529 - DNA, 22 bp, Homo sapiens
ccacccttccattcttcctctt

SEQ ID NO: 7535530 - DNA, 22 bp, Homo sapiens
ccacccttgggttcggaggccg

SEQ ID NO: 7535531 - DNA, 22 bp, Homo sapiens
ccacccttgggttcggaggccg

SEQ ID NO: 7535532 - DNA, 22 bp, Homo sapiens
ccaccctgtgtttttgccattg

SEQ ID NO: 7535533 - DNA, 22 bp, Homo sapiens
ccaccctgtgtttttgccattg

SEQ ID NO: 7535534 - DNA, 22 bp, Homo sapiens
ccaccctgtgtttttgccattg

SEQ ID NO: 7535535 - DNA, 22 bp, Homo sapiens
ccaccctgtgcaggcgtgggta

SEQ ID NO: 7535536 - DNA, 22 bp, Homo sapiens
ccaccctgtgtttttgccattg

SEQ ID NO: 7535537 - DNA, 22 bp, Homo sapiens
ccaccctgggttctgatgtgga

SEQ ID NO: 7535538 - DNA, 19 bp, Homo sapiens
ccaccctgggagctcactc

SEQ ID NO: 7535539 - DNA, 22 bp, Homo sapiens
ccaccctgggttctgatgtgga

SEQ ID NO: 7535540 - DNA, 22 bp, Homo sapiens
ccaccctgggttctgatgtgga

SEQ ID NO: 7535541 - DNA, 19 bp, Homo sapiens
ccaccctgggagctcactc

SEQ ID NO: 7535542 - DNA, 19 bp, Homo sapiens
ccaccctgggagctcactc

SEQ ID NO: 7535543 - DNA, 20 bp, Homo sapiens
ccaccctgtccggggcggag

SEQ ID NO: 7535544 - DNA, 22 bp, Homo sapiens
ccaccctgtgcaggcgtgggta

SEQ ID NO: 7535545 - DNA, 22 bp, Homo sapiens
ccaccctgggttctgatgtgga

SEQ ID NO: 7535546 - DNA, 22 bp, Homo sapiens
ccaccctgtgcaggcgtgggta

SEQ ID NO: 7535547 - DNA, 22 bp, Homo sapiens
ccaccctgtgcaggcgtgggta

SEQ ID NO: 7535548 - DNA, 20 bp, Homo sapiens
ccaccctgtccggggcggag

SEQ ID NO: 7535549 - DNA, 22 bp, Homo sapiens
ccaccctggactcgaggcccga

SEQ ID NO: 7535550 - DNA, 22 bp, Homo sapiens
ccaccctggacaggcctctgag

SEQ ID NO: 7535551 - DNA, 22 bp, Homo sapiens
ccaccctggactcgaggcccga

SEQ ID NO: 7535552 - DNA, 22 bp, Homo sapiens
ccaccctggactcgaggcccga

SEQ ID NO: 7535553 - DNA, 23 bp, Homo sapiens
tcggtgggcgtggaggccgaggc

SEQ ID NO: 7535554 - DNA, 17 bp, Homo sapiens
tcggtttgccaggcttc

SEQ ID NO: 7535555 - DNA, 23 bp, Homo sapiens
tcggtgggcgtggaggccgaggc

SEQ ID NO: 7535556 - DNA, 23 bp, Homo sapiens
tcggtgggcgtggaggccgaggc

SEQ ID NO: 7535557 - DNA, 23 bp, Homo sapiens
tcggtgggcgtggaggccgaggc

SEQ ID NO: 7535558 - DNA, 23 bp, Homo sapiens
tcggtgggcgtggaggccgaggc

SEQ ID NO: 7535559 - DNA, 22 bp, Homo sapiens
tcggtgcgcgaggcgcggtccc

SEQ ID NO: 7535560 - DNA, 22 bp, Homo sapiens
tcggtggcgcccgcgcgggacc

SEQ ID NO: 7535561 - DNA, 23 bp, Homo sapiens
tcggtgggcgtggaggccgaggc

SEQ ID NO: 7535562 - DNA, 23 bp, Homo sapiens
tcggtgggcgtggaggccgaggc

SEQ ID NO: 7535563 - DNA, 22 bp, Homo sapiens
cctggaggcagaaataggactt

SEQ ID NO: 7535564 - DNA, 22 bp, Homo sapiens
cctggaggcagaaataggactt

SEQ ID NO: 7535565 - DNA, 22 bp, Homo sapiens
cctggaggcggaggttgcagtg

SEQ ID NO: 7535566 - DNA, 22 bp, Homo sapiens
cctggaggcggaggttgcagtg

SEQ ID NO: 7535567 - DNA, 22 bp, Homo sapiens
cctggaggcggaggttgcagtg

SEQ ID NO: 7535568 - DNA, 22 bp, Homo sapiens
cctggaggcggaggttgcagtg

SEQ ID NO: 7535569 - DNA, 22 bp, Homo sapiens
cctggaggcggaggttgcagtg

SEQ ID NO: 7535570 - DNA, 22 bp, Homo sapiens
cctggaggctctgggagggcag

SEQ ID NO: 7535571 - DNA, 22 bp, Homo sapiens
cctggaggctctgggagggcag

SEQ ID NO: 7535572 - DNA, 22 bp, Homo sapiens
cctggaggctctgggagggcag

SEQ ID NO: 7535573 - DNA, 22 bp, Homo sapiens
cctggagggaccctggccctgt

SEQ ID NO: 7535574 - DNA, 22 bp, Homo sapiens
cctggagggaccctggccctgt

SEQ ID NO: 7535575 - DNA, 22 bp, Homo sapiens
cctggagggaccctggccctgt

SEQ ID NO: 7535576 - DNA, 22 bp, Homo sapiens
cctggagggaccctggccctgt

SEQ ID NO: 7535577 - DNA, 22 bp, Homo sapiens
cctggagggcgccgcacagtcc

SEQ ID NO: 7535578 - DNA, 22 bp, Homo sapiens
cctggagggcgccgcacagtcc

SEQ ID NO: 7535579 - DNA, 22 bp, Homo sapiens
cctggagggcgccgcacagtcc

SEQ ID NO: 7535580 - DNA, 22 bp, Homo sapiens
cctggaggagcgctgaccagct

SEQ ID NO: 7535581 - DNA, 22 bp, Homo sapiens
cctggaggagcgctgaccagct

SEQ ID NO: 7535582 - DNA, 22 bp, Homo sapiens
cctggaggagcgctgaccagct

SEQ ID NO: 7535583 - DNA, 22 bp, Homo sapiens
cctggaggagcgctgaccagct

SEQ ID NO: 7535584 - DNA, 22 bp, Homo sapiens
cctggaggagcgctgaccagct

SEQ ID NO: 7535585 - DNA, 22 bp, Homo sapiens
cctggaggagcgctgaccagct

SEQ ID NO: 7535586 - DNA, 22 bp, Homo sapiens
cctggaggagcgctgaccagct

SEQ ID NO: 7535587 - DNA, 22 bp, Homo sapiens
cctggagcttttccatcctgga

SEQ ID NO: 7535588 - DNA, 22 bp, Homo sapiens
cctggagcttttccatcctgga

SEQ ID NO: 7535589 - DNA, 22 bp, Homo sapiens
cctggagcttttccatcctgga

SEQ ID NO: 7535590 - DNA, 22 bp, Homo sapiens
cctggagcttttccatcctgga

SEQ ID NO: 7535591 - DNA, 22 bp, Homo sapiens
cctggagcttttccatcctgga

SEQ ID NO: 7535592 - DNA, 22 bp, Homo sapiens
cctggagcttttccatcctgga

SEQ ID NO: 7535593 - DNA, 22 bp, Homo sapiens
cctggagcttttccatcctgga

SEQ ID NO: 7535594 - DNA, 18 bp, Homo sapiens
cctggagctccacagcaa

SEQ ID NO: 7535595 - DNA, 18 bp, Homo sapiens
cctggagctccacagcaa

SEQ ID NO: 7535596 - DNA, 18 bp, Homo sapiens
cctggagctccacagcaa

SEQ ID NO: 7535597 - DNA, 18 bp, Homo sapiens
cctggagctccacagcaa

SEQ ID NO: 7535598 - DNA, 18 bp, Homo sapiens
cctggagctccacagcaa

SEQ ID NO: 7535599 - DNA, 18 bp, Homo sapiens
cctggagctccacagcaa

SEQ ID NO: 7535600 - DNA, 22 bp, Homo sapiens
cctggagcttggtcacgctgcg

SEQ ID NO: 7535601 - DNA, 18 bp, Homo sapiens
cctggagctccacagcaa

SEQ ID NO: 7535602 - DNA, 18 bp, Homo sapiens
cctggagctccacagcaa

SEQ ID NO: 7535603 - DNA, 22 bp, Homo sapiens
cctggagcttttccagttgaca

SEQ ID NO: 7535604 - DNA, 22 bp, Homo sapiens
cctggagcttttccagttgaca

SEQ ID NO: 7535605 - DNA, 22 bp, Homo sapiens
cctggagcttttccagttgaca

SEQ ID NO: 7535606 - DNA, 22 bp, Homo sapiens
cctggagcttttccagttgaca

SEQ ID NO: 7535607 - DNA, 22 bp, Homo sapiens
cctggagcttggtcacgctgcg

SEQ ID NO: 7535608 - DNA, 22 bp, Homo sapiens
cctggagcttggtcacgctgcg

SEQ ID NO: 7535609 - DNA, 22 bp, Homo sapiens
cctggagcttggtcacgctgcg

SEQ ID NO: 7535610 - DNA, 22 bp, Homo sapiens
tgtcaaggacgtgcatgaaccc

SEQ ID NO: 7535611 - DNA, 23 bp, Homo sapiens
tgtcaagtatagcaggccctccc

SEQ ID NO: 7535612 - DNA, 22 bp, Homo sapiens
tgtcaagatgacagatagatga

SEQ ID NO: 7535613 - DNA, 22 bp, Homo sapiens
tgtcaaggacgtgcatgaaccc

SEQ ID NO: 7535614 - DNA, 22 bp, Homo sapiens
tgtcaagagtagtttgaatagt

SEQ ID NO: 7535615 - DNA, 22 bp, Homo sapiens
tgtcaactgtgatgtcaacact

SEQ ID NO: 7535616 - DNA, 22 bp, Homo sapiens
tgtcaagagtagtttgaatagt

SEQ ID NO: 7535617 - DNA, 22 bp, Homo sapiens
tgtcaagagtagtttgaatagt

SEQ ID NO: 7535618 - DNA, 22 bp, Homo sapiens
tgtcaagagtgcacacatctgc

SEQ ID NO: 7535619 - DNA, 22 bp, Homo sapiens
tgtcaagagtgcacacatctgc

SEQ ID NO: 7535620 - DNA, 22 bp, Homo sapiens
tgtcaagtctctgaatgaaatg

SEQ ID NO: 7535621 - DNA, 22 bp, Homo sapiens
tgtcaagtctctgaatgaaatg

SEQ ID NO: 7535622 - DNA, 22 bp, Homo sapiens
tgtcaagtctagttgctggctt

SEQ ID NO: 7535623 - DNA, 23 bp, Homo sapiens
tgtcaagtatagcaggccctccc

SEQ ID NO: 7535624 - DNA, 22 bp, Homo sapiens
tgtcaagtctagttgctggctt

SEQ ID NO: 7535625 - DNA, 22 bp, Homo sapiens
tgtcaagtgattagccataatg

SEQ ID NO: 7535626 - DNA, 22 bp, Homo sapiens
tgtcaagtctctgaatgaaatg

SEQ ID NO: 7535627 - DNA, 22 bp, Homo sapiens
tgtcaagtgattagccataatg

SEQ ID NO: 7535628 - DNA, 22 bp, Homo sapiens
tgtcaagttgtggcatgtctaa

SEQ ID NO: 7535629 - DNA, 22 bp, Homo sapiens
tgtcaataacatttacttctat

SEQ ID NO: 7535630 - DNA, 22 bp, Homo sapiens
tgtcaataacatttacttctat

SEQ ID NO: 7535631 - DNA, 22 bp, Homo sapiens
tgtcaagttgtggcatgtctaa

SEQ ID NO: 7535632 - DNA, 22 bp, Homo sapiens
tgtcaataactggagtcattat

SEQ ID NO: 7535633 - DNA, 22 bp, Homo sapiens
tgtcaataacatttacttctat

SEQ ID NO: 7535634 - DNA, 22 bp, Homo sapiens
tgtcaataactggagtcattat

SEQ ID NO: 7535635 - DNA, 22 bp, Homo sapiens
tgtcaagttgttaagttctggg

SEQ ID NO: 7535636 - DNA, 22 bp, Homo sapiens
tgtcaagttgttaagttctggg

SEQ ID NO: 7535637 - DNA, 22 bp, Homo sapiens
tgtcaagttgtggcatgtctaa

SEQ ID NO: 7535638 - DNA, 22 bp, Homo sapiens
tgtcaagttgttaagttctggg

SEQ ID NO: 7535639 - DNA, 22 bp, Homo sapiens
tgtcaacattggctgacagttg

SEQ ID NO: 7535640 - DNA, 22 bp, Homo sapiens
tgtcaacattggctgacagttg

SEQ ID NO: 7535641 - DNA, 22 bp, Homo sapiens
tgtcaacattggctgacagttg

SEQ ID NO: 7535642 - DNA, 22 bp, Homo sapiens
tgtcaacagatctcaaagctgg

SEQ ID NO: 7535643 - DNA, 22 bp, Homo sapiens
tgtcaacaggctttctaaggca

SEQ ID NO: 7535644 - DNA, 22 bp, Homo sapiens
tgtcaacatttatcaagttatt

SEQ ID NO: 7535645 - DNA, 22 bp, Homo sapiens
tgtcaacatttatcaagttatt

SEQ ID NO: 7535646 - DNA, 22 bp, Homo sapiens
tgtcaaccaggtattttggtct

SEQ ID NO: 7535647 - DNA, 22 bp, Homo sapiens
tgtcaacagatactagagagct

SEQ ID NO: 7535648 - DNA, 22 bp, Homo sapiens
tgtcaacagatactagagagct

SEQ ID NO: 7535649 - DNA, 22 bp, Homo sapiens
tgtcaacagatactagagagct

SEQ ID NO: 7535650 - DNA, 22 bp, Homo sapiens
tgtcaacagatactagagagct

SEQ ID NO: 7535651 - DNA, 22 bp, Homo sapiens
tgtcaacagatactagagagct

SEQ ID NO: 7535652 - DNA, 22 bp, Homo sapiens
tgtcaacaacagcattttctat

SEQ ID NO: 7535653 - DNA, 22 bp, Homo sapiens
tgtcaacaacagcattttctat

SEQ ID NO: 7535654 - DNA, 22 bp, Homo sapiens
tgtcaacaacagcattttctat

SEQ ID NO: 7535655 - DNA, 22 bp, Homo sapiens
tgtcaacacacctatctcaatt

SEQ ID NO: 7535656 - DNA, 22 bp, Homo sapiens
tgtcaacacacctatctcaatt

SEQ ID NO: 7535657 - DNA, 22 bp, Homo sapiens
cctggaggggaccaggaccagg

SEQ ID NO: 7535658 - DNA, 22 bp, Homo sapiens
cctggaggggaccaggaccagg

SEQ ID NO: 7535659 - DNA, 22 bp, Homo sapiens
cctggaggggaccaggaccagg

SEQ ID NO: 7535660 - DNA, 22 bp, Homo sapiens
cctggaggggaccaggaccagg

SEQ ID NO: 7535661 - DNA, 22 bp, Homo sapiens
cctggagggcgccgcacagtcc

SEQ ID NO: 7535662 - DNA, 22 bp, Homo sapiens
cctggagggcgccgcacagtcc

SEQ ID NO: 7535663 - DNA, 18 bp, Homo sapiens
cctggaggtcttcggggt

SEQ ID NO: 7535664 - DNA, 19 bp, Homo sapiens
cctggaggtgaaggttctc

SEQ ID NO: 7535665 - DNA, 18 bp, Homo sapiens
cctggaggtcttcggggt

SEQ ID NO: 7535666 - DNA, 18 bp, Homo sapiens
cctggaggtcttcggggt

SEQ ID NO: 7535667 - DNA, 22 bp, Homo sapiens
tgtcaaatagtagaaagatggc

SEQ ID NO: 7535668 - DNA, 22 bp, Homo sapiens
tgtcaaatagtagaaagatggc

SEQ ID NO: 7535669 - DNA, 22 bp, Homo sapiens
tgtcaaatagtagaaagatggc

SEQ ID NO: 7535670 - DNA, 22 bp, Homo sapiens
tgtcaaatttttattgcagtat

SEQ ID NO: 7535671 - DNA, 22 bp, Homo sapiens
tgtcaacaaaacggttcaaatg

SEQ ID NO: 7535672 - DNA, 22 bp, Homo sapiens
tgtcaaatttttattgcagtat

SEQ ID NO: 7535673 - DNA, 23 bp, Homo sapiens
tgtcaacaaaactttcaggagaa

SEQ ID NO: 7535674 - DNA, 23 bp, Homo sapiens
tgtcaacaaaactttcaggagaa

SEQ ID NO: 7535675 - DNA, 22 bp, Homo sapiens
tgtcaacaacagcattttctat

SEQ ID NO: 7535676 - DNA, 22 bp, Homo sapiens
tgtattctaaatacatcttacc

SEQ ID NO: 7535677 - DNA, 22 bp, Homo sapiens
tgtattctctcaatatttcata

SEQ ID NO: 7535678 - DNA, 22 bp, Homo sapiens
tgtattccaaaatgctgaggat

SEQ ID NO: 7535679 - DNA, 22 bp, Homo sapiens
tgtattcatgtgagcctaggaa

SEQ ID NO: 7535680 - DNA, 22 bp, Homo sapiens
tgtattcagtgcctagcatatg

SEQ ID NO: 7535681 - DNA, 22 bp, Homo sapiens
tgtattcagtgcctagcatatg

SEQ ID NO: 7535682 - DNA, 22 bp, Homo sapiens
tgtattcagtgatttcacaata

SEQ ID NO: 7535683 - DNA, 22 bp, Homo sapiens
tgtattcagtgcctagcatatg

SEQ ID NO: 7535684 - DNA, 22 bp, Homo sapiens
tgtattcagtgcctagcatatg

SEQ ID NO: 7535685 - DNA, 22 bp, Homo sapiens
tgtaatttcctgatgttagaac

SEQ ID NO: 7535686 - DNA, 22 bp, Homo sapiens
tgtaatttcctgatgttagaac

SEQ ID NO: 7535687 - DNA, 22 bp, Homo sapiens
tgtaattcattcaactgaagaa

SEQ ID NO: 7535688 - DNA, 22 bp, Homo sapiens
tgtaatttcctgatgttagaac

SEQ ID NO: 7535689 - DNA, 22 bp, Homo sapiens
tgtaatttcctgatgttagaac

SEQ ID NO: 7535690 - DNA, 22 bp, Homo sapiens
tgtaatttgcatggctgaatgc

SEQ ID NO: 7535691 - DNA, 22 bp, Homo sapiens
tgtaatttgcatggctgaatgc

SEQ ID NO: 7535692 - DNA, 22 bp, Homo sapiens
tgtaatttgcatggctgaatgc

SEQ ID NO: 7535693 - DNA, 22 bp, Homo sapiens
tgtaattttacgtgacacagtt

SEQ ID NO: 7535694 - DNA, 22 bp, Homo sapiens
tgtaattttacgtgacacagtt

SEQ ID NO: 7535695 - DNA, 22 bp, Homo sapiens
tgtaatttgcatggctgaatgc

SEQ ID NO: 7535696 - DNA, 22 bp, Homo sapiens
tgtaattatttctgtgcagtca

SEQ ID NO: 7535697 - DNA, 22 bp, Homo sapiens
tgtaattatgttgttagagtat

SEQ ID NO: 7535698 - DNA, 22 bp, Homo sapiens
tgtaattcattcaactgaagaa

SEQ ID NO: 7535699 - DNA, 22 bp, Homo sapiens
tgtaattaacgttcttgttaga

SEQ ID NO: 7535700 - DNA, 22 bp, Homo sapiens
tgtaattaacgttcttgttaga

SEQ ID NO: 7535701 - DNA, 22 bp, Homo sapiens
tgtaattaacgttcttgttaga

SEQ ID NO: 7535702 - DNA, 22 bp, Homo sapiens
tgtaattatgttgttagagtat

SEQ ID NO: 7535703 - DNA, 22 bp, Homo sapiens
tgtaatggtagaaattagggat

SEQ ID NO: 7535704 - DNA, 22 bp, Homo sapiens
tgtaatggtagaaattagggat

SEQ ID NO: 7535705 - DNA, 22 bp, Homo sapiens
tgtaatggttaccaggtggggg

SEQ ID NO: 7535706 - DNA, 22 bp, Homo sapiens
tgtaatggttaccaggtggggg

SEQ ID NO: 7535707 - DNA, 22 bp, Homo sapiens
tgtaatggttctgagcaggttt

SEQ ID NO: 7535708 - DNA, 22 bp, Homo sapiens
tgtaatggttctgagcaggttt

SEQ ID NO: 7535709 - DNA, 22 bp, Homo sapiens
tgtaatgggctactaggaagag

SEQ ID NO: 7535710 - DNA, 22 bp, Homo sapiens
tgtaatgggctactaggaagag

SEQ ID NO: 7535711 - DNA, 22 bp, Homo sapiens
tgtaatggagcttagagttatc

SEQ ID NO: 7535712 - DNA, 22 bp, Homo sapiens
tgtaatgggctactaggaagag

SEQ ID NO: 7535713 - DNA, 22 bp, Homo sapiens
tgtaatggttttcttccttctt

SEQ ID NO: 7535714 - DNA, 22 bp, Homo sapiens
tgtaattaaactgaagacagaa

SEQ ID NO: 7535715 - DNA, 22 bp, Homo sapiens
tgtaattaaactgaagacagaa

SEQ ID NO: 7535716 - DNA, 22 bp, Homo sapiens
tgtaattaaactgaagacagaa

SEQ ID NO: 7535717 - DNA, 22 bp, Homo sapiens
tgtacagtgtagtcatgaggtt

SEQ ID NO: 7535718 - DNA, 22 bp, Homo sapiens
tgtacagtgtagtcatgaggtt

SEQ ID NO: 7535719 - DNA, 22 bp, Homo sapiens
tgtacagtgtaaataagtggat

SEQ ID NO: 7535720 - DNA, 22 bp, Homo sapiens
tgtacagtgtagtcatgaggtt

SEQ ID NO: 7535721 - DNA, 22 bp, Homo sapiens
tgtacagttaatcttaagccat

SEQ ID NO: 7535722 - DNA, 18 bp, Homo sapiens
tgtacagttatgagcatt

SEQ ID NO: 7535723 - DNA, 18 bp, Homo sapiens
tgtacagttatgagcatt

SEQ ID NO: 7535724 - DNA, 22 bp, Homo sapiens
tgtaattttacgtgacacagtt

SEQ ID NO: 7535725 - DNA, 22 bp, Homo sapiens
tgtacagtggaaaatggattcg

SEQ ID NO: 7535726 - DNA, 22 bp, Homo sapiens
tgtacagtggaaaatggattcg

SEQ ID NO: 7535727 - DNA, 22 bp, Homo sapiens
tgtacagtggaaaatggattcg

SEQ ID NO: 7535728 - DNA, 22 bp, Homo sapiens
tgtacagtgtaaataagtggat

SEQ ID NO: 7535729 - DNA, 22 bp, Homo sapiens
tgtacagtgtaaataagtggat

SEQ ID NO: 7535730 - DNA, 22 bp, Homo sapiens
tgtacagtgtaaataagtggat

SEQ ID NO: 7535731 - DNA, 22 bp, Homo sapiens
tgtacatacatagatatacaca

SEQ ID NO: 7535732 - DNA, 22 bp, Homo sapiens
tgtacatacatagatatacaca

SEQ ID NO: 7535733 - DNA, 22 bp, Homo sapiens
tgtacatacatagatatacaca

SEQ ID NO: 7535734 - DNA, 22 bp, Homo sapiens
tgtacatacatagatatacaca

SEQ ID NO: 7535735 - DNA, 22 bp, Homo sapiens
tgtacagttttaactctgaggg

SEQ ID NO: 7535736 - DNA, 23 bp, Homo sapiens
tgtacagttgtttgactcagctc

SEQ ID NO: 7535737 - DNA, 22 bp, Homo sapiens
tgtacagttttaactctgaggg

SEQ ID NO: 7535738 - DNA, 23 bp, Homo sapiens
tgtacagttgtttgactcagctc

SEQ ID NO: 7535739 - DNA, 18 bp, Homo sapiens
tgtacagttatgagcatt

SEQ ID NO: 7535740 - DNA, 18 bp, Homo sapiens
tgtacagttatgagcatt

SEQ ID NO: 7535741 - DNA, 18 bp, Homo sapiens
tgtacagttatgagcatt

SEQ ID NO: 7535742 - DNA, 23 bp, Homo sapiens
tgtacagttgtttgactcagctc

SEQ ID NO: 7535743 - DNA, 22 bp, Homo sapiens
tgtacatacatagatatacaca

SEQ ID NO: 7535744 - DNA, 22 bp, Homo sapiens
tgtacatacatagatatacaca

SEQ ID NO: 7535745 - DNA, 22 bp, Homo sapiens
tgtacatacatagatatacaca

SEQ ID NO: 7535746 - DNA, 22 bp, Homo sapiens
tgtacatacatagatatacaca

SEQ ID NO: 7535747 - DNA, 22 bp, Homo sapiens
tgtacatacatagatatacaca

SEQ ID NO: 7535748 - DNA, 22 bp, Homo sapiens
tgtacatacatagatatacaca

SEQ ID NO: 7535749 - DNA, 22 bp, Homo sapiens
tgtacatattcaagcacttcta

SEQ ID NO: 7535750 - DNA, 22 bp, Homo sapiens
tgtacatagatcttgaaaatta

SEQ ID NO: 7535751 - DNA, 22 bp, Homo sapiens
tgtacatgaataaaagatcttg

SEQ ID NO: 7535752 - DNA, 22 bp, Homo sapiens
tgtacatatatgtatgtacgca

SEQ ID NO: 7535753 - DNA, 19 bp, Homo sapiens
tgtacatatagagctcagt

SEQ ID NO: 7535754 - DNA, 22 bp, Homo sapiens
tgtacatagaaaggatacagct

SEQ ID NO: 7535755 - DNA, 22 bp, Homo sapiens
tgtacatagaaaggatacagct

SEQ ID NO: 7535756 - DNA, 22 bp, Homo sapiens
tgtacatagatcttgaaaatta

SEQ ID NO: 7535757 - DNA, 22 bp, Homo sapiens
tgtacatagatcttgaaaatta

SEQ ID NO: 7535758 - DNA, 19 bp, Homo sapiens
tgtacatatagagctcagt

SEQ ID NO: 7535759 - DNA, 19 bp, Homo sapiens
tgtacatatagagctcagt

SEQ ID NO: 7535760 - DNA, 22 bp, Homo sapiens
tgtacatagaaaggatacagct

SEQ ID NO: 7535761 - DNA, 22 bp, Homo sapiens
tgtacatagatcttgaaaatta

SEQ ID NO: 7535762 - DNA, 22 bp, Homo sapiens
tgtacatagatcttgaaaatta

SEQ ID NO: 7535763 - DNA, 22 bp, Homo sapiens
tgtacattgtcactcatcaagt

SEQ ID NO: 7535764 - DNA, 22 bp, Homo sapiens
tgtacattgtcactcatcaagt

SEQ ID NO: 7535765 - DNA, 22 bp, Homo sapiens
tgtacatgacagagagagccaa

SEQ ID NO: 7535766 - DNA, 22 bp, Homo sapiens
tgtacattgtcactcatcaagt

SEQ ID NO: 7535767 - DNA, 22 bp, Homo sapiens
tgtacatgtgtctgtatatctt

SEQ ID NO: 7535768 - DNA, 22 bp, Homo sapiens
tgtacatttagagctcaataga

SEQ ID NO: 7535769 - DNA, 22 bp, Homo sapiens
tgtacatttagagctcaataga

SEQ ID NO: 7535770 - DNA, 22 bp, Homo sapiens
tgtacatttagagctcaataga

SEQ ID NO: 7535771 - DNA, 22 bp, Homo sapiens
tgtacattttctcagagtttat

SEQ ID NO: 7535772 - DNA, 22 bp, Homo sapiens
tgtacattttctcagagtttat

SEQ ID NO: 7535773 - DNA, 22 bp, Homo sapiens
cctggagcactctccctggctg

SEQ ID NO: 7535774 - DNA, 22 bp, Homo sapiens
cctggagcactctccctggctg

SEQ ID NO: 7535775 - DNA, 22 bp, Homo sapiens
cctggagcactctccctggctg

SEQ ID NO: 7535776 - DNA, 22 bp, Homo sapiens
cctggagcactctccctggctg

SEQ ID NO: 7535777 - DNA, 22 bp, Homo sapiens
cctggagcacatggcaggaggc

SEQ ID NO: 7535778 - DNA, 22 bp, Homo sapiens
tgtaccaaaaatgtgtcagact

SEQ ID NO: 7535779 - DNA, 22 bp, Homo sapiens
tgtaccaaaaatgtgtcagact

SEQ ID NO: 7535780 - DNA, 22 bp, Homo sapiens
cctggaaaacatgggaatcaca

SEQ ID NO: 7535781 - DNA, 22 bp, Homo sapiens
cctggaaaacatgggaatcaca

SEQ ID NO: 7535782 - DNA, 22 bp, Homo sapiens
cctgctttggcaggcagctcct

SEQ ID NO: 7535783 - DNA, 22 bp, Homo sapiens
cctgcttcagggatgatggcac

SEQ ID NO: 7535784 - DNA, 22 bp, Homo sapiens
cctgcttaacattgccatgaca

SEQ ID NO: 7535785 - DNA, 22 bp, Homo sapiens
tgtaaagacagataaaacagca

SEQ ID NO: 7535786 - DNA, 22 bp, Homo sapiens
cctggaaaatgccactttcaca

SEQ ID NO: 7535787 - DNA, 22 bp, Homo sapiens
tgtaaagacagataaaacagca

SEQ ID NO: 7535788 - DNA, 22 bp, Homo sapiens
tgtaaagacagataaaacagca

SEQ ID NO: 7535789 - DNA, 22 bp, Homo sapiens
cctggaaaacatgggaatcaca

SEQ ID NO: 7535790 - DNA, 22 bp, Homo sapiens
tgtaaagagaagaaacgtgagc

SEQ ID NO: 7535791 - DNA, 22 bp, Homo sapiens
tgtaaagagaagaaacgtgagc

SEQ ID NO: 7535792 - DNA, 22 bp, Homo sapiens
tgtaaagacgcttatagcttgc

SEQ ID NO: 7535793 - DNA, 22 bp, Homo sapiens
tgtaaagagaagaaacgtgagc

SEQ ID NO: 7535794 - DNA, 22 bp, Homo sapiens
tgtaagtagtaatggaaggaca

SEQ ID NO: 7535795 - DNA, 22 bp, Homo sapiens
cctgcttaacattgccatgaca

SEQ ID NO: 7535796 - DNA, 22 bp, Homo sapiens
cctgcttaacattgccatgaca

SEQ ID NO: 7535797 - DNA, 22 bp, Homo sapiens
cctgcttaacattgccatgaca

SEQ ID NO: 7535798 - DNA, 22 bp, Homo sapiens
cctgcttcagggatgatggcac

SEQ ID NO: 7535799 - DNA, 22 bp, Homo sapiens
cctgcttcagggatgatggcac

SEQ ID NO: 7535800 - DNA, 20 bp, Homo sapiens
cctgctgtttccatggggcc

SEQ ID NO: 7535801 - DNA, 22 bp, Homo sapiens
cctgctgttttcttcacttcag

SEQ ID NO: 7535802 - DNA, 22 bp, Homo sapiens
cctgctgttttcttcacttcag

SEQ ID NO: 7535803 - DNA, 22 bp, Homo sapiens
cctgctgtgtccctggctttct

SEQ ID NO: 7535804 - DNA, 20 bp, Homo sapiens
cctgctgtgctttccatgga

SEQ ID NO: 7535805 - DNA, 20 bp, Homo sapiens
cctgctgtgctttccatgga

SEQ ID NO: 7535806 - DNA, 22 bp, Homo sapiens
cctgctgtgtgacgggatgtta

SEQ ID NO: 7535807 - DNA, 21 bp, Homo sapiens
tgtaagtttcatctgaattgg

SEQ ID NO: 7535808 - DNA, 21 bp, Homo sapiens
tgtaagtttcatctgaattgg

SEQ ID NO: 7535809 - DNA, 21 bp, Homo sapiens
tgtaagtttcatctgaattgg

SEQ ID NO: 7535810 - DNA, 21 bp, Homo sapiens
tgtaagtttcatctgaattgg

SEQ ID NO: 7535811 - DNA, 22 bp, Homo sapiens
tgtaagttttgtgaaacaaaca

SEQ ID NO: 7535812 - DNA, 22 bp, Homo sapiens
tgtaatataagcattaatagtt

SEQ ID NO: 7535813 - DNA, 22 bp, Homo sapiens
tgtaatataagcattaatagtt

SEQ ID NO: 7535814 - DNA, 22 bp, Homo sapiens
tgtaatataagcattaatagtt

SEQ ID NO: 7535815 - DNA, 22 bp, Homo sapiens
tgtaatactccattgtatggat

SEQ ID NO: 7535816 - DNA, 22 bp, Homo sapiens
tgtaataccactgttggacatt

SEQ ID NO: 7535817 - DNA, 22 bp, Homo sapiens
tgtaataccactgttggacatt

SEQ ID NO: 7535818 - DNA, 22 bp, Homo sapiens
tgtaataccactgttggacatt

SEQ ID NO: 7535819 - DNA, 22 bp, Homo sapiens
tgtaataatgaggcatccagcc

SEQ ID NO: 7535820 - DNA, 22 bp, Homo sapiens
tgtaataatgaggcatccagcc

SEQ ID NO: 7535821 - DNA, 22 bp, Homo sapiens
tgtaagttttgtgaaacaaaca

SEQ ID NO: 7535822 - DNA, 22 bp, Homo sapiens
tgtaataatgaggcatccagcc

SEQ ID NO: 7535823 - DNA, 22 bp, Homo sapiens
tgtaagtagtaatggaaggaca

SEQ ID NO: 7535824 - DNA, 21 bp, Homo sapiens
tgtaagtttcatctgaattgg

SEQ ID NO: 7535825 - DNA, 22 bp, Homo sapiens
tgtaagtctggcttatagcttt

SEQ ID NO: 7535826 - DNA, 22 bp, Homo sapiens
tgtaagtgctcagctgatggtt

SEQ ID NO: 7535827 - DNA, 22 bp, Homo sapiens
tgtaagtgctcagctgatggtt

SEQ ID NO: 7535828 - DNA, 21 bp, Homo sapiens
tgtaagtttcatctgaattgg

SEQ ID NO: 7535829 - DNA, 21 bp, Homo sapiens
tgtaagtttcatctgaattgg

SEQ ID NO: 7535830 - DNA, 22 bp, Homo sapiens
tgtaatatatataactgtgtgc

SEQ ID NO: 7535831 - DNA, 22 bp, Homo sapiens
tgtaatatatataactgtgtgc

SEQ ID NO: 7535832 - DNA, 22 bp, Homo sapiens
tgtaatattgtagtgacagtac

SEQ ID NO: 7535833 - DNA, 22 bp, Homo sapiens
tgtaatcatgcatcagttagtt

SEQ ID NO: 7535834 - DNA, 22 bp, Homo sapiens
tgtaatcatgcatcagttagtt

SEQ ID NO: 7535835 - DNA, 22 bp, Homo sapiens
tgtaatcattacagtacatgga

SEQ ID NO: 7535836 - DNA, 22 bp, Homo sapiens
tgtaatcattacagtacatgga

SEQ ID NO: 7535837 - DNA, 22 bp, Homo sapiens
tgtaatcatgcatcagttagtt

SEQ ID NO: 7535838 - DNA, 22 bp, Homo sapiens
tgtaatcattacagtacatgga

SEQ ID NO: 7535839 - DNA, 22 bp, Homo sapiens
tgtaatcattacagtacatgga

SEQ ID NO: 7535840 - DNA, 22 bp, Homo sapiens
tgtaatcccagctactcgggag

SEQ ID NO: 7535841 - DNA, 22 bp, Homo sapiens
tgtaatgaaatggtacaactgt

SEQ ID NO: 7535842 - DNA, 22 bp, Homo sapiens
tgtaatgaaatggtacaactgt

SEQ ID NO: 7535843 - DNA, 22 bp, Homo sapiens
tgtaatgagaaagagagtgaat

SEQ ID NO: 7535844 - DNA, 22 bp, Homo sapiens
tgtaatggaagtgggattgcat

SEQ ID NO: 7535845 - DNA, 22 bp, Homo sapiens
tgtaatggaagtgggattgcat

SEQ ID NO: 7535846 - DNA, 22 bp, Homo sapiens
tgtaatggagcttagagttatc

SEQ ID NO: 7535847 - DNA, 22 bp, Homo sapiens
tgtaatggaaaaacattagcat

SEQ ID NO: 7535848 - DNA, 22 bp, Homo sapiens
tgtaatggaaaaacattagcat

SEQ ID NO: 7535849 - DNA, 22 bp, Homo sapiens
tgtaatgagaaagagagtgaat

SEQ ID NO: 7535850 - DNA, 22 bp, Homo sapiens
tgtaatgatgtacttagaagga

SEQ ID NO: 7535851 - DNA, 22 bp, Homo sapiens
cctgccttcagccctgaagtct

SEQ ID NO: 7535852 - DNA, 22 bp, Homo sapiens
cctgccttcagccctgaagtct

SEQ ID NO: 7535853 - DNA, 22 bp, Homo sapiens
cctgccttccagccttgggctc

SEQ ID NO: 7535854 - DNA, 22 bp, Homo sapiens
cctgccttccagccttgggctc

SEQ ID NO: 7535855 - DNA, 22 bp, Homo sapiens
cctgccttccagccttgggctc

SEQ ID NO: 7535856 - DNA, 22 bp, Homo sapiens
cctgccttccagccttgggctc

SEQ ID NO: 7535857 - DNA, 22 bp, Homo sapiens
cctgccttccagccttgggctc

SEQ ID NO: 7535858 - DNA, 22 bp, Homo sapiens
cctgccttccagccttgggctc

SEQ ID NO: 7535859 - DNA, 22 bp, Homo sapiens
cctgccttcccagcttggcttt

SEQ ID NO: 7535860 - DNA, 22 bp, Homo sapiens
cctgccttcccagcttggcttt

SEQ ID NO: 7535861 - DNA, 22 bp, Homo sapiens
cctgccttcccagcttggcttt

SEQ ID NO: 7535862 - DNA, 22 bp, Homo sapiens
cctgccttcccagcttggcttt

SEQ ID NO: 7535863 - DNA, 23 bp, Homo sapiens
tggtctgaagcctcaggttcctc

SEQ ID NO: 7535864 - DNA, 22 bp, Homo sapiens
tggtctcttttcagcctgggga

SEQ ID NO: 7535865 - DNA, 22 bp, Homo sapiens
tggtctcttttcagcctgggga

SEQ ID NO: 7535866 - DNA, 22 bp, Homo sapiens
tggtctcttcttccaagatggc

SEQ ID NO: 7535867 - DNA, 22 bp, Homo sapiens
tggtctcttcttccaagatggc

SEQ ID NO: 7535868 - DNA, 22 bp, Homo sapiens
tggtctgcctggatcacagccc

SEQ ID NO: 7535869 - DNA, 22 bp, Homo sapiens
tggtctgcctggatcacagccc

SEQ ID NO: 7535870 - DNA, 22 bp, Homo sapiens
tggtctgcagacatgtgggtgt

SEQ ID NO: 7535871 - DNA, 22 bp, Homo sapiens
tggtctgattcttgctccccaa

SEQ ID NO: 7535872 - DNA, 22 bp, Homo sapiens
tggtctgatggtcccaccaccg

SEQ ID NO: 7535873 - DNA, 22 bp, Homo sapiens
tggtctgataccggattccagt

SEQ ID NO: 7535874 - DNA, 22 bp, Homo sapiens
tggtctgaggaacaccagcact

SEQ ID NO: 7535875 - DNA, 22 bp, Homo sapiens
tggtctgaaggacttctgaggg

SEQ ID NO: 7535876 - DNA, 22 bp, Homo sapiens
tggtctgaaggtggatttgaga

SEQ ID NO: 7535877 - DNA, 22 bp, Homo sapiens
tggtctgtcccactctgccctt

SEQ ID NO: 7535878 - DNA, 22 bp, Homo sapiens
cctgctctaaatctcatggaac

SEQ ID NO: 7535879 - DNA, 22 bp, Homo sapiens
cctgctgctatgaaggtgacag

SEQ ID NO: 7535880 - DNA, 22 bp, Homo sapiens
cctgctctaaatctcatggaac

SEQ ID NO: 7535881 - DNA, 22 bp, Homo sapiens
cctgctcggggtgcagtgggct

SEQ ID NO: 7535882 - DNA, 22 bp, Homo sapiens
cctgctctaaatctcatggaac

SEQ ID NO: 7535883 - DNA, 22 bp, Homo sapiens
tggtctgttcaaggtggctgat

SEQ ID NO: 7535884 - DNA, 22 bp, Homo sapiens
tggtcttaaaaacatcaaatgg

SEQ ID NO: 7535885 - DNA, 22 bp, Homo sapiens
cctgctctaaatctcatggaac

SEQ ID NO: 7535886 - DNA, 22 bp, Homo sapiens
tggtcttagctggaaggaggga

SEQ ID NO: 7535887 - DNA, 22 bp, Homo sapiens
cctgctggacaggggtgttcat

SEQ ID NO: 7535888 - DNA, 22 bp, Homo sapiens
cctgctgcttaggccatatttc

SEQ ID NO: 7535889 - DNA, 22 bp, Homo sapiens
cctgctggacctcaacacattt

SEQ ID NO: 7535890 - DNA, 22 bp, Homo sapiens
cctgctggacctcaacacattt

SEQ ID NO: 7535891 - DNA, 22 bp, Homo sapiens
cctgctggacctcaacacattt

SEQ ID NO: 7535892 - DNA, 22 bp, Homo sapiens
cctgctggacgtggaggagggg

SEQ ID NO: 7535893 - DNA, 22 bp, Homo sapiens
cctgctggacgtggaggagggg

SEQ ID NO: 7535894 - DNA, 22 bp, Homo sapiens
cctgctggacgtggaggagggg

SEQ ID NO: 7535895 - DNA, 22 bp, Homo sapiens
cctgctggacgtggaggagggg

SEQ ID NO: 7535896 - DNA, 20 bp, Homo sapiens
tggtctggagccagtgagga

SEQ ID NO: 7535897 - DNA, 17 bp, Homo sapiens
tggtctggaagaactga

SEQ ID NO: 7535898 - DNA, 22 bp, Homo sapiens
tggtctggaactcctggcttca

SEQ ID NO: 7535899 - DNA, 22 bp, Homo sapiens
tggtctggaactcctggcttca

SEQ ID NO: 7535900 - DNA, 22 bp, Homo sapiens
tggtctgctgaacagccgtatc

SEQ ID NO: 7535901 - DNA, 22 bp, Homo sapiens
tggtctgctgaacagccgtatc

SEQ ID NO: 7535902 - DNA, 22 bp, Homo sapiens
tggtctgctgaacagccgtatc

SEQ ID NO: 7535903 - DNA, 22 bp, Homo sapiens
tggtctgctgaacagccgtatc

SEQ ID NO: 7535904 - DNA, 22 bp, Homo sapiens
tggtctgggcaaatccttctga

SEQ ID NO: 7535905 - DNA, 22 bp, Homo sapiens
tggtctgggcaaatccttctga

SEQ ID NO: 7535906 - DNA, 22 bp, Homo sapiens
tggtctggggaccgagggttac

SEQ ID NO: 7535907 - DNA, 22 bp, Homo sapiens
tggtctggggaccgagggttac

SEQ ID NO: 7535908 - DNA, 22 bp, Homo sapiens
tggtctggttatttcttaatga

SEQ ID NO: 7535909 - DNA, 20 bp, Homo sapiens
tggtctggagccagtgagga

SEQ ID NO: 7535910 - DNA, 20 bp, Homo sapiens
tggtctggagccagtgagga

SEQ ID NO: 7535911 - DNA, 22 bp, Homo sapiens
cctgctgtctctgggcaggcag

SEQ ID NO: 7535912 - DNA, 22 bp, Homo sapiens
cctgctgtctctgggcaggcag

SEQ ID NO: 7535913 - DNA, 22 bp, Homo sapiens
cctgctgtctctgggcaggcag

SEQ ID NO: 7535914 - DNA, 22 bp, Homo sapiens
cctgctgtgaaactggcatatg

SEQ ID NO: 7535915 - DNA, 22 bp, Homo sapiens
cctgctgtgaagccaggcctgt

SEQ ID NO: 7535916 - DNA, 22 bp, Homo sapiens
cctgctgtgaagccaggcctgt

SEQ ID NO: 7535917 - DNA, 22 bp, Homo sapiens
cctgctgtgaagccaggcctgt

SEQ ID NO: 7535918 - DNA, 22 bp, Homo sapiens
cctgctgtgaccggggagcagg

SEQ ID NO: 7535919 - DNA, 22 bp, Homo sapiens
cctgctgtgaccggggagcagg

SEQ ID NO: 7535920 - DNA, 20 bp, Homo sapiens
cctgctgtgctttccatgga

SEQ ID NO: 7535921 - DNA, 22 bp, Homo sapiens
cctgctgtgaccggggagcagg

SEQ ID NO: 7535922 - DNA, 22 bp, Homo sapiens
cctgctgtgaccggggagcagg

SEQ ID NO: 7535923 - DNA, 22 bp, Homo sapiens
cctgctggtttttacaaagatg

SEQ ID NO: 7535924 - DNA, 22 bp, Homo sapiens
cctgctgtaatgtgtctttatt

SEQ ID NO: 7535925 - DNA, 22 bp, Homo sapiens
cctgctggtttttacaaagatg

SEQ ID NO: 7535926 - DNA, 22 bp, Homo sapiens
cctgctggtttttacaaagatg

SEQ ID NO: 7535927 - DNA, 22 bp, Homo sapiens
cctgctggtgtccaggctttgg

SEQ ID NO: 7535928 - DNA, 22 bp, Homo sapiens
cctgctgtaccctactcggagt

SEQ ID NO: 7535929 - DNA, 22 bp, Homo sapiens
cctgctgtagggcccctggggc

SEQ ID NO: 7535930 - DNA, 22 bp, Homo sapiens
cctgctgtcagcatcctcgcga

SEQ ID NO: 7535931 - DNA, 22 bp, Homo sapiens
cctgctgtcagcatcctcgcga

SEQ ID NO: 7535932 - DNA, 22 bp, Homo sapiens
cctgctgtagggcccctggggc

SEQ ID NO: 7535933 - DNA, 22 bp, Homo sapiens
cctgctgtcagtggggcaggca

SEQ ID NO: 7535934 - DNA, 22 bp, Homo sapiens
cctgctgtcagtggggcaggca

SEQ ID NO: 7535935 - DNA, 22 bp, Homo sapiens
cctgctgtccctctgggctcca

SEQ ID NO: 7535936 - DNA, 22 bp, Homo sapiens
cctgctgtccctctgggctcca

SEQ ID NO: 7535937 - DNA, 22 bp, Homo sapiens
cctgctgtccctctgggctcca

SEQ ID NO: 7535938 - DNA, 22 bp, Homo sapiens
cctgctgtcccctgagcctgga

SEQ ID NO: 7535939 - DNA, 22 bp, Homo sapiens
cctgctggctggtagagttccg

SEQ ID NO: 7535940 - DNA, 22 bp, Homo sapiens
cctgctggctctgttgctcggc

SEQ ID NO: 7535941 - DNA, 22 bp, Homo sapiens
cctgctggctggtagagttccg

SEQ ID NO: 7535942 - DNA, 22 bp, Homo sapiens
cctgctggctggtagagttccg

SEQ ID NO: 7535943 - DNA, 22 bp, Homo sapiens
cctgctggcgtggctggcgccc

SEQ ID NO: 7535944 - DNA, 22 bp, Homo sapiens
cctgctggcgtggctggcgccc

SEQ ID NO: 7535945 - DNA, 22 bp, Homo sapiens
cctgctggcgtggctggcgccc

SEQ ID NO: 7535946 - DNA, 22 bp, Homo sapiens
cctgctggcgtggctggcgccc

SEQ ID NO: 7535947 - DNA, 22 bp, Homo sapiens
cctgctggcgtggctggcgccc

SEQ ID NO: 7535948 - DNA, 20 bp, Homo sapiens
cctgctgggaaccctctgaa

SEQ ID NO: 7535949 - DNA, 22 bp, Homo sapiens
cctgctgggacgtgtggttgcc

SEQ ID NO: 7535950 - DNA, 20 bp, Homo sapiens
cctgctgggaaccctctgaa

SEQ ID NO: 7535951 - DNA, 20 bp, Homo sapiens
cctgctgggaaccctctgaa

SEQ ID NO: 7535952 - DNA, 20 bp, Homo sapiens
cctgctgggaaccctctgaa

SEQ ID NO: 7535953 - DNA, 22 bp, Homo sapiens
cctgctgggcctgagcaatgag

SEQ ID NO: 7535954 - DNA, 22 bp, Homo sapiens
cctgctgggcctgagcaatgag

SEQ ID NO: 7535955 - DNA, 22 bp, Homo sapiens
cctgctgggacgtgtggttgcc

SEQ ID NO: 7535956 - DNA, 22 bp, Homo sapiens
cctgctgggcctgagcaatgag

SEQ ID NO: 7535957 - DNA, 22 bp, Homo sapiens
cctgctgggcctgagcaatgag

SEQ ID NO: 7535958 - DNA, 22 bp, Homo sapiens
cctgctgggcctgagcaatgag

SEQ ID NO: 7535959 - DNA, 22 bp, Homo sapiens
cctgctggccactgctccacct

SEQ ID NO: 7535960 - DNA, 22 bp, Homo sapiens
cctgctggccactgctccacct

SEQ ID NO: 7535961 - DNA, 22 bp, Homo sapiens
cctgctggccactgctccacct

SEQ ID NO: 7535962 - DNA, 22 bp, Homo sapiens
cctgctggccactgctccacct

SEQ ID NO: 7535963 - DNA, 22 bp, Homo sapiens
cctgctggccactgctccacct

SEQ ID NO: 7535964 - DNA, 22 bp, Homo sapiens
cctgctggcattcttgctccct

SEQ ID NO: 7535965 - DNA, 22 bp, Homo sapiens
cctgctggcattcttgctccct

SEQ ID NO: 7535966 - DNA, 22 bp, Homo sapiens
cctgctggccactgctccacct

SEQ ID NO: 7535967 - DNA, 22 bp, Homo sapiens
cctgctggacgtggaggagggg

SEQ ID NO: 7535968 - DNA, 22 bp, Homo sapiens
cctgctggcagagggggttact

SEQ ID NO: 7535969 - DNA, 22 bp, Homo sapiens
cctgctggccagtggagggctg

SEQ ID NO: 7535970 - DNA, 22 bp, Homo sapiens
cctgctggccagtggagggctg

SEQ ID NO: 7535971 - DNA, 22 bp, Homo sapiens
cctgctggccagtggagggctg

SEQ ID NO: 7535972 - DNA, 22 bp, Homo sapiens
cctgctggccagtggagggctg

SEQ ID NO: 7535973 - DNA, 22 bp, Homo sapiens
cctgctggccagtggagggctg

SEQ ID NO: 7535974 - DNA, 22 bp, Homo sapiens
cctgctggcggggacccagtga

SEQ ID NO: 7535975 - DNA, 22 bp, Homo sapiens
cctgctggcggggacccagtga

SEQ ID NO: 7535976 - DNA, 22 bp, Homo sapiens
cctgctggcggggacccagtga

SEQ ID NO: 7535977 - DNA, 22 bp, Homo sapiens
cctgctggcggggacccagtga

SEQ ID NO: 7535978 - DNA, 22 bp, Homo sapiens
cctgctggcggggacccagtga

SEQ ID NO: 7535979 - DNA, 22 bp, Homo sapiens
cctgctggcgcttgtctgggag

SEQ ID NO: 7535980 - DNA, 22 bp, Homo sapiens
cctgctggcgcttgtctgggag

SEQ ID NO: 7535981 - DNA, 22 bp, Homo sapiens
cctgctggcgcttgtctgggag

SEQ ID NO: 7535982 - DNA, 18 bp, Homo sapiens
cctgccagtctggagcag

SEQ ID NO: 7535983 - DNA, 18 bp, Homo sapiens
cctgccagtctggagcag

SEQ ID NO: 7535984 - DNA, 18 bp, Homo sapiens
cctgccagtctggagcag

SEQ ID NO: 7535985 - DNA, 18 bp, Homo sapiens
cctgccagtctggagcag

SEQ ID NO: 7535986 - DNA, 18 bp, Homo sapiens
cctgccagtctggagcag

SEQ ID NO: 7535987 - DNA, 22 bp, Homo sapiens
cctgccagtcactatgtcacct

SEQ ID NO: 7535988 - DNA, 22 bp, Homo sapiens
cctgccagtcactatgtcacct

SEQ ID NO: 7535989 - DNA, 22 bp, Homo sapiens
cctgccagtcactatgtcacct

SEQ ID NO: 7535990 - DNA, 22 bp, Homo sapiens
cctgccagggccttggaagaaa

SEQ ID NO: 7535991 - DNA, 22 bp, Homo sapiens
cctgccagggccttggaagaaa

SEQ ID NO: 7535992 - DNA, 22 bp, Homo sapiens
cctgccagtcactatgtcacct

SEQ ID NO: 7535993 - DNA, 22 bp, Homo sapiens
cctgccagggccttggaagaaa

SEQ ID NO: 7535994 - DNA, 22 bp, Homo sapiens
cctgccagggccttggaagaaa

SEQ ID NO: 7535995 - DNA, 22 bp, Homo sapiens
cctgccagggccagaggccagc

SEQ ID NO: 7535996 - DNA, 22 bp, Homo sapiens
cctgccagggccagaggccagc

SEQ ID NO: 7535997 - DNA, 22 bp, Homo sapiens
cctgccagggccagaggccagc

SEQ ID NO: 7535998 - DNA, 22 bp, Homo sapiens
cctgccagggccagaggccagc

SEQ ID NO: 7535999 - DNA, 22 bp, Homo sapiens
cctgccagggccagaggccagc

SEQ ID NO: 7536000 - DNA, 22 bp, Homo sapiens
cctgccaggccagtgagcttcc

SEQ ID NO: 7536001 - DNA, 22 bp, Homo sapiens
cctgccaggccagtgagcttcc

SEQ ID NO: 7536002 - DNA, 22 bp, Homo sapiens
cctgccaggcgagtctaggcca

SEQ ID NO: 7536003 - DNA, 22 bp, Homo sapiens
cctgccaggcgagtctaggcca

SEQ ID NO: 7536004 - DNA, 22 bp, Homo sapiens
cctgccaggcgagtctaggcca

SEQ ID NO: 7536005 - DNA, 22 bp, Homo sapiens
cctgccaggcgagtctaggcca

SEQ ID NO: 7536006 - DNA, 22 bp, Homo sapiens
cctgccaggccagtgagcttcc

SEQ ID NO: 7536007 - DNA, 22 bp, Homo sapiens
cctgccaggcgagtctaggcca

SEQ ID NO: 7536008 - DNA, 22 bp, Homo sapiens
cctgccaggctttcaggtttgg

SEQ ID NO: 7536009 - DNA, 22 bp, Homo sapiens
cctgccaggctttcaggtttgg

SEQ ID NO: 7536010 - DNA, 22 bp, Homo sapiens
cctgccaggcgagtctaggcca

SEQ ID NO: 7536011 - DNA, 22 bp, Homo sapiens
cctgccaggctttgggcttctg

SEQ ID NO: 7536012 - DNA, 22 bp, Homo sapiens
cctgccaggctttgggcttctg

SEQ ID NO: 7536013 - DNA, 22 bp, Homo sapiens
cctgccagggccagaggccagc

SEQ ID NO: 7536014 - DNA, 22 bp, Homo sapiens
cctgccagggccagaggccagc

SEQ ID NO: 7536015 - DNA, 22 bp, Homo sapiens
cctgccaggctttgggcttctg

SEQ ID NO: 7536016 - DNA, 22 bp, Homo sapiens
cctgccaggctttgggcttctg

SEQ ID NO: 7536017 - DNA, 22 bp, Homo sapiens
cctgccaggctttgggcttctg

SEQ ID NO: 7536018 - DNA, 22 bp, Homo sapiens
tgggtcagagctgtgctgccca

SEQ ID NO: 7536019 - DNA, 22 bp, Homo sapiens
tgggtcagagctgtgctgccca

SEQ ID NO: 7536020 - DNA, 22 bp, Homo sapiens
tgggtcagacagccagtgggcc

SEQ ID NO: 7536021 - DNA, 22 bp, Homo sapiens
tgggtcagagcagacctctgga

SEQ ID NO: 7536022 - DNA, 22 bp, Homo sapiens
tgggtcagagcagacctctgga

SEQ ID NO: 7536023 - DNA, 22 bp, Homo sapiens
tgggtcagaggacctcgtggcc

SEQ ID NO: 7536024 - DNA, 22 bp, Homo sapiens
tgggtcagaggacctcgtggcc

SEQ ID NO: 7536025 - DNA, 22 bp, Homo sapiens
tgggtcagaggacctcgtggcc

SEQ ID NO: 7536026 - DNA, 22 bp, Homo sapiens
tgggtcagagctgtgctgccca

SEQ ID NO: 7536027 - DNA, 22 bp, Homo sapiens
tgggtcagagctgtgctgccca

SEQ ID NO: 7536028 - DNA, 22 bp, Homo sapiens
tgggtcagagctgtgctgccca

SEQ ID NO: 7536029 - DNA, 22 bp, Homo sapiens
tgggtcagacagccagtgggcc

SEQ ID NO: 7536030 - DNA, 22 bp, Homo sapiens
tgggtcagaatcagagagttgc

SEQ ID NO: 7536031 - DNA, 22 bp, Homo sapiens
tgggtcagaatcagagagttgc

SEQ ID NO: 7536032 - DNA, 22 bp, Homo sapiens
tgggtcagacagccagtgggcc

SEQ ID NO: 7536033 - DNA, 22 bp, Homo sapiens
tgggtcagacagccagtgggcc

SEQ ID NO: 7536034 - DNA, 22 bp, Homo sapiens
tgggtcagacagccagtgggcc

SEQ ID NO: 7536035 - DNA, 22 bp, Homo sapiens
tgggtcagacagccagtgggcc

SEQ ID NO: 7536036 - DNA, 22 bp, Homo sapiens
tgggtcagacagccagtgggcc

SEQ ID NO: 7536037 - DNA, 22 bp, Homo sapiens
tgggtaggtgtggcctgaatgt

SEQ ID NO: 7536038 - DNA, 22 bp, Homo sapiens
tgggtaggtgtggcctgaatgt

SEQ ID NO: 7536039 - DNA, 22 bp, Homo sapiens
tgggtaggtgctggggattcag

SEQ ID NO: 7536040 - DNA, 22 bp, Homo sapiens
tgggtaggtgctggggattcag

SEQ ID NO: 7536041 - DNA, 22 bp, Homo sapiens
tgggtaggtgctggggattcag

SEQ ID NO: 7536042 - DNA, 22 bp, Homo sapiens
tgggtaggtgctggggattcag

SEQ ID NO: 7536043 - DNA, 18 bp, Homo sapiens
cctgccagtctggagcag

SEQ ID NO: 7536044 - DNA, 22 bp, Homo sapiens
tgggtcaaatggtaattctatg

SEQ ID NO: 7536045 - DNA, 22 bp, Homo sapiens
tgggtaggtgtggcctgaatgt

SEQ ID NO: 7536046 - DNA, 22 bp, Homo sapiens
tgggtcaacctgataaaatgtg

SEQ ID NO: 7536047 - DNA, 22 bp, Homo sapiens
tgggtcacaaaggccagatgat

SEQ ID NO: 7536048 - DNA, 22 bp, Homo sapiens
tgggtcaccacttcagaggaga

SEQ ID NO: 7536049 - DNA, 22 bp, Homo sapiens
tgggtcactatttgcagagacg

SEQ ID NO: 7536050 - DNA, 22 bp, Homo sapiens
tgggtcaccacttcagaggaga

SEQ ID NO: 7536051 - DNA, 22 bp, Homo sapiens
tgggtcactatttgcagagacg

SEQ ID NO: 7536052 - DNA, 22 bp, Homo sapiens
tgggtcactctatcctgcttag

SEQ ID NO: 7536053 - DNA, 23 bp, Homo sapiens
tgggtcactgtttcaccattgct

SEQ ID NO: 7536054 - DNA, 23 bp, Homo sapiens
tgggtcactgtttcaccattgct

SEQ ID NO: 7536055 - DNA, 20 bp, Homo sapiens
cctgcctgtgtttgtgatga

SEQ ID NO: 7536056 - DNA, 20 bp, Homo sapiens
cctgcctgtgtttgtgatga

SEQ ID NO: 7536057 - DNA, 20 bp, Homo sapiens
cctgcctgtgtttgtgatga

SEQ ID NO: 7536058 - DNA, 23 bp, Homo sapiens
cctgcctgttctaactccatttc

SEQ ID NO: 7536059 - DNA, 23 bp, Homo sapiens
cctgcctgttctaactccatttc

SEQ ID NO: 7536060 - DNA, 23 bp, Homo sapiens
cctgcctgttctaactccatttc

SEQ ID NO: 7536061 - DNA, 23 bp, Homo sapiens
cctgcctgttctaactccatttc

SEQ ID NO: 7536062 - DNA, 23 bp, Homo sapiens
cctgcctgttctaactccatttc

SEQ ID NO: 7536063 - DNA, 22 bp, Homo sapiens
cctgcctgtctttatcccctgt

SEQ ID NO: 7536064 - DNA, 22 bp, Homo sapiens
cctgcctgtctttatcccctgt

SEQ ID NO: 7536065 - DNA, 22 bp, Homo sapiens
cctgcctgtccctcagtccaca

SEQ ID NO: 7536066 - DNA, 22 bp, Homo sapiens
cctgcctgtctttatcccctgt

SEQ ID NO: 7536067 - DNA, 22 bp, Homo sapiens
cctgcctgtccctcagtccaca

SEQ ID NO: 7536068 - DNA, 22 bp, Homo sapiens
cctgcctgtccctcagtccaca

SEQ ID NO: 7536069 - DNA, 22 bp, Homo sapiens
cctgcctgtccctcagtccaca

SEQ ID NO: 7536070 - DNA, 22 bp, Homo sapiens
cctgcctgtaagatgggtacaa

SEQ ID NO: 7536071 - DNA, 22 bp, Homo sapiens
cctgcctgtaagatgggtacaa

SEQ ID NO: 7536072 - DNA, 22 bp, Homo sapiens
cctgcctggtgtaagtctaagg

SEQ ID NO: 7536073 - DNA, 22 bp, Homo sapiens
cctgcctgtaagatgggtacaa

SEQ ID NO: 7536074 - DNA, 22 bp, Homo sapiens
cctgcctgtactagagacccag

SEQ ID NO: 7536075 - DNA, 22 bp, Homo sapiens
cctgcctgtactagagacccag

SEQ ID NO: 7536076 - DNA, 22 bp, Homo sapiens
cctgcctgtactagagacccag

SEQ ID NO: 7536077 - DNA, 22 bp, Homo sapiens
cctgcctgtactagagacccag

SEQ ID NO: 7536078 - DNA, 22 bp, Homo sapiens
cctgcctgtaagatgggtacaa

SEQ ID NO: 7536079 - DNA, 22 bp, Homo sapiens
cctgcctgtcatcgcctgcgcc

SEQ ID NO: 7536080 - DNA, 22 bp, Homo sapiens
cctgcctgtcatcgcctgcgcc

SEQ ID NO: 7536081 - DNA, 22 bp, Homo sapiens
cctgcctgtcatcgcctgcgcc

SEQ ID NO: 7536082 - DNA, 22 bp, Homo sapiens
cctgcctgtcatcgcctgcgcc

SEQ ID NO: 7536083 - DNA, 22 bp, Homo sapiens
cctgcctgtccctcagtccaca

SEQ ID NO: 7536084 - DNA, 22 bp, Homo sapiens
cctgcctgtccctcagtccaca

SEQ ID NO: 7536085 - DNA, 22 bp, Homo sapiens
cctgcctgtccctcagtccaca

SEQ ID NO: 7536086 - DNA, 20 bp, Homo sapiens
cctgcctgcctcggctcatt

SEQ ID NO: 7536087 - DNA, 22 bp, Homo sapiens
tgggtcagtttgggggccagcc

SEQ ID NO: 7536088 - DNA, 20 bp, Homo sapiens
cctgcctgcctcggctcatt

SEQ ID NO: 7536089 - DNA, 20 bp, Homo sapiens
cctgcctgcctcggctcatt

SEQ ID NO: 7536090 - DNA, 20 bp, Homo sapiens
cctgcctgcctcggctcatt

SEQ ID NO: 7536091 - DNA, 22 bp, Homo sapiens
tgggtcagtttgggggccagcc

SEQ ID NO: 7536092 - DNA, 22 bp, Homo sapiens
tgggtcagtttgggggccagcc

SEQ ID NO: 7536093 - DNA, 22 bp, Homo sapiens
tgggtcagtttgggggccagcc

SEQ ID NO: 7536094 - DNA, 22 bp, Homo sapiens
tgggtcagtttgggggccagcc

SEQ ID NO: 7536095 - DNA, 22 bp, Homo sapiens
tgggtcaggctgggagtcctga

SEQ ID NO: 7536096 - DNA, 22 bp, Homo sapiens
tgggtcaggctgggagtcctga

SEQ ID NO: 7536097 - DNA, 22 bp, Homo sapiens
tgggtcagaggacctcgtggcc

SEQ ID NO: 7536098 - DNA, 22 bp, Homo sapiens
tgggtcagattgagcccctggt

SEQ ID NO: 7536099 - DNA, 22 bp, Homo sapiens
tgggtcagattgagcccctggt

SEQ ID NO: 7536100 - DNA, 22 bp, Homo sapiens
tgggtcagattgagcccctggt

SEQ ID NO: 7536101 - DNA, 22 bp, Homo sapiens
tgggtcaggctgggagtcctga

SEQ ID NO: 7536102 - DNA, 22 bp, Homo sapiens
tgggtcaggctgggagtcctga

SEQ ID NO: 7536103 - DNA, 22 bp, Homo sapiens
tgggtcagattgagcccctggt

SEQ ID NO: 7536104 - DNA, 23 bp, Homo sapiens
tgggtcagctgcctccaggacaa

SEQ ID NO: 7536105 - DNA, 22 bp, Homo sapiens
cctgcctggggacaaaggaggg

SEQ ID NO: 7536106 - DNA, 22 bp, Homo sapiens
cctgcctggggacaaaggaggg

SEQ ID NO: 7536107 - DNA, 22 bp, Homo sapiens
cctgcctgggctcacttgccag

SEQ ID NO: 7536108 - DNA, 22 bp, Homo sapiens
cctgcctgggctcacttgccag

SEQ ID NO: 7536109 - DNA, 22 bp, Homo sapiens
cctgcctggggacaaaggaggg

SEQ ID NO: 7536110 - DNA, 22 bp, Homo sapiens
cctgcctgggttcaaatcccag

SEQ ID NO: 7536111 - DNA, 22 bp, Homo sapiens
cctgcctggtgtaagtctaagg

SEQ ID NO: 7536112 - DNA, 22 bp, Homo sapiens
cctgcctggtgtaagtctaagg

SEQ ID NO: 7536113 - DNA, 22 bp, Homo sapiens
cctgcctgggctcacttgccag

SEQ ID NO: 7536114 - DNA, 22 bp, Homo sapiens
cctgcctgggctcacttgccag

SEQ ID NO: 7536115 - DNA, 22 bp, Homo sapiens
cctgcctgcctgctggccggga

SEQ ID NO: 7536116 - DNA, 22 bp, Homo sapiens
cctgcctgcctgctggccggga

SEQ ID NO: 7536117 - DNA, 22 bp, Homo sapiens
cctgcctgcctgctggccggga

SEQ ID NO: 7536118 - DNA, 22 bp, Homo sapiens
cctgaggctccacctccagaga

SEQ ID NO: 7536119 - DNA, 22 bp, Homo sapiens
cctgaggctccacctccagaga

SEQ ID NO: 7536120 - DNA, 22 bp, Homo sapiens
cctgaggctccacctccagaga

SEQ ID NO: 7536121 - DNA, 22 bp, Homo sapiens
cctgaggctccacctccagaga

SEQ ID NO: 7536122 - DNA, 22 bp, Homo sapiens
cctgaggctccacctccagaga

SEQ ID NO: 7536123 - DNA, 22 bp, Homo sapiens
cctgaggccctggctgtgctga

SEQ ID NO: 7536124 - DNA, 22 bp, Homo sapiens
cctgaggctccacctccagaga

SEQ ID NO: 7536125 - DNA, 22 bp, Homo sapiens
cctgaggctccacctccagaga

SEQ ID NO: 7536126 - DNA, 22 bp, Homo sapiens
cctgaggccctggctgtgctga

SEQ ID NO: 7536127 - DNA, 22 bp, Homo sapiens
cctgagcttgatccttctgtct

SEQ ID NO: 7536128 - DNA, 22 bp, Homo sapiens
cctgagcttgatccttctgtct

SEQ ID NO: 7536129 - DNA, 22 bp, Homo sapiens
cctgagcttgatccttctgtct

SEQ ID NO: 7536130 - DNA, 22 bp, Homo sapiens
cctgaggccctggctgtgctga

SEQ ID NO: 7536131 - DNA, 22 bp, Homo sapiens
cctgaggccctggctgtgctga

SEQ ID NO: 7536132 - DNA, 22 bp, Homo sapiens
cctgaggctctcctgaataatg

SEQ ID NO: 7536133 - DNA, 22 bp, Homo sapiens
cctgaggctcgcgcgcccctgg

SEQ ID NO: 7536134 - DNA, 22 bp, Homo sapiens
cctgaggctcgcgcgcccctgg

SEQ ID NO: 7536135 - DNA, 22 bp, Homo sapiens
cctgaggctccacctccagaga

SEQ ID NO: 7536136 - DNA, 22 bp, Homo sapiens
cctgaggctccacctccagaga

SEQ ID NO: 7536137 - DNA, 22 bp, Homo sapiens
cctgaggctcgcgcgcccctgg

SEQ ID NO: 7536138 - DNA, 22 bp, Homo sapiens
cctgaggctggcccttccatcc

SEQ ID NO: 7536139 - DNA, 22 bp, Homo sapiens
cctgaggcttaatctgtcccaa

SEQ ID NO: 7536140 - DNA, 22 bp, Homo sapiens
cctgaggcttaatctgtcccaa

SEQ ID NO: 7536141 - DNA, 22 bp, Homo sapiens
cctgaggctggcccttccatcc

SEQ ID NO: 7536142 - DNA, 22 bp, Homo sapiens
cctgaggcttaatctgtcccaa

SEQ ID NO: 7536143 - DNA, 22 bp, Homo sapiens
cctgaggcttaatctgtcccaa

SEQ ID NO: 7536144 - DNA, 22 bp, Homo sapiens
cctgaggctggcccttccatcc

SEQ ID NO: 7536145 - DNA, 22 bp, Homo sapiens
cctgaggctggcccttccatcc

SEQ ID NO: 7536146 - DNA, 22 bp, Homo sapiens
cctgaggctctcctgaataatg

SEQ ID NO: 7536147 - DNA, 22 bp, Homo sapiens
cctgaggctggcccttccatcc

SEQ ID NO: 7536148 - DNA, 22 bp, Homo sapiens
cctgaggggctgcaggccagct

SEQ ID NO: 7536149 - DNA, 22 bp, Homo sapiens
cctgaggggctgcaggccagct

SEQ ID NO: 7536150 - DNA, 22 bp, Homo sapiens
cctgaggggctgcaggccagct

SEQ ID NO: 7536151 - DNA, 22 bp, Homo sapiens
cctgaggggctgcaggccagct

SEQ ID NO: 7536152 - DNA, 22 bp, Homo sapiens
cctgaggggctgcaggccagct

SEQ ID NO: 7536153 - DNA, 22 bp, Homo sapiens
cctgaggggaagcttcccaaga

SEQ ID NO: 7536154 - DNA, 22 bp, Homo sapiens
cctgagggctcagcccccagcc

SEQ ID NO: 7536155 - DNA, 22 bp, Homo sapiens
cctgaggggaagcttcccaaga

SEQ ID NO: 7536156 - DNA, 22 bp, Homo sapiens
cctgaggggaagcttcccaaga

SEQ ID NO: 7536157 - DNA, 22 bp, Homo sapiens
cctgagggtcaaggagccctag

SEQ ID NO: 7536158 - DNA, 22 bp, Homo sapiens
cctgaggggctgcaggccagct

SEQ ID NO: 7536159 - DNA, 22 bp, Homo sapiens
cctgaggggctgcaggccagct

SEQ ID NO: 7536160 - DNA, 22 bp, Homo sapiens
cctgaggggctgcaggccagct

SEQ ID NO: 7536161 - DNA, 22 bp, Homo sapiens
cctgaggggctgcaggccagct

SEQ ID NO: 7536162 - DNA, 22 bp, Homo sapiens
cctgagggctcagcccccagcc

SEQ ID NO: 7536163 - DNA, 22 bp, Homo sapiens
cctgagggcgtaattaacagtg

SEQ ID NO: 7536164 - DNA, 22 bp, Homo sapiens
cctgagggcgtaattaacagtg

SEQ ID NO: 7536165 - DNA, 22 bp, Homo sapiens
cctgagggcgtaattaacagtg

SEQ ID NO: 7536166 - DNA, 22 bp, Homo sapiens
cctgagggctcagcccccagcc

SEQ ID NO: 7536167 - DNA, 22 bp, Homo sapiens
cctgagggctcagcccccagcc

SEQ ID NO: 7536168 - DNA, 22 bp, Homo sapiens
cctgagggcgccgagctcccag

SEQ ID NO: 7536169 - DNA, 22 bp, Homo sapiens
cctgagggcgccgagctcccag

SEQ ID NO: 7536170 - DNA, 22 bp, Homo sapiens
cctgagggatctgtggaatagc

SEQ ID NO: 7536171 - DNA, 22 bp, Homo sapiens
cctgagggatctgtggaatagc

SEQ ID NO: 7536172 - DNA, 22 bp, Homo sapiens
cctgagggcgccgagctcccag

SEQ ID NO: 7536173 - DNA, 22 bp, Homo sapiens
cctgagggcgccgagctcccag

SEQ ID NO: 7536174 - DNA, 22 bp, Homo sapiens
cctgagggcgccgagctcccag

SEQ ID NO: 7536175 - DNA, 22 bp, Homo sapiens
cctgaggcttaatctgtcccaa

SEQ ID NO: 7536176 - DNA, 22 bp, Homo sapiens
cctgaggcttaatctgtcccaa

SEQ ID NO: 7536177 - DNA, 22 bp, Homo sapiens
cctgaggcttgggagttccgcc

SEQ ID NO: 7536178 - DNA, 22 bp, Homo sapiens
cctgaggcttaatctgtcccaa

SEQ ID NO: 7536179 - DNA, 22 bp, Homo sapiens
cctgaggcttaatctgtcccaa

SEQ ID NO: 7536180 - DNA, 22 bp, Homo sapiens
cctgaggcttgggagttccgcc

SEQ ID NO: 7536181 - DNA, 22 bp, Homo sapiens
cctgagggaacatgcacccaat

SEQ ID NO: 7536182 - DNA, 22 bp, Homo sapiens
cctgagggaacatgcacccaat

SEQ ID NO: 7536183 - DNA, 22 bp, Homo sapiens
cctgagggaacatgcacccaat

SEQ ID NO: 7536184 - DNA, 22 bp, Homo sapiens
cctgagggaacatgcacccaat

SEQ ID NO: 7536185 - DNA, 22 bp, Homo sapiens
cctgagggagggtataggctgt

SEQ ID NO: 7536186 - DNA, 22 bp, Homo sapiens
cctgagggagggtataggctgt

SEQ ID NO: 7536187 - DNA, 22 bp, Homo sapiens
cctgagggagggtataggctgt

SEQ ID NO: 7536188 - DNA, 22 bp, Homo sapiens
cctgagggagggtataggctgt

SEQ ID NO: 7536189 - DNA, 22 bp, Homo sapiens
cctgagggaaggatgctaccca

SEQ ID NO: 7536190 - DNA, 22 bp, Homo sapiens
cctgagggaaggatgctaccca

SEQ ID NO: 7536191 - DNA, 22 bp, Homo sapiens
cctgacagtggtagccttggca

SEQ ID NO: 7536192 - DNA, 22 bp, Homo sapiens
cctgacagtccttttctagtgt

SEQ ID NO: 7536193 - DNA, 22 bp, Homo sapiens
cctgacaggcggaggctgcagt

SEQ ID NO: 7536194 - DNA, 22 bp, Homo sapiens
cctgacaggcggaggctgcagt

SEQ ID NO: 7536195 - DNA, 22 bp, Homo sapiens
cctgacagtccttttctagtgt

SEQ ID NO: 7536196 - DNA, 22 bp, Homo sapiens
cctgacagttaattgtcctgta

SEQ ID NO: 7536197 - DNA, 22 bp, Homo sapiens
cctgacagtggtagccttggca

SEQ ID NO: 7536198 - DNA, 22 bp, Homo sapiens
cctgacagttaattgtcctgta

SEQ ID NO: 7536199 - DNA, 19 bp, Homo sapiens
cctgaccacacaggccttg

SEQ ID NO: 7536200 - DNA, 19 bp, Homo sapiens
cctgaccacacaggccttg

SEQ ID NO: 7536201 - DNA, 23 bp, Homo sapiens
cctgacacaaaaggattcttgct

SEQ ID NO: 7536202 - DNA, 22 bp, Homo sapiens
cctgacactgccgccaccccgc

SEQ ID NO: 7536203 - DNA, 22 bp, Homo sapiens
cctgacactgccgccaccccgc

SEQ ID NO: 7536204 - DNA, 22 bp, Homo sapiens
cctgacagcgtgtccctggccc

SEQ ID NO: 7536205 - DNA, 22 bp, Homo sapiens
cctgacagcgtgtccctggccc

SEQ ID NO: 7536206 - DNA, 22 bp, Homo sapiens
cctgacaggagaagcgcagcat

SEQ ID NO: 7536207 - DNA, 22 bp, Homo sapiens
cctgacaggagaagcgcagcat

SEQ ID NO: 7536208 - DNA, 22 bp, Homo sapiens
cctgacaggagaagcgcagcat

SEQ ID NO: 7536209 - DNA, 22 bp, Homo sapiens
cctgacagcgtgtccctggccc

SEQ ID NO: 7536210 - DNA, 22 bp, Homo sapiens
cctgacaggagaagcgcagcat

SEQ ID NO: 7536211 - DNA, 22 bp, Homo sapiens
cctgacaggagaagcgcagcat

SEQ ID NO: 7536212 - DNA, 23 bp, Homo sapiens
cctgaccctgtctccctcacatg

SEQ ID NO: 7536213 - DNA, 23 bp, Homo sapiens
cctgaccctgtctccctcacatg

SEQ ID NO: 7536214 - DNA, 22 bp, Homo sapiens
cctgaccccagcacttgtccct

SEQ ID NO: 7536215 - DNA, 22 bp, Homo sapiens
cctgaccctccttagagtccag

SEQ ID NO: 7536216 - DNA, 22 bp, Homo sapiens
cctgaccctccttagagtccag

SEQ ID NO: 7536217 - DNA, 22 bp, Homo sapiens
cctgaccctccttagagtccag

SEQ ID NO: 7536218 - DNA, 22 bp, Homo sapiens
cctgacctatttttctcagctg

SEQ ID NO: 7536219 - DNA, 22 bp, Homo sapiens
cctgacctatttttctcagctg

SEQ ID NO: 7536220 - DNA, 22 bp, Homo sapiens
cctgacctatttttctcagctg

SEQ ID NO: 7536221 - DNA, 22 bp, Homo sapiens
cctgaccctttccagtgttggc

SEQ ID NO: 7536222 - DNA, 21 bp, Homo sapiens
cctgacctaatttgccatcag

SEQ ID NO: 7536223 - DNA, 21 bp, Homo sapiens
cctgacctaatttgccatcag

SEQ ID NO: 7536224 - DNA, 21 bp, Homo sapiens
cctgacctaatttgccatcag

SEQ ID NO: 7536225 - DNA, 22 bp, Homo sapiens
cctgaccatttgccacatgggt

SEQ ID NO: 7536226 - DNA, 22 bp, Homo sapiens
cctgacccaggagcaaagtcga

SEQ ID NO: 7536227 - DNA, 22 bp, Homo sapiens
cctgaccccagcacttgtccct

SEQ ID NO: 7536228 - DNA, 22 bp, Homo sapiens
cctgaccatttgccacatgggt

SEQ ID NO: 7536229 - DNA, 22 bp, Homo sapiens
cctgaccagagtgagggcttag

SEQ ID NO: 7536230 - DNA, 19 bp, Homo sapiens
cctgaccacacaggccttg

SEQ ID NO: 7536231 - DNA, 22 bp, Homo sapiens
cctgaccacccttggacaaggt

SEQ ID NO: 7536232 - DNA, 19 bp, Homo sapiens
cctgaccacacaggccttg

SEQ ID NO: 7536233 - DNA, 22 bp, Homo sapiens
cctgagacatgaaccaggctcc

SEQ ID NO: 7536234 - DNA, 22 bp, Homo sapiens
cctgagaccaagttgcagccat

SEQ ID NO: 7536235 - DNA, 22 bp, Homo sapiens
cctgagacatgaaccaggctcc

SEQ ID NO: 7536236 - DNA, 22 bp, Homo sapiens
cctgagaataattctccatagc

SEQ ID NO: 7536237 - DNA, 22 bp, Homo sapiens
cctgagaataacaaattgctgc

SEQ ID NO: 7536238 - DNA, 22 bp, Homo sapiens
cctgagaatgtttaacagagaa

SEQ ID NO: 7536239 - DNA, 22 bp, Homo sapiens
cctgagaatttgtggttcagga

SEQ ID NO: 7536240 - DNA, 22 bp, Homo sapiens
cctgagaatttgtggttcagga

SEQ ID NO: 7536241 - DNA, 22 bp, Homo sapiens
cctgagaaatagcatcattttt

SEQ ID NO: 7536242 - DNA, 22 bp, Homo sapiens
cctgagaagactgtttctttga

SEQ ID NO: 7536243 - DNA, 22 bp, Homo sapiens
cctgagaagactgtttctttga

SEQ ID NO: 7536244 - DNA, 22 bp, Homo sapiens
cctgagaagactgtttctttga

SEQ ID NO: 7536245 - DNA, 22 bp, Homo sapiens
cctgagaagagcttatgagtga

SEQ ID NO: 7536246 - DNA, 22 bp, Homo sapiens
cctgagaataacaaattgctgc

SEQ ID NO: 7536247 - DNA, 22 bp, Homo sapiens
cctgagaataattctccatagc

SEQ ID NO: 7536248 - DNA, 22 bp, Homo sapiens
cctgagaagagcttatgagtga

SEQ ID NO: 7536249 - DNA, 22 bp, Homo sapiens
cctgagaagctggacctggcag

SEQ ID NO: 7536250 - DNA, 22 bp, Homo sapiens
cctgagaagctggacctggcag

SEQ ID NO: 7536251 - DNA, 22 bp, Homo sapiens
cctgactctggccaggccagct

SEQ ID NO: 7536252 - DNA, 22 bp, Homo sapiens
cctgactctggccaggccagct

SEQ ID NO: 7536253 - DNA, 22 bp, Homo sapiens
cctgactctggccaggccagct

SEQ ID NO: 7536254 - DNA, 22 bp, Homo sapiens
cctgagaaacctggtgcaatta

SEQ ID NO: 7536255 - DNA, 22 bp, Homo sapiens
cctgacttaagtctcctgttgg

SEQ ID NO: 7536256 - DNA, 22 bp, Homo sapiens
cctgacttaagtctcctgttgg

SEQ ID NO: 7536257 - DNA, 22 bp, Homo sapiens
cctgagaaacctggtgcaatta

SEQ ID NO: 7536258 - DNA, 22 bp, Homo sapiens
cctgaccttagtttccttgtga

SEQ ID NO: 7536259 - DNA, 22 bp, Homo sapiens
cctgaccttagtttccttgtga

SEQ ID NO: 7536260 - DNA, 22 bp, Homo sapiens
cctgaccttagtttccttgtga

SEQ ID NO: 7536261 - DNA, 22 bp, Homo sapiens
cctgacctccaagtggctctgg

SEQ ID NO: 7536262 - DNA, 22 bp, Homo sapiens
cctgacctccaagtggctctgg

SEQ ID NO: 7536263 - DNA, 22 bp, Homo sapiens
cctgacctatttttctcagctg

SEQ ID NO: 7536264 - DNA, 22 bp, Homo sapiens
cctgacctatttttctcagctg

SEQ ID NO: 7536265 - DNA, 22 bp, Homo sapiens
cctgacctccaagtggctctgg

SEQ ID NO: 7536266 - DNA, 22 bp, Homo sapiens
cctgacctccaagtggctctgg

SEQ ID NO: 7536267 - DNA, 22 bp, Homo sapiens
cctgactcctgggcaaaaccaa

SEQ ID NO: 7536268 - DNA, 22 bp, Homo sapiens
cctgaccttcaagtctgttctt

SEQ ID NO: 7536269 - DNA, 22 bp, Homo sapiens
cctgactagctgggactacaga

SEQ ID NO: 7536270 - DNA, 22 bp, Homo sapiens
cctgaccttcaagtctgttctt

SEQ ID NO: 7536271 - DNA, 22 bp, Homo sapiens
cctgacgaaaggcgtgctggag

SEQ ID NO: 7536272 - DNA, 22 bp, Homo sapiens
cctgacgaaaggcgtgctggag

SEQ ID NO: 7536273 - DNA, 22 bp, Homo sapiens
cctgccagacgcaccagggggc

SEQ ID NO: 7536274 - DNA, 22 bp, Homo sapiens
cctgccagacgcaccagggggc

SEQ ID NO: 7536275 - DNA, 22 bp, Homo sapiens
cctgccagagcagcttgtcctc

SEQ ID NO: 7536276 - DNA, 22 bp, Homo sapiens
cctgccagagcagcttgtcctc

SEQ ID NO: 7536277 - DNA, 22 bp, Homo sapiens
cctgcagacacttgtccagcaa

SEQ ID NO: 7536278 - DNA, 22 bp, Homo sapiens
cctgccagacgcaccagggggc

SEQ ID NO: 7536279 - DNA, 22 bp, Homo sapiens
cctgcagaagagtccagctcat

SEQ ID NO: 7536280 - DNA, 22 bp, Homo sapiens
cctgcagaagagtccagctcat

SEQ ID NO: 7536281 - DNA, 22 bp, Homo sapiens
cctgccaggagctggtgctgca

SEQ ID NO: 7536282 - DNA, 22 bp, Homo sapiens
cctgccaggccagtgagcttcc

SEQ ID NO: 7536283 - DNA, 22 bp, Homo sapiens
cctgccaggccagtgagcttcc

SEQ ID NO: 7536284 - DNA, 22 bp, Homo sapiens
cctgccaggagctggtgctgca

SEQ ID NO: 7536285 - DNA, 22 bp, Homo sapiens
cctgccaggagctggtgctgca

SEQ ID NO: 7536286 - DNA, 22 bp, Homo sapiens
cctgccagagcagcttgtcctc

SEQ ID NO: 7536287 - DNA, 22 bp, Homo sapiens
cctgccaggagctggtgctgca

SEQ ID NO: 7536288 - DNA, 22 bp, Homo sapiens
cctgcacctaacacaacgctct

SEQ ID NO: 7536289 - DNA, 22 bp, Homo sapiens
cctgcacccaggccgcacctct

SEQ ID NO: 7536290 - DNA, 22 bp, Homo sapiens
cctgcaccaggcccagcatggt

SEQ ID NO: 7536291 - DNA, 22 bp, Homo sapiens
cctgcacctgagcagcctgact

SEQ ID NO: 7536292 - DNA, 22 bp, Homo sapiens
cctgcacctgagcagcctgact

SEQ ID NO: 7536293 - DNA, 22 bp, Homo sapiens
cctgcacctgagcagcctgact

SEQ ID NO: 7536294 - DNA, 22 bp, Homo sapiens
cctgcacccaggccgcacctct

SEQ ID NO: 7536295 - DNA, 22 bp, Homo sapiens
cctgcacttctcacagctgctg

SEQ ID NO: 7536296 - DNA, 22 bp, Homo sapiens
cctgcactacctggggctgctg

SEQ ID NO: 7536297 - DNA, 22 bp, Homo sapiens
cctgcacttctcacagctgctg

SEQ ID NO: 7536298 - DNA, 22 bp, Homo sapiens
cctgcactacctggggctgctg

SEQ ID NO: 7536299 - DNA, 22 bp, Homo sapiens
cctgcagaagagtccagctcat

SEQ ID NO: 7536300 - DNA, 22 bp, Homo sapiens
cctgcagaagagtccagctcat

SEQ ID NO: 7536301 - DNA, 22 bp, Homo sapiens
cctgcagaaagggtccccagga

SEQ ID NO: 7536302 - DNA, 22 bp, Homo sapiens
cctgatggctgtctgggcctga

SEQ ID NO: 7536303 - DNA, 22 bp, Homo sapiens
tggggtcgagggttctctggca

SEQ ID NO: 7536304 - DNA, 19 bp, Homo sapiens
cctgatggagctggtgcaa

SEQ ID NO: 7536305 - DNA, 20 bp, Homo sapiens
tggggtcctggaggggatcc

SEQ ID NO: 7536306 - DNA, 20 bp, Homo sapiens
tggggtcctggaggggatcc

SEQ ID NO: 7536307 - DNA, 17 bp, Homo sapiens
tggggtccccgatggtg

SEQ ID NO: 7536308 - DNA, 17 bp, Homo sapiens
tggggtccccgatggtg

SEQ ID NO: 7536309 - DNA, 17 bp, Homo sapiens
tggggtccccgatggtg

SEQ ID NO: 7536310 - DNA, 22 bp, Homo sapiens
tggggtcctctcacttggaggg

SEQ ID NO: 7536311 - DNA, 22 bp, Homo sapiens
tggggtcctctcacttggaggg

SEQ ID NO: 7536312 - DNA, 22 bp, Homo sapiens
cctgattctgatgcctcatgga

SEQ ID NO: 7536313 - DNA, 22 bp, Homo sapiens
cctgattctgccactactagcc

SEQ ID NO: 7536314 - DNA, 22 bp, Homo sapiens
cctgattcagtggtgcccagag

SEQ ID NO: 7536315 - DNA, 22 bp, Homo sapiens
cctgattcagtggtgcccagag

SEQ ID NO: 7536316 - DNA, 22 bp, Homo sapiens
cctgatggtatattgttgggag

SEQ ID NO: 7536317 - DNA, 22 bp, Homo sapiens
cctgattagggtctttcaaatg

SEQ ID NO: 7536318 - DNA, 22 bp, Homo sapiens
cctgattattgtaaatatattt

SEQ ID NO: 7536319 - DNA, 22 bp, Homo sapiens
cctgattattgtaaatatattt

SEQ ID NO: 7536320 - DNA, 22 bp, Homo sapiens
cctgattagggtctttcaaatg

SEQ ID NO: 7536321 - DNA, 22 bp, Homo sapiens
cctgatggctgtctgggcctga

SEQ ID NO: 7536322 - DNA, 22 bp, Homo sapiens
cctgatggctgtctgggcctga

SEQ ID NO: 7536323 - DNA, 22 bp, Homo sapiens
cctgatggctgtctgggcctga

SEQ ID NO: 7536324 - DNA, 22 bp, Homo sapiens
cctgatggtatattgttgggag

SEQ ID NO: 7536325 - DNA, 22 bp, Homo sapiens
cctgcacaggccaggcatctga

SEQ ID NO: 7536326 - DNA, 22 bp, Homo sapiens
cctgcacagccggacccctgct

SEQ ID NO: 7536327 - DNA, 22 bp, Homo sapiens
cctgcacaggccaggcatctga

SEQ ID NO: 7536328 - DNA, 22 bp, Homo sapiens
cctgcacagttctttttgccaa

SEQ ID NO: 7536329 - DNA, 22 bp, Homo sapiens
cctgcaccacactcactgctca

SEQ ID NO: 7536330 - DNA, 22 bp, Homo sapiens
cctgcaccacactcactgctca

SEQ ID NO: 7536331 - DNA, 22 bp, Homo sapiens
cctgcaccaggcccagcatggt

SEQ ID NO: 7536332 - DNA, 22 bp, Homo sapiens
cctgcacagccggacccctgct

SEQ ID NO: 7536333 - DNA, 22 bp, Homo sapiens
cctgcaagagcggagaagccag

SEQ ID NO: 7536334 - DNA, 22 bp, Homo sapiens
cctgattgtctcttgcagcact

SEQ ID NO: 7536335 - DNA, 23 bp, Homo sapiens
cctgcaaagaaacaagccacctg

SEQ ID NO: 7536336 - DNA, 22 bp, Homo sapiens
cctgcaagacctgagacacacc

SEQ ID NO: 7536337 - DNA, 22 bp, Homo sapiens
tgggggtgtcctggtgcacaca

SEQ ID NO: 7536338 - DNA, 22 bp, Homo sapiens
tgggggtgtcctggtgcacaca

SEQ ID NO: 7536339 - DNA, 22 bp, Homo sapiens
tgggggtgtcctggtgcacaca

SEQ ID NO: 7536340 - DNA, 22 bp, Homo sapiens
tgggggtgtcctggtgcacaca

SEQ ID NO: 7536341 - DNA, 22 bp, Homo sapiens
tgggggtgtcctggtgcacaca

SEQ ID NO: 7536342 - DNA, 22 bp, Homo sapiens
tgggggtgtcctggtgcacaca

SEQ ID NO: 7536343 - DNA, 22 bp, Homo sapiens
tgggggtggttcttgcctccag

SEQ ID NO: 7536344 - DNA, 22 bp, Homo sapiens
tgggggtggttcttgcctccag

SEQ ID NO: 7536345 - DNA, 22 bp, Homo sapiens
tgggggtggttcttgcctccag

SEQ ID NO: 7536346 - DNA, 22 bp, Homo sapiens
tgggggtgtcctggtgcacaca

SEQ ID NO: 7536347 - DNA, 22 bp, Homo sapiens
tgggggagagaggcattctttc

SEQ ID NO: 7536348 - DNA, 22 bp, Homo sapiens
tgggggtggttcttgcctccag

SEQ ID NO: 7536349 - DNA, 22 bp, Homo sapiens
cctgaggtcatggtccagtgtt

SEQ ID NO: 7536350 - DNA, 22 bp, Homo sapiens
cctgaggtcatggtccagtgtt

SEQ ID NO: 7536351 - DNA, 22 bp, Homo sapiens
cctgaggtcatggtccagtgtt

SEQ ID NO: 7536352 - DNA, 21 bp, Homo sapiens
tgggggagaattggttgcttt

SEQ ID NO: 7536353 - DNA, 22 bp, Homo sapiens
tgggggagagaggcattctttc

SEQ ID NO: 7536354 - DNA, 22 bp, Homo sapiens
tgggggagagaggcattctttc

SEQ ID NO: 7536355 - DNA, 21 bp, Homo sapiens
cctgagggtggttgtgaagat

SEQ ID NO: 7536356 - DNA, 22 bp, Homo sapiens
cctgagggtcaaggagccctag

SEQ ID NO: 7536357 - DNA, 22 bp, Homo sapiens
cctgagggtcaaggagccctag

SEQ ID NO: 7536358 - DNA, 22 bp, Homo sapiens
cctgagggtcaaggagccctag

SEQ ID NO: 7536359 - DNA, 21 bp, Homo sapiens
cctgagggtggttgtgaagat

SEQ ID NO: 7536360 - DNA, 21 bp, Homo sapiens
cctgagggtggttgtgaagat

SEQ ID NO: 7536361 - DNA, 21 bp, Homo sapiens
cctgagggtggttgtgaagat

SEQ ID NO: 7536362 - DNA, 21 bp, Homo sapiens
cctgagggtggttgtgaagat

SEQ ID NO: 7536363 - DNA, 22 bp, Homo sapiens
cctgaggtcacaacttgcttat

SEQ ID NO: 7536364 - DNA, 22 bp, Homo sapiens
cctgaggtcacaacttgcttat

SEQ ID NO: 7536365 - DNA, 21 bp, Homo sapiens
cctgagggtggttgtgaagat

SEQ ID NO: 7536366 - DNA, 21 bp, Homo sapiens
cctgagggtggttgtgaagat

SEQ ID NO: 7536367 - DNA, 21 bp, Homo sapiens
cctgagggtggttgtgaagat

SEQ ID NO: 7536368 - DNA, 21 bp, Homo sapiens
cctgagggtggttgtgaagat

SEQ ID NO: 7536369 - DNA, 22 bp, Homo sapiens
cctgaggtcatgcatttccaac

SEQ ID NO: 7536370 - DNA, 22 bp, Homo sapiens
cctgaggtcatggtccagtgtt

SEQ ID NO: 7536371 - DNA, 22 bp, Homo sapiens
cctgaggtcatggtccagtgtt

SEQ ID NO: 7536372 - DNA, 22 bp, Homo sapiens
cctgaggtcatgcatttccaac

SEQ ID NO: 7536373 - DNA, 22 bp, Homo sapiens
cctgaggtcagcggttcccaca

SEQ ID NO: 7536374 - DNA, 22 bp, Homo sapiens
cctgaggtcagcggttcccaca

SEQ ID NO: 7536375 - DNA, 22 bp, Homo sapiens
cctgaggtcacaacttgcttat

SEQ ID NO: 7536376 - DNA, 22 bp, Homo sapiens
cctgaggtcagccattcttgcc

SEQ ID NO: 7536377 - DNA, 22 bp, Homo sapiens
cctgaggtcagccattcttgcc

SEQ ID NO: 7536378 - DNA, 22 bp, Homo sapiens
cctgaggtcagccattcttgcc

SEQ ID NO: 7536379 - DNA, 20 bp, Homo sapiens
cctgagggtttgtgttcttt

SEQ ID NO: 7536380 - DNA, 22 bp, Homo sapiens
tgggggtgtgccagggacctcc

SEQ ID NO: 7536381 - DNA, 22 bp, Homo sapiens
tgggggtgtgccagggacctcc

SEQ ID NO: 7536382 - DNA, 22 bp, Homo sapiens
tgggggtgtgccagggacctcc

SEQ ID NO: 7536383 - DNA, 22 bp, Homo sapiens
tgggggtgtgccagggacctcc

SEQ ID NO: 7536384 - DNA, 22 bp, Homo sapiens
tgggggtgtgccagggacctcc

SEQ ID NO: 7536385 - DNA, 22 bp, Homo sapiens
tgggggtgtgccagggacctcc

SEQ ID NO: 7536386 - DNA, 22 bp, Homo sapiens
tgggggtgtcctggtgcacaca

SEQ ID NO: 7536387 - DNA, 22 bp, Homo sapiens
tgggggtgtcctggtgcacaca

SEQ ID NO: 7536388 - DNA, 22 bp, Homo sapiens
tggggtaaggacagccagtagg

SEQ ID NO: 7536389 - DNA, 22 bp, Homo sapiens
tggggtacttgtatcaaagcac

SEQ ID NO: 7536390 - DNA, 22 bp, Homo sapiens
tggggtacttgtatcaaagcac

SEQ ID NO: 7536391 - DNA, 22 bp, Homo sapiens
tggggtaggagtcagcgagaga

SEQ ID NO: 7536392 - DNA, 22 bp, Homo sapiens
tggggtaggagtcagcgagaga

SEQ ID NO: 7536393 - DNA, 22 bp, Homo sapiens
tggggtaggagtcagcgagaga

SEQ ID NO: 7536394 - DNA, 22 bp, Homo sapiens
tggggtaggagtcagcgagaga

SEQ ID NO: 7536395 - DNA, 22 bp, Homo sapiens
tggggtcccactcagctcccct

SEQ ID NO: 7536396 - DNA, 22 bp, Homo sapiens
tggggtccagtgcctggcaagg

SEQ ID NO: 7536397 - DNA, 22 bp, Homo sapiens
tggggtccagtgccaccccaag

SEQ ID NO: 7536398 - DNA, 19 bp, Homo sapiens
tggggtcaagagaggcttc

SEQ ID NO: 7536399 - DNA, 19 bp, Homo sapiens
tggggtcaagagaggcttc

SEQ ID NO: 7536400 - DNA, 19 bp, Homo sapiens
tggggtcaagagaggcttc

SEQ ID NO: 7536401 - DNA, 22 bp, Homo sapiens
tggggtaggtatgaaaactagg

SEQ ID NO: 7536402 - DNA, 22 bp, Homo sapiens
tggggtagggaaaagaagtcga

SEQ ID NO: 7536403 - DNA, 22 bp, Homo sapiens
tggggtaggtatgaaaactagg

SEQ ID NO: 7536404 - DNA, 22 bp, Homo sapiens
tggggtaggtatgaaaactagg

SEQ ID NO: 7536405 - DNA, 22 bp, Homo sapiens
tggggtagggaaaagaagtcga

SEQ ID NO: 7536406 - DNA, 22 bp, Homo sapiens
tggggtaggagtcagcgagaga

SEQ ID NO: 7536407 - DNA, 22 bp, Homo sapiens
tggggtagggaaaagaagtcga

SEQ ID NO: 7536408 - DNA, 22 bp, Homo sapiens
tggggtagggaaaagaagtcga

SEQ ID NO: 7536409 - DNA, 22 bp, Homo sapiens
cctgaataggctctgctcaaaa

SEQ ID NO: 7536410 - DNA, 22 bp, Homo sapiens
cctgaagggactccagagagca

SEQ ID NO: 7536411 - DNA, 23 bp, Homo sapiens
cctgaagggtcagggtcctcagc

SEQ ID NO: 7536412 - DNA, 23 bp, Homo sapiens
cctgaagggtcagggtcctcagc

SEQ ID NO: 7536413 - DNA, 23 bp, Homo sapiens
cctgaagggtcagggtcctcagc

SEQ ID NO: 7536414 - DNA, 22 bp, Homo sapiens
cctgaatactggtgctgaaagt

SEQ ID NO: 7536415 - DNA, 22 bp, Homo sapiens
cctgaataatttgtgaaaagat

SEQ ID NO: 7536416 - DNA, 22 bp, Homo sapiens
cctgaagctcttaagaccttta

SEQ ID NO: 7536417 - DNA, 22 bp, Homo sapiens
cctgaaggaaactggaaataca

SEQ ID NO: 7536418 - DNA, 22 bp, Homo sapiens
cctgaaggaaactggaaataca

SEQ ID NO: 7536419 - DNA, 17 bp, Homo sapiens
cctgaaggcacttccag

SEQ ID NO: 7536420 - DNA, 17 bp, Homo sapiens
cctgaaggcacttccag

SEQ ID NO: 7536421 - DNA, 17 bp, Homo sapiens
cctgaaggcacttccag

SEQ ID NO: 7536422 - DNA, 22 bp, Homo sapiens
cctgaagggactccagagagca

SEQ ID NO: 7536423 - DNA, 22 bp, Homo sapiens
cctgaaggaaactggaaataca

SEQ ID NO: 7536424 - DNA, 22 bp, Homo sapiens
cctgaagggactccagagagca

SEQ ID NO: 7536425 - DNA, 22 bp, Homo sapiens
cctgaagggactccagagagca

SEQ ID NO: 7536426 - DNA, 22 bp, Homo sapiens
cctgaagggactccagagagca

SEQ ID NO: 7536427 - DNA, 22 bp, Homo sapiens
cctgaagggactccagagagca

SEQ ID NO: 7536428 - DNA, 22 bp, Homo sapiens
cctgaaaatcaaggtagtttgg

SEQ ID NO: 7536429 - DNA, 22 bp, Homo sapiens
cctgaaaatcaaggtagtttgg

SEQ ID NO: 7536430 - DNA, 22 bp, Homo sapiens
cctgaagcacaaaagcacagct

SEQ ID NO: 7536431 - DNA, 18 bp, Homo sapiens
cctgaagcctgtgtcttt

SEQ ID NO: 7536432 - DNA, 22 bp, Homo sapiens
cctctttgttcaggctgctggc

SEQ ID NO: 7536433 - DNA, 22 bp, Homo sapiens
cctctttgtgcctgcaggctgc

SEQ ID NO: 7536434 - DNA, 22 bp, Homo sapiens
cctctttgtgcctgcaggctgc

SEQ ID NO: 7536435 - DNA, 22 bp, Homo sapiens
cctgaaaatatcctctcctttg

SEQ ID NO: 7536436 - DNA, 22 bp, Homo sapiens
cctctttgttcaggctgctggc

SEQ ID NO: 7536437 - DNA, 22 bp, Homo sapiens
cctctttgttcaggctgctggc

SEQ ID NO: 7536438 - DNA, 22 bp, Homo sapiens
cctctttgactctcaggtcttt

SEQ ID NO: 7536439 - DNA, 22 bp, Homo sapiens
cctctttgactctcaggtcttt

SEQ ID NO: 7536440 - DNA, 22 bp, Homo sapiens
cctctttgagattcagttttcc

SEQ ID NO: 7536441 - DNA, 22 bp, Homo sapiens
cctctttgtgcctgcaggctgc

SEQ ID NO: 7536442 - DNA, 22 bp, Homo sapiens
cctcttgccaatcagctacaga

SEQ ID NO: 7536443 - DNA, 21 bp, Homo sapiens
cctcttgatttttagctctgg

SEQ ID NO: 7536444 - DNA, 21 bp, Homo sapiens
cctcttgatttttagctctgg

SEQ ID NO: 7536445 - DNA, 22 bp, Homo sapiens
cctcttgatttggctgtgaagt

SEQ ID NO: 7536446 - DNA, 22 bp, Homo sapiens
cctcttgatttggctgtgaagt

SEQ ID NO: 7536447 - DNA, 22 bp, Homo sapiens
cctcttgatttggctgtgaagt

SEQ ID NO: 7536448 - DNA, 22 bp, Homo sapiens
cctcttgattggttggaagcgg

SEQ ID NO: 7536449 - DNA, 22 bp, Homo sapiens
cctcttgattggttggaagcgg

SEQ ID NO: 7536450 - DNA, 22 bp, Homo sapiens
cctcttgagaggcactcaggtt

SEQ ID NO: 7536451 - DNA, 22 bp, Homo sapiens
cctcttctgcttcaggagcact

SEQ ID NO: 7536452 - DNA, 22 bp, Homo sapiens
cctcttgattggttggaagcgg

SEQ ID NO: 7536453 - DNA, 22 bp, Homo sapiens
cctcttgagtgtctgttttcca

SEQ ID NO: 7536454 - DNA, 22 bp, Homo sapiens
cctcttgagtgtctgttttcca

SEQ ID NO: 7536455 - DNA, 22 bp, Homo sapiens
cctcttgagttctttaaaagct

SEQ ID NO: 7536456 - DNA, 22 bp, Homo sapiens
cctcttgagttctttaaaagct

SEQ ID NO: 7536457 - DNA, 22 bp, Homo sapiens
cctctttaatcccatccatgtg

SEQ ID NO: 7536458 - DNA, 22 bp, Homo sapiens
cctcttgccaatcagctacaga

SEQ ID NO: 7536459 - DNA, 20 bp, Homo sapiens
cctcttgcaaaagagatgac

SEQ ID NO: 7536460 - DNA, 20 bp, Homo sapiens
cctcttgcaaaagagatgac

SEQ ID NO: 7536461 - DNA, 22 bp, Homo sapiens
cctctttgacaagtacctgccc

SEQ ID NO: 7536462 - DNA, 22 bp, Homo sapiens
cctctttgacaagtacctgccc

SEQ ID NO: 7536463 - DNA, 22 bp, Homo sapiens
cctctttgacaagtacctgccc

SEQ ID NO: 7536464 - DNA, 22 bp, Homo sapiens
cctctttgactctcaggtcttt

SEQ ID NO: 7536465 - DNA, 22 bp, Homo sapiens
cctctttgactctcaggtcttt

SEQ ID NO: 7536466 - DNA, 22 bp, Homo sapiens
cctctttgactatagtagttaa

SEQ ID NO: 7536467 - DNA, 22 bp, Homo sapiens
tgggccagcaattgctgctcag

SEQ ID NO: 7536468 - DNA, 22 bp, Homo sapiens
cctcttctgagtgagactccct

SEQ ID NO: 7536469 - DNA, 22 bp, Homo sapiens
cctcttctgagtgagactccct

SEQ ID NO: 7536470 - DNA, 22 bp, Homo sapiens
cctcttctgcttcaggagcact

SEQ ID NO: 7536471 - DNA, 22 bp, Homo sapiens
cctcttctgcttcaggagcact

SEQ ID NO: 7536472 - DNA, 22 bp, Homo sapiens
cctcttctgcttcaggagcact

SEQ ID NO: 7536473 - DNA, 22 bp, Homo sapiens
cctcttgagaggcactcaggtt

SEQ ID NO: 7536474 - DNA, 22 bp, Homo sapiens
cctcttgaggccgggccggatc

SEQ ID NO: 7536475 - DNA, 22 bp, Homo sapiens
cctcttgaggccgggccggatc

SEQ ID NO: 7536476 - DNA, 22 bp, Homo sapiens
cctcttgacagcctctgtttcc

SEQ ID NO: 7536477 - DNA, 22 bp, Homo sapiens
cctcttgacagcctctgtttcc

SEQ ID NO: 7536478 - DNA, 22 bp, Homo sapiens
cctcttgactctaaatcccgcg

SEQ ID NO: 7536479 - DNA, 22 bp, Homo sapiens
cctcttgactctaaatcccgcg

SEQ ID NO: 7536480 - DNA, 22 bp, Homo sapiens
cctcttgaacctaggcaagact

SEQ ID NO: 7536481 - DNA, 22 bp, Homo sapiens
cctcttgaacctaggcaagact

SEQ ID NO: 7536482 - DNA, 22 bp, Homo sapiens
cctcttgaagagaagagttact

SEQ ID NO: 7536483 - DNA, 22 bp, Homo sapiens
cctcttgaagagaagagttact

SEQ ID NO: 7536484 - DNA, 22 bp, Homo sapiens
cctcttgaatgccaggaaggac

SEQ ID NO: 7536485 - DNA, 22 bp, Homo sapiens
cctcttgaatgccaggaaggac

SEQ ID NO: 7536486 - DNA, 22 bp, Homo sapiens
cctctggctcacagcaccaact

SEQ ID NO: 7536487 - DNA, 22 bp, Homo sapiens
tgggcagggagctggaaccaca

SEQ ID NO: 7536488 - DNA, 22 bp, Homo sapiens
tgggcagggagctggaaccaca

SEQ ID NO: 7536489 - DNA, 22 bp, Homo sapiens
cctctggctcacagcaccaact

SEQ ID NO: 7536490 - DNA, 22 bp, Homo sapiens
cctctggctcacagcaccaact

SEQ ID NO: 7536491 - DNA, 22 bp, Homo sapiens
tgggccacgtgacccttaccct

SEQ ID NO: 7536492 - DNA, 22 bp, Homo sapiens
tgggccactaccttctctggat

SEQ ID NO: 7536493 - DNA, 22 bp, Homo sapiens
tgggccacgtgacccttaccct

SEQ ID NO: 7536494 - DNA, 22 bp, Homo sapiens
tgggccacttgaaagtggatgt

SEQ ID NO: 7536495 - DNA, 22 bp, Homo sapiens
tgggccactgctgcggaaggcg

SEQ ID NO: 7536496 - DNA, 22 bp, Homo sapiens
tgggccactgctgcggaaggcg

SEQ ID NO: 7536497 - DNA, 22 bp, Homo sapiens
tgggccactgctgcggaaggcg

SEQ ID NO: 7536498 - DNA, 22 bp, Homo sapiens
tgggccactgctccaagtagct

SEQ ID NO: 7536499 - DNA, 22 bp, Homo sapiens
tgggccactgctccaagtagct

SEQ ID NO: 7536500 - DNA, 22 bp, Homo sapiens
tgggccactgctccaagtagct

SEQ ID NO: 7536501 - DNA, 22 bp, Homo sapiens
tgggccactcttccctgggtct

SEQ ID NO: 7536502 - DNA, 23 bp, Homo sapiens
tgggccactatagaaatctctca

SEQ ID NO: 7536503 - DNA, 22 bp, Homo sapiens
tgggccactgagggtggtcatt

SEQ ID NO: 7536504 - DNA, 22 bp, Homo sapiens
tgggccactgagggtggtcatt

SEQ ID NO: 7536505 - DNA, 22 bp, Homo sapiens
tgggccactcttccctgggtct

SEQ ID NO: 7536506 - DNA, 23 bp, Homo sapiens
tgggccactatagaaatctctca

SEQ ID NO: 7536507 - DNA, 22 bp, Homo sapiens
tgggccactcttccctgggtct

SEQ ID NO: 7536508 - DNA, 22 bp, Homo sapiens
cctctggcctaggccgggagag

SEQ ID NO: 7536509 - DNA, 22 bp, Homo sapiens
cctctggcctaggccgggagag

SEQ ID NO: 7536510 - DNA, 22 bp, Homo sapiens
cctctggcctaggccgggagag

SEQ ID NO: 7536511 - DNA, 22 bp, Homo sapiens
cctctggcctaggccgggagag

SEQ ID NO: 7536512 - DNA, 22 bp, Homo sapiens
cctctggcctaggccgggagag

SEQ ID NO: 7536513 - DNA, 22 bp, Homo sapiens
cctctggccattctttgatgga

SEQ ID NO: 7536514 - DNA, 22 bp, Homo sapiens
cctctggccattctttgatgga

SEQ ID NO: 7536515 - DNA, 22 bp, Homo sapiens
cctctggccatcccccattaag

SEQ ID NO: 7536516 - DNA, 22 bp, Homo sapiens
cctctggccatcccccattaag

SEQ ID NO: 7536517 - DNA, 22 bp, Homo sapiens
cctctggccagagaaaggccag

SEQ ID NO: 7536518 - DNA, 22 bp, Homo sapiens
cctctggccacatgggacatag

SEQ ID NO: 7536519 - DNA, 22 bp, Homo sapiens
cctctggccacatgggacatag

SEQ ID NO: 7536520 - DNA, 22 bp, Homo sapiens
cctctggccagagaaaggccag

SEQ ID NO: 7536521 - DNA, 22 bp, Homo sapiens
cctctggccagagaaaggccag

SEQ ID NO: 7536522 - DNA, 22 bp, Homo sapiens
tgggccagaggcatggagctat

SEQ ID NO: 7536523 - DNA, 22 bp, Homo sapiens
tgggccagaggcatggagctat

SEQ ID NO: 7536524 - DNA, 22 bp, Homo sapiens
tgggccagagagtaagaaaggt

SEQ ID NO: 7536525 - DNA, 22 bp, Homo sapiens
tgggccagagagtaagaaaggt

SEQ ID NO: 7536526 - DNA, 22 bp, Homo sapiens
tgggccagagagtaagaaaggt

SEQ ID NO: 7536527 - DNA, 22 bp, Homo sapiens
tgggccagagagtaagaaaggt

SEQ ID NO: 7536528 - DNA, 22 bp, Homo sapiens
tgggccagaagtatgcatgttt

SEQ ID NO: 7536529 - DNA, 22 bp, Homo sapiens
tgggccacttgaaagtggatgt

SEQ ID NO: 7536530 - DNA, 22 bp, Homo sapiens
tgggccagaagtatgcatgttt

SEQ ID NO: 7536531 - DNA, 22 bp, Homo sapiens
tgggccagaagtatgcatgttt

SEQ ID NO: 7536532 - DNA, 22 bp, Homo sapiens
tgggccacttgaaagtggatgt

SEQ ID NO: 7536533 - DNA, 22 bp, Homo sapiens
tgggccagaagtatgcatgttt

SEQ ID NO: 7536534 - DNA, 22 bp, Homo sapiens
tgggccagaagtatgcatgttt

SEQ ID NO: 7536535 - DNA, 22 bp, Homo sapiens
tgggccagcaattgctgctcag

SEQ ID NO: 7536536 - DNA, 21 bp, Homo sapiens
tgggccagatctgagtttcta

SEQ ID NO: 7536537 - DNA, 22 bp, Homo sapiens
tgggccagcaattgctgctcag

SEQ ID NO: 7536538 - DNA, 22 bp, Homo sapiens
tgggccagcaattgctgctcag

SEQ ID NO: 7536539 - DNA, 22 bp, Homo sapiens
tgggccagcaattgctgctcag

SEQ ID NO: 7536540 - DNA, 21 bp, Homo sapiens
tgggccagatctgagtttcta

SEQ ID NO: 7536541 - DNA, 21 bp, Homo sapiens
tgggccagatctgagtttcta

SEQ ID NO: 7536542 - DNA, 22 bp, Homo sapiens
tgggccagatccatggcaataa

SEQ ID NO: 7536543 - DNA, 22 bp, Homo sapiens
tgggccagatccatggcaataa

SEQ ID NO: 7536544 - DNA, 22 bp, Homo sapiens
tgggccagatccatggcaataa

SEQ ID NO: 7536545 - DNA, 22 bp, Homo sapiens
tgggccagatccatggcaataa

SEQ ID NO: 7536546 - DNA, 22 bp, Homo sapiens
tgggccagatccatggcaataa

SEQ ID NO: 7536547 - DNA, 22 bp, Homo sapiens
tgggccagatccatggcaataa

SEQ ID NO: 7536548 - DNA, 22 bp, Homo sapiens
tgggccagaggcatggagctat

SEQ ID NO: 7536549 - DNA, 22 bp, Homo sapiens
tgggccagaggcatggagctat

SEQ ID NO: 7536550 - DNA, 22 bp, Homo sapiens
tgggagcaggctgatgataggt

SEQ ID NO: 7536551 - DNA, 22 bp, Homo sapiens
tgggagcaggctgatgataggt

SEQ ID NO: 7536552 - DNA, 22 bp, Homo sapiens
tgggagcaggaagcaggaagta

SEQ ID NO: 7536553 - DNA, 22 bp, Homo sapiens
tgggagcaggctgatgataggt

SEQ ID NO: 7536554 - DNA, 22 bp, Homo sapiens
tgggagcaggaagcaggaagta

SEQ ID NO: 7536555 - DNA, 22 bp, Homo sapiens
tgggagcaggaagcaggaagta

SEQ ID NO: 7536556 - DNA, 22 bp, Homo sapiens
tgggagcaggtgtgctagggaa

SEQ ID NO: 7536557 - DNA, 22 bp, Homo sapiens
tgggagcaggtgtgctagggaa

SEQ ID NO: 7536558 - DNA, 22 bp, Homo sapiens
tgggagcaggtgtgctagggaa

SEQ ID NO: 7536559 - DNA, 22 bp, Homo sapiens
tgggagcaggtgtgctagggaa

SEQ ID NO: 7536560 - DNA, 22 bp, Homo sapiens
tggctctgaccaggtagaggag

SEQ ID NO: 7536561 - DNA, 22 bp, Homo sapiens
tggctctgaccaggtagaggag

SEQ ID NO: 7536562 - DNA, 21 bp, Homo sapiens
tgggagagcgttgctgtcctc

SEQ ID NO: 7536563 - DNA, 21 bp, Homo sapiens
tgggagagcgttgctgtcctc

SEQ ID NO: 7536564 - DNA, 21 bp, Homo sapiens
tgggagagcgttgctgtcctc

SEQ ID NO: 7536565 - DNA, 21 bp, Homo sapiens
tgggagagcgttgctgtcctc

SEQ ID NO: 7536566 - DNA, 21 bp, Homo sapiens
tgggagagcgttgctgtcctc

SEQ ID NO: 7536567 - DNA, 21 bp, Homo sapiens
tggctctgaaagagtgctgca

SEQ ID NO: 7536568 - DNA, 22 bp, Homo sapiens
tggctctgaccaggtagaggag

SEQ ID NO: 7536569 - DNA, 22 bp, Homo sapiens
tggctctgaccaggtagaggag

SEQ ID NO: 7536570 - DNA, 21 bp, Homo sapiens
tggctctgaaagagtgctgca

SEQ ID NO: 7536571 - DNA, 21 bp, Homo sapiens
tggctctgaaagagtgctgca

SEQ ID NO: 7536572 - DNA, 21 bp, Homo sapiens
tggctctgaaagagtgctgca

SEQ ID NO: 7536573 - DNA, 21 bp, Homo sapiens
tggctctgaaagagtgctgca

SEQ ID NO: 7536574 - DNA, 21 bp, Homo sapiens
tggctctgaaagagtgctgca

SEQ ID NO: 7536575 - DNA, 21 bp, Homo sapiens
tggctctgaaagagtgctgca

SEQ ID NO: 7536576 - DNA, 21 bp, Homo sapiens
tggctctgaaagagtgctgca

SEQ ID NO: 7536577 - DNA, 21 bp, Homo sapiens
tggctctgaaagagtgctgca

SEQ ID NO: 7536578 - DNA, 21 bp, Homo sapiens
tggctctgaaagagtgctgca

SEQ ID NO: 7536579 - DNA, 21 bp, Homo sapiens
tggctctgaaagagtgctgca

SEQ ID NO: 7536580 - DNA, 21 bp, Homo sapiens
tggctctgaaagagtgctgca

SEQ ID NO: 7536581 - DNA, 22 bp, Homo sapiens
tggctctcttgtaaggtagtag

SEQ ID NO: 7536582 - DNA, 22 bp, Homo sapiens
tggctctcttgtaaggtagtag

SEQ ID NO: 7536583 - DNA, 22 bp, Homo sapiens
tggctctctgggaggtcctggc

SEQ ID NO: 7536584 - DNA, 22 bp, Homo sapiens
tggctctctgggaggtcctggc

SEQ ID NO: 7536585 - DNA, 22 bp, Homo sapiens
tggctctctgggaggtcctggc

SEQ ID NO: 7536586 - DNA, 20 bp, Homo sapiens
tggctctctctagtaagtgg

SEQ ID NO: 7536587 - DNA, 20 bp, Homo sapiens
tggctctctctagtaagtgg

SEQ ID NO: 7536588 - DNA, 22 bp, Homo sapiens
tggctctcaggcctgctgcgtt

SEQ ID NO: 7536589 - DNA, 22 bp, Homo sapiens
tggctctcagctcccagcagcc

SEQ ID NO: 7536590 - DNA, 22 bp, Homo sapiens
tggctctcaggcctgctgcgtt

SEQ ID NO: 7536591 - DNA, 22 bp, Homo sapiens
tggctctccagagcctatggta

SEQ ID NO: 7536592 - DNA, 22 bp, Homo sapiens
tggctctccagctctaaggcct

SEQ ID NO: 7536593 - DNA, 22 bp, Homo sapiens
tggctctccagctctaaggcct

SEQ ID NO: 7536594 - DNA, 22 bp, Homo sapiens
tggctctccagctctaaggcct

SEQ ID NO: 7536595 - DNA, 23 bp, Homo sapiens
tggctctctcagtgctgcagagg

SEQ ID NO: 7536596 - DNA, 20 bp, Homo sapiens
tggctctctctagtaagtgg

SEQ ID NO: 7536597 - DNA, 22 bp, Homo sapiens
tggctctcccaatacctttctg

SEQ ID NO: 7536598 - DNA, 22 bp, Homo sapiens
tggctctctacaggtcaagacc

SEQ ID NO: 7536599 - DNA, 22 bp, Homo sapiens
tggctctcccaatacctttctg

SEQ ID NO: 7536600 - DNA, 22 bp, Homo sapiens
tggctctctacaggtcaagacc

SEQ ID NO: 7536601 - DNA, 22 bp, Homo sapiens
cctccctgctcctcaactggca

SEQ ID NO: 7536602 - DNA, 22 bp, Homo sapiens
cctccctgctcctcaactggca

SEQ ID NO: 7536603 - DNA, 22 bp, Homo sapiens
cctccctgctcctcaactggca

SEQ ID NO: 7536604 - DNA, 22 bp, Homo sapiens
cctccctgctcctcaactggca

SEQ ID NO: 7536605 - DNA, 22 bp, Homo sapiens
cctccctgcgctcctgcggcgg

SEQ ID NO: 7536606 - DNA, 22 bp, Homo sapiens
tggctctcagctcccagcagcc

SEQ ID NO: 7536607 - DNA, 22 bp, Homo sapiens
tggctctcagctcccagcagcc

SEQ ID NO: 7536608 - DNA, 22 bp, Homo sapiens
cctccctgctcctcaactggca

SEQ ID NO: 7536609 - DNA, 22 bp, Homo sapiens
tggctctcagctcccagcagcc

SEQ ID NO: 7536610 - DNA, 22 bp, Homo sapiens
cctccctgcgctcctgcggcgg

SEQ ID NO: 7536611 - DNA, 22 bp, Homo sapiens
cctccctctttcagtcccacag

SEQ ID NO: 7536612 - DNA, 22 bp, Homo sapiens
cctccctgccggctggactagt

SEQ ID NO: 7536613 - DNA, 22 bp, Homo sapiens
cctccctgccggctggactagt

SEQ ID NO: 7536614 - DNA, 22 bp, Homo sapiens
cctccctctttcagtcccacag

SEQ ID NO: 7536615 - DNA, 22 bp, Homo sapiens
cctccctgcgctcctgcggcgg

SEQ ID NO: 7536616 - DNA, 22 bp, Homo sapiens
cctccctgcgctcctgcggcgg

SEQ ID NO: 7536617 - DNA, 22 bp, Homo sapiens
cctccctgcgctcctgcggcgg

SEQ ID NO: 7536618 - DNA, 22 bp, Homo sapiens
cctccctgcgctcctgcggcgg

SEQ ID NO: 7536619 - DNA, 22 bp, Homo sapiens
cctctggcaacttcacagccca

SEQ ID NO: 7536620 - DNA, 22 bp, Homo sapiens
cctctggcaacttcacagccca

SEQ ID NO: 7536621 - DNA, 22 bp, Homo sapiens
cctctggcaacttcacagccca

SEQ ID NO: 7536622 - DNA, 22 bp, Homo sapiens
cctctggcaacttcacagccca

SEQ ID NO: 7536623 - DNA, 22 bp, Homo sapiens
cctctggcaacttcacagccca

SEQ ID NO: 7536624 - DNA, 22 bp, Homo sapiens
cctctggcaacttcacagccca

SEQ ID NO: 7536625 - DNA, 22 bp, Homo sapiens
cctctggatctttctccacact

SEQ ID NO: 7536626 - DNA, 22 bp, Homo sapiens
cctctggatctttctccacact

SEQ ID NO: 7536627 - DNA, 22 bp, Homo sapiens
tgggagctcctggagggcagga

SEQ ID NO: 7536628 - DNA, 22 bp, Homo sapiens
tgggagctcctggagggcagga

SEQ ID NO: 7536629 - DNA, 22 bp, Homo sapiens
cctctggagtcagaccagcttg

SEQ ID NO: 7536630 - DNA, 22 bp, Homo sapiens
cctctggcaacttcacagccca

SEQ ID NO: 7536631 - DNA, 22 bp, Homo sapiens
cctctggatctttctccacact

SEQ ID NO: 7536632 - DNA, 22 bp, Homo sapiens
cctctggatctttctccacact

SEQ ID NO: 7536633 - DNA, 22 bp, Homo sapiens
tgggagctcagaaagggaggtc

SEQ ID NO: 7536634 - DNA, 22 bp, Homo sapiens
tgggagctcagaaagggaggtc

SEQ ID NO: 7536635 - DNA, 22 bp, Homo sapiens
tgggagctcacaggcctggctc

SEQ ID NO: 7536636 - DNA, 22 bp, Homo sapiens
tgggagctcacaggcctggctc

SEQ ID NO: 7536637 - DNA, 22 bp, Homo sapiens
cctctggccacatgggacatag

SEQ ID NO: 7536638 - DNA, 22 bp, Homo sapiens
cctctggccacatgggacatag

SEQ ID NO: 7536639 - DNA, 22 bp, Homo sapiens
cctctggccacatgggacatag

SEQ ID NO: 7536640 - DNA, 22 bp, Homo sapiens
cctctggcatagcaagtggcct

SEQ ID NO: 7536641 - DNA, 22 bp, Homo sapiens
cctctggcatagcaagtggcct

SEQ ID NO: 7536642 - DNA, 22 bp, Homo sapiens
cctctggcatagcaagtggcct

SEQ ID NO: 7536643 - DNA, 22 bp, Homo sapiens
cctctggcatagcaagtggcct

SEQ ID NO: 7536644 - DNA, 22 bp, Homo sapiens
cctctggcagccagccagttgt

SEQ ID NO: 7536645 - DNA, 22 bp, Homo sapiens
cctctggcaacttcacagccca

SEQ ID NO: 7536646 - DNA, 22 bp, Homo sapiens
cctctggcagccagccagttgt

SEQ ID NO: 7536647 - DNA, 22 bp, Homo sapiens
cctctggcagccagccagttgt

SEQ ID NO: 7536648 - DNA, 22 bp, Homo sapiens
cctctggcagccagccagttgt

SEQ ID NO: 7536649 - DNA, 16 bp, Homo sapiens
cctctggcaattagat

SEQ ID NO: 7536650 - DNA, 22 bp, Homo sapiens
cctctggcaagtgatttatcat

SEQ ID NO: 7536651 - DNA, 22 bp, Homo sapiens
tgggagcagttgtgaagctcag

SEQ ID NO: 7536652 - DNA, 22 bp, Homo sapiens
tgggagcagttgtgaagctcag

SEQ ID NO: 7536653 - DNA, 22 bp, Homo sapiens
tgggagcagttgtgaagctcag

SEQ ID NO: 7536654 - DNA, 22 bp, Homo sapiens
tgggagcagttgtgaagctcag

SEQ ID NO: 7536655 - DNA, 22 bp, Homo sapiens
tgggagcagttgtgaagctcag

SEQ ID NO: 7536656 - DNA, 22 bp, Homo sapiens
tgggagcagttgtgaagctcag

SEQ ID NO: 7536657 - DNA, 22 bp, Homo sapiens
tgggagcagttgcatctccagt

SEQ ID NO: 7536658 - DNA, 22 bp, Homo sapiens
tgggagcagttgcatctccagt

SEQ ID NO: 7536659 - DNA, 22 bp, Homo sapiens
tgggagcagttcaggtgtggct

SEQ ID NO: 7536660 - DNA, 22 bp, Homo sapiens
tgggagcagttcaggtgtggct

SEQ ID NO: 7536661 - DNA, 22 bp, Homo sapiens
tgggagcaggtgtgctagggaa

SEQ ID NO: 7536662 - DNA, 22 bp, Homo sapiens
tgggagcaggtgtgctagggaa

SEQ ID NO: 7536663 - DNA, 22 bp, Homo sapiens
tgggagcaggtgtgctagggaa

SEQ ID NO: 7536664 - DNA, 22 bp, Homo sapiens
tgggagcaggtgtgctagggaa

SEQ ID NO: 7536665 - DNA, 22 bp, Homo sapiens
tgggagcaggtgtgctagggaa

SEQ ID NO: 7536666 - DNA, 22 bp, Homo sapiens
tgggagcaggtgtgctagggaa

SEQ ID NO: 7536667 - DNA, 22 bp, Homo sapiens
tgggagcagttcaggtgtggct

SEQ ID NO: 7536668 - DNA, 22 bp, Homo sapiens
tgggagcagttcaggtgtggct

SEQ ID NO: 7536669 - DNA, 22 bp, Homo sapiens
tgggagcagttcaggtgtggct

SEQ ID NO: 7536670 - DNA, 22 bp, Homo sapiens
tgggagcagttcaggtgtggct

SEQ ID NO: 7536671 - DNA, 22 bp, Homo sapiens
tgggagcagttcaggtgtggct

SEQ ID NO: 7536672 - DNA, 22 bp, Homo sapiens
tgggagcaggtgtgctagggaa

SEQ ID NO: 7536673 - DNA, 22 bp, Homo sapiens
tgggagcccaagggagctgccg

SEQ ID NO: 7536674 - DNA, 22 bp, Homo sapiens
tgggagcccaagggagctgccg

SEQ ID NO: 7536675 - DNA, 22 bp, Homo sapiens
tgggagcccaagggagctgccg

SEQ ID NO: 7536676 - DNA, 22 bp, Homo sapiens
tgggagccattttagaggctgc

SEQ ID NO: 7536677 - DNA, 22 bp, Homo sapiens
tgggagccattttagaggctgc

SEQ ID NO: 7536678 - DNA, 22 bp, Homo sapiens
tgggagccattttagaggctgc

SEQ ID NO: 7536679 - DNA, 22 bp, Homo sapiens
tgggagccattttagaggctgc

SEQ ID NO: 7536680 - DNA, 23 bp, Homo sapiens
tgggagctcaagggaggctgccc

SEQ ID NO: 7536681 - DNA, 22 bp, Homo sapiens
tgggagctaattactccggttg

SEQ ID NO: 7536682 - DNA, 23 bp, Homo sapiens
tgggagctcaagggaggctgccc

SEQ ID NO: 7536683 - DNA, 23 bp, Homo sapiens
tgggagctcaagggaggctgccc

SEQ ID NO: 7536684 - DNA, 23 bp, Homo sapiens
tgggagctcaagggaggctgccc

SEQ ID NO: 7536685 - DNA, 22 bp, Homo sapiens
tgggagcctggcaggccagagg

SEQ ID NO: 7536686 - DNA, 22 bp, Homo sapiens
tgggagcccaagggagctgccg

SEQ ID NO: 7536687 - DNA, 22 bp, Homo sapiens
tgggagcctggcaggccagagg

SEQ ID NO: 7536688 - DNA, 23 bp, Homo sapiens
ccctggagctagtctgagcgggg

SEQ ID NO: 7536689 - DNA, 23 bp, Homo sapiens
ccctggagctagtctgagcagag

SEQ ID NO: 7536690 - DNA, 23 bp, Homo sapiens
ccctggagctagtctgagcagag

SEQ ID NO: 7536691 - DNA, 22 bp, Homo sapiens
ccctggagctgcttgcatgttg

SEQ ID NO: 7536692 - DNA, 22 bp, Homo sapiens
ccctggagctgcttgcatgttg

SEQ ID NO: 7536693 - DNA, 22 bp, Homo sapiens
ccctggagctgcttgcatgttg

SEQ ID NO: 7536694 - DNA, 23 bp, Homo sapiens
ccctggagctagtctgagcgggg

SEQ ID NO: 7536695 - DNA, 23 bp, Homo sapiens
ccctggagctagtctgagcgggg

SEQ ID NO: 7536696 - DNA, 23 bp, Homo sapiens
ccctggagctagtctgagcgggg

SEQ ID NO: 7536697 - DNA, 23 bp, Homo sapiens
ccctggagctagtctgagcagag

SEQ ID NO: 7536698 - DNA, 22 bp, Homo sapiens
ccctggagctagtctgagcaga

SEQ ID NO: 7536699 - DNA, 22 bp, Homo sapiens
ccctggagctagtctgagcaga

SEQ ID NO: 7536700 - DNA, 23 bp, Homo sapiens
ccctggagctagtctgagcagag

SEQ ID NO: 7536701 - DNA, 23 bp, Homo sapiens
ccctggagctagtctgagcagag

SEQ ID NO: 7536702 - DNA, 23 bp, Homo sapiens
ccctggagctagtctgagcagag

SEQ ID NO: 7536703 - DNA, 23 bp, Homo sapiens
ccctggagctagtctgagcagag

SEQ ID NO: 7536704 - DNA, 23 bp, Homo sapiens
ccctggagctagtctgagcagag

SEQ ID NO: 7536705 - DNA, 23 bp, Homo sapiens
ccctggagctagtctgagcagag

SEQ ID NO: 7536706 - DNA, 22 bp, Homo sapiens
tggaggtgagtgtggtacagca

SEQ ID NO: 7536707 - DNA, 22 bp, Homo sapiens
tggaggtgagtgtggtacagca

SEQ ID NO: 7536708 - DNA, 22 bp, Homo sapiens
tggaggtgagtgtggtacagca

SEQ ID NO: 7536709 - DNA, 22 bp, Homo sapiens
tggaggtggagttggaaactga

SEQ ID NO: 7536710 - DNA, 22 bp, Homo sapiens
ccctggagctagtctgagcaga

SEQ ID NO: 7536711 - DNA, 22 bp, Homo sapiens
ccctggagctagtctgagcaga

SEQ ID NO: 7536712 - DNA, 22 bp, Homo sapiens
tggaggtgagtgtggtacagca

SEQ ID NO: 7536713 - DNA, 22 bp, Homo sapiens
tggaggtgagtgtggtacagca

SEQ ID NO: 7536714 - DNA, 22 bp, Homo sapiens
tggaggtgagtgtggtacagca

SEQ ID NO: 7536715 - DNA, 22 bp, Homo sapiens
tggaggtgagtgtggtacagca

SEQ ID NO: 7536716 - DNA, 22 bp, Homo sapiens
tggaggtgacggggcctcgttg

SEQ ID NO: 7536717 - DNA, 22 bp, Homo sapiens
tggaggtgacggggcctcgttg

SEQ ID NO: 7536718 - DNA, 22 bp, Homo sapiens
tggaggtgacggggcctcgttg

SEQ ID NO: 7536719 - DNA, 22 bp, Homo sapiens
tggaggtgacggggcctcgttg

SEQ ID NO: 7536720 - DNA, 22 bp, Homo sapiens
tggaggtgacggggcctcgttg

SEQ ID NO: 7536721 - DNA, 22 bp, Homo sapiens
tggaggtgaaatgagattttgt

SEQ ID NO: 7536722 - DNA, 22 bp, Homo sapiens
tggaggtgaaatgagattttgt

SEQ ID NO: 7536723 - DNA, 22 bp, Homo sapiens
tggaggtgacggggcctcgttg

SEQ ID NO: 7536724 - DNA, 22 bp, Homo sapiens
tggaggggcaatggagcgcgga

SEQ ID NO: 7536725 - DNA, 22 bp, Homo sapiens
tggaggggcaatggagcgcgga

SEQ ID NO: 7536726 - DNA, 22 bp, Homo sapiens
tggaggggcaatggagcgcgga

SEQ ID NO: 7536727 - DNA, 19 bp, Homo sapiens
tggaggggtttgaatgtgg

SEQ ID NO: 7536728 - DNA, 19 bp, Homo sapiens
tggaggggtttgaatgtgg

SEQ ID NO: 7536729 - DNA, 19 bp, Homo sapiens
tggaggggtttgaatgtgg

SEQ ID NO: 7536730 - DNA, 19 bp, Homo sapiens
tggaggggtttgaatgtgg

SEQ ID NO: 7536731 - DNA, 19 bp, Homo sapiens
tggaggggtttgaatgtgg

SEQ ID NO: 7536732 - DNA, 19 bp, Homo sapiens
tggaggggtttgaatgtgg

SEQ ID NO: 7536733 - DNA, 22 bp, Homo sapiens
tggaggtacataatgagagggt

SEQ ID NO: 7536734 - DNA, 22 bp, Homo sapiens
tggaggtacataatgagagggt

SEQ ID NO: 7536735 - DNA, 22 bp, Homo sapiens
tggaggtacataatgagagggt

SEQ ID NO: 7536736 - DNA, 22 bp, Homo sapiens
tggagggtcaccccttgctgag

SEQ ID NO: 7536737 - DNA, 22 bp, Homo sapiens
tggagggtcaccccttgctgag

SEQ ID NO: 7536738 - DNA, 19 bp, Homo sapiens
tggaggggtttgaatgtgg

SEQ ID NO: 7536739 - DNA, 19 bp, Homo sapiens
tggaggggtttgaatgtgg

SEQ ID NO: 7536740 - DNA, 22 bp, Homo sapiens
tggaggtactcaggcacagagt

SEQ ID NO: 7536741 - DNA, 19 bp, Homo sapiens
tggaggtccaggagtaggg

SEQ ID NO: 7536742 - DNA, 22 bp, Homo sapiens
tggaggtaggacgaagaactct

SEQ ID NO: 7536743 - DNA, 22 bp, Homo sapiens
tggaggtcctgcaggatggcac

SEQ ID NO: 7536744 - DNA, 22 bp, Homo sapiens
tggaggtcctgcaggatggcac

SEQ ID NO: 7536745 - DNA, 19 bp, Homo sapiens
tggaggtccaggagtaggg

SEQ ID NO: 7536746 - DNA, 19 bp, Homo sapiens
tggaggtccaggagtaggg

SEQ ID NO: 7536747 - DNA, 22 bp, Homo sapiens
tggaggtcgcgcgggtgctgca

SEQ ID NO: 7536748 - DNA, 22 bp, Homo sapiens
tggaggtcctgcaggatggcac

SEQ ID NO: 7536749 - DNA, 22 bp, Homo sapiens
tggaggtcctggctgggtttta

SEQ ID NO: 7536750 - DNA, 22 bp, Homo sapiens
tggaggtcgcgcgggtgctgca

SEQ ID NO: 7536751 - DNA, 22 bp, Homo sapiens
tggaggtctctgtctgggcagg

SEQ ID NO: 7536752 - DNA, 22 bp, Homo sapiens
tggaggtctctgtctgggcagg

SEQ ID NO: 7536753 - DNA, 22 bp, Homo sapiens
tggaggtcgctagcgagcgggc

SEQ ID NO: 7536754 - DNA, 22 bp, Homo sapiens
tggaggtctctgtctgggcagg

SEQ ID NO: 7536755 - DNA, 22 bp, Homo sapiens
tggaggtctctgtctgggcagg

SEQ ID NO: 7536756 - DNA, 22 bp, Homo sapiens
tggaggtcttacccagggctat

SEQ ID NO: 7536757 - DNA, 22 bp, Homo sapiens
tggaggtctgcaaggcgctgga

SEQ ID NO: 7536758 - DNA, 22 bp, Homo sapiens
tggaggtctgcaaggcgctgga

SEQ ID NO: 7536759 - DNA, 22 bp, Homo sapiens
tggaggtcttacccagggctat

SEQ ID NO: 7536760 - DNA, 19 bp, Homo sapiens
tggaggccaggacacaggt

SEQ ID NO: 7536761 - DNA, 19 bp, Homo sapiens
tggaggccaggacacaggt

SEQ ID NO: 7536762 - DNA, 22 bp, Homo sapiens
tggaggggcaatggagcgcgga

SEQ ID NO: 7536763 - DNA, 19 bp, Homo sapiens
tggaggccaggacacaggt

SEQ ID NO: 7536764 - DNA, 22 bp, Homo sapiens
tggaggggcaatggagcgcgga

SEQ ID NO: 7536765 - DNA, 22 bp, Homo sapiens
tggaggggcaatggagcgcgga

SEQ ID NO: 7536766 - DNA, 22 bp, Homo sapiens
tggaggggcaatggagcgcgga

SEQ ID NO: 7536767 - DNA, 22 bp, Homo sapiens
tggaggggcaatggagcgcgga

SEQ ID NO: 7536768 - DNA, 22 bp, Homo sapiens
tggaggggcaatggagcgcgga

SEQ ID NO: 7536769 - DNA, 22 bp, Homo sapiens
tggaggggcaatggagcgcgga

SEQ ID NO: 7536770 - DNA, 22 bp, Homo sapiens
ccctgctgaatcccatggagtc

SEQ ID NO: 7536771 - DNA, 22 bp, Homo sapiens
ccctgctgaatcccatggagtc

SEQ ID NO: 7536772 - DNA, 22 bp, Homo sapiens
tggaggccagaggtactgggac

SEQ ID NO: 7536773 - DNA, 22 bp, Homo sapiens
ccctgctgaatcccatggagtc

SEQ ID NO: 7536774 - DNA, 22 bp, Homo sapiens
ccctgctgaatcccatggagtc

SEQ ID NO: 7536775 - DNA, 22 bp, Homo sapiens
ccctgctgaatcccatggagtc

SEQ ID NO: 7536776 - DNA, 22 bp, Homo sapiens
tggaggccaggaaggcagcgag

SEQ ID NO: 7536777 - DNA, 22 bp, Homo sapiens
tggaggccaggaaggcagcgag

SEQ ID NO: 7536778 - DNA, 22 bp, Homo sapiens
tggaggccaggaaggcagcgag

SEQ ID NO: 7536779 - DNA, 22 bp, Homo sapiens
tggaggccaggaaggcagcgag

SEQ ID NO: 7536780 - DNA, 22 bp, Homo sapiens
tggaggccagaggtactgggac

SEQ ID NO: 7536781 - DNA, 22 bp, Homo sapiens
ccctgctagttgtctcagtgat

SEQ ID NO: 7536782 - DNA, 23 bp, Homo sapiens
ccctgctcaggggtctgattctc

SEQ ID NO: 7536783 - DNA, 23 bp, Homo sapiens
ccctgctcaggggtctgattctc

SEQ ID NO: 7536784 - DNA, 23 bp, Homo sapiens
ccctgctcaggggtctgattctc

SEQ ID NO: 7536785 - DNA, 22 bp, Homo sapiens
ccctgctcttagtgcctgtgtg

SEQ ID NO: 7536786 - DNA, 22 bp, Homo sapiens
ccctgctcttagtgcctgtgtg

SEQ ID NO: 7536787 - DNA, 22 bp, Homo sapiens
ccctgctcttagtgcctgtgtg

SEQ ID NO: 7536788 - DNA, 22 bp, Homo sapiens
ccctgctcttagtgcctgtgtg

SEQ ID NO: 7536789 - DNA, 22 bp, Homo sapiens
ccctgctgaatcccatggagtc

SEQ ID NO: 7536790 - DNA, 22 bp, Homo sapiens
ccctgctgaagaacgttcatac

SEQ ID NO: 7536791 - DNA, 22 bp, Homo sapiens
ccctgctgaagaacgttcatac

SEQ ID NO: 7536792 - DNA, 22 bp, Homo sapiens
ccctgctcttctgactcaagct

SEQ ID NO: 7536793 - DNA, 22 bp, Homo sapiens
ccctgctcttctgactcaagct

SEQ ID NO: 7536794 - DNA, 22 bp, Homo sapiens
ccctgctcttctgactcaagct

SEQ ID NO: 7536795 - DNA, 22 bp, Homo sapiens
ccctgctcttagtgcctgtgtg

SEQ ID NO: 7536796 - DNA, 22 bp, Homo sapiens
ccctgctcttctgactcaagct

SEQ ID NO: 7536797 - DNA, 22 bp, Homo sapiens
ccctgctcttctgactcaagct

SEQ ID NO: 7536798 - DNA, 22 bp, Homo sapiens
ccctgccttcttggcctttaaa

SEQ ID NO: 7536799 - DNA, 22 bp, Homo sapiens
ccctgccttcttggcctttaaa

SEQ ID NO: 7536800 - DNA, 22 bp, Homo sapiens
ccctgccttcttggcctttaaa

SEQ ID NO: 7536801 - DNA, 22 bp, Homo sapiens
ccctgccttcttggcctttaaa

SEQ ID NO: 7536802 - DNA, 22 bp, Homo sapiens
ccctgccttggggtccacaccg

SEQ ID NO: 7536803 - DNA, 22 bp, Homo sapiens
ccctgccttggggtccacaccg

SEQ ID NO: 7536804 - DNA, 22 bp, Homo sapiens
ccctgccttggggtccacaccg

SEQ ID NO: 7536805 - DNA, 22 bp, Homo sapiens
ccctgccttcttggcctttaaa

SEQ ID NO: 7536806 - DNA, 22 bp, Homo sapiens
ccctgccttcttggcctttaaa

SEQ ID NO: 7536807 - DNA, 22 bp, Homo sapiens
ccctgccttgtctgggctaggt

SEQ ID NO: 7536808 - DNA, 22 bp, Homo sapiens
ccctgccttggggtccacaccg

SEQ ID NO: 7536809 - DNA, 22 bp, Homo sapiens
ccctgccttggggtccacaccg

SEQ ID NO: 7536810 - DNA, 22 bp, Homo sapiens
ccctgccttggggtccacaccg

SEQ ID NO: 7536811 - DNA, 22 bp, Homo sapiens
ccctgccttgtctgggctaggt

SEQ ID NO: 7536812 - DNA, 22 bp, Homo sapiens
ccctgccttgtctgggctaggt

SEQ ID NO: 7536813 - DNA, 22 bp, Homo sapiens
ccctgccttgtctgggctaggt

SEQ ID NO: 7536814 - DNA, 22 bp, Homo sapiens
ccctgccttgtctgggctaggt

SEQ ID NO: 7536815 - DNA, 22 bp, Homo sapiens
ccctgccttgtctgggctaggt

SEQ ID NO: 7536816 - DNA, 22 bp, Homo sapiens
ccctgccttgttggagcctatg

SEQ ID NO: 7536817 - DNA, 22 bp, Homo sapiens
ccctgccttgttggagcctatg

SEQ ID NO: 7536818 - DNA, 22 bp, Homo sapiens
ccctgccttgttggagcctatg

SEQ ID NO: 7536819 - DNA, 22 bp, Homo sapiens
ccctgccttgttggagcctatg

SEQ ID NO: 7536820 - DNA, 22 bp, Homo sapiens
ccctgccttgttggagcctatg

SEQ ID NO: 7536821 - DNA, 22 bp, Homo sapiens
ccctgccttgttggagcctatg

SEQ ID NO: 7536822 - DNA, 22 bp, Homo sapiens
ccctgccttgttggagcctatg

SEQ ID NO: 7536823 - DNA, 22 bp, Homo sapiens
ccctgccttgttggagcctatg

SEQ ID NO: 7536824 - DNA, 22 bp, Homo sapiens
ccctgccttgttggagcctatg

SEQ ID NO: 7536825 - DNA, 23 bp, Homo sapiens
tggacagtagggtagacagtgcc

SEQ ID NO: 7536826 - DNA, 23 bp, Homo sapiens
tggacagtagggtagacagtgcc

SEQ ID NO: 7536827 - DNA, 22 bp, Homo sapiens
tggacagtattgtgaagcaggc

SEQ ID NO: 7536828 - DNA, 22 bp, Homo sapiens
tggacagtgcagatacagaatg

SEQ ID NO: 7536829 - DNA, 23 bp, Homo sapiens
tggacagtagggtagacagtgcc

SEQ ID NO: 7536830 - DNA, 22 bp, Homo sapiens
tggacagtatctcttattcctc

SEQ ID NO: 7536831 - DNA, 22 bp, Homo sapiens
tggacagtatctcttattcctc

SEQ ID NO: 7536832 - DNA, 22 bp, Homo sapiens
tggacagttactgagcttgagt

SEQ ID NO: 7536833 - DNA, 22 bp, Homo sapiens
tggacagtgcagatacagaatg

SEQ ID NO: 7536834 - DNA, 23 bp, Homo sapiens
tggacagttatctcattgtcctg

SEQ ID NO: 7536835 - DNA, 23 bp, Homo sapiens
tggacagttatctcattgtcctg

SEQ ID NO: 7536836 - DNA, 20 bp, Homo sapiens
tggacagttactttatctct

SEQ ID NO: 7536837 - DNA, 20 bp, Homo sapiens
tggacagttactttatctct

SEQ ID NO: 7536838 - DNA, 22 bp, Homo sapiens
tggacagtgctcagaaatttgt

SEQ ID NO: 7536839 - DNA, 22 bp, Homo sapiens
tggacagttgtcttgtagctaa

SEQ ID NO: 7536840 - DNA, 22 bp, Homo sapiens
tggacagttgtcttgtagctaa

SEQ ID NO: 7536841 - DNA, 22 bp, Homo sapiens
tggacatcttagtcatgtcaat

SEQ ID NO: 7536842 - DNA, 22 bp, Homo sapiens
tggacatcttagtcatgtcaat

SEQ ID NO: 7536843 - DNA, 22 bp, Homo sapiens
tggacatgacctcgagcgagat

SEQ ID NO: 7536844 - DNA, 22 bp, Homo sapiens
tggacatgagctgagtgggtgt

SEQ ID NO: 7536845 - DNA, 22 bp, Homo sapiens
tggacaggtgcacacagcagcc

SEQ ID NO: 7536846 - DNA, 22 bp, Homo sapiens
tggacaggtgcacacagcagcc

SEQ ID NO: 7536847 - DNA, 22 bp, Homo sapiens
tggacaggttgagtaggaggag

SEQ ID NO: 7536848 - DNA, 22 bp, Homo sapiens
tggacaggttgagtaggaggag

SEQ ID NO: 7536849 - DNA, 22 bp, Homo sapiens
tggacaggttgagtaggaggag

SEQ ID NO: 7536850 - DNA, 22 bp, Homo sapiens
tggacaggttgagtaggaggag

SEQ ID NO: 7536851 - DNA, 22 bp, Homo sapiens
tggacaggttgagtaggaggag

SEQ ID NO: 7536852 - DNA, 22 bp, Homo sapiens
tggacaggttgagtaggaggag

SEQ ID NO: 7536853 - DNA, 22 bp, Homo sapiens
tggacaggttgagtaggaggag

SEQ ID NO: 7536854 - DNA, 22 bp, Homo sapiens
tggacaggttgagtaggaggag

SEQ ID NO: 7536855 - DNA, 22 bp, Homo sapiens
tggacaggttgagtaggaggag

SEQ ID NO: 7536856 - DNA, 22 bp, Homo sapiens
tggacaggttgagtaggaggag

SEQ ID NO: 7536857 - DNA, 22 bp, Homo sapiens
tggacagtaggaagagtgtggg

SEQ ID NO: 7536858 - DNA, 22 bp, Homo sapiens
tggacagtaagagaagatgtag

SEQ ID NO: 7536859 - DNA, 22 bp, Homo sapiens
tggacagtaagagaagatgtag

SEQ ID NO: 7536860 - DNA, 22 bp, Homo sapiens
tggacaggtttgggtgcctgtt

SEQ ID NO: 7536861 - DNA, 22 bp, Homo sapiens
tggacaggtttgggtgcctgtt

SEQ ID NO: 7536862 - DNA, 22 bp, Homo sapiens
tggacaggtttgggtgcctgtt

SEQ ID NO: 7536863 - DNA, 22 bp, Homo sapiens
tggacaggtttgggtgcctgtt

SEQ ID NO: 7536864 - DNA, 22 bp, Homo sapiens
tggacaggtttgggtgcctgtt

SEQ ID NO: 7536865 - DNA, 22 bp, Homo sapiens
tggacaggttgagtaggaggag

SEQ ID NO: 7536866 - DNA, 22 bp, Homo sapiens
tggacaggttgagtaggaggag

SEQ ID NO: 7536867 - DNA, 22 bp, Homo sapiens
tggacaggtttgggtgcctgtt

SEQ ID NO: 7536868 - DNA, 22 bp, Homo sapiens
tggacaggtttgggtgcctgtt

SEQ ID NO: 7536869 - DNA, 22 bp, Homo sapiens
ccctgcagtcctttcttggctc

SEQ ID NO: 7536870 - DNA, 23 bp, Homo sapiens
ccctgcagtcagggtgagatggt

SEQ ID NO: 7536871 - DNA, 22 bp, Homo sapiens
ccctgcagtcctttcttggctc

SEQ ID NO: 7536872 - DNA, 22 bp, Homo sapiens
ccctgcagtcctttcttggctc

SEQ ID NO: 7536873 - DNA, 22 bp, Homo sapiens
ccctgcagtcctttcttggctc

SEQ ID NO: 7536874 - DNA, 22 bp, Homo sapiens
ccctgcagtgtgacctcaccta

SEQ ID NO: 7536875 - DNA, 22 bp, Homo sapiens
ccctgcagtgtgacctcaccta

SEQ ID NO: 7536876 - DNA, 22 bp, Homo sapiens
ccctgcagtgtgacctcaccta

SEQ ID NO: 7536877 - DNA, 19 bp, Homo sapiens
ccctgccctggtgactggg

SEQ ID NO: 7536878 - DNA, 19 bp, Homo sapiens
ccctgccctggtgactggg

SEQ ID NO: 7536879 - DNA, 19 bp, Homo sapiens
ccctgccctggtgactggg

SEQ ID NO: 7536880 - DNA, 22 bp, Homo sapiens
ccctgcctacagggttttcttt

SEQ ID NO: 7536881 - DNA, 22 bp, Homo sapiens
ccctgcctacagggttttcttt

SEQ ID NO: 7536882 - DNA, 22 bp, Homo sapiens
ccctgcctacagggttttcttt

SEQ ID NO: 7536883 - DNA, 22 bp, Homo sapiens
ccctgcctctgaagctgctcag

SEQ ID NO: 7536884 - DNA, 22 bp, Homo sapiens
ccctgcctctgaagctgctcag

SEQ ID NO: 7536885 - DNA, 22 bp, Homo sapiens
ccctgcctctgaagctgctcag

SEQ ID NO: 7536886 - DNA, 22 bp, Homo sapiens
ccctgcctctgaagctgctcag

SEQ ID NO: 7536887 - DNA, 22 bp, Homo sapiens
ccctgcctctgaagctgctcag

SEQ ID NO: 7536888 - DNA, 22 bp, Homo sapiens
ccctgccttcttggcctttaaa

SEQ ID NO: 7536889 - DNA, 22 bp, Homo sapiens
ccctgcctgtgggcatcaacat

SEQ ID NO: 7536890 - DNA, 22 bp, Homo sapiens
ccctgcctgtgggcatcaacat

SEQ ID NO: 7536891 - DNA, 22 bp, Homo sapiens
ccctgcctgtgggcatcaacat

SEQ ID NO: 7536892 - DNA, 22 bp, Homo sapiens
ccctgcctgtgggcatcaacat

SEQ ID NO: 7536893 - DNA, 22 bp, Homo sapiens
ccctgcctgtgggcatcaacat

SEQ ID NO: 7536894 - DNA, 22 bp, Homo sapiens
ccctgcctgtgggcatcaacat

SEQ ID NO: 7536895 - DNA, 22 bp, Homo sapiens
ccctgcctctgaagctgctcag

SEQ ID NO: 7536896 - DNA, 22 bp, Homo sapiens
ccctgcctctgaagctgctcag

SEQ ID NO: 7536897 - DNA, 22 bp, Homo sapiens
ccctgcctctgaagctgctcag

SEQ ID NO: 7536898 - DNA, 22 bp, Homo sapiens
tggacaggtgcacacagcagcc

SEQ ID NO: 7536899 - DNA, 22 bp, Homo sapiens
tggacaggtgcacacagcagcc

SEQ ID NO: 7536900 - DNA, 22 bp, Homo sapiens
tggacaggtgcacacagcagcc

SEQ ID NO: 7536901 - DNA, 22 bp, Homo sapiens
ccctgcagccggccagctcatt

SEQ ID NO: 7536902 - DNA, 22 bp, Homo sapiens
tggacaggtgcacacagcagcc

SEQ ID NO: 7536903 - DNA, 22 bp, Homo sapiens
tggacaggtgcacacagcagcc

SEQ ID NO: 7536904 - DNA, 22 bp, Homo sapiens
tggacaggtgcacacagcagcc

SEQ ID NO: 7536905 - DNA, 22 bp, Homo sapiens
tggacaggttgagtaggaggag

SEQ ID NO: 7536906 - DNA, 22 bp, Homo sapiens
tggacaggttgagtaggaggag

SEQ ID NO: 7536907 - DNA, 22 bp, Homo sapiens
ccctgcagccggccagctcatt

SEQ ID NO: 7536908 - DNA, 22 bp, Homo sapiens
ccctgcagccggccagctcatt

SEQ ID NO: 7536909 - DNA, 22 bp, Homo sapiens
ccctgcagccggccagctcatt

SEQ ID NO: 7536910 - DNA, 22 bp, Homo sapiens
ccctgcagccggccagctcatt

SEQ ID NO: 7536911 - DNA, 20 bp, Homo sapiens
ccctgcagccatgggagtgg

SEQ ID NO: 7536912 - DNA, 20 bp, Homo sapiens
ccctgcagccatgggagtgg

SEQ ID NO: 7536913 - DNA, 20 bp, Homo sapiens
ccctgcagccatgggagtgg

SEQ ID NO: 7536914 - DNA, 20 bp, Homo sapiens
ccctgcagccatgggagtgg

SEQ ID NO: 7536915 - DNA, 20 bp, Homo sapiens
ccctgcagccatgggagtgg

SEQ ID NO: 7536916 - DNA, 22 bp, Homo sapiens
ccctgcagcattctctaactgg

SEQ ID NO: 7536917 - DNA, 22 bp, Homo sapiens
ccctgcagatctagggtccttc

SEQ ID NO: 7536918 - DNA, 22 bp, Homo sapiens
ccctgcagatctagggtccttc

SEQ ID NO: 7536919 - DNA, 22 bp, Homo sapiens
ccctgcagagccagccctgacc

SEQ ID NO: 7536920 - DNA, 22 bp, Homo sapiens
ccctgcagagggatgggggcag

SEQ ID NO: 7536921 - DNA, 22 bp, Homo sapiens
ccctgcagagggatgggggcag

SEQ ID NO: 7536922 - DNA, 22 bp, Homo sapiens
ccctgcagatcagtgagaactt

SEQ ID NO: 7536923 - DNA, 22 bp, Homo sapiens
ccctgcagatcagtgagaactt

SEQ ID NO: 7536924 - DNA, 22 bp, Homo sapiens
ccctgcagagggatgggggcag

SEQ ID NO: 7536925 - DNA, 22 bp, Homo sapiens
ccctgcagaccaatgccataga

SEQ ID NO: 7536926 - DNA, 22 bp, Homo sapiens
ccctgcagaaccacagacaaac

SEQ ID NO: 7536927 - DNA, 22 bp, Homo sapiens
ccctgcagaccaatgccataga

SEQ ID NO: 7536928 - DNA, 22 bp, Homo sapiens
ccctgcagacgtcttgatgcct

SEQ ID NO: 7536929 - DNA, 22 bp, Homo sapiens
ccctgcagaccaatgccataga

SEQ ID NO: 7536930 - DNA, 22 bp, Homo sapiens
ccctgcagacgtcttgatgcct

SEQ ID NO: 7536931 - DNA, 23 bp, Homo sapiens
ccctgcactaagaggagaaggtg

SEQ ID NO: 7536932 - DNA, 22 bp, Homo sapiens
ccctgcagaaccacagacaaac

SEQ ID NO: 7536933 - DNA, 22 bp, Homo sapiens
ccctgcagaccaatgccataga

SEQ ID NO: 7536934 - DNA, 22 bp, Homo sapiens
ccctgcagaaccacagacaaac

SEQ ID NO: 7536935 - DNA, 22 bp, Homo sapiens
ccctgcagaaccacagacaaac

SEQ ID NO: 7536936 - DNA, 22 bp, Homo sapiens
ccctgcagagccagccctgacc

SEQ ID NO: 7536937 - DNA, 22 bp, Homo sapiens
ccctgcagagagtgcttttgtg

SEQ ID NO: 7536938 - DNA, 22 bp, Homo sapiens
ccctgcagagagtgcttttgtg

SEQ ID NO: 7536939 - DNA, 22 bp, Homo sapiens
ccctgcagagccagccctgacc

SEQ ID NO: 7536940 - DNA, 22 bp, Homo sapiens
ccctgcagagccagccctgacc

SEQ ID NO: 7536941 - DNA, 22 bp, Homo sapiens
ccctgcagagaccactgacctt

SEQ ID NO: 7536942 - DNA, 22 bp, Homo sapiens
ccctgcagacgtcttgatgcct

SEQ ID NO: 7536943 - DNA, 22 bp, Homo sapiens
ccctgcagagaccactgacctt

SEQ ID NO: 7536944 - DNA, 21 bp, Homo sapiens
tggaagggaagtcttggttgt

SEQ ID NO: 7536945 - DNA, 21 bp, Homo sapiens
tggaagggaagtcttggttgt

SEQ ID NO: 7536946 - DNA, 21 bp, Homo sapiens
tggaagggaagtcttggttgt

SEQ ID NO: 7536947 - DNA, 21 bp, Homo sapiens
tggaagggaagtcttggttgt

SEQ ID NO: 7536948 - DNA, 22 bp, Homo sapiens
tggaagggaacaggtgggtgtt

SEQ ID NO: 7536949 - DNA, 22 bp, Homo sapiens
tggaagggaacaggtgggtgtt

SEQ ID NO: 7536950 - DNA, 22 bp, Homo sapiens
tggaagggaacaggtgggtgtt

SEQ ID NO: 7536951 - DNA, 17 bp, Homo sapiens
ccctgcaccctactctc

SEQ ID NO: 7536952 - DNA, 17 bp, Homo sapiens
ccctgcaccctactctc

SEQ ID NO: 7536953 - DNA, 17 bp, Homo sapiens
ccctgcaccctactctc

SEQ ID NO: 7536954 - DNA, 17 bp, Homo sapiens
ccctgcaccctactctc

SEQ ID NO: 7536955 - DNA, 22 bp, Homo sapiens
ccctgaggagagcgcttcccga

SEQ ID NO: 7536956 - DNA, 22 bp, Homo sapiens
ccctgaggagagcgcttcccga

SEQ ID NO: 7536957 - DNA, 22 bp, Homo sapiens
ccctgaggaccaggaaggaggg

SEQ ID NO: 7536958 - DNA, 22 bp, Homo sapiens
ccctgaggagagcgcttcccga

SEQ ID NO: 7536959 - DNA, 22 bp, Homo sapiens
ccctgaggaccaggaaggaggg

SEQ ID NO: 7536960 - DNA, 22 bp, Homo sapiens
ccctgaggaccaggaaggaggg

SEQ ID NO: 7536961 - DNA, 22 bp, Homo sapiens
tgctttattggaacctcatcct

SEQ ID NO: 7536962 - DNA, 22 bp, Homo sapiens
tgctttattggaacctcatcct

SEQ ID NO: 7536963 - DNA, 22 bp, Homo sapiens
tgctttattggaacctcatcct

SEQ ID NO: 7536964 - DNA, 22 bp, Homo sapiens
tgctttattgcatcagtgtggg

SEQ ID NO: 7536965 - DNA, 22 bp, Homo sapiens
tgctttattgcatcagtgtggg

SEQ ID NO: 7536966 - DNA, 22 bp, Homo sapiens
tgctttattgcatcagtgtggg

SEQ ID NO: 7536967 - DNA, 22 bp, Homo sapiens
tgctttatttataaaatagcaa

SEQ ID NO: 7536968 - DNA, 22 bp, Homo sapiens
tgctttattttaaatatgccat

SEQ ID NO: 7536969 - DNA, 22 bp, Homo sapiens
tgctttattttaaatatgccat

SEQ ID NO: 7536970 - DNA, 22 bp, Homo sapiens
tgctttatttataaaatagcaa

SEQ ID NO: 7536971 - DNA, 22 bp, Homo sapiens
tgctttatttataaaatagcaa

SEQ ID NO: 7536972 - DNA, 22 bp, Homo sapiens
tgctttatttataaaatagcaa

SEQ ID NO: 7536973 - DNA, 22 bp, Homo sapiens
tgctttatttataaaatagcaa

SEQ ID NO: 7536974 - DNA, 22 bp, Homo sapiens
tgctttatttataaaatagcaa

SEQ ID NO: 7536975 - DNA, 22 bp, Homo sapiens
tgctttatttataaaatagcaa

SEQ ID NO: 7536976 - DNA, 22 bp, Homo sapiens
tgcctgctccagtcctgtccac

SEQ ID NO: 7536977 - DNA, 22 bp, Homo sapiens
tgcctgctatttgcctaaagtg

SEQ ID NO: 7536978 - DNA, 22 bp, Homo sapiens
tgcctgctatttgcctaaagtg

SEQ ID NO: 7536979 - DNA, 22 bp, Homo sapiens
tgcctgctaggccctgctgggt

SEQ ID NO: 7536980 - DNA, 22 bp, Homo sapiens
tgcctgctaggccctgctgggt

SEQ ID NO: 7536981 - DNA, 22 bp, Homo sapiens
tgcctgctaggccctgctgggt

SEQ ID NO: 7536982 - DNA, 22 bp, Homo sapiens
tgctttattgcatcagtgtggg

SEQ ID NO: 7536983 - DNA, 22 bp, Homo sapiens
tgcttgtctctctgtgcccact

SEQ ID NO: 7536984 - DNA, 22 bp, Homo sapiens
tgctttattgcatcagtgtggg

SEQ ID NO: 7536985 - DNA, 22 bp, Homo sapiens
tgctttattgcatcagtgtggg

SEQ ID NO: 7536986 - DNA, 22 bp, Homo sapiens
tgcttgtctctctgtgcccact

SEQ ID NO: 7536987 - DNA, 22 bp, Homo sapiens
tgcttgtctcagataaaactat

SEQ ID NO: 7536988 - DNA, 19 bp, Homo sapiens
tgcctgctcctggcttcca

SEQ ID NO: 7536989 - DNA, 19 bp, Homo sapiens
tgcctgctcctggcttcca

SEQ ID NO: 7536990 - DNA, 22 bp, Homo sapiens
tgcttgtctcagataaaactat

SEQ ID NO: 7536991 - DNA, 22 bp, Homo sapiens
tgcttgtccgaggtgagtactt

SEQ ID NO: 7536992 - DNA, 22 bp, Homo sapiens
tgctttattttaaatatgccat

SEQ ID NO: 7536993 - DNA, 22 bp, Homo sapiens
tgctttcaatgaattgtatact

SEQ ID NO: 7536994 - DNA, 22 bp, Homo sapiens
tgctttcaatgaattgtatact

SEQ ID NO: 7536995 - DNA, 22 bp, Homo sapiens
tgctttcacaccatgcctataa

SEQ ID NO: 7536996 - DNA, 22 bp, Homo sapiens
tgctttcacaccatgcctataa

SEQ ID NO: 7536997 - DNA, 22 bp, Homo sapiens
tgctttcacctgtttgcaccca

SEQ ID NO: 7536998 - DNA, 22 bp, Homo sapiens
tgctttcacctgtttgcaccca

SEQ ID NO: 7536999 - DNA, 22 bp, Homo sapiens
tgctttcacctgtttgcaccca

SEQ ID NO: 7537000 - DNA, 22 bp, Homo sapiens
tgctttcacatgtatgcacaaa

SEQ ID NO: 7537001 - DNA, 22 bp, Homo sapiens
tgctttcacatgtatgcacaaa

SEQ ID NO: 7537002 - DNA, 22 bp, Homo sapiens
tgctttcacatgtatgcacaaa

SEQ ID NO: 7537003 - DNA, 22 bp, Homo sapiens
tgctttcacatgtatgcacaaa

SEQ ID NO: 7537004 - DNA, 22 bp, Homo sapiens
tgctttcagatatctgtttcaa

SEQ ID NO: 7537005 - DNA, 21 bp, Homo sapiens
tgctttcagactcttacagaa

SEQ ID NO: 7537006 - DNA, 22 bp, Homo sapiens
tgctttcagggatgtctgtgag

SEQ ID NO: 7537007 - DNA, 22 bp, Homo sapiens
tgctttcagctggtaaagaaac

SEQ ID NO: 7537008 - DNA, 22 bp, Homo sapiens
tgctttcagccagtgtctggat

SEQ ID NO: 7537009 - DNA, 22 bp, Homo sapiens
tgctttcattgtgataggaagc

SEQ ID NO: 7537010 - DNA, 22 bp, Homo sapiens
tgctttcattcacaaaatagca

SEQ ID NO: 7537011 - DNA, 22 bp, Homo sapiens
tgctttcattcacaaaatagca

SEQ ID NO: 7537012 - DNA, 22 bp, Homo sapiens
tgctttcatattgcctatgact

SEQ ID NO: 7537013 - DNA, 22 bp, Homo sapiens
tgctttcatattgcctatgact

SEQ ID NO: 7537014 - DNA, 22 bp, Homo sapiens
tgctttcatattgcctatgact

SEQ ID NO: 7537015 - DNA, 22 bp, Homo sapiens
tgcctcagtttctccatatgaa

SEQ ID NO: 7537016 - DNA, 22 bp, Homo sapiens
tgcctcattaactgtccttaat

SEQ ID NO: 7537017 - DNA, 22 bp, Homo sapiens
tgcctcagtttctccatatgaa

SEQ ID NO: 7537018 - DNA, 22 bp, Homo sapiens
tgcctcagtttctccatatgaa

SEQ ID NO: 7537019 - DNA, 22 bp, Homo sapiens
tgcctcagtttctccatatgaa

SEQ ID NO: 7537020 - DNA, 22 bp, Homo sapiens
tgcctcagtttctccatatgaa

SEQ ID NO: 7537021 - DNA, 22 bp, Homo sapiens
tgcctcatttttaagtgttata

SEQ ID NO: 7537022 - DNA, 22 bp, Homo sapiens
tgcctccaacagcccatcctag

SEQ ID NO: 7537023 - DNA, 22 bp, Homo sapiens
tgcctccaacagcccatcctag

SEQ ID NO: 7537024 - DNA, 22 bp, Homo sapiens
tgcctccaccattgctcacttt

SEQ ID NO: 7537025 - DNA, 22 bp, Homo sapiens
tgcctccaccattgctcacttt

SEQ ID NO: 7537026 - DNA, 22 bp, Homo sapiens
tgcctccaccattgctcacttt

SEQ ID NO: 7537027 - DNA, 22 bp, Homo sapiens
tgcctccaccattgctcacttt

SEQ ID NO: 7537028 - DNA, 22 bp, Homo sapiens
tgcctcagtttcatctgcagaa

SEQ ID NO: 7537029 - DNA, 22 bp, Homo sapiens
tgcctcagtttcatctgcagaa

SEQ ID NO: 7537030 - DNA, 22 bp, Homo sapiens
tgcctcagtttctccatatgaa

SEQ ID NO: 7537031 - DNA, 22 bp, Homo sapiens
tgcctcagtttcatctgcagaa

SEQ ID NO: 7537032 - DNA, 22 bp, Homo sapiens
tgcctcagtttcatctgcagaa

SEQ ID NO: 7537033 - DNA, 22 bp, Homo sapiens
tgcctcagtttcatctgcagaa

SEQ ID NO: 7537034 - DNA, 22 bp, Homo sapiens
tgcctcagtttcatctgcagaa

SEQ ID NO: 7537035 - DNA, 23 bp, Homo sapiens
tgcctccaccgagggccaggcat

SEQ ID NO: 7537036 - DNA, 23 bp, Homo sapiens
tgcctccaccgagggccaggcat

SEQ ID NO: 7537037 - DNA, 23 bp, Homo sapiens
tgcctccaccgagggccaggcat

SEQ ID NO: 7537038 - DNA, 23 bp, Homo sapiens
tgcctccaccgagggccaggcat

SEQ ID NO: 7537039 - DNA, 23 bp, Homo sapiens
tgcctccaccgagggccaggcat

SEQ ID NO: 7537040 - DNA, 17 bp, Homo sapiens
tgcctccagcagggtga

SEQ ID NO: 7537041 - DNA, 23 bp, Homo sapiens
tgcctccaccgagggccaggcat

SEQ ID NO: 7537042 - DNA, 17 bp, Homo sapiens
tgcctccagcagggtga

SEQ ID NO: 7537043 - DNA, 22 bp, Homo sapiens
tgcctccaggaggggcagctct

SEQ ID NO: 7537044 - DNA, 17 bp, Homo sapiens
tgcctccagcagggtga

SEQ ID NO: 7537045 - DNA, 22 bp, Homo sapiens
tgcctccaggaggggcagctct

SEQ ID NO: 7537046 - DNA, 22 bp, Homo sapiens
tgcctccaggaggggcagctct

SEQ ID NO: 7537047 - DNA, 22 bp, Homo sapiens
tgcctccaggaggggcagctct

SEQ ID NO: 7537048 - DNA, 22 bp, Homo sapiens
tgcctccaggaggggcagctct

SEQ ID NO: 7537049 - DNA, 22 bp, Homo sapiens
tgcctccatgtttcagcatcta

SEQ ID NO: 7537050 - DNA, 22 bp, Homo sapiens
tgcctccatgtttcagcatcta

SEQ ID NO: 7537051 - DNA, 22 bp, Homo sapiens
tgcctccatgtttcagcatcta

SEQ ID NO: 7537052 - DNA, 18 bp, Homo sapiens
tgcctgccccgtaagggt

SEQ ID NO: 7537053 - DNA, 22 bp, Homo sapiens
tgcctccattcctgggtcattg

SEQ ID NO: 7537054 - DNA, 22 bp, Homo sapiens
tgcctccatgtttcagcatcta

SEQ ID NO: 7537055 - DNA, 22 bp, Homo sapiens
tgcctgccctgaaaactgccca

SEQ ID NO: 7537056 - DNA, 22 bp, Homo sapiens
tgcctgccctgaaaactgccca

SEQ ID NO: 7537057 - DNA, 22 bp, Homo sapiens
tgcctgccctttccacacagcc

SEQ ID NO: 7537058 - DNA, 22 bp, Homo sapiens
tgcctgccctttccacacagcc

SEQ ID NO: 7537059 - DNA, 22 bp, Homo sapiens
tgcctgccctgaaaactgccca

SEQ ID NO: 7537060 - DNA, 22 bp, Homo sapiens
tgcctgccctttccacacagcc

SEQ ID NO: 7537061 - DNA, 22 bp, Homo sapiens
tgcctgccctttccacacagcc

SEQ ID NO: 7537062 - DNA, 22 bp, Homo sapiens
tgcctgccgctgtctagtactg

SEQ ID NO: 7537063 - DNA, 22 bp, Homo sapiens
tgcctgccgctgtctagtactg

SEQ ID NO: 7537064 - DNA, 22 bp, Homo sapiens
tgcctgccctttccacacagcc

SEQ ID NO: 7537065 - DNA, 22 bp, Homo sapiens
tgcctgccctttccacacagcc

SEQ ID NO: 7537066 - DNA, 22 bp, Homo sapiens
tgcctgccctttccacacagcc

SEQ ID NO: 7537067 - DNA, 22 bp, Homo sapiens
tgcctgccgctgtctagtactg

SEQ ID NO: 7537068 - DNA, 22 bp, Homo sapiens
tgcctgcctaggaagctgtgaa

SEQ ID NO: 7537069 - DNA, 22 bp, Homo sapiens
tgcctgcctaggaagctgtgaa

SEQ ID NO: 7537070 - DNA, 22 bp, Homo sapiens
tgcctgcctaggaagctgtgaa

SEQ ID NO: 7537071 - DNA, 22 bp, Homo sapiens
tgcctgcctcaggccgagtgct

SEQ ID NO: 7537072 - DNA, 22 bp, Homo sapiens
tgcctgcctcaggccgagtgct

SEQ ID NO: 7537073 - DNA, 22 bp, Homo sapiens
tgcctgcctcaggccgagtgct

SEQ ID NO: 7537074 - DNA, 22 bp, Homo sapiens
tgcctgcctctggcagccctgc

SEQ ID NO: 7537075 - DNA, 22 bp, Homo sapiens
tgcctgcctctggcagccctgc

SEQ ID NO: 7537076 - DNA, 22 bp, Homo sapiens
tgcctgcctctggagcccatcc

SEQ ID NO: 7537077 - DNA, 22 bp, Homo sapiens
tgcctgcctctggagcccatcc

SEQ ID NO: 7537078 - DNA, 22 bp, Homo sapiens
tgcctgcctctggagcccatcc

SEQ ID NO: 7537079 - DNA, 22 bp, Homo sapiens
tgcctgcctctggagcccatcc

SEQ ID NO: 7537080 - DNA, 22 bp, Homo sapiens
tgcctgcctctggagcccatcc

SEQ ID NO: 7537081 - DNA, 22 bp, Homo sapiens
tgcctgcctctggcagccctgc

SEQ ID NO: 7537082 - DNA, 22 bp, Homo sapiens
tgcctgcctctggcagccctgc

SEQ ID NO: 7537083 - DNA, 22 bp, Homo sapiens
tgcctgcgaggcatgggtgaga

SEQ ID NO: 7537084 - DNA, 22 bp, Homo sapiens
tgcctgccttgctgctggacag

SEQ ID NO: 7537085 - DNA, 22 bp, Homo sapiens
tgcctgccttgctgctggacag

SEQ ID NO: 7537086 - DNA, 22 bp, Homo sapiens
tgcctgctagatatccaggtga

SEQ ID NO: 7537087 - DNA, 22 bp, Homo sapiens
tgcctgctagatatccaggtga

SEQ ID NO: 7537088 - DNA, 22 bp, Homo sapiens
tgcctgccttgctgctggacag

SEQ ID NO: 7537089 - DNA, 22 bp, Homo sapiens
tgcctgcgaggcatgggtgaga

SEQ ID NO: 7537090 - DNA, 22 bp, Homo sapiens
tgcctgcctgcatagtcccacg

SEQ ID NO: 7537091 - DNA, 22 bp, Homo sapiens
tgcctgcctctggcagccctgc

SEQ ID NO: 7537092 - DNA, 22 bp, Homo sapiens
tgcctgcctgcatagtcccacg

SEQ ID NO: 7537093 - DNA, 22 bp, Homo sapiens
tgcctgcctgcatagtcccacg

SEQ ID NO: 7537094 - DNA, 22 bp, Homo sapiens
tgcctgcctgcatagtcccacg

SEQ ID NO: 7537095 - DNA, 22 bp, Homo sapiens
tgcctgcctgcatagtcccacg

SEQ ID NO: 7537096 - DNA, 22 bp, Homo sapiens
tggaagaaggcagagaggcatt

SEQ ID NO: 7537097 - DNA, 22 bp, Homo sapiens
tggaagaatagaagatggttga

SEQ ID NO: 7537098 - DNA, 22 bp, Homo sapiens
tggaagaatagaagatggttga

SEQ ID NO: 7537099 - DNA, 22 bp, Homo sapiens
tggaagaaggcagagaggcatt

SEQ ID NO: 7537100 - DNA, 22 bp, Homo sapiens
tggaagaaggcagagaggcatt

SEQ ID NO: 7537101 - DNA, 22 bp, Homo sapiens
tggaagaaggcagagaggcatt

SEQ ID NO: 7537102 - DNA, 22 bp, Homo sapiens
tggaagaaggcagagaggcatt

SEQ ID NO: 7537103 - DNA, 22 bp, Homo sapiens
tggaagaagctacaagcggtga

SEQ ID NO: 7537104 - DNA, 22 bp, Homo sapiens
tggaagaagctacaagcggtga

SEQ ID NO: 7537105 - DNA, 22 bp, Homo sapiens
tggaagaatatgggggtacaga

SEQ ID NO: 7537106 - DNA, 22 bp, Homo sapiens
tggaagaataggatagaagaac

SEQ ID NO: 7537107 - DNA, 22 bp, Homo sapiens
tggaagaataggatagaagaac

SEQ ID NO: 7537108 - DNA, 22 bp, Homo sapiens
tggaagaataggatagaagaac

SEQ ID NO: 7537109 - DNA, 22 bp, Homo sapiens
tggaagaataggatagaagaac

SEQ ID NO: 7537110 - DNA, 22 bp, Homo sapiens
tggaagaataggatagaagaac

SEQ ID NO: 7537111 - DNA, 22 bp, Homo sapiens
tggaagaataggatagaagaac

SEQ ID NO: 7537112 - DNA, 22 bp, Homo sapiens
tggaagaataggatagaagaac

SEQ ID NO: 7537113 - DNA, 22 bp, Homo sapiens
tggaagaataggatagaagaac

SEQ ID NO: 7537114 - DNA, 22 bp, Homo sapiens
tggaagaataggatagaagaac

SEQ ID NO: 7537115 - DNA, 22 bp, Homo sapiens
tggaagaagctacaagcggtga

SEQ ID NO: 7537116 - DNA, 22 bp, Homo sapiens
tggaagaagctacaagcggtga

SEQ ID NO: 7537117 - DNA, 22 bp, Homo sapiens
tggaaagagaaactcttgctaa

SEQ ID NO: 7537118 - DNA, 20 bp, Homo sapiens
tggaagaagaactcaggctt

SEQ ID NO: 7537119 - DNA, 20 bp, Homo sapiens
tggaagaagaactcaggctt

SEQ ID NO: 7537120 - DNA, 22 bp, Homo sapiens
tggaaagagaaactcttgctaa

SEQ ID NO: 7537121 - DNA, 22 bp, Homo sapiens
tggaaagacattcagccgctgg

SEQ ID NO: 7537122 - DNA, 22 bp, Homo sapiens
tggaaagagaaactcttgctaa

SEQ ID NO: 7537123 - DNA, 22 bp, Homo sapiens
tggaaagacatgtccttcatta

SEQ ID NO: 7537124 - DNA, 22 bp, Homo sapiens
tggaaagacatgtccttcatta

SEQ ID NO: 7537125 - DNA, 22 bp, Homo sapiens
tggaaagaattcctatggttca

SEQ ID NO: 7537126 - DNA, 22 bp, Homo sapiens
tggaaagacatgtccttcatta

SEQ ID NO: 7537127 - DNA, 22 bp, Homo sapiens
tggaaagacattcagccgctgg

SEQ ID NO: 7537128 - DNA, 22 bp, Homo sapiens
tggaaagacattcagccgctgg

SEQ ID NO: 7537129 - DNA, 22 bp, Homo sapiens
tggaaagacattcagccgctgg

SEQ ID NO: 7537130 - DNA, 20 bp, Homo sapiens
ccctaggaacgcagcaggag

SEQ ID NO: 7537131 - DNA, 20 bp, Homo sapiens
ccctaggaacgcagcaggag

SEQ ID NO: 7537132 - DNA, 19 bp, Homo sapiens
ccctagagtaagactgcat

SEQ ID NO: 7537133 - DNA, 19 bp, Homo sapiens
ccctagagtaagactgcat

SEQ ID NO: 7537134 - DNA, 19 bp, Homo sapiens
ccctagagtaagactgcat

SEQ ID NO: 7537135 - DNA, 22 bp, Homo sapiens
ccctagagagatcagatgggga

SEQ ID NO: 7537136 - DNA, 19 bp, Homo sapiens
ccctagagtaagactgcat

SEQ ID NO: 7537137 - DNA, 19 bp, Homo sapiens
ccctagagtaagactgcat

SEQ ID NO: 7537138 - DNA, 22 bp, Homo sapiens
ccctagaacacgcagacactga

SEQ ID NO: 7537139 - DNA, 22 bp, Homo sapiens
ccctagaacacgcagacactga

SEQ ID NO: 7537140 - DNA, 22 bp, Homo sapiens
ccctagagagatcagatgggga

SEQ ID NO: 7537141 - DNA, 22 bp, Homo sapiens
ccctagaacacgcagacactga

SEQ ID NO: 7537142 - DNA, 22 bp, Homo sapiens
cccgtcccttttgcccgctggt

SEQ ID NO: 7537143 - DNA, 22 bp, Homo sapiens
cccgtccctgtgcgtcgcgagc

SEQ ID NO: 7537144 - DNA, 22 bp, Homo sapiens
cccgtcccttttgcccgctggt

SEQ ID NO: 7537145 - DNA, 22 bp, Homo sapiens
cccgtcccttttgcccgctggt

SEQ ID NO: 7537146 - DNA, 22 bp, Homo sapiens
cccgtgtggacagcgtgccagt

SEQ ID NO: 7537147 - DNA, 22 bp, Homo sapiens
cccgtccctgtgcgtcgcgagc

SEQ ID NO: 7537148 - DNA, 22 bp, Homo sapiens
cccggtgttgtggaagatgcta

SEQ ID NO: 7537149 - DNA, 23 bp, Homo sapiens
cccggtttgcccacatgtccttg

SEQ ID NO: 7537150 - DNA, 21 bp, Homo sapiens
cccgtcagcagggcccctcct

SEQ ID NO: 7537151 - DNA, 22 bp, Homo sapiens
cccgggaggcggaggttgcagt

SEQ ID NO: 7537152 - DNA, 22 bp, Homo sapiens
cccgggaggtggaggttgcagt

SEQ ID NO: 7537153 - DNA, 22 bp, Homo sapiens
cccgggaggtggagactgcagt

SEQ ID NO: 7537154 - DNA, 22 bp, Homo sapiens
cccgggaggtggagactgcagt

SEQ ID NO: 7537155 - DNA, 22 bp, Homo sapiens
cccgggaacataaagcagtgag

SEQ ID NO: 7537156 - DNA, 22 bp, Homo sapiens
cccgggagactcctctagggct

SEQ ID NO: 7537157 - DNA, 22 bp, Homo sapiens
cccgggagactcctctagggct

SEQ ID NO: 7537158 - DNA, 22 bp, Homo sapiens
cccgggaggcagaggttgcagt

SEQ ID NO: 7537159 - DNA, 21 bp, Homo sapiens
tgctttctaaaaatactattg

SEQ ID NO: 7537160 - DNA, 22 bp, Homo sapiens
ccctagaaatgaaagcatacgt

SEQ ID NO: 7537161 - DNA, 22 bp, Homo sapiens
ccctaatgcagctgagaagggc

SEQ ID NO: 7537162 - DNA, 22 bp, Homo sapiens
ccctacgcctcatacagaccag

SEQ ID NO: 7537163 - DNA, 22 bp, Homo sapiens
ccctaaaagtctcattttccag

SEQ ID NO: 7537164 - DNA, 22 bp, Homo sapiens
ccctaaaagtctcattttccag

SEQ ID NO: 7537165 - DNA, 22 bp, Homo sapiens
ccctaaggcagcccagtctgtg

SEQ ID NO: 7537166 - DNA, 22 bp, Homo sapiens
cccgtgtgtgcgaggctcccgc

SEQ ID NO: 7537167 - DNA, 22 bp, Homo sapiens
cccgtgtggatgcgctggtgct

SEQ ID NO: 7537168 - DNA, 22 bp, Homo sapiens
cccgtgggagagacacgcaccc

SEQ ID NO: 7537169 - DNA, 22 bp, Homo sapiens
cccgttcctataatagcataga

SEQ ID NO: 7537170 - DNA, 23 bp, Homo sapiens
ccctaactaattctagggcctaa

SEQ ID NO: 7537171 - DNA, 21 bp, Homo sapiens
ccctaactctaaaggatccat

SEQ ID NO: 7537172 - DNA, 22 bp, Homo sapiens
cccgtcccttttgcccgctggt

SEQ ID NO: 7537173 - DNA, 22 bp, Homo sapiens
tggaagacactatttaccaggt

SEQ ID NO: 7537174 - DNA, 20 bp, Homo sapiens
tggaagacactgaagggcca

SEQ ID NO: 7537175 - DNA, 22 bp, Homo sapiens
tggaagacaatttgaaaacatt

SEQ ID NO: 7537176 - DNA, 22 bp, Homo sapiens
tggaagacactatttaccaggt

SEQ ID NO: 7537177 - DNA, 20 bp, Homo sapiens
tggaagacactgaagggcca

SEQ ID NO: 7537178 - DNA, 22 bp, Homo sapiens
tggaagacaggagatgtgtgta

SEQ ID NO: 7537179 - DNA, 22 bp, Homo sapiens
tggaagacactatttaccaggt

SEQ ID NO: 7537180 - DNA, 22 bp, Homo sapiens
tggaagacaatttgaaaacatt

SEQ ID NO: 7537181 - DNA, 22 bp, Homo sapiens
tggaagacaatgtacatgcagt

SEQ ID NO: 7537182 - DNA, 22 bp, Homo sapiens
tggaagacaatgtacatgcagt

SEQ ID NO: 7537183 - DNA, 22 bp, Homo sapiens
tggaagacaatgtacatgcagt

SEQ ID NO: 7537184 - DNA, 22 bp, Homo sapiens
tggaagacaatgtacatgcagt

SEQ ID NO: 7537185 - DNA, 22 bp, Homo sapiens
tggaagacaagtgttagcatgg

SEQ ID NO: 7537186 - DNA, 22 bp, Homo sapiens
tggaagacaatgtacatgcagt

SEQ ID NO: 7537187 - DNA, 22 bp, Homo sapiens
tggaagacaaagattcaatatt

SEQ ID NO: 7537188 - DNA, 22 bp, Homo sapiens
tggaagaatttggggataaatt

SEQ ID NO: 7537189 - DNA, 22 bp, Homo sapiens
tggaagacaaagattcaatatt

SEQ ID NO: 7537190 - DNA, 22 bp, Homo sapiens
tggaagacaagtgttagcatgg

SEQ ID NO: 7537191 - DNA, 22 bp, Homo sapiens
tggaagaatgctccacagggaa

SEQ ID NO: 7537192 - DNA, 22 bp, Homo sapiens
tggaagaatatgggggtacaga

SEQ ID NO: 7537193 - DNA, 22 bp, Homo sapiens
tggaagaatgctccacagggaa

SEQ ID NO: 7537194 - DNA, 22 bp, Homo sapiens
tggaagaatgctccacagggaa

SEQ ID NO: 7537195 - DNA, 22 bp, Homo sapiens
tggaagaatgtttgccttataa

SEQ ID NO: 7537196 - DNA, 22 bp, Homo sapiens
tggaagaatgtttgccttataa

SEQ ID NO: 7537197 - DNA, 22 bp, Homo sapiens
tggaagaatgtttgccttataa

SEQ ID NO: 7537198 - DNA, 22 bp, Homo sapiens
tggaagaatttggggataaatt

SEQ ID NO: 7537199 - DNA, 22 bp, Homo sapiens
tggaaggcatttcacacaggat

SEQ ID NO: 7537200 - DNA, 22 bp, Homo sapiens
tggaaggcagtgatattgttga

SEQ ID NO: 7537201 - DNA, 22 bp, Homo sapiens
tggaaggcatgggaactgttct

SEQ ID NO: 7537202 - DNA, 22 bp, Homo sapiens
tggaaggcatgggaactgttct

SEQ ID NO: 7537203 - DNA, 20 bp, Homo sapiens
tggaaggcatctgcattatt

SEQ ID NO: 7537204 - DNA, 20 bp, Homo sapiens
tggaaggcatctgcattatt

SEQ ID NO: 7537205 - DNA, 22 bp, Homo sapiens
tggaaggcaggacctgccttgg

SEQ ID NO: 7537206 - DNA, 22 bp, Homo sapiens
tggaaggcactgggagaagact

SEQ ID NO: 7537207 - DNA, 22 bp, Homo sapiens
tggaaggcactgggagaagact

SEQ ID NO: 7537208 - DNA, 22 bp, Homo sapiens
tggaagacatactgttttctta

SEQ ID NO: 7537209 - DNA, 22 bp, Homo sapiens
tggaagacagttgatgggagtt

SEQ ID NO: 7537210 - DNA, 22 bp, Homo sapiens
tggaaggcaacggagtgagctg

SEQ ID NO: 7537211 - DNA, 22 bp, Homo sapiens
tggaagacagttgatgggagtt

SEQ ID NO: 7537212 - DNA, 22 bp, Homo sapiens
tggaagacagttgatgggagtt

SEQ ID NO: 7537213 - DNA, 22 bp, Homo sapiens
tggaagacagtgactggttgtg

SEQ ID NO: 7537214 - DNA, 22 bp, Homo sapiens
tggaagacaggcatggaagtgg

SEQ ID NO: 7537215 - DNA, 22 bp, Homo sapiens
tggaagacaggagatgtgtgta

SEQ ID NO: 7537216 - DNA, 22 bp, Homo sapiens
tggaagacaggagatgtgtgta

SEQ ID NO: 7537217 - DNA, 22 bp, Homo sapiens
tggaagacaggcatggaagtgg

SEQ ID NO: 7537218 - DNA, 22 bp, Homo sapiens
tggaagacaggctgtattttaa

SEQ ID NO: 7537219 - DNA, 22 bp, Homo sapiens
tggaagacagtgactggttgtg

SEQ ID NO: 7537220 - DNA, 22 bp, Homo sapiens
tggaagggaaagtttggggtcc

SEQ ID NO: 7537221 - DNA, 22 bp, Homo sapiens
tggaagggaaagtttggggtcc

SEQ ID NO: 7537222 - DNA, 22 bp, Homo sapiens
tggaagggaacaggtgggtgtt

SEQ ID NO: 7537223 - DNA, 22 bp, Homo sapiens
tggaagggaacaggtgggtgtt

SEQ ID NO: 7537224 - DNA, 22 bp, Homo sapiens
tggaagggaacaggtgggtgtt

SEQ ID NO: 7537225 - DNA, 22 bp, Homo sapiens
tggaagggaacaggtgggtgtt

SEQ ID NO: 7537226 - DNA, 22 bp, Homo sapiens
tggaagggaacaggtgggtgtt

SEQ ID NO: 7537227 - DNA, 22 bp, Homo sapiens
tggaagggaacaggtgggtgtt

SEQ ID NO: 7537228 - DNA, 22 bp, Homo sapiens
tggaagggaacaggtgggtgtt

SEQ ID NO: 7537229 - DNA, 22 bp, Homo sapiens
tggaaggcttcatatgtaaaga

SEQ ID NO: 7537230 - DNA, 17 bp, Homo sapiens
tggaaggcttcaatatt

SEQ ID NO: 7537231 - DNA, 17 bp, Homo sapiens
tggaaggcttcaatatt

SEQ ID NO: 7537232 - DNA, 22 bp, Homo sapiens
tggaaggcttcatatgtaaaga

SEQ ID NO: 7537233 - DNA, 16 bp, Homo sapiens
tggaaggcttccccca

SEQ ID NO: 7537234 - DNA, 22 bp, Homo sapiens
tggaaggcttggaatacttcca

SEQ ID NO: 7537235 - DNA, 22 bp, Homo sapiens
tggaaggcttggaatacttcca

SEQ ID NO: 7537236 - DNA, 22 bp, Homo sapiens
tggaagggaaagtttggggtcc

SEQ ID NO: 7537237 - DNA, 22 bp, Homo sapiens
tggaaggctttgctgtccttgc

SEQ ID NO: 7537238 - DNA, 22 bp, Homo sapiens
tggaagggaaagtttggggtcc

SEQ ID NO: 7537239 - DNA, 22 bp, Homo sapiens
tggaagggaaagtttggggtcc

SEQ ID NO: 7537240 - DNA, 22 bp, Homo sapiens
tggaagggaaagtttggggtcc

SEQ ID NO: 7537241 - DNA, 22 bp, Homo sapiens
tggaaggcttggaatacttcca

SEQ ID NO: 7537242 - DNA, 22 bp, Homo sapiens
tggaagggaaagtttggggtcc

SEQ ID NO: 7537243 - DNA, 19 bp, Homo sapiens
tggaaggctaagacacttg

SEQ ID NO: 7537244 - DNA, 19 bp, Homo sapiens
tggaaggctaagacacttg

SEQ ID NO: 7537245 - DNA, 19 bp, Homo sapiens
tggaaggctaagacacttg

SEQ ID NO: 7537246 - DNA, 22 bp, Homo sapiens
tggaaggctaggtgctaggccc

SEQ ID NO: 7537247 - DNA, 22 bp, Homo sapiens
tggaaggctaggtgctaggccc

SEQ ID NO: 7537248 - DNA, 22 bp, Homo sapiens
tggaaggcatttcacacaggat

SEQ ID NO: 7537249 - DNA, 22 bp, Homo sapiens
tggaaggcgtctcgaaggccta

SEQ ID NO: 7537250 - DNA, 22 bp, Homo sapiens
tggaaggcgtctcgaaggccta

SEQ ID NO: 7537251 - DNA, 22 bp, Homo sapiens
tggaaggcgcagtgatgatgct

SEQ ID NO: 7537252 - DNA, 22 bp, Homo sapiens
tggaaggcctgttgtgtcctag

SEQ ID NO: 7537253 - DNA, 21 bp, Homo sapiens
tggaaggctgctctgccaggg

SEQ ID NO: 7537254 - DNA, 21 bp, Homo sapiens
tggaaggctgctctgccaggg

SEQ ID NO: 7537255 - DNA, 21 bp, Homo sapiens
tggaaggctgctctgccaggg

SEQ ID NO: 7537256 - DNA, 21 bp, Homo sapiens
tggaaggctgctctgccaggg

SEQ ID NO: 7537257 - DNA, 22 bp, Homo sapiens
tggaaggctgagagtcctgggg

SEQ ID NO: 7537258 - DNA, 22 bp, Homo sapiens
tggaaggctgagagtcctgggg

SEQ ID NO: 7537259 - DNA, 22 bp, Homo sapiens
tggaaggctgagagtcctgggg

SEQ ID NO: 7537260 - DNA, 22 bp, Homo sapiens
tggaaggctaggtgctaggccc

SEQ ID NO: 7537261 - DNA, 22 bp, Homo sapiens
ccgtctgcagcctccaggagtt

SEQ ID NO: 7537262 - DNA, 21 bp, Homo sapiens
ccgtgctcggctatggaccac

SEQ ID NO: 7537263 - DNA, 21 bp, Homo sapiens
ccgtgctcggctatggaccac

SEQ ID NO: 7537264 - DNA, 22 bp, Homo sapiens
ccgtgctcgggaaaggccagtg

SEQ ID NO: 7537265 - DNA, 22 bp, Homo sapiens
ccgtgcttcttcagatgtgaat

SEQ ID NO: 7537266 - DNA, 21 bp, Homo sapiens
ccgtgctcggctatggaccac

SEQ ID NO: 7537267 - DNA, 21 bp, Homo sapiens
ccgtgctcggctatggaccac

SEQ ID NO: 7537268 - DNA, 22 bp, Homo sapiens
ccgtccccagccacctgctgat

SEQ ID NO: 7537269 - DNA, 22 bp, Homo sapiens
ccgtcccctctgaccttgctga

SEQ ID NO: 7537270 - DNA, 22 bp, Homo sapiens
ccgtccccagccacctgctgat

SEQ ID NO: 7537271 - DNA, 22 bp, Homo sapiens
ccgtccccagccacctgctgat

SEQ ID NO: 7537272 - DNA, 22 bp, Homo sapiens
ccgtccccagccacctgctgat

SEQ ID NO: 7537273 - DNA, 22 bp, Homo sapiens
ccgtcccctctgaccttgctga

SEQ ID NO: 7537274 - DNA, 22 bp, Homo sapiens
ccgtcccctctgaccttgctga

SEQ ID NO: 7537275 - DNA, 22 bp, Homo sapiens
ccgtggtcacctgagctccttg

SEQ ID NO: 7537276 - DNA, 22 bp, Homo sapiens
ccgtggttgagttgggctacag

SEQ ID NO: 7537277 - DNA, 22 bp, Homo sapiens
ccgtggttgcccaggcgactgt

SEQ ID NO: 7537278 - DNA, 22 bp, Homo sapiens
ccgtggtttggcataggaagaa

SEQ ID NO: 7537279 - DNA, 22 bp, Homo sapiens
ccgtggttttccctggagcccc

SEQ ID NO: 7537280 - DNA, 22 bp, Homo sapiens
ccgtggtcacctgagctccttg

SEQ ID NO: 7537281 - DNA, 22 bp, Homo sapiens
ccgtggtcacctgagctccttg

SEQ ID NO: 7537282 - DNA, 22 bp, Homo sapiens
ccgtggagttgtgctgagtatg

SEQ ID NO: 7537283 - DNA, 22 bp, Homo sapiens
ccgtggagttgtgctgagtatg

SEQ ID NO: 7537284 - DNA, 22 bp, Homo sapiens
ccgtggcttcccaggcggatgt

SEQ ID NO: 7537285 - DNA, 22 bp, Homo sapiens
ccgtggccttgatggctccggt

SEQ ID NO: 7537286 - DNA, 22 bp, Homo sapiens
ccgtggagttgtgctgagtatg

SEQ ID NO: 7537287 - DNA, 22 bp, Homo sapiens
ccgtggccttgatggctccggt

SEQ ID NO: 7537288 - DNA, 22 bp, Homo sapiens
ccgggttgaggttcccatagat

SEQ ID NO: 7537289 - DNA, 22 bp, Homo sapiens
ccggggtgcgaggagcgtcttt

SEQ ID NO: 7537290 - DNA, 22 bp, Homo sapiens
ccgggggcgggacgagcttgac

SEQ ID NO: 7537291 - DNA, 22 bp, Homo sapiens
ccgggggcgggacgagcttgac

SEQ ID NO: 7537292 - DNA, 22 bp, Homo sapiens
ccgggggactactgggaaactg

SEQ ID NO: 7537293 - DNA, 18 bp, Homo sapiens
ccgggctttggtgacaca

SEQ ID NO: 7537294 - DNA, 22 bp, Homo sapiens
ccgggctggagtgcaatggctc

SEQ ID NO: 7537295 - DNA, 22 bp, Homo sapiens
ccggtcccaggtgccccggtga

SEQ ID NO: 7537296 - DNA, 22 bp, Homo sapiens
ccggtcccaggtgccccggtga

SEQ ID NO: 7537297 - DNA, 22 bp, Homo sapiens
ccggtctgtgtacttgctggcc

SEQ ID NO: 7537298 - DNA, 22 bp, Homo sapiens
ccgtccccagccacctgctgat

SEQ ID NO: 7537299 - DNA, 22 bp, Homo sapiens
ccgtatgtctgggtttcttaat

SEQ ID NO: 7537300 - DNA, 22 bp, Homo sapiens
ccgtattataagtttttccttc

SEQ ID NO: 7537301 - DNA, 22 bp, Homo sapiens
ccggtgttcaaagtctggtatg

SEQ ID NO: 7537302 - DNA, 22 bp, Homo sapiens
ccggctactcgggaggctgacg

SEQ ID NO: 7537303 - DNA, 22 bp, Homo sapiens
ccggctactcgggaggctgacg

SEQ ID NO: 7537304 - DNA, 22 bp, Homo sapiens
ccggctactcgggaggctgacg

SEQ ID NO: 7537305 - DNA, 22 bp, Homo sapiens
ccggctactcgggaggctgacg

SEQ ID NO: 7537306 - DNA, 22 bp, Homo sapiens
ccggctactcgggaggctgacg

SEQ ID NO: 7537307 - DNA, 22 bp, Homo sapiens
ccggctactcgggaggctgacg

SEQ ID NO: 7537308 - DNA, 22 bp, Homo sapiens
ccggctcggcgaccaggctgaa

SEQ ID NO: 7537309 - DNA, 22 bp, Homo sapiens
ccggctactcgggaggctgacg

SEQ ID NO: 7537310 - DNA, 22 bp, Homo sapiens
ccggctactcgggaggctgacg

SEQ ID NO: 7537311 - DNA, 22 bp, Homo sapiens
ccggctactcgggaggctgacg

SEQ ID NO: 7537312 - DNA, 22 bp, Homo sapiens
ccgggagagtggaaccaagagg

SEQ ID NO: 7537313 - DNA, 22 bp, Homo sapiens
ccgggagcaggcgccaccgcca

SEQ ID NO: 7537314 - DNA, 22 bp, Homo sapiens
ccgggagcaggcgccaccgcca

SEQ ID NO: 7537315 - DNA, 22 bp, Homo sapiens
ccggctcggcgaccaggctgaa

SEQ ID NO: 7537316 - DNA, 22 bp, Homo sapiens
ccgggagactttgagcaccatg

SEQ ID NO: 7537317 - DNA, 22 bp, Homo sapiens
ccgggagactttgagcaccatg

SEQ ID NO: 7537318 - DNA, 22 bp, Homo sapiens
ccgggcctcgggacaccgggta

SEQ ID NO: 7537319 - DNA, 22 bp, Homo sapiens
ccgggcgggggctctcgtcacc

SEQ ID NO: 7537320 - DNA, 22 bp, Homo sapiens
ccgggcctcgggacaccgggta

SEQ ID NO: 7537321 - DNA, 22 bp, Homo sapiens
ccgggcctcgggacaccgggta

SEQ ID NO: 7537322 - DNA, 22 bp, Homo sapiens
ccgggcctcgggacaccgggta

SEQ ID NO: 7537323 - DNA, 22 bp, Homo sapiens
ccgggcctcgggacaccgggta

SEQ ID NO: 7537324 - DNA, 22 bp, Homo sapiens
ccgggccccacggtgacctcag

SEQ ID NO: 7537325 - DNA, 22 bp, Homo sapiens
ccgggcctcgggacaccgggta

SEQ ID NO: 7537326 - DNA, 22 bp, Homo sapiens
ccgggaggcagaggttgcagtg

SEQ ID NO: 7537327 - DNA, 22 bp, Homo sapiens
ccgggaggctaaggttgcagtg

SEQ ID NO: 7537328 - DNA, 22 bp, Homo sapiens
ccgggaggtggaggttgcagtg

SEQ ID NO: 7537329 - DNA, 22 bp, Homo sapiens
ccgggagcaggcgccaccgcca

SEQ ID NO: 7537330 - DNA, 22 bp, Homo sapiens
ccgggagcaggcgccaccgcca

SEQ ID NO: 7537331 - DNA, 22 bp, Homo sapiens
ccgggagcaggcgccaccgcca

SEQ ID NO: 7537332 - DNA, 22 bp, Homo sapiens
cctcacagtttggctaactgtg

SEQ ID NO: 7537333 - DNA, 22 bp, Homo sapiens
cctcacatgaatgtaagctcca

SEQ ID NO: 7537334 - DNA, 22 bp, Homo sapiens
cctcacccactacactcaaggg

SEQ ID NO: 7537335 - DNA, 22 bp, Homo sapiens
cctcacccactacactcaaggg

SEQ ID NO: 7537336 - DNA, 22 bp, Homo sapiens
cctcacagtttggctaactgtg

SEQ ID NO: 7537337 - DNA, 22 bp, Homo sapiens
cctcacagtgttcgtgtcagat

SEQ ID NO: 7537338 - DNA, 22 bp, Homo sapiens
cctcacagtgttcgtgtcagat

SEQ ID NO: 7537339 - DNA, 22 bp, Homo sapiens
cctcaccctgaccactactttt

SEQ ID NO: 7537340 - DNA, 19 bp, Homo sapiens
cctcaccctgcagaggagg

SEQ ID NO: 7537341 - DNA, 22 bp, Homo sapiens
cctcacccagtcacctaggtgg

SEQ ID NO: 7537342 - DNA, 22 bp, Homo sapiens
cctcacccagtcacctaggtgg

SEQ ID NO: 7537343 - DNA, 22 bp, Homo sapiens
cctcacccagtcacctaggtgg

SEQ ID NO: 7537344 - DNA, 22 bp, Homo sapiens
cctcacccagtcacctaggtgg

SEQ ID NO: 7537345 - DNA, 22 bp, Homo sapiens
cctcacccagtcacctaggtgg

SEQ ID NO: 7537346 - DNA, 22 bp, Homo sapiens
cctcacccactacactcaaggg

SEQ ID NO: 7537347 - DNA, 22 bp, Homo sapiens
cctcacccactacactcaaggg

SEQ ID NO: 7537348 - DNA, 22 bp, Homo sapiens
cctcacagcttttcaaagtgga

SEQ ID NO: 7537349 - DNA, 22 bp, Homo sapiens
cctcacagcttttcaaagtgga

SEQ ID NO: 7537350 - DNA, 17 bp, Homo sapiens
cctcacagggaccagac

SEQ ID NO: 7537351 - DNA, 22 bp, Homo sapiens
cctcacagcctcatgcccagcc

SEQ ID NO: 7537352 - DNA, 22 bp, Homo sapiens
cctcacagcctcatgcccagcc

SEQ ID NO: 7537353 - DNA, 20 bp, Homo sapiens
cctcacagggcagagagggg

SEQ ID NO: 7537354 - DNA, 17 bp, Homo sapiens
cctcacagggaccagac

SEQ ID NO: 7537355 - DNA, 17 bp, Homo sapiens
cctcacagggaccagac

SEQ ID NO: 7537356 - DNA, 22 bp, Homo sapiens
cctatttgtaggctgggccagt

SEQ ID NO: 7537357 - DNA, 21 bp, Homo sapiens
cctcaaagatgatggggtttc

SEQ ID NO: 7537358 - DNA, 22 bp, Homo sapiens
cctcacagagcccagatgtcta

SEQ ID NO: 7537359 - DNA, 22 bp, Homo sapiens
cctcacagagcccagatgtcta

SEQ ID NO: 7537360 - DNA, 22 bp, Homo sapiens
cctcacagagcccagatgtcta

SEQ ID NO: 7537361 - DNA, 22 bp, Homo sapiens
cctatttgtaggctgggccagt

SEQ ID NO: 7537362 - DNA, 22 bp, Homo sapiens
cctaaatagagtcagatgtaat

SEQ ID NO: 7537363 - DNA, 22 bp, Homo sapiens
cctaaatagagtcagatgtaat

SEQ ID NO: 7537364 - DNA, 22 bp, Homo sapiens
cctaaagaattttcatagagct

SEQ ID NO: 7537365 - DNA, 22 bp, Homo sapiens
cctaaagtggaaatataactat

SEQ ID NO: 7537366 - DNA, 20 bp, Homo sapiens
cctaaatacctgtcaccagg

SEQ ID NO: 7537367 - DNA, 20 bp, Homo sapiens
cctaaatacctgtcaccagg

SEQ ID NO: 7537368 - DNA, 22 bp, Homo sapiens
cctaaagaattttcatagagct

SEQ ID NO: 7537369 - DNA, 21 bp, Homo sapiens
cctaaacaagactgacacaca

SEQ ID NO: 7537370 - DNA, 21 bp, Homo sapiens
cctaaacaagactgacacaca

SEQ ID NO: 7537371 - DNA, 21 bp, Homo sapiens
cctaaacaagactgacacaca

SEQ ID NO: 7537372 - DNA, 21 bp, Homo sapiens
cctaaacaagactgacacaca

SEQ ID NO: 7537373 - DNA, 23 bp, Homo sapiens
ccgtgtgtatactctgtaataga

SEQ ID NO: 7537374 - DNA, 22 bp, Homo sapiens
ccgtgtacataaagccctggta

SEQ ID NO: 7537375 - DNA, 22 bp, Homo sapiens
ccgtgtgtatggtggaactgct

SEQ ID NO: 7537376 - DNA, 22 bp, Homo sapiens
cctcacagcccttggcccagga

SEQ ID NO: 7537377 - DNA, 22 bp, Homo sapiens
cctcacagcccttggcccagga

SEQ ID NO: 7537378 - DNA, 22 bp, Homo sapiens
cctcacagccctcctctagcac

SEQ ID NO: 7537379 - DNA, 22 bp, Homo sapiens
cctcacagcctcatgcccagcc

SEQ ID NO: 7537380 - DNA, 22 bp, Homo sapiens
cctcacagcctcatgcccagcc

SEQ ID NO: 7537381 - DNA, 22 bp, Homo sapiens
cctcacagccctcctctagcac

SEQ ID NO: 7537382 - DNA, 22 bp, Homo sapiens
cctcacagaggggcagccatct

SEQ ID NO: 7537383 - DNA, 22 bp, Homo sapiens
cctcacagcaaggatttcagtg

SEQ ID NO: 7537384 - DNA, 22 bp, Homo sapiens
cctcacagccctcctctagcac

SEQ ID NO: 7537385 - DNA, 22 bp, Homo sapiens
cctcacagagcccagatgtcta

SEQ ID NO: 7537386 - DNA, 22 bp, Homo sapiens
cctcacagaggggcagccatct

SEQ ID NO: 7537387 - DNA, 22 bp, Homo sapiens
cctcacagaggggcagccatct

SEQ ID NO: 7537388 - DNA, 22 bp, Homo sapiens
cctcacagaggggcagccatct

SEQ ID NO: 7537389 - DNA, 22 bp, Homo sapiens
ccctggtgtccactggaggaag

SEQ ID NO: 7537390 - DNA, 22 bp, Homo sapiens
ccctggtgtccactggaggaag

SEQ ID NO: 7537391 - DNA, 22 bp, Homo sapiens
ccctggtggtacggcactggca

SEQ ID NO: 7537392 - DNA, 22 bp, Homo sapiens
ccctggtggtacggcactggca

SEQ ID NO: 7537393 - DNA, 22 bp, Homo sapiens
ccctggtggtacggcactggca

SEQ ID NO: 7537394 - DNA, 22 bp, Homo sapiens
ccctggtggtacggcactggca

SEQ ID NO: 7537395 - DNA, 22 bp, Homo sapiens
ccctggtggtacggcactggca

SEQ ID NO: 7537396 - DNA, 22 bp, Homo sapiens
ccctggtggtacggcactggca

SEQ ID NO: 7537397 - DNA, 22 bp, Homo sapiens
ccctggtggtacggcactggca

SEQ ID NO: 7537398 - DNA, 22 bp, Homo sapiens
ccctggtgtggatgtgattggc

SEQ ID NO: 7537399 - DNA, 22 bp, Homo sapiens
ccctggtgtccactggaggaag

SEQ ID NO: 7537400 - DNA, 22 bp, Homo sapiens
ccctggtgtccactggaggaag

SEQ ID NO: 7537401 - DNA, 22 bp, Homo sapiens
ccctggtgtccactggaggaag

SEQ ID NO: 7537402 - DNA, 22 bp, Homo sapiens
ccctggtgtggatgtgattggc

SEQ ID NO: 7537403 - DNA, 22 bp, Homo sapiens
ccctggtgtggatgtgattggc

SEQ ID NO: 7537404 - DNA, 22 bp, Homo sapiens
ccctggttcaggtttctctgaa

SEQ ID NO: 7537405 - DNA, 22 bp, Homo sapiens
ccctggttcaggtttctctgaa

SEQ ID NO: 7537406 - DNA, 22 bp, Homo sapiens
ccctggtggtacggcactggca

SEQ ID NO: 7537407 - DNA, 22 bp, Homo sapiens
ccctggttgacaagccagctca

SEQ ID NO: 7537408 - DNA, 21 bp, Homo sapiens
ccctggttccactgtcaccgc

SEQ ID NO: 7537409 - DNA, 22 bp, Homo sapiens
ccctgtccttggctgtgaggct

SEQ ID NO: 7537410 - DNA, 22 bp, Homo sapiens
ccctgtccttggctgtgaggct

SEQ ID NO: 7537411 - DNA, 22 bp, Homo sapiens
ccctgtccttggctgtgaggct

SEQ ID NO: 7537412 - DNA, 22 bp, Homo sapiens
ccctgtccttggctgtgaggct

SEQ ID NO: 7537413 - DNA, 22 bp, Homo sapiens
ccctgtccttggctgtgaggct

SEQ ID NO: 7537414 - DNA, 22 bp, Homo sapiens
ccctgtctcattgatcacttgt

SEQ ID NO: 7537415 - DNA, 22 bp, Homo sapiens
ccctgtctgtaccgtgatgagc

SEQ ID NO: 7537416 - DNA, 22 bp, Homo sapiens
ccctgtctgtaccgtgatgagc

SEQ ID NO: 7537417 - DNA, 22 bp, Homo sapiens
ccctgtgacagtatctgcttga

SEQ ID NO: 7537418 - DNA, 22 bp, Homo sapiens
ccctgtctcattgatcacttgt

SEQ ID NO: 7537419 - DNA, 22 bp, Homo sapiens
ccctgtctcattgatcacttgt

SEQ ID NO: 7537420 - DNA, 22 bp, Homo sapiens
ccctgtctgtaccgtgatgagc

SEQ ID NO: 7537421 - DNA, 22 bp, Homo sapiens
ccctgtctgtaccgtgatgagc

SEQ ID NO: 7537422 - DNA, 22 bp, Homo sapiens
ccctgtcacaatggatgacatt

SEQ ID NO: 7537423 - DNA, 22 bp, Homo sapiens
ccctgtcctgctaggccctggt

SEQ ID NO: 7537424 - DNA, 23 bp, Homo sapiens
ccctgtagcccaggacaggcttt

SEQ ID NO: 7537425 - DNA, 22 bp, Homo sapiens
ccctgtatagatacaggtcata

SEQ ID NO: 7537426 - DNA, 22 bp, Homo sapiens
ccctgtcctggatgggagcact

SEQ ID NO: 7537427 - DNA, 22 bp, Homo sapiens
ccctgtcctggatgggagcact

SEQ ID NO: 7537428 - DNA, 22 bp, Homo sapiens
ccctgtcctggatgggagcact

SEQ ID NO: 7537429 - DNA, 22 bp, Homo sapiens
ccctgtcctgctaggccctggt

SEQ ID NO: 7537430 - DNA, 22 bp, Homo sapiens
ccctgtcctgctaggccctggt

SEQ ID NO: 7537431 - DNA, 22 bp, Homo sapiens
ccctgtcctgctaggccctggt

SEQ ID NO: 7537432 - DNA, 22 bp, Homo sapiens
ccctggaggaaaatctgaggct

SEQ ID NO: 7537433 - DNA, 22 bp, Homo sapiens
ccctggaggaaaatctgaggct

SEQ ID NO: 7537434 - DNA, 22 bp, Homo sapiens
ccctggaggaaaatctgaggct

SEQ ID NO: 7537435 - DNA, 22 bp, Homo sapiens
ccctggaggaaaatctgaggct

SEQ ID NO: 7537436 - DNA, 22 bp, Homo sapiens
ccctggaggaaaatctgaggct

SEQ ID NO: 7537437 - DNA, 22 bp, Homo sapiens
ccctggagctgcttgcatgttg

SEQ ID NO: 7537438 - DNA, 22 bp, Homo sapiens
ccctggagctgcttgcatgttg

SEQ ID NO: 7537439 - DNA, 22 bp, Homo sapiens
ccctggagctgcttgcatgttg

SEQ ID NO: 7537440 - DNA, 22 bp, Homo sapiens
ccctggaggaagaaacaatggc

SEQ ID NO: 7537441 - DNA, 22 bp, Homo sapiens
ccctggaggaagaaacaatggc

SEQ ID NO: 7537442 - DNA, 22 bp, Homo sapiens
ccctggaggaagaaacaatggc

SEQ ID NO: 7537443 - DNA, 22 bp, Homo sapiens
ccctggaggaaaatctgaggct

SEQ ID NO: 7537444 - DNA, 22 bp, Homo sapiens
ccctggaggaagaaacaatggc

SEQ ID NO: 7537445 - DNA, 22 bp, Homo sapiens
ccctggaggaaaatctgaggct

SEQ ID NO: 7537446 - DNA, 22 bp, Homo sapiens
ccctggaggaaaatctgaggct

SEQ ID NO: 7537447 - DNA, 22 bp, Homo sapiens
ccctgggatggattggcaggaa

SEQ ID NO: 7537448 - DNA, 22 bp, Homo sapiens
ccctgggatggattggcaggaa

SEQ ID NO: 7537449 - DNA, 22 bp, Homo sapiens
ccctgggataccagacaccaga

SEQ ID NO: 7537450 - DNA, 22 bp, Homo sapiens
ccctgggataccagacaccaga

SEQ ID NO: 7537451 - DNA, 22 bp, Homo sapiens
ccctgggataccagacaccaga

SEQ ID NO: 7537452 - DNA, 22 bp, Homo sapiens
ccctggtcagggaaggcgcctg

SEQ ID NO: 7537453 - DNA, 22 bp, Homo sapiens
ccctggtcagggaaggcgcctg

SEQ ID NO: 7537454 - DNA, 22 bp, Homo sapiens
ccctgggttctggctgggctgc

SEQ ID NO: 7537455 - DNA, 22 bp, Homo sapiens
ccctggtcagggaaggcgcctg

SEQ ID NO: 7537456 - DNA, 22 bp, Homo sapiens
ccctggtggtacggcactggca

SEQ ID NO: 7537457 - DNA, 22 bp, Homo sapiens
ccctggtggggccagacttgct

SEQ ID NO: 7537458 - DNA, 22 bp, Homo sapiens
ccctggtggggccagacttgct

SEQ ID NO: 7537459 - DNA, 22 bp, Homo sapiens
ccctggtggggccagacttgct

SEQ ID NO: 7537460 - DNA, 22 bp, Homo sapiens
ccctggtggggccagacttgct

SEQ ID NO: 7537461 - DNA, 22 bp, Homo sapiens
ccctggtgccctgggtcagcct

SEQ ID NO: 7537462 - DNA, 22 bp, Homo sapiens
ccctggtgccctgggtcagcct

SEQ ID NO: 7537463 - DNA, 22 bp, Homo sapiens
ccctggtcagggaaggcgcctg

SEQ ID NO: 7537464 - DNA, 22 bp, Homo sapiens
ccctggtgccctgggtcagcct

SEQ ID NO: 7537465 - DNA, 22 bp, Homo sapiens
ccctggtgccctgggtcagcct

SEQ ID NO: 7537466 - DNA, 22 bp, Homo sapiens
ccctggtcagggaaggcgcctg

SEQ ID NO: 7537467 - DNA, 20 bp, Homo sapiens
ccctgtgattggcaagtgtc

SEQ ID NO: 7537468 - DNA, 20 bp, Homo sapiens
ccctgtgattggcaagtgtc

SEQ ID NO: 7537469 - DNA, 22 bp, Homo sapiens
ccctgtgatgtagctagagtag

SEQ ID NO: 7537470 - DNA, 22 bp, Homo sapiens
ccctgtgcacacacttcactct

SEQ ID NO: 7537471 - DNA, 22 bp, Homo sapiens
ccctgtgatgtagctagagtag

SEQ ID NO: 7537472 - DNA, 20 bp, Homo sapiens
ccctgtgattggcaagtgtc

SEQ ID NO: 7537473 - DNA, 22 bp, Homo sapiens
ccctgtgacgagcacggccagt

SEQ ID NO: 7537474 - DNA, 22 bp, Homo sapiens
ccctgtgacgagcacggccagt

SEQ ID NO: 7537475 - DNA, 22 bp, Homo sapiens
ccctgtgagcggctggatgcct

SEQ ID NO: 7537476 - DNA, 22 bp, Homo sapiens
ccctgtgatgtagctagagtag

SEQ ID NO: 7537477 - DNA, 22 bp, Homo sapiens
ccctgtgagtagggactggtgg

SEQ ID NO: 7537478 - DNA, 22 bp, Homo sapiens
ccctgtgcatattgccagatac

SEQ ID NO: 7537479 - DNA, 20 bp, Homo sapiens
ccctgtgattggcaagtgtc

SEQ ID NO: 7537480 - DNA, 22 bp, Homo sapiens
ccctgtgcagatggcagctggg

SEQ ID NO: 7537481 - DNA, 22 bp, Homo sapiens
ccctgtgcatattgccagatac

SEQ ID NO: 7537482 - DNA, 22 bp, Homo sapiens
ccctgtgcattggagggtgttt

SEQ ID NO: 7537483 - DNA, 22 bp, Homo sapiens
ccctgtgcacacacttcactct

SEQ ID NO: 7537484 - DNA, 22 bp, Homo sapiens
ccctgtgcacacacttcactct

SEQ ID NO: 7537485 - DNA, 22 bp, Homo sapiens
ccctgtgcacacacttcactct

SEQ ID NO: 7537486 - DNA, 22 bp, Homo sapiens
ccctgtgcagatggcagctggg

SEQ ID NO: 7537487 - DNA, 22 bp, Homo sapiens
ccctgtgcagatggcagctggg

SEQ ID NO: 7537488 - DNA, 22 bp, Homo sapiens
ccctgtgcagatggcagctggg

SEQ ID NO: 7537489 - DNA, 22 bp, Homo sapiens
ccctgtgcagatggcagctggg

SEQ ID NO: 7537490 - DNA, 22 bp, Homo sapiens
ccctgtggaggaggagagcagt

SEQ ID NO: 7537491 - DNA, 22 bp, Homo sapiens
ccctgtgctgtcatgctgggcg

SEQ ID NO: 7537492 - DNA, 22 bp, Homo sapiens
ccctgtggaggaggagagcagt

SEQ ID NO: 7537493 - DNA, 22 bp, Homo sapiens
ccctgtggaggaggagagcagt

SEQ ID NO: 7537494 - DNA, 22 bp, Homo sapiens
ccctgtggaggcagcatcctgc

SEQ ID NO: 7537495 - DNA, 22 bp, Homo sapiens
ccctgtggaggaggagagcagt

SEQ ID NO: 7537496 - DNA, 22 bp, Homo sapiens
ccctgtggaggaggagagcagt

SEQ ID NO: 7537497 - DNA, 22 bp, Homo sapiens
ccctgtggaggcagcatcctgc

SEQ ID NO: 7537498 - DNA, 22 bp, Homo sapiens
ccctgtggaggcagcatcctgc

SEQ ID NO: 7537499 - DNA, 22 bp, Homo sapiens
ccctgtggaggcagcatcctgc

SEQ ID NO: 7537500 - DNA, 22 bp, Homo sapiens
ccctgtgcctagttggcctaaa

SEQ ID NO: 7537501 - DNA, 22 bp, Homo sapiens
ccctgtgcctagttggcctaaa

SEQ ID NO: 7537502 - DNA, 22 bp, Homo sapiens
ccctgtgcctagttggcctaaa

SEQ ID NO: 7537503 - DNA, 22 bp, Homo sapiens
ccctgtgccagagaggcaggag

SEQ ID NO: 7537504 - DNA, 22 bp, Homo sapiens
ccctgtgccagagaggcaggag

SEQ ID NO: 7537505 - DNA, 22 bp, Homo sapiens
ccctgtgccagagaggcaggag

SEQ ID NO: 7537506 - DNA, 22 bp, Homo sapiens
ccctgtgccagagaggcaggag

SEQ ID NO: 7537507 - DNA, 22 bp, Homo sapiens
ccctgtgccagagaggcaggag

SEQ ID NO: 7537508 - DNA, 22 bp, Homo sapiens
ccctgtgcctagttggcctaaa

SEQ ID NO: 7537509 - DNA, 22 bp, Homo sapiens
ccctgtgcctcagtttcctcat

SEQ ID NO: 7537510 - DNA, 22 bp, Homo sapiens
ccctgtgcctcagtttcctcat

SEQ ID NO: 7537511 - DNA, 22 bp, Homo sapiens
ccctgtgcctagttggcctaaa

SEQ ID NO: 7537512 - DNA, 22 bp, Homo sapiens
ccctgtgctgtcatgctgggcg

SEQ ID NO: 7537513 - DNA, 22 bp, Homo sapiens
ccctgtgctgtcatgctgggcg

SEQ ID NO: 7537514 - DNA, 22 bp, Homo sapiens
ccctgtggatttcagtttgtgt

SEQ ID NO: 7537515 - DNA, 22 bp, Homo sapiens
ccctgtggaggcagcatcctgc

SEQ ID NO: 7537516 - DNA, 22 bp, Homo sapiens
ccctgtggatttcagtttgtgt

SEQ ID NO: 7537517 - DNA, 22 bp, Homo sapiens
ccctgtggatttcagtttgtgt

SEQ ID NO: 7537518 - DNA, 22 bp, Homo sapiens
ccctgtggcaggaggaggagca

SEQ ID NO: 7537519 - DNA, 22 bp, Homo sapiens
ccctgtggatttcagtttgtgt

SEQ ID NO: 7537520 - DNA, 22 bp, Homo sapiens
ccctgtggatttcagtttgtgt

SEQ ID NO: 7537521 - DNA, 22 bp, Homo sapiens
ccctgtgggaactcctgagttg

SEQ ID NO: 7537522 - DNA, 22 bp, Homo sapiens
ccctgtggcaggaggaggagca

SEQ ID NO: 7537523 - DNA, 22 bp, Homo sapiens
ccctgtggcaggaggaggagca

SEQ ID NO: 7537524 - DNA, 22 bp, Homo sapiens
ccctgtgggaactcctgagttg

SEQ ID NO: 7537525 - DNA, 22 bp, Homo sapiens
ccctgtggcaggaggaggagca

SEQ ID NO: 7537526 - DNA, 22 bp, Homo sapiens
ccctgtggcaggaggaggagca

SEQ ID NO: 7537527 - DNA, 22 bp, Homo sapiens
ccctgtggcaggaggaggagca

SEQ ID NO: 7537528 - DNA, 22 bp, Homo sapiens
ccctttccatggctctcctagg

SEQ ID NO: 7537529 - DNA, 22 bp, Homo sapiens
ccctttccatggctctcctagg

SEQ ID NO: 7537530 - DNA, 22 bp, Homo sapiens
ccgcgaggtggaggttgcagtg

SEQ ID NO: 7537531 - DNA, 22 bp, Homo sapiens
ccgcgccacccattcccactga

SEQ ID NO: 7537532 - DNA, 22 bp, Homo sapiens
ccgcgcgcgtgggcgtccaggg

SEQ ID NO: 7537533 - DNA, 22 bp, Homo sapiens
ccgcggggcgtgggctcttacc

SEQ ID NO: 7537534 - DNA, 22 bp, Homo sapiens
ccctttcattggcagagctctc

SEQ ID NO: 7537535 - DNA, 22 bp, Homo sapiens
ccctgtgggaactcctgagttg

SEQ ID NO: 7537536 - DNA, 22 bp, Homo sapiens
ccgcggggcgtgggctcttacc

SEQ ID NO: 7537537 - DNA, 22 bp, Homo sapiens
ccgcttggatggggggtccaga

SEQ ID NO: 7537538 - DNA, 22 bp, Homo sapiens
ccgctgtcctggagctgctgct

SEQ ID NO: 7537539 - DNA, 22 bp, Homo sapiens
ccgctaggcctccggtcgcgca

SEQ ID NO: 7537540 - DNA, 22 bp, Homo sapiens
ccgctcctgaagagcctccccg

SEQ ID NO: 7537541 - DNA, 22 bp, Homo sapiens
ccgctcctgaagagcctccccg

SEQ ID NO: 7537542 - DNA, 22 bp, Homo sapiens
ccggagtgtctggcctgctggg

SEQ ID NO: 7537543 - DNA, 22 bp, Homo sapiens
ccggagtgtctggcctgctggg

SEQ ID NO: 7537544 - DNA, 22 bp, Homo sapiens
ccggagagtcagagcgcggccc

SEQ ID NO: 7537545 - DNA, 22 bp, Homo sapiens
ccggaggaggacgagcccgcgg

SEQ ID NO: 7537546 - DNA, 22 bp, Homo sapiens
ccggagagtcagagcgcggccc

SEQ ID NO: 7537547 - DNA, 22 bp, Homo sapiens
ccggagagtcagagcgcggccc

SEQ ID NO: 7537548 - DNA, 22 bp, Homo sapiens
ccggagaaactggcaaacccta

SEQ ID NO: 7537549 - DNA, 22 bp, Homo sapiens
ccggctactcgggaggctgacg

SEQ ID NO: 7537550 - DNA, 22 bp, Homo sapiens
ccggctactcgggaggctgacg

SEQ ID NO: 7537551 - DNA, 22 bp, Homo sapiens
ccggcgggcgcggtgacgtcag

SEQ ID NO: 7537552 - DNA, 22 bp, Homo sapiens
ccggctactcgggaggctgacg

SEQ ID NO: 7537553 - DNA, 22 bp, Homo sapiens
ccggcgaccgctgtcggaggcg

SEQ ID NO: 7537554 - DNA, 22 bp, Homo sapiens
ccggcgccttcacggggcttag

SEQ ID NO: 7537555 - DNA, 22 bp, Homo sapiens
ccggcgggcagcggcagtgagc

SEQ ID NO: 7537556 - DNA, 22 bp, Homo sapiens
ccggagtgtctggcctgctggg

SEQ ID NO: 7537557 - DNA, 22 bp, Homo sapiens
ccggcaaaggccccttccccag

SEQ ID NO: 7537558 - DNA, 22 bp, Homo sapiens
cctcagctgcttccctggagcc

SEQ ID NO: 7537559 - DNA, 22 bp, Homo sapiens
cctcagctgtcttttccgaggt

SEQ ID NO: 7537560 - DNA, 22 bp, Homo sapiens
cctcagctgtcttttccgaggt

SEQ ID NO: 7537561 - DNA, 22 bp, Homo sapiens
cctcagctgcttccctggagcc

SEQ ID NO: 7537562 - DNA, 22 bp, Homo sapiens
cctcagctgcttccctggagcc

SEQ ID NO: 7537563 - DNA, 22 bp, Homo sapiens
tggcctggggacctgtgagacc

SEQ ID NO: 7537564 - DNA, 22 bp, Homo sapiens
tggcctgggtcacaccagggtc

SEQ ID NO: 7537565 - DNA, 22 bp, Homo sapiens
tggctaacaaggtgaaaccccg

SEQ ID NO: 7537566 - DNA, 22 bp, Homo sapiens
tggctaacaaggtgaaaccccg

SEQ ID NO: 7537567 - DNA, 22 bp, Homo sapiens
tggcctgggtcacaccagggtc

SEQ ID NO: 7537568 - DNA, 22 bp, Homo sapiens
tggctaacaaggtgaaaccccg

SEQ ID NO: 7537569 - DNA, 22 bp, Homo sapiens
cctcagctgcttccctggagcc

SEQ ID NO: 7537570 - DNA, 22 bp, Homo sapiens
cctcagctgcttccctggagcc

SEQ ID NO: 7537571 - DNA, 22 bp, Homo sapiens
cctcagctgcttccctggagcc

SEQ ID NO: 7537572 - DNA, 22 bp, Homo sapiens
cctcagctgcttccctggagcc

SEQ ID NO: 7537573 - DNA, 22 bp, Homo sapiens
cctcagctgctgcacagctttt

SEQ ID NO: 7537574 - DNA, 22 bp, Homo sapiens
cctcagctgctgcacagctttt

SEQ ID NO: 7537575 - DNA, 22 bp, Homo sapiens
cctcagctgctgcacagctttt

SEQ ID NO: 7537576 - DNA, 22 bp, Homo sapiens
cctcagccttggccccaggcag

SEQ ID NO: 7537577 - DNA, 22 bp, Homo sapiens
cctcagccttggccccaggcag

SEQ ID NO: 7537578 - DNA, 22 bp, Homo sapiens
cctcagctcccatgagatctgc

SEQ ID NO: 7537579 - DNA, 22 bp, Homo sapiens
cctcagctcccatgagatctgc

SEQ ID NO: 7537580 - DNA, 22 bp, Homo sapiens
cctcagctcccatgagatctgc

SEQ ID NO: 7537581 - DNA, 22 bp, Homo sapiens
cctcagctcttccctgtgcaca

SEQ ID NO: 7537582 - DNA, 22 bp, Homo sapiens
cctcagctcttccctgtgcaca

SEQ ID NO: 7537583 - DNA, 22 bp, Homo sapiens
cctcagctcttccctgtgcaca

SEQ ID NO: 7537584 - DNA, 22 bp, Homo sapiens
cctcagctcttccctgtgcaca

SEQ ID NO: 7537585 - DNA, 22 bp, Homo sapiens
cctcagctgctgcacagctttt

SEQ ID NO: 7537586 - DNA, 22 bp, Homo sapiens
cctcagctcttccctgtgcaca

SEQ ID NO: 7537587 - DNA, 23 bp, Homo sapiens
tggcctctccccacctggcagaa

SEQ ID NO: 7537588 - DNA, 23 bp, Homo sapiens
tggcctctccccacctggcagaa

SEQ ID NO: 7537589 - DNA, 23 bp, Homo sapiens
tggcctctccccacctggcagaa

SEQ ID NO: 7537590 - DNA, 22 bp, Homo sapiens
tggcctctcctggcagcatcca

SEQ ID NO: 7537591 - DNA, 23 bp, Homo sapiens
tggcctctccccacctggcagaa

SEQ ID NO: 7537592 - DNA, 22 bp, Homo sapiens
tggcctctctaccaggcagcct

SEQ ID NO: 7537593 - DNA, 22 bp, Homo sapiens
tggcctctcctggctgagtttc

SEQ ID NO: 7537594 - DNA, 22 bp, Homo sapiens
tggcctctcctggcagcatcca

SEQ ID NO: 7537595 - DNA, 22 bp, Homo sapiens
tggcctctcctggcagcatcca

SEQ ID NO: 7537596 - DNA, 22 bp, Homo sapiens
tggcctcggcatccagcaagag

SEQ ID NO: 7537597 - DNA, 22 bp, Homo sapiens
tggcctcggcatccagcaagag

SEQ ID NO: 7537598 - DNA, 22 bp, Homo sapiens
tggcctcggcatccagcaagag

SEQ ID NO: 7537599 - DNA, 22 bp, Homo sapiens
tggcctcggcatccagcaagag

SEQ ID NO: 7537600 - DNA, 22 bp, Homo sapiens
tggcctcggcatccagcaagag

SEQ ID NO: 7537601 - DNA, 22 bp, Homo sapiens
tggcctcctcgggctgaccctg

SEQ ID NO: 7537602 - DNA, 22 bp, Homo sapiens
tggcctcccctaacagcctctt

SEQ ID NO: 7537603 - DNA, 22 bp, Homo sapiens
tggcctcggcatccagcaagag

SEQ ID NO: 7537604 - DNA, 22 bp, Homo sapiens
tggcctcggcatccagcaagag

SEQ ID NO: 7537605 - DNA, 22 bp, Homo sapiens
tggcctcggcatccagcaagag

SEQ ID NO: 7537606 - DNA, 22 bp, Homo sapiens
tggcctcggcatccagcaagag

SEQ ID NO: 7537607 - DNA, 22 bp, Homo sapiens
tggcctcggcatccagcaagag

SEQ ID NO: 7537608 - DNA, 22 bp, Homo sapiens
cctcagccttggccccaggcag

SEQ ID NO: 7537609 - DNA, 22 bp, Homo sapiens
cctcagccttggccccaggcag

SEQ ID NO: 7537610 - DNA, 22 bp, Homo sapiens
cctcagccttggccccaggcag

SEQ ID NO: 7537611 - DNA, 22 bp, Homo sapiens
cctcagccttggccccaggcag

SEQ ID NO: 7537612 - DNA, 22 bp, Homo sapiens
cctcagccttggccccaggcag

SEQ ID NO: 7537613 - DNA, 22 bp, Homo sapiens
cctcagccttggccccaggcag

SEQ ID NO: 7537614 - DNA, 23 bp, Homo sapiens
cctcagcatggcaggagcccagc

SEQ ID NO: 7537615 - DNA, 22 bp, Homo sapiens
cctcagcccctgaatggagaga

SEQ ID NO: 7537616 - DNA, 22 bp, Homo sapiens
cctcagcccctgaatggagaga

SEQ ID NO: 7537617 - DNA, 22 bp, Homo sapiens
tggcctctcctggctgagtttc

SEQ ID NO: 7537618 - DNA, 22 bp, Homo sapiens
cctcagcatcctggtgaagtag

SEQ ID NO: 7537619 - DNA, 23 bp, Homo sapiens
cctcagcatggcaggagcccagc

SEQ ID NO: 7537620 - DNA, 22 bp, Homo sapiens
cctcagcatcctggtgaagtag

SEQ ID NO: 7537621 - DNA, 23 bp, Homo sapiens
cctcagcatggcaggagcccagc

SEQ ID NO: 7537622 - DNA, 22 bp, Homo sapiens
cctcagcccctgaatggagaga

SEQ ID NO: 7537623 - DNA, 23 bp, Homo sapiens
cctcagcatggcaggagcccagc

SEQ ID NO: 7537624 - DNA, 22 bp, Homo sapiens
tggcctcaatctgtcctccagc

SEQ ID NO: 7537625 - DNA, 22 bp, Homo sapiens
tggcctcaagtctgagggcctt

SEQ ID NO: 7537626 - DNA, 22 bp, Homo sapiens
tggcctcaatctgtcctccagc

SEQ ID NO: 7537627 - DNA, 22 bp, Homo sapiens
tggcctcaatctgtcctccagc

SEQ ID NO: 7537628 - DNA, 22 bp, Homo sapiens
tggcctcaatctgtcctccagc

SEQ ID NO: 7537629 - DNA, 22 bp, Homo sapiens
tggcctcaaccgtcctaagcac

SEQ ID NO: 7537630 - DNA, 22 bp, Homo sapiens
tggcctcaagtctgagggcctt

SEQ ID NO: 7537631 - DNA, 22 bp, Homo sapiens
tggcctcaagtctgagggcctt

SEQ ID NO: 7537632 - DNA, 22 bp, Homo sapiens
tggcctcaagtctgagggcctt

SEQ ID NO: 7537633 - DNA, 21 bp, Homo sapiens
tggccctggccacggctgcca

SEQ ID NO: 7537634 - DNA, 22 bp, Homo sapiens
tggcctcaaccgtcctaagcac

SEQ ID NO: 7537635 - DNA, 21 bp, Homo sapiens
tggccctggccacggctgcca

SEQ ID NO: 7537636 - DNA, 21 bp, Homo sapiens
tggccctggccacggctgcca

SEQ ID NO: 7537637 - DNA, 21 bp, Homo sapiens
tggccctggccacggctgcca

SEQ ID NO: 7537638 - DNA, 21 bp, Homo sapiens
tggccctggccacggctgcca

SEQ ID NO: 7537639 - DNA, 22 bp, Homo sapiens
tggccctgcttatgtctctctt

SEQ ID NO: 7537640 - DNA, 22 bp, Homo sapiens
cctcagaagctcaaggacattg

SEQ ID NO: 7537641 - DNA, 22 bp, Homo sapiens
cctcagaagctcaaggacattg

SEQ ID NO: 7537642 - DNA, 22 bp, Homo sapiens
tggcctcccctaacagcctctt

SEQ ID NO: 7537643 - DNA, 22 bp, Homo sapiens
tggcctcccctaacagcctctt

SEQ ID NO: 7537644 - DNA, 22 bp, Homo sapiens
tggcctcccctaacagcctctt

SEQ ID NO: 7537645 - DNA, 22 bp, Homo sapiens
tggcctcatttggaaatagggc

SEQ ID NO: 7537646 - DNA, 22 bp, Homo sapiens
tggcctcatttggaaatagggc

SEQ ID NO: 7537647 - DNA, 22 bp, Homo sapiens
tggcctcagatttcaggggtgg

SEQ ID NO: 7537648 - DNA, 22 bp, Homo sapiens
tggcctcatttggaaatagggc

SEQ ID NO: 7537649 - DNA, 21 bp, Homo sapiens
tggcctcccacacttccatgg

SEQ ID NO: 7537650 - DNA, 22 bp, Homo sapiens
tggcctcagattattgcacagt

SEQ ID NO: 7537651 - DNA, 22 bp, Homo sapiens
tggcctcagattattgcacagt

SEQ ID NO: 7537652 - DNA, 22 bp, Homo sapiens
tggcctcagatttcaggggtgg

SEQ ID NO: 7537653 - DNA, 22 bp, Homo sapiens
tggcctcagattattgcacagt

SEQ ID NO: 7537654 - DNA, 22 bp, Homo sapiens
tggcctcaccactagctgggtg

SEQ ID NO: 7537655 - DNA, 22 bp, Homo sapiens
tggcctcaatctgtcctccagc

SEQ ID NO: 7537656 - DNA, 22 bp, Homo sapiens
tggcctcaccactagctgggtg

SEQ ID NO: 7537657 - DNA, 22 bp, Homo sapiens
tggcctcaccactagctgggtg

SEQ ID NO: 7537658 - DNA, 22 bp, Homo sapiens
tggcctcaccactagctgggtg

SEQ ID NO: 7537659 - DNA, 22 bp, Homo sapiens
tggcctcaccactagctgggtg

SEQ ID NO: 7537660 - DNA, 22 bp, Homo sapiens
cctcagaagactttagggaaga

SEQ ID NO: 7537661 - DNA, 22 bp, Homo sapiens
cctcagaagaagtggaattgat

SEQ ID NO: 7537662 - DNA, 22 bp, Homo sapiens
cctcagaagctcaaggacattg

SEQ ID NO: 7537663 - DNA, 22 bp, Homo sapiens
cctcagaagactttagggaaga

SEQ ID NO: 7537664 - DNA, 22 bp, Homo sapiens
cctcagaagactttagggaaga

SEQ ID NO: 7537665 - DNA, 22 bp, Homo sapiens
cctcagaacggaaatggttttg

SEQ ID NO: 7537666 - DNA, 22 bp, Homo sapiens
cctcactgtcacttatagtggt

SEQ ID NO: 7537667 - DNA, 22 bp, Homo sapiens
cctcactgtcacttatagtggt

SEQ ID NO: 7537668 - DNA, 22 bp, Homo sapiens
cctcactgtcatcagtagttat

SEQ ID NO: 7537669 - DNA, 22 bp, Homo sapiens
cctcagaagaagtggaattgat

SEQ ID NO: 7537670 - DNA, 22 bp, Homo sapiens
cctcactgaagaggtgacattt

SEQ ID NO: 7537671 - DNA, 22 bp, Homo sapiens
cctcactgctatgtgtttgctc

SEQ ID NO: 7537672 - DNA, 22 bp, Homo sapiens
cctcactggccagccaggggtg

SEQ ID NO: 7537673 - DNA, 22 bp, Homo sapiens
cctcactgtcacttatagtggt

SEQ ID NO: 7537674 - DNA, 22 bp, Homo sapiens
cctcactgtcatcagtagttat

SEQ ID NO: 7537675 - DNA, 22 bp, Homo sapiens
cctcactgctatgtgtttgctc

SEQ ID NO: 7537676 - DNA, 22 bp, Homo sapiens
cctcactggccagccaggggtg

SEQ ID NO: 7537677 - DNA, 22 bp, Homo sapiens
cctcacctcagtctgggcctca

SEQ ID NO: 7537678 - DNA, 22 bp, Homo sapiens
cctcacctcagtctgggcctca

SEQ ID NO: 7537679 - DNA, 19 bp, Homo sapiens
cctcaccctgcagaggagg

SEQ ID NO: 7537680 - DNA, 22 bp, Homo sapiens
cctcaccttttctctgattgct

SEQ ID NO: 7537681 - DNA, 19 bp, Homo sapiens
cctcaccctgcagaggagg

SEQ ID NO: 7537682 - DNA, 19 bp, Homo sapiens
cctcaccctgcagaggagg

SEQ ID NO: 7537683 - DNA, 19 bp, Homo sapiens
cctcaccctgcagaggagg

SEQ ID NO: 7537684 - DNA, 19 bp, Homo sapiens
cctcaccctgcagaggagg

SEQ ID NO: 7537685 - DNA, 22 bp, Homo sapiens
cctcactctgcaccctgcagca

SEQ ID NO: 7537686 - DNA, 22 bp, Homo sapiens
cctcactctgcaccctgcagca

SEQ ID NO: 7537687 - DNA, 22 bp, Homo sapiens
cctcactgaagaggtgacattt

SEQ ID NO: 7537688 - DNA, 22 bp, Homo sapiens
cctcactcttgtcctggcaggt

SEQ ID NO: 7537689 - DNA, 22 bp, Homo sapiens
cctcactcttgtcctggcaggt

SEQ ID NO: 7537690 - DNA, 22 bp, Homo sapiens
cctcactcttgtcctggcaggt

SEQ ID NO: 7537691 - DNA, 22 bp, Homo sapiens
tggctacagcaagaggaaagaa

SEQ ID NO: 7537692 - DNA, 22 bp, Homo sapiens
tggctacagcaagaggaaagaa

SEQ ID NO: 7537693 - DNA, 22 bp, Homo sapiens
tggctacagcaagaggaaagaa

SEQ ID NO: 7537694 - DNA, 22 bp, Homo sapiens
tggctacagcaagaggaaagaa

SEQ ID NO: 7537695 - DNA, 22 bp, Homo sapiens
tggctacagatttgctgacaat

SEQ ID NO: 7537696 - DNA, 22 bp, Homo sapiens
tggctacagatttgctgacaat

SEQ ID NO: 7537697 - DNA, 22 bp, Homo sapiens
tggctacagcttggccacagag

SEQ ID NO: 7537698 - DNA, 22 bp, Homo sapiens
tggctacagcttggccacagag

SEQ ID NO: 7537699 - DNA, 22 bp, Homo sapiens
tggctacagtggcatatcaaat

SEQ ID NO: 7537700 - DNA, 22 bp, Homo sapiens
tggctacagtggcatatcaaat

SEQ ID NO: 7537701 - DNA, 22 bp, Homo sapiens
tggctacagtggcatatcaaat

SEQ ID NO: 7537702 - DNA, 21 bp, Homo sapiens
tggctacagtggtaagaactg

SEQ ID NO: 7537703 - DNA, 21 bp, Homo sapiens
tggctacagtggtaagaactg

SEQ ID NO: 7537704 - DNA, 22 bp, Homo sapiens
tggctacagtggcatatcaaat

SEQ ID NO: 7537705 - DNA, 22 bp, Homo sapiens
tggctagaattgggttcacagg

SEQ ID NO: 7537706 - DNA, 23 bp, Homo sapiens
tggctagacaaatcatccaaggg

SEQ ID NO: 7537707 - DNA, 19 bp, Homo sapiens
tggctagaccgcggagcca

SEQ ID NO: 7537708 - DNA, 22 bp, Homo sapiens
tggctagaccgcggagccaaga

SEQ ID NO: 7537709 - DNA, 22 bp, Homo sapiens
tggctagaccgcggagccaaga

SEQ ID NO: 7537710 - DNA, 22 bp, Homo sapiens
tggctagactcggccagccaca

SEQ ID NO: 7537711 - DNA, 22 bp, Homo sapiens
tggctacctgatttcttttcag

SEQ ID NO: 7537712 - DNA, 22 bp, Homo sapiens
tggctacatttgttgatcactt

SEQ ID NO: 7537713 - DNA, 22 bp, Homo sapiens
tggctacatttgttgatcactt

SEQ ID NO: 7537714 - DNA, 22 bp, Homo sapiens
tggctacatcacagagaattcc

SEQ ID NO: 7537715 - DNA, 22 bp, Homo sapiens
tggctacatttatactctcatt

SEQ ID NO: 7537716 - DNA, 22 bp, Homo sapiens
tggctacatttatactctcatt

SEQ ID NO: 7537717 - DNA, 22 bp, Homo sapiens
tggctaacaaggtgaaaccccg

SEQ ID NO: 7537718 - DNA, 22 bp, Homo sapiens
tggctaagaattggcagctgct

SEQ ID NO: 7537719 - DNA, 22 bp, Homo sapiens
tggctaacaaggtgaaaccccg

SEQ ID NO: 7537720 - DNA, 22 bp, Homo sapiens
tggctaacagttaagatttcat

SEQ ID NO: 7537721 - DNA, 22 bp, Homo sapiens
tggctaacaaggtgaaaccccg

SEQ ID NO: 7537722 - DNA, 22 bp, Homo sapiens
tggctaagctggggaggcctgg

SEQ ID NO: 7537723 - DNA, 22 bp, Homo sapiens
tggctaaggggaacaggcttag

SEQ ID NO: 7537724 - DNA, 22 bp, Homo sapiens
tggctaagaattggcagctgct

SEQ ID NO: 7537725 - DNA, 22 bp, Homo sapiens
tggctaagatttaaatgtttgc

SEQ ID NO: 7537726 - DNA, 22 bp, Homo sapiens
tggctaagcatgctccagctgc

SEQ ID NO: 7537727 - DNA, 22 bp, Homo sapiens
tggctacaagtgtgtttagttt

SEQ ID NO: 7537728 - DNA, 22 bp, Homo sapiens
tggctacaagtgtgtttagttt

SEQ ID NO: 7537729 - DNA, 22 bp, Homo sapiens
tggctacagaatgaatgctgcc

SEQ ID NO: 7537730 - DNA, 22 bp, Homo sapiens
tggctacagaatgaatgctgcc

SEQ ID NO: 7537731 - DNA, 22 bp, Homo sapiens
tggctacagaatgaatgctgcc

SEQ ID NO: 7537732 - DNA, 22 bp, Homo sapiens
tggctacagaattggccctgtt

SEQ ID NO: 7537733 - DNA, 22 bp, Homo sapiens
tggctacagaattggccctgtt

SEQ ID NO: 7537734 - DNA, 22 bp, Homo sapiens
tggctacagacattcctaggga

SEQ ID NO: 7537735 - DNA, 22 bp, Homo sapiens
tggctacagacattcctaggga

SEQ ID NO: 7537736 - DNA, 22 bp, Homo sapiens
tggctaggctggtgtcaagctc

SEQ ID NO: 7537737 - DNA, 22 bp, Homo sapiens
tggctaggctggtgtcaagctc

SEQ ID NO: 7537738 - DNA, 22 bp, Homo sapiens
tggctcagccagccctaggaac

SEQ ID NO: 7537739 - DNA, 22 bp, Homo sapiens
tggctaggctccaagagctgga

SEQ ID NO: 7537740 - DNA, 22 bp, Homo sapiens
tggctaggacctctgcggagca

SEQ ID NO: 7537741 - DNA, 22 bp, Homo sapiens
tggctaggacctctgcggagca

SEQ ID NO: 7537742 - DNA, 22 bp, Homo sapiens
tggctagctgtgggctggaagc

SEQ ID NO: 7537743 - DNA, 23 bp, Homo sapiens
tggctagctgaagaggtatgggt

SEQ ID NO: 7537744 - DNA, 22 bp, Homo sapiens
tggctaggaatccatgactctc

SEQ ID NO: 7537745 - DNA, 20 bp, Homo sapiens
tggctagcattaaaatgact

SEQ ID NO: 7537746 - DNA, 20 bp, Homo sapiens
tggctagcattaaaatgact

SEQ ID NO: 7537747 - DNA, 22 bp, Homo sapiens
tggctagcccttgtggggagag

SEQ ID NO: 7537748 - DNA, 22 bp, Homo sapiens
tggctagccgaggggtgggccc

SEQ ID NO: 7537749 - DNA, 22 bp, Homo sapiens
tggctagataactagaatttca

SEQ ID NO: 7537750 - DNA, 22 bp, Homo sapiens
tggctagagaactttgaagtag

SEQ ID NO: 7537751 - DNA, 22 bp, Homo sapiens
tggctagataactagaatttca

SEQ ID NO: 7537752 - DNA, 22 bp, Homo sapiens
tggctagatggcagaaagctgg

SEQ ID NO: 7537753 - DNA, 22 bp, Homo sapiens
tggctagatttattgctgagca

SEQ ID NO: 7537754 - DNA, 22 bp, Homo sapiens
tggctagatttattgctgagca

SEQ ID NO: 7537755 - DNA, 22 bp, Homo sapiens
tggctagatttattgctgagca

SEQ ID NO: 7537756 - DNA, 22 bp, Homo sapiens
tggctagcaactcaactgttaa

SEQ ID NO: 7537757 - DNA, 22 bp, Homo sapiens
tggctagcactctacctttctc

SEQ ID NO: 7537758 - DNA, 22 bp, Homo sapiens
tggctcagcgcggcctggtctt

SEQ ID NO: 7537759 - DNA, 22 bp, Homo sapiens
tggctcagcgcggcctggtctt

SEQ ID NO: 7537760 - DNA, 22 bp, Homo sapiens
tggctcagcgcggcctggtctt

SEQ ID NO: 7537761 - DNA, 22 bp, Homo sapiens
tggctcagcgcggcctggtctt

SEQ ID NO: 7537762 - DNA, 22 bp, Homo sapiens
tggctcagcctggccctttcat

SEQ ID NO: 7537763 - DNA, 22 bp, Homo sapiens
tggctcagcctggccctttcat

SEQ ID NO: 7537764 - DNA, 22 bp, Homo sapiens
tggctcagcgcggcctggtctt

SEQ ID NO: 7537765 - DNA, 22 bp, Homo sapiens
tggctcagcgcggcctggtctt

SEQ ID NO: 7537766 - DNA, 22 bp, Homo sapiens
tggctcagcgcggcctggtctt

SEQ ID NO: 7537767 - DNA, 22 bp, Homo sapiens
tggctcagcctggccctttcat

SEQ ID NO: 7537768 - DNA, 22 bp, Homo sapiens
tggctcagccattcgtgttgcc

SEQ ID NO: 7537769 - DNA, 22 bp, Homo sapiens
tggctcagccattcgtgttgcc

SEQ ID NO: 7537770 - DNA, 22 bp, Homo sapiens
tggctcagccattcgtgttgcc

SEQ ID NO: 7537771 - DNA, 22 bp, Homo sapiens
tggctcagccattcgtgttgcc

SEQ ID NO: 7537772 - DNA, 23 bp, Homo sapiens
cctccccttcccacagctgggtg

SEQ ID NO: 7537773 - DNA, 23 bp, Homo sapiens
cctccccttcccacagctgggtg

SEQ ID NO: 7537774 - DNA, 23 bp, Homo sapiens
cctccccttcccacagctgggtg

SEQ ID NO: 7537775 - DNA, 22 bp, Homo sapiens
cctcccctgctcagaactctgg

SEQ ID NO: 7537776 - DNA, 22 bp, Homo sapiens
cctcccctgctcagaactctgg

SEQ ID NO: 7537777 - DNA, 19 bp, Homo sapiens
cctccccttggaccagcaa

SEQ ID NO: 7537778 - DNA, 19 bp, Homo sapiens
cctccccttggaccagcaa

SEQ ID NO: 7537779 - DNA, 19 bp, Homo sapiens
cctccccttggaccagcaa

SEQ ID NO: 7537780 - DNA, 19 bp, Homo sapiens
cctccccttggaccagcaa

SEQ ID NO: 7537781 - DNA, 19 bp, Homo sapiens
cctccccttggaccagcaa

SEQ ID NO: 7537782 - DNA, 19 bp, Homo sapiens
cctccccttggaccagcaa

SEQ ID NO: 7537783 - DNA, 22 bp, Homo sapiens
cctcccggatcatgtcccgcac

SEQ ID NO: 7537784 - DNA, 19 bp, Homo sapiens
cctccccttggaccagcaa

SEQ ID NO: 7537785 - DNA, 19 bp, Homo sapiens
cctccccttggaccagcaa

SEQ ID NO: 7537786 - DNA, 22 bp, Homo sapiens
cctccctcagaatgaagaaagg

SEQ ID NO: 7537787 - DNA, 18 bp, Homo sapiens
cctccctcattttcccag

SEQ ID NO: 7537788 - DNA, 18 bp, Homo sapiens
cctccctcattttcccag

SEQ ID NO: 7537789 - DNA, 22 bp, Homo sapiens
cctccctcagaatgaagaaagg

SEQ ID NO: 7537790 - DNA, 22 bp, Homo sapiens
cctccctccattgccatcgtct

SEQ ID NO: 7537791 - DNA, 22 bp, Homo sapiens
cctccctccattgccatcgtct

SEQ ID NO: 7537792 - DNA, 22 bp, Homo sapiens
cctccctccattgccatcgtct

SEQ ID NO: 7537793 - DNA, 22 bp, Homo sapiens
cctccctcagaatgaagaaagg

SEQ ID NO: 7537794 - DNA, 18 bp, Homo sapiens
cctccctcattttcccag

SEQ ID NO: 7537795 - DNA, 22 bp, Homo sapiens
cctccctctgttagagctgtct

SEQ ID NO: 7537796 - DNA, 22 bp, Homo sapiens
cctccctctgttagagctgtct

SEQ ID NO: 7537797 - DNA, 22 bp, Homo sapiens
cctccctctgttagagctgtct

SEQ ID NO: 7537798 - DNA, 22 bp, Homo sapiens
cctccctctgttagagctgtct

SEQ ID NO: 7537799 - DNA, 22 bp, Homo sapiens
cctccctctgttagagctgtct

SEQ ID NO: 7537800 - DNA, 22 bp, Homo sapiens
cctccctctgttagagctgtct

SEQ ID NO: 7537801 - DNA, 22 bp, Homo sapiens
cctccctctttcagtcccacag

SEQ ID NO: 7537802 - DNA, 22 bp, Homo sapiens
cctccctctttcagtcccacag

SEQ ID NO: 7537803 - DNA, 22 bp, Homo sapiens
cctccctctgttagagctgtct

SEQ ID NO: 7537804 - DNA, 22 bp, Homo sapiens
cctccctctttcagtcccacag

SEQ ID NO: 7537805 - DNA, 22 bp, Homo sapiens
cctccctccctcttatggttta

SEQ ID NO: 7537806 - DNA, 22 bp, Homo sapiens
cctccctccctcttatggttta

SEQ ID NO: 7537807 - DNA, 22 bp, Homo sapiens
cctccctccctgcagaagccac

SEQ ID NO: 7537808 - DNA, 22 bp, Homo sapiens
cctccctccctgcagaagccac

SEQ ID NO: 7537809 - DNA, 22 bp, Homo sapiens
cctccctccctgcagaagccac

SEQ ID NO: 7537810 - DNA, 22 bp, Homo sapiens
cctccctccctgcagaagccac

SEQ ID NO: 7537811 - DNA, 22 bp, Homo sapiens
cctccctccctcttatggttta

SEQ ID NO: 7537812 - DNA, 22 bp, Homo sapiens
cctccctccctcttatggttta

SEQ ID NO: 7537813 - DNA, 22 bp, Homo sapiens
cctccctccctcttatggttta

SEQ ID NO: 7537814 - DNA, 22 bp, Homo sapiens
cctccctccattgccatcgtct

SEQ ID NO: 7537815 - DNA, 22 bp, Homo sapiens
cctccctccattgccatcgtct

SEQ ID NO: 7537816 - DNA, 18 bp, Homo sapiens
cctccctcattttcccag

SEQ ID NO: 7537817 - DNA, 22 bp, Homo sapiens
tggctcagcggtggcagcagac

SEQ ID NO: 7537818 - DNA, 22 bp, Homo sapiens
tggctcagcggtggcagcagac

SEQ ID NO: 7537819 - DNA, 22 bp, Homo sapiens
tggctcagcggtggcagcagac

SEQ ID NO: 7537820 - DNA, 22 bp, Homo sapiens
tggctcagcgcggcctggtctt

SEQ ID NO: 7537821 - DNA, 22 bp, Homo sapiens
tggctcagcgcggcctggtctt

SEQ ID NO: 7537822 - DNA, 22 bp, Homo sapiens
tggctcagcggtggcagcagac

SEQ ID NO: 7537823 - DNA, 23 bp, Homo sapiens
tggctcagctagttttccatttc

SEQ ID NO: 7537824 - DNA, 23 bp, Homo sapiens
tggctcagctagttttccatttc

SEQ ID NO: 7537825 - DNA, 23 bp, Homo sapiens
tggctcagctagttttccatttc

SEQ ID NO: 7537826 - DNA, 23 bp, Homo sapiens
tggctcagctagttttccatttc

SEQ ID NO: 7537827 - DNA, 22 bp, Homo sapiens
tggctcagcggtggcagcagac

SEQ ID NO: 7537828 - DNA, 22 bp, Homo sapiens
tggctcagcggtggcagcagac

SEQ ID NO: 7537829 - DNA, 22 bp, Homo sapiens
tggctcagcggtggcagcagac

SEQ ID NO: 7537830 - DNA, 22 bp, Homo sapiens
tggctcagcggtggcagcagac

SEQ ID NO: 7537831 - DNA, 22 bp, Homo sapiens
tggctcagcggtggcagcagac

SEQ ID NO: 7537832 - DNA, 22 bp, Homo sapiens
cctcccctcagacagagactgg

SEQ ID NO: 7537833 - DNA, 22 bp, Homo sapiens
cctcccctgctcagaactctgg

SEQ ID NO: 7537834 - DNA, 22 bp, Homo sapiens
cctcccctgctcagaactctgg

SEQ ID NO: 7537835 - DNA, 22 bp, Homo sapiens
cctcccctcagacagagactgg

SEQ ID NO: 7537836 - DNA, 22 bp, Homo sapiens
cctcccctcagacagagactgg

SEQ ID NO: 7537837 - DNA, 22 bp, Homo sapiens
cctcccctcagacagagactgg

SEQ ID NO: 7537838 - DNA, 22 bp, Homo sapiens
cctccccatgacccggtgctgg

SEQ ID NO: 7537839 - DNA, 22 bp, Homo sapiens
cctcccctcagacagagactgg

SEQ ID NO: 7537840 - DNA, 22 bp, Homo sapiens
cctccccatgacccggtgctgg

SEQ ID NO: 7537841 - DNA, 22 bp, Homo sapiens
cctcccagatgtgcccaatgga

SEQ ID NO: 7537842 - DNA, 22 bp, Homo sapiens
cctcccagatgtgcccaatgga

SEQ ID NO: 7537843 - DNA, 22 bp, Homo sapiens
tggctcagctgactcggcttct

SEQ ID NO: 7537844 - DNA, 22 bp, Homo sapiens
cctcccacttcttgctgaggtc

SEQ ID NO: 7537845 - DNA, 22 bp, Homo sapiens
cctcccaggcattgccattttc

SEQ ID NO: 7537846 - DNA, 22 bp, Homo sapiens
cctcccagatgtgcccaatgga

SEQ ID NO: 7537847 - DNA, 22 bp, Homo sapiens
cctcccaggcattgccattttc

SEQ ID NO: 7537848 - DNA, 22 bp, Homo sapiens
tgaacacatctgcgtgtgtctc

SEQ ID NO: 7537849 - DNA, 22 bp, Homo sapiens
tgaacacatttctggccaattt

SEQ ID NO: 7537850 - DNA, 22 bp, Homo sapiens
tgaacacatttgggaaaatctt

SEQ ID NO: 7537851 - DNA, 22 bp, Homo sapiens
tgaacacatttgggaaaatctt

SEQ ID NO: 7537852 - DNA, 22 bp, Homo sapiens
tgaacacattttcttcagtaga

SEQ ID NO: 7537853 - DNA, 22 bp, Homo sapiens
tgaacacattttcttcagtaga

SEQ ID NO: 7537854 - DNA, 22 bp, Homo sapiens
tgaacacattttcttcagtaga

SEQ ID NO: 7537855 - DNA, 22 bp, Homo sapiens
tgaacactgccatatttaagaa

SEQ ID NO: 7537856 - DNA, 22 bp, Homo sapiens
tgaacactctggggtgggaggt

SEQ ID NO: 7537857 - DNA, 22 bp, Homo sapiens
tgaacacgcttcatacagaggg

SEQ ID NO: 7537858 - DNA, 21 bp, Homo sapiens
tgaacactctacccatttttt

SEQ ID NO: 7537859 - DNA, 21 bp, Homo sapiens
tgaacactctacccatttttt

SEQ ID NO: 7537860 - DNA, 22 bp, Homo sapiens
tgaacactgtatattcttcttg

SEQ ID NO: 7537861 - DNA, 22 bp, Homo sapiens
tgaacactgtccagagccatta

SEQ ID NO: 7537862 - DNA, 22 bp, Homo sapiens
tgaacagactgacctctgacct

SEQ ID NO: 7537863 - DNA, 22 bp, Homo sapiens
tgaacactgtccagagccatta

SEQ ID NO: 7537864 - DNA, 22 bp, Homo sapiens
tgaacagactgacctctgacct

SEQ ID NO: 7537865 - DNA, 19 bp, Homo sapiens
tgaacagagaggactctgg

SEQ ID NO: 7537866 - DNA, 19 bp, Homo sapiens
tgaacagagaggactctgg

SEQ ID NO: 7537867 - DNA, 19 bp, Homo sapiens
tgaacagagaggactctgg

SEQ ID NO: 7537868 - DNA, 20 bp, Homo sapiens
tgaacactggggtgtttcag

SEQ ID NO: 7537869 - DNA, 22 bp, Homo sapiens
tgaacactgtatattcttcttg

SEQ ID NO: 7537870 - DNA, 22 bp, Homo sapiens
tgaacactgtatattcttcttg

SEQ ID NO: 7537871 - DNA, 20 bp, Homo sapiens
tgaacactggggtgtttcag

SEQ ID NO: 7537872 - DNA, 20 bp, Homo sapiens
tgaacactggggtgtttcag

SEQ ID NO: 7537873 - DNA, 22 bp, Homo sapiens
tgaacagatggcccagcagagg

SEQ ID NO: 7537874 - DNA, 22 bp, Homo sapiens
tgaacagatggcccagcagagg

SEQ ID NO: 7537875 - DNA, 22 bp, Homo sapiens
tgaacagatggcccagcagagg

SEQ ID NO: 7537876 - DNA, 22 bp, Homo sapiens
tgaacagatggcccagcagagg

SEQ ID NO: 7537877 - DNA, 22 bp, Homo sapiens
tgaacagctatcttgtcagtgt

SEQ ID NO: 7537878 - DNA, 22 bp, Homo sapiens
tgaacagatgtggaggtacctt

SEQ ID NO: 7537879 - DNA, 22 bp, Homo sapiens
tgaacagatgtggaggtacctt

SEQ ID NO: 7537880 - DNA, 22 bp, Homo sapiens
tgaacaggcattatcagggatc

SEQ ID NO: 7537881 - DNA, 22 bp, Homo sapiens
tgaacagctatcttgtcagtgt

SEQ ID NO: 7537882 - DNA, 18 bp, Homo sapiens
tgaacagatgagttgaag

SEQ ID NO: 7537883 - DNA, 18 bp, Homo sapiens
tgaacagatgagttgaag

SEQ ID NO: 7537884 - DNA, 18 bp, Homo sapiens
tgaacagatgagttgaag

SEQ ID NO: 7537885 - DNA, 22 bp, Homo sapiens
tgaacagatgccttctcccatg

SEQ ID NO: 7537886 - DNA, 22 bp, Homo sapiens
tgaacagatgccttctcccatg

SEQ ID NO: 7537887 - DNA, 22 bp, Homo sapiens
tgaacagatcaatagaactgac

SEQ ID NO: 7537888 - DNA, 22 bp, Homo sapiens
tgaacagatcaatagaactgac

SEQ ID NO: 7537889 - DNA, 22 bp, Homo sapiens
tgaacagatcaatagaactgac

SEQ ID NO: 7537890 - DNA, 22 bp, Homo sapiens
tgaacagagctgattcagctca

SEQ ID NO: 7537891 - DNA, 22 bp, Homo sapiens
tgaacagagctgattcagctca

SEQ ID NO: 7537892 - DNA, 22 bp, Homo sapiens
tgaacagatcaatagaactgac

SEQ ID NO: 7537893 - DNA, 22 bp, Homo sapiens
tgaagaggccaaactatcattg

SEQ ID NO: 7537894 - DNA, 22 bp, Homo sapiens
tgaagaggccaaactatcattg

SEQ ID NO: 7537895 - DNA, 20 bp, Homo sapiens
tgaagaggaagaggacggcc

SEQ ID NO: 7537896 - DNA, 22 bp, Homo sapiens
tgaagaggccgtgtgcaggtga

SEQ ID NO: 7537897 - DNA, 22 bp, Homo sapiens
tgaagaggccgtgtgcaggtga

SEQ ID NO: 7537898 - DNA, 22 bp, Homo sapiens
tgaagaggccaaactatcattg

SEQ ID NO: 7537899 - DNA, 20 bp, Homo sapiens
tgaagaggaagaggacggcc

SEQ ID NO: 7537900 - DNA, 22 bp, Homo sapiens
tgaagagattaagttggttttg

SEQ ID NO: 7537901 - DNA, 22 bp, Homo sapiens
tgaagagattaagttggttttg

SEQ ID NO: 7537902 - DNA, 19 bp, Homo sapiens
tgaagagctgtcaaaagtg

SEQ ID NO: 7537903 - DNA, 20 bp, Homo sapiens
tgaagaggaagaggacggcc

SEQ ID NO: 7537904 - DNA, 20 bp, Homo sapiens
tgaagagtgcgcacattgcc

SEQ ID NO: 7537905 - DNA, 20 bp, Homo sapiens
tgaagagtgcgcacattgcc

SEQ ID NO: 7537906 - DNA, 22 bp, Homo sapiens
tgaagagtgattcatgcagtca

SEQ ID NO: 7537907 - DNA, 22 bp, Homo sapiens
tgaagagtcatttcattcccag

SEQ ID NO: 7537908 - DNA, 22 bp, Homo sapiens
tgaagaggccgtgtgcaggtga

SEQ ID NO: 7537909 - DNA, 22 bp, Homo sapiens
tgaagagtattaggttatttga

SEQ ID NO: 7537910 - DNA, 22 bp, Homo sapiens
tgaagagtgtgactgcacctag

SEQ ID NO: 7537911 - DNA, 22 bp, Homo sapiens
tgaagagtgcttgagattttaa

SEQ ID NO: 7537912 - DNA, 22 bp, Homo sapiens
tgaagagttaattatgaggtgc

SEQ ID NO: 7537913 - DNA, 22 bp, Homo sapiens
tgaagagtgcttgagattttaa

SEQ ID NO: 7537914 - DNA, 20 bp, Homo sapiens
tgaagagtgcgcacattgcc

SEQ ID NO: 7537915 - DNA, 20 bp, Homo sapiens
tgaagagtgcgcacattgcc

SEQ ID NO: 7537916 - DNA, 22 bp, Homo sapiens
tgaacaggtatttattgaacat

SEQ ID NO: 7537917 - DNA, 22 bp, Homo sapiens
tgaacaggtatttattgaacat

SEQ ID NO: 7537918 - DNA, 23 bp, Homo sapiens
tgaacagtatgtgggacattgag

SEQ ID NO: 7537919 - DNA, 22 bp, Homo sapiens
tgaacaggtgccttcagggagt

SEQ ID NO: 7537920 - DNA, 22 bp, Homo sapiens
tgaacagtcatttagaatgtgc

SEQ ID NO: 7537921 - DNA, 22 bp, Homo sapiens
tgaagagaagaaaattatcttt

SEQ ID NO: 7537922 - DNA, 22 bp, Homo sapiens
tgaacagtcaaaaagtgaccat

SEQ ID NO: 7537923 - DNA, 23 bp, Homo sapiens
tgaacagtatgtgggacattgag

SEQ ID NO: 7537924 - DNA, 22 bp, Homo sapiens
tgaagagatagaagtacatgct

SEQ ID NO: 7537925 - DNA, 22 bp, Homo sapiens
tgaagagatagaagtacatgct

SEQ ID NO: 7537926 - DNA, 22 bp, Homo sapiens
tgaagagatagaagtacatgct

SEQ ID NO: 7537927 - DNA, 22 bp, Homo sapiens
tgaagagatagaagtacatgct

SEQ ID NO: 7537928 - DNA, 22 bp, Homo sapiens
tgaagagatagaagtacatgct

SEQ ID NO: 7537929 - DNA, 22 bp, Homo sapiens
tgaagagatagaagtacatgct

SEQ ID NO: 7537930 - DNA, 22 bp, Homo sapiens
tgaagagattaagttggttttg

SEQ ID NO: 7537931 - DNA, 22 bp, Homo sapiens
tgaagataaattgtactgaaga

SEQ ID NO: 7537932 - DNA, 22 bp, Homo sapiens
tgaagataaattgtactgaaga

SEQ ID NO: 7537933 - DNA, 22 bp, Homo sapiens
tgaagataacagtaaggtattg

SEQ ID NO: 7537934 - DNA, 22 bp, Homo sapiens
tgaagataacagtaaggtattg

SEQ ID NO: 7537935 - DNA, 22 bp, Homo sapiens
tgaagataaattgtactgaaga

SEQ ID NO: 7537936 - DNA, 22 bp, Homo sapiens
tgaagataaattgtactgaaga

SEQ ID NO: 7537937 - DNA, 22 bp, Homo sapiens
tgaagagtttccagcctgcttg

SEQ ID NO: 7537938 - DNA, 22 bp, Homo sapiens
tgaagagtttccagcctgcttg

SEQ ID NO: 7537939 - DNA, 22 bp, Homo sapiens
tgaagagtgtgactgcacctag

SEQ ID NO: 7537940 - DNA, 22 bp, Homo sapiens
tgaagatattttaaaatactga

SEQ ID NO: 7537941 - DNA, 22 bp, Homo sapiens
tgaagatattttaaaatactga

SEQ ID NO: 7537942 - DNA, 22 bp, Homo sapiens
tgaagataaattgtactgaaga

SEQ ID NO: 7537943 - DNA, 17 bp, Homo sapiens
tgaagatgcatggcagc

SEQ ID NO: 7537944 - DNA, 22 bp, Homo sapiens
tgaagatctgtcaaccccatat

SEQ ID NO: 7537945 - DNA, 22 bp, Homo sapiens
tgaagattgtgcttggcctgta

SEQ ID NO: 7537946 - DNA, 22 bp, Homo sapiens
tgaagattgtgcttggcctgta

SEQ ID NO: 7537947 - DNA, 22 bp, Homo sapiens
tgaagattgccctgtctcctgt

SEQ ID NO: 7537948 - DNA, 22 bp, Homo sapiens
tgaagatgtcagcaggggtggt

SEQ ID NO: 7537949 - DNA, 17 bp, Homo sapiens
tgaagatgcatggcagc

SEQ ID NO: 7537950 - DNA, 22 bp, Homo sapiens
tgaagatctgtcaaccccatat

SEQ ID NO: 7537951 - DNA, 17 bp, Homo sapiens
tgaagatgcatggcagc

SEQ ID NO: 7537952 - DNA, 17 bp, Homo sapiens
tgaagatgcatggcagc

SEQ ID NO: 7537953 - DNA, 22 bp, Homo sapiens
tgaagatttaagcatctcaatt

SEQ ID NO: 7537954 - DNA, 22 bp, Homo sapiens
tgaagatttaagcatctcaatt

SEQ ID NO: 7537955 - DNA, 22 bp, Homo sapiens
tgaagatttccaccaaatcaca

SEQ ID NO: 7537956 - DNA, 22 bp, Homo sapiens
tgaagatttaagcatctcaatt

SEQ ID NO: 7537957 - DNA, 22 bp, Homo sapiens
tgaagatttagacctctttgcc

SEQ ID NO: 7537958 - DNA, 22 bp, Homo sapiens
tgaagatttccaccaaatcaca

SEQ ID NO: 7537959 - DNA, 22 bp, Homo sapiens
tgaagctttaggatgggttcat

SEQ ID NO: 7537960 - DNA, 22 bp, Homo sapiens
tgaagatttccaccaaatcaca

SEQ ID NO: 7537961 - DNA, 22 bp, Homo sapiens
tgaagctttaggatgggttcat

SEQ ID NO: 7537962 - DNA, 22 bp, Homo sapiens
tgaagctttaggatgggttcat

SEQ ID NO: 7537963 - DNA, 22 bp, Homo sapiens
tgaagctttaggatgggttcat

SEQ ID NO: 7537964 - DNA, 22 bp, Homo sapiens
tgaagctttcctgtggtcagga

SEQ ID NO: 7537965 - DNA, 22 bp, Homo sapiens
tgaagctttcctgtggtcagga

SEQ ID NO: 7537966 - DNA, 22 bp, Homo sapiens
tgaagctttaggatgggttcat

SEQ ID NO: 7537967 - DNA, 22 bp, Homo sapiens
tgaaggaaagagggaacatccc

SEQ ID NO: 7537968 - DNA, 22 bp, Homo sapiens
tgaaggaaagagggaacatccc

SEQ ID NO: 7537969 - DNA, 22 bp, Homo sapiens
tgaaggaaagagggaacatccc

SEQ ID NO: 7537970 - DNA, 22 bp, Homo sapiens
tgaaggaaatgacggcagaaga

SEQ ID NO: 7537971 - DNA, 22 bp, Homo sapiens
tgaaggaatgagggagtgggtc

SEQ ID NO: 7537972 - DNA, 22 bp, Homo sapiens
tgaaggaatgagggagtgggtc

SEQ ID NO: 7537973 - DNA, 22 bp, Homo sapiens
tgaaggaatgagggagtgggtc

SEQ ID NO: 7537974 - DNA, 22 bp, Homo sapiens
tgaaggaatgagggagtgggtc

SEQ ID NO: 7537975 - DNA, 22 bp, Homo sapiens
tgaaggaatgagggagtgggtc

SEQ ID NO: 7537976 - DNA, 17 bp, Homo sapiens
tgaaggaaggatgatgt

SEQ ID NO: 7537977 - DNA, 17 bp, Homo sapiens
tgaaggaaggatgatgt

SEQ ID NO: 7537978 - DNA, 17 bp, Homo sapiens
tgaaggaaggatgatgt

SEQ ID NO: 7537979 - DNA, 17 bp, Homo sapiens
tgaaggaaggatgatgt

SEQ ID NO: 7537980 - DNA, 17 bp, Homo sapiens
tgaaggaaggatgatgt

SEQ ID NO: 7537981 - DNA, 22 bp, Homo sapiens
tgaaggaagaataggcagtgtt

SEQ ID NO: 7537982 - DNA, 22 bp, Homo sapiens
tgaaggaagaataggcagtgtt

SEQ ID NO: 7537983 - DNA, 22 bp, Homo sapiens
tgaaggaagaataggcagtgtt

SEQ ID NO: 7537984 - DNA, 22 bp, Homo sapiens
tgaaggaagaataggcagtgtt

SEQ ID NO: 7537985 - DNA, 22 bp, Homo sapiens
tgaaggaaatgacggcagaaga

SEQ ID NO: 7537986 - DNA, 22 bp, Homo sapiens
tgaaggaaatgacggcagaaga

SEQ ID NO: 7537987 - DNA, 22 bp, Homo sapiens
tgaaggaaatgacggcagaaga

SEQ ID NO: 7537988 - DNA, 22 bp, Homo sapiens
tgaaggaaatgacggcagaaga

SEQ ID NO: 7537989 - DNA, 22 bp, Homo sapiens
tgaaggagaattaataggcatt

SEQ ID NO: 7537990 - DNA, 22 bp, Homo sapiens
tgaaggagaattaataggcatt

SEQ ID NO: 7537991 - DNA, 22 bp, Homo sapiens
tgaaggagaaatggaaagtggg

SEQ ID NO: 7537992 - DNA, 22 bp, Homo sapiens
tgaaggagaaatggaaagtggg

SEQ ID NO: 7537993 - DNA, 22 bp, Homo sapiens
tgaaggagaaatggaaagtggg

SEQ ID NO: 7537994 - DNA, 22 bp, Homo sapiens
tgaaggagaaatggaaagtggg

SEQ ID NO: 7537995 - DNA, 22 bp, Homo sapiens
tgaaggagaaatggaaagtggg

SEQ ID NO: 7537996 - DNA, 22 bp, Homo sapiens
tgaaggacagcagtggctccaa

SEQ ID NO: 7537997 - DNA, 19 bp, Homo sapiens
tgaaggacagtgcacatca

SEQ ID NO: 7537998 - DNA, 22 bp, Homo sapiens
tgaaggaatggaggatcagagc

SEQ ID NO: 7537999 - DNA, 22 bp, Homo sapiens
tgaaggaatggaggatcagagc

SEQ ID NO: 7538000 - DNA, 22 bp, Homo sapiens
tgaaggaatggaggatcagagc

SEQ ID NO: 7538001 - DNA, 22 bp, Homo sapiens
tgaaggaatggaggatcagagc

SEQ ID NO: 7538002 - DNA, 22 bp, Homo sapiens
tgaaggaatgagtatactgttt

SEQ ID NO: 7538003 - DNA, 22 bp, Homo sapiens
tgaaggaatgagtatactgttt

SEQ ID NO: 7538004 - DNA, 22 bp, Homo sapiens
tgaaggaatgagggagtgggtc

SEQ ID NO: 7538005 - DNA, 22 bp, Homo sapiens
tgaaggaatgagtatactgttt

SEQ ID NO: 7538006 - DNA, 22 bp, Homo sapiens
tgaaggaatgagtatactgttt

SEQ ID NO: 7538007 - DNA, 22 bp, Homo sapiens
tgaaggaatgagtatactgttt

SEQ ID NO: 7538008 - DNA, 21 bp, Homo sapiens
tgaacacagatttgtctgatt

SEQ ID NO: 7538009 - DNA, 22 bp, Homo sapiens
tgaaatgcaacagttatttttg

SEQ ID NO: 7538010 - DNA, 22 bp, Homo sapiens
tgaaatgcaacagttatttttg

SEQ ID NO: 7538011 - DNA, 22 bp, Homo sapiens
tgaaatgattatatggtgtttg

SEQ ID NO: 7538012 - DNA, 22 bp, Homo sapiens
tgaaatgattatatggtgtttg

SEQ ID NO: 7538013 - DNA, 22 bp, Homo sapiens
ccaggctgctgttggtgtccgc

SEQ ID NO: 7538014 - DNA, 22 bp, Homo sapiens
ccaggctgctcacaagctgccc

SEQ ID NO: 7538015 - DNA, 22 bp, Homo sapiens
ccaggctgctcacaagctgccc

SEQ ID NO: 7538016 - DNA, 22 bp, Homo sapiens
ccaggctgctcacaagctgccc

SEQ ID NO: 7538017 - DNA, 22 bp, Homo sapiens
ccaggctgctcacaagctgccc

SEQ ID NO: 7538018 - DNA, 22 bp, Homo sapiens
ccaggctgctcacaagctgccc

SEQ ID NO: 7538019 - DNA, 22 bp, Homo sapiens
ccaggctgctcacaagctgccc

SEQ ID NO: 7538020 - DNA, 22 bp, Homo sapiens
tgaacacatctgcgtgtgtctc

SEQ ID NO: 7538021 - DNA, 22 bp, Homo sapiens
tgaacacatctgcgtgtgtctc

SEQ ID NO: 7538022 - DNA, 22 bp, Homo sapiens
tgaacacatattaggtgctcat

SEQ ID NO: 7538023 - DNA, 22 bp, Homo sapiens
tgaacacatattaggtgctcat

SEQ ID NO: 7538024 - DNA, 22 bp, Homo sapiens
tgaacacataaggctttcctgt

SEQ ID NO: 7538025 - DNA, 22 bp, Homo sapiens
tgaacacataaggctttcctgt

SEQ ID NO: 7538026 - DNA, 22 bp, Homo sapiens
tgaacacagttctgatgagctt

SEQ ID NO: 7538027 - DNA, 22 bp, Homo sapiens
tgaacacagttctgatgagctt

SEQ ID NO: 7538028 - DNA, 22 bp, Homo sapiens
tgaacacagttctgatgagctt

SEQ ID NO: 7538029 - DNA, 22 bp, Homo sapiens
tgaacacagttctgatgagctt

SEQ ID NO: 7538030 - DNA, 22 bp, Homo sapiens
tgaacacataaaagcaaagggt

SEQ ID NO: 7538031 - DNA, 22 bp, Homo sapiens
tgaacacataaaagcaaagggt

SEQ ID NO: 7538032 - DNA, 22 bp, Homo sapiens
tgaacacagggaatgggggttt

SEQ ID NO: 7538033 - DNA, 22 bp, Homo sapiens
tgaacacagggccaaacttgag

SEQ ID NO: 7538034 - DNA, 22 bp, Homo sapiens
tgaacacagggaatgggggttt

SEQ ID NO: 7538035 - DNA, 22 bp, Homo sapiens
tgaacacagcatattttgttac

SEQ ID NO: 7538036 - DNA, 22 bp, Homo sapiens
tgaacacagcatattttgttac

SEQ ID NO: 7538037 - DNA, 22 bp, Homo sapiens
tgaacacagcatattttgttac

SEQ ID NO: 7538038 - DNA, 22 bp, Homo sapiens
tgaacacagggccaaacttgag

SEQ ID NO: 7538039 - DNA, 18 bp, Homo sapiens
tgaacacagtacaattcc

SEQ ID NO: 7538040 - DNA, 22 bp, Homo sapiens
tgaacacagggccaaacttgag

SEQ ID NO: 7538041 - DNA, 18 bp, Homo sapiens
tgaacacagtacaattcc

SEQ ID NO: 7538042 - DNA, 18 bp, Homo sapiens
tgaacacagtacaattcc

SEQ ID NO: 7538043 - DNA, 22 bp, Homo sapiens
tgaaaggggttgagttacagct

SEQ ID NO: 7538044 - DNA, 22 bp, Homo sapiens
ccaggctgagcatgattggagc

SEQ ID NO: 7538045 - DNA, 22 bp, Homo sapiens
tgaaagggaacctgctggactg

SEQ ID NO: 7538046 - DNA, 22 bp, Homo sapiens
tgaaagggaacctgctggactg

SEQ ID NO: 7538047 - DNA, 22 bp, Homo sapiens
tgaaagggaacctgctggactg

SEQ ID NO: 7538048 - DNA, 22 bp, Homo sapiens
tgaaaggaagagggctactcct

SEQ ID NO: 7538049 - DNA, 22 bp, Homo sapiens
ccaggctgcagtcaaggggcat

SEQ ID NO: 7538050 - DNA, 22 bp, Homo sapiens
ccaggctgcagtcaaggggcat

SEQ ID NO: 7538051 - DNA, 22 bp, Homo sapiens
ccaggctgcagtcaaggggcat

SEQ ID NO: 7538052 - DNA, 22 bp, Homo sapiens
ccaggctgcagtcaaggggcat

SEQ ID NO: 7538053 - DNA, 22 bp, Homo sapiens
ccaggctgcagtcaaggggcat

SEQ ID NO: 7538054 - DNA, 22 bp, Homo sapiens
ccaggctgcagtcaaggggcat

SEQ ID NO: 7538055 - DNA, 22 bp, Homo sapiens
ccaggctgagcatgattggagc

SEQ ID NO: 7538056 - DNA, 22 bp, Homo sapiens
ccaggctgcagtcaaggggcat

SEQ ID NO: 7538057 - DNA, 22 bp, Homo sapiens
ccaggctgagcatgattggagc

SEQ ID NO: 7538058 - DNA, 22 bp, Homo sapiens
ccaggctgccgaggaaagaaag

SEQ ID NO: 7538059 - DNA, 22 bp, Homo sapiens
ccaggctgcagtcaaggggcat

SEQ ID NO: 7538060 - DNA, 22 bp, Homo sapiens
ccaggctgcagtcaaggggcat

SEQ ID NO: 7538061 - DNA, 22 bp, Homo sapiens
ccaggctgcagtcaaggggcat

SEQ ID NO: 7538062 - DNA, 22 bp, Homo sapiens
ccaggctgcagtcaaggggcat

SEQ ID NO: 7538063 - DNA, 22 bp, Homo sapiens
ccaggctgcagtcaaggggcat

SEQ ID NO: 7538064 - DNA, 22 bp, Homo sapiens
ccaggctgcagtcaaggggcat

SEQ ID NO: 7538065 - DNA, 22 bp, Homo sapiens
ccaggctgctcacaagctgccc

SEQ ID NO: 7538066 - DNA, 22 bp, Homo sapiens
ccaggctgctcacaagctgccc

SEQ ID NO: 7538067 - DNA, 22 bp, Homo sapiens
ccaggctgctcacaagctgccc

SEQ ID NO: 7538068 - DNA, 22 bp, Homo sapiens
ccaggctgctcacaagctgccc

SEQ ID NO: 7538069 - DNA, 22 bp, Homo sapiens
ccaggctgctcacaagctgccc

SEQ ID NO: 7538070 - DNA, 22 bp, Homo sapiens
ccaggctgccgaggaaagaaag

SEQ ID NO: 7538071 - DNA, 22 bp, Homo sapiens
ccaggctgccgaggaaagaaag

SEQ ID NO: 7538072 - DNA, 22 bp, Homo sapiens
ccaggctgccgaggaaagaaag

SEQ ID NO: 7538073 - DNA, 22 bp, Homo sapiens
ccaggctgccgaggaaagaaag

SEQ ID NO: 7538074 - DNA, 22 bp, Homo sapiens
ccaggctgccgaggaaagaaag

SEQ ID NO: 7538075 - DNA, 22 bp, Homo sapiens
ccaggctgccgaggaaagaaag

SEQ ID NO: 7538076 - DNA, 22 bp, Homo sapiens
tgaaaggaaagtacagtgatgc

SEQ ID NO: 7538077 - DNA, 22 bp, Homo sapiens
tgaaaggaaagtacagtgatgc

SEQ ID NO: 7538078 - DNA, 22 bp, Homo sapiens
tgaaagctgggcacaagattct

SEQ ID NO: 7538079 - DNA, 22 bp, Homo sapiens
tgaaagctgggcacaagattct

SEQ ID NO: 7538080 - DNA, 22 bp, Homo sapiens
tgaaagctgtacatgtggtaca

SEQ ID NO: 7538081 - DNA, 22 bp, Homo sapiens
tgaaagctgtccactaggctgt

SEQ ID NO: 7538082 - DNA, 22 bp, Homo sapiens
tgaaagctgtccactaggctgt

SEQ ID NO: 7538083 - DNA, 22 bp, Homo sapiens
tgaaagctctgtcatcattcct

SEQ ID NO: 7538084 - DNA, 22 bp, Homo sapiens
tgaaagcattagtctaaggtag

SEQ ID NO: 7538085 - DNA, 22 bp, Homo sapiens
tgaaagctctgtcatcattcct

SEQ ID NO: 7538086 - DNA, 22 bp, Homo sapiens
tgaaagctgaggacaggagggt

SEQ ID NO: 7538087 - DNA, 22 bp, Homo sapiens
tgaaagcattagtctaaggtag

SEQ ID NO: 7538088 - DNA, 22 bp, Homo sapiens
tgaaagcattagtctaaggtag

SEQ ID NO: 7538089 - DNA, 20 bp, Homo sapiens
tgaaagcatgtggtatttgg

SEQ ID NO: 7538090 - DNA, 20 bp, Homo sapiens
tgaaagcatgtggtatttgg

SEQ ID NO: 7538091 - DNA, 20 bp, Homo sapiens
tgaaagcatgtggtatttgg

SEQ ID NO: 7538092 - DNA, 22 bp, Homo sapiens
tgaaagcatgcttgccaagctt

SEQ ID NO: 7538093 - DNA, 22 bp, Homo sapiens
tgaaagcatgcttgccaagctt

SEQ ID NO: 7538094 - DNA, 22 bp, Homo sapiens
tgaaagcatgcttgccaagctt

SEQ ID NO: 7538095 - DNA, 22 bp, Homo sapiens
tgaaagcatatgctaaagacca

SEQ ID NO: 7538096 - DNA, 22 bp, Homo sapiens
tgaaagcatgcttgccaagctt

SEQ ID NO: 7538097 - DNA, 22 bp, Homo sapiens
tgaaagcagtgccatgattatg

SEQ ID NO: 7538098 - DNA, 22 bp, Homo sapiens
tgaaagcatatgctaaagacca

SEQ ID NO: 7538099 - DNA, 22 bp, Homo sapiens
tgaaagcagtgccatgattatg

SEQ ID NO: 7538100 - DNA, 22 bp, Homo sapiens
tgaaagcagtgatttctccttc

SEQ ID NO: 7538101 - DNA, 22 bp, Homo sapiens
tgaaagcagtgatttctccttc

SEQ ID NO: 7538102 - DNA, 22 bp, Homo sapiens
tgaaagcaggcgggctacttta

SEQ ID NO: 7538103 - DNA, 22 bp, Homo sapiens
tgaaagcaggcgggctacttta

SEQ ID NO: 7538104 - DNA, 22 bp, Homo sapiens
tgaaagcagtgccatgattatg

SEQ ID NO: 7538105 - DNA, 22 bp, Homo sapiens
tgaaagcagtgccatgattatg

SEQ ID NO: 7538106 - DNA, 22 bp, Homo sapiens
tgaaagcagtgccatgattatg

SEQ ID NO: 7538107 - DNA, 22 bp, Homo sapiens
tgaaagcagcaccaataccatt

SEQ ID NO: 7538108 - DNA, 22 bp, Homo sapiens
tgaaagcagcaccaataccatt

SEQ ID NO: 7538109 - DNA, 22 bp, Homo sapiens
tgaaagcaggcgggctacttta

SEQ ID NO: 7538110 - DNA, 22 bp, Homo sapiens
tgaaagcagcaccaataccatt

SEQ ID NO: 7538111 - DNA, 22 bp, Homo sapiens
tgaaagcagcaccaataccatt

SEQ ID NO: 7538112 - DNA, 22 bp, Homo sapiens
tgaaagcagatagctctgttgt

SEQ ID NO: 7538113 - DNA, 22 bp, Homo sapiens
tgaaagcactgattctcaactc

SEQ ID NO: 7538114 - DNA, 22 bp, Homo sapiens
tgaaagcagatagctctgttgt

SEQ ID NO: 7538115 - DNA, 22 bp, Homo sapiens
tgaaagcagatagctctgttgt

SEQ ID NO: 7538116 - DNA, 22 bp, Homo sapiens
tgaaagcagatagctctgttgt

SEQ ID NO: 7538117 - DNA, 22 bp, Homo sapiens
tgaaacagattgatggtttcta

SEQ ID NO: 7538118 - DNA, 22 bp, Homo sapiens
tgaaacagctatcagtagactg

SEQ ID NO: 7538119 - DNA, 22 bp, Homo sapiens
tgaaacaggaagtaaacagaca

SEQ ID NO: 7538120 - DNA, 22 bp, Homo sapiens
tgaaagcactgattctcaactc

SEQ ID NO: 7538121 - DNA, 22 bp, Homo sapiens
tgaaagcactgattctcaactc

SEQ ID NO: 7538122 - DNA, 22 bp, Homo sapiens
tgaaacaggaagtaaacagaca

SEQ ID NO: 7538123 - DNA, 22 bp, Homo sapiens
tgaaacaggaagtaaacagaca

SEQ ID NO: 7538124 - DNA, 22 bp, Homo sapiens
tgaaacagctatcagtagactg

SEQ ID NO: 7538125 - DNA, 22 bp, Homo sapiens
ccaggctcctcatgatcttgtt

SEQ ID NO: 7538126 - DNA, 21 bp, Homo sapiens
ccaggctcctgaggctggtca

SEQ ID NO: 7538127 - DNA, 21 bp, Homo sapiens
tgaaacagatggaagtatttg

SEQ ID NO: 7538128 - DNA, 22 bp, Homo sapiens
ccaggctcctcatgatcttgtt

SEQ ID NO: 7538129 - DNA, 22 bp, Homo sapiens
ccaggctcctcatgatcttgtt

SEQ ID NO: 7538130 - DNA, 22 bp, Homo sapiens
ccaggctcctcatgatcttgtt

SEQ ID NO: 7538131 - DNA, 22 bp, Homo sapiens
ccaggctccgcatagaccccac

SEQ ID NO: 7538132 - DNA, 22 bp, Homo sapiens
ccaggctccgcatagaccccac

SEQ ID NO: 7538133 - DNA, 22 bp, Homo sapiens
ccaggctccgcatagaccccac

SEQ ID NO: 7538134 - DNA, 22 bp, Homo sapiens
ccaggctccgcatagaccccac

SEQ ID NO: 7538135 - DNA, 22 bp, Homo sapiens
ccaggctccgcatagaccccac

SEQ ID NO: 7538136 - DNA, 22 bp, Homo sapiens
ccaggctccgcatagaccccac

SEQ ID NO: 7538137 - DNA, 22 bp, Homo sapiens
ccaggctccccaggaggccctt

SEQ ID NO: 7538138 - DNA, 22 bp, Homo sapiens
ccaggctccccaggaggccctt

SEQ ID NO: 7538139 - DNA, 22 bp, Homo sapiens
ccaggctccccaggaggccctt

SEQ ID NO: 7538140 - DNA, 22 bp, Homo sapiens
ccaggctccccaggaggccctt

SEQ ID NO: 7538141 - DNA, 22 bp, Homo sapiens
ccaggctccccaggaggccctt

SEQ ID NO: 7538142 - DNA, 22 bp, Homo sapiens
ccaggctccccaggaggccctt

SEQ ID NO: 7538143 - DNA, 22 bp, Homo sapiens
tctttatttctgaatcccccat

SEQ ID NO: 7538144 - DNA, 22 bp, Homo sapiens
tctttatttctgaatcccccat

SEQ ID NO: 7538145 - DNA, 22 bp, Homo sapiens
tctttatttctgaatcccccat

SEQ ID NO: 7538146 - DNA, 22 bp, Homo sapiens
tctttatttctgaatcccccat

SEQ ID NO: 7538147 - DNA, 22 bp, Homo sapiens
tctttatttctgaatcccccat

SEQ ID NO: 7538148 - DNA, 22 bp, Homo sapiens
tctttatttctgaatcccccat

SEQ ID NO: 7538149 - DNA, 22 bp, Homo sapiens
tctttatttaagtctgttgtaa

SEQ ID NO: 7538150 - DNA, 22 bp, Homo sapiens
tctttatttctgaatcccccat

SEQ ID NO: 7538151 - DNA, 22 bp, Homo sapiens
tctttatttctgaatcccccat

SEQ ID NO: 7538152 - DNA, 22 bp, Homo sapiens
tctttatttctgaatcccccat

SEQ ID NO: 7538153 - DNA, 22 bp, Homo sapiens
tctttatttctgaatcccccat

SEQ ID NO: 7538154 - DNA, 22 bp, Homo sapiens
tctttatttctgaatcccccat

SEQ ID NO: 7538155 - DNA, 22 bp, Homo sapiens
tctttatttctgaatcccccat

SEQ ID NO: 7538156 - DNA, 22 bp, Homo sapiens
tctttatttaagtctgttgtaa

SEQ ID NO: 7538157 - DNA, 22 bp, Homo sapiens
tctttatttaagtctgttgtaa

SEQ ID NO: 7538158 - DNA, 22 bp, Homo sapiens
tctttatttaagtctgttgtaa

SEQ ID NO: 7538159 - DNA, 22 bp, Homo sapiens
tctttatttaagtctgttgtaa

SEQ ID NO: 7538160 - DNA, 22 bp, Homo sapiens
tctttatttaagtctgttgtaa

SEQ ID NO: 7538161 - DNA, 22 bp, Homo sapiens
tctttatttaagtctgttgtaa

SEQ ID NO: 7538162 - DNA, 22 bp, Homo sapiens
tctttatttaagtctgttgtaa

SEQ ID NO: 7538163 - DNA, 22 bp, Homo sapiens
tctttaatatctgccccagagc

SEQ ID NO: 7538164 - DNA, 22 bp, Homo sapiens
tctttatttaagtctgttgtaa

SEQ ID NO: 7538165 - DNA, 22 bp, Homo sapiens
tctttatttaagtctgttgtaa

SEQ ID NO: 7538166 - DNA, 22 bp, Homo sapiens
tctttaagagttcatttgcatg

SEQ ID NO: 7538167 - DNA, 22 bp, Homo sapiens
tctttaagagtaattattttgg

SEQ ID NO: 7538168 - DNA, 22 bp, Homo sapiens
tctttaagagttcatttgcatg

SEQ ID NO: 7538169 - DNA, 22 bp, Homo sapiens
tctttaagagttcatttgcatg

SEQ ID NO: 7538170 - DNA, 22 bp, Homo sapiens
tctttaagccaagatatattta

SEQ ID NO: 7538171 - DNA, 18 bp, Homo sapiens
tctttaagttgtcagagt

SEQ ID NO: 7538172 - DNA, 22 bp, Homo sapiens
tctttaatataaaggaatgaat

SEQ ID NO: 7538173 - DNA, 22 bp, Homo sapiens
tctttaatataaaggaatgaat

SEQ ID NO: 7538174 - DNA, 18 bp, Homo sapiens
tctttaagttgtcagagt

SEQ ID NO: 7538175 - DNA, 22 bp, Homo sapiens
tctttaagggatgttctgcttt

SEQ ID NO: 7538176 - DNA, 22 bp, Homo sapiens
tctttaaggtgatttctgctac

SEQ ID NO: 7538177 - DNA, 22 bp, Homo sapiens
tctttattttatgcttgtgcaa

SEQ ID NO: 7538178 - DNA, 22 bp, Homo sapiens
tctttattttatgcttgtgcaa

SEQ ID NO: 7538179 - DNA, 22 bp, Homo sapiens
tctttattttatgcttgtgcaa

SEQ ID NO: 7538180 - DNA, 22 bp, Homo sapiens
tctttattttatgcttgtgcaa

SEQ ID NO: 7538181 - DNA, 22 bp, Homo sapiens
tctttattttatgcttgtgcaa

SEQ ID NO: 7538182 - DNA, 22 bp, Homo sapiens
tctttattttatgcttgtgcaa

SEQ ID NO: 7538183 - DNA, 22 bp, Homo sapiens
tctttattttatgcttgtgcaa

SEQ ID NO: 7538184 - DNA, 22 bp, Homo sapiens
tctttattttatgcttgtgcaa

SEQ ID NO: 7538185 - DNA, 22 bp, Homo sapiens
tctttattttatgcttgtgcaa

SEQ ID NO: 7538186 - DNA, 22 bp, Homo sapiens
tctttcaaagcaaaatgaggct

SEQ ID NO: 7538187 - DNA, 22 bp, Homo sapiens
tctttcaaagctgtagtagatt

SEQ ID NO: 7538188 - DNA, 22 bp, Homo sapiens
tctttcaaagctgtagtagatt

SEQ ID NO: 7538189 - DNA, 22 bp, Homo sapiens
tctttcaaagctgtagtagatt

SEQ ID NO: 7538190 - DNA, 22 bp, Homo sapiens
tctttattttatgcttgtgcaa

SEQ ID NO: 7538191 - DNA, 22 bp, Homo sapiens
tctttattttatgcttgtgcaa

SEQ ID NO: 7538192 - DNA, 19 bp, Homo sapiens
ccaggcctggcgtctccgc

SEQ ID NO: 7538193 - DNA, 19 bp, Homo sapiens
ccaggcctggcgtctccgc

SEQ ID NO: 7538194 - DNA, 22 bp, Homo sapiens
tctttcaaatgcttgaattgga

SEQ ID NO: 7538195 - DNA, 19 bp, Homo sapiens
ccaggcctggcgtctccgc

SEQ ID NO: 7538196 - DNA, 19 bp, Homo sapiens
ccaggcctggcgtctccgc

SEQ ID NO: 7538197 - DNA, 19 bp, Homo sapiens
ccaggcctggcgtctccgc

SEQ ID NO: 7538198 - DNA, 19 bp, Homo sapiens
ccaggcctggcgtctccgc

SEQ ID NO: 7538199 - DNA, 22 bp, Homo sapiens
tctttcaaagtaacaaccacga

SEQ ID NO: 7538200 - DNA, 22 bp, Homo sapiens
tctttcaaagctgtagtagatt

SEQ ID NO: 7538201 - DNA, 22 bp, Homo sapiens
tctttcaaagtaacaaccacga

SEQ ID NO: 7538202 - DNA, 22 bp, Homo sapiens
ccaggctagaaactgaggcaca

SEQ ID NO: 7538203 - DNA, 18 bp, Homo sapiens
ccaggctacttcttggcc

SEQ ID NO: 7538204 - DNA, 23 bp, Homo sapiens
ccaggctaaatgttagagtctga

SEQ ID NO: 7538205 - DNA, 22 bp, Homo sapiens
ccaggctacacatcagatgagt

SEQ ID NO: 7538206 - DNA, 22 bp, Homo sapiens
ccaggctagaaactgaggcaca

SEQ ID NO: 7538207 - DNA, 22 bp, Homo sapiens
ccaggctagagagcagtggcac

SEQ ID NO: 7538208 - DNA, 22 bp, Homo sapiens
ccaggctagagagcagtggcac

SEQ ID NO: 7538209 - DNA, 19 bp, Homo sapiens
ccaggcctggcgtctccgc

SEQ ID NO: 7538210 - DNA, 19 bp, Homo sapiens
ccaggcctggcgtctccgc

SEQ ID NO: 7538211 - DNA, 22 bp, Homo sapiens
ccaggcgtggcttcagcagccc

SEQ ID NO: 7538212 - DNA, 19 bp, Homo sapiens
ccaggcctggcgtctccgc

SEQ ID NO: 7538213 - DNA, 23 bp, Homo sapiens
ccaggctaaatgttagagtctga

SEQ ID NO: 7538214 - DNA, 22 bp, Homo sapiens
ccaggctcaggcctgctcgttg

SEQ ID NO: 7538215 - DNA, 22 bp, Homo sapiens
ccaggctcagggcagactttca

SEQ ID NO: 7538216 - DNA, 22 bp, Homo sapiens
ccaggctcaggcctgctcgttg

SEQ ID NO: 7538217 - DNA, 22 bp, Homo sapiens
ccaggctcaggcctgctcgttg

SEQ ID NO: 7538218 - DNA, 22 bp, Homo sapiens
ccaggctcaggcctgctcgttg

SEQ ID NO: 7538219 - DNA, 22 bp, Homo sapiens
ccaggctcaggcctgctcgttg

SEQ ID NO: 7538220 - DNA, 22 bp, Homo sapiens
ccaggctcaggcctgctcgttg

SEQ ID NO: 7538221 - DNA, 22 bp, Homo sapiens
ccaggctcaggcctgctcgttg

SEQ ID NO: 7538222 - DNA, 22 bp, Homo sapiens
ccaggctcaggcctgctcgttg

SEQ ID NO: 7538223 - DNA, 22 bp, Homo sapiens
ccaggctcaggcctgctcgttg

SEQ ID NO: 7538224 - DNA, 22 bp, Homo sapiens
ccaggctcagcgcgcacgtctg

SEQ ID NO: 7538225 - DNA, 22 bp, Homo sapiens
ccaggctcagctattaagaaac

SEQ ID NO: 7538226 - DNA, 22 bp, Homo sapiens
ccaggctcagcgcgcacgtctg

SEQ ID NO: 7538227 - DNA, 22 bp, Homo sapiens
ccaggctcagcgcgcacgtctg

SEQ ID NO: 7538228 - DNA, 22 bp, Homo sapiens
ccaggctcagctattaagaaac

SEQ ID NO: 7538229 - DNA, 22 bp, Homo sapiens
ccaggctcagcgcgcacgtctg

SEQ ID NO: 7538230 - DNA, 22 bp, Homo sapiens
ccaggctcagcgcgcacgtctg

SEQ ID NO: 7538231 - DNA, 22 bp, Homo sapiens
ccaggctcagcgcgcacgtctg

SEQ ID NO: 7538232 - DNA, 22 bp, Homo sapiens
ccaggctcagcgcgcacgtctg

SEQ ID NO: 7538233 - DNA, 22 bp, Homo sapiens
ccaggctcagcgcgcacgtctg

SEQ ID NO: 7538234 - DNA, 17 bp, Homo sapiens
ccaggctccatcactgt

SEQ ID NO: 7538235 - DNA, 17 bp, Homo sapiens
ccaggctccatcactgt

SEQ ID NO: 7538236 - DNA, 22 bp, Homo sapiens
ccaggctccccaggaggccctt

SEQ ID NO: 7538237 - DNA, 22 bp, Homo sapiens
ccaggctccccaggaggccctt

SEQ ID NO: 7538238 - DNA, 17 bp, Homo sapiens
ccaggctccatcactgt

SEQ ID NO: 7538239 - DNA, 17 bp, Homo sapiens
ccaggctccatcactgt

SEQ ID NO: 7538240 - DNA, 17 bp, Homo sapiens
ccaggctccatcactgt

SEQ ID NO: 7538241 - DNA, 17 bp, Homo sapiens
ccaggctccatcactgt

SEQ ID NO: 7538242 - DNA, 17 bp, Homo sapiens
ccaggctccatcactgt

SEQ ID NO: 7538243 - DNA, 17 bp, Homo sapiens
ccaggctccatcactgt

SEQ ID NO: 7538244 - DNA, 17 bp, Homo sapiens
ccaggctccatcactgt

SEQ ID NO: 7538245 - DNA, 17 bp, Homo sapiens
ccaggctccatcactgt

SEQ ID NO: 7538246 - DNA, 22 bp, Homo sapiens
ccaggctcaggtgcgagagaca

SEQ ID NO: 7538247 - DNA, 22 bp, Homo sapiens
ccaggctcaggtgcgagagaca

SEQ ID NO: 7538248 - DNA, 22 bp, Homo sapiens
ccaggctcagggcagactttca

SEQ ID NO: 7538249 - DNA, 22 bp, Homo sapiens
ccaggctcaggtgcgagagaca

SEQ ID NO: 7538250 - DNA, 22 bp, Homo sapiens
ccaggctcaggtgcgagagaca

SEQ ID NO: 7538251 - DNA, 22 bp, Homo sapiens
ccaggctcaggtgcgagagaca

SEQ ID NO: 7538252 - DNA, 22 bp, Homo sapiens
ccaggctcaggtgcgagagaca

SEQ ID NO: 7538253 - DNA, 22 bp, Homo sapiens
ccaggctcactgactaccacat

SEQ ID NO: 7538254 - DNA, 22 bp, Homo sapiens
ccaggctcactgactaccacat

SEQ ID NO: 7538255 - DNA, 22 bp, Homo sapiens
ccaggctcactgactaccacat

SEQ ID NO: 7538256 - DNA, 22 bp, Homo sapiens
ccaggctcagcgcgcacgtctg

SEQ ID NO: 7538257 - DNA, 22 bp, Homo sapiens
ccaggctcagcgcgcacgtctg

SEQ ID NO: 7538258 - DNA, 22 bp, Homo sapiens
ccaggctcactgactaccacat

SEQ ID NO: 7538259 - DNA, 22 bp, Homo sapiens
ccaggctcactgactaccacat

SEQ ID NO: 7538260 - DNA, 22 bp, Homo sapiens
ccaggctcacagcatcccagga

SEQ ID NO: 7538261 - DNA, 22 bp, Homo sapiens
ccaggctcacctggagcccctg

SEQ ID NO: 7538262 - DNA, 22 bp, Homo sapiens
ccaggctcacctggagcccctg

SEQ ID NO: 7538263 - DNA, 22 bp, Homo sapiens
ccaggctcacctggagcccctg

SEQ ID NO: 7538264 - DNA, 22 bp, Homo sapiens
ccaggctcacctggagcccctg

SEQ ID NO: 7538265 - DNA, 22 bp, Homo sapiens
ccaggctcacctggagcccctg

SEQ ID NO: 7538266 - DNA, 22 bp, Homo sapiens
ccaggctcactgactaccacat

SEQ ID NO: 7538267 - DNA, 22 bp, Homo sapiens
ccaggctcacctggagcccctg

SEQ ID NO: 7538268 - DNA, 22 bp, Homo sapiens
ccaggctcacagcatcccagga

SEQ ID NO: 7538269 - DNA, 17 bp, Homo sapiens
ccaggctataccaggct

SEQ ID NO: 7538270 - DNA, 17 bp, Homo sapiens
ccaggctataccaggct

SEQ ID NO: 7538271 - DNA, 22 bp, Homo sapiens
ccaggctatctggccttgagct

SEQ ID NO: 7538272 - DNA, 22 bp, Homo sapiens
ccaggctagagtgcagtggcgt

SEQ ID NO: 7538273 - DNA, 22 bp, Homo sapiens
ccaggctagcccagaccacagg

SEQ ID NO: 7538274 - DNA, 22 bp, Homo sapiens
ccaggctaggaccgatttccct

SEQ ID NO: 7538275 - DNA, 22 bp, Homo sapiens
ccaggctcacagcatcccagga

SEQ ID NO: 7538276 - DNA, 22 bp, Homo sapiens
ccaggctcacagcatcccagga

SEQ ID NO: 7538277 - DNA, 22 bp, Homo sapiens
ccaggctcacagcatcccagga

SEQ ID NO: 7538278 - DNA, 22 bp, Homo sapiens
ccaggctcacagcatcccagga

SEQ ID NO: 7538279 - DNA, 22 bp, Homo sapiens
ccaggctagagagcagtggcac

SEQ ID NO: 7538280 - DNA, 22 bp, Homo sapiens
ccaggctagagagcagtggcat

SEQ ID NO: 7538281 - DNA, 22 bp, Homo sapiens
ccaggctagagagcagtggcat

SEQ ID NO: 7538282 - DNA, 22 bp, Homo sapiens
ccaggctagagagcagtggcat

SEQ ID NO: 7538283 - DNA, 22 bp, Homo sapiens
ccaggctagagtgcaatggcat

SEQ ID NO: 7538284 - DNA, 22 bp, Homo sapiens
ccaggctagagtgcaatggcgc

SEQ ID NO: 7538285 - DNA, 22 bp, Homo sapiens
ccaggctagagtgcagtggcat

SEQ ID NO: 7538286 - DNA, 22 bp, Homo sapiens
ccaggctagagtgcagtggcat

SEQ ID NO: 7538287 - DNA, 22 bp, Homo sapiens
ccaggctagagtgcagtggcat

SEQ ID NO: 7538288 - DNA, 22 bp, Homo sapiens
ccaggctagagtgcagtggcgt

SEQ ID NO: 7538289 - DNA, 22 bp, Homo sapiens
ccaggctagagtgcagtggcgt

SEQ ID NO: 7538290 - DNA, 22 bp, Homo sapiens
ccagccctttgtggttcactga

SEQ ID NO: 7538291 - DNA, 22 bp, Homo sapiens
ccagccctttgtggttcactga

SEQ ID NO: 7538292 - DNA, 22 bp, Homo sapiens
ccagccctttgtggttcactga

SEQ ID NO: 7538293 - DNA, 22 bp, Homo sapiens
ccagcccttgaggtctgtccat

SEQ ID NO: 7538294 - DNA, 22 bp, Homo sapiens
ccagcccttgaggtctgtccat

SEQ ID NO: 7538295 - DNA, 22 bp, Homo sapiens
ccagcccttgaggtctgtccat

SEQ ID NO: 7538296 - DNA, 22 bp, Homo sapiens
ccagcccttgctgaagggtggc

SEQ ID NO: 7538297 - DNA, 22 bp, Homo sapiens
ccagcccttgctgaagggtggc

SEQ ID NO: 7538298 - DNA, 22 bp, Homo sapiens
ccagcccttgctgaagggtggc

SEQ ID NO: 7538299 - DNA, 22 bp, Homo sapiens
ccagcctcactggcatcaccta

SEQ ID NO: 7538300 - DNA, 22 bp, Homo sapiens
ccagccgcggtgagggtggctg

SEQ ID NO: 7538301 - DNA, 22 bp, Homo sapiens
ccagccggactccacttcccgt

SEQ ID NO: 7538302 - DNA, 22 bp, Homo sapiens
ccagccgcggtgagggtggctg

SEQ ID NO: 7538303 - DNA, 22 bp, Homo sapiens
ccagccctttgtggttcactga

SEQ ID NO: 7538304 - DNA, 22 bp, Homo sapiens
ccagccctttgtggttcactga

SEQ ID NO: 7538305 - DNA, 22 bp, Homo sapiens
ccagcctcactggcatcaccta

SEQ ID NO: 7538306 - DNA, 22 bp, Homo sapiens
ccagcctcactggcatcaccta

SEQ ID NO: 7538307 - DNA, 22 bp, Homo sapiens
ccagcctcactggcatcaccta

SEQ ID NO: 7538308 - DNA, 22 bp, Homo sapiens
ccagcccttgaggtctgtccat

SEQ ID NO: 7538309 - DNA, 22 bp, Homo sapiens
ccagcccttgaggtctgtccat

SEQ ID NO: 7538310 - DNA, 22 bp, Homo sapiens
ccagcccttgaggtctgtccat

SEQ ID NO: 7538311 - DNA, 22 bp, Homo sapiens
ccagcccttgaggtctgtccat

SEQ ID NO: 7538312 - DNA, 22 bp, Homo sapiens
ccagcccttgagatggaaggga

SEQ ID NO: 7538313 - DNA, 22 bp, Homo sapiens
ccagcccttgagatggaaggga

SEQ ID NO: 7538314 - DNA, 20 bp, Homo sapiens
tctgcagataagggaaagac

SEQ ID NO: 7538315 - DNA, 22 bp, Homo sapiens
tctgcagatccctttagtgagg

SEQ ID NO: 7538316 - DNA, 22 bp, Homo sapiens
tctgcagatccctttagtgagg

SEQ ID NO: 7538317 - DNA, 20 bp, Homo sapiens
tctgcagataagggaaagac

SEQ ID NO: 7538318 - DNA, 22 bp, Homo sapiens
tctgcagaggtaatttacagat

SEQ ID NO: 7538319 - DNA, 22 bp, Homo sapiens
tctgcagaggtaatttacagat

SEQ ID NO: 7538320 - DNA, 22 bp, Homo sapiens
tctgcagaggtaatttacagat

SEQ ID NO: 7538321 - DNA, 22 bp, Homo sapiens
ccagcccttgagatggaaggga

SEQ ID NO: 7538322 - DNA, 22 bp, Homo sapiens
ccagcccttgagatggaaggga

SEQ ID NO: 7538323 - DNA, 22 bp, Homo sapiens
ccagcccttgagatggaaggga

SEQ ID NO: 7538324 - DNA, 22 bp, Homo sapiens
ccagcccttgagatggaaggga

SEQ ID NO: 7538325 - DNA, 22 bp, Homo sapiens
tctgcagagcctcaggagaaca

SEQ ID NO: 7538326 - DNA, 19 bp, Homo sapiens
tctgcagaggaattcttca

SEQ ID NO: 7538327 - DNA, 19 bp, Homo sapiens
tctgcagaggaattcttca

SEQ ID NO: 7538328 - DNA, 22 bp, Homo sapiens
tctgcagagcctcaggagaaca

SEQ ID NO: 7538329 - DNA, 22 bp, Homo sapiens
tctgcagaggtaatttacagat

SEQ ID NO: 7538330 - DNA, 22 bp, Homo sapiens
tctgcagaggtaatttacagat

SEQ ID NO: 7538331 - DNA, 22 bp, Homo sapiens
tctgcagagggagtgctgggtc

SEQ ID NO: 7538332 - DNA, 22 bp, Homo sapiens
tctgcagagggagtgctgggtc

SEQ ID NO: 7538333 - DNA, 22 bp, Homo sapiens
tctgcagagggagtgctgggtc

SEQ ID NO: 7538334 - DNA, 17 bp, Homo sapiens
tctgcagaggcaaacct

SEQ ID NO: 7538335 - DNA, 22 bp, Homo sapiens
tctgcagagcattatagcaaaa

SEQ ID NO: 7538336 - DNA, 22 bp, Homo sapiens
tctgcagagcattatagcaaaa

SEQ ID NO: 7538337 - DNA, 22 bp, Homo sapiens
tctgcagagcattatagcaaaa

SEQ ID NO: 7538338 - DNA, 22 bp, Homo sapiens
tctgcagagattctgggctgag

SEQ ID NO: 7538339 - DNA, 22 bp, Homo sapiens
tctgcagagattctgggctgag

SEQ ID NO: 7538340 - DNA, 22 bp, Homo sapiens
tctgcagagattctgggctgag

SEQ ID NO: 7538341 - DNA, 22 bp, Homo sapiens
tctgcagagacaaagtgttatt

SEQ ID NO: 7538342 - DNA, 22 bp, Homo sapiens
tctgcagacttgcctaagtgtg

SEQ ID NO: 7538343 - DNA, 22 bp, Homo sapiens
tctgcagagacaaagtgttatt

SEQ ID NO: 7538344 - DNA, 22 bp, Homo sapiens
tctgcagagacaaagtgttatt

SEQ ID NO: 7538345 - DNA, 22 bp, Homo sapiens
tctgcagacttgcctaagtgtg

SEQ ID NO: 7538346 - DNA, 22 bp, Homo sapiens
tctgcagacttgcctaagtgtg

SEQ ID NO: 7538347 - DNA, 22 bp, Homo sapiens
tctgcagacttgcctaagtgtg

SEQ ID NO: 7538348 - DNA, 22 bp, Homo sapiens
tctgcagaattgtctcaagcta

SEQ ID NO: 7538349 - DNA, 22 bp, Homo sapiens
tctgcagaattcgaggaagaaa

SEQ ID NO: 7538350 - DNA, 22 bp, Homo sapiens
tctgcagacactggggtctgga

SEQ ID NO: 7538351 - DNA, 22 bp, Homo sapiens
tctgcagacactggggtctgga

SEQ ID NO: 7538352 - DNA, 22 bp, Homo sapiens
tctgcagacactggggtctgga

SEQ ID NO: 7538353 - DNA, 22 bp, Homo sapiens
tctgcagacaggaagctgaggc

SEQ ID NO: 7538354 - DNA, 22 bp, Homo sapiens
tctgcagacaggaagctgaggc

SEQ ID NO: 7538355 - DNA, 22 bp, Homo sapiens
tctgcagacaggaagctgaggc

SEQ ID NO: 7538356 - DNA, 22 bp, Homo sapiens
tctgcagacaggaagctgaggc

SEQ ID NO: 7538357 - DNA, 19 bp, Homo sapiens
tctgcagactatattgtga

SEQ ID NO: 7538358 - DNA, 19 bp, Homo sapiens
tctgcagactatattgtga

SEQ ID NO: 7538359 - DNA, 19 bp, Homo sapiens
tctgcagactatattgtga

SEQ ID NO: 7538360 - DNA, 22 bp, Homo sapiens
tctgcagacttgataaccactg

SEQ ID NO: 7538361 - DNA, 22 bp, Homo sapiens
tctgcagacttgataaccactg

SEQ ID NO: 7538362 - DNA, 22 bp, Homo sapiens
tctgcagacttgataaccactg

SEQ ID NO: 7538363 - DNA, 23 bp, Homo sapiens
tctgcagacgctgttctattgtc

SEQ ID NO: 7538364 - DNA, 23 bp, Homo sapiens
tctgcagacgctgttctattgtc

SEQ ID NO: 7538365 - DNA, 23 bp, Homo sapiens
tctgcagacgctgttctattgtc

SEQ ID NO: 7538366 - DNA, 23 bp, Homo sapiens
tctgcagacgctgttctattgtc

SEQ ID NO: 7538367 - DNA, 23 bp, Homo sapiens
tctgcagacgctgttctattgtc

SEQ ID NO: 7538368 - DNA, 22 bp, Homo sapiens
tctgcagacaggaagctgaggc

SEQ ID NO: 7538369 - DNA, 22 bp, Homo sapiens
tctgcagacaggaagctgaggc

SEQ ID NO: 7538370 - DNA, 22 bp, Homo sapiens
tcttgtgtggtggaagatatgg

SEQ ID NO: 7538371 - DNA, 22 bp, Homo sapiens
tcttgttaaagtgaagatactg

SEQ ID NO: 7538372 - DNA, 22 bp, Homo sapiens
tcttgtttctgtatataatgac

SEQ ID NO: 7538373 - DNA, 22 bp, Homo sapiens
tcttgtttctgtatataatgac

SEQ ID NO: 7538374 - DNA, 22 bp, Homo sapiens
tcttgtttctgtatataatgac

SEQ ID NO: 7538375 - DNA, 22 bp, Homo sapiens
tcttgtttctgtatataatgac

SEQ ID NO: 7538376 - DNA, 23 bp, Homo sapiens
tcttgtttcctttgcgctatcca

SEQ ID NO: 7538377 - DNA, 23 bp, Homo sapiens
tcttgtttcctttgcgctatcca

SEQ ID NO: 7538378 - DNA, 22 bp, Homo sapiens
tcttgtctaggacagtgatgtg

SEQ ID NO: 7538379 - DNA, 22 bp, Homo sapiens
tcttgtctaggacagtgatgtg

SEQ ID NO: 7538380 - DNA, 22 bp, Homo sapiens
tcttgtctaggacagtgatgtg

SEQ ID NO: 7538381 - DNA, 21 bp, Homo sapiens
tcttgtgtgggaaacaatttg

SEQ ID NO: 7538382 - DNA, 22 bp, Homo sapiens
tcttgtctgcagatactttgaa

SEQ ID NO: 7538383 - DNA, 22 bp, Homo sapiens
tcttgtgcttgcagctggggag

SEQ ID NO: 7538384 - DNA, 21 bp, Homo sapiens
tcttgtgtgctgccctgctac

SEQ ID NO: 7538385 - DNA, 21 bp, Homo sapiens
tcttgtccttgctctcccact

SEQ ID NO: 7538386 - DNA, 21 bp, Homo sapiens
tcttgtccttgctctcccact

SEQ ID NO: 7538387 - DNA, 22 bp, Homo sapiens
tcttgtcctaagagctggattc

SEQ ID NO: 7538388 - DNA, 22 bp, Homo sapiens
tcttgtttctgtatataatgac

SEQ ID NO: 7538389 - DNA, 22 bp, Homo sapiens
tcttgtttctgtatataatgac

SEQ ID NO: 7538390 - DNA, 22 bp, Homo sapiens
tcttgtttcttctaagcagcag

SEQ ID NO: 7538391 - DNA, 22 bp, Homo sapiens
tcttgtttcttctaagcagcag

SEQ ID NO: 7538392 - DNA, 22 bp, Homo sapiens
tcttgtttggattttgggcagt

SEQ ID NO: 7538393 - DNA, 22 bp, Homo sapiens
tcttgtttggattttgggcagt

SEQ ID NO: 7538394 - DNA, 22 bp, Homo sapiens
tcttgtttggattttgggcagt

SEQ ID NO: 7538395 - DNA, 22 bp, Homo sapiens
tcttgtttggattttgggcagt

SEQ ID NO: 7538396 - DNA, 22 bp, Homo sapiens
tcttgttttgaactcatcagga

SEQ ID NO: 7538397 - DNA, 22 bp, Homo sapiens
tcttgttttgaactcatcagga

SEQ ID NO: 7538398 - DNA, 22 bp, Homo sapiens
tctttaaagttggagcttgcaa

SEQ ID NO: 7538399 - DNA, 22 bp, Homo sapiens
tcttgttttgaactcatcagga

SEQ ID NO: 7538400 - DNA, 22 bp, Homo sapiens
tctttaaagttggagcttgcaa

SEQ ID NO: 7538401 - DNA, 22 bp, Homo sapiens
tctttaaagttggagcttgcaa

SEQ ID NO: 7538402 - DNA, 22 bp, Homo sapiens
tctttaaagttggagcttgcaa

SEQ ID NO: 7538403 - DNA, 22 bp, Homo sapiens
tctttaaagttggagcttgcaa

SEQ ID NO: 7538404 - DNA, 22 bp, Homo sapiens
tctttaaagttggagcttgcaa

SEQ ID NO: 7538405 - DNA, 22 bp, Homo sapiens
tctttaaagttggagcttgcaa

SEQ ID NO: 7538406 - DNA, 22 bp, Homo sapiens
tctttaaagttggagcttgcaa

SEQ ID NO: 7538407 - DNA, 22 bp, Homo sapiens
tctttaaagttggagcttgcaa

SEQ ID NO: 7538408 - DNA, 22 bp, Homo sapiens
tcttgtttcttctaagcagcag

SEQ ID NO: 7538409 - DNA, 22 bp, Homo sapiens
tctttaaagttggagcttgcaa

SEQ ID NO: 7538410 - DNA, 22 bp, Homo sapiens
tctttaaagttggagcttgcaa

SEQ ID NO: 7538411 - DNA, 22 bp, Homo sapiens
tcttggtcttctactcatcagc

SEQ ID NO: 7538412 - DNA, 19 bp, Homo sapiens
tcttgggtcgagacataga

SEQ ID NO: 7538413 - DNA, 22 bp, Homo sapiens
tcttgggggactttggcatgga

SEQ ID NO: 7538414 - DNA, 22 bp, Homo sapiens
tcttgggggactttggcatgga

SEQ ID NO: 7538415 - DNA, 22 bp, Homo sapiens
tcttgggggactttggcatgga

SEQ ID NO: 7538416 - DNA, 22 bp, Homo sapiens
tcttggtttttccagggctgat

SEQ ID NO: 7538417 - DNA, 22 bp, Homo sapiens
tcttgtaattaactagaaagat

SEQ ID NO: 7538418 - DNA, 21 bp, Homo sapiens
tcttggttccgtgtgtttgat

SEQ ID NO: 7538419 - DNA, 22 bp, Homo sapiens
tcttggttaggggaaataggca

SEQ ID NO: 7538420 - DNA, 22 bp, Homo sapiens
tcttggttaggggaaataggca

SEQ ID NO: 7538421 - DNA, 22 bp, Homo sapiens
tcttggtctttcatccttcaac

SEQ ID NO: 7538422 - DNA, 22 bp, Homo sapiens
tcttgtatgtcttcatctggtt

SEQ ID NO: 7538423 - DNA, 21 bp, Homo sapiens
tcttgtattggatctgtgtgt

SEQ ID NO: 7538424 - DNA, 21 bp, Homo sapiens
ccagcctcagatcagggagct

SEQ ID NO: 7538425 - DNA, 22 bp, Homo sapiens
ccagcctcactggcatcaccta

SEQ ID NO: 7538426 - DNA, 21 bp, Homo sapiens
ccagcctcagatcagggagct

SEQ ID NO: 7538427 - DNA, 21 bp, Homo sapiens
ccagcctcagatcagggagct

SEQ ID NO: 7538428 - DNA, 21 bp, Homo sapiens
ccagcctcagatcagggagct

SEQ ID NO: 7538429 - DNA, 21 bp, Homo sapiens
ccagcctcagatcagggagct

SEQ ID NO: 7538430 - DNA, 21 bp, Homo sapiens
ccagcctcagatcagggagct

SEQ ID NO: 7538431 - DNA, 22 bp, Homo sapiens
ccagcctcactggcatcaccta

SEQ ID NO: 7538432 - DNA, 21 bp, Homo sapiens
ccagcctcagatcagggagct

SEQ ID NO: 7538433 - DNA, 22 bp, Homo sapiens
ccagcctcactggcatcaccta

SEQ ID NO: 7538434 - DNA, 21 bp, Homo sapiens
ccagcctcagatcagggagct

SEQ ID NO: 7538435 - DNA, 18 bp, Homo sapiens
tcttgcctgcaccctctc

SEQ ID NO: 7538436 - DNA, 18 bp, Homo sapiens
tcttgcctgcaccctctc

SEQ ID NO: 7538437 - DNA, 18 bp, Homo sapiens
tcttgcctgcaccctctc

SEQ ID NO: 7538438 - DNA, 21 bp, Homo sapiens
ccagcctcagatcagggagct

SEQ ID NO: 7538439 - DNA, 21 bp, Homo sapiens
ccagcctcagatcagggagct

SEQ ID NO: 7538440 - DNA, 21 bp, Homo sapiens
ccagcctcagatcagggagct

SEQ ID NO: 7538441 - DNA, 22 bp, Homo sapiens
ccagggcatgtaactaatggtg

SEQ ID NO: 7538442 - DNA, 22 bp, Homo sapiens
ccagggcatgtaactaatggtg

SEQ ID NO: 7538443 - DNA, 22 bp, Homo sapiens
ccagggcatgggaagaactgaa

SEQ ID NO: 7538444 - DNA, 22 bp, Homo sapiens
ccagggcatgggaagaactgaa

SEQ ID NO: 7538445 - DNA, 22 bp, Homo sapiens
ccagggcatgtaactaatggtg

SEQ ID NO: 7538446 - DNA, 22 bp, Homo sapiens
ccagggcatgtaactaatggtg

SEQ ID NO: 7538447 - DNA, 22 bp, Homo sapiens
ccagggccaagagacctcgagg

SEQ ID NO: 7538448 - DNA, 22 bp, Homo sapiens
ccagggccaagagacctcgagg

SEQ ID NO: 7538449 - DNA, 22 bp, Homo sapiens
ccagggccaagagacctcgagg

SEQ ID NO: 7538450 - DNA, 22 bp, Homo sapiens
ccagggccaagagacctcgagg

SEQ ID NO: 7538451 - DNA, 22 bp, Homo sapiens
ccagggcatgtccaagacttag

SEQ ID NO: 7538452 - DNA, 22 bp, Homo sapiens
ccagggcatgtccaagacttag

SEQ ID NO: 7538453 - DNA, 22 bp, Homo sapiens
ccagggcatgtccaagacttag

SEQ ID NO: 7538454 - DNA, 22 bp, Homo sapiens
tgacagagtccagaagtagtgt

SEQ ID NO: 7538455 - DNA, 22 bp, Homo sapiens
tgacagaggctgagttagtctg

SEQ ID NO: 7538456 - DNA, 22 bp, Homo sapiens
tgacagagtccagaagtagtgt

SEQ ID NO: 7538457 - DNA, 22 bp, Homo sapiens
tgacagaggcacccacaactat

SEQ ID NO: 7538458 - DNA, 22 bp, Homo sapiens
tgacagaggctgagttagtctg

SEQ ID NO: 7538459 - DNA, 22 bp, Homo sapiens
tgacagagtcggggcaagctgt

SEQ ID NO: 7538460 - DNA, 22 bp, Homo sapiens
tgacagagtcggggcaagctgt

SEQ ID NO: 7538461 - DNA, 22 bp, Homo sapiens
tgacagagtcggggcaagctgt

SEQ ID NO: 7538462 - DNA, 22 bp, Homo sapiens
tgacagagtccagaagtagtgt

SEQ ID NO: 7538463 - DNA, 22 bp, Homo sapiens
tgacagagtccagaagtagtgt

SEQ ID NO: 7538464 - DNA, 22 bp, Homo sapiens
ccagggcatgggaagaactgaa

SEQ ID NO: 7538465 - DNA, 22 bp, Homo sapiens
ccagggcatgggaagaactgaa

SEQ ID NO: 7538466 - DNA, 22 bp, Homo sapiens
ccagggcatgggaagaactgaa

SEQ ID NO: 7538467 - DNA, 22 bp, Homo sapiens
ccagggcatgggaagaactgaa

SEQ ID NO: 7538468 - DNA, 22 bp, Homo sapiens
tgacagagtgacactcttgtct

SEQ ID NO: 7538469 - DNA, 22 bp, Homo sapiens
ccagggcatgggaagaactgaa

SEQ ID NO: 7538470 - DNA, 22 bp, Homo sapiens
ccagggcatgggaagaactgaa

SEQ ID NO: 7538471 - DNA, 22 bp, Homo sapiens
ccagggcatgggaagaactgaa

SEQ ID NO: 7538472 - DNA, 22 bp, Homo sapiens
ccagggcatgggaagaactgaa

SEQ ID NO: 7538473 - DNA, 22 bp, Homo sapiens
ccagggcatgggaagaactgaa

SEQ ID NO: 7538474 - DNA, 22 bp, Homo sapiens
tgacagagatggaatgaatctt

SEQ ID NO: 7538475 - DNA, 23 bp, Homo sapiens
tgacagagcaagacttggtctca

SEQ ID NO: 7538476 - DNA, 23 bp, Homo sapiens
tgacagagcaagacttggtctca

SEQ ID NO: 7538477 - DNA, 22 bp, Homo sapiens
tgacagagcaagatctagataa

SEQ ID NO: 7538478 - DNA, 22 bp, Homo sapiens
tgacagagcaagatctagataa

SEQ ID NO: 7538479 - DNA, 22 bp, Homo sapiens
tgacagagcaagatcttatctc

SEQ ID NO: 7538480 - DNA, 23 bp, Homo sapiens
tgacagagcacagtgggggagat

SEQ ID NO: 7538481 - DNA, 23 bp, Homo sapiens
tgacagagcacagtgggggagat

SEQ ID NO: 7538482 - DNA, 23 bp, Homo sapiens
tgacagagcacagtgggggagat

SEQ ID NO: 7538483 - DNA, 22 bp, Homo sapiens
tgacagagaggtaagttatgaa

SEQ ID NO: 7538484 - DNA, 22 bp, Homo sapiens
tgacagagaggtaagttatgaa

SEQ ID NO: 7538485 - DNA, 22 bp, Homo sapiens
tgacagagagcttttgactgtc

SEQ ID NO: 7538486 - DNA, 22 bp, Homo sapiens
tgacagagaggtaagttatgaa

SEQ ID NO: 7538487 - DNA, 19 bp, Homo sapiens
tgacagagagcagggtggt

SEQ ID NO: 7538488 - DNA, 19 bp, Homo sapiens
tgacagagagcagggtggt

SEQ ID NO: 7538489 - DNA, 19 bp, Homo sapiens
tgacagagagcagggtggt

SEQ ID NO: 7538490 - DNA, 19 bp, Homo sapiens
tgacagagagcagggtggt

SEQ ID NO: 7538491 - DNA, 19 bp, Homo sapiens
tgacagagagcagggtggt

SEQ ID NO: 7538492 - DNA, 22 bp, Homo sapiens
tgacagaggagctggaatgatt

SEQ ID NO: 7538493 - DNA, 22 bp, Homo sapiens
tgacagaggagctggaatgatt

SEQ ID NO: 7538494 - DNA, 22 bp, Homo sapiens
tgacagaggagctggaatgatt

SEQ ID NO: 7538495 - DNA, 22 bp, Homo sapiens
tgacagagctggagaataattt

SEQ ID NO: 7538496 - DNA, 22 bp, Homo sapiens
tgacagagccaagatcagtact

SEQ ID NO: 7538497 - DNA, 22 bp, Homo sapiens
tgacagagccaagatcagtact

SEQ ID NO: 7538498 - DNA, 22 bp, Homo sapiens
tgacagagccaagatcagtact

SEQ ID NO: 7538499 - DNA, 22 bp, Homo sapiens
tgacagagcatgtagtgacagc

SEQ ID NO: 7538500 - DNA, 22 bp, Homo sapiens
tgacagagcatgtagtgacagc

SEQ ID NO: 7538501 - DNA, 22 bp, Homo sapiens
tgacagagcatgtagtgacagc

SEQ ID NO: 7538502 - DNA, 22 bp, Homo sapiens
tgacagagcatgtagtgacagc

SEQ ID NO: 7538503 - DNA, 22 bp, Homo sapiens
tgacagagcatgtagtgacagc

SEQ ID NO: 7538504 - DNA, 22 bp, Homo sapiens
tgacagagcatgtagtgacagc

SEQ ID NO: 7538505 - DNA, 22 bp, Homo sapiens
ccagggaaactttggagtggag

SEQ ID NO: 7538506 - DNA, 22 bp, Homo sapiens
ccagggaaactttggagtggag

SEQ ID NO: 7538507 - DNA, 22 bp, Homo sapiens
ccagggaaaggaggttgacttg

SEQ ID NO: 7538508 - DNA, 22 bp, Homo sapiens
ccagggaaaggaggttgacttg

SEQ ID NO: 7538509 - DNA, 22 bp, Homo sapiens
ccagggaaaggaggttgacttg

SEQ ID NO: 7538510 - DNA, 22 bp, Homo sapiens
ccagggaagaaagatgaagtgc

SEQ ID NO: 7538511 - DNA, 22 bp, Homo sapiens
ccagggaagaaagatgaagtgc

SEQ ID NO: 7538512 - DNA, 22 bp, Homo sapiens
ccagggaagaaagatgaagtgc

SEQ ID NO: 7538513 - DNA, 22 bp, Homo sapiens
ccagggaaattaatgagttaat

SEQ ID NO: 7538514 - DNA, 22 bp, Homo sapiens
ccagggaaattaatgagttaat

SEQ ID NO: 7538515 - DNA, 22 bp, Homo sapiens
ccagggaaattaatgagttaat

SEQ ID NO: 7538516 - DNA, 22 bp, Homo sapiens
ccagggaagaataggtgtggtt

SEQ ID NO: 7538517 - DNA, 22 bp, Homo sapiens
ccagggaagaataggtgtggtt

SEQ ID NO: 7538518 - DNA, 22 bp, Homo sapiens
ccagggaagaataggtgtggtt

SEQ ID NO: 7538519 - DNA, 22 bp, Homo sapiens
ccagggaagaccacttcctgga

SEQ ID NO: 7538520 - DNA, 22 bp, Homo sapiens
ccagggaagaccacttcctgga

SEQ ID NO: 7538521 - DNA, 22 bp, Homo sapiens
ccagggaagaccacttcctgga

SEQ ID NO: 7538522 - DNA, 21 bp, Homo sapiens
ccagggaagaaatgagggcag

SEQ ID NO: 7538523 - DNA, 21 bp, Homo sapiens
ccagggaagaaatgagggcag

SEQ ID NO: 7538524 - DNA, 21 bp, Homo sapiens
ccagggaagaaatgagggcag

SEQ ID NO: 7538525 - DNA, 22 bp, Homo sapiens
ccagggaagaaagatgaagtgc

SEQ ID NO: 7538526 - DNA, 21 bp, Homo sapiens
ccagggaagaaatgagggcag

SEQ ID NO: 7538527 - DNA, 22 bp, Homo sapiens
tgacaatgggtggacaagatag

SEQ ID NO: 7538528 - DNA, 22 bp, Homo sapiens
ccagggaagattagaagccact

SEQ ID NO: 7538529 - DNA, 22 bp, Homo sapiens
tgacaatggggcacatggaaag

SEQ ID NO: 7538530 - DNA, 22 bp, Homo sapiens
tgacaatgggtggacaagatag

SEQ ID NO: 7538531 - DNA, 22 bp, Homo sapiens
tgacaatggggcacatggaaag

SEQ ID NO: 7538532 - DNA, 22 bp, Homo sapiens
tgacaattcattatatctacag

SEQ ID NO: 7538533 - DNA, 22 bp, Homo sapiens
tgacaattgcagacacagaagt

SEQ ID NO: 7538534 - DNA, 22 bp, Homo sapiens
tgacaattcattatatctacag

SEQ ID NO: 7538535 - DNA, 22 bp, Homo sapiens
tgacaattgcagacacagaagt

SEQ ID NO: 7538536 - DNA, 22 bp, Homo sapiens
tgacaattgcagacacagaagt

SEQ ID NO: 7538537 - DNA, 22 bp, Homo sapiens
tgacagagacttcagagccaaa

SEQ ID NO: 7538538 - DNA, 22 bp, Homo sapiens
tgacagagacttcagagccaaa

SEQ ID NO: 7538539 - DNA, 22 bp, Homo sapiens
tgacagagagatgggaaagggc

SEQ ID NO: 7538540 - DNA, 22 bp, Homo sapiens
tgacagagagatgggaaagggc

SEQ ID NO: 7538541 - DNA, 22 bp, Homo sapiens
tgacagagacttcagagccaaa

SEQ ID NO: 7538542 - DNA, 22 bp, Homo sapiens
tgacagagacttcagagccaaa

SEQ ID NO: 7538543 - DNA, 22 bp, Homo sapiens
tgacaattgtgggcagtttgtg

SEQ ID NO: 7538544 - DNA, 22 bp, Homo sapiens
tgacagactttacttctcctat

SEQ ID NO: 7538545 - DNA, 22 bp, Homo sapiens
tgaaggagaattaataggcatt

SEQ ID NO: 7538546 - DNA, 22 bp, Homo sapiens
tgaaggagaattaataggcatt

SEQ ID NO: 7538547 - DNA, 21 bp, Homo sapiens
tgaaggagaggaccgagtgct

SEQ ID NO: 7538548 - DNA, 21 bp, Homo sapiens
tgaaggagaggaccgagtgct

SEQ ID NO: 7538549 - DNA, 22 bp, Homo sapiens
ccaggcttggtgtgtggtcagg

SEQ ID NO: 7538550 - DNA, 22 bp, Homo sapiens
ccaggcttggtgtgtggtcagg

SEQ ID NO: 7538551 - DNA, 22 bp, Homo sapiens
ccaggctttaagaggtggaaac

SEQ ID NO: 7538552 - DNA, 22 bp, Homo sapiens
ccaggcttggtgtgtggtcagg

SEQ ID NO: 7538553 - DNA, 19 bp, Homo sapiens
ccaggctttatgcaaatac

SEQ ID NO: 7538554 - DNA, 22 bp, Homo sapiens
ccaggctttaagaggtggaaac

SEQ ID NO: 7538555 - DNA, 19 bp, Homo sapiens
ccaggctttatgcaaatac

SEQ ID NO: 7538556 - DNA, 22 bp, Homo sapiens
ccaggctttctcctgactcaca

SEQ ID NO: 7538557 - DNA, 22 bp, Homo sapiens
ccaggctttctcctgactcaca

SEQ ID NO: 7538558 - DNA, 22 bp, Homo sapiens
ccaggctttctcctgactcaca

SEQ ID NO: 7538559 - DNA, 22 bp, Homo sapiens
ccaggctttcccagcctctcca

SEQ ID NO: 7538560 - DNA, 19 bp, Homo sapiens
ccaggctttatgcaaatac

SEQ ID NO: 7538561 - DNA, 22 bp, Homo sapiens
ccaggctttcccagcctctcca

SEQ ID NO: 7538562 - DNA, 22 bp, Homo sapiens
ccaggctttcccagcctctcca

SEQ ID NO: 7538563 - DNA, 22 bp, Homo sapiens
ccaggcttttagctgcatggca

SEQ ID NO: 7538564 - DNA, 22 bp, Homo sapiens
ccaggcttttagctgcatggca

SEQ ID NO: 7538565 - DNA, 22 bp, Homo sapiens
ccaggctttctcctgactcaca

SEQ ID NO: 7538566 - DNA, 22 bp, Homo sapiens
ccaggctttgtaccaggctttc

SEQ ID NO: 7538567 - DNA, 22 bp, Homo sapiens
ccaggctttgtaccaggctttc

SEQ ID NO: 7538568 - DNA, 22 bp, Homo sapiens
ccagggaaactttggagtggag

SEQ ID NO: 7538569 - DNA, 22 bp, Homo sapiens
ccagggaaactttggagtggag

SEQ ID NO: 7538570 - DNA, 22 bp, Homo sapiens
ccagggaaacagcccagtgtga

SEQ ID NO: 7538571 - DNA, 22 bp, Homo sapiens
ccagggaaacagcccagtgtga

SEQ ID NO: 7538572 - DNA, 22 bp, Homo sapiens
ccagggaaacagcccagtgtga

SEQ ID NO: 7538573 - DNA, 22 bp, Homo sapiens
ccagggaaacagcccagtgtga

SEQ ID NO: 7538574 - DNA, 22 bp, Homo sapiens
ccagggaaaatcaacttctact

SEQ ID NO: 7538575 - DNA, 22 bp, Homo sapiens
ccagggaaaatcaacttctact

SEQ ID NO: 7538576 - DNA, 22 bp, Homo sapiens
ccaggcttttctcatggagtca

SEQ ID NO: 7538577 - DNA, 22 bp, Homo sapiens
ccaggcttttctcatggagtca

SEQ ID NO: 7538578 - DNA, 22 bp, Homo sapiens
ccaggcttttagctgcatggca

SEQ ID NO: 7538579 - DNA, 22 bp, Homo sapiens
ccaggcttttctcatggagtca

SEQ ID NO: 7538580 - DNA, 22 bp, Homo sapiens
ccagggaaaatcaacttctact

SEQ ID NO: 7538581 - DNA, 22 bp, Homo sapiens
ccagggccagtaagattggcat

SEQ ID NO: 7538582 - DNA, 22 bp, Homo sapiens
ccagggccagtaagattggcat

SEQ ID NO: 7538583 - DNA, 22 bp, Homo sapiens
ccagggccagtaagattggcat

SEQ ID NO: 7538584 - DNA, 22 bp, Homo sapiens
ccagggccagtaagattggcat

SEQ ID NO: 7538585 - DNA, 22 bp, Homo sapiens
ccagggccagtaagattggcat

SEQ ID NO: 7538586 - DNA, 22 bp, Homo sapiens
ccagggccagtaagattggcat

SEQ ID NO: 7538587 - DNA, 22 bp, Homo sapiens
ccagggcccacggccagaatag

SEQ ID NO: 7538588 - DNA, 23 bp, Homo sapiens
ccagggcccctacaccactgtcc

SEQ ID NO: 7538589 - DNA, 23 bp, Homo sapiens
ccagggcccctacaccactgtcc

SEQ ID NO: 7538590 - DNA, 23 bp, Homo sapiens
ccagggcccctacaccactgtcc

SEQ ID NO: 7538591 - DNA, 23 bp, Homo sapiens
ccagggcccctacaccactgtcc

SEQ ID NO: 7538592 - DNA, 23 bp, Homo sapiens
ccagggcccctacaccactgtcc

SEQ ID NO: 7538593 - DNA, 22 bp, Homo sapiens
ccagggcccacggccagaatag

SEQ ID NO: 7538594 - DNA, 22 bp, Homo sapiens
ccagggcccacggccagaatag

SEQ ID NO: 7538595 - DNA, 22 bp, Homo sapiens
ccagggcccacggccagaatag

SEQ ID NO: 7538596 - DNA, 22 bp, Homo sapiens
ccagggcccacggccagaatag

SEQ ID NO: 7538597 - DNA, 22 bp, Homo sapiens
tgacatttttataagagtcaaa

SEQ ID NO: 7538598 - DNA, 22 bp, Homo sapiens
tgacatttttgtacaaagtcag

SEQ ID NO: 7538599 - DNA, 22 bp, Homo sapiens
tgacatttttataagagtcaaa

SEQ ID NO: 7538600 - DNA, 22 bp, Homo sapiens
tgacatgcttgttttccttgaa

SEQ ID NO: 7538601 - DNA, 22 bp, Homo sapiens
tgacatgaaactgtgttgctac

SEQ ID NO: 7538602 - DNA, 22 bp, Homo sapiens
tgacatgaaactgtgttgctac

SEQ ID NO: 7538603 - DNA, 22 bp, Homo sapiens
tgacatctttgatctcatttag

SEQ ID NO: 7538604 - DNA, 22 bp, Homo sapiens
tgacatctttgatctcatttag

SEQ ID NO: 7538605 - DNA, 23 bp, Homo sapiens
ccagggcccctacaccactgtcc

SEQ ID NO: 7538606 - DNA, 23 bp, Homo sapiens
ccagggcccctacaccactgtcc

SEQ ID NO: 7538607 - DNA, 23 bp, Homo sapiens
ccagggcccctacaccactgtcc

SEQ ID NO: 7538608 - DNA, 23 bp, Homo sapiens
ccagggcccctacaccactgtcc

SEQ ID NO: 7538609 - DNA, 22 bp, Homo sapiens
tgacatctgccagtttggtcgt

SEQ ID NO: 7538610 - DNA, 22 bp, Homo sapiens
tgacatctgaccacacgtattc

SEQ ID NO: 7538611 - DNA, 22 bp, Homo sapiens
tgacatctgaccacacgtattc

SEQ ID NO: 7538612 - DNA, 22 bp, Homo sapiens
tgacatctgggccctcagctaa

SEQ ID NO: 7538613 - DNA, 22 bp, Homo sapiens
tgaccaaagactttagatgttc

SEQ ID NO: 7538614 - DNA, 22 bp, Homo sapiens
tgaccacacgtctggaattgtg

SEQ ID NO: 7538615 - DNA, 22 bp, Homo sapiens
tgaccaaaggtggtttatttgg

SEQ ID NO: 7538616 - DNA, 22 bp, Homo sapiens
tgaccaaagagttgcttgtatt

SEQ ID NO: 7538617 - DNA, 22 bp, Homo sapiens
tgaccaaaggtggtttatttgg

SEQ ID NO: 7538618 - DNA, 22 bp, Homo sapiens
tgaccactgacctcagccctgg

SEQ ID NO: 7538619 - DNA, 22 bp, Homo sapiens
tgaccactgacctcagccctgg

SEQ ID NO: 7538620 - DNA, 22 bp, Homo sapiens
tgaccactgaatatgactgcct

SEQ ID NO: 7538621 - DNA, 22 bp, Homo sapiens
tgaccacattgatttctcatcc

SEQ ID NO: 7538622 - DNA, 22 bp, Homo sapiens
tgaccacagacccaatgactac

SEQ ID NO: 7538623 - DNA, 22 bp, Homo sapiens
tgaccactgaaaacatggctag

SEQ ID NO: 7538624 - DNA, 22 bp, Homo sapiens
tgaccactgaaaacatggctag

SEQ ID NO: 7538625 - DNA, 22 bp, Homo sapiens
tgaccacgacatcttgtgagtt

SEQ ID NO: 7538626 - DNA, 22 bp, Homo sapiens
tgaccactgaaaacatggctag

SEQ ID NO: 7538627 - DNA, 22 bp, Homo sapiens
tgaccacagacccaatgactac

SEQ ID NO: 7538628 - DNA, 22 bp, Homo sapiens
tgaccacacttgatcactctga

SEQ ID NO: 7538629 - DNA, 22 bp, Homo sapiens
tgaccacacttgatcactctga

SEQ ID NO: 7538630 - DNA, 22 bp, Homo sapiens
tgaccacacgtctggaattgtg

SEQ ID NO: 7538631 - DNA, 22 bp, Homo sapiens
tgaccatttgatctacattcca

SEQ ID NO: 7538632 - DNA, 22 bp, Homo sapiens
tgaccatgctgtggatagcagt

SEQ ID NO: 7538633 - DNA, 22 bp, Homo sapiens
tgacccaggtgagctgtgacca

SEQ ID NO: 7538634 - DNA, 22 bp, Homo sapiens
tgaccagtgagcacagcatggt

SEQ ID NO: 7538635 - DNA, 22 bp, Homo sapiens
tgacccaagggcttagcagttt

SEQ ID NO: 7538636 - DNA, 22 bp, Homo sapiens
tgacccaagtagtgccttttct

SEQ ID NO: 7538637 - DNA, 22 bp, Homo sapiens
tgaccatttgatctacattcca

SEQ ID NO: 7538638 - DNA, 22 bp, Homo sapiens
tgaccatggtgtgccctgtgcg

SEQ ID NO: 7538639 - DNA, 22 bp, Homo sapiens
tgacccaggtgagctgtgacca

SEQ ID NO: 7538640 - DNA, 22 bp, Homo sapiens
tgacccatcaggccacatgagg

SEQ ID NO: 7538641 - DNA, 22 bp, Homo sapiens
tgaccagttaagtcatcctgtc

SEQ ID NO: 7538642 - DNA, 21 bp, Homo sapiens
tgaccagtgccccatcctgtc

SEQ ID NO: 7538643 - DNA, 22 bp, Homo sapiens
tgaccagtgatctactgggatt

SEQ ID NO: 7538644 - DNA, 22 bp, Homo sapiens
tgaccaggatactgcagggatg

SEQ ID NO: 7538645 - DNA, 22 bp, Homo sapiens
tgaccagacatcaatttcaaag

SEQ ID NO: 7538646 - DNA, 22 bp, Homo sapiens
tgaccaggatactgcagggatg

SEQ ID NO: 7538647 - DNA, 22 bp, Homo sapiens
tgactttaataggattttgcat

SEQ ID NO: 7538648 - DNA, 22 bp, Homo sapiens
tgactttaagctatctgattct

SEQ ID NO: 7538649 - DNA, 22 bp, Homo sapiens
tgactttaagctatctgattct

SEQ ID NO: 7538650 - DNA, 22 bp, Homo sapiens
tgactttaagctatctgattct

SEQ ID NO: 7538651 - DNA, 22 bp, Homo sapiens
tgaccctgcttcttggtgcagg

SEQ ID NO: 7538652 - DNA, 22 bp, Homo sapiens
tgaccctgcttcttggtgcagg

SEQ ID NO: 7538653 - DNA, 22 bp, Homo sapiens
tgactttaaagctcactctttt

SEQ ID NO: 7538654 - DNA, 22 bp, Homo sapiens
tgactttaaagctcactctttt

SEQ ID NO: 7538655 - DNA, 22 bp, Homo sapiens
tgacccatcaggccacatgagg

SEQ ID NO: 7538656 - DNA, 19 bp, Homo sapiens
tgaccccacgctccagagc

SEQ ID NO: 7538657 - DNA, 22 bp, Homo sapiens
tgaccccactgtgctcagaggt

SEQ ID NO: 7538658 - DNA, 19 bp, Homo sapiens
tgaccccacgctccagagc

SEQ ID NO: 7538659 - DNA, 22 bp, Homo sapiens
tgaccccactgtgctcagaggt

SEQ ID NO: 7538660 - DNA, 22 bp, Homo sapiens
tgaccccactgtgctcagaggt

SEQ ID NO: 7538661 - DNA, 22 bp, Homo sapiens
tgacccctatatcctgtttctt

SEQ ID NO: 7538662 - DNA, 22 bp, Homo sapiens
tgaccctgagagctgaatggct

SEQ ID NO: 7538663 - DNA, 22 bp, Homo sapiens
tgaccctcttccccatgcgctc

SEQ ID NO: 7538664 - DNA, 22 bp, Homo sapiens
tgaccctgaaatgtagtggttt

SEQ ID NO: 7538665 - DNA, 22 bp, Homo sapiens
tgaccctgagagctgaatggct

SEQ ID NO: 7538666 - DNA, 21 bp, Homo sapiens
tgaccctcccagccctgccaa

SEQ ID NO: 7538667 - DNA, 22 bp, Homo sapiens
tgacccgggcctgctacgccgc

SEQ ID NO: 7538668 - DNA, 22 bp, Homo sapiens
tgaccctctggccccacagcca

SEQ ID NO: 7538669 - DNA, 22 bp, Homo sapiens
tgaccctcttccccatgcgctc

SEQ ID NO: 7538670 - DNA, 22 bp, Homo sapiens
tgactttacagatatgtttcct

SEQ ID NO: 7538671 - DNA, 22 bp, Homo sapiens
tgactttagaattttatccaga

SEQ ID NO: 7538672 - DNA, 22 bp, Homo sapiens
tgactttagagatgggaggtca

SEQ ID NO: 7538673 - DNA, 22 bp, Homo sapiens
tgactttagacttagtcaagtt

SEQ ID NO: 7538674 - DNA, 22 bp, Homo sapiens
tgactttagaattttatccaga

SEQ ID NO: 7538675 - DNA, 22 bp, Homo sapiens
tgactttagaattttatccaga

SEQ ID NO: 7538676 - DNA, 21 bp, Homo sapiens
tgactttatattgtgtcagga

SEQ ID NO: 7538677 - DNA, 17 bp, Homo sapiens
tgactttatttgcttgg

SEQ ID NO: 7538678 - DNA, 22 bp, Homo sapiens
tgactttggactagtgatttaa

SEQ ID NO: 7538679 - DNA, 17 bp, Homo sapiens
tgactttatttgcttgg

SEQ ID NO: 7538680 - DNA, 17 bp, Homo sapiens
tgactttatttgcttgg

SEQ ID NO: 7538681 - DNA, 22 bp, Homo sapiens
tgacttttggacctcactgtcc

SEQ ID NO: 7538682 - DNA, 22 bp, Homo sapiens
tgactttgtgccatttttataa

SEQ ID NO: 7538683 - DNA, 22 bp, Homo sapiens
tgacttttggacctcactgtcc

SEQ ID NO: 7538684 - DNA, 22 bp, Homo sapiens
tgactttgtgccatttttataa

SEQ ID NO: 7538685 - DNA, 22 bp, Homo sapiens
tgactttgtccctttcaaatcc

SEQ ID NO: 7538686 - DNA, 22 bp, Homo sapiens
tgactttgtgcaagtgaattat

SEQ ID NO: 7538687 - DNA, 22 bp, Homo sapiens
tgactttggataagaaaatgag

SEQ ID NO: 7538688 - DNA, 22 bp, Homo sapiens
tgactttggataagaaaatgag

SEQ ID NO: 7538689 - DNA, 22 bp, Homo sapiens
tgactttgtccctttcaaatcc

SEQ ID NO: 7538690 - DNA, 22 bp, Homo sapiens
tgagaaaactcaaagacagatc

SEQ ID NO: 7538691 - DNA, 22 bp, Homo sapiens
tgagaaaactcaaagacagatc

SEQ ID NO: 7538692 - DNA, 22 bp, Homo sapiens
tgagaaaactcaaagacagatc

SEQ ID NO: 7538693 - DNA, 22 bp, Homo sapiens
tgagaaaacagtttgtaataat

SEQ ID NO: 7538694 - DNA, 22 bp, Homo sapiens
tgagaaaacagtttgtaataat

SEQ ID NO: 7538695 - DNA, 22 bp, Homo sapiens
tgagaaaacagtttgtaataat

SEQ ID NO: 7538696 - DNA, 22 bp, Homo sapiens
tgagaaaacagtttgtaataat

SEQ ID NO: 7538697 - DNA, 22 bp, Homo sapiens
tgagaaaacagtttgtaataat

SEQ ID NO: 7538698 - DNA, 22 bp, Homo sapiens
tgagaaaacagtttgtaataat

SEQ ID NO: 7538699 - DNA, 22 bp, Homo sapiens
tgagaaaacagtttgtaataat

SEQ ID NO: 7538700 - DNA, 22 bp, Homo sapiens
ccagggtcttcgaggcagcaat

SEQ ID NO: 7538701 - DNA, 22 bp, Homo sapiens
ccagggtcttcgaggcagcaat

SEQ ID NO: 7538702 - DNA, 22 bp, Homo sapiens
ccagggtggcgtagatgctggg

SEQ ID NO: 7538703 - DNA, 22 bp, Homo sapiens
ccagggtcttcgaggcagcaat

SEQ ID NO: 7538704 - DNA, 22 bp, Homo sapiens
ccagggtctctgctgcctgaga

SEQ ID NO: 7538705 - DNA, 22 bp, Homo sapiens
tgagaaaactcaaagacagatc

SEQ ID NO: 7538706 - DNA, 22 bp, Homo sapiens
tgagaaaactcaaagacagatc

SEQ ID NO: 7538707 - DNA, 22 bp, Homo sapiens
tgagaaaactcaaagacagatc

SEQ ID NO: 7538708 - DNA, 22 bp, Homo sapiens
tgagaaaactcaaagacagatc

SEQ ID NO: 7538709 - DNA, 22 bp, Homo sapiens
tgagaaaaggttgagatgataa

SEQ ID NO: 7538710 - DNA, 22 bp, Homo sapiens
tgagaaaactcaaagacagatc

SEQ ID NO: 7538711 - DNA, 22 bp, Homo sapiens
tgagaaaaggttgagatgataa

SEQ ID NO: 7538712 - DNA, 22 bp, Homo sapiens
tgagaaaaggttgagatgataa

SEQ ID NO: 7538713 - DNA, 22 bp, Homo sapiens
tgagaaaaggttgagatgataa

SEQ ID NO: 7538714 - DNA, 22 bp, Homo sapiens
tgagctggcaggggctcaggga

SEQ ID NO: 7538715 - DNA, 22 bp, Homo sapiens
tgagctggcaggggctcaggga

SEQ ID NO: 7538716 - DNA, 22 bp, Homo sapiens
tgagctggcaggggctcaggga

SEQ ID NO: 7538717 - DNA, 22 bp, Homo sapiens
tgagctggcaggggctcaggga

SEQ ID NO: 7538718 - DNA, 22 bp, Homo sapiens
tgagctggcaggggctcaggga

SEQ ID NO: 7538719 - DNA, 22 bp, Homo sapiens
tgagctggcaggggctcaggga

SEQ ID NO: 7538720 - DNA, 22 bp, Homo sapiens
tgagctggcaggggctcaggga

SEQ ID NO: 7538721 - DNA, 19 bp, Homo sapiens
tgagctggctgagcctctc

SEQ ID NO: 7538722 - DNA, 19 bp, Homo sapiens
tgagctggctgagcctctc

SEQ ID NO: 7538723 - DNA, 22 bp, Homo sapiens
tgagctggcaggggctcaggga

SEQ ID NO: 7538724 - DNA, 22 bp, Homo sapiens
tgagctggcacttttcctggga

SEQ ID NO: 7538725 - DNA, 22 bp, Homo sapiens
tgagcccagtctgtctgacatg

SEQ ID NO: 7538726 - DNA, 22 bp, Homo sapiens
tgagcccagtctgtctgacatg

SEQ ID NO: 7538727 - DNA, 22 bp, Homo sapiens
tgagcccaggagttggaggctg

SEQ ID NO: 7538728 - DNA, 22 bp, Homo sapiens
tgagcccaggagttggaggctg

SEQ ID NO: 7538729 - DNA, 22 bp, Homo sapiens
tgagcccaggagttggaggctg

SEQ ID NO: 7538730 - DNA, 22 bp, Homo sapiens
tgagctggcacttttcctggga

SEQ ID NO: 7538731 - DNA, 22 bp, Homo sapiens
tgagctggcacttttcctggga

SEQ ID NO: 7538732 - DNA, 22 bp, Homo sapiens
tgagctggcaggggctcaggga

SEQ ID NO: 7538733 - DNA, 19 bp, Homo sapiens
tgagctggctgagcctctc

SEQ ID NO: 7538734 - DNA, 19 bp, Homo sapiens
tgagctggctgagcctctc

SEQ ID NO: 7538735 - DNA, 22 bp, Homo sapiens
tgagctggcttgtcaaccaggg

SEQ ID NO: 7538736 - DNA, 22 bp, Homo sapiens
tgagctggcttgtcaaccaggg

SEQ ID NO: 7538737 - DNA, 22 bp, Homo sapiens
tgagctggcttgtcaaccaggg

SEQ ID NO: 7538738 - DNA, 22 bp, Homo sapiens
tgagctgggaagagcagccaga

SEQ ID NO: 7538739 - DNA, 22 bp, Homo sapiens
tgagctgggaagagcagccaga

SEQ ID NO: 7538740 - DNA, 22 bp, Homo sapiens
tgagctgggaagagcagccaga

SEQ ID NO: 7538741 - DNA, 22 bp, Homo sapiens
tgagctgggaagagcagccaga

SEQ ID NO: 7538742 - DNA, 22 bp, Homo sapiens
tgagctgggaagagcagccaga

SEQ ID NO: 7538743 - DNA, 22 bp, Homo sapiens
tgagctgggagtggtgatgagg

SEQ ID NO: 7538744 - DNA, 21 bp, Homo sapiens
tgagctgggagttctgaaaag

SEQ ID NO: 7538745 - DNA, 21 bp, Homo sapiens
tgagctgggagttctgaaaag

SEQ ID NO: 7538746 - DNA, 22 bp, Homo sapiens
tgagctgggagtggtgatgagg

SEQ ID NO: 7538747 - DNA, 22 bp, Homo sapiens
tgagcagactctgcagagccac

SEQ ID NO: 7538748 - DNA, 22 bp, Homo sapiens
tgagcagactctgcagagccac

SEQ ID NO: 7538749 - DNA, 22 bp, Homo sapiens
tgagcagacttgatgaggcagc

SEQ ID NO: 7538750 - DNA, 22 bp, Homo sapiens
tgagcagacttgatgaggcagc

SEQ ID NO: 7538751 - DNA, 22 bp, Homo sapiens
tgagcagactctgcagagccac

SEQ ID NO: 7538752 - DNA, 22 bp, Homo sapiens
tgagcagactctgcagagccac

SEQ ID NO: 7538753 - DNA, 22 bp, Homo sapiens
tgagcagaatgttcagataaat

SEQ ID NO: 7538754 - DNA, 22 bp, Homo sapiens
tgagcagaatgttcagataaat

SEQ ID NO: 7538755 - DNA, 22 bp, Homo sapiens
tgagcagaatgttcagataaat

SEQ ID NO: 7538756 - DNA, 22 bp, Homo sapiens
tgagcagaatgttcagataaat

SEQ ID NO: 7538757 - DNA, 22 bp, Homo sapiens
tgagcagaagttataaataaga

SEQ ID NO: 7538758 - DNA, 22 bp, Homo sapiens
tgagcagaagttataaataaga

SEQ ID NO: 7538759 - DNA, 22 bp, Homo sapiens
tgagcagaagttataaataaga

SEQ ID NO: 7538760 - DNA, 22 bp, Homo sapiens
tgagcagacttgatgaggcagc

SEQ ID NO: 7538761 - DNA, 22 bp, Homo sapiens
tgagcagacttgatgaggcagc

SEQ ID NO: 7538762 - DNA, 22 bp, Homo sapiens
tgagcagacttgatgaggcagc

SEQ ID NO: 7538763 - DNA, 22 bp, Homo sapiens
tgagcagagacgggggcctcca

SEQ ID NO: 7538764 - DNA, 22 bp, Homo sapiens
tgagcccaggagttggaggctg

SEQ ID NO: 7538765 - DNA, 22 bp, Homo sapiens
tgagcccaggagttggaggctg

SEQ ID NO: 7538766 - DNA, 22 bp, Homo sapiens
tgagcagagacgggggcctcca

SEQ ID NO: 7538767 - DNA, 22 bp, Homo sapiens
tgagcagagacgggggcctcca

SEQ ID NO: 7538768 - DNA, 22 bp, Homo sapiens
tgagcagagacgggggcctcca

SEQ ID NO: 7538769 - DNA, 22 bp, Homo sapiens
tgagcccaggagttggagaccg

SEQ ID NO: 7538770 - DNA, 22 bp, Homo sapiens
tgagcagaagccctcctggact

SEQ ID NO: 7538771 - DNA, 22 bp, Homo sapiens
tgagcagaagccctcctggact

SEQ ID NO: 7538772 - DNA, 22 bp, Homo sapiens
tgagcagaagccctcctggact

SEQ ID NO: 7538773 - DNA, 22 bp, Homo sapiens
tgagcagaagccctcctggact

SEQ ID NO: 7538774 - DNA, 22 bp, Homo sapiens
tgagcagaagccctcctggact

SEQ ID NO: 7538775 - DNA, 22 bp, Homo sapiens
tgagcagaagattggaacttac

SEQ ID NO: 7538776 - DNA, 22 bp, Homo sapiens
tgagcagaagattggaacttac

SEQ ID NO: 7538777 - DNA, 22 bp, Homo sapiens
tgagcagaagattggaacttac

SEQ ID NO: 7538778 - DNA, 22 bp, Homo sapiens
tgagcagaacacgggatccatg

SEQ ID NO: 7538779 - DNA, 22 bp, Homo sapiens
tgagcagaacacgggatccatg

SEQ ID NO: 7538780 - DNA, 22 bp, Homo sapiens
tgagcagaacacgggatccatg

SEQ ID NO: 7538781 - DNA, 22 bp, Homo sapiens
tgagcagaacacgggatccatg

SEQ ID NO: 7538782 - DNA, 22 bp, Homo sapiens
tgagcagaaaagaatgctgagc

SEQ ID NO: 7538783 - DNA, 22 bp, Homo sapiens
tgagcagaacacgggatccatg

SEQ ID NO: 7538784 - DNA, 22 bp, Homo sapiens
tgagcagaaaagaatgctgagc

SEQ ID NO: 7538785 - DNA, 22 bp, Homo sapiens
tgagcagaaaagaatgctgagc

SEQ ID NO: 7538786 - DNA, 22 bp, Homo sapiens
tgagcagaaaagaatgctgagc

SEQ ID NO: 7538787 - DNA, 22 bp, Homo sapiens
tgagcagaaaagaatgctgagc

SEQ ID NO: 7538788 - DNA, 22 bp, Homo sapiens
tgagcagaaaagaatgctgagc

SEQ ID NO: 7538789 - DNA, 22 bp, Homo sapiens
tgagcagaaaagaatgctgagc

SEQ ID NO: 7538790 - DNA, 22 bp, Homo sapiens
tgaggaatgctgagcagaggaa

SEQ ID NO: 7538791 - DNA, 22 bp, Homo sapiens
tgaggaatgctgagcagaggaa

SEQ ID NO: 7538792 - DNA, 22 bp, Homo sapiens
tgaggaatgtgacaaaaccaag

SEQ ID NO: 7538793 - DNA, 22 bp, Homo sapiens
tgaggaatgttttgagtgccga

SEQ ID NO: 7538794 - DNA, 22 bp, Homo sapiens
tgaggacaatccctaactcaga

SEQ ID NO: 7538795 - DNA, 22 bp, Homo sapiens
tgaggaatttctttatgaatga

SEQ ID NO: 7538796 - DNA, 22 bp, Homo sapiens
tgaggaatttctttatgaatga

SEQ ID NO: 7538797 - DNA, 22 bp, Homo sapiens
tgaggacatgagtgggacagag

SEQ ID NO: 7538798 - DNA, 22 bp, Homo sapiens
tgaggacaatccctaactcaga

SEQ ID NO: 7538799 - DNA, 22 bp, Homo sapiens
tgaggacaatccctaactcaga

SEQ ID NO: 7538800 - DNA, 22 bp, Homo sapiens
tgaggaagttgtttctcttcta

SEQ ID NO: 7538801 - DNA, 22 bp, Homo sapiens
tgaggaagttgtttctcttcta

SEQ ID NO: 7538802 - DNA, 22 bp, Homo sapiens
tgaggaatgctgagcagaggaa

SEQ ID NO: 7538803 - DNA, 22 bp, Homo sapiens
tgaggaagttgtttctcttcta

SEQ ID NO: 7538804 - DNA, 22 bp, Homo sapiens
tgaggaagttgtttctcttcta

SEQ ID NO: 7538805 - DNA, 22 bp, Homo sapiens
tgagctggtcactccttctgaa

SEQ ID NO: 7538806 - DNA, 22 bp, Homo sapiens
tgagctggtcactccttctgaa

SEQ ID NO: 7538807 - DNA, 22 bp, Homo sapiens
tgagctggtcactccttctgaa

SEQ ID NO: 7538808 - DNA, 23 bp, Homo sapiens
tgagctggtattgtccatctcca

SEQ ID NO: 7538809 - DNA, 22 bp, Homo sapiens
tgagctgggctgggctgagctg

SEQ ID NO: 7538810 - DNA, 22 bp, Homo sapiens
tgagctgggctgggctgagctg

SEQ ID NO: 7538811 - DNA, 22 bp, Homo sapiens
tgagctgggctgggctgagctg

SEQ ID NO: 7538812 - DNA, 22 bp, Homo sapiens
tgagctgggctgggctgagctg

SEQ ID NO: 7538813 - DNA, 23 bp, Homo sapiens
tgagctggtattgtccatctcca

SEQ ID NO: 7538814 - DNA, 23 bp, Homo sapiens
tgagctggtattgtccatctcca

SEQ ID NO: 7538815 - DNA, 23 bp, Homo sapiens
tgagctggtattgtccatctcca

SEQ ID NO: 7538816 - DNA, 22 bp, Homo sapiens
tgagctggggtcagctcccctg

SEQ ID NO: 7538817 - DNA, 22 bp, Homo sapiens
tgagctggggtcagctcccctg

SEQ ID NO: 7538818 - DNA, 22 bp, Homo sapiens
tgagctggggtcagctcccctg

SEQ ID NO: 7538819 - DNA, 22 bp, Homo sapiens
tgagctggggtcagctcccctg

SEQ ID NO: 7538820 - DNA, 22 bp, Homo sapiens
tgagctggggtcagctcccctg

SEQ ID NO: 7538821 - DNA, 23 bp, Homo sapiens
tgagctgggcctgcaggggtctc

SEQ ID NO: 7538822 - DNA, 23 bp, Homo sapiens
tgagctgggcctgcaggggtctc

SEQ ID NO: 7538823 - DNA, 23 bp, Homo sapiens
tgagctgggcctgcaggggtctc

SEQ ID NO: 7538824 - DNA, 23 bp, Homo sapiens
tgagctgggcctgcaggggtctc

SEQ ID NO: 7538825 - DNA, 23 bp, Homo sapiens
tgagctgggcctgcaggggtctc

SEQ ID NO: 7538826 - DNA, 22 bp, Homo sapiens
tgagctgggctgggctgagctg

SEQ ID NO: 7538827 - DNA, 22 bp, Homo sapiens
tgagctgggctgggctgagctg

SEQ ID NO: 7538828 - DNA, 22 bp, Homo sapiens
tgagctgggctgggctgagctg

SEQ ID NO: 7538829 - DNA, 22 bp, Homo sapiens
ccagtgggaacactggcattgc

SEQ ID NO: 7538830 - DNA, 22 bp, Homo sapiens
ccagtgtgccaatttacagctg

SEQ ID NO: 7538831 - DNA, 22 bp, Homo sapiens
ccagtgtgccaatttacagctg

SEQ ID NO: 7538832 - DNA, 22 bp, Homo sapiens
ccagtgtggactctctcctttg

SEQ ID NO: 7538833 - DNA, 22 bp, Homo sapiens
ccagtgtggactctctcctttg

SEQ ID NO: 7538834 - DNA, 22 bp, Homo sapiens
ccagtgtggccaggtcttctgg

SEQ ID NO: 7538835 - DNA, 22 bp, Homo sapiens
ccagtgtggccaggtgctggta

SEQ ID NO: 7538836 - DNA, 22 bp, Homo sapiens
ccagtgtggccaggtgctggta

SEQ ID NO: 7538837 - DNA, 22 bp, Homo sapiens
ccagtgggaacactggcattgc

SEQ ID NO: 7538838 - DNA, 22 bp, Homo sapiens
ccagtgggaacactggcattgc

SEQ ID NO: 7538839 - DNA, 20 bp, Homo sapiens
ccagtgggaagtgattaggt

SEQ ID NO: 7538840 - DNA, 22 bp, Homo sapiens
tgaggacattggtcaggacatg

SEQ ID NO: 7538841 - DNA, 22 bp, Homo sapiens
tgaggacattggtcaggacatg

SEQ ID NO: 7538842 - DNA, 22 bp, Homo sapiens
tgaggacatttatcttggcgca

SEQ ID NO: 7538843 - DNA, 22 bp, Homo sapiens
tgaggacatttatcttggcgca

SEQ ID NO: 7538844 - DNA, 22 bp, Homo sapiens
tgaggacatttatcttggcgca

SEQ ID NO: 7538845 - DNA, 23 bp, Homo sapiens
ccagtggcgtaaactagaggata

SEQ ID NO: 7538846 - DNA, 22 bp, Homo sapiens
tgaggacattgagactggagac

SEQ ID NO: 7538847 - DNA, 22 bp, Homo sapiens
tgaggacattgagactggagac

SEQ ID NO: 7538848 - DNA, 22 bp, Homo sapiens
tgaggacattgagactggagac

SEQ ID NO: 7538849 - DNA, 22 bp, Homo sapiens
tgaggacattgagactggagac

SEQ ID NO: 7538850 - DNA, 22 bp, Homo sapiens
tgaggacattgagactggagac

SEQ ID NO: 7538851 - DNA, 22 bp, Homo sapiens
tgaggacattaggaagtgaagg

SEQ ID NO: 7538852 - DNA, 22 bp, Homo sapiens
tgaggacattaggaagtgaagg

SEQ ID NO: 7538853 - DNA, 22 bp, Homo sapiens
tgaggacattgagactggagac

SEQ ID NO: 7538854 - DNA, 22 bp, Homo sapiens
tgaggacattgagactggagac

SEQ ID NO: 7538855 - DNA, 22 bp, Homo sapiens
tgaggacattgagactggagac

SEQ ID NO: 7538856 - DNA, 22 bp, Homo sapiens
tgaggacattgagactggagac

SEQ ID NO: 7538857 - DNA, 22 bp, Homo sapiens
tgaggacattaggaagtgaagg

SEQ ID NO: 7538858 - DNA, 22 bp, Homo sapiens
tgaggacattaggaagtgaagg

SEQ ID NO: 7538859 - DNA, 22 bp, Homo sapiens
tgaggacattaggaagtgaagg

SEQ ID NO: 7538860 - DNA, 22 bp, Homo sapiens
tgaggacatgagtgggacagag

SEQ ID NO: 7538861 - DNA, 22 bp, Homo sapiens
tgaggacatgagtgggacagag

SEQ ID NO: 7538862 - DNA, 22 bp, Homo sapiens
tgaggacatgagtgggacagag

SEQ ID NO: 7538863 - DNA, 22 bp, Homo sapiens
tgaggacatgagtgggacagag

SEQ ID NO: 7538864 - DNA, 22 bp, Homo sapiens
ccagggtgtagggattccagat

SEQ ID NO: 7538865 - DNA, 22 bp, Homo sapiens
ccagggtgtagggattccagat

SEQ ID NO: 7538866 - DNA, 22 bp, Homo sapiens
ccagggtgtgagaaggaagtag

SEQ ID NO: 7538867 - DNA, 22 bp, Homo sapiens
ccagggtgtgagaaggaagtag

SEQ ID NO: 7538868 - DNA, 22 bp, Homo sapiens
ccagggtgtgagaaggaagtag

SEQ ID NO: 7538869 - DNA, 22 bp, Homo sapiens
ccagggtgtgagaaggaagtag

SEQ ID NO: 7538870 - DNA, 22 bp, Homo sapiens
ccagggtgtgggcgtcggcacg

SEQ ID NO: 7538871 - DNA, 22 bp, Homo sapiens
ccagggtggggtccaggaacca

SEQ ID NO: 7538872 - DNA, 22 bp, Homo sapiens
ccagggtggggtccaggaacca

SEQ ID NO: 7538873 - DNA, 22 bp, Homo sapiens
ccagggtgtagggattccagat

SEQ ID NO: 7538874 - DNA, 22 bp, Homo sapiens
ccagggtggggtccaggaacca

SEQ ID NO: 7538875 - DNA, 22 bp, Homo sapiens
ccagggtggggtccaggaacca

SEQ ID NO: 7538876 - DNA, 22 bp, Homo sapiens
ccagggtggggtccaggaacca

SEQ ID NO: 7538877 - DNA, 22 bp, Homo sapiens
ccagggtggggtccaggaacca

SEQ ID NO: 7538878 - DNA, 22 bp, Homo sapiens
ccagggtggggtccaggaacca

SEQ ID NO: 7538879 - DNA, 22 bp, Homo sapiens
ccagggtggcgtagatgctggg

SEQ ID NO: 7538880 - DNA, 22 bp, Homo sapiens
ccagggtggcgtagatgctggg

SEQ ID NO: 7538881 - DNA, 22 bp, Homo sapiens
ccagggtggcgtagatgctggg

SEQ ID NO: 7538882 - DNA, 22 bp, Homo sapiens
ccagggtggcgtagatgctggg

SEQ ID NO: 7538883 - DNA, 22 bp, Homo sapiens
ccagggtggcgtagatgctggg

SEQ ID NO: 7538884 - DNA, 22 bp, Homo sapiens
ccagggtggcgtagatgctggg

SEQ ID NO: 7538885 - DNA, 22 bp, Homo sapiens
ccagggtgggaggctgaaggcg

SEQ ID NO: 7538886 - DNA, 22 bp, Homo sapiens
ccagggtggcgtagatgctggg

SEQ ID NO: 7538887 - DNA, 22 bp, Homo sapiens
ccagggtgggaggctgaaggcg

SEQ ID NO: 7538888 - DNA, 22 bp, Homo sapiens
ccagggtgggaggctgaaggcg

SEQ ID NO: 7538889 - DNA, 22 bp, Homo sapiens
ccagggtgggaggctgaaggcg

SEQ ID NO: 7538890 - DNA, 22 bp, Homo sapiens
ccagggtgggaggctgaaggcg

SEQ ID NO: 7538891 - DNA, 22 bp, Homo sapiens
ccagggtgggaggctgaaggcg

SEQ ID NO: 7538892 - DNA, 22 bp, Homo sapiens
ccagggtgggaggctgaaggcg

SEQ ID NO: 7538893 - DNA, 22 bp, Homo sapiens
ccagggtggggcaggcccactg

SEQ ID NO: 7538894 - DNA, 22 bp, Homo sapiens
ccagggtgtgggcgtcggcacg

SEQ ID NO: 7538895 - DNA, 22 bp, Homo sapiens
ccagggttataaatgcatctgt

SEQ ID NO: 7538896 - DNA, 22 bp, Homo sapiens
ccagggttcagtagcattagag

SEQ ID NO: 7538897 - DNA, 22 bp, Homo sapiens
ccagggttgcagggagccagca

SEQ ID NO: 7538898 - DNA, 22 bp, Homo sapiens
ccagggttgacaaattattggg

SEQ ID NO: 7538899 - DNA, 22 bp, Homo sapiens
ccagggttgcagggagccagca

SEQ ID NO: 7538900 - DNA, 22 bp, Homo sapiens
ccagggttgcagggagccagca

SEQ ID NO: 7538901 - DNA, 22 bp, Homo sapiens
ccagggttataaatgcatctgt

SEQ ID NO: 7538902 - DNA, 22 bp, Homo sapiens
ccagggttgcagggagccagca

SEQ ID NO: 7538903 - DNA, 22 bp, Homo sapiens
ccagggttgctgtatggcactt

SEQ ID NO: 7538904 - DNA, 22 bp, Homo sapiens
ccagggttggatgagtcactta

SEQ ID NO: 7538905 - DNA, 22 bp, Homo sapiens
ccagggttgctgtatggcactt

SEQ ID NO: 7538906 - DNA, 22 bp, Homo sapiens
ccagggttgctttagattctga

SEQ ID NO: 7538907 - DNA, 22 bp, Homo sapiens
ccagggttgctttagattctga

SEQ ID NO: 7538908 - DNA, 22 bp, Homo sapiens
ccagggttggatgagtcactta

SEQ ID NO: 7538909 - DNA, 22 bp, Homo sapiens
ccagggttggcaagcaaggctt

SEQ ID NO: 7538910 - DNA, 22 bp, Homo sapiens
ccagggttggtattcacctgga

SEQ ID NO: 7538911 - DNA, 22 bp, Homo sapiens
ccagggttggcaagcaaggctt

SEQ ID NO: 7538912 - DNA, 22 bp, Homo sapiens
ccagggttggtattcacctgga

SEQ ID NO: 7538913 - DNA, 22 bp, Homo sapiens
ccagggtttttccagttgctca

SEQ ID NO: 7538914 - DNA, 22 bp, Homo sapiens
ccagggtttcttctctgtatag

SEQ ID NO: 7538915 - DNA, 22 bp, Homo sapiens
ccagggtttcttctctgtatag

SEQ ID NO: 7538916 - DNA, 22 bp, Homo sapiens
ccagggtttttccagttgctca

SEQ ID NO: 7538917 - DNA, 22 bp, Homo sapiens
ccagggtttagcaagcctacaa

SEQ ID NO: 7538918 - DNA, 22 bp, Homo sapiens
ccagggtttagcaagcctacaa

SEQ ID NO: 7538919 - DNA, 22 bp, Homo sapiens
ccagggtttagcaagcctacaa

SEQ ID NO: 7538920 - DNA, 22 bp, Homo sapiens
ccagggtttaaattctgactat

SEQ ID NO: 7538921 - DNA, 22 bp, Homo sapiens
ccagggttggtctctctgaggt

SEQ ID NO: 7538922 - DNA, 22 bp, Homo sapiens
ccagggttggtctctctgaggt

SEQ ID NO: 7538923 - DNA, 22 bp, Homo sapiens
ccagggttggtctctctgaggt

SEQ ID NO: 7538924 - DNA, 22 bp, Homo sapiens
ccagggttggtctctctgaggt

SEQ ID NO: 7538925 - DNA, 22 bp, Homo sapiens
ccagggtttaaattctgactat

SEQ ID NO: 7538926 - DNA, 22 bp, Homo sapiens
ccagggtttaaattctgactat

SEQ ID NO: 7538927 - DNA, 22 bp, Homo sapiens
ccagggtttaaattctgactat

SEQ ID NO: 7538928 - DNA, 22 bp, Homo sapiens
ccaggtaggagagagggatcct

SEQ ID NO: 7538929 - DNA, 22 bp, Homo sapiens
ccaggtagccaaggggtctggg

SEQ ID NO: 7538930 - DNA, 22 bp, Homo sapiens
ccaggtagccaaggggtctggg

SEQ ID NO: 7538931 - DNA, 22 bp, Homo sapiens
ccaggtccctggaatttatgag

SEQ ID NO: 7538932 - DNA, 22 bp, Homo sapiens
ccaggtcaagctcccctgtggt

SEQ ID NO: 7538933 - DNA, 22 bp, Homo sapiens
ccaggtccctggaatttatgag

SEQ ID NO: 7538934 - DNA, 22 bp, Homo sapiens
ccaggtccctggaatttatgag

SEQ ID NO: 7538935 - DNA, 22 bp, Homo sapiens
ccaggtcctgttttcaccacag

SEQ ID NO: 7538936 - DNA, 22 bp, Homo sapiens
ccaggtcctgttttcaccacag

SEQ ID NO: 7538937 - DNA, 22 bp, Homo sapiens
ccaggtcaagctcccctgtggt

SEQ ID NO: 7538938 - DNA, 22 bp, Homo sapiens
tgagcacctggaccagattctg

SEQ ID NO: 7538939 - DNA, 22 bp, Homo sapiens
tgagcacctccctgacagtggg

SEQ ID NO: 7538940 - DNA, 22 bp, Homo sapiens
tgagcacctccctgacagtggg

SEQ ID NO: 7538941 - DNA, 22 bp, Homo sapiens
tgagcacctggaccagattctg

SEQ ID NO: 7538942 - DNA, 19 bp, Homo sapiens
tgagcaccttctcacgtaa

SEQ ID NO: 7538943 - DNA, 22 bp, Homo sapiens
tgagcacctggaccagattctg

SEQ ID NO: 7538944 - DNA, 22 bp, Homo sapiens
tgagcacctaccttgtccagtg

SEQ ID NO: 7538945 - DNA, 22 bp, Homo sapiens
tgagcacctactgtattccagg

SEQ ID NO: 7538946 - DNA, 22 bp, Homo sapiens
tgagcacctactgtattccagg

SEQ ID NO: 7538947 - DNA, 22 bp, Homo sapiens
tgagataataaatagctttctt

SEQ ID NO: 7538948 - DNA, 22 bp, Homo sapiens
tgagataataaatagctttctt

SEQ ID NO: 7538949 - DNA, 22 bp, Homo sapiens
tgagataaggatgttatactcg

SEQ ID NO: 7538950 - DNA, 23 bp, Homo sapiens
tgagcacctaatgctgggcactg

SEQ ID NO: 7538951 - DNA, 23 bp, Homo sapiens
tgagcacctaatgctgggcactg

SEQ ID NO: 7538952 - DNA, 22 bp, Homo sapiens
tgagcaccctctggaaaatggg

SEQ ID NO: 7538953 - DNA, 22 bp, Homo sapiens
tgagcaccatctgtttgtgtgc

SEQ ID NO: 7538954 - DNA, 22 bp, Homo sapiens
tgagcaccgccgcatttccaag

SEQ ID NO: 7538955 - DNA, 21 bp, Homo sapiens
tgagataaatttccttactac

SEQ ID NO: 7538956 - DNA, 22 bp, Homo sapiens
tgagagttttgacgcttgtaac

SEQ ID NO: 7538957 - DNA, 22 bp, Homo sapiens
tgagataacaaaattatcttca

SEQ ID NO: 7538958 - DNA, 22 bp, Homo sapiens
tgagagttttgacgcttgtaac

SEQ ID NO: 7538959 - DNA, 22 bp, Homo sapiens
tgagagttcctcctctttccac

SEQ ID NO: 7538960 - DNA, 22 bp, Homo sapiens
tgagagttcctcctctttccac

SEQ ID NO: 7538961 - DNA, 22 bp, Homo sapiens
tgagagttctctcttcaggtgg

SEQ ID NO: 7538962 - DNA, 22 bp, Homo sapiens
tgagataactattctgtcaact

SEQ ID NO: 7538963 - DNA, 22 bp, Homo sapiens
tgagataactattctgtcaact

SEQ ID NO: 7538964 - DNA, 22 bp, Homo sapiens
tgagataactctgatttatgtt

SEQ ID NO: 7538965 - DNA, 22 bp, Homo sapiens
tgagataagcaaggataaaggt

SEQ ID NO: 7538966 - DNA, 22 bp, Homo sapiens
tgagataaggaagtaattagga

SEQ ID NO: 7538967 - DNA, 22 bp, Homo sapiens
tgagagtctcagacctcctggt

SEQ ID NO: 7538968 - DNA, 22 bp, Homo sapiens
tgagagtctgttcctcttgcag

SEQ ID NO: 7538969 - DNA, 22 bp, Homo sapiens
tgagagtgaaatgtcacatgtc

SEQ ID NO: 7538970 - DNA, 22 bp, Homo sapiens
tgagagtgaaatgtcacatgtc

SEQ ID NO: 7538971 - DNA, 22 bp, Homo sapiens
tgagagtgaaatgtcacatgtc

SEQ ID NO: 7538972 - DNA, 22 bp, Homo sapiens
tgagagtacttatatgaacatt

SEQ ID NO: 7538973 - DNA, 22 bp, Homo sapiens
tgagagtacttatatgaacatt

SEQ ID NO: 7538974 - DNA, 22 bp, Homo sapiens
tgagagtattttggcattatca

SEQ ID NO: 7538975 - DNA, 22 bp, Homo sapiens
tgagagtattttggcattatca

SEQ ID NO: 7538976 - DNA, 22 bp, Homo sapiens
tgagagtattttggcattatca

SEQ ID NO: 7538977 - DNA, 19 bp, Homo sapiens
tgagagtgaggaaggcttc

SEQ ID NO: 7538978 - DNA, 22 bp, Homo sapiens
tgagagtggttcagctcagaag

SEQ ID NO: 7538979 - DNA, 22 bp, Homo sapiens
tgagaggtgaggcatgaggcat

SEQ ID NO: 7538980 - DNA, 19 bp, Homo sapiens
tgagagtgaggaaggcttc

SEQ ID NO: 7538981 - DNA, 19 bp, Homo sapiens
tgagagtgaggaaggcttc

SEQ ID NO: 7538982 - DNA, 22 bp, Homo sapiens
tgagagttattctgaatttagc

SEQ ID NO: 7538983 - DNA, 22 bp, Homo sapiens
tgagagtggttcagctcagaag

SEQ ID NO: 7538984 - DNA, 22 bp, Homo sapiens
tgagacttcctgatgaggcccg

SEQ ID NO: 7538985 - DNA, 22 bp, Homo sapiens
tgagacttaagaggtcatgttg

SEQ ID NO: 7538986 - DNA, 22 bp, Homo sapiens
tgagaggtcattaggccatgag

SEQ ID NO: 7538987 - DNA, 22 bp, Homo sapiens
tgagaggtgaggcatgaggcat

SEQ ID NO: 7538988 - DNA, 22 bp, Homo sapiens
tgagaggtcattaggccatgag

SEQ ID NO: 7538989 - DNA, 22 bp, Homo sapiens
tgagaggtcattaggccatgag

SEQ ID NO: 7538990 - DNA, 22 bp, Homo sapiens
tgagagtagagtcttcatctgt

SEQ ID NO: 7538991 - DNA, 22 bp, Homo sapiens
tgagaggtgaggcatgaggcat

SEQ ID NO: 7538992 - DNA, 22 bp, Homo sapiens
ccaggtcctgttttcaccacag

SEQ ID NO: 7538993 - DNA, 22 bp, Homo sapiens
ccaggtctatcaagttgggctc

SEQ ID NO: 7538994 - DNA, 22 bp, Homo sapiens
ccaggtctatcaagttgggctc

SEQ ID NO: 7538995 - DNA, 22 bp, Homo sapiens
ccaggtcctgttttcaccacag

SEQ ID NO: 7538996 - DNA, 22 bp, Homo sapiens
ccaggtcctgttttcaccacag

SEQ ID NO: 7538997 - DNA, 22 bp, Homo sapiens
ccaggtctatcaagttgggctc

SEQ ID NO: 7538998 - DNA, 17 bp, Homo sapiens
ccaggtctccttgcttt

SEQ ID NO: 7538999 - DNA, 19 bp, Homo sapiens
tgagactgggtgcagtact

SEQ ID NO: 7539000 - DNA, 21 bp, Homo sapiens
cccaggagaagaaaagatgca

SEQ ID NO: 7539001 - DNA, 21 bp, Homo sapiens
cccaggagaagaaaagatgca

SEQ ID NO: 7539002 - DNA, 22 bp, Homo sapiens
cccaggactcttcactgcagcc

SEQ ID NO: 7539003 - DNA, 22 bp, Homo sapiens
cccaggactcttcactgcagcc

SEQ ID NO: 7539004 - DNA, 22 bp, Homo sapiens
cccaggactcttcactgcagcc

SEQ ID NO: 7539005 - DNA, 22 bp, Homo sapiens
cccaggactcttcactgcagcc

SEQ ID NO: 7539006 - DNA, 22 bp, Homo sapiens
cccaggactcttcactgcagcc

SEQ ID NO: 7539007 - DNA, 22 bp, Homo sapiens
cccaggactcttcactgcagcc

SEQ ID NO: 7539008 - DNA, 22 bp, Homo sapiens
cccaggactcttcactgcagcc

SEQ ID NO: 7539009 - DNA, 22 bp, Homo sapiens
cccaggactctgacacccccaa

SEQ ID NO: 7539010 - DNA, 22 bp, Homo sapiens
cccaggactctgacacccccaa

SEQ ID NO: 7539011 - DNA, 22 bp, Homo sapiens
cccaggactctgacacccccaa

SEQ ID NO: 7539012 - DNA, 21 bp, Homo sapiens
cccaggagaagaaaagatgca

SEQ ID NO: 7539013 - DNA, 21 bp, Homo sapiens
cccaggagaagaaaagatgca

SEQ ID NO: 7539014 - DNA, 21 bp, Homo sapiens
cccaggagaagaaaagatgca

SEQ ID NO: 7539015 - DNA, 21 bp, Homo sapiens
cccaggagaagaaaagatgca

SEQ ID NO: 7539016 - DNA, 22 bp, Homo sapiens
cccaggagaatataatgttctt

SEQ ID NO: 7539017 - DNA, 21 bp, Homo sapiens
cccaggagaagaaaagatgca

SEQ ID NO: 7539018 - DNA, 22 bp, Homo sapiens
cccaggagaatataatgttctt

SEQ ID NO: 7539019 - DNA, 22 bp, Homo sapiens
cccaggagaatataatgttctt

SEQ ID NO: 7539020 - DNA, 22 bp, Homo sapiens
cccaggagaatataatgttctt

SEQ ID NO: 7539021 - DNA, 22 bp, Homo sapiens
cccaggaccgcgcggctgagcg

SEQ ID NO: 7539022 - DNA, 22 bp, Homo sapiens
cccaggaccgcgcggctgagcg

SEQ ID NO: 7539023 - DNA, 22 bp, Homo sapiens
cccaggaccgcgcggctgagcg

SEQ ID NO: 7539024 - DNA, 22 bp, Homo sapiens
cccaggaccgcgcggctgagcg

SEQ ID NO: 7539025 - DNA, 22 bp, Homo sapiens
cccaggactaatgagctctacg

SEQ ID NO: 7539026 - DNA, 22 bp, Homo sapiens
cccaggactaatgagctctacg

SEQ ID NO: 7539027 - DNA, 22 bp, Homo sapiens
cccaggactaatgagctctacg

SEQ ID NO: 7539028 - DNA, 22 bp, Homo sapiens
cccaggactaatgagctctacg

SEQ ID NO: 7539029 - DNA, 22 bp, Homo sapiens
cccaggactcggcactctcctt

SEQ ID NO: 7539030 - DNA, 22 bp, Homo sapiens
cccaggaccgcgcggctgagcg

SEQ ID NO: 7539031 - DNA, 22 bp, Homo sapiens
cccaggaccatccttctgtgcc

SEQ ID NO: 7539032 - DNA, 22 bp, Homo sapiens
cccaggacccttcaatggctcc

SEQ ID NO: 7539033 - DNA, 22 bp, Homo sapiens
cccaggaattggaggctgcagt

SEQ ID NO: 7539034 - DNA, 22 bp, Homo sapiens
cccaggaattggaggctgcagt

SEQ ID NO: 7539035 - DNA, 22 bp, Homo sapiens
cccaggaattggaggctgcagt

SEQ ID NO: 7539036 - DNA, 22 bp, Homo sapiens
cccaggaccatccttctgtgcc

SEQ ID NO: 7539037 - DNA, 22 bp, Homo sapiens
cccagctccagagccagaaaca

SEQ ID NO: 7539038 - DNA, 22 bp, Homo sapiens
cccagctccagagccagaaaca

SEQ ID NO: 7539039 - DNA, 22 bp, Homo sapiens
cccagctccagagccagaaaca

SEQ ID NO: 7539040 - DNA, 18 bp, Homo sapiens
cccagctccacttccctc

SEQ ID NO: 7539041 - DNA, 18 bp, Homo sapiens
cccagctccacttccctc

SEQ ID NO: 7539042 - DNA, 22 bp, Homo sapiens
cccagctccagagccagaaaca

SEQ ID NO: 7539043 - DNA, 18 bp, Homo sapiens
cccagctccacttccctc

SEQ ID NO: 7539044 - DNA, 22 bp, Homo sapiens
cccagctcccatgttctccaat

SEQ ID NO: 7539045 - DNA, 22 bp, Homo sapiens
cccagctcccatgttctccaat

SEQ ID NO: 7539046 - DNA, 22 bp, Homo sapiens
cccagctcccatgttctccaat

SEQ ID NO: 7539047 - DNA, 22 bp, Homo sapiens
cccagctcccatgttctccaat

SEQ ID NO: 7539048 - DNA, 22 bp, Homo sapiens
cccagctcccatgttctccaat

SEQ ID NO: 7539049 - DNA, 22 bp, Homo sapiens
cccagctcccatgttctccaat

SEQ ID NO: 7539050 - DNA, 22 bp, Homo sapiens
cccagctcccatgttctccaat

SEQ ID NO: 7539051 - DNA, 22 bp, Homo sapiens
cccagctcccatgttctccaat

SEQ ID NO: 7539052 - DNA, 22 bp, Homo sapiens
cccagctcccatgttctccaat

SEQ ID NO: 7539053 - DNA, 22 bp, Homo sapiens
cccagctcccatgttctccaat

SEQ ID NO: 7539054 - DNA, 22 bp, Homo sapiens
cccagctcccaagttgctatgg

SEQ ID NO: 7539055 - DNA, 22 bp, Homo sapiens
cccagctccagagccagaaaca

SEQ ID NO: 7539056 - DNA, 22 bp, Homo sapiens
cccagctcccaagttgctatgg

SEQ ID NO: 7539057 - DNA, 22 bp, Homo sapiens
cccagctcccaagttgctatgg

SEQ ID NO: 7539058 - DNA, 22 bp, Homo sapiens
cccaggaattcagggctcaagg

SEQ ID NO: 7539059 - DNA, 22 bp, Homo sapiens
cccaggaattggaggctgcagt

SEQ ID NO: 7539060 - DNA, 22 bp, Homo sapiens
cccaggaattggaggctgcagt

SEQ ID NO: 7539061 - DNA, 22 bp, Homo sapiens
cccaggaattggaggctgcagt

SEQ ID NO: 7539062 - DNA, 22 bp, Homo sapiens
cccaggaattggaggctgcagt

SEQ ID NO: 7539063 - DNA, 22 bp, Homo sapiens
cccaggaattggaggctgcagt

SEQ ID NO: 7539064 - DNA, 22 bp, Homo sapiens
cccaggaaatagccaggaggtg

SEQ ID NO: 7539065 - DNA, 22 bp, Homo sapiens
cccaggaaatagccaggaggtg

SEQ ID NO: 7539066 - DNA, 22 bp, Homo sapiens
cccaggaaatagccaggaggtg

SEQ ID NO: 7539067 - DNA, 22 bp, Homo sapiens
cccaggaaatagccaggaggtg

SEQ ID NO: 7539068 - DNA, 22 bp, Homo sapiens
cccaggaaatagccaggaggtg

SEQ ID NO: 7539069 - DNA, 22 bp, Homo sapiens
cccaggaaatagccaggaggtg

SEQ ID NO: 7539070 - DNA, 22 bp, Homo sapiens
cccagctccgagctccgagccg

SEQ ID NO: 7539071 - DNA, 22 bp, Homo sapiens
cccagctccgagctccgagccg

SEQ ID NO: 7539072 - DNA, 22 bp, Homo sapiens
cccagctccgagctccgagccg

SEQ ID NO: 7539073 - DNA, 22 bp, Homo sapiens
cccagctccgagctccgagccg

SEQ ID NO: 7539074 - DNA, 22 bp, Homo sapiens
cccagctccgagctccgagccg

SEQ ID NO: 7539075 - DNA, 22 bp, Homo sapiens
cccagctccctggtatttgtgc

SEQ ID NO: 7539076 - DNA, 22 bp, Homo sapiens
cccagctccctggtatttgtgc

SEQ ID NO: 7539077 - DNA, 22 bp, Homo sapiens
cccagctccctggtatttgtgc

SEQ ID NO: 7539078 - DNA, 22 bp, Homo sapiens
cccagctccgagctccgagccg

SEQ ID NO: 7539079 - DNA, 22 bp, Homo sapiens
tgcaggtggacacgggagacgg

SEQ ID NO: 7539080 - DNA, 22 bp, Homo sapiens
tgcaggtggacacgggagacgg

SEQ ID NO: 7539081 - DNA, 22 bp, Homo sapiens
tgcagtctctagtttctgaatg

SEQ ID NO: 7539082 - DNA, 22 bp, Homo sapiens
tgcagtctggatgtcctcagat

SEQ ID NO: 7539083 - DNA, 22 bp, Homo sapiens
cccagcctactctgccatagca

SEQ ID NO: 7539084 - DNA, 22 bp, Homo sapiens
cccagccctgacctattggaaa

SEQ ID NO: 7539085 - DNA, 22 bp, Homo sapiens
cccagccctgacctattggaaa

SEQ ID NO: 7539086 - DNA, 22 bp, Homo sapiens
tgcaggtgctgtgtcaagagag

SEQ ID NO: 7539087 - DNA, 22 bp, Homo sapiens
tgcaggtggacacgggagacgg

SEQ ID NO: 7539088 - DNA, 22 bp, Homo sapiens
tgcagtcttccagctgcacaaa

SEQ ID NO: 7539089 - DNA, 22 bp, Homo sapiens
tgcagtcttccagctgcacaaa

SEQ ID NO: 7539090 - DNA, 22 bp, Homo sapiens
tgcagtcttccagctgcacaaa

SEQ ID NO: 7539091 - DNA, 22 bp, Homo sapiens
tgcagtctggatgtcctcagat

SEQ ID NO: 7539092 - DNA, 22 bp, Homo sapiens
tgcagtctggatgtcctcagat

SEQ ID NO: 7539093 - DNA, 22 bp, Homo sapiens
tgcagtctgtacattttaagaa

SEQ ID NO: 7539094 - DNA, 22 bp, Homo sapiens
tgcagtctgtacattttaagaa

SEQ ID NO: 7539095 - DNA, 22 bp, Homo sapiens
tgcagtgaaagtatcttaattt

SEQ ID NO: 7539096 - DNA, 22 bp, Homo sapiens
tgcagtgaaagtatcttaattt

SEQ ID NO: 7539097 - DNA, 22 bp, Homo sapiens
tgcagtgagaagcagttatgat

SEQ ID NO: 7539098 - DNA, 22 bp, Homo sapiens
tgcagtgagaagcagttatgat

SEQ ID NO: 7539099 - DNA, 22 bp, Homo sapiens
tgcagtgagaagcagttatgat

SEQ ID NO: 7539100 - DNA, 22 bp, Homo sapiens
tgcagtgatttgtacaattaga

SEQ ID NO: 7539101 - DNA, 22 bp, Homo sapiens
tgcagtgatttgtacaattaga

SEQ ID NO: 7539102 - DNA, 21 bp, Homo sapiens
tgcagtgaggggagctgtcag

SEQ ID NO: 7539103 - DNA, 21 bp, Homo sapiens
tgcagtgaggggagctgtcag

SEQ ID NO: 7539104 - DNA, 22 bp, Homo sapiens
tgcagtgaggcagttgggttgg

SEQ ID NO: 7539105 - DNA, 22 bp, Homo sapiens
tgcagtgatgcttctggctcag

SEQ ID NO: 7539106 - DNA, 22 bp, Homo sapiens
tgcagtgatgcttctggctcag

SEQ ID NO: 7539107 - DNA, 22 bp, Homo sapiens
tgcagtgcagctggaatatctt

SEQ ID NO: 7539108 - DNA, 22 bp, Homo sapiens
tgcagtgcctcggcagtgcagc

SEQ ID NO: 7539109 - DNA, 22 bp, Homo sapiens
tgcagtgattaaagtgttaaat

SEQ ID NO: 7539110 - DNA, 22 bp, Homo sapiens
tgcagtgatttgtacaattaga

SEQ ID NO: 7539111 - DNA, 22 bp, Homo sapiens
tgcagtggaagaggtggagatc

SEQ ID NO: 7539112 - DNA, 22 bp, Homo sapiens
tgcagtggaagaggtggagatc

SEQ ID NO: 7539113 - DNA, 22 bp, Homo sapiens
tgcagtggaagaggtggagatc

SEQ ID NO: 7539114 - DNA, 22 bp, Homo sapiens
tgcagtggaagaggtggagatc

SEQ ID NO: 7539115 - DNA, 22 bp, Homo sapiens
tgcagtggaaagactcagactt

SEQ ID NO: 7539116 - DNA, 22 bp, Homo sapiens
tgcagtggaaagactcagactt

SEQ ID NO: 7539117 - DNA, 22 bp, Homo sapiens
tgcagtgctttggaacaaagtc

SEQ ID NO: 7539118 - DNA, 22 bp, Homo sapiens
tgcagtggaaagactcagactt

SEQ ID NO: 7539119 - DNA, 22 bp, Homo sapiens
cccagctccaagggacagcgaa

SEQ ID NO: 7539120 - DNA, 22 bp, Homo sapiens
cccagctccaagggacagcgaa

SEQ ID NO: 7539121 - DNA, 22 bp, Homo sapiens
cccagctccaagggacagcgaa

SEQ ID NO: 7539122 - DNA, 18 bp, Homo sapiens
cccagctccacttccctc

SEQ ID NO: 7539123 - DNA, 18 bp, Homo sapiens
cccagctccacttccctc

SEQ ID NO: 7539124 - DNA, 18 bp, Homo sapiens
cccagctccacttccctc

SEQ ID NO: 7539125 - DNA, 22 bp, Homo sapiens
cccagctccaagggacagcgaa

SEQ ID NO: 7539126 - DNA, 22 bp, Homo sapiens
cccagctccaagggacagcgaa

SEQ ID NO: 7539127 - DNA, 22 bp, Homo sapiens
cccagctccaagggacagcgaa

SEQ ID NO: 7539128 - DNA, 22 bp, Homo sapiens
cccagctccaagggacagcgaa

SEQ ID NO: 7539129 - DNA, 18 bp, Homo sapiens
cccagctccacttccctc

SEQ ID NO: 7539130 - DNA, 22 bp, Homo sapiens
cccagctcatcaggagccgccc

SEQ ID NO: 7539131 - DNA, 22 bp, Homo sapiens
cccagctcaagcagagagctaa

SEQ ID NO: 7539132 - DNA, 22 bp, Homo sapiens
cccagctcatcaggagccgccc

SEQ ID NO: 7539133 - DNA, 22 bp, Homo sapiens
cccagctcatcaggagccgccc

SEQ ID NO: 7539134 - DNA, 22 bp, Homo sapiens
cccagctcaagcagagagctaa

SEQ ID NO: 7539135 - DNA, 22 bp, Homo sapiens
tgcagtggcgccatctcagctc

SEQ ID NO: 7539136 - DNA, 22 bp, Homo sapiens
tgcagtggaatctggagagcag

SEQ ID NO: 7539137 - DNA, 22 bp, Homo sapiens
tgcagtggaatctggagagcag

SEQ ID NO: 7539138 - DNA, 22 bp, Homo sapiens
tgcagtggaatctggagagcag

SEQ ID NO: 7539139 - DNA, 22 bp, Homo sapiens
tgcagtggaatctggagagcag

SEQ ID NO: 7539140 - DNA, 22 bp, Homo sapiens
tgcagtggaatctggagagcag

SEQ ID NO: 7539141 - DNA, 22 bp, Homo sapiens
tgcagtggaagaggtggagatc

SEQ ID NO: 7539142 - DNA, 22 bp, Homo sapiens
tgcagtggaggccgtgagacag

SEQ ID NO: 7539143 - DNA, 22 bp, Homo sapiens
tgcagtggaggccgtgagacag

SEQ ID NO: 7539144 - DNA, 22 bp, Homo sapiens
tgcagtggaatctggagagcag

SEQ ID NO: 7539145 - DNA, 22 bp, Homo sapiens
tgcagtggaggccgtgagacag

SEQ ID NO: 7539146 - DNA, 22 bp, Homo sapiens
tgcagtggaatctggagagcag

SEQ ID NO: 7539147 - DNA, 22 bp, Homo sapiens
tgcagtggcgccatctcagctc

SEQ ID NO: 7539148 - DNA, 22 bp, Homo sapiens
tgcagtggaggccgtgagacag

SEQ ID NO: 7539149 - DNA, 22 bp, Homo sapiens
tgcagtggaggccgtgagacag

SEQ ID NO: 7539150 - DNA, 22 bp, Homo sapiens
cccagcccccgagtgtctggaa

SEQ ID NO: 7539151 - DNA, 22 bp, Homo sapiens
cccagcccccgagtgtctggaa

SEQ ID NO: 7539152 - DNA, 22 bp, Homo sapiens
cccagcccccgagtgtctggaa

SEQ ID NO: 7539153 - DNA, 22 bp, Homo sapiens
cccagcccccgagtgtctggaa

SEQ ID NO: 7539154 - DNA, 22 bp, Homo sapiens
cccagcccccgagtgtctggaa

SEQ ID NO: 7539155 - DNA, 22 bp, Homo sapiens
cccagcccatctcaaaggtcta

SEQ ID NO: 7539156 - DNA, 22 bp, Homo sapiens
cccagcccatctcaaaggtcta

SEQ ID NO: 7539157 - DNA, 22 bp, Homo sapiens
cccagcccatctcaaaggtcta

SEQ ID NO: 7539158 - DNA, 20 bp, Homo sapiens
cccagcccctacctgttgcc

SEQ ID NO: 7539159 - DNA, 20 bp, Homo sapiens
cccagcccctacctgttgcc

SEQ ID NO: 7539160 - DNA, 20 bp, Homo sapiens
cccagcccctacctgttgcc

SEQ ID NO: 7539161 - DNA, 22 bp, Homo sapiens
cccagcccccgagtgtctggaa

SEQ ID NO: 7539162 - DNA, 22 bp, Homo sapiens
cccagcccccgagtgtctggaa

SEQ ID NO: 7539163 - DNA, 22 bp, Homo sapiens
cccagcccccgagtgtctggaa

SEQ ID NO: 7539164 - DNA, 22 bp, Homo sapiens
cccagcccccgagtgtctggaa

SEQ ID NO: 7539165 - DNA, 22 bp, Homo sapiens
cccagcccagcgttcgaggggt

SEQ ID NO: 7539166 - DNA, 20 bp, Homo sapiens
cccagcccgggccgcgctcg

SEQ ID NO: 7539167 - DNA, 20 bp, Homo sapiens
cccagcccgggccgcgctcg

SEQ ID NO: 7539168 - DNA, 20 bp, Homo sapiens
cccagcccgggccgcgctcg

SEQ ID NO: 7539169 - DNA, 20 bp, Homo sapiens
cccagcccgggccgcgctcg

SEQ ID NO: 7539170 - DNA, 22 bp, Homo sapiens
cccagccctgacctattggaaa

SEQ ID NO: 7539171 - DNA, 22 bp, Homo sapiens
cccagccctgacctattggaaa

SEQ ID NO: 7539172 - DNA, 20 bp, Homo sapiens
cccagcccctacctgttgcc

SEQ ID NO: 7539173 - DNA, 20 bp, Homo sapiens
cccagcccctacctgttgcc

SEQ ID NO: 7539174 - DNA, 20 bp, Homo sapiens
cccagcccgggccgcgctcg

SEQ ID NO: 7539175 - DNA, 20 bp, Homo sapiens
cccagcccgggccgcgctcg

SEQ ID NO: 7539176 - DNA, 20 bp, Homo sapiens
cccagcccctacctgttgcc

SEQ ID NO: 7539177 - DNA, 20 bp, Homo sapiens
cccagcccctacctgttgcc

SEQ ID NO: 7539178 - DNA, 20 bp, Homo sapiens
cccagcccctacctgttgcc

SEQ ID NO: 7539179 - DNA, 19 bp, Homo sapiens
cccagccaggtcttgcatc

SEQ ID NO: 7539180 - DNA, 19 bp, Homo sapiens
cccagccaggtcttgcatc

SEQ ID NO: 7539181 - DNA, 19 bp, Homo sapiens
cccagccaggtcttgcatc

SEQ ID NO: 7539182 - DNA, 22 bp, Homo sapiens
cccagccagcctcttcccatat

SEQ ID NO: 7539183 - DNA, 19 bp, Homo sapiens
cccagccaggtcttgcatc

SEQ ID NO: 7539184 - DNA, 19 bp, Homo sapiens
cccagccaggtcttgcatc

SEQ ID NO: 7539185 - DNA, 18 bp, Homo sapiens
cccagcccaccatttctc

SEQ ID NO: 7539186 - DNA, 18 bp, Homo sapiens
cccagcccaccatttctc

SEQ ID NO: 7539187 - DNA, 19 bp, Homo sapiens
cccagccaggtcttgcatc

SEQ ID NO: 7539188 - DNA, 18 bp, Homo sapiens
cccagcccaccatttctc

SEQ ID NO: 7539189 - DNA, 19 bp, Homo sapiens
cccagccaggtcttgcatc

SEQ ID NO: 7539190 - DNA, 22 bp, Homo sapiens
cccagcccacggtcctgggtgg

SEQ ID NO: 7539191 - DNA, 22 bp, Homo sapiens
cccagcccacggtcctgggtgg

SEQ ID NO: 7539192 - DNA, 22 bp, Homo sapiens
cccagcccacggtcctgggtgg

SEQ ID NO: 7539193 - DNA, 18 bp, Homo sapiens
cccagcccaccatttctc

SEQ ID NO: 7539194 - DNA, 18 bp, Homo sapiens
cccagcccaccatttctc

SEQ ID NO: 7539195 - DNA, 18 bp, Homo sapiens
cccagcccaccatttctc

SEQ ID NO: 7539196 - DNA, 18 bp, Homo sapiens
cccagcccaccatttctc

SEQ ID NO: 7539197 - DNA, 18 bp, Homo sapiens
cccagcccaccatttctc

SEQ ID NO: 7539198 - DNA, 22 bp, Homo sapiens
cccagcccagcgttcgaggggt

SEQ ID NO: 7539199 - DNA, 22 bp, Homo sapiens
cccagcccatctcaaaggtcta

SEQ ID NO: 7539200 - DNA, 22 bp, Homo sapiens
cccagcccagcgttcgaggggt

SEQ ID NO: 7539201 - DNA, 22 bp, Homo sapiens
cccagcccagcgttcgaggggt

SEQ ID NO: 7539202 - DNA, 22 bp, Homo sapiens
cccagcccagcgttcgaggggt

SEQ ID NO: 7539203 - DNA, 22 bp, Homo sapiens
cccagcccagcgttcgaggggt

SEQ ID NO: 7539204 - DNA, 22 bp, Homo sapiens
cccagcccagcgttcgaggggt

SEQ ID NO: 7539205 - DNA, 22 bp, Homo sapiens
cccagcccacggtcctgggtgg

SEQ ID NO: 7539206 - DNA, 22 bp, Homo sapiens
cccagcccacggtcctgggtgg

SEQ ID NO: 7539207 - DNA, 22 bp, Homo sapiens
cccagcccacggtcctgggtgg

SEQ ID NO: 7539208 - DNA, 22 bp, Homo sapiens
cccagcccagcgttcgaggggt

SEQ ID NO: 7539209 - DNA, 22 bp, Homo sapiens
cccagcccagcgttcgaggggt

SEQ ID NO: 7539210 - DNA, 22 bp, Homo sapiens
cccagcccacggtcctgggtgg

SEQ ID NO: 7539211 - DNA, 22 bp, Homo sapiens
cccagcccacggtcctgggtgg

SEQ ID NO: 7539212 - DNA, 22 bp, Homo sapiens
cccagcccacggtcctgggtgg

SEQ ID NO: 7539213 - DNA, 22 bp, Homo sapiens
tgcagcagtttaatgcagggtt

SEQ ID NO: 7539214 - DNA, 22 bp, Homo sapiens
tgcagcagtttaatgcagggtt

SEQ ID NO: 7539215 - DNA, 22 bp, Homo sapiens
tgcagcagtttaatgcagggtt

SEQ ID NO: 7539216 - DNA, 22 bp, Homo sapiens
tgcagcagtttaatgcagggtt

SEQ ID NO: 7539217 - DNA, 22 bp, Homo sapiens
tgcagcagtttaatgcagggtt

SEQ ID NO: 7539218 - DNA, 22 bp, Homo sapiens
tgcagcagtgttccttggcttg

SEQ ID NO: 7539219 - DNA, 22 bp, Homo sapiens
tgcagcagtttaatgcagggtt

SEQ ID NO: 7539220 - DNA, 17 bp, Homo sapiens
tgcagcagttcccatct

SEQ ID NO: 7539221 - DNA, 22 bp, Homo sapiens
tgcagcagtgttccttggcttg

SEQ ID NO: 7539222 - DNA, 22 bp, Homo sapiens
tgcagcatctccttaaatcttg

SEQ ID NO: 7539223 - DNA, 22 bp, Homo sapiens
tgcagcatctccttaaatcttg

SEQ ID NO: 7539224 - DNA, 22 bp, Homo sapiens
tgcagcagtttaatgcagggtt

SEQ ID NO: 7539225 - DNA, 22 bp, Homo sapiens
tgcagcatatagcttagtgatg

SEQ ID NO: 7539226 - DNA, 22 bp, Homo sapiens
tgcagcatgcaggagaggctct

SEQ ID NO: 7539227 - DNA, 22 bp, Homo sapiens
tgcagcatgcaggagaggctct

SEQ ID NO: 7539228 - DNA, 22 bp, Homo sapiens
tgcagcatgcaggagaggctct

SEQ ID NO: 7539229 - DNA, 22 bp, Homo sapiens
tgcagcatgcaggagaggctct

SEQ ID NO: 7539230 - DNA, 22 bp, Homo sapiens
tgcagcatctccttgtgccatg

SEQ ID NO: 7539231 - DNA, 22 bp, Homo sapiens
cccagcaggtgccatcactctg

SEQ ID NO: 7539232 - DNA, 22 bp, Homo sapiens
cccagcaggtgccatcactctg

SEQ ID NO: 7539233 - DNA, 22 bp, Homo sapiens
tgcagcattttataccatcatt

SEQ ID NO: 7539234 - DNA, 22 bp, Homo sapiens
tgcagcattgcactccagcctg

SEQ ID NO: 7539235 - DNA, 22 bp, Homo sapiens
tgcagcattgcaaagcagtctt

SEQ ID NO: 7539236 - DNA, 22 bp, Homo sapiens
tgcagcattgaaatagctaggc

SEQ ID NO: 7539237 - DNA, 22 bp, Homo sapiens
tgcagcattcttggccactact

SEQ ID NO: 7539238 - DNA, 22 bp, Homo sapiens
tgcagcattcttggccactact

SEQ ID NO: 7539239 - DNA, 22 bp, Homo sapiens
tgcagcattctggtaaaaggca

SEQ ID NO: 7539240 - DNA, 22 bp, Homo sapiens
tgcagcattctggtaaaaggca

SEQ ID NO: 7539241 - DNA, 22 bp, Homo sapiens
tgcagcattctggtaaaaggca

SEQ ID NO: 7539242 - DNA, 22 bp, Homo sapiens
tgcagcattattcacagtagcc

SEQ ID NO: 7539243 - DNA, 22 bp, Homo sapiens
tgcagcattattcacagtagcc

SEQ ID NO: 7539244 - DNA, 22 bp, Homo sapiens
tgcagcattagtacaagtctca

SEQ ID NO: 7539245 - DNA, 22 bp, Homo sapiens
tgcagcattagtacaagtctca

SEQ ID NO: 7539246 - DNA, 22 bp, Homo sapiens
tgcagcattagtacaagtctca

SEQ ID NO: 7539247 - DNA, 22 bp, Homo sapiens
tgcagcattagtacaagtctca

SEQ ID NO: 7539248 - DNA, 22 bp, Homo sapiens
cccagccaagtgatctgaccgc

SEQ ID NO: 7539249 - DNA, 22 bp, Homo sapiens
cccagccaagtgatctgaccgc

SEQ ID NO: 7539250 - DNA, 22 bp, Homo sapiens
cccagccaaggtgctggtgttg

SEQ ID NO: 7539251 - DNA, 22 bp, Homo sapiens
cccagccagcctcttcccatat

SEQ ID NO: 7539252 - DNA, 22 bp, Homo sapiens
cccagccagcctcttcccatat

SEQ ID NO: 7539253 - DNA, 22 bp, Homo sapiens
cccagccaagtgatctgaccgc

SEQ ID NO: 7539254 - DNA, 22 bp, Homo sapiens
cccagccagcctcttcccatat

SEQ ID NO: 7539255 - DNA, 22 bp, Homo sapiens
cccagccagcctcttcccatat

SEQ ID NO: 7539256 - DNA, 22 bp, Homo sapiens
cccagccaaggtgctggtgttg

SEQ ID NO: 7539257 - DNA, 22 bp, Homo sapiens
cccagccaaggtgctggtgttg

SEQ ID NO: 7539258 - DNA, 22 bp, Homo sapiens
cccagccaaaagcaagtttacc

SEQ ID NO: 7539259 - DNA, 22 bp, Homo sapiens
cccagcatttctgggctgcact

SEQ ID NO: 7539260 - DNA, 22 bp, Homo sapiens
cccagccaaaagcaagtttacc

SEQ ID NO: 7539261 - DNA, 22 bp, Homo sapiens
cccagccaaaagcaagtttacc

SEQ ID NO: 7539262 - DNA, 22 bp, Homo sapiens
cccagcaggtgccatcactctg

SEQ ID NO: 7539263 - DNA, 22 bp, Homo sapiens
cccagcaggtgccatcactctg

SEQ ID NO: 7539264 - DNA, 22 bp, Homo sapiens
cccagcagtaaccagtggaaat

SEQ ID NO: 7539265 - DNA, 22 bp, Homo sapiens
cccagcaggtgccatcactctg

SEQ ID NO: 7539266 - DNA, 22 bp, Homo sapiens
cccagcagtaaccagtggaaat

SEQ ID NO: 7539267 - DNA, 22 bp, Homo sapiens
cccagcatctccaggcatggcc

SEQ ID NO: 7539268 - DNA, 22 bp, Homo sapiens
cccagcatggagtgaggactca

SEQ ID NO: 7539269 - DNA, 22 bp, Homo sapiens
cccagcatggagtgaggactca

SEQ ID NO: 7539270 - DNA, 22 bp, Homo sapiens
cccagcatggagtgaggactca

SEQ ID NO: 7539271 - DNA, 22 bp, Homo sapiens
cccagcatttctgggctgcact

SEQ ID NO: 7539272 - DNA, 22 bp, Homo sapiens
cccagcatttctgggctgcact

SEQ ID NO: 7539273 - DNA, 22 bp, Homo sapiens
cccagcatttctgggctgcact

SEQ ID NO: 7539274 - DNA, 22 bp, Homo sapiens
cccagcatttctgggctgcact

SEQ ID NO: 7539275 - DNA, 22 bp, Homo sapiens
cccagcatttctgggctgcact

SEQ ID NO: 7539276 - DNA, 22 bp, Homo sapiens
cccagcaggtgccatcactctg

SEQ ID NO: 7539277 - DNA, 22 bp, Homo sapiens
cccagcatgcacgctgacactc

SEQ ID NO: 7539278 - DNA, 22 bp, Homo sapiens
cccagcatgcacgctgacactc

SEQ ID NO: 7539279 - DNA, 22 bp, Homo sapiens
cccagcatgcacgctgacactc

SEQ ID NO: 7539280 - DNA, 22 bp, Homo sapiens
cccagcatggagtgaggactca

SEQ ID NO: 7539281 - DNA, 21 bp, Homo sapiens
cccaggaggctgagaagagca

SEQ ID NO: 7539282 - DNA, 21 bp, Homo sapiens
cccaggaggctgagaagagca

SEQ ID NO: 7539283 - DNA, 22 bp, Homo sapiens
cccaggaggcggaggttgtggt

SEQ ID NO: 7539284 - DNA, 21 bp, Homo sapiens
cccaggaggctgagaagagca

SEQ ID NO: 7539285 - DNA, 21 bp, Homo sapiens
cccaggaggctgagaagagca

SEQ ID NO: 7539286 - DNA, 21 bp, Homo sapiens
cccaggaggctgagaagagca

SEQ ID NO: 7539287 - DNA, 21 bp, Homo sapiens
cccaggaggctgagaagagca

SEQ ID NO: 7539288 - DNA, 22 bp, Homo sapiens
cccaggaggcggaggttgtggt

SEQ ID NO: 7539289 - DNA, 22 bp, Homo sapiens
cccaggaggcggaggttgtggt

SEQ ID NO: 7539290 - DNA, 22 bp, Homo sapiens
cccaggaggcggaggttgtggt

SEQ ID NO: 7539291 - DNA, 22 bp, Homo sapiens
cccaggaggcggaggttgtggt

SEQ ID NO: 7539292 - DNA, 22 bp, Homo sapiens
cccaggaggcggaggttgtggt

SEQ ID NO: 7539293 - DNA, 22 bp, Homo sapiens
cccaggaggcggaggttgtggt

SEQ ID NO: 7539294 - DNA, 21 bp, Homo sapiens
cccaggaggctgagaagagca

SEQ ID NO: 7539295 - DNA, 22 bp, Homo sapiens
cccaggaggcggaggttgtggt

SEQ ID NO: 7539296 - DNA, 22 bp, Homo sapiens
cccaggaggcggaggttgcagt

SEQ ID NO: 7539297 - DNA, 22 bp, Homo sapiens
cccaggaggcggaggttgcagt

SEQ ID NO: 7539298 - DNA, 22 bp, Homo sapiens
cccaggaggcggaggttgcagt

SEQ ID NO: 7539299 - DNA, 22 bp, Homo sapiens
cccaggaggcggaggttgcagt

SEQ ID NO: 7539300 - DNA, 22 bp, Homo sapiens
cccaggaggcggaggttgcagt

SEQ ID NO: 7539301 - DNA, 19 bp, Homo sapiens
cccaggaggcggaggttgc

SEQ ID NO: 7539302 - DNA, 22 bp, Homo sapiens
cccaggaggcggaggttgtggt

SEQ ID NO: 7539303 - DNA, 22 bp, Homo sapiens
cccaggaggcggaggttgcagt

SEQ ID NO: 7539304 - DNA, 22 bp, Homo sapiens
cccaggaggcggaggttgcagt

SEQ ID NO: 7539305 - DNA, 22 bp, Homo sapiens
cccaggaggcggaggttgcagt

SEQ ID NO: 7539306 - DNA, 22 bp, Homo sapiens
tgccctcagaattgctccctgc

SEQ ID NO: 7539307 - DNA, 22 bp, Homo sapiens
tgccctcagcagcagctcctgc

SEQ ID NO: 7539308 - DNA, 22 bp, Homo sapiens
tgccctcagcagcagctcctgc

SEQ ID NO: 7539309 - DNA, 22 bp, Homo sapiens
tgccctcagcagcagctcctgc

SEQ ID NO: 7539310 - DNA, 22 bp, Homo sapiens
tgccctcagcagcagctcctgc

SEQ ID NO: 7539311 - DNA, 22 bp, Homo sapiens
tgccctcagcagcagctcctgc

SEQ ID NO: 7539312 - DNA, 22 bp, Homo sapiens
tgccctcagccacctccaagtt

SEQ ID NO: 7539313 - DNA, 22 bp, Homo sapiens
tgccctcagccacctccaagtt

SEQ ID NO: 7539314 - DNA, 22 bp, Homo sapiens
tgccctcagccacctccaagtt

SEQ ID NO: 7539315 - DNA, 22 bp, Homo sapiens
tgccctcagccacctccaagtt

SEQ ID NO: 7539316 - DNA, 22 bp, Homo sapiens
tgcccaggatctggcgatgctc

SEQ ID NO: 7539317 - DNA, 21 bp, Homo sapiens
cccaggaggctgagaagagca

SEQ ID NO: 7539318 - DNA, 22 bp, Homo sapiens
tgcccaggatctggcgatgctc

SEQ ID NO: 7539319 - DNA, 22 bp, Homo sapiens
tgcccaggatctggcgatgctc

SEQ ID NO: 7539320 - DNA, 22 bp, Homo sapiens
tgcccaggatctggcgatgctc

SEQ ID NO: 7539321 - DNA, 21 bp, Homo sapiens
cccaggaggctgagaagagca

SEQ ID NO: 7539322 - DNA, 21 bp, Homo sapiens
cccaggaggctgagaagagca

SEQ ID NO: 7539323 - DNA, 21 bp, Homo sapiens
cccaggaggctgagaagagca

SEQ ID NO: 7539324 - DNA, 21 bp, Homo sapiens
cccaggaggctgagaagagca

SEQ ID NO: 7539325 - DNA, 22 bp, Homo sapiens
tgccctctgcctcctctgcaga

SEQ ID NO: 7539326 - DNA, 22 bp, Homo sapiens
tgccctctgcctcctctgcaga

SEQ ID NO: 7539327 - DNA, 22 bp, Homo sapiens
tgccctctgcctcctctgcaga

SEQ ID NO: 7539328 - DNA, 22 bp, Homo sapiens
tgccctctgcctcctctgcaga

SEQ ID NO: 7539329 - DNA, 22 bp, Homo sapiens
tgccctcttaggtctgcgcagc

SEQ ID NO: 7539330 - DNA, 22 bp, Homo sapiens
tgccctcttaggtctgcgcagc

SEQ ID NO: 7539331 - DNA, 22 bp, Homo sapiens
tgccctcttaggtctgcgcagc

SEQ ID NO: 7539332 - DNA, 22 bp, Homo sapiens
tgccctcttaggtctgcgcagc

SEQ ID NO: 7539333 - DNA, 22 bp, Homo sapiens
tgccctctttctgtacagctcc

SEQ ID NO: 7539334 - DNA, 22 bp, Homo sapiens
tgccctctttctgtacagctcc

SEQ ID NO: 7539335 - DNA, 22 bp, Homo sapiens
tgccctctttctgtacagctcc

SEQ ID NO: 7539336 - DNA, 22 bp, Homo sapiens
tgccctctgcaggccgccatgg

SEQ ID NO: 7539337 - DNA, 22 bp, Homo sapiens
tgccctctgcaggccgccatgg

SEQ ID NO: 7539338 - DNA, 22 bp, Homo sapiens
tgccctctgcaggccgccatgg

SEQ ID NO: 7539339 - DNA, 22 bp, Homo sapiens
tgccctctaggctacagttcca

SEQ ID NO: 7539340 - DNA, 22 bp, Homo sapiens
tgccctctcaagttgagtcaga

SEQ ID NO: 7539341 - DNA, 22 bp, Homo sapiens
tgccctctcaagttgagtcaga

SEQ ID NO: 7539342 - DNA, 22 bp, Homo sapiens
tgccctctcaagttgagtcaga

SEQ ID NO: 7539343 - DNA, 22 bp, Homo sapiens
tgccctcctcctgagcccatgt

SEQ ID NO: 7539344 - DNA, 22 bp, Homo sapiens
tgccctctaggctacagttcca

SEQ ID NO: 7539345 - DNA, 22 bp, Homo sapiens
tgccctctaggctacagttcca

SEQ ID NO: 7539346 - DNA, 22 bp, Homo sapiens
tgccctcctcctgagcccatgt

SEQ ID NO: 7539347 - DNA, 22 bp, Homo sapiens
tgccctccctgtactgtcagga

SEQ ID NO: 7539348 - DNA, 22 bp, Homo sapiens
tgccctcattataagaggctca

SEQ ID NO: 7539349 - DNA, 22 bp, Homo sapiens
tgccctcagtttcacatgagtg

SEQ ID NO: 7539350 - DNA, 22 bp, Homo sapiens
tgccctcaggagtccctgacca

SEQ ID NO: 7539351 - DNA, 22 bp, Homo sapiens
tgccctcagccacctccaagtt

SEQ ID NO: 7539352 - DNA, 22 bp, Homo sapiens
tgccctcaggagtccctgacca

SEQ ID NO: 7539353 - DNA, 22 bp, Homo sapiens
tgccctccacagtggctccacc

SEQ ID NO: 7539354 - DNA, 22 bp, Homo sapiens
tgccctccacagtggctccacc

SEQ ID NO: 7539355 - DNA, 22 bp, Homo sapiens
tgccctcattataagaggctca

SEQ ID NO: 7539356 - DNA, 22 bp, Homo sapiens
tgccctccacagtggctccacc

SEQ ID NO: 7539357 - DNA, 22 bp, Homo sapiens
tgccctccacagtggctccacc

SEQ ID NO: 7539358 - DNA, 22 bp, Homo sapiens
tgccctccacagtggctccacc

SEQ ID NO: 7539359 - DNA, 22 bp, Homo sapiens
tgccctccctgtactgtcagga

SEQ ID NO: 7539360 - DNA, 22 bp, Homo sapiens
tgccctcccacattatggctgt

SEQ ID NO: 7539361 - DNA, 22 bp, Homo sapiens
tgccctcccacattatggctgt

SEQ ID NO: 7539362 - DNA, 22 bp, Homo sapiens
tgccctccctgtactgtcagga

SEQ ID NO: 7539363 - DNA, 22 bp, Homo sapiens
tgccctccctgtactgtcagga

SEQ ID NO: 7539364 - DNA, 22 bp, Homo sapiens
tgccctccctgtactgtcagga

SEQ ID NO: 7539365 - DNA, 23 bp, Homo sapiens
tgccctcccaatgcttcggtcac

SEQ ID NO: 7539366 - DNA, 22 bp, Homo sapiens
tgccctccacagtggctccacc

SEQ ID NO: 7539367 - DNA, 22 bp, Homo sapiens
tgccctcccacattatggctgt

SEQ ID NO: 7539368 - DNA, 23 bp, Homo sapiens
tgccctcccaatgcttcggtcac

SEQ ID NO: 7539369 - DNA, 22 bp, Homo sapiens
tgccctcccacattatggctgt

SEQ ID NO: 7539370 - DNA, 23 bp, Homo sapiens
tgccctcccaatgcttcggtcac

SEQ ID NO: 7539371 - DNA, 19 bp, Homo sapiens
cccaggagtctggctggtt

SEQ ID NO: 7539372 - DNA, 19 bp, Homo sapiens
cccaggagtctggctggtt

SEQ ID NO: 7539373 - DNA, 20 bp, Homo sapiens
cccaggagtgagcagcttta

SEQ ID NO: 7539374 - DNA, 20 bp, Homo sapiens
cccaggagtgagcagcttta

SEQ ID NO: 7539375 - DNA, 20 bp, Homo sapiens
cccaggagtgagcagcttta

SEQ ID NO: 7539376 - DNA, 20 bp, Homo sapiens
cccaggagtgagcagcttta

SEQ ID NO: 7539377 - DNA, 20 bp, Homo sapiens
cccaggagtgagcagcttta

SEQ ID NO: 7539378 - DNA, 20 bp, Homo sapiens
cccaggagtgagcagcttta

SEQ ID NO: 7539379 - DNA, 20 bp, Homo sapiens
cccaggagtgagcagcttta

SEQ ID NO: 7539380 - DNA, 20 bp, Homo sapiens
cccaggagtgagcagcttta

SEQ ID NO: 7539381 - DNA, 20 bp, Homo sapiens
cccaggagtgagcagcttta

SEQ ID NO: 7539382 - DNA, 22 bp, Homo sapiens
cccaggagttagaggttgtggt

SEQ ID NO: 7539383 - DNA, 22 bp, Homo sapiens
cccaggagttagaggttgtggt

SEQ ID NO: 7539384 - DNA, 22 bp, Homo sapiens
cccaggagttagaggttgtggt

SEQ ID NO: 7539385 - DNA, 20 bp, Homo sapiens
cccaggagtgagcagcttta

SEQ ID NO: 7539386 - DNA, 20 bp, Homo sapiens
cccaggagtgagcagcttta

SEQ ID NO: 7539387 - DNA, 20 bp, Homo sapiens
cccaggagtgagcagcttta

SEQ ID NO: 7539388 - DNA, 22 bp, Homo sapiens
cccaggagttagaggttgtggt

SEQ ID NO: 7539389 - DNA, 22 bp, Homo sapiens
cccaggagttagaggttgtggt

SEQ ID NO: 7539390 - DNA, 22 bp, Homo sapiens
tgccctggttacactggagtcc

SEQ ID NO: 7539391 - DNA, 22 bp, Homo sapiens
cccaggagttagaggttgtggt

SEQ ID NO: 7539392 - DNA, 22 bp, Homo sapiens
tgccctggttacactggagtcc

SEQ ID NO: 7539393 - DNA, 23 bp, Homo sapiens
tgcctcagtggaatgtgagggtg

SEQ ID NO: 7539394 - DNA, 22 bp, Homo sapiens
tgcctcagtctaaagtctctca

SEQ ID NO: 7539395 - DNA, 22 bp, Homo sapiens
tgcctcagtctaaagtctctca

SEQ ID NO: 7539396 - DNA, 22 bp, Homo sapiens
tgcctcagtctaaagtctctca

SEQ ID NO: 7539397 - DNA, 22 bp, Homo sapiens
tgcctcagtctaaagtctctca

SEQ ID NO: 7539398 - DNA, 22 bp, Homo sapiens
tgcctcagtctaaagtctctca

SEQ ID NO: 7539399 - DNA, 22 bp, Homo sapiens
tgccctgtcgctcactcccacc

SEQ ID NO: 7539400 - DNA, 22 bp, Homo sapiens
tgccctgtcgctcactcccacc

SEQ ID NO: 7539401 - DNA, 22 bp, Homo sapiens
tgccctggttacactggagtcc

SEQ ID NO: 7539402 - DNA, 22 bp, Homo sapiens
tgccctggttctgtgggtgagc

SEQ ID NO: 7539403 - DNA, 22 bp, Homo sapiens
tgccctggttctgtgggtgagc

SEQ ID NO: 7539404 - DNA, 22 bp, Homo sapiens
cccaggagttagaggttgtggt

SEQ ID NO: 7539405 - DNA, 22 bp, Homo sapiens
tgccctggttctgtgggtgagc

SEQ ID NO: 7539406 - DNA, 23 bp, Homo sapiens
tgcctcagtggaatgtgagggtg

SEQ ID NO: 7539407 - DNA, 23 bp, Homo sapiens
tgcctcagtggaatgtgagggtg

SEQ ID NO: 7539408 - DNA, 23 bp, Homo sapiens
tgcctcagtggaatgtgagggtg

SEQ ID NO: 7539409 - DNA, 23 bp, Homo sapiens
tgcctcagtggaatgtgagggtg

SEQ ID NO: 7539410 - DNA, 23 bp, Homo sapiens
tgcctcagtggaatgtgagggtg

SEQ ID NO: 7539411 - DNA, 22 bp, Homo sapiens
tgcctcagtttcatctgcagaa

SEQ ID NO: 7539412 - DNA, 22 bp, Homo sapiens
tgcctcagtttcatctgcagaa

SEQ ID NO: 7539413 - DNA, 22 bp, Homo sapiens
tgcctcagtttcatctgcagaa

SEQ ID NO: 7539414 - DNA, 22 bp, Homo sapiens
tgcctcagtttcatctgcagaa

SEQ ID NO: 7539415 - DNA, 22 bp, Homo sapiens
tgcctcagtttcatctgcagaa

SEQ ID NO: 7539416 - DNA, 22 bp, Homo sapiens
tgcctcagtttcatctgcagaa

SEQ ID NO: 7539417 - DNA, 22 bp, Homo sapiens
tgcctcagtttcatctgcagaa

SEQ ID NO: 7539418 - DNA, 23 bp, Homo sapiens
tgcctcagtggaatgtgagggtg

SEQ ID NO: 7539419 - DNA, 19 bp, Homo sapiens
cccaggagtctggctggtt

SEQ ID NO: 7539420 - DNA, 19 bp, Homo sapiens
cccaggagtctggctggtt

SEQ ID NO: 7539421 - DNA, 21 bp, Homo sapiens
cccaggagtcctatttaaatg

SEQ ID NO: 7539422 - DNA, 22 bp, Homo sapiens
cccaggagtaagtgacattgtt

SEQ ID NO: 7539423 - DNA, 21 bp, Homo sapiens
cccaggagtcctatttaaatg

SEQ ID NO: 7539424 - DNA, 22 bp, Homo sapiens
cccaggagtaagtgacattgtt

SEQ ID NO: 7539425 - DNA, 21 bp, Homo sapiens
cccaggagtcctatttaaatg

SEQ ID NO: 7539426 - DNA, 21 bp, Homo sapiens
cccaggagtcctatttaaatg

SEQ ID NO: 7539427 - DNA, 19 bp, Homo sapiens
cccaggagtctggctggtt

SEQ ID NO: 7539428 - DNA, 19 bp, Homo sapiens
cccaggagtctggctggtt

SEQ ID NO: 7539429 - DNA, 19 bp, Homo sapiens
cccaggagtctggctggtt

SEQ ID NO: 7539430 - DNA, 19 bp, Homo sapiens
cccaggagtctggctggtt

SEQ ID NO: 7539431 - DNA, 22 bp, Homo sapiens
cccaggagtaagtgacattgtt

SEQ ID NO: 7539432 - DNA, 22 bp, Homo sapiens
cccaggagtaagtgacattgtt

SEQ ID NO: 7539433 - DNA, 22 bp, Homo sapiens
cccaggagtaagtgacattgtt

SEQ ID NO: 7539434 - DNA, 22 bp, Homo sapiens
cccaggagtaagtgacattgtt

SEQ ID NO: 7539435 - DNA, 22 bp, Homo sapiens
cccaggagtaagtgacattgtt

SEQ ID NO: 7539436 - DNA, 22 bp, Homo sapiens
cccaggaggttggggctacagt

SEQ ID NO: 7539437 - DNA, 22 bp, Homo sapiens
cccaggaggttggggctacagt

SEQ ID NO: 7539438 - DNA, 22 bp, Homo sapiens
cccaggaggttggggctacagt

SEQ ID NO: 7539439 - DNA, 22 bp, Homo sapiens
cccaggaggttggggctacagt

SEQ ID NO: 7539440 - DNA, 22 bp, Homo sapiens
cccaggaggttggggctacagt

SEQ ID NO: 7539441 - DNA, 22 bp, Homo sapiens
tgccctgaagcaccctcaccct

SEQ ID NO: 7539442 - DNA, 22 bp, Homo sapiens
tgccctgaagcaccctcaccct

SEQ ID NO: 7539443 - DNA, 19 bp, Homo sapiens
tgccctgcacgctgtcctg

SEQ ID NO: 7539444 - DNA, 22 bp, Homo sapiens
tgccctgaggcactccatccat

SEQ ID NO: 7539445 - DNA, 22 bp, Homo sapiens
tgccctgatgatcctcctcgca

SEQ ID NO: 7539446 - DNA, 22 bp, Homo sapiens
tgccctgaagcaccctcaccct

SEQ ID NO: 7539447 - DNA, 22 bp, Homo sapiens
tgccctctttctgtacagctcc

SEQ ID NO: 7539448 - DNA, 22 bp, Homo sapiens
tgccctctttctgtacagctcc

SEQ ID NO: 7539449 - DNA, 22 bp, Homo sapiens
tgccctctttctgtacagctcc

SEQ ID NO: 7539450 - DNA, 19 bp, Homo sapiens
tgccctgcacgctgtcctg

SEQ ID NO: 7539451 - DNA, 19 bp, Homo sapiens
tgccctgcacgctgtcctg

SEQ ID NO: 7539452 - DNA, 22 bp, Homo sapiens
cccaggaggttgaggctgcagt

SEQ ID NO: 7539453 - DNA, 22 bp, Homo sapiens
cccaggaggttgaggctgcagt

SEQ ID NO: 7539454 - DNA, 22 bp, Homo sapiens
cccaggaggttgaggctgcagt

SEQ ID NO: 7539455 - DNA, 22 bp, Homo sapiens
cccaggaggttgaggctgcagt

SEQ ID NO: 7539456 - DNA, 22 bp, Homo sapiens
cccaggaggttggggctacagt

SEQ ID NO: 7539457 - DNA, 22 bp, Homo sapiens
cccaggaggttggggctacagt

SEQ ID NO: 7539458 - DNA, 22 bp, Homo sapiens
cccaggaggttggggctacagt

SEQ ID NO: 7539459 - DNA, 22 bp, Homo sapiens
cccaggaggttggggctacagt

SEQ ID NO: 7539460 - DNA, 22 bp, Homo sapiens
cccaggaggttgaggctgcagt

SEQ ID NO: 7539461 - DNA, 22 bp, Homo sapiens
cccaggaggttgaggctgcagt

SEQ ID NO: 7539462 - DNA, 22 bp, Homo sapiens
cccaggaggttgaggctgcagt

SEQ ID NO: 7539463 - DNA, 22 bp, Homo sapiens
cccaggaggaggaaaaagctcg

SEQ ID NO: 7539464 - DNA, 22 bp, Homo sapiens
cccaggaggaggaaaaagctcg

SEQ ID NO: 7539465 - DNA, 22 bp, Homo sapiens
cccaggaggaggaaaaagctcg

SEQ ID NO: 7539466 - DNA, 21 bp, Homo sapiens
cccaggaggagctccggctcc

SEQ ID NO: 7539467 - DNA, 21 bp, Homo sapiens
cccaggaggagctccggctcc

SEQ ID NO: 7539468 - DNA, 22 bp, Homo sapiens
cccaggaggaggaaaaagctcg

SEQ ID NO: 7539469 - DNA, 22 bp, Homo sapiens
cccaggaggcagaagttgcagt

SEQ ID NO: 7539470 - DNA, 22 bp, Homo sapiens
cccaggaggcagaagttgcagt

SEQ ID NO: 7539471 - DNA, 22 bp, Homo sapiens
cccaggaggaggaaaaagctcg

SEQ ID NO: 7539472 - DNA, 22 bp, Homo sapiens
cccaggaggcagaagttgcagt

SEQ ID NO: 7539473 - DNA, 22 bp, Homo sapiens
cccaggaggaggaaaaagctcg

SEQ ID NO: 7539474 - DNA, 22 bp, Homo sapiens
cccaggaggaggaaaaagctcg

SEQ ID NO: 7539475 - DNA, 22 bp, Homo sapiens
cccaggaggaggaaaaagctcg

SEQ ID NO: 7539476 - DNA, 22 bp, Homo sapiens
cccaggaggcagaagttgcagt

SEQ ID NO: 7539477 - DNA, 22 bp, Homo sapiens
cccaggaggcagaagttgcagt

SEQ ID NO: 7539478 - DNA, 22 bp, Homo sapiens
cccaggaggcagaagttgcagt

SEQ ID NO: 7539479 - DNA, 22 bp, Homo sapiens
cccaggaggcagaagttgcagt

SEQ ID NO: 7539480 - DNA, 22 bp, Homo sapiens
cccaggaggcagaagttgcagt

SEQ ID NO: 7539481 - DNA, 22 bp, Homo sapiens
cccaggaggcagaagttgcagt

SEQ ID NO: 7539482 - DNA, 22 bp, Homo sapiens
cccaggaggcagaagttgcagt

SEQ ID NO: 7539483 - DNA, 22 bp, Homo sapiens
cccaggaggcagaagttgcagt

SEQ ID NO: 7539484 - DNA, 22 bp, Homo sapiens
cccaggaggcagaagttgcagt

SEQ ID NO: 7539485 - DNA, 22 bp, Homo sapiens
cccaggaggcagagatagcagt

SEQ ID NO: 7539486 - DNA, 22 bp, Homo sapiens
cccaggaggcagagatagcagt

SEQ ID NO: 7539487 - DNA, 22 bp, Homo sapiens
cccaggaggcagagatagcagt

SEQ ID NO: 7539488 - DNA, 22 bp, Homo sapiens
cccaggaggcagagatagcagt

SEQ ID NO: 7539489 - DNA, 22 bp, Homo sapiens
cccaggaggcagagatagcagt

SEQ ID NO: 7539490 - DNA, 22 bp, Homo sapiens
cccaggaggcagagatagcagt

SEQ ID NO: 7539491 - DNA, 22 bp, Homo sapiens
cccaggaggcagagcttgcagt

SEQ ID NO: 7539492 - DNA, 22 bp, Homo sapiens
cccaggaggcagagcttgcagt

SEQ ID NO: 7539493 - DNA, 22 bp, Homo sapiens
cccaggaggcagagcttgcagt

SEQ ID NO: 7539494 - DNA, 22 bp, Homo sapiens
cccaggaggcagagcttgcagt

SEQ ID NO: 7539495 - DNA, 22 bp, Homo sapiens
cccaggaggcagagatagcagt

SEQ ID NO: 7539496 - DNA, 22 bp, Homo sapiens
cccaggaggcagagatagcagt

SEQ ID NO: 7539497 - DNA, 22 bp, Homo sapiens
cccaggaggcagagatagcagt

SEQ ID NO: 7539498 - DNA, 22 bp, Homo sapiens
cccaggaggcagagcttgcagt

SEQ ID NO: 7539499 - DNA, 22 bp, Homo sapiens
cccaggaggcagaggttgcagt

SEQ ID NO: 7539500 - DNA, 22 bp, Homo sapiens
cccaggaggcagaggttgcagt

SEQ ID NO: 7539501 - DNA, 22 bp, Homo sapiens
cccaggaggcagaggttgcagt

SEQ ID NO: 7539502 - DNA, 22 bp, Homo sapiens
cccaggaggcagaggttgcagt

SEQ ID NO: 7539503 - DNA, 22 bp, Homo sapiens
cccaggaggcagagcttgcagt

SEQ ID NO: 7539504 - DNA, 22 bp, Homo sapiens
cccaggaggcagagcttgcagt

SEQ ID NO: 7539505 - DNA, 22 bp, Homo sapiens
cccaggaggcagagcttgcagt

SEQ ID NO: 7539506 - DNA, 22 bp, Homo sapiens
cccaggaggcagagcttgcagt

SEQ ID NO: 7539507 - DNA, 22 bp, Homo sapiens
cccaggaggcagagcttgcagt

SEQ ID NO: 7539508 - DNA, 22 bp, Homo sapiens
cccaggaggccaaggttgcagt

SEQ ID NO: 7539509 - DNA, 22 bp, Homo sapiens
cccaggaggccaaggttgcagt

SEQ ID NO: 7539510 - DNA, 22 bp, Homo sapiens
cccaggaggccaaggttgcagt

SEQ ID NO: 7539511 - DNA, 22 bp, Homo sapiens
cccaggaggccaaggttgcagt

SEQ ID NO: 7539512 - DNA, 22 bp, Homo sapiens
cccaggaggcagatgttgcagt

SEQ ID NO: 7539513 - DNA, 22 bp, Homo sapiens
cccaggaggcagatgttgcagt

SEQ ID NO: 7539514 - DNA, 22 bp, Homo sapiens
cccaggaggcagatgttgcagt

SEQ ID NO: 7539515 - DNA, 22 bp, Homo sapiens
cccaggaggcagaggttggagc

SEQ ID NO: 7539516 - DNA, 22 bp, Homo sapiens
cccaggaggcagatgttgcagt

SEQ ID NO: 7539517 - DNA, 22 bp, Homo sapiens
cccaggaggcagatgttgcagt

SEQ ID NO: 7539518 - DNA, 22 bp, Homo sapiens
cccaggaggcagatgttgcagt

SEQ ID NO: 7539519 - DNA, 22 bp, Homo sapiens
cccaggaggcagatgttgcagt

SEQ ID NO: 7539520 - DNA, 22 bp, Homo sapiens
cccaggaggcagatgttgcagt

SEQ ID NO: 7539521 - DNA, 22 bp, Homo sapiens
cccaggaggcagaggttggagc

SEQ ID NO: 7539522 - DNA, 22 bp, Homo sapiens
cccaggaggcagaggttggagc

SEQ ID NO: 7539523 - DNA, 22 bp, Homo sapiens
cccaggaggcagaggttggagc

SEQ ID NO: 7539524 - DNA, 22 bp, Homo sapiens
cccaggaggcagaggttgcagt

SEQ ID NO: 7539525 - DNA, 22 bp, Homo sapiens
cccaggaggcagaggttgcagt

SEQ ID NO: 7539526 - DNA, 22 bp, Homo sapiens
cccaggaggcagaggttgcagt

SEQ ID NO: 7539527 - DNA, 22 bp, Homo sapiens
cccaggaggcagaggttggagc

SEQ ID NO: 7539528 - DNA, 22 bp, Homo sapiens
cccaggaggcagaggttgcagt

SEQ ID NO: 7539529 - DNA, 22 bp, Homo sapiens
cccaggaggcagaggttggagc

SEQ ID NO: 7539530 - DNA, 22 bp, Homo sapiens
cccaggaggcagaggttggagc

SEQ ID NO: 7539531 - DNA, 22 bp, Homo sapiens
cccaggaggcagaggttggagc

SEQ ID NO: 7539532 - DNA, 22 bp, Homo sapiens
cccaggaggcagaggttggagc

SEQ ID NO: 7539533 - DNA, 22 bp, Homo sapiens
cccaggaggcctgcctggccgg

SEQ ID NO: 7539534 - DNA, 19 bp, Homo sapiens
cccaggaggcggaggttgc

SEQ ID NO: 7539535 - DNA, 19 bp, Homo sapiens
cccaggaggcggaggttgc

SEQ ID NO: 7539536 - DNA, 19 bp, Homo sapiens
cccaggaggcggaggttgc

SEQ ID NO: 7539537 - DNA, 22 bp, Homo sapiens
cccaggaggcgcaggttgcggt

SEQ ID NO: 7539538 - DNA, 19 bp, Homo sapiens
cccaggaggcggaggttgc

SEQ ID NO: 7539539 - DNA, 22 bp, Homo sapiens
cccaggaggcgcaggttgcggt

SEQ ID NO: 7539540 - DNA, 22 bp, Homo sapiens
cccaggaggcgcaggttgcggt

SEQ ID NO: 7539541 - DNA, 22 bp, Homo sapiens
cccaggaggcgcaggttgcggt

SEQ ID NO: 7539542 - DNA, 22 bp, Homo sapiens
cccaggaggcctgcctggccgg

SEQ ID NO: 7539543 - DNA, 22 bp, Homo sapiens
cccaggaggcctgcctggccgg

SEQ ID NO: 7539544 - DNA, 22 bp, Homo sapiens
cccaggaggccaaggttgcagt

SEQ ID NO: 7539545 - DNA, 22 bp, Homo sapiens
cccaggaggcctgcctggccgg

SEQ ID NO: 7539546 - DNA, 22 bp, Homo sapiens
cccaggaggcctgcctggccgg

SEQ ID NO: 7539547 - DNA, 22 bp, Homo sapiens
cccaggaggcctgcctggccgg

SEQ ID NO: 7539548 - DNA, 22 bp, Homo sapiens
cccaggaggcctgcctggccgg

SEQ ID NO: 7539549 - DNA, 22 bp, Homo sapiens
cccaggaggcctgcctggccgg

SEQ ID NO: 7539550 - DNA, 22 bp, Homo sapiens
cccaggaggccaaggttgcagt

SEQ ID NO: 7539551 - DNA, 22 bp, Homo sapiens
cccaggaggccaaggttgcagt

SEQ ID NO: 7539552 - DNA, 22 bp, Homo sapiens
cccaggaggccaaggttgcagt

SEQ ID NO: 7539553 - DNA, 22 bp, Homo sapiens
tgcatattatgtgtatctgtct

SEQ ID NO: 7539554 - DNA, 22 bp, Homo sapiens
tgcatattataaagagaattag

SEQ ID NO: 7539555 - DNA, 22 bp, Homo sapiens
tgcatattctcctttattttgt

SEQ ID NO: 7539556 - DNA, 22 bp, Homo sapiens
tgcatattctcctttattttgt

SEQ ID NO: 7539557 - DNA, 22 bp, Homo sapiens
tgcatattatgtgtatctgtct

SEQ ID NO: 7539558 - DNA, 22 bp, Homo sapiens
tgcatattatgtgtatctgtct

SEQ ID NO: 7539559 - DNA, 22 bp, Homo sapiens
tgcatattatgtgtatctgtct

SEQ ID NO: 7539560 - DNA, 22 bp, Homo sapiens
tgcatattctcctttattttgt

SEQ ID NO: 7539561 - DNA, 19 bp, Homo sapiens
tgcatatatctatgaaaga

SEQ ID NO: 7539562 - DNA, 19 bp, Homo sapiens
tgcatatatctatgaaaga

SEQ ID NO: 7539563 - DNA, 22 bp, Homo sapiens
tgcatatatcttatttttctgt

SEQ ID NO: 7539564 - DNA, 22 bp, Homo sapiens
tgcatatatcttatttttctgt

SEQ ID NO: 7539565 - DNA, 22 bp, Homo sapiens
tgcatatatttgagattatggc

SEQ ID NO: 7539566 - DNA, 22 bp, Homo sapiens
tgcatatcagaattcaagagtg

SEQ ID NO: 7539567 - DNA, 22 bp, Homo sapiens
tgcatatccacaccttatctct

SEQ ID NO: 7539568 - DNA, 22 bp, Homo sapiens
tgcatatcttcaatgctgttgc

SEQ ID NO: 7539569 - DNA, 22 bp, Homo sapiens
cccaggagacagaaacagaggt

SEQ ID NO: 7539570 - DNA, 22 bp, Homo sapiens
cccaggagacagaaacagaggt

SEQ ID NO: 7539571 - DNA, 22 bp, Homo sapiens
cccaggagacagaaacagaggt

SEQ ID NO: 7539572 - DNA, 22 bp, Homo sapiens
cccaggagacagaaacagaggt

SEQ ID NO: 7539573 - DNA, 22 bp, Homo sapiens
cccaggagaatatttttgggtc

SEQ ID NO: 7539574 - DNA, 22 bp, Homo sapiens
cccaggagaatataatgttctt

SEQ ID NO: 7539575 - DNA, 22 bp, Homo sapiens
cccaggagaatatttttgggtc

SEQ ID NO: 7539576 - DNA, 22 bp, Homo sapiens
cccaggagaatatttttgggtc

SEQ ID NO: 7539577 - DNA, 22 bp, Homo sapiens
cccaggagacagaaacagaggt

SEQ ID NO: 7539578 - DNA, 22 bp, Homo sapiens
cccaggagacagaaacagaggt

SEQ ID NO: 7539579 - DNA, 22 bp, Homo sapiens
cccaggagacagaaacagaggt

SEQ ID NO: 7539580 - DNA, 22 bp, Homo sapiens
cccaggagacagaaacagaggt

SEQ ID NO: 7539581 - DNA, 22 bp, Homo sapiens
cccaggagacagaaacagaggt

SEQ ID NO: 7539582 - DNA, 22 bp, Homo sapiens
cccaggagacagaaacagaggt

SEQ ID NO: 7539583 - DNA, 22 bp, Homo sapiens
cccaggagacagaaacagaggt

SEQ ID NO: 7539584 - DNA, 22 bp, Homo sapiens
cccaggagacagaaacagaggt

SEQ ID NO: 7539585 - DNA, 22 bp, Homo sapiens
cccaggagacatatagaaggac

SEQ ID NO: 7539586 - DNA, 22 bp, Homo sapiens
cccaggagacagaaacagaggt

SEQ ID NO: 7539587 - DNA, 22 bp, Homo sapiens
cccaggagacagaaacagaggt

SEQ ID NO: 7539588 - DNA, 21 bp, Homo sapiens
tgcatatataagtgcatacac

SEQ ID NO: 7539589 - DNA, 22 bp, Homo sapiens
cccaggagacatatagaaggac

SEQ ID NO: 7539590 - DNA, 19 bp, Homo sapiens
tgcatatatctatgaaaga

SEQ ID NO: 7539591 - DNA, 21 bp, Homo sapiens
tgcatatataagtgcatacac

SEQ ID NO: 7539592 - DNA, 22 bp, Homo sapiens
cccaggagacatatagaaggac

SEQ ID NO: 7539593 - DNA, 21 bp, Homo sapiens
tgcatatataagtgcatacac

SEQ ID NO: 7539594 - DNA, 22 bp, Homo sapiens
cccaggagatctggatctcgtc

SEQ ID NO: 7539595 - DNA, 22 bp, Homo sapiens
cccaggaggacattccataccc

SEQ ID NO: 7539596 - DNA, 22 bp, Homo sapiens
cccaggaggacattccataccc

SEQ ID NO: 7539597 - DNA, 22 bp, Homo sapiens
cccaggaggacattccataccc

SEQ ID NO: 7539598 - DNA, 21 bp, Homo sapiens
cccaggaggagctccggctcc

SEQ ID NO: 7539599 - DNA, 22 bp, Homo sapiens
cccaggaggacattccataccc

SEQ ID NO: 7539600 - DNA, 21 bp, Homo sapiens
cccaggaggagctccggctcc

SEQ ID NO: 7539601 - DNA, 21 bp, Homo sapiens
cccaggaggagctccggctcc

SEQ ID NO: 7539602 - DNA, 21 bp, Homo sapiens
cccaggaggagctccggctcc

SEQ ID NO: 7539603 - DNA, 22 bp, Homo sapiens
cccaggagatctggatctcgtc

SEQ ID NO: 7539604 - DNA, 22 bp, Homo sapiens
cccaggagatctggatctcgtc

SEQ ID NO: 7539605 - DNA, 22 bp, Homo sapiens
cccaggagatctggatctcgtc

SEQ ID NO: 7539606 - DNA, 22 bp, Homo sapiens
cccaggagataacgttcccaag

SEQ ID NO: 7539607 - DNA, 22 bp, Homo sapiens
tgcatcaaaactggactccttc

SEQ ID NO: 7539608 - DNA, 22 bp, Homo sapiens
tgcatcaaattctgaaattagc

SEQ ID NO: 7539609 - DNA, 22 bp, Homo sapiens
tgcatattttctgattcagaag

SEQ ID NO: 7539610 - DNA, 22 bp, Homo sapiens
tgcatattttataaagatggaa

SEQ ID NO: 7539611 - DNA, 22 bp, Homo sapiens
tgcatattttctgattcagaag

SEQ ID NO: 7539612 - DNA, 21 bp, Homo sapiens
tgcatattcttctggtggctg

SEQ ID NO: 7539613 - DNA, 21 bp, Homo sapiens
tgcatattcttctggtggctg

SEQ ID NO: 7539614 - DNA, 22 bp, Homo sapiens
tgcatattgtccttgatattat

SEQ ID NO: 7539615 - DNA, 22 bp, Homo sapiens
tgcatattgtgaaaatgtagat

SEQ ID NO: 7539616 - DNA, 22 bp, Homo sapiens
tgcatattgtccttgatattat

SEQ ID NO: 7539617 - DNA, 22 bp, Homo sapiens
tgcatatttgattgagatacct

SEQ ID NO: 7539618 - DNA, 22 bp, Homo sapiens
tgcatatttgtatgatgtttag

SEQ ID NO: 7539619 - DNA, 22 bp, Homo sapiens
tgcatattgtgaaaatgtagat

SEQ ID NO: 7539620 - DNA, 22 bp, Homo sapiens
tgcatattgtgaaaatgtagat

SEQ ID NO: 7539621 - DNA, 22 bp, Homo sapiens
tgcatatttgattgagatacct

SEQ ID NO: 7539622 - DNA, 22 bp, Homo sapiens
tgcatattttataaagatggaa

SEQ ID NO: 7539623 - DNA, 22 bp, Homo sapiens
tgcatattttataaagatggaa

SEQ ID NO: 7539624 - DNA, 22 bp, Homo sapiens
tgcatattttataaagatggaa

SEQ ID NO: 7539625 - DNA, 22 bp, Homo sapiens
tgcatatttgtatgatgtttag

SEQ ID NO: 7539626 - DNA, 22 bp, Homo sapiens
tgcatatttgtatgatgtttag

SEQ ID NO: 7539627 - DNA, 22 bp, Homo sapiens
tgcatatttgtatgatgtttag

SEQ ID NO: 7539628 - DNA, 22 bp, Homo sapiens
tgaggcagtcaccccctcctgc

SEQ ID NO: 7539629 - DNA, 22 bp, Homo sapiens
tgaggcagtcaccccctcctgc

SEQ ID NO: 7539630 - DNA, 22 bp, Homo sapiens
tgaggcagtcaccccctcctgc

SEQ ID NO: 7539631 - DNA, 22 bp, Homo sapiens
tgaggcagtcaccccctcctgc

SEQ ID NO: 7539632 - DNA, 22 bp, Homo sapiens
tgaggcagtcaccccctcctgc

SEQ ID NO: 7539633 - DNA, 18 bp, Homo sapiens
tgaggcagtcagtgatgg

SEQ ID NO: 7539634 - DNA, 18 bp, Homo sapiens
tgaggcagtcagtgatgg

SEQ ID NO: 7539635 - DNA, 18 bp, Homo sapiens
tgaggcagtcagtgatgg

SEQ ID NO: 7539636 - DNA, 22 bp, Homo sapiens
tgaggcagtcaccccctcctgc

SEQ ID NO: 7539637 - DNA, 18 bp, Homo sapiens
tgaggcagtcagtgatgg

SEQ ID NO: 7539638 - DNA, 18 bp, Homo sapiens
tgaggcagtcagtgatgg

SEQ ID NO: 7539639 - DNA, 22 bp, Homo sapiens
tgaggcagtattttagtgactt

SEQ ID NO: 7539640 - DNA, 22 bp, Homo sapiens
tgaggcagtattttagtgactt

SEQ ID NO: 7539641 - DNA, 22 bp, Homo sapiens
tgaggcagtattttagtgactt

SEQ ID NO: 7539642 - DNA, 22 bp, Homo sapiens
tgaggcagtattttagtgactt

SEQ ID NO: 7539643 - DNA, 22 bp, Homo sapiens
tgaggcagtattttagtgactt

SEQ ID NO: 7539644 - DNA, 22 bp, Homo sapiens
tgaggcagtattttagtgactt

SEQ ID NO: 7539645 - DNA, 22 bp, Homo sapiens
tgaggcagtattttagtgactt

SEQ ID NO: 7539646 - DNA, 22 bp, Homo sapiens
tgaggcagtattttagtgactt

SEQ ID NO: 7539647 - DNA, 22 bp, Homo sapiens
tgaggcagtattttagtgactt

SEQ ID NO: 7539648 - DNA, 22 bp, Homo sapiens
tgaggcagtattctccattcca

SEQ ID NO: 7539649 - DNA, 21 bp, Homo sapiens
tgaggcaggggtgcttttgtc

SEQ ID NO: 7539650 - DNA, 21 bp, Homo sapiens
tgaggcaggggtgcttttgtc

SEQ ID NO: 7539651 - DNA, 22 bp, Homo sapiens
tgaggcaggtaagcaagttttg

SEQ ID NO: 7539652 - DNA, 22 bp, Homo sapiens
tgaggcaggtaagcaagttttg

SEQ ID NO: 7539653 - DNA, 22 bp, Homo sapiens
tgaggcaggtaagcaagttttg

SEQ ID NO: 7539654 - DNA, 22 bp, Homo sapiens
tgaggcaggtaagcaagttttg

SEQ ID NO: 7539655 - DNA, 22 bp, Homo sapiens
tgaggcaggtggattacaaggt

SEQ ID NO: 7539656 - DNA, 22 bp, Homo sapiens
tgaggcaggtggattacaaggt

SEQ ID NO: 7539657 - DNA, 22 bp, Homo sapiens
tgaggcaggtaagcaagttttg

SEQ ID NO: 7539658 - DNA, 22 bp, Homo sapiens
tgaggcagtattctccattcca

SEQ ID NO: 7539659 - DNA, 22 bp, Homo sapiens
tgaggcagtattctccattcca

SEQ ID NO: 7539660 - DNA, 22 bp, Homo sapiens
tgaggcagtattctccattcca

SEQ ID NO: 7539661 - DNA, 22 bp, Homo sapiens
tgaggcagtattctccattcca

SEQ ID NO: 7539662 - DNA, 22 bp, Homo sapiens
tgaggcaggtggattacaaggt

SEQ ID NO: 7539663 - DNA, 22 bp, Homo sapiens
tgaggcaggtggattacaaggt

SEQ ID NO: 7539664 - DNA, 22 bp, Homo sapiens
tgaggcagtattctccattcca

SEQ ID NO: 7539665 - DNA, 22 bp, Homo sapiens
ccagtgtggtaggtccacaggt

SEQ ID NO: 7539666 - DNA, 23 bp, Homo sapiens
ccagtgtggtaggtccacaggtg

SEQ ID NO: 7539667 - DNA, 23 bp, Homo sapiens
ccagtgtggtaggtccacaggtg

SEQ ID NO: 7539668 - DNA, 22 bp, Homo sapiens
ccagtgtggtaggtccacaggt

SEQ ID NO: 7539669 - DNA, 22 bp, Homo sapiens
ccagtgtggtaggtccacaggt

SEQ ID NO: 7539670 - DNA, 22 bp, Homo sapiens
ccagtgtggtaggtccacaggt

SEQ ID NO: 7539671 - DNA, 23 bp, Homo sapiens
ccagtgtggtaggtccacaggtg

SEQ ID NO: 7539672 - DNA, 22 bp, Homo sapiens
ccagtgtggtttaggataggga

SEQ ID NO: 7539673 - DNA, 22 bp, Homo sapiens
ccagtgtggtttaggataggga

SEQ ID NO: 7539674 - DNA, 23 bp, Homo sapiens
ccagtgtggtaggtccacaggtg

SEQ ID NO: 7539675 - DNA, 23 bp, Homo sapiens
ccagtgtggtaggtccacaggtg

SEQ ID NO: 7539676 - DNA, 22 bp, Homo sapiens
ccagtgtggtttaggataggga

SEQ ID NO: 7539677 - DNA, 22 bp, Homo sapiens
ccagtgtgttagtggatttccc

SEQ ID NO: 7539678 - DNA, 22 bp, Homo sapiens
ccagtgtgttagtggatttccc

SEQ ID NO: 7539679 - DNA, 22 bp, Homo sapiens
ccagtgtgttccctgcctcact

SEQ ID NO: 7539680 - DNA, 22 bp, Homo sapiens
ccagtgtgttccctgcctcact

SEQ ID NO: 7539681 - DNA, 23 bp, Homo sapiens
ccagtgtggctctgtccgctctc

SEQ ID NO: 7539682 - DNA, 22 bp, Homo sapiens
ccagtgtggccaggtgctggta

SEQ ID NO: 7539683 - DNA, 22 bp, Homo sapiens
ccagtgtggccaggtcttctgg

SEQ ID NO: 7539684 - DNA, 22 bp, Homo sapiens
ccagtgtgggcccggcctcctc

SEQ ID NO: 7539685 - DNA, 22 bp, Homo sapiens
ccagtgtggccaggtgctggta

SEQ ID NO: 7539686 - DNA, 23 bp, Homo sapiens
ccagtgtggctctgtccgctctc

SEQ ID NO: 7539687 - DNA, 22 bp, Homo sapiens
ccagtgtgggcccggcctcctc

SEQ ID NO: 7539688 - DNA, 23 bp, Homo sapiens
ccagtgtggctctgtccgctctc

SEQ ID NO: 7539689 - DNA, 22 bp, Homo sapiens
ccagtgtgggcccggcctcctc

SEQ ID NO: 7539690 - DNA, 22 bp, Homo sapiens
ccagtgtgggctggtggaggac

SEQ ID NO: 7539691 - DNA, 22 bp, Homo sapiens
ccagtgtgggctggtggaggac

SEQ ID NO: 7539692 - DNA, 22 bp, Homo sapiens
ccagtgtgggctggtggaggac

SEQ ID NO: 7539693 - DNA, 22 bp, Homo sapiens
ccagtgtggtaggtccacaggt

SEQ ID NO: 7539694 - DNA, 22 bp, Homo sapiens
ccagtgttagagactgatacag

SEQ ID NO: 7539695 - DNA, 22 bp, Homo sapiens
ccagtgttcaatacatatttgt

SEQ ID NO: 7539696 - DNA, 22 bp, Homo sapiens
ccagtgttcaatacatatttgt

SEQ ID NO: 7539697 - DNA, 22 bp, Homo sapiens
ccagtgttcagtatgcattaag

SEQ ID NO: 7539698 - DNA, 22 bp, Homo sapiens
ccagtgttcatcaagaaaatgt

SEQ ID NO: 7539699 - DNA, 22 bp, Homo sapiens
ccagtgttcatcaagaaaatgt

SEQ ID NO: 7539700 - DNA, 22 bp, Homo sapiens
ccagtgtgtttttctctgactc

SEQ ID NO: 7539701 - DNA, 22 bp, Homo sapiens
ccagtgtgtttaatgcattcca

SEQ ID NO: 7539702 - DNA, 22 bp, Homo sapiens
ccagtgtgttccctgcctcact

SEQ ID NO: 7539703 - DNA, 22 bp, Homo sapiens
ccagtgtgtttaatgcattcca

SEQ ID NO: 7539704 - DNA, 22 bp, Homo sapiens
ccagtgtgtttttctctgactc

SEQ ID NO: 7539705 - DNA, 18 bp, Homo sapiens
tgaggcagtcagtgatgg

SEQ ID NO: 7539706 - DNA, 18 bp, Homo sapiens
tgaggcagtcagtgatgg

SEQ ID NO: 7539707 - DNA, 18 bp, Homo sapiens
tgaggcagtcagtgatgg

SEQ ID NO: 7539708 - DNA, 22 bp, Homo sapiens
tgaggcagtgatgtttaagcac

SEQ ID NO: 7539709 - DNA, 22 bp, Homo sapiens
tgaggcagtgatgtttaagcac

SEQ ID NO: 7539710 - DNA, 18 bp, Homo sapiens
tgaggcagtcagtgatgg

SEQ ID NO: 7539711 - DNA, 18 bp, Homo sapiens
tgaggcagtcagtgatgg

SEQ ID NO: 7539712 - DNA, 22 bp, Homo sapiens
tgaggcagtgatgtttaagcac

SEQ ID NO: 7539713 - DNA, 22 bp, Homo sapiens
tgaggcagtgatgtttaagcac

SEQ ID NO: 7539714 - DNA, 22 bp, Homo sapiens
tgaggcagtgctgggaagcctg

SEQ ID NO: 7539715 - DNA, 22 bp, Homo sapiens
tgaggcagtgctgggaagcctg

SEQ ID NO: 7539716 - DNA, 22 bp, Homo sapiens
tgaggcagtgctgggaagcctg

SEQ ID NO: 7539717 - DNA, 22 bp, Homo sapiens
tgaggcagtgctgggaagcctg

SEQ ID NO: 7539718 - DNA, 22 bp, Homo sapiens
tgaggcagtgctgggaagcctg

SEQ ID NO: 7539719 - DNA, 22 bp, Homo sapiens
tgatacagtcagctcacaattg

SEQ ID NO: 7539720 - DNA, 21 bp, Homo sapiens
tgatacaggaatggttctatg

SEQ ID NO: 7539721 - DNA, 22 bp, Homo sapiens
tgaggcagtgctgggaagcctg

SEQ ID NO: 7539722 - DNA, 22 bp, Homo sapiens
tgatacagtcagctcacaattg

SEQ ID NO: 7539723 - DNA, 22 bp, Homo sapiens
tgatacagtcagctcacaattg

SEQ ID NO: 7539724 - DNA, 22 bp, Homo sapiens
tgatgacaatgttgctgcaata

SEQ ID NO: 7539725 - DNA, 22 bp, Homo sapiens
tgatgacagcaaaaaatgctag

SEQ ID NO: 7539726 - DNA, 22 bp, Homo sapiens
tgatgacagcaaaaaatgctag

SEQ ID NO: 7539727 - DNA, 22 bp, Homo sapiens
tgatgacagcaaaaaatgctag

SEQ ID NO: 7539728 - DNA, 22 bp, Homo sapiens
tgatgacagcatggaccccagg

SEQ ID NO: 7539729 - DNA, 22 bp, Homo sapiens
tgatgacagtgttacagctcca

SEQ ID NO: 7539730 - DNA, 22 bp, Homo sapiens
tgatgacagtgttacagctcca

SEQ ID NO: 7539731 - DNA, 22 bp, Homo sapiens
tgatgacatgtgggctgtggct

SEQ ID NO: 7539732 - DNA, 22 bp, Homo sapiens
tgatgacaaactttcctgatgc

SEQ ID NO: 7539733 - DNA, 22 bp, Homo sapiens
tgatgaattggaaattctgatt

SEQ ID NO: 7539734 - DNA, 22 bp, Homo sapiens
tgatgaattagtaacaaatgag

SEQ ID NO: 7539735 - DNA, 22 bp, Homo sapiens
tgatgaattagtaacaaatgag

SEQ ID NO: 7539736 - DNA, 22 bp, Homo sapiens
tgatacataaaccatcattttg

SEQ ID NO: 7539737 - DNA, 22 bp, Homo sapiens
tgatgaggcatatgctacacat

SEQ ID NO: 7539738 - DNA, 22 bp, Homo sapiens
tgatgaggcatatgctacacat

SEQ ID NO: 7539739 - DNA, 22 bp, Homo sapiens
tgatgaggagactgtggcttgg

SEQ ID NO: 7539740 - DNA, 22 bp, Homo sapiens
tgatgaggagactgtggcttgg

SEQ ID NO: 7539741 - DNA, 22 bp, Homo sapiens
tgatgaggacctggtctctgct

SEQ ID NO: 7539742 - DNA, 22 bp, Homo sapiens
tgatgaggacctggtctctgct

SEQ ID NO: 7539743 - DNA, 22 bp, Homo sapiens
tgatgagggaactggttcatac

SEQ ID NO: 7539744 - DNA, 22 bp, Homo sapiens
tgatgaggagactgtggcttgg

SEQ ID NO: 7539745 - DNA, 22 bp, Homo sapiens
tgatgaggcttcttggtgaaca

SEQ ID NO: 7539746 - DNA, 22 bp, Homo sapiens
tgatgaggcatatgctacacat

SEQ ID NO: 7539747 - DNA, 22 bp, Homo sapiens
tgatgagggagatttgagccca

SEQ ID NO: 7539748 - DNA, 22 bp, Homo sapiens
tgatgaggcttcttggtgaaca

SEQ ID NO: 7539749 - DNA, 22 bp, Homo sapiens
tgatgaggcatatgctacacat

SEQ ID NO: 7539750 - DNA, 22 bp, Homo sapiens
tgatgagagaggtcattgaaat

SEQ ID NO: 7539751 - DNA, 22 bp, Homo sapiens
tgatgagagaggtcattgaaat

SEQ ID NO: 7539752 - DNA, 22 bp, Homo sapiens
tgatgaggacccatcacctggt

SEQ ID NO: 7539753 - DNA, 22 bp, Homo sapiens
tgatgaggacccatcacctggt

SEQ ID NO: 7539754 - DNA, 22 bp, Homo sapiens
tgatgaggacctggtctctgct

SEQ ID NO: 7539755 - DNA, 22 bp, Homo sapiens
tgatgaggacccatcacctggt

SEQ ID NO: 7539756 - DNA, 22 bp, Homo sapiens
tgatgacagtgttacagctcca

SEQ ID NO: 7539757 - DNA, 22 bp, Homo sapiens
tgatgacccaaggtgtcctctg

SEQ ID NO: 7539758 - DNA, 22 bp, Homo sapiens
tgatgaccgccaacgtttaggt

SEQ ID NO: 7539759 - DNA, 21 bp, Homo sapiens
tgatgaggtcatagcaccctc

SEQ ID NO: 7539760 - DNA, 22 bp, Homo sapiens
tgatgaggtggattcaaagcag

SEQ ID NO: 7539761 - DNA, 19 bp, Homo sapiens
ccatggagagagatgcatt

SEQ ID NO: 7539762 - DNA, 19 bp, Homo sapiens
ccatggagagagatgcatt

SEQ ID NO: 7539763 - DNA, 19 bp, Homo sapiens
ccatggagagagatgcatt

SEQ ID NO: 7539764 - DNA, 19 bp, Homo sapiens
ccatggagagagatgcatt

SEQ ID NO: 7539765 - DNA, 23 bp, Homo sapiens
ccatggagcatggctcactaggc

SEQ ID NO: 7539766 - DNA, 22 bp, Homo sapiens
ccatggagcacctcacagaggc

SEQ ID NO: 7539767 - DNA, 22 bp, Homo sapiens
ccatggagcacctcacagaggc

SEQ ID NO: 7539768 - DNA, 22 bp, Homo sapiens
tgatgaggggctcagaggtcag

SEQ ID NO: 7539769 - DNA, 22 bp, Homo sapiens
tgatgagggcagttcttgttgc

SEQ ID NO: 7539770 - DNA, 22 bp, Homo sapiens
tgatgaggggctcagaggtcag

SEQ ID NO: 7539771 - DNA, 22 bp, Homo sapiens
tgatgagggcagttcttgttgc

SEQ ID NO: 7539772 - DNA, 22 bp, Homo sapiens
tgatgagggagatttgagccca

SEQ ID NO: 7539773 - DNA, 22 bp, Homo sapiens
tgatgagggggaacagagattt

SEQ ID NO: 7539774 - DNA, 22 bp, Homo sapiens
tgatgaggggctcagaggtcag

SEQ ID NO: 7539775 - DNA, 21 bp, Homo sapiens
tgatgaggtcatagcaccctc

SEQ ID NO: 7539776 - DNA, 22 bp, Homo sapiens
tgatgagggggaacagagattt

SEQ ID NO: 7539777 - DNA, 22 bp, Homo sapiens
tgattatattctaacttcataa

SEQ ID NO: 7539778 - DNA, 22 bp, Homo sapiens
tgattatattctaacttcataa

SEQ ID NO: 7539779 - DNA, 22 bp, Homo sapiens
tgattatattaactatgttcct

SEQ ID NO: 7539780 - DNA, 22 bp, Homo sapiens
tgattagtccactataatccta

SEQ ID NO: 7539781 - DNA, 22 bp, Homo sapiens
tgattagattgagtcaaccttg

SEQ ID NO: 7539782 - DNA, 22 bp, Homo sapiens
tgattagctgaagaatatgctg

SEQ ID NO: 7539783 - DNA, 17 bp, Homo sapiens
tgattcaactagaaact

SEQ ID NO: 7539784 - DNA, 22 bp, Homo sapiens
tgattcaaatattgtgtatgat

SEQ ID NO: 7539785 - DNA, 22 bp, Homo sapiens
tgattatattctaacttcataa

SEQ ID NO: 7539786 - DNA, 22 bp, Homo sapiens
tgattatcttttactgccagag

SEQ ID NO: 7539787 - DNA, 22 bp, Homo sapiens
tgattcaactttcataacaaaa

SEQ ID NO: 7539788 - DNA, 22 bp, Homo sapiens
tgattcaactttcataacaaaa

SEQ ID NO: 7539789 - DNA, 22 bp, Homo sapiens
tgattcaactttcataacaaaa

SEQ ID NO: 7539790 - DNA, 22 bp, Homo sapiens
tgattcaactttcataacaaaa

SEQ ID NO: 7539791 - DNA, 17 bp, Homo sapiens
tgattcaactagaaact

SEQ ID NO: 7539792 - DNA, 22 bp, Homo sapiens
tgattacacagcagtaatttca

SEQ ID NO: 7539793 - DNA, 22 bp, Homo sapiens
cccaagccagaccctgaccctg

SEQ ID NO: 7539794 - DNA, 22 bp, Homo sapiens
tgattacacagcagtaatttca

SEQ ID NO: 7539795 - DNA, 22 bp, Homo sapiens
tgattacactatttgggaatag

SEQ ID NO: 7539796 - DNA, 22 bp, Homo sapiens
tgattacactatttgggaatag

SEQ ID NO: 7539797 - DNA, 22 bp, Homo sapiens
tgattacagtatttgagatcca

SEQ ID NO: 7539798 - DNA, 23 bp, Homo sapiens
tgattacaggaagttcaagtgtt

SEQ ID NO: 7539799 - DNA, 23 bp, Homo sapiens
tgattacaggaagttcaagtgtt

SEQ ID NO: 7539800 - DNA, 23 bp, Homo sapiens
tgattacaggaagttcaagtgtt

SEQ ID NO: 7539801 - DNA, 22 bp, Homo sapiens
tgattacagtctgacagatgtt

SEQ ID NO: 7539802 - DNA, 22 bp, Homo sapiens
tgattacagtatttgagatcca

SEQ ID NO: 7539803 - DNA, 22 bp, Homo sapiens
tgattagacaaaggaatcatgc

SEQ ID NO: 7539804 - DNA, 22 bp, Homo sapiens
tgattacattggtaatgtttat

SEQ ID NO: 7539805 - DNA, 22 bp, Homo sapiens
tgattacattggtaatgtttat

SEQ ID NO: 7539806 - DNA, 22 bp, Homo sapiens
tgattacattggtaatgtttat

SEQ ID NO: 7539807 - DNA, 22 bp, Homo sapiens
tgattacattggtaatgtttat

SEQ ID NO: 7539808 - DNA, 22 bp, Homo sapiens
cccaagccagaccctgaccctg

SEQ ID NO: 7539809 - DNA, 22 bp, Homo sapiens
tgattacacaccacagtgctcc

SEQ ID NO: 7539810 - DNA, 22 bp, Homo sapiens
cccaagccagaccctgaccctg

SEQ ID NO: 7539811 - DNA, 22 bp, Homo sapiens
cccaagcagggtgcagaggcat

SEQ ID NO: 7539812 - DNA, 22 bp, Homo sapiens
cccaagcagggtgcagaggcat

SEQ ID NO: 7539813 - DNA, 22 bp, Homo sapiens
cccaagcagggtgcagaggcat

SEQ ID NO: 7539814 - DNA, 22 bp, Homo sapiens
cccaagcagggtgcagaggcat

SEQ ID NO: 7539815 - DNA, 22 bp, Homo sapiens
cccaagcagggtgcagaggcat

SEQ ID NO: 7539816 - DNA, 22 bp, Homo sapiens
cccaagatctttcgtgcactaa

SEQ ID NO: 7539817 - DNA, 19 bp, Homo sapiens
cccaacttgactattttct

SEQ ID NO: 7539818 - DNA, 22 bp, Homo sapiens
cccaagagatcgcatgtagttg

SEQ ID NO: 7539819 - DNA, 22 bp, Homo sapiens
cccaagagcttctaggacgctg

SEQ ID NO: 7539820 - DNA, 22 bp, Homo sapiens
cccaagagcttctaggacgctg

SEQ ID NO: 7539821 - DNA, 22 bp, Homo sapiens
cccaagaggtggaggttgcagt

SEQ ID NO: 7539822 - DNA, 22 bp, Homo sapiens
cccaagaggtggaggttgcagt

SEQ ID NO: 7539823 - DNA, 22 bp, Homo sapiens
cccaagagatcgcatgtagttg

SEQ ID NO: 7539824 - DNA, 22 bp, Homo sapiens
cccaagatctaggacagaaaga

SEQ ID NO: 7539825 - DNA, 21 bp, Homo sapiens
cccaacccatttccagttcat

SEQ ID NO: 7539826 - DNA, 22 bp, Homo sapiens
cccaaccagaaattgacagaga

SEQ ID NO: 7539827 - DNA, 22 bp, Homo sapiens
cccaaccagaaattgacagaca

SEQ ID NO: 7539828 - DNA, 22 bp, Homo sapiens
cccaaccccaacttcctatgtt

SEQ ID NO: 7539829 - DNA, 22 bp, Homo sapiens
cccaactgaaatctccacctgc

SEQ ID NO: 7539830 - DNA, 19 bp, Homo sapiens
cccaactggatccatcata

SEQ ID NO: 7539831 - DNA, 22 bp, Homo sapiens
cccaaccccaacttcctatgtt

SEQ ID NO: 7539832 - DNA, 22 bp, Homo sapiens
cccaactactctcaggcagctt

SEQ ID NO: 7539833 - DNA, 22 bp, Homo sapiens
cccaaaggttgaggctgcagtg

SEQ ID NO: 7539834 - DNA, 22 bp, Homo sapiens
cccaaaggtttggtagatatga

SEQ ID NO: 7539835 - DNA, 22 bp, Homo sapiens
cccaaaggttgaggctgcagtg

SEQ ID NO: 7539836 - DNA, 22 bp, Homo sapiens
cccaaagggtgtcagcagcaag

SEQ ID NO: 7539837 - DNA, 22 bp, Homo sapiens
cccaaagggtgtcagcagcaag

SEQ ID NO: 7539838 - DNA, 22 bp, Homo sapiens
cccaaagggtgtcagcagcaag

SEQ ID NO: 7539839 - DNA, 22 bp, Homo sapiens
cccaaagggtgtcagcagcaag

SEQ ID NO: 7539840 - DNA, 22 bp, Homo sapiens
cccaaagtacaagtaaacatgt

SEQ ID NO: 7539841 - DNA, 23 bp, Homo sapiens
cccaacacattccttttcttctg

SEQ ID NO: 7539842 - DNA, 22 bp, Homo sapiens
cccaacaacatgaaactaccta

SEQ ID NO: 7539843 - DNA, 22 bp, Homo sapiens
cccaacactcacctccggatta

SEQ ID NO: 7539844 - DNA, 22 bp, Homo sapiens
cccaacactcacctccggatta

SEQ ID NO: 7539845 - DNA, 22 bp, Homo sapiens
ccatttttcataaactatccaa

SEQ ID NO: 7539846 - DNA, 22 bp, Homo sapiens
ccatttttcacaagactcactt

SEQ ID NO: 7539847 - DNA, 22 bp, Homo sapiens
ccatttttcataaactatccaa

SEQ ID NO: 7539848 - DNA, 22 bp, Homo sapiens
ccatttttcataaactatccaa

SEQ ID NO: 7539849 - DNA, 22 bp, Homo sapiens
ccatttttgacagaaggcctaa

SEQ ID NO: 7539850 - DNA, 22 bp, Homo sapiens
ccatttttgacagaaggcctaa

SEQ ID NO: 7539851 - DNA, 22 bp, Homo sapiens
ccatttttgacagaaggcctaa

SEQ ID NO: 7539852 - DNA, 22 bp, Homo sapiens
cccaaaatgtgcatgttcgaat

SEQ ID NO: 7539853 - DNA, 22 bp, Homo sapiens
cccaaagggcttcctgttctca

SEQ ID NO: 7539854 - DNA, 22 bp, Homo sapiens
cccaaaggctctggagatttga

SEQ ID NO: 7539855 - DNA, 22 bp, Homo sapiens
cccaaaggctctggagatttga

SEQ ID NO: 7539856 - DNA, 22 bp, Homo sapiens
cccaaaggcattttgctgacca

SEQ ID NO: 7539857 - DNA, 22 bp, Homo sapiens
cccaaagcagggtcattgggcc

SEQ ID NO: 7539858 - DNA, 22 bp, Homo sapiens
cccaaagcagttgatgtaccag

SEQ ID NO: 7539859 - DNA, 20 bp, Homo sapiens
cccaaagcttcatatgagcc

SEQ ID NO: 7539860 - DNA, 22 bp, Homo sapiens
cccaaacatccaggtgctggac

SEQ ID NO: 7539861 - DNA, 22 bp, Homo sapiens
ccatttttaaagagcttaagta

SEQ ID NO: 7539862 - DNA, 22 bp, Homo sapiens
ccatttttaaagagcttaagta

SEQ ID NO: 7539863 - DNA, 22 bp, Homo sapiens
ccatttttaaagagcttaagta

SEQ ID NO: 7539864 - DNA, 22 bp, Homo sapiens
ccatttttcacaagactcactt

SEQ ID NO: 7539865 - DNA, 22 bp, Homo sapiens
ccatttttcacaagactcactt

SEQ ID NO: 7539866 - DNA, 22 bp, Homo sapiens
ccatttttcacaagactcactt

SEQ ID NO: 7539867 - DNA, 22 bp, Homo sapiens
ccatttttcacaagactcactt

SEQ ID NO: 7539868 - DNA, 22 bp, Homo sapiens
ccattgtgcacctccagggctg

SEQ ID NO: 7539869 - DNA, 22 bp, Homo sapiens
ccattgtagtatctgttttagt

SEQ ID NO: 7539870 - DNA, 18 bp, Homo sapiens
ccattgtcctgaggatcc

SEQ ID NO: 7539871 - DNA, 19 bp, Homo sapiens
ccattgtttgttgcccaag

SEQ ID NO: 7539872 - DNA, 22 bp, Homo sapiens
ccattgtgcacctccagggctg

SEQ ID NO: 7539873 - DNA, 22 bp, Homo sapiens
ccattgtagtatctgttttagt

SEQ ID NO: 7539874 - DNA, 22 bp, Homo sapiens
ccatggccgccgctgctcagga

SEQ ID NO: 7539875 - DNA, 22 bp, Homo sapiens
ccatggccgccgctgctcagga

SEQ ID NO: 7539876 - DNA, 22 bp, Homo sapiens
ccatggccgccgctgctcagga

SEQ ID NO: 7539877 - DNA, 22 bp, Homo sapiens
ccatggccgccgctgctcagga

SEQ ID NO: 7539878 - DNA, 22 bp, Homo sapiens
ccatggccgccgctgctcagga

SEQ ID NO: 7539879 - DNA, 20 bp, Homo sapiens
ccatggccacatctgtgctg

SEQ ID NO: 7539880 - DNA, 22 bp, Homo sapiens
ccatggccaggaaagccaaggt

SEQ ID NO: 7539881 - DNA, 22 bp, Homo sapiens
ccatggccaggaaagccaaggt

SEQ ID NO: 7539882 - DNA, 22 bp, Homo sapiens
ccatggccaattgcaccttgct

SEQ ID NO: 7539883 - DNA, 20 bp, Homo sapiens
ccatggccacatctgtgctg

SEQ ID NO: 7539884 - DNA, 23 bp, Homo sapiens
ccatggccaatgtcaagctacta

SEQ ID NO: 7539885 - DNA, 23 bp, Homo sapiens
ccatggccaatgtcaagctacta

SEQ ID NO: 7539886 - DNA, 23 bp, Homo sapiens
ccatggccaatgtcaagctacta

SEQ ID NO: 7539887 - DNA, 22 bp, Homo sapiens
ccatggcattttatgtgtctta

SEQ ID NO: 7539888 - DNA, 22 bp, Homo sapiens
ccatggcattttatgtgtctta

SEQ ID NO: 7539889 - DNA, 22 bp, Homo sapiens
ccatggcattttatgtgtctta

SEQ ID NO: 7539890 - DNA, 22 bp, Homo sapiens
ccatggcagcctggcctggctt

SEQ ID NO: 7539891 - DNA, 22 bp, Homo sapiens
ccatggcagcctggcctggctt

SEQ ID NO: 7539892 - DNA, 22 bp, Homo sapiens
ccatggcagcctggcctggctt

SEQ ID NO: 7539893 - DNA, 22 bp, Homo sapiens
ccatggcagccatgggagccac

SEQ ID NO: 7539894 - DNA, 22 bp, Homo sapiens
ccatggcaatggtcagtctatt

SEQ ID NO: 7539895 - DNA, 22 bp, Homo sapiens
ccatggcagccatgggagccac

SEQ ID NO: 7539896 - DNA, 22 bp, Homo sapiens
ccatggcaatggtcagtctatt

SEQ ID NO: 7539897 - DNA, 22 bp, Homo sapiens
ccatggcaatggtcagtctatt

SEQ ID NO: 7539898 - DNA, 22 bp, Homo sapiens
ccatggcaatggtaaactgaca

SEQ ID NO: 7539899 - DNA, 19 bp, Homo sapiens
ccatggcaatgatctgatg

SEQ ID NO: 7539900 - DNA, 19 bp, Homo sapiens
ccatggcaatgatctgatg

SEQ ID NO: 7539901 - DNA, 22 bp, Homo sapiens
ccatggcaactggcgtccaggg

SEQ ID NO: 7539902 - DNA, 22 bp, Homo sapiens
ccatggcaaaggagatgttttc

SEQ ID NO: 7539903 - DNA, 22 bp, Homo sapiens
ccatggagcgggtgagtgagtg

SEQ ID NO: 7539904 - DNA, 22 bp, Homo sapiens
ccatggagcgggtgagtgagtg

SEQ ID NO: 7539905 - DNA, 22 bp, Homo sapiens
ccatggagcgggtgagtgagtg

SEQ ID NO: 7539906 - DNA, 22 bp, Homo sapiens
ccatggagcgggtgagtgagtg

SEQ ID NO: 7539907 - DNA, 22 bp, Homo sapiens
ccatggcaaaggagatgttttc

SEQ ID NO: 7539908 - DNA, 22 bp, Homo sapiens
ccatggagcgggtgagtgagtg

SEQ ID NO: 7539909 - DNA, 22 bp, Homo sapiens
ccatggagttcctctggtctat

SEQ ID NO: 7539910 - DNA, 22 bp, Homo sapiens
tgcagaggtttgtggtgttgct

SEQ ID NO: 7539911 - DNA, 22 bp, Homo sapiens
tgcagaggtttgtggtgttgct

SEQ ID NO: 7539912 - DNA, 22 bp, Homo sapiens
tgcagaggtttgtggtgttgct

SEQ ID NO: 7539913 - DNA, 22 bp, Homo sapiens
tgcagaggtttgtggtgttgct

SEQ ID NO: 7539914 - DNA, 22 bp, Homo sapiens
tgcagaggtttgtggtgttgct

SEQ ID NO: 7539915 - DNA, 22 bp, Homo sapiens
tgcagaggtttccaggcaagtt

SEQ ID NO: 7539916 - DNA, 22 bp, Homo sapiens
tgcagaggtttccaggcaagtt

SEQ ID NO: 7539917 - DNA, 22 bp, Homo sapiens
tgcagaggtttccaggcaagtt

SEQ ID NO: 7539918 - DNA, 22 bp, Homo sapiens
tgcagaggtttttaatacattt

SEQ ID NO: 7539919 - DNA, 22 bp, Homo sapiens
tgcagaggtttttaatacattt

SEQ ID NO: 7539920 - DNA, 22 bp, Homo sapiens
tgcagaggtttttaatacattt

SEQ ID NO: 7539921 - DNA, 22 bp, Homo sapiens
tgcagagtaaaagcagatgcta

SEQ ID NO: 7539922 - DNA, 22 bp, Homo sapiens
tgcagagtaaaagcagatgcta

SEQ ID NO: 7539923 - DNA, 22 bp, Homo sapiens
tgcagagtaaaagcagatgcta

SEQ ID NO: 7539924 - DNA, 22 bp, Homo sapiens
cccagagaaccttctgtgccac

SEQ ID NO: 7539925 - DNA, 22 bp, Homo sapiens
cccagagaagtgaagtgacttg

SEQ ID NO: 7539926 - DNA, 22 bp, Homo sapiens
cccagagaagtgaagtgacttg

SEQ ID NO: 7539927 - DNA, 22 bp, Homo sapiens
cccagagaagtgaagtgacttg

SEQ ID NO: 7539928 - DNA, 22 bp, Homo sapiens
cccagagaaccttctgtgccac

SEQ ID NO: 7539929 - DNA, 22 bp, Homo sapiens
cccagagaaccttctgtgccac

SEQ ID NO: 7539930 - DNA, 22 bp, Homo sapiens
cccagagaaccttctgtgccac

SEQ ID NO: 7539931 - DNA, 22 bp, Homo sapiens
cccagactgcagagcgggcaga

SEQ ID NO: 7539932 - DNA, 22 bp, Homo sapiens
tgcagagtaaaagcagatgcta

SEQ ID NO: 7539933 - DNA, 22 bp, Homo sapiens
cccagactgcagagcgggcaga

SEQ ID NO: 7539934 - DNA, 22 bp, Homo sapiens
cccagagaagtgaagtgacttg

SEQ ID NO: 7539935 - DNA, 22 bp, Homo sapiens
cccagagaagtgaagtgacttg

SEQ ID NO: 7539936 - DNA, 22 bp, Homo sapiens
cccagagaatctttcagaaagg

SEQ ID NO: 7539937 - DNA, 22 bp, Homo sapiens
cccagagaatctttcagaaagg

SEQ ID NO: 7539938 - DNA, 22 bp, Homo sapiens
cccagagaatctttcagaaagg

SEQ ID NO: 7539939 - DNA, 22 bp, Homo sapiens
cccagagaatctttcagaaagg

SEQ ID NO: 7539940 - DNA, 22 bp, Homo sapiens
cccagagaattccacatagagg

SEQ ID NO: 7539941 - DNA, 22 bp, Homo sapiens
cccagagaatctttcagaaagg

SEQ ID NO: 7539942 - DNA, 22 bp, Homo sapiens
cccagagaattccacatagagg

SEQ ID NO: 7539943 - DNA, 22 bp, Homo sapiens
cccagagaattccacatagagg

SEQ ID NO: 7539944 - DNA, 22 bp, Homo sapiens
cccagagaattccacatagagg

SEQ ID NO: 7539945 - DNA, 19 bp, Homo sapiens
cccagagagatctcttgcc

SEQ ID NO: 7539946 - DNA, 19 bp, Homo sapiens
cccagagagatctcttgcc

SEQ ID NO: 7539947 - DNA, 19 bp, Homo sapiens
cccagagagatctcttgcc

SEQ ID NO: 7539948 - DNA, 19 bp, Homo sapiens
cccagagagatctcttgcc

SEQ ID NO: 7539949 - DNA, 22 bp, Homo sapiens
cccagagagcacaggtggtggg

SEQ ID NO: 7539950 - DNA, 22 bp, Homo sapiens
cccagagagcacaggtggtggg

SEQ ID NO: 7539951 - DNA, 19 bp, Homo sapiens
cccagagagatctcttgcc

SEQ ID NO: 7539952 - DNA, 22 bp, Homo sapiens
cccagagaattccacatagagg

SEQ ID NO: 7539953 - DNA, 22 bp, Homo sapiens
cccagagactttgtccgacgac

SEQ ID NO: 7539954 - DNA, 22 bp, Homo sapiens
cccagagactttgtccgacgac

SEQ ID NO: 7539955 - DNA, 22 bp, Homo sapiens
cccagagactttgtccgacgac

SEQ ID NO: 7539956 - DNA, 22 bp, Homo sapiens
cccagagactttgtccgacgac

SEQ ID NO: 7539957 - DNA, 22 bp, Homo sapiens
cccagagaattccacatagagg

SEQ ID NO: 7539958 - DNA, 22 bp, Homo sapiens
cccagagaattccacatagagg

SEQ ID NO: 7539959 - DNA, 22 bp, Homo sapiens
cccagagaattccacatagagg

SEQ ID NO: 7539960 - DNA, 22 bp, Homo sapiens
cccagagaggtaaaacagcctt

SEQ ID NO: 7539961 - DNA, 22 bp, Homo sapiens
cccagagatctactgagcccag

SEQ ID NO: 7539962 - DNA, 22 bp, Homo sapiens
cccagagatctactgagcccag

SEQ ID NO: 7539963 - DNA, 22 bp, Homo sapiens
cccagagagcatttggacaaag

SEQ ID NO: 7539964 - DNA, 22 bp, Homo sapiens
cccagagagcatttggacaaag

SEQ ID NO: 7539965 - DNA, 22 bp, Homo sapiens
cccagagaggtaaaacagcctt

SEQ ID NO: 7539966 - DNA, 22 bp, Homo sapiens
cccagagagctttctttgtgct

SEQ ID NO: 7539967 - DNA, 22 bp, Homo sapiens
cccagagagctttctttgtgct

SEQ ID NO: 7539968 - DNA, 22 bp, Homo sapiens
cccagagaggtaaaacagcctt

SEQ ID NO: 7539969 - DNA, 22 bp, Homo sapiens
cccagagaggtaaaacagcctt

SEQ ID NO: 7539970 - DNA, 22 bp, Homo sapiens
cccagagagcatttggacaaag

SEQ ID NO: 7539971 - DNA, 22 bp, Homo sapiens
cccagagagcatttggacaaag

SEQ ID NO: 7539972 - DNA, 22 bp, Homo sapiens
cccagagagcacaggtggtggg

SEQ ID NO: 7539973 - DNA, 22 bp, Homo sapiens
cccagagagcacaggtggtggg

SEQ ID NO: 7539974 - DNA, 22 bp, Homo sapiens
cccagagagcatttggacaaag

SEQ ID NO: 7539975 - DNA, 22 bp, Homo sapiens
cccagagatctactgagcccag

SEQ ID NO: 7539976 - DNA, 22 bp, Homo sapiens
cccagagatcttgtcctttcca

SEQ ID NO: 7539977 - DNA, 22 bp, Homo sapiens
cccagagatcttgtcctttcca

SEQ ID NO: 7539978 - DNA, 22 bp, Homo sapiens
cccagagatcttgtcctttcca

SEQ ID NO: 7539979 - DNA, 17 bp, Homo sapiens
cccagagatgctgcctt

SEQ ID NO: 7539980 - DNA, 17 bp, Homo sapiens
cccagagatgctgcctt

SEQ ID NO: 7539981 - DNA, 22 bp, Homo sapiens
cccagagggtggaggttgcagt

SEQ ID NO: 7539982 - DNA, 22 bp, Homo sapiens
cccagagggtggaggttgcagt

SEQ ID NO: 7539983 - DNA, 22 bp, Homo sapiens
cccagagggtggaggttgcagt

SEQ ID NO: 7539984 - DNA, 22 bp, Homo sapiens
cccagagggtggaggttgcagt

SEQ ID NO: 7539985 - DNA, 22 bp, Homo sapiens
cccagagggtggaggttgcagt

SEQ ID NO: 7539986 - DNA, 22 bp, Homo sapiens
cccagcactcagcaggctcata

SEQ ID NO: 7539987 - DNA, 22 bp, Homo sapiens
cccagcactcagcaggctcata

SEQ ID NO: 7539988 - DNA, 22 bp, Homo sapiens
cccagcactcagcaggctcata

SEQ ID NO: 7539989 - DNA, 22 bp, Homo sapiens
cccagcactcagcaggctcata

SEQ ID NO: 7539990 - DNA, 22 bp, Homo sapiens
cccagaggtgaaggaggtggga

SEQ ID NO: 7539991 - DNA, 22 bp, Homo sapiens
cccagaggtgaaggaggtggga

SEQ ID NO: 7539992 - DNA, 22 bp, Homo sapiens
cccagaggtgaaggaggtggga

SEQ ID NO: 7539993 - DNA, 22 bp, Homo sapiens
cccagcactcagcaggctcata

SEQ ID NO: 7539994 - DNA, 22 bp, Homo sapiens
cccagcactcagcaggctcata

SEQ ID NO: 7539995 - DNA, 22 bp, Homo sapiens
cccagaggtgaaggaggtggga

SEQ ID NO: 7539996 - DNA, 22 bp, Homo sapiens
cccagaggtgaaggaggtggga

SEQ ID NO: 7539997 - DNA, 22 bp, Homo sapiens
cccagaggtgaaggaggtggga

SEQ ID NO: 7539998 - DNA, 22 bp, Homo sapiens
cccagaggtctgaaaaggttga

SEQ ID NO: 7539999 - DNA, 22 bp, Homo sapiens
cccagaggtgaaggaggtggga

SEQ ID NO: 7540000 - DNA, 22 bp, Homo sapiens
cccagaggtgaaggaggtggga

SEQ ID NO: 7540001 - DNA, 22 bp, Homo sapiens
cccagaggtctgaaaaggttga

SEQ ID NO: 7540002 - DNA, 22 bp, Homo sapiens
tgcagcaggttccaaagggtta

SEQ ID NO: 7540003 - DNA, 22 bp, Homo sapiens
tgcagcaggttccaaagggtta

SEQ ID NO: 7540004 - DNA, 22 bp, Homo sapiens
tgcagcaggttccaaagggtta

SEQ ID NO: 7540005 - DNA, 22 bp, Homo sapiens
tgcagcaggttccaaagggtta

SEQ ID NO: 7540006 - DNA, 22 bp, Homo sapiens
tgcagcaggtatggcaagctcc

SEQ ID NO: 7540007 - DNA, 22 bp, Homo sapiens
cccagcagccagaatgaggagc

SEQ ID NO: 7540008 - DNA, 22 bp, Homo sapiens
tgcagcaggtatggcaagctcc

SEQ ID NO: 7540009 - DNA, 22 bp, Homo sapiens
tgcagcaggtgacaacgagtgg

SEQ ID NO: 7540010 - DNA, 22 bp, Homo sapiens
tgcagcagtgttccttggcttg

SEQ ID NO: 7540011 - DNA, 22 bp, Homo sapiens
tgcagcagtcagtcaggcctgg

SEQ ID NO: 7540012 - DNA, 22 bp, Homo sapiens
tgcagcagtgttccttggcttg

SEQ ID NO: 7540013 - DNA, 22 bp, Homo sapiens
tgcagcagtcagtcaggcctgg

SEQ ID NO: 7540014 - DNA, 22 bp, Homo sapiens
tgcagcagtcagtcaggcctgg

SEQ ID NO: 7540015 - DNA, 22 bp, Homo sapiens
tgcagcagtcagtcaggcctgg

SEQ ID NO: 7540016 - DNA, 22 bp, Homo sapiens
tgcagcagtcagtcaggcctgg

SEQ ID NO: 7540017 - DNA, 23 bp, Homo sapiens
cccagcagattgtaaagtgtcca

SEQ ID NO: 7540018 - DNA, 23 bp, Homo sapiens
cccagcagattgtaaagtgtcca

SEQ ID NO: 7540019 - DNA, 22 bp, Homo sapiens
cccagcagccagaatgaggagc

SEQ ID NO: 7540020 - DNA, 22 bp, Homo sapiens
cccagcagccagaatgaggagc

SEQ ID NO: 7540021 - DNA, 22 bp, Homo sapiens
cccagcagccagaatgaggagc

SEQ ID NO: 7540022 - DNA, 22 bp, Homo sapiens
cccagcagccagaatgaggagc

SEQ ID NO: 7540023 - DNA, 22 bp, Homo sapiens
cccagcagccagaatgaggagc

SEQ ID NO: 7540024 - DNA, 22 bp, Homo sapiens
cccagcagccagaatgaggagc

SEQ ID NO: 7540025 - DNA, 22 bp, Homo sapiens
cccagcagccagaatgaggagc

SEQ ID NO: 7540026 - DNA, 22 bp, Homo sapiens
cccagcagccagaatgaggagc

SEQ ID NO: 7540027 - DNA, 22 bp, Homo sapiens
cccagcagccagaatgaggagc

SEQ ID NO: 7540028 - DNA, 22 bp, Homo sapiens
cccagcagaatctgatgagggc

SEQ ID NO: 7540029 - DNA, 22 bp, Homo sapiens
cccagcagaatctgatgagggc

SEQ ID NO: 7540030 - DNA, 22 bp, Homo sapiens
cccagcagaatctgatgagggc

SEQ ID NO: 7540031 - DNA, 22 bp, Homo sapiens
cccagcagaatctgatgagggc

SEQ ID NO: 7540032 - DNA, 22 bp, Homo sapiens
cccagcagaatctgatgagggc

SEQ ID NO: 7540033 - DNA, 22 bp, Homo sapiens
cccagcagaatctgatgagggc

SEQ ID NO: 7540034 - DNA, 22 bp, Homo sapiens
cccagcagaatctgatgagggc

SEQ ID NO: 7540035 - DNA, 22 bp, Homo sapiens
cccagcagaatctgatgagggc

SEQ ID NO: 7540036 - DNA, 22 bp, Homo sapiens
cccagcagaatctgatgagggc

SEQ ID NO: 7540037 - DNA, 18 bp, Homo sapiens
cccagcactttgggagcc

SEQ ID NO: 7540038 - DNA, 18 bp, Homo sapiens
cccagcactttgggagcc

SEQ ID NO: 7540039 - DNA, 22 bp, Homo sapiens
cccagcactttgaatatgtcac

SEQ ID NO: 7540040 - DNA, 22 bp, Homo sapiens
cccagcactttgaatatgtcac

SEQ ID NO: 7540041 - DNA, 22 bp, Homo sapiens
cccagcactttgaatatgtcac

SEQ ID NO: 7540042 - DNA, 22 bp, Homo sapiens
cccagcactttgaatatgtcac

SEQ ID NO: 7540043 - DNA, 22 bp, Homo sapiens
cccagcactttgaatatgtcac

SEQ ID NO: 7540044 - DNA, 22 bp, Homo sapiens
cccagcagaccgctgtgatggc

SEQ ID NO: 7540045 - DNA, 22 bp, Homo sapiens
cccagcagaccgctgtgatggc

SEQ ID NO: 7540046 - DNA, 22 bp, Homo sapiens
cccagcagaccgctgtgatggc

SEQ ID NO: 7540047 - DNA, 22 bp, Homo sapiens
cccagcagaccgctgtgatggc

SEQ ID NO: 7540048 - DNA, 23 bp, Homo sapiens
cccagcagagatgaggaggggtc

SEQ ID NO: 7540049 - DNA, 22 bp, Homo sapiens
cccagcagaccgctgtgatggc

SEQ ID NO: 7540050 - DNA, 23 bp, Homo sapiens
cccagcagagatgaggaggggtc

SEQ ID NO: 7540051 - DNA, 23 bp, Homo sapiens
cccagcagagatgaggaggggtc

SEQ ID NO: 7540052 - DNA, 23 bp, Homo sapiens
cccagcagagatgaggaggggtc

SEQ ID NO: 7540053 - DNA, 23 bp, Homo sapiens
cccagcagagatgaggaggggtc

SEQ ID NO: 7540054 - DNA, 22 bp, Homo sapiens
cccagcagatggctatgtgcta

SEQ ID NO: 7540055 - DNA, 22 bp, Homo sapiens
cccagcagatggctatgtgcta

SEQ ID NO: 7540056 - DNA, 22 bp, Homo sapiens
cccagcagatggctatgtgcta

SEQ ID NO: 7540057 - DNA, 22 bp, Homo sapiens
cccacaggacgggctaaagagt

SEQ ID NO: 7540058 - DNA, 22 bp, Homo sapiens
cccacaggacgggctaaagagt

SEQ ID NO: 7540059 - DNA, 19 bp, Homo sapiens
cccacaggaggacatatgg

SEQ ID NO: 7540060 - DNA, 22 bp, Homo sapiens
cccacaggacgggctaaagagt

SEQ ID NO: 7540061 - DNA, 22 bp, Homo sapiens
cccacagaatgccaatgagacc

SEQ ID NO: 7540062 - DNA, 22 bp, Homo sapiens
cccacagaatgccaatgagacc

SEQ ID NO: 7540063 - DNA, 22 bp, Homo sapiens
cccacagaatgccaatgagacc

SEQ ID NO: 7540064 - DNA, 22 bp, Homo sapiens
cccacaggcaggggcagagaca

SEQ ID NO: 7540065 - DNA, 19 bp, Homo sapiens
cccacaggaggacatatgg

SEQ ID NO: 7540066 - DNA, 22 bp, Homo sapiens
cccacaggcaggggcagagaca

SEQ ID NO: 7540067 - DNA, 22 bp, Homo sapiens
cccacaggcaggggcagagaca

SEQ ID NO: 7540068 - DNA, 22 bp, Homo sapiens
cccacaggcaggggcagagaca

SEQ ID NO: 7540069 - DNA, 22 bp, Homo sapiens
cccacaggcaggggcagagaca

SEQ ID NO: 7540070 - DNA, 19 bp, Homo sapiens
cccacaggaggacatatgg

SEQ ID NO: 7540071 - DNA, 22 bp, Homo sapiens
cccaagggtgcccagcagagga

SEQ ID NO: 7540072 - DNA, 22 bp, Homo sapiens
cccaagggtgcccagcagagga

SEQ ID NO: 7540073 - DNA, 22 bp, Homo sapiens
cccacactctgagaaatgctga

SEQ ID NO: 7540074 - DNA, 22 bp, Homo sapiens
tgattcaagagagttggggtat

SEQ ID NO: 7540075 - DNA, 20 bp, Homo sapiens
cccaaggtcacagctagcag

SEQ ID NO: 7540076 - DNA, 22 bp, Homo sapiens
cccaagggtgcccagcagagga

SEQ ID NO: 7540077 - DNA, 22 bp, Homo sapiens
cccaagggtgcccagcagagga

SEQ ID NO: 7540078 - DNA, 22 bp, Homo sapiens
tgattcaactttcttgaatgca

SEQ ID NO: 7540079 - DNA, 22 bp, Homo sapiens
tgattcaactttcttgaatgca

SEQ ID NO: 7540080 - DNA, 22 bp, Homo sapiens
tgattcaactttcttgaatgca

SEQ ID NO: 7540081 - DNA, 22 bp, Homo sapiens
cccacaggccctgctgccttga

SEQ ID NO: 7540082 - DNA, 22 bp, Homo sapiens
cccacaggccctgctgccttga

SEQ ID NO: 7540083 - DNA, 22 bp, Homo sapiens
cccacaggcaggtgcatgggct

SEQ ID NO: 7540084 - DNA, 22 bp, Homo sapiens
cccacaggcaggtgcatgggct

SEQ ID NO: 7540085 - DNA, 22 bp, Homo sapiens
cccacaggccctgctgccttga

SEQ ID NO: 7540086 - DNA, 22 bp, Homo sapiens
cccacaggccctgctgccttga

SEQ ID NO: 7540087 - DNA, 22 bp, Homo sapiens
cccacaggccctgctgccttga

SEQ ID NO: 7540088 - DNA, 22 bp, Homo sapiens
cccacaggccctgctgccttga

SEQ ID NO: 7540089 - DNA, 22 bp, Homo sapiens
cccacaggcaggtgcatgggct

SEQ ID NO: 7540090 - DNA, 22 bp, Homo sapiens
cccacaggcaggtgcatgggct

SEQ ID NO: 7540091 - DNA, 22 bp, Homo sapiens
cccacaggcaggtgcatgggct

SEQ ID NO: 7540092 - DNA, 19 bp, Homo sapiens
cccacaggaggacatatgg

SEQ ID NO: 7540093 - DNA, 22 bp, Homo sapiens
cccacaggcaggggcagagaca

SEQ ID NO: 7540094 - DNA, 22 bp, Homo sapiens
cccacaggcaggtgcatgggct

SEQ ID NO: 7540095 - DNA, 22 bp, Homo sapiens
cccacaggcaggtgcatgggct

SEQ ID NO: 7540096 - DNA, 22 bp, Homo sapiens
cccacaggcaggtgcatgggct

SEQ ID NO: 7540097 - DNA, 22 bp, Homo sapiens
cccacaggcaggggcagagaca

SEQ ID NO: 7540098 - DNA, 22 bp, Homo sapiens
cccacaggcaggggcagagaca

SEQ ID NO: 7540099 - DNA, 22 bp, Homo sapiens
cccacaggcaggggcagagaca

SEQ ID NO: 7540100 - DNA, 22 bp, Homo sapiens
cccacaggtgtgagcttgctgg

SEQ ID NO: 7540101 - DNA, 22 bp, Homo sapiens
cccacaggtggaagcctcggaa

SEQ ID NO: 7540102 - DNA, 22 bp, Homo sapiens
cccacaggtggaagcctcggaa

SEQ ID NO: 7540103 - DNA, 22 bp, Homo sapiens
cccacaggtgtgagcttgctgg

SEQ ID NO: 7540104 - DNA, 22 bp, Homo sapiens
cccacaggtgtgagcttgctgg

SEQ ID NO: 7540105 - DNA, 22 bp, Homo sapiens
cccacaggtgtgagcttgctgg

SEQ ID NO: 7540106 - DNA, 22 bp, Homo sapiens
cccacagttaaccaaaggaatt

SEQ ID NO: 7540107 - DNA, 22 bp, Homo sapiens
cccacaggtgtgagcttgctgg

SEQ ID NO: 7540108 - DNA, 22 bp, Homo sapiens
cccacatcccttccccgctgtg

SEQ ID NO: 7540109 - DNA, 23 bp, Homo sapiens
cccacatgtctgagtcagtgcca

SEQ ID NO: 7540110 - DNA, 23 bp, Homo sapiens
cccacatgtctgagtcagtgcca

SEQ ID NO: 7540111 - DNA, 22 bp, Homo sapiens
cccacaggtggaagcctcggaa

SEQ ID NO: 7540112 - DNA, 22 bp, Homo sapiens
cccacaggtggaagcctcggaa

SEQ ID NO: 7540113 - DNA, 22 bp, Homo sapiens
cccacaggtggaagcctcggaa

SEQ ID NO: 7540114 - DNA, 22 bp, Homo sapiens
cccacaggtggaagcctcggaa

SEQ ID NO: 7540115 - DNA, 22 bp, Homo sapiens
cccacaggtggaagcctcggaa

SEQ ID NO: 7540116 - DNA, 22 bp, Homo sapiens
cccacaggtggaagcctcggaa

SEQ ID NO: 7540117 - DNA, 22 bp, Homo sapiens
cccacaggtggaagcctcggaa

SEQ ID NO: 7540118 - DNA, 22 bp, Homo sapiens
cccacaggtccccatgaactcg

SEQ ID NO: 7540119 - DNA, 22 bp, Homo sapiens
cccacaggtccccatgaactcg

SEQ ID NO: 7540120 - DNA, 22 bp, Homo sapiens
cccacaggtccccatgaactcg

SEQ ID NO: 7540121 - DNA, 22 bp, Homo sapiens
cccacaggtccccatgaactcg

SEQ ID NO: 7540122 - DNA, 22 bp, Homo sapiens
cccacaggtccccatgaactcg

SEQ ID NO: 7540123 - DNA, 22 bp, Homo sapiens
cccacagggctgctgatggcag

SEQ ID NO: 7540124 - DNA, 22 bp, Homo sapiens
cccacagggctgctgatggcag

SEQ ID NO: 7540125 - DNA, 22 bp, Homo sapiens
cccacagggctgctgatggcag

SEQ ID NO: 7540126 - DNA, 22 bp, Homo sapiens
cccacagggctgctgatggcag

SEQ ID NO: 7540127 - DNA, 22 bp, Homo sapiens
cccacagggctgctgatggcag

SEQ ID NO: 7540128 - DNA, 22 bp, Homo sapiens
cccacagggctgctgatggcag

SEQ ID NO: 7540129 - DNA, 22 bp, Homo sapiens
cccacaggtccccatgaactcg

SEQ ID NO: 7540130 - DNA, 22 bp, Homo sapiens
cccacaggtccccatgaactcg

SEQ ID NO: 7540131 - DNA, 22 bp, Homo sapiens
cccacagggctgctgatggcag

SEQ ID NO: 7540132 - DNA, 22 bp, Homo sapiens
cccacagggctgctgatggcag

SEQ ID NO: 7540133 - DNA, 22 bp, Homo sapiens
cccacaggctaggggtagggca

SEQ ID NO: 7540134 - DNA, 22 bp, Homo sapiens
cccacaggctaggggtagggca

SEQ ID NO: 7540135 - DNA, 22 bp, Homo sapiens
cccacaggctaggggtagggca

SEQ ID NO: 7540136 - DNA, 22 bp, Homo sapiens
cccacaggctaggggtagggca

SEQ ID NO: 7540137 - DNA, 22 bp, Homo sapiens
cccacaggctaggggtagggca

SEQ ID NO: 7540138 - DNA, 22 bp, Homo sapiens
cccacaggccctgctgccttga

SEQ ID NO: 7540139 - DNA, 22 bp, Homo sapiens
cccacaggctaggggtagggca

SEQ ID NO: 7540140 - DNA, 22 bp, Homo sapiens
cccacaggctaggggtagggca

SEQ ID NO: 7540141 - DNA, 22 bp, Homo sapiens
cccacaggccctgctgccttga

SEQ ID NO: 7540142 - DNA, 22 bp, Homo sapiens
cccacaggccctgctgccttga

SEQ ID NO: 7540143 - DNA, 22 bp, Homo sapiens
cccacccagcctggctgagggg

SEQ ID NO: 7540144 - DNA, 22 bp, Homo sapiens
cccacccagcctggctgagggg

SEQ ID NO: 7540145 - DNA, 22 bp, Homo sapiens
cccacccagcctggctgagggg

SEQ ID NO: 7540146 - DNA, 22 bp, Homo sapiens
cccacccactctgaccagaagc

SEQ ID NO: 7540147 - DNA, 22 bp, Homo sapiens
cccacccactctgaccagaagc

SEQ ID NO: 7540148 - DNA, 22 bp, Homo sapiens
cccaccagtacagatggtagat

SEQ ID NO: 7540149 - DNA, 22 bp, Homo sapiens
cccaccagtacagatggtagat

SEQ ID NO: 7540150 - DNA, 22 bp, Homo sapiens
cccaccagtacagatggtagat

SEQ ID NO: 7540151 - DNA, 22 bp, Homo sapiens
cccaccagccatctgagagtgt

SEQ ID NO: 7540152 - DNA, 22 bp, Homo sapiens
cccaccagattctcaaatatct

SEQ ID NO: 7540153 - DNA, 22 bp, Homo sapiens
cccaccatgtgcccattggctt

SEQ ID NO: 7540154 - DNA, 22 bp, Homo sapiens
cccaccatgtgcccattggctt

SEQ ID NO: 7540155 - DNA, 22 bp, Homo sapiens
cccacccactctgaccagaagc

SEQ ID NO: 7540156 - DNA, 22 bp, Homo sapiens
cccaccacgtgctttgctggag

SEQ ID NO: 7540157 - DNA, 22 bp, Homo sapiens
cccacatttttgagtcttcatc

SEQ ID NO: 7540158 - DNA, 23 bp, Homo sapiens
cccacatgtctgagtcagtgcca

SEQ ID NO: 7540159 - DNA, 23 bp, Homo sapiens
cccacatgtctgagtcagtgcca

SEQ ID NO: 7540160 - DNA, 22 bp, Homo sapiens
cccaccagccatctgagagtgt

SEQ ID NO: 7540161 - DNA, 22 bp, Homo sapiens
cccaccagattctcaaatatct

SEQ ID NO: 7540162 - DNA, 22 bp, Homo sapiens
cccaccagccatctgagagtgt

SEQ ID NO: 7540163 - DNA, 22 bp, Homo sapiens
cccaccagccatctgagagtgt

SEQ ID NO: 7540164 - DNA, 22 bp, Homo sapiens
cccaccagacctgcaccggcac

SEQ ID NO: 7540165 - DNA, 22 bp, Homo sapiens
cccaccacgtgctttgctggag

SEQ ID NO: 7540166 - DNA, 22 bp, Homo sapiens
cccaccacgtgctttgctggag

SEQ ID NO: 7540167 - DNA, 22 bp, Homo sapiens
cccacccagctgagccgctcac

SEQ ID NO: 7540168 - DNA, 22 bp, Homo sapiens
cccacccagctgagccgctcac

SEQ ID NO: 7540169 - DNA, 22 bp, Homo sapiens
cccacccagctgagccgctcac

SEQ ID NO: 7540170 - DNA, 22 bp, Homo sapiens
cccacccagcctggctgagggg

SEQ ID NO: 7540171 - DNA, 22 bp, Homo sapiens
cccacccagcctggctgagggg

SEQ ID NO: 7540172 - DNA, 22 bp, Homo sapiens
cccacccagcctggctgagggg

SEQ ID NO: 7540173 - DNA, 22 bp, Homo sapiens
tgcagagagttagggcccgtat

SEQ ID NO: 7540174 - DNA, 22 bp, Homo sapiens
cccacccctggacaggtgagtg

SEQ ID NO: 7540175 - DNA, 22 bp, Homo sapiens
tgcagagatagaactactttct

SEQ ID NO: 7540176 - DNA, 22 bp, Homo sapiens
tgcagagatagaactactttct

SEQ ID NO: 7540177 - DNA, 22 bp, Homo sapiens
cccacccctggacaggtgagtg

SEQ ID NO: 7540178 - DNA, 21 bp, Homo sapiens
cccaccccataaggcagaacc

SEQ ID NO: 7540179 - DNA, 21 bp, Homo sapiens
cccaccccataaggcagaacc

SEQ ID NO: 7540180 - DNA, 21 bp, Homo sapiens
cccaccccataaggcagaacc

SEQ ID NO: 7540181 - DNA, 15 bp, Homo sapiens
tgcagaggtacctgg

SEQ ID NO: 7540182 - DNA, 15 bp, Homo sapiens
tgcagaggtacctgg

SEQ ID NO: 7540183 - DNA, 21 bp, Homo sapiens
tgcagagatatctgaagcaga

SEQ ID NO: 7540184 - DNA, 22 bp, Homo sapiens
tgcagagatagaactactttct

SEQ ID NO: 7540185 - DNA, 22 bp, Homo sapiens
tgcagagatagaactactttct

SEQ ID NO: 7540186 - DNA, 21 bp, Homo sapiens
tgcagagatatctgaagcaga

SEQ ID NO: 7540187 - DNA, 21 bp, Homo sapiens
tgcagagatatctgaagcaga

SEQ ID NO: 7540188 - DNA, 22 bp, Homo sapiens
tgcagaggtgaaagactagcaa

SEQ ID NO: 7540189 - DNA, 22 bp, Homo sapiens
tgcagaggtgaaagactagcaa

SEQ ID NO: 7540190 - DNA, 22 bp, Homo sapiens
tgcagaggtgaaagactagcaa

SEQ ID NO: 7540191 - DNA, 22 bp, Homo sapiens
tgcagaggtgaaagactagcaa

SEQ ID NO: 7540192 - DNA, 22 bp, Homo sapiens
tgcagaggtgaaagactagcaa

SEQ ID NO: 7540193 - DNA, 22 bp, Homo sapiens
tgcagaggtgtgcattcttaag

SEQ ID NO: 7540194 - DNA, 22 bp, Homo sapiens
tgcagaggtgtgcattcttaag

SEQ ID NO: 7540195 - DNA, 22 bp, Homo sapiens
tgcagaggtgtgcattcttaag

SEQ ID NO: 7540196 - DNA, 22 bp, Homo sapiens
tgcagaggtgttgctgagataa

SEQ ID NO: 7540197 - DNA, 22 bp, Homo sapiens
tgcagaggtgttgctgagataa

SEQ ID NO: 7540198 - DNA, 22 bp, Homo sapiens
tgcagaggtgaaagactagcaa

SEQ ID NO: 7540199 - DNA, 22 bp, Homo sapiens
tgcagaggtgtgcattcttaag

SEQ ID NO: 7540200 - DNA, 22 bp, Homo sapiens
tgcagaggtgaaagactagcaa

SEQ ID NO: 7540201 - DNA, 22 bp, Homo sapiens
tgcagaggtttccaggcaagtt

SEQ ID NO: 7540202 - DNA, 22 bp, Homo sapiens
tgcagaggtttccaggcaagtt

SEQ ID NO: 7540203 - DNA, 22 bp, Homo sapiens
tgcagaggtttccaggcaagtt

SEQ ID NO: 7540204 - DNA, 22 bp, Homo sapiens
tgcagaggtttccaggcaagtt

SEQ ID NO: 7540205 - DNA, 22 bp, Homo sapiens
tgcagaggtttccaggcaagtt

SEQ ID NO: 7540206 - DNA, 22 bp, Homo sapiens
tgcagaggtttccaggcaagtt

SEQ ID NO: 7540207 - DNA, 22 bp, Homo sapiens
tgcagaggtttccaggcaagtt

SEQ ID NO: 7540208 - DNA, 22 bp, Homo sapiens
tgcagaggtgttgctgagataa

SEQ ID NO: 7540209 - DNA, 22 bp, Homo sapiens
tgcagaggtgttgctgagataa

SEQ ID NO: 7540210 - DNA, 22 bp, Homo sapiens
tgcagaggtgttgctgagataa

SEQ ID NO: 7540211 - DNA, 22 bp, Homo sapiens
tgcagaggtttccaggcaagtt

SEQ ID NO: 7540212 - DNA, 22 bp, Homo sapiens
tgcagaggtttccaggcaagtt

SEQ ID NO: 7540213 - DNA, 22 bp, Homo sapiens
tgcagaggtttccaggcaagtt

SEQ ID NO: 7540214 - DNA, 22 bp, Homo sapiens
tgcagaggtgttgctgagataa

SEQ ID NO: 7540215 - DNA, 22 bp, Homo sapiens
tgcagaggtgttgctgagataa

SEQ ID NO: 7540216 - DNA, 22 bp, Homo sapiens
tttgaggttagctagcagatca

SEQ ID NO: 7540217 - DNA, 22 bp, Homo sapiens
tttgaggttagctagcagatca

SEQ ID NO: 7540218 - DNA, 22 bp, Homo sapiens
tttgagtaggcttatattttgg

SEQ ID NO: 7540219 - DNA, 22 bp, Homo sapiens
tttgaggttagctagcagatca

SEQ ID NO: 7540220 - DNA, 22 bp, Homo sapiens
tttgaggttagctagcagatca

SEQ ID NO: 7540221 - DNA, 22 bp, Homo sapiens
tttgaggttagctagcagatca

SEQ ID NO: 7540222 - DNA, 22 bp, Homo sapiens
tttgaggttagctagcagatca

SEQ ID NO: 7540223 - DNA, 22 bp, Homo sapiens
tttgacagcagataaaataaaa

SEQ ID NO: 7540224 - DNA, 22 bp, Homo sapiens
tttgacagatctcagagcattt

SEQ ID NO: 7540225 - DNA, 22 bp, Homo sapiens
tttgacagatccttaactcagc

SEQ ID NO: 7540226 - DNA, 22 bp, Homo sapiens
tttgaggaagatcggagggaaa

SEQ ID NO: 7540227 - DNA, 22 bp, Homo sapiens
tttgaggacattttagaaagtt

SEQ ID NO: 7540228 - DNA, 22 bp, Homo sapiens
tttgacagcagataaaataaaa

SEQ ID NO: 7540229 - DNA, 18 bp, Homo sapiens
tttgaggaaatgtcctga

SEQ ID NO: 7540230 - DNA, 22 bp, Homo sapiens
tttgaggaagatcggagggaaa

SEQ ID NO: 7540231 - DNA, 22 bp, Homo sapiens
tttgagtagtgagactaggcag

SEQ ID NO: 7540232 - DNA, 22 bp, Homo sapiens
tttgagtctgcttccattttca

SEQ ID NO: 7540233 - DNA, 22 bp, Homo sapiens
tttgagtcccagctgtgtggct

SEQ ID NO: 7540234 - DNA, 22 bp, Homo sapiens
tttgagttgcttatttaatagg

SEQ ID NO: 7540235 - DNA, 22 bp, Homo sapiens
tttgataacagtgaatatcatg

SEQ ID NO: 7540236 - DNA, 22 bp, Homo sapiens
tttgagttgcttatttaatagg

SEQ ID NO: 7540237 - DNA, 22 bp, Homo sapiens
tttgataacagtgaatatcatg

SEQ ID NO: 7540238 - DNA, 22 bp, Homo sapiens
tttgataacagtgaatatcatg

SEQ ID NO: 7540239 - DNA, 22 bp, Homo sapiens
tttgataacagtgaatatcatg

SEQ ID NO: 7540240 - DNA, 22 bp, Homo sapiens
tttgataacagtgaatatcatg

SEQ ID NO: 7540241 - DNA, 22 bp, Homo sapiens
tttgataacagtgaatatcatg

SEQ ID NO: 7540242 - DNA, 22 bp, Homo sapiens
tttgataatacacaagagaaag

SEQ ID NO: 7540243 - DNA, 22 bp, Homo sapiens
tttgataatacacaagagaaag

SEQ ID NO: 7540244 - DNA, 22 bp, Homo sapiens
tttgataatacacaagagaaag

SEQ ID NO: 7540245 - DNA, 22 bp, Homo sapiens
tttgataagagctgctgaaact

SEQ ID NO: 7540246 - DNA, 22 bp, Homo sapiens
tttgataacagtgaatatcatg

SEQ ID NO: 7540247 - DNA, 22 bp, Homo sapiens
tttgatatcttggtatacagat

SEQ ID NO: 7540248 - DNA, 22 bp, Homo sapiens
tttgatatgcaaaattatggac

SEQ ID NO: 7540249 - DNA, 22 bp, Homo sapiens
tttgatcatgaagaggataaac

SEQ ID NO: 7540250 - DNA, 22 bp, Homo sapiens
tttgatcagcaagataaataga

SEQ ID NO: 7540251 - DNA, 22 bp, Homo sapiens
tttgatcagcaagataaataga

SEQ ID NO: 7540252 - DNA, 19 bp, Homo sapiens
tttgatatctgaattatgc

SEQ ID NO: 7540253 - DNA, 19 bp, Homo sapiens
tttgatatctgaattatgc

SEQ ID NO: 7540254 - DNA, 19 bp, Homo sapiens
tttgatatctgaattatgc

SEQ ID NO: 7540255 - DNA, 22 bp, Homo sapiens
tttgatatcttggtatacagat

SEQ ID NO: 7540256 - DNA, 22 bp, Homo sapiens
tttgatatcttggtatacagat

SEQ ID NO: 7540257 - DNA, 19 bp, Homo sapiens
tttgatatctgaattatgc

SEQ ID NO: 7540258 - DNA, 22 bp, Homo sapiens
tttgatctatgcgtggtttccc

SEQ ID NO: 7540259 - DNA, 22 bp, Homo sapiens
tttgatctcccagactaaggag

SEQ ID NO: 7540260 - DNA, 22 bp, Homo sapiens
tttgatctcccagactaaggag

SEQ ID NO: 7540261 - DNA, 22 bp, Homo sapiens
tttgatgaaagctactatttac

SEQ ID NO: 7540262 - DNA, 22 bp, Homo sapiens
tttgatgaaagctactatttac

SEQ ID NO: 7540263 - DNA, 22 bp, Homo sapiens
tttgatgaaagctactatttac

SEQ ID NO: 7540264 - DNA, 22 bp, Homo sapiens
tttgatccgttgctggtgagga

SEQ ID NO: 7540265 - DNA, 22 bp, Homo sapiens
tttgatccgttgctggtgagga

SEQ ID NO: 7540266 - DNA, 22 bp, Homo sapiens
tttgatcctttagccatttgac

SEQ ID NO: 7540267 - DNA, 22 bp, Homo sapiens
tttgatcatgaagaggataaac

SEQ ID NO: 7540268 - DNA, 22 bp, Homo sapiens
tttgatccagggcttacacata

SEQ ID NO: 7540269 - DNA, 22 bp, Homo sapiens
tttgatcatgaagaggataaac

SEQ ID NO: 7540270 - DNA, 22 bp, Homo sapiens
tttgatccgttgctggtgagga

SEQ ID NO: 7540271 - DNA, 17 bp, Homo sapiens
tttgatagaatcagagt

SEQ ID NO: 7540272 - DNA, 22 bp, Homo sapiens
tttgatactttgtgcaatttct

SEQ ID NO: 7540273 - DNA, 17 bp, Homo sapiens
tttgatagaatcagagt

SEQ ID NO: 7540274 - DNA, 22 bp, Homo sapiens
tttgatactgagaaaaacaaat

SEQ ID NO: 7540275 - DNA, 22 bp, Homo sapiens
tttgatactgagaaaaacaaat

SEQ ID NO: 7540276 - DNA, 22 bp, Homo sapiens
tttgatactttgtgcaatttct

SEQ ID NO: 7540277 - DNA, 22 bp, Homo sapiens
tttgataattaaaaattgtagt

SEQ ID NO: 7540278 - DNA, 22 bp, Homo sapiens
tttgataatacacaagagaaag

SEQ ID NO: 7540279 - DNA, 22 bp, Homo sapiens
tttgataattaaaaattgtagt

SEQ ID NO: 7540280 - DNA, 22 bp, Homo sapiens
tttgataattaaaaattgtagt

SEQ ID NO: 7540281 - DNA, 22 bp, Homo sapiens
tttgataattaaaaattgtagt

SEQ ID NO: 7540282 - DNA, 22 bp, Homo sapiens
tttgataattaaaaattgtagt

SEQ ID NO: 7540283 - DNA, 22 bp, Homo sapiens
tttgatatcctatacaagtaaa

SEQ ID NO: 7540284 - DNA, 22 bp, Homo sapiens
tttgatatcctatacaagtaaa

SEQ ID NO: 7540285 - DNA, 22 bp, Homo sapiens
tttgatatcctatacaagtaaa

SEQ ID NO: 7540286 - DNA, 19 bp, Homo sapiens
tttgatagggcataatata

SEQ ID NO: 7540287 - DNA, 19 bp, Homo sapiens
tttgatagggcataatata

SEQ ID NO: 7540288 - DNA, 22 bp, Homo sapiens
tttgatagttagggggacaagc

SEQ ID NO: 7540289 - DNA, 19 bp, Homo sapiens
tttgatagggcataatata

SEQ ID NO: 7540290 - DNA, 22 bp, Homo sapiens
tttgattctgtaaaataacagg

SEQ ID NO: 7540291 - DNA, 22 bp, Homo sapiens
tttgattgcaatagttttatga

SEQ ID NO: 7540292 - DNA, 22 bp, Homo sapiens
tttgattgcaatagttttatga

SEQ ID NO: 7540293 - DNA, 20 bp, Homo sapiens
tttgattgcccctctgactt

SEQ ID NO: 7540294 - DNA, 22 bp, Homo sapiens
tttgattctggcctctgagaag

SEQ ID NO: 7540295 - DNA, 22 bp, Homo sapiens
tttgatgtcaaaatatcctgtt

SEQ ID NO: 7540296 - DNA, 22 bp, Homo sapiens
tttgattcaatgtttatataaa

SEQ ID NO: 7540297 - DNA, 22 bp, Homo sapiens
tttgattctaagttctgtcaac

SEQ ID NO: 7540298 - DNA, 22 bp, Homo sapiens
tttgatttactataagcagcac

SEQ ID NO: 7540299 - DNA, 22 bp, Homo sapiens
tttgatttactataagcagcac

SEQ ID NO: 7540300 - DNA, 22 bp, Homo sapiens
tttgatttactggatattctca

SEQ ID NO: 7540301 - DNA, 22 bp, Homo sapiens
tttgatttactggatattctca

SEQ ID NO: 7540302 - DNA, 22 bp, Homo sapiens
tttgatttactggatattctca

SEQ ID NO: 7540303 - DNA, 22 bp, Homo sapiens
tttgatttactggatattctca

SEQ ID NO: 7540304 - DNA, 22 bp, Homo sapiens
tttgatttactataagcagcac

SEQ ID NO: 7540305 - DNA, 22 bp, Homo sapiens
tttgatttactggatattctca

SEQ ID NO: 7540306 - DNA, 22 bp, Homo sapiens
tttgatgaacctatataatttg

SEQ ID NO: 7540307 - DNA, 19 bp, Homo sapiens
tttgatgagaatttaagca

SEQ ID NO: 7540308 - DNA, 19 bp, Homo sapiens
tttgatgagaatttaagca

SEQ ID NO: 7540309 - DNA, 19 bp, Homo sapiens
tttgatgagaatttaagca

SEQ ID NO: 7540310 - DNA, 22 bp, Homo sapiens
tttgatgctaagatttaataaa

SEQ ID NO: 7540311 - DNA, 22 bp, Homo sapiens
tttgatgtcaaaatatcctgtt

SEQ ID NO: 7540312 - DNA, 22 bp, Homo sapiens
tttgatgagtttaataacagcc

SEQ ID NO: 7540313 - DNA, 22 bp, Homo sapiens
tttgatgagtttaataacagcc

SEQ ID NO: 7540314 - DNA, 22 bp, Homo sapiens
tttgatgatgatgataaagttt

SEQ ID NO: 7540315 - DNA, 22 bp, Homo sapiens
tttgatttactggatattctca

SEQ ID NO: 7540316 - DNA, 22 bp, Homo sapiens
tttgctttcccttgtagaaagt

SEQ ID NO: 7540317 - DNA, 22 bp, Homo sapiens
tttgctttcccttgtagaaagt

SEQ ID NO: 7540318 - DNA, 22 bp, Homo sapiens
tttgcttgttcaagatttctgt

SEQ ID NO: 7540319 - DNA, 22 bp, Homo sapiens
tttgctttcccttgtagaaagt

SEQ ID NO: 7540320 - DNA, 22 bp, Homo sapiens
tttgctttcccttgtagaaagt

SEQ ID NO: 7540321 - DNA, 22 bp, Homo sapiens
tttgctttcccttgtagaaagt

SEQ ID NO: 7540322 - DNA, 22 bp, Homo sapiens
tttgctttcccttgtagaaagt

SEQ ID NO: 7540323 - DNA, 18 bp, Homo sapiens
tttgctttccttcttcag

SEQ ID NO: 7540324 - DNA, 18 bp, Homo sapiens
tttgctttccttcttcag

SEQ ID NO: 7540325 - DNA, 22 bp, Homo sapiens
tttgctttctgttgaacagagt

SEQ ID NO: 7540326 - DNA, 22 bp, Homo sapiens
tttgctttctgttgaacagagt

SEQ ID NO: 7540327 - DNA, 22 bp, Homo sapiens
tttgctttctgttgaacagagt

SEQ ID NO: 7540328 - DNA, 22 bp, Homo sapiens
tttgctttctgttgaacagagt

SEQ ID NO: 7540329 - DNA, 22 bp, Homo sapiens
tttgctttctgttgaacagagt

SEQ ID NO: 7540330 - DNA, 18 bp, Homo sapiens
tttgctttccttcttcag

SEQ ID NO: 7540331 - DNA, 18 bp, Homo sapiens
tttgctttccttcttcag

SEQ ID NO: 7540332 - DNA, 18 bp, Homo sapiens
tttgctttccttcttcag

SEQ ID NO: 7540333 - DNA, 18 bp, Homo sapiens
tttgctttccttcttcag

SEQ ID NO: 7540334 - DNA, 18 bp, Homo sapiens
tttgctttccttcttcag

SEQ ID NO: 7540335 - DNA, 18 bp, Homo sapiens
tttgctttccttcttcag

SEQ ID NO: 7540336 - DNA, 18 bp, Homo sapiens
tttgctttccttcttcag

SEQ ID NO: 7540337 - DNA, 18 bp, Homo sapiens
tttgctttccttcttcag

SEQ ID NO: 7540338 - DNA, 22 bp, Homo sapiens
tttgctttcttgattcagatta

SEQ ID NO: 7540339 - DNA, 22 bp, Homo sapiens
tttgctttcttgattcagatta

SEQ ID NO: 7540340 - DNA, 22 bp, Homo sapiens
tttgctttcttgattcagatta

SEQ ID NO: 7540341 - DNA, 22 bp, Homo sapiens
tttgctttcttgattcagatta

SEQ ID NO: 7540342 - DNA, 22 bp, Homo sapiens
tttgctttcttgattcagatta

SEQ ID NO: 7540343 - DNA, 22 bp, Homo sapiens
tttgctttcttgattcagatta

SEQ ID NO: 7540344 - DNA, 22 bp, Homo sapiens
tttgctttcttgattcagatta

SEQ ID NO: 7540345 - DNA, 22 bp, Homo sapiens
tttgctttgactgtcagcaagt

SEQ ID NO: 7540346 - DNA, 22 bp, Homo sapiens
tttgctttgactgtcagcaagt

SEQ ID NO: 7540347 - DNA, 22 bp, Homo sapiens
tttgctttgactgtcagcaagt

SEQ ID NO: 7540348 - DNA, 22 bp, Homo sapiens
tttgctttgactgtcagcaagt

SEQ ID NO: 7540349 - DNA, 22 bp, Homo sapiens
tttgctttgactgtcagcaagt

SEQ ID NO: 7540350 - DNA, 22 bp, Homo sapiens
tttgctttgggaggttgtctgg

SEQ ID NO: 7540351 - DNA, 22 bp, Homo sapiens
tttgctttgggaggttgtctgg

SEQ ID NO: 7540352 - DNA, 22 bp, Homo sapiens
tttgctttgggaggttgtctgg

SEQ ID NO: 7540353 - DNA, 22 bp, Homo sapiens
tttgctttgggaggttgtctgg

SEQ ID NO: 7540354 - DNA, 22 bp, Homo sapiens
tttgctttgggaggttgtctgg

SEQ ID NO: 7540355 - DNA, 22 bp, Homo sapiens
tttgctttgggaggttgtctgg

SEQ ID NO: 7540356 - DNA, 22 bp, Homo sapiens
tttgctttgggaggttgtctgg

SEQ ID NO: 7540357 - DNA, 22 bp, Homo sapiens
tttgctttgggaggttgtctgg

SEQ ID NO: 7540358 - DNA, 22 bp, Homo sapiens
tttgctttgactgtcagcaagt

SEQ ID NO: 7540359 - DNA, 22 bp, Homo sapiens
tttgctttgactgtcagcaagt

SEQ ID NO: 7540360 - DNA, 22 bp, Homo sapiens
tttgctttgactgtcagcaagt

SEQ ID NO: 7540361 - DNA, 22 bp, Homo sapiens
tttgctttgactgtcagcaagt

SEQ ID NO: 7540362 - DNA, 22 bp, Homo sapiens
tttggttaatttaggcttgcat

SEQ ID NO: 7540363 - DNA, 22 bp, Homo sapiens
tttggttaaacgagagaacata

SEQ ID NO: 7540364 - DNA, 22 bp, Homo sapiens
tttggttcttatctttggagat

SEQ ID NO: 7540365 - DNA, 22 bp, Homo sapiens
tttggtgtctggctgtatggac

SEQ ID NO: 7540366 - DNA, 22 bp, Homo sapiens
tttggtttagggtcatttaaca

SEQ ID NO: 7540367 - DNA, 22 bp, Homo sapiens
tttggtttagggtcatttaaca

SEQ ID NO: 7540368 - DNA, 22 bp, Homo sapiens
tttggtttagggtcatttaaca

SEQ ID NO: 7540369 - DNA, 22 bp, Homo sapiens
tttggtttagggtcatttaaca

SEQ ID NO: 7540370 - DNA, 22 bp, Homo sapiens
tttggtgagctgcgagtgagga

SEQ ID NO: 7540371 - DNA, 22 bp, Homo sapiens
tttggtcttttatttaaagcag

SEQ ID NO: 7540372 - DNA, 22 bp, Homo sapiens
tttggtcttttatttaaagcag

SEQ ID NO: 7540373 - DNA, 22 bp, Homo sapiens
tttggtctggaatcttcagggt

SEQ ID NO: 7540374 - DNA, 22 bp, Homo sapiens
tttggtctctgtgcatcctcct

SEQ ID NO: 7540375 - DNA, 22 bp, Homo sapiens
tttggtctggaatcttcagggt

SEQ ID NO: 7540376 - DNA, 22 bp, Homo sapiens
tttggtgagctgcgagtgagga

SEQ ID NO: 7540377 - DNA, 22 bp, Homo sapiens
tttggtgatagtgcagagaaat

SEQ ID NO: 7540378 - DNA, 22 bp, Homo sapiens
tttggtgagctgcgagtgagga

SEQ ID NO: 7540379 - DNA, 22 bp, Homo sapiens
tttggtgagctgcgagtgagga

SEQ ID NO: 7540380 - DNA, 22 bp, Homo sapiens
tttggtgatagtgcagagaaat

SEQ ID NO: 7540381 - DNA, 22 bp, Homo sapiens
tttgtaaaagcccaagctgtag

SEQ ID NO: 7540382 - DNA, 22 bp, Homo sapiens
tttggtttttacctgctgagag

SEQ ID NO: 7540383 - DNA, 22 bp, Homo sapiens
tttggtttttacctgctgagag

SEQ ID NO: 7540384 - DNA, 22 bp, Homo sapiens
tttggtttttaatacaaagtac

SEQ ID NO: 7540385 - DNA, 22 bp, Homo sapiens
tttgtaaaagcccaagctgtag

SEQ ID NO: 7540386 - DNA, 22 bp, Homo sapiens
tttgtaaaagcccaagctgtag

SEQ ID NO: 7540387 - DNA, 22 bp, Homo sapiens
tttgtaaaagcccaagctgtag

SEQ ID NO: 7540388 - DNA, 22 bp, Homo sapiens
tttggtttgcctgagtaccctc

SEQ ID NO: 7540389 - DNA, 22 bp, Homo sapiens
tttggtttgaatgagcataaga

SEQ ID NO: 7540390 - DNA, 22 bp, Homo sapiens
tttggtttttaatacaaagtac

SEQ ID NO: 7540391 - DNA, 22 bp, Homo sapiens
tttggtttgcctgagtaccctc

SEQ ID NO: 7540392 - DNA, 22 bp, Homo sapiens
tttggtttttaatacaaagtac

SEQ ID NO: 7540393 - DNA, 22 bp, Homo sapiens
tttggtttttaatacaaagtac

SEQ ID NO: 7540394 - DNA, 22 bp, Homo sapiens
tttggtttgaatgagcataaga

SEQ ID NO: 7540395 - DNA, 22 bp, Homo sapiens
tttggtttgaatgagcataaga

SEQ ID NO: 7540396 - DNA, 22 bp, Homo sapiens
tttggtttgaatgagcataaga

SEQ ID NO: 7540397 - DNA, 22 bp, Homo sapiens
tttggtttattaaattgtaggc

SEQ ID NO: 7540398 - DNA, 22 bp, Homo sapiens
tttggtttattaaattgtaggc

SEQ ID NO: 7540399 - DNA, 22 bp, Homo sapiens
tttggtttattaaattgtaggc

SEQ ID NO: 7540400 - DNA, 22 bp, Homo sapiens
tttggtttagggtcatttaaca

SEQ ID NO: 7540401 - DNA, 22 bp, Homo sapiens
tttggttgtatcattctatgaa

SEQ ID NO: 7540402 - DNA, 22 bp, Homo sapiens
tttggtcagggtaggacagttg

SEQ ID NO: 7540403 - DNA, 22 bp, Homo sapiens
tttggtcagcagttggtggcgt

SEQ ID NO: 7540404 - DNA, 22 bp, Homo sapiens
tttggtcagcaatattgtgggg

SEQ ID NO: 7540405 - DNA, 22 bp, Homo sapiens
tttggtcagataagtcaatgta

SEQ ID NO: 7540406 - DNA, 22 bp, Homo sapiens
tttggtccaagttttactcttt

SEQ ID NO: 7540407 - DNA, 22 bp, Homo sapiens
tttggtcatgtcgtcatttggg

SEQ ID NO: 7540408 - DNA, 22 bp, Homo sapiens
tttggtcatgtcgtcatttggg

SEQ ID NO: 7540409 - DNA, 22 bp, Homo sapiens
tttggtctctgtgcatcctcct

SEQ ID NO: 7540410 - DNA, 22 bp, Homo sapiens
tttggtctcattcactcatggg

SEQ ID NO: 7540411 - DNA, 22 bp, Homo sapiens
tttggtctcattcactcatggg

SEQ ID NO: 7540412 - DNA, 18 bp, Homo sapiens
tttggtcctttataaaca

SEQ ID NO: 7540413 - DNA, 18 bp, Homo sapiens
tttggtcctttataaaca

SEQ ID NO: 7540414 - DNA, 22 bp, Homo sapiens
tttggtcctaagctgctctcta

SEQ ID NO: 7540415 - DNA, 22 bp, Homo sapiens
tttggtccattatatgctgtca

SEQ ID NO: 7540416 - DNA, 22 bp, Homo sapiens
tttggtcaaatattatcctgag

SEQ ID NO: 7540417 - DNA, 22 bp, Homo sapiens
tttggtattgcacactgtcttc

SEQ ID NO: 7540418 - DNA, 22 bp, Homo sapiens
tttggtaatgtttcattgcaga

SEQ ID NO: 7540419 - DNA, 17 bp, Homo sapiens
tttggtaatatattaag

SEQ ID NO: 7540420 - DNA, 22 bp, Homo sapiens
tttggtattgcacactgtcttc

SEQ ID NO: 7540421 - DNA, 22 bp, Homo sapiens
tttggtattgcacactgtcttc

SEQ ID NO: 7540422 - DNA, 22 bp, Homo sapiens
tttggtattgcacactgtcttc

SEQ ID NO: 7540423 - DNA, 22 bp, Homo sapiens
tttggtattgcacactgtcttc

SEQ ID NO: 7540424 - DNA, 22 bp, Homo sapiens
tttggtattgcacactgtcttc

SEQ ID NO: 7540425 - DNA, 22 bp, Homo sapiens
tttggaaattttcatccagaca

SEQ ID NO: 7540426 - DNA, 22 bp, Homo sapiens
tttggaaattttcatccagaca

SEQ ID NO: 7540427 - DNA, 22 bp, Homo sapiens
tttggtaagtacccacctgggt

SEQ ID NO: 7540428 - DNA, 22 bp, Homo sapiens
tttggtaagtacccacctgggt

SEQ ID NO: 7540429 - DNA, 22 bp, Homo sapiens
tttggtaagtatgaatgcagta

SEQ ID NO: 7540430 - DNA, 22 bp, Homo sapiens
tttggtaagtatgaatgcagta

SEQ ID NO: 7540431 - DNA, 22 bp, Homo sapiens
tttggtaagtcaggaatgcttc

SEQ ID NO: 7540432 - DNA, 22 bp, Homo sapiens
tttggtaagtcaggaatgcttc

SEQ ID NO: 7540433 - DNA, 17 bp, Homo sapiens
tttggtaatatattaag

SEQ ID NO: 7540434 - DNA, 22 bp, Homo sapiens
tttggaaattttcatccagaca

SEQ ID NO: 7540435 - DNA, 22 bp, Homo sapiens
tttggaaatttcatcaatagcc

SEQ ID NO: 7540436 - DNA, 22 bp, Homo sapiens
tttggaaatgagaagccacctt

SEQ ID NO: 7540437 - DNA, 22 bp, Homo sapiens
tttggaaattactcattgtcct

SEQ ID NO: 7540438 - DNA, 22 bp, Homo sapiens
tttggaaatttcatcaatagcc

SEQ ID NO: 7540439 - DNA, 22 bp, Homo sapiens
tttggaaattactcattgtcct

SEQ ID NO: 7540440 - DNA, 22 bp, Homo sapiens
tttggaaataattccatctcat

SEQ ID NO: 7540441 - DNA, 22 bp, Homo sapiens
tttggaaagttgtcactttaga

SEQ ID NO: 7540442 - DNA, 22 bp, Homo sapiens
tttggaaagttgtcactttaga

SEQ ID NO: 7540443 - DNA, 22 bp, Homo sapiens
tttggaaataattccatctcat

SEQ ID NO: 7540444 - DNA, 22 bp, Homo sapiens
tttggaaataattccatctcat

SEQ ID NO: 7540445 - DNA, 22 bp, Homo sapiens
tttggaaataattccatctcat

SEQ ID NO: 7540446 - DNA, 22 bp, Homo sapiens
tttggaaatacgcgtaggcaga

SEQ ID NO: 7540447 - DNA, 22 bp, Homo sapiens
tttggaaatacgcgtaggcaga

SEQ ID NO: 7540448 - DNA, 22 bp, Homo sapiens
tttggaaatgaccccgtctaag

SEQ ID NO: 7540449 - DNA, 22 bp, Homo sapiens
tttggaaatacgcgtaggcaga

SEQ ID NO: 7540450 - DNA, 22 bp, Homo sapiens
tttggaaagttgtcactttaga

SEQ ID NO: 7540451 - DNA, 22 bp, Homo sapiens
tttggaaagttgtcactttaga

SEQ ID NO: 7540452 - DNA, 22 bp, Homo sapiens
tttggaaagttgtcactttaga

SEQ ID NO: 7540453 - DNA, 22 bp, Homo sapiens
tttggaaagtgtgatttcaagg

SEQ ID NO: 7540454 - DNA, 22 bp, Homo sapiens
tttggaaagtgtgatttcaagg

SEQ ID NO: 7540455 - DNA, 22 bp, Homo sapiens
tttggaaagtgtgatttcaagg

SEQ ID NO: 7540456 - DNA, 22 bp, Homo sapiens
tttggaaagtgtacaaatttga

SEQ ID NO: 7540457 - DNA, 22 bp, Homo sapiens
tttggaaagtgtgatttcaagg

SEQ ID NO: 7540458 - DNA, 22 bp, Homo sapiens
tttggaaagtgtgatttcaagg

SEQ ID NO: 7540459 - DNA, 17 bp, Homo sapiens
tttggaaagtgatcatt

SEQ ID NO: 7540460 - DNA, 22 bp, Homo sapiens
tttggaaaggtttggccattat

SEQ ID NO: 7540461 - DNA, 22 bp, Homo sapiens
tttggaaagacacacagtttta

SEQ ID NO: 7540462 - DNA, 22 bp, Homo sapiens
tttggaaagacacacagtttta

SEQ ID NO: 7540463 - DNA, 22 bp, Homo sapiens
tttggaaagtgtacaaatttga

SEQ ID NO: 7540464 - DNA, 22 bp, Homo sapiens
tttggaaagtgtacaaatttga

SEQ ID NO: 7540465 - DNA, 22 bp, Homo sapiens
tttggaaaatattgaactggtt

SEQ ID NO: 7540466 - DNA, 22 bp, Homo sapiens
tttggaaaatattgaactggtt

SEQ ID NO: 7540467 - DNA, 22 bp, Homo sapiens
tttggaaaaagcctgaacatag

SEQ ID NO: 7540468 - DNA, 22 bp, Homo sapiens
tttggaaaaagcctgaacatag

SEQ ID NO: 7540469 - DNA, 22 bp, Homo sapiens
tttggaaaaagacagcttatga

SEQ ID NO: 7540470 - DNA, 22 bp, Homo sapiens
tttggaaaaagcctgaacatag

SEQ ID NO: 7540471 - DNA, 22 bp, Homo sapiens
tttggaaaaagacagcttatga

SEQ ID NO: 7540472 - DNA, 22 bp, Homo sapiens
tttgctttgggaggttgtctgg

SEQ ID NO: 7540473 - DNA, 22 bp, Homo sapiens
tttgctttgtttaaaagtggta

SEQ ID NO: 7540474 - DNA, 22 bp, Homo sapiens
tttgctttgtttaaaagtggta

SEQ ID NO: 7540475 - DNA, 22 bp, Homo sapiens
tttgctttgtttaaaagtggta

SEQ ID NO: 7540476 - DNA, 22 bp, Homo sapiens
tttgcttttgtgctctagtggt

SEQ ID NO: 7540477 - DNA, 22 bp, Homo sapiens
tttgcttttgtgctctagtggt

SEQ ID NO: 7540478 - DNA, 22 bp, Homo sapiens
tttgcttttgtgctctagtggt

SEQ ID NO: 7540479 - DNA, 22 bp, Homo sapiens
tttgctttgtttaaaagtggta

SEQ ID NO: 7540480 - DNA, 22 bp, Homo sapiens
tttgcttttgtgctctagtggt

SEQ ID NO: 7540481 - DNA, 22 bp, Homo sapiens
tttgcttttgtgctctagtggt

SEQ ID NO: 7540482 - DNA, 22 bp, Homo sapiens
tttgcttttgtgctctagtggt

SEQ ID NO: 7540483 - DNA, 22 bp, Homo sapiens
tttgcttttgtgctctagtggt

SEQ ID NO: 7540484 - DNA, 22 bp, Homo sapiens
tttggaaactgcctcagctctt

SEQ ID NO: 7540485 - DNA, 22 bp, Homo sapiens
tttggaaactgcctcagctctt

SEQ ID NO: 7540486 - DNA, 22 bp, Homo sapiens
tttggaaactgcctcagctctt

SEQ ID NO: 7540487 - DNA, 22 bp, Homo sapiens
tttggaaagacacacagtttta

SEQ ID NO: 7540488 - DNA, 22 bp, Homo sapiens
tttggaaactgcctcagctctt

SEQ ID NO: 7540489 - DNA, 22 bp, Homo sapiens
tttggaaactgatggtacattc

SEQ ID NO: 7540490 - DNA, 22 bp, Homo sapiens
tttggaaactgatggtacattc

SEQ ID NO: 7540491 - DNA, 22 bp, Homo sapiens
tttggaaacatctcagaaaata

SEQ ID NO: 7540492 - DNA, 22 bp, Homo sapiens
tttggaaacatctcagaaaata

SEQ ID NO: 7540493 - DNA, 22 bp, Homo sapiens
tttggaaacatctcagaaaata

SEQ ID NO: 7540494 - DNA, 22 bp, Homo sapiens
tttggaaacatctcagaaaata

SEQ ID NO: 7540495 - DNA, 22 bp, Homo sapiens
tttggaaacacggtcatcttcc

SEQ ID NO: 7540496 - DNA, 22 bp, Homo sapiens
tttggaaacacggtcatcttcc

SEQ ID NO: 7540497 - DNA, 22 bp, Homo sapiens
tttggaaacacggtcatcttcc

SEQ ID NO: 7540498 - DNA, 22 bp, Homo sapiens
tttggaaacacggtcatcttcc

SEQ ID NO: 7540499 - DNA, 22 bp, Homo sapiens
tttggaaacacggtcatcttcc

SEQ ID NO: 7540500 - DNA, 22 bp, Homo sapiens
tttggaaaattttctaagtctg

SEQ ID NO: 7540501 - DNA, 22 bp, Homo sapiens
tttcttttgccctgtgggttag

SEQ ID NO: 7540502 - DNA, 22 bp, Homo sapiens
tttcttttgccctgtgggttag

SEQ ID NO: 7540503 - DNA, 22 bp, Homo sapiens
tttcttttgccctgtgggttag

SEQ ID NO: 7540504 - DNA, 22 bp, Homo sapiens
tttcttttgccctgtgggttag

SEQ ID NO: 7540505 - DNA, 22 bp, Homo sapiens
tttcttttgccctgtgggttag

SEQ ID NO: 7540506 - DNA, 22 bp, Homo sapiens
tttcttttgccctgtgggttag

SEQ ID NO: 7540507 - DNA, 22 bp, Homo sapiens
tttcttttgccctgtgggttag

SEQ ID NO: 7540508 - DNA, 22 bp, Homo sapiens
tttcttttgccctgtgggttag

SEQ ID NO: 7540509 - DNA, 22 bp, Homo sapiens
tttcttttgctgagaggggcac

SEQ ID NO: 7540510 - DNA, 22 bp, Homo sapiens
tttcttttgctgagaggggcac

SEQ ID NO: 7540511 - DNA, 22 bp, Homo sapiens
tttcttttgctgagaggggcac

SEQ ID NO: 7540512 - DNA, 22 bp, Homo sapiens
tttcttttgctgagaggggcac

SEQ ID NO: 7540513 - DNA, 22 bp, Homo sapiens
tttcttttgctgagaggggcac

SEQ ID NO: 7540514 - DNA, 22 bp, Homo sapiens
tttcttttgctgagaggggcac

SEQ ID NO: 7540515 - DNA, 22 bp, Homo sapiens
tttgaaaaaggcctttggtatg

SEQ ID NO: 7540516 - DNA, 22 bp, Homo sapiens
tttgaaaaaggcctttggtatg

SEQ ID NO: 7540517 - DNA, 22 bp, Homo sapiens
tttgaaagcaccatttgagtag

SEQ ID NO: 7540518 - DNA, 22 bp, Homo sapiens
tttcttttccaatatccctact

SEQ ID NO: 7540519 - DNA, 19 bp, Homo sapiens
tttcttttcccctcagcac

SEQ ID NO: 7540520 - DNA, 19 bp, Homo sapiens
tttcttttcccctcagcac

SEQ ID NO: 7540521 - DNA, 19 bp, Homo sapiens
tttcttttcccctcagcac

SEQ ID NO: 7540522 - DNA, 19 bp, Homo sapiens
tttcttttcccctcagcac

SEQ ID NO: 7540523 - DNA, 22 bp, Homo sapiens
tttcttttccaatatccctact

SEQ ID NO: 7540524 - DNA, 22 bp, Homo sapiens
tttcttttccaatatccctact

SEQ ID NO: 7540525 - DNA, 22 bp, Homo sapiens
tttcttttccaatatccctact

SEQ ID NO: 7540526 - DNA, 22 bp, Homo sapiens
tttcttttccaatatccctact

SEQ ID NO: 7540527 - DNA, 22 bp, Homo sapiens
tttcttttccaatatccctact

SEQ ID NO: 7540528 - DNA, 22 bp, Homo sapiens
tttcttttccaatatccctact

SEQ ID NO: 7540529 - DNA, 22 bp, Homo sapiens
tttcttttgaatagtgtgtggt

SEQ ID NO: 7540530 - DNA, 19 bp, Homo sapiens
tttcttttcccctcagcac

SEQ ID NO: 7540531 - DNA, 19 bp, Homo sapiens
tttcttttcccctcagcac

SEQ ID NO: 7540532 - DNA, 22 bp, Homo sapiens
tttcttttgaatagtgtgtggt

SEQ ID NO: 7540533 - DNA, 22 bp, Homo sapiens
tttcttttgaatagtgtgtggt

SEQ ID NO: 7540534 - DNA, 22 bp, Homo sapiens
tttcttttgaatagtgtgtggt

SEQ ID NO: 7540535 - DNA, 22 bp, Homo sapiens
tttcttttgaatagtgtgtggt

SEQ ID NO: 7540536 - DNA, 22 bp, Homo sapiens
tttcttttgaatagtgtgtggt

SEQ ID NO: 7540537 - DNA, 22 bp, Homo sapiens
tttcttttacagtgtggctatt

SEQ ID NO: 7540538 - DNA, 22 bp, Homo sapiens
tttcttttacagtgtggctatt

SEQ ID NO: 7540539 - DNA, 22 bp, Homo sapiens
tttcttttacagtgtggctatt

SEQ ID NO: 7540540 - DNA, 22 bp, Homo sapiens
tttcttttacagtgtggctatt

SEQ ID NO: 7540541 - DNA, 22 bp, Homo sapiens
tttcttttacagtgtggctatt

SEQ ID NO: 7540542 - DNA, 22 bp, Homo sapiens
tttctttgttgttatcacatca

SEQ ID NO: 7540543 - DNA, 22 bp, Homo sapiens
tttctttgttgttatcacatca

SEQ ID NO: 7540544 - DNA, 22 bp, Homo sapiens
tttctttgttgttatcacatca

SEQ ID NO: 7540545 - DNA, 22 bp, Homo sapiens
tttctttgttgttatcacatca

SEQ ID NO: 7540546 - DNA, 22 bp, Homo sapiens
tttctttgttgttatcacatca

SEQ ID NO: 7540547 - DNA, 22 bp, Homo sapiens
tttctttgttgttatcacatca

SEQ ID NO: 7540548 - DNA, 22 bp, Homo sapiens
tttctttgttgttatcacatca

SEQ ID NO: 7540549 - DNA, 22 bp, Homo sapiens
tttctttgttgttatcacatca

SEQ ID NO: 7540550 - DNA, 22 bp, Homo sapiens
tttctttgtagtagcataatca

SEQ ID NO: 7540551 - DNA, 22 bp, Homo sapiens
tttctttgtagtagcataatca

SEQ ID NO: 7540552 - DNA, 22 bp, Homo sapiens
tttctttgtagtagcataatca

SEQ ID NO: 7540553 - DNA, 22 bp, Homo sapiens
tttctttgtagtagcataatca

SEQ ID NO: 7540554 - DNA, 22 bp, Homo sapiens
tttctttgtagtagcataatca

SEQ ID NO: 7540555 - DNA, 22 bp, Homo sapiens
tttctttgtagtagcataatca

SEQ ID NO: 7540556 - DNA, 21 bp, Homo sapiens
tttctttctggctctcacagt

SEQ ID NO: 7540557 - DNA, 21 bp, Homo sapiens
tttctttctggctctcacagt

SEQ ID NO: 7540558 - DNA, 21 bp, Homo sapiens
tttctttctggctctcacagt

SEQ ID NO: 7540559 - DNA, 21 bp, Homo sapiens
tttctttctggctctcacagt

SEQ ID NO: 7540560 - DNA, 22 bp, Homo sapiens
tttctttgagtctcagtttgct

SEQ ID NO: 7540561 - DNA, 22 bp, Homo sapiens
tttctttgagtctcagtttgct

SEQ ID NO: 7540562 - DNA, 22 bp, Homo sapiens
tttctttgagtctcagtttgct

SEQ ID NO: 7540563 - DNA, 22 bp, Homo sapiens
tttctttgagtctcagtttgct

SEQ ID NO: 7540564 - DNA, 22 bp, Homo sapiens
tttctttgagtctcagtttgct

SEQ ID NO: 7540565 - DNA, 22 bp, Homo sapiens
tttctttgagtctcagtttgct

SEQ ID NO: 7540566 - DNA, 22 bp, Homo sapiens
tttctttgagtctcagtttgct

SEQ ID NO: 7540567 - DNA, 18 bp, Homo sapiens
tttctttctgcctggggc

SEQ ID NO: 7540568 - DNA, 18 bp, Homo sapiens
tttctttctgcctggggc

SEQ ID NO: 7540569 - DNA, 22 bp, Homo sapiens
tttcctctgatgctgacttgga

SEQ ID NO: 7540570 - DNA, 22 bp, Homo sapiens
tttcctctgatgctgacttgga

SEQ ID NO: 7540571 - DNA, 22 bp, Homo sapiens
tttcctctgatgctgacttgga

SEQ ID NO: 7540572 - DNA, 22 bp, Homo sapiens
tttcctctgatgctgacttgga

SEQ ID NO: 7540573 - DNA, 22 bp, Homo sapiens
tttcctctgatgctgacttgga

SEQ ID NO: 7540574 - DNA, 22 bp, Homo sapiens
tttcctctgatgctgacttgga

SEQ ID NO: 7540575 - DNA, 21 bp, Homo sapiens
tttctttctggctctcacagt

SEQ ID NO: 7540576 - DNA, 21 bp, Homo sapiens
tttctttctggctctcacagt

SEQ ID NO: 7540577 - DNA, 19 bp, Homo sapiens
tttcctaaaaagctgtgct

SEQ ID NO: 7540578 - DNA, 19 bp, Homo sapiens
tttcctaaaaagctgtgct

SEQ ID NO: 7540579 - DNA, 22 bp, Homo sapiens
tttcctaacacaatgcatgaga

SEQ ID NO: 7540580 - DNA, 22 bp, Homo sapiens
tttcctaacacaatgcatgaga

SEQ ID NO: 7540581 - DNA, 22 bp, Homo sapiens
tttccctttgcactctacaatt

SEQ ID NO: 7540582 - DNA, 22 bp, Homo sapiens
tttccctttgcactctacaatt

SEQ ID NO: 7540583 - DNA, 22 bp, Homo sapiens
tttccctttgcactctacaatt

SEQ ID NO: 7540584 - DNA, 22 bp, Homo sapiens
tttccctttgcactctacaatt

SEQ ID NO: 7540585 - DNA, 22 bp, Homo sapiens
tttcccttgttccttcctctga

SEQ ID NO: 7540586 - DNA, 22 bp, Homo sapiens
tttccctttagcctgagaatcc

SEQ ID NO: 7540587 - DNA, 22 bp, Homo sapiens
tttccctttagcctgagaatcc

SEQ ID NO: 7540588 - DNA, 22 bp, Homo sapiens
tttccctgtgaatatttaaaga

SEQ ID NO: 7540589 - DNA, 22 bp, Homo sapiens
tttcccttctttcctgagtaat

SEQ ID NO: 7540590 - DNA, 22 bp, Homo sapiens
tttcccttctttcctgagtaat

SEQ ID NO: 7540591 - DNA, 22 bp, Homo sapiens
tttcccttctttcctgagtaat

SEQ ID NO: 7540592 - DNA, 22 bp, Homo sapiens
tttcccttctttcctgagtaat

SEQ ID NO: 7540593 - DNA, 22 bp, Homo sapiens
tttcccttgaataaagatatct

SEQ ID NO: 7540594 - DNA, 22 bp, Homo sapiens
tttcccttgaataaagatatct

SEQ ID NO: 7540595 - DNA, 22 bp, Homo sapiens
tttcccttgttccttcctctga

SEQ ID NO: 7540596 - DNA, 22 bp, Homo sapiens
tttccctacttgtaactggaaa

SEQ ID NO: 7540597 - DNA, 21 bp, Homo sapiens
tttccctcattgtgttggcac

SEQ ID NO: 7540598 - DNA, 22 bp, Homo sapiens
tttcccctgaaagcaacctcct

SEQ ID NO: 7540599 - DNA, 22 bp, Homo sapiens
tttccctacttgtaactggaaa

SEQ ID NO: 7540600 - DNA, 17 bp, Homo sapiens
tttccctccttccactc

SEQ ID NO: 7540601 - DNA, 17 bp, Homo sapiens
tttccctccttccactc

SEQ ID NO: 7540602 - DNA, 17 bp, Homo sapiens
tttccctccttccactc

SEQ ID NO: 7540603 - DNA, 22 bp, Homo sapiens
tttccctctcatctctattatt

SEQ ID NO: 7540604 - DNA, 22 bp, Homo sapiens
tttccctctcatctctattatt

SEQ ID NO: 7540605 - DNA, 22 bp, Homo sapiens
tttccctctgtgccagcttctc

SEQ ID NO: 7540606 - DNA, 22 bp, Homo sapiens
tttccctctgtgccagcttctc

SEQ ID NO: 7540607 - DNA, 22 bp, Homo sapiens
tttccctctgtgccagcttctc

SEQ ID NO: 7540608 - DNA, 22 bp, Homo sapiens
tttccctctgtgccagcttctc

SEQ ID NO: 7540609 - DNA, 22 bp, Homo sapiens
tttcccttctttcctgagtaat

SEQ ID NO: 7540610 - DNA, 22 bp, Homo sapiens
tttccctgtgaatatttaaaga

SEQ ID NO: 7540611 - DNA, 22 bp, Homo sapiens
tttcccttctttcctgagtaat

SEQ ID NO: 7540612 - DNA, 22 bp, Homo sapiens
tttccctgaggcctggacatta

SEQ ID NO: 7540613 - DNA, 22 bp, Homo sapiens
tttccctgaggcctggacatta

SEQ ID NO: 7540614 - DNA, 22 bp, Homo sapiens
tttcctctccaccaggaggtct

SEQ ID NO: 7540615 - DNA, 22 bp, Homo sapiens
tttcctctaaacgcatttgctt

SEQ ID NO: 7540616 - DNA, 22 bp, Homo sapiens
tttcctctaaacgcatttgctt

SEQ ID NO: 7540617 - DNA, 22 bp, Homo sapiens
tttcctcctagcctccagccgc

SEQ ID NO: 7540618 - DNA, 22 bp, Homo sapiens
tttcctcctagcctccagccgc

SEQ ID NO: 7540619 - DNA, 22 bp, Homo sapiens
tttcctcatttatctgctggga

SEQ ID NO: 7540620 - DNA, 22 bp, Homo sapiens
tttcctcagaagtgtctactat

SEQ ID NO: 7540621 - DNA, 22 bp, Homo sapiens
tttcctcagaagtgtctactat

SEQ ID NO: 7540622 - DNA, 22 bp, Homo sapiens
tttcctcagaagtgtctactat

SEQ ID NO: 7540623 - DNA, 22 bp, Homo sapiens
tttcctaacacaatgcatgaga

SEQ ID NO: 7540624 - DNA, 22 bp, Homo sapiens
tttcctcacttcatgagagttt

SEQ ID NO: 7540625 - DNA, 22 bp, Homo sapiens
tttcctctccggggcctccagg

SEQ ID NO: 7540626 - DNA, 22 bp, Homo sapiens
tttcctctccggggcctccagg

SEQ ID NO: 7540627 - DNA, 22 bp, Homo sapiens
tttcctctccggggcctccagg

SEQ ID NO: 7540628 - DNA, 22 bp, Homo sapiens
tttcctctccggggcctccagg

SEQ ID NO: 7540629 - DNA, 22 bp, Homo sapiens
tttcctctccaccaggaggtct

SEQ ID NO: 7540630 - DNA, 22 bp, Homo sapiens
tttcctctccaccaggaggtct

SEQ ID NO: 7540631 - DNA, 22 bp, Homo sapiens
tttcctctccaccaggaggtct

SEQ ID NO: 7540632 - DNA, 22 bp, Homo sapiens
tttcctctccaccaggaggtct

SEQ ID NO: 7540633 - DNA, 22 bp, Homo sapiens
tttcctctgactgctcccctgc

SEQ ID NO: 7540634 - DNA, 22 bp, Homo sapiens
tttcctctgactgctcccctgc

SEQ ID NO: 7540635 - DNA, 22 bp, Homo sapiens
tttcctctgactgctcccctgc

SEQ ID NO: 7540636 - DNA, 22 bp, Homo sapiens
tttcctctgactgctcccctgc

SEQ ID NO: 7540637 - DNA, 22 bp, Homo sapiens
tttcctctgagtgagctgggag

SEQ ID NO: 7540638 - DNA, 22 bp, Homo sapiens
tttcctctgagtgagctgggag

SEQ ID NO: 7540639 - DNA, 22 bp, Homo sapiens
tttcctctgagtgagctgggag

SEQ ID NO: 7540640 - DNA, 22 bp, Homo sapiens
tttgacaaaattatgctaatat

SEQ ID NO: 7540641 - DNA, 22 bp, Homo sapiens
tttgacaaaattatgctaatat

SEQ ID NO: 7540642 - DNA, 22 bp, Homo sapiens
tttgacaaaggaaaaatgcaca

SEQ ID NO: 7540643 - DNA, 22 bp, Homo sapiens
tttgacaaaggaaaaatgcaca

SEQ ID NO: 7540644 - DNA, 22 bp, Homo sapiens
tttgacaaaggaaaaatgcaca

SEQ ID NO: 7540645 - DNA, 22 bp, Homo sapiens
tttgacaaaggaaaaatgcaca

SEQ ID NO: 7540646 - DNA, 22 bp, Homo sapiens
tttgacaaaggaaaaatgcaca

SEQ ID NO: 7540647 - DNA, 22 bp, Homo sapiens
tttgacaaaggaaaaatgcaca

SEQ ID NO: 7540648 - DNA, 22 bp, Homo sapiens
tttgacaaataggggaataagg

SEQ ID NO: 7540649 - DNA, 22 bp, Homo sapiens
tttgacaaatatttattggcac

SEQ ID NO: 7540650 - DNA, 22 bp, Homo sapiens
tttgacaaataggggaataagg

SEQ ID NO: 7540651 - DNA, 22 bp, Homo sapiens
tttgacaacacgttatttgcct

SEQ ID NO: 7540652 - DNA, 22 bp, Homo sapiens
tttgacaacagcaaatgtcaca

SEQ ID NO: 7540653 - DNA, 22 bp, Homo sapiens
tttgacaacagcaaatgtcaca

SEQ ID NO: 7540654 - DNA, 22 bp, Homo sapiens
tttgacaaatgtatctgcatta

SEQ ID NO: 7540655 - DNA, 22 bp, Homo sapiens
tttgacaacacgttatttgcct

SEQ ID NO: 7540656 - DNA, 22 bp, Homo sapiens
tttgacaaatccttcagcaatg

SEQ ID NO: 7540657 - DNA, 22 bp, Homo sapiens
tttgacaaatatttattggcac

SEQ ID NO: 7540658 - DNA, 22 bp, Homo sapiens
tttgacaaatccttcagcaatg

SEQ ID NO: 7540659 - DNA, 22 bp, Homo sapiens
tttgacaaatccttcagcaatg

SEQ ID NO: 7540660 - DNA, 22 bp, Homo sapiens
tttgacaaatatttattggcac

SEQ ID NO: 7540661 - DNA, 22 bp, Homo sapiens
tttgacaaatatttattggcac

SEQ ID NO: 7540662 - DNA, 23 bp, Homo sapiens
tttgaatgggtctatttttctta

SEQ ID NO: 7540663 - DNA, 22 bp, Homo sapiens
tttgaatggactgagaatcttg

SEQ ID NO: 7540664 - DNA, 22 bp, Homo sapiens
tttgaatggactgagaatcttg

SEQ ID NO: 7540665 - DNA, 23 bp, Homo sapiens
tttgaatgggtctatttttctta

SEQ ID NO: 7540666 - DNA, 22 bp, Homo sapiens
tttgaatgcaggacatacagaa

SEQ ID NO: 7540667 - DNA, 22 bp, Homo sapiens
tttgaatgattatctttcggca

SEQ ID NO: 7540668 - DNA, 22 bp, Homo sapiens
tttgaatggactgagaatcttg

SEQ ID NO: 7540669 - DNA, 22 bp, Homo sapiens
tttgaatgcaggacatacagaa

SEQ ID NO: 7540670 - DNA, 22 bp, Homo sapiens
tttgaatgcaggacatacagaa

SEQ ID NO: 7540671 - DNA, 22 bp, Homo sapiens
tttgaatgagggaaccacagtt

SEQ ID NO: 7540672 - DNA, 22 bp, Homo sapiens
tttgaatgagggaaccacagtt

SEQ ID NO: 7540673 - DNA, 22 bp, Homo sapiens
tttgaatgattatctttcggca

SEQ ID NO: 7540674 - DNA, 22 bp, Homo sapiens
tttgaatgagaattattgtcat

SEQ ID NO: 7540675 - DNA, 22 bp, Homo sapiens
tttgaatgttttaggtacttaa

SEQ ID NO: 7540676 - DNA, 22 bp, Homo sapiens
tttgaatgttttaggtacttaa

SEQ ID NO: 7540677 - DNA, 22 bp, Homo sapiens
tttgaattattccttgagttga

SEQ ID NO: 7540678 - DNA, 22 bp, Homo sapiens
tttgaatgttggattgacttag

SEQ ID NO: 7540679 - DNA, 22 bp, Homo sapiens
tttgaatgttggattgacttag

SEQ ID NO: 7540680 - DNA, 23 bp, Homo sapiens
tttgaatgggtctatttttctta

SEQ ID NO: 7540681 - DNA, 23 bp, Homo sapiens
tttgaatgggtctatttttctta

SEQ ID NO: 7540682 - DNA, 20 bp, Homo sapiens
tttgaatgtaaagcatgtca

SEQ ID NO: 7540683 - DNA, 20 bp, Homo sapiens
tttgaatgtaaagcatgtca

SEQ ID NO: 7540684 - DNA, 20 bp, Homo sapiens
tttgaatgtaaagcatgtca

SEQ ID NO: 7540685 - DNA, 22 bp, Homo sapiens
tttgaatgtaaatgctgcagct

SEQ ID NO: 7540686 - DNA, 22 bp, Homo sapiens
tttgaatgtaaatgctgcagct

SEQ ID NO: 7540687 - DNA, 22 bp, Homo sapiens
tttgaatgtgtgagttaacttt

SEQ ID NO: 7540688 - DNA, 22 bp, Homo sapiens
tttgacaattaggtagaaaaag

SEQ ID NO: 7540689 - DNA, 22 bp, Homo sapiens
tttgacaattaggtagaaaaag

SEQ ID NO: 7540690 - DNA, 22 bp, Homo sapiens
tttgacaattaggtagaaaaag

SEQ ID NO: 7540691 - DNA, 22 bp, Homo sapiens
tttgacaattaggtagaaaaag

SEQ ID NO: 7540692 - DNA, 22 bp, Homo sapiens
tttgacaattaggtagaaaaag

SEQ ID NO: 7540693 - DNA, 22 bp, Homo sapiens
tttgacaattaggtagaaaaag

SEQ ID NO: 7540694 - DNA, 22 bp, Homo sapiens
tttgacaataattgcatttata

SEQ ID NO: 7540695 - DNA, 22 bp, Homo sapiens
tttgacaataattgcatttata

SEQ ID NO: 7540696 - DNA, 22 bp, Homo sapiens
tttgacaagagggcatcttcag

SEQ ID NO: 7540697 - DNA, 22 bp, Homo sapiens
tttgacaataattgcatttata

SEQ ID NO: 7540698 - DNA, 22 bp, Homo sapiens
tttgacaataattgcatttata

SEQ ID NO: 7540699 - DNA, 22 bp, Homo sapiens
tttgacaagagggcatcttcag

SEQ ID NO: 7540700 - DNA, 22 bp, Homo sapiens
tttgacaagagcaaatgttctt

SEQ ID NO: 7540701 - DNA, 22 bp, Homo sapiens
tttgacaagagcaaatgttctt

SEQ ID NO: 7540702 - DNA, 22 bp, Homo sapiens
tttgacaacagcaaatgtcaca

SEQ ID NO: 7540703 - DNA, 22 bp, Homo sapiens
tttgacaacagcaaatgtcaca

SEQ ID NO: 7540704 - DNA, 22 bp, Homo sapiens
tttgacaaccaggcaggtaaga

SEQ ID NO: 7540705 - DNA, 22 bp, Homo sapiens
tttgacaaccaggcaggtaaga

SEQ ID NO: 7540706 - DNA, 22 bp, Homo sapiens
tttgacaaccaggcaggtaaga

SEQ ID NO: 7540707 - DNA, 22 bp, Homo sapiens
tttgacaaccaggcaggtaaga

SEQ ID NO: 7540708 - DNA, 22 bp, Homo sapiens
tttgacaactgtgcagtttgta

SEQ ID NO: 7540709 - DNA, 22 bp, Homo sapiens
tttgacaactgtgcagtttgta

SEQ ID NO: 7540710 - DNA, 22 bp, Homo sapiens
tttgacaacgttgttgtgagga

SEQ ID NO: 7540711 - DNA, 22 bp, Homo sapiens
tttgacaacgttgttgtgagga

SEQ ID NO: 7540712 - DNA, 22 bp, Homo sapiens
tttgacagacatttactacatt

SEQ ID NO: 7540713 - DNA, 22 bp, Homo sapiens
tttgacactgggagtgtgggtg

SEQ ID NO: 7540714 - DNA, 22 bp, Homo sapiens
tttgacagaaagttattatttt

SEQ ID NO: 7540715 - DNA, 22 bp, Homo sapiens
tttgacagaaagttattatttt

SEQ ID NO: 7540716 - DNA, 22 bp, Homo sapiens
tttgacaattcatgacatttat

SEQ ID NO: 7540717 - DNA, 22 bp, Homo sapiens
tttgacaattcatgacatttat

SEQ ID NO: 7540718 - DNA, 22 bp, Homo sapiens
tttgacaattcatgacatttat

SEQ ID NO: 7540719 - DNA, 22 bp, Homo sapiens
tttgacagatagatgttatgtt

SEQ ID NO: 7540720 - DNA, 22 bp, Homo sapiens
tttgacagatagatgttatgtt

SEQ ID NO: 7540721 - DNA, 19 bp, Homo sapiens
tttgacagagtttgagcat

SEQ ID NO: 7540722 - DNA, 19 bp, Homo sapiens
tttgacagagtttgagcat

SEQ ID NO: 7540723 - DNA, 22 bp, Homo sapiens
tttgacagagttgtgaggattt

SEQ ID NO: 7540724 - DNA, 22 bp, Homo sapiens
tttgacagacagtgctgggaca

SEQ ID NO: 7540725 - DNA, 22 bp, Homo sapiens
tttgacagaggttgtggtgtat

SEQ ID NO: 7540726 - DNA, 22 bp, Homo sapiens
tttgacagagctcttagtctct

SEQ ID NO: 7540727 - DNA, 22 bp, Homo sapiens
tttgacagagctcttagtctct

SEQ ID NO: 7540728 - DNA, 22 bp, Homo sapiens
tttgaaaggtgtcgagatgtgt

SEQ ID NO: 7540729 - DNA, 22 bp, Homo sapiens
tttgaaagggttatgagactga

SEQ ID NO: 7540730 - DNA, 22 bp, Homo sapiens
tttgaagagccacagtgaaatt

SEQ ID NO: 7540731 - DNA, 22 bp, Homo sapiens
tttgaagagccacagtgaaatt

SEQ ID NO: 7540732 - DNA, 22 bp, Homo sapiens
tttgaatagggctttgcaggga

SEQ ID NO: 7540733 - DNA, 19 bp, Homo sapiens
tttgaatataatgcagcta

SEQ ID NO: 7540734 - DNA, 22 bp, Homo sapiens
tttgaagataaatatggagaaa

SEQ ID NO: 7540735 - DNA, 22 bp, Homo sapiens
tttgaagcaccaaaggagaaaa

SEQ ID NO: 7540736 - DNA, 22 bp, Homo sapiens
tttgaagataaatatggagaaa

SEQ ID NO: 7540737 - DNA, 22 bp, Homo sapiens
tttgaatgaaattgacatttgg

SEQ ID NO: 7540738 - DNA, 22 bp, Homo sapiens
tttgaatgaaattgacatttgg

SEQ ID NO: 7540739 - DNA, 22 bp, Homo sapiens
tttgaatgagaattattgtcat

SEQ ID NO: 7540740 - DNA, 22 bp, Homo sapiens
tttgaatgagaattattgtcat

SEQ ID NO: 7540741 - DNA, 22 bp, Homo sapiens
tttgaatgacatgattcaggca

SEQ ID NO: 7540742 - DNA, 22 bp, Homo sapiens
tttgaatgacatgattcaggca

SEQ ID NO: 7540743 - DNA, 22 bp, Homo sapiens
tttgaatatgtgcttgttaaat

SEQ ID NO: 7540744 - DNA, 22 bp, Homo sapiens
tttgaatatgtgcttgttaaat

SEQ ID NO: 7540745 - DNA, 22 bp, Homo sapiens
tttgaatatgtgcttgttaaat

SEQ ID NO: 7540746 - DNA, 22 bp, Homo sapiens
tttgaatatgtgcttgttaaat

SEQ ID NO: 7540747 - DNA, 22 bp, Homo sapiens
tttgaatatgtgcttgttaaat

SEQ ID NO: 7540748 - DNA, 22 bp, Homo sapiens
tttgaatatacttcaaacaaag

SEQ ID NO: 7540749 - DNA, 22 bp, Homo sapiens
tttgaatatacttcaaacaaag

SEQ ID NO: 7540750 - DNA, 22 bp, Homo sapiens
tttgaatatacttcaaacaaag

SEQ ID NO: 7540751 - DNA, 22 bp, Homo sapiens
tttgaatatacttcaaacaaag

SEQ ID NO: 7540752 - DNA, 22 bp, Homo sapiens
tttgaatatcacaaactttcaa

SEQ ID NO: 7540753 - DNA, 22 bp, Homo sapiens
tttgaatatacttcaaacaaag

SEQ ID NO: 7540754 - DNA, 22 bp, Homo sapiens
tttgaatatacttcaaacaaag

SEQ ID NO: 7540755 - DNA, 22 bp, Homo sapiens
tttgaatatacttcaaacaaag

SEQ ID NO: 7540756 - DNA, 22 bp, Homo sapiens
tttgaatatcacaaactttcaa

SEQ ID NO: 7540757 - DNA, 22 bp, Homo sapiens
tttgaatatcacaaactttcaa

SEQ ID NO: 7540758 - DNA, 21 bp, Homo sapiens
tttgaaagctacatctatagc

SEQ ID NO: 7540759 - DNA, 21 bp, Homo sapiens
tttgaaagctacatctatagc

SEQ ID NO: 7540760 - DNA, 21 bp, Homo sapiens
tttgaaagccctatgttttca

SEQ ID NO: 7540761 - DNA, 22 bp, Homo sapiens
tttgaaagcctggcttttctct

SEQ ID NO: 7540762 - DNA, 21 bp, Homo sapiens
tttgaaagctacatctatagc

SEQ ID NO: 7540763 - DNA, 21 bp, Homo sapiens
tttgaaagccctatgttttca

SEQ ID NO: 7540764 - DNA, 21 bp, Homo sapiens
tttgaaagccctatgttttca

SEQ ID NO: 7540765 - DNA, 21 bp, Homo sapiens
tttgaaagccctatgttttca

SEQ ID NO: 7540766 - DNA, 22 bp, Homo sapiens
tttgaaagcctggcttttctct

SEQ ID NO: 7540767 - DNA, 22 bp, Homo sapiens
tttgaaaaaggcctttggtatg

SEQ ID NO: 7540768 - DNA, 22 bp, Homo sapiens
tttgaaagcaccatttgagtag

SEQ ID NO: 7540769 - DNA, 22 bp, Homo sapiens
tttgaaagcaccatttgagtag

SEQ ID NO: 7540770 - DNA, 21 bp, Homo sapiens
tttgaaagccctatgttttca

SEQ ID NO: 7540771 - DNA, 22 bp, Homo sapiens
tttgaaagcaggtgtgggaggg

SEQ ID NO: 7540772 - DNA, 21 bp, Homo sapiens
tttgaaagccctatgttttca

SEQ ID NO: 7540773 - DNA, 22 bp, Homo sapiens
tttgaaagggaaataaactcct

SEQ ID NO: 7540774 - DNA, 19 bp, Homo sapiens
tttgaaaggattgttattt

SEQ ID NO: 7540775 - DNA, 19 bp, Homo sapiens
tttgaaaggattgttattt

SEQ ID NO: 7540776 - DNA, 19 bp, Homo sapiens
tttgaaaggattgttattt

SEQ ID NO: 7540777 - DNA, 22 bp, Homo sapiens
tttgaaagggaaataaactcct

SEQ ID NO: 7540778 - DNA, 22 bp, Homo sapiens
tttgaaagggacaaagtcactg

SEQ ID NO: 7540779 - DNA, 22 bp, Homo sapiens
tttgaaagggttatgagactga

SEQ ID NO: 7540780 - DNA, 22 bp, Homo sapiens
tttgaaaggagctttatccaga

SEQ ID NO: 7540781 - DNA, 22 bp, Homo sapiens
tttgaaaggaattaggatgaca

SEQ ID NO: 7540782 - DNA, 22 bp, Homo sapiens
tttgaaaggaattaggatgaca

SEQ ID NO: 7540783 - DNA, 22 bp, Homo sapiens
tttgaaaggaagttaatacttt

SEQ ID NO: 7540784 - DNA, 22 bp, Homo sapiens
tttgaaaggaagttaatacttt

SEQ ID NO: 7540785 - DNA, 22 bp, Homo sapiens
ttttattggagtgataccaagc

SEQ ID NO: 7540786 - DNA, 22 bp, Homo sapiens
ttttattggagtgataccaagc

SEQ ID NO: 7540787 - DNA, 22 bp, Homo sapiens
ttttattggagtgataccaagc

SEQ ID NO: 7540788 - DNA, 22 bp, Homo sapiens
ttttattggagtgataccaagc

SEQ ID NO: 7540789 - DNA, 22 bp, Homo sapiens
ttttattggagtgataccaagc

SEQ ID NO: 7540790 - DNA, 22 bp, Homo sapiens
ttttattgcaataaagtgtgta

SEQ ID NO: 7540791 - DNA, 22 bp, Homo sapiens
ttttattgcaataaagtgtgta

SEQ ID NO: 7540792 - DNA, 22 bp, Homo sapiens
ttttattggagtgataccaagc

SEQ ID NO: 7540793 - DNA, 22 bp, Homo sapiens
ttttattggagtgataccaagc

SEQ ID NO: 7540794 - DNA, 22 bp, Homo sapiens
ttttattggagtgataccaagc

SEQ ID NO: 7540795 - DNA, 22 bp, Homo sapiens
ttttattggagtgataccaagc

SEQ ID NO: 7540796 - DNA, 22 bp, Homo sapiens
ttttattggagtgataccaagc

SEQ ID NO: 7540797 - DNA, 22 bp, Homo sapiens
ttttattggagtgataccaagc

SEQ ID NO: 7540798 - DNA, 22 bp, Homo sapiens
ttttattggagtgataccaagc

SEQ ID NO: 7540799 - DNA, 22 bp, Homo sapiens
ttttattggagtgataccaagc

SEQ ID NO: 7540800 - DNA, 22 bp, Homo sapiens
ttttattggagtgataccaagc

SEQ ID NO: 7540801 - DNA, 22 bp, Homo sapiens
ttttattggagtgataccaagc

SEQ ID NO: 7540802 - DNA, 21 bp, Homo sapiens
ttttattgatgaatggccact

SEQ ID NO: 7540803 - DNA, 21 bp, Homo sapiens
ttttattgatgaatggccact

SEQ ID NO: 7540804 - DNA, 21 bp, Homo sapiens
ttttattgatgaatggccact

SEQ ID NO: 7540805 - DNA, 22 bp, Homo sapiens
ttttattatctttgaatgggac

SEQ ID NO: 7540806 - DNA, 22 bp, Homo sapiens
ttttattatctttgaatgggac

SEQ ID NO: 7540807 - DNA, 22 bp, Homo sapiens
ttttattatctttgaatgggac

SEQ ID NO: 7540808 - DNA, 22 bp, Homo sapiens
ttttattatctttgaatgggac

SEQ ID NO: 7540809 - DNA, 22 bp, Homo sapiens
ttttattgcaataaagtgtgta

SEQ ID NO: 7540810 - DNA, 22 bp, Homo sapiens
ttttattgcaataaagtgtgta

SEQ ID NO: 7540811 - DNA, 22 bp, Homo sapiens
ttttattgcaataaagtgtgta

SEQ ID NO: 7540812 - DNA, 22 bp, Homo sapiens
ttttattgcaataaagtgtgta

SEQ ID NO: 7540813 - DNA, 22 bp, Homo sapiens
ttttattgcaataaagtgtgta

SEQ ID NO: 7540814 - DNA, 22 bp, Homo sapiens
ttttattgcaataaagtgtgta

SEQ ID NO: 7540815 - DNA, 22 bp, Homo sapiens
ttttattgcaataaagtgtgta

SEQ ID NO: 7540816 - DNA, 22 bp, Homo sapiens
ttttattgcaataaagtgtgta

SEQ ID NO: 7540817 - DNA, 22 bp, Homo sapiens
ttttattgcaataaagtgtgta

SEQ ID NO: 7540818 - DNA, 22 bp, Homo sapiens
ttttattgcaataaagtgtgta

SEQ ID NO: 7540819 - DNA, 22 bp, Homo sapiens
ttttatgtgtgaaatgctgtct

SEQ ID NO: 7540820 - DNA, 22 bp, Homo sapiens
ttttatgtgtgaaatgctgtct

SEQ ID NO: 7540821 - DNA, 22 bp, Homo sapiens
ttttatgtgtgaaatgctgtct

SEQ ID NO: 7540822 - DNA, 22 bp, Homo sapiens
ttttatgtgtgaaatgctgtct

SEQ ID NO: 7540823 - DNA, 22 bp, Homo sapiens
ttttatgtgtgaaatgctgtct

SEQ ID NO: 7540824 - DNA, 22 bp, Homo sapiens
ttttatgtgtgaaatgctgtct

SEQ ID NO: 7540825 - DNA, 22 bp, Homo sapiens
ttttatgtgtgaaatgctgtct

SEQ ID NO: 7540826 - DNA, 22 bp, Homo sapiens
ttttatgtgtgaaatgctgtct

SEQ ID NO: 7540827 - DNA, 22 bp, Homo sapiens
ttttatgtgtgaaatgctgtct

SEQ ID NO: 7540828 - DNA, 22 bp, Homo sapiens
ttttatgttcctctttatgcga

SEQ ID NO: 7540829 - DNA, 22 bp, Homo sapiens
ttttatgttcctctttatgcga

SEQ ID NO: 7540830 - DNA, 22 bp, Homo sapiens
ttttatgttcctctttatgcga

SEQ ID NO: 7540831 - DNA, 22 bp, Homo sapiens
ttttatgttcctctttatgcga

SEQ ID NO: 7540832 - DNA, 22 bp, Homo sapiens
ttttatgttcctctttatgcga

SEQ ID NO: 7540833 - DNA, 22 bp, Homo sapiens
ttttatgttcctgaagctatct

SEQ ID NO: 7540834 - DNA, 22 bp, Homo sapiens
ttttatgttcctctttatgcga

SEQ ID NO: 7540835 - DNA, 22 bp, Homo sapiens
ttttatgttcctctttatgcga

SEQ ID NO: 7540836 - DNA, 22 bp, Homo sapiens
ttttatgttcctgaagctatct

SEQ ID NO: 7540837 - DNA, 22 bp, Homo sapiens
ttttatgttcctgaagctatct

SEQ ID NO: 7540838 - DNA, 22 bp, Homo sapiens
ttttatgttcctgaagctatct

SEQ ID NO: 7540839 - DNA, 22 bp, Homo sapiens
ttttatgttcctgaagctatct

SEQ ID NO: 7540840 - DNA, 22 bp, Homo sapiens
ttttatgttgctataataggta

SEQ ID NO: 7540841 - DNA, 22 bp, Homo sapiens
ttttatgttgctataataggta

SEQ ID NO: 7540842 - DNA, 22 bp, Homo sapiens
ttttatgttcctgaagctatct

SEQ ID NO: 7540843 - DNA, 22 bp, Homo sapiens
ttttatgttcctgaagctatct

SEQ ID NO: 7540844 - DNA, 22 bp, Homo sapiens
ttttattagtggctagatgggg

SEQ ID NO: 7540845 - DNA, 22 bp, Homo sapiens
ttttattagtggctagatgggg

SEQ ID NO: 7540846 - DNA, 22 bp, Homo sapiens
ttttattagtggctagatgggg

SEQ ID NO: 7540847 - DNA, 22 bp, Homo sapiens
ttttattagtggctagatgggg

SEQ ID NO: 7540848 - DNA, 22 bp, Homo sapiens
ttttatgttgctataataggta

SEQ ID NO: 7540849 - DNA, 22 bp, Homo sapiens
ttttattagtggctagatgggg

SEQ ID NO: 7540850 - DNA, 22 bp, Homo sapiens
ttttattagtggctagatgggg

SEQ ID NO: 7540851 - DNA, 22 bp, Homo sapiens
ttttattagtggctagatgggg

SEQ ID NO: 7540852 - DNA, 22 bp, Homo sapiens
ttttattagtggctagatgggg

SEQ ID NO: 7540853 - DNA, 22 bp, Homo sapiens
ttttattagtggctagatgggg

SEQ ID NO: 7540854 - DNA, 22 bp, Homo sapiens
ttttattagtggctagatgggg

SEQ ID NO: 7540855 - DNA, 22 bp, Homo sapiens
ttttattagtggctagatgggg

SEQ ID NO: 7540856 - DNA, 22 bp, Homo sapiens
ttttattagtggctagatgggg

SEQ ID NO: 7540857 - DNA, 19 bp, Homo sapiens
ttttcacatactggatcct

SEQ ID NO: 7540858 - DNA, 22 bp, Homo sapiens
ttttcacatgcttggggactta

SEQ ID NO: 7540859 - DNA, 19 bp, Homo sapiens
ttttcacatactggatcct

SEQ ID NO: 7540860 - DNA, 22 bp, Homo sapiens
ttttcagtttgcactgcagtgc

SEQ ID NO: 7540861 - DNA, 22 bp, Homo sapiens
ttttcagttttccaggtagccg

SEQ ID NO: 7540862 - DNA, 22 bp, Homo sapiens
ttttcacattgtcccagcacta

SEQ ID NO: 7540863 - DNA, 22 bp, Homo sapiens
ttttcacattgtcccagcacta

SEQ ID NO: 7540864 - DNA, 22 bp, Homo sapiens
ttttcacacaaggtgataagtt

SEQ ID NO: 7540865 - DNA, 22 bp, Homo sapiens
ttttcacacaaggtgataagtt

SEQ ID NO: 7540866 - DNA, 22 bp, Homo sapiens
ttttattggagtgataccaagc

SEQ ID NO: 7540867 - DNA, 22 bp, Homo sapiens
ttttattggagtgataccaagc

SEQ ID NO: 7540868 - DNA, 22 bp, Homo sapiens
ttttcatggccaccgcaagtga

SEQ ID NO: 7540869 - DNA, 22 bp, Homo sapiens
ttttcatgaggaaatactgccc

SEQ ID NO: 7540870 - DNA, 22 bp, Homo sapiens
ttttcatggccaccgcaagtga

SEQ ID NO: 7540871 - DNA, 22 bp, Homo sapiens
ttttcatggccaccgcaagtga

SEQ ID NO: 7540872 - DNA, 22 bp, Homo sapiens
ttttcatggccaccgcaagtga

SEQ ID NO: 7540873 - DNA, 22 bp, Homo sapiens
ttttcatgtcatgtccttgagg

SEQ ID NO: 7540874 - DNA, 22 bp, Homo sapiens
ttttcatgtgatgtgacatttc

SEQ ID NO: 7540875 - DNA, 22 bp, Homo sapiens
ttttcatgtgatgtgacatttc

SEQ ID NO: 7540876 - DNA, 22 bp, Homo sapiens
ttttcatgtgatgtgacatttc

SEQ ID NO: 7540877 - DNA, 22 bp, Homo sapiens
ttttcatgtcatgtccttgagg

SEQ ID NO: 7540878 - DNA, 22 bp, Homo sapiens
ttttcatgtcatgtccttgagg

SEQ ID NO: 7540879 - DNA, 22 bp, Homo sapiens
ttttcatgaggaaatactgccc

SEQ ID NO: 7540880 - DNA, 22 bp, Homo sapiens
ttttcatgtcatgtccttgagg

SEQ ID NO: 7540881 - DNA, 22 bp, Homo sapiens
ttttcatctctgctttgtacct

SEQ ID NO: 7540882 - DNA, 22 bp, Homo sapiens
ttttcatctctgctttgtacct

SEQ ID NO: 7540883 - DNA, 22 bp, Homo sapiens
ttttcatgaggaaatactgccc

SEQ ID NO: 7540884 - DNA, 22 bp, Homo sapiens
ttttcatgaggaaatactgccc

SEQ ID NO: 7540885 - DNA, 22 bp, Homo sapiens
ttttcatctctgctttgtacct

SEQ ID NO: 7540886 - DNA, 22 bp, Homo sapiens
ttttcatctctgctttgtacct

SEQ ID NO: 7540887 - DNA, 22 bp, Homo sapiens
ttttcatctctgctttgtacct

SEQ ID NO: 7540888 - DNA, 22 bp, Homo sapiens
ttttcatagtaatggtgcatgt

SEQ ID NO: 7540889 - DNA, 22 bp, Homo sapiens
ttttcatagtaatggtgcatgt

SEQ ID NO: 7540890 - DNA, 22 bp, Homo sapiens
ttttcattgtaaatcaggaaac

SEQ ID NO: 7540891 - DNA, 22 bp, Homo sapiens
ttttcattgtaaatcaggaaac

SEQ ID NO: 7540892 - DNA, 22 bp, Homo sapiens
ttttcattgtaaatcaggaaac

SEQ ID NO: 7540893 - DNA, 22 bp, Homo sapiens
ttttcattgtaaatcaggaaac

SEQ ID NO: 7540894 - DNA, 22 bp, Homo sapiens
ttttcattgtaaatcaggaaac

SEQ ID NO: 7540895 - DNA, 22 bp, Homo sapiens
ttttcattgtaaatcaggaaac

SEQ ID NO: 7540896 - DNA, 22 bp, Homo sapiens
ttttcattgagcacctgagtaa

SEQ ID NO: 7540897 - DNA, 22 bp, Homo sapiens
ttttcattgagcacctgagtaa

SEQ ID NO: 7540898 - DNA, 22 bp, Homo sapiens
ttttcattgagcacctgagtaa

SEQ ID NO: 7540899 - DNA, 22 bp, Homo sapiens
ttttcattgagcacctgagtaa

SEQ ID NO: 7540900 - DNA, 22 bp, Homo sapiens
ttttcatgttccttgttaagtg

SEQ ID NO: 7540901 - DNA, 22 bp, Homo sapiens
ttttcattgagcacctgagtaa

SEQ ID NO: 7540902 - DNA, 22 bp, Homo sapiens
ttttcatgttccttgttaagtg

SEQ ID NO: 7540903 - DNA, 22 bp, Homo sapiens
ttttcatgtgatgtgacatttc

SEQ ID NO: 7540904 - DNA, 22 bp, Homo sapiens
ttttcatgttccttgttaagtg

SEQ ID NO: 7540905 - DNA, 22 bp, Homo sapiens
ttttcatgttccttgttaagtg

SEQ ID NO: 7540906 - DNA, 22 bp, Homo sapiens
ttttcatgttccttgttaagtg

SEQ ID NO: 7540907 - DNA, 22 bp, Homo sapiens
ttttcattagaatgactgagaa

SEQ ID NO: 7540908 - DNA, 22 bp, Homo sapiens
ttttcattagaatgactgagaa

SEQ ID NO: 7540909 - DNA, 22 bp, Homo sapiens
ttttcattagaatgactgagaa

SEQ ID NO: 7540910 - DNA, 22 bp, Homo sapiens
ttttcattagaatgactgagaa

SEQ ID NO: 7540911 - DNA, 22 bp, Homo sapiens
ttttcattagaatgactgagaa

SEQ ID NO: 7540912 - DNA, 22 bp, Homo sapiens
ttttcattagaatgactgagaa

SEQ ID NO: 7540913 - DNA, 22 bp, Homo sapiens
ttttcattgtaaatcaggaaac

SEQ ID NO: 7540914 - DNA, 22 bp, Homo sapiens
ttttcattgtaaatcaggaaac

SEQ ID NO: 7540915 - DNA, 22 bp, Homo sapiens
ttttcattgttactatgagcta

SEQ ID NO: 7540916 - DNA, 22 bp, Homo sapiens
ttttcattgttactatgagcta

SEQ ID NO: 7540917 - DNA, 22 bp, Homo sapiens
ttttcattgttactatgagcta

SEQ ID NO: 7540918 - DNA, 22 bp, Homo sapiens
ttttcattgtaaatcaggaaac

SEQ ID NO: 7540919 - DNA, 22 bp, Homo sapiens
ttttcattgttactatgagcta

SEQ ID NO: 7540920 - DNA, 22 bp, Homo sapiens
ttttcattgttactatgagcta

SEQ ID NO: 7540921 - DNA, 22 bp, Homo sapiens
ttttcattgttactatgagcta

SEQ ID NO: 7540922 - DNA, 22 bp, Homo sapiens
ttttcattgttactatgagcta

SEQ ID NO: 7540923 - DNA, 22 bp, Homo sapiens
ttttcattgttactatgagcta

SEQ ID NO: 7540924 - DNA, 22 bp, Homo sapiens
ttttcattgttactatgagcta

SEQ ID NO: 7540925 - DNA, 22 bp, Homo sapiens
ttttcattgttcctcgagcatt

SEQ ID NO: 7540926 - DNA, 22 bp, Homo sapiens
ttttcattgttcctcgagcatt

SEQ ID NO: 7540927 - DNA, 22 bp, Homo sapiens
ttttcattgttcctcgagcatt

SEQ ID NO: 7540928 - DNA, 22 bp, Homo sapiens
ttttcattgttcctcgagcatt

SEQ ID NO: 7540929 - DNA, 22 bp, Homo sapiens
ttttcattgttcctcgagcatt

SEQ ID NO: 7540930 - DNA, 22 bp, Homo sapiens
ttttcattgttcctcgagcatt

SEQ ID NO: 7540931 - DNA, 22 bp, Homo sapiens
ttttcattgttcctcgagcatt

SEQ ID NO: 7540932 - DNA, 22 bp, Homo sapiens
ttttctcagctgcactgtatta

SEQ ID NO: 7540933 - DNA, 22 bp, Homo sapiens
ttttctcagctgcactgtatta

SEQ ID NO: 7540934 - DNA, 22 bp, Homo sapiens
ttttctcagctgcactgtatta

SEQ ID NO: 7540935 - DNA, 22 bp, Homo sapiens
ttttctcaagatccaatgcact

SEQ ID NO: 7540936 - DNA, 22 bp, Homo sapiens
ttttctattcattgtctatggt

SEQ ID NO: 7540937 - DNA, 22 bp, Homo sapiens
ttttctcagctgcactgtatta

SEQ ID NO: 7540938 - DNA, 22 bp, Homo sapiens
ttttctcagctgcactgtatta

SEQ ID NO: 7540939 - DNA, 22 bp, Homo sapiens
ttttctcaagatccaatgcact

SEQ ID NO: 7540940 - DNA, 22 bp, Homo sapiens
ttttctcaagatccaatgcact

SEQ ID NO: 7540941 - DNA, 22 bp, Homo sapiens
ttttctcaagatccaatgcact

SEQ ID NO: 7540942 - DNA, 22 bp, Homo sapiens
ttttctcaagatccaatgcact

SEQ ID NO: 7540943 - DNA, 22 bp, Homo sapiens
ttttctcaggtgcttatctaag

SEQ ID NO: 7540944 - DNA, 22 bp, Homo sapiens
ttttctcaggtgcttatctaag

SEQ ID NO: 7540945 - DNA, 22 bp, Homo sapiens
ttttctcaggtgcttatctaag

SEQ ID NO: 7540946 - DNA, 19 bp, Homo sapiens
ttttctcagcttctagcgg

SEQ ID NO: 7540947 - DNA, 19 bp, Homo sapiens
ttttctcagcttctagcgg

SEQ ID NO: 7540948 - DNA, 22 bp, Homo sapiens
ttttctcttgttaatgtactga

SEQ ID NO: 7540949 - DNA, 19 bp, Homo sapiens
ttttctcagcttctagcgg

SEQ ID NO: 7540950 - DNA, 22 bp, Homo sapiens
ttttctcttgttaatgtactga

SEQ ID NO: 7540951 - DNA, 22 bp, Homo sapiens
ttttctcttgttaatgtactga

SEQ ID NO: 7540952 - DNA, 22 bp, Homo sapiens
ttttctcttgttaatgtactga

SEQ ID NO: 7540953 - DNA, 22 bp, Homo sapiens
ttttctcttgttaatgtactga

SEQ ID NO: 7540954 - DNA, 22 bp, Homo sapiens
ttttctcttgttaatgtactga

SEQ ID NO: 7540955 - DNA, 22 bp, Homo sapiens
ttttctgaagtttaagacattt

SEQ ID NO: 7540956 - DNA, 22 bp, Homo sapiens
ttttctgaagtttaagacattt

SEQ ID NO: 7540957 - DNA, 22 bp, Homo sapiens
ttttctcttgttaatgtactga

SEQ ID NO: 7540958 - DNA, 22 bp, Homo sapiens
ttttctcttgttaatgtactga

SEQ ID NO: 7540959 - DNA, 22 bp, Homo sapiens
ttttctcttgttaatgtactga

SEQ ID NO: 7540960 - DNA, 22 bp, Homo sapiens
ttttctgaagtttaagacattt

SEQ ID NO: 7540961 - DNA, 22 bp, Homo sapiens
ttttctgacctatctacattta

SEQ ID NO: 7540962 - DNA, 22 bp, Homo sapiens
ttttctgaagtttaagacattt

SEQ ID NO: 7540963 - DNA, 22 bp, Homo sapiens
ttttctgaagtttaagacattt

SEQ ID NO: 7540964 - DNA, 22 bp, Homo sapiens
ttttctgaagtttaagacattt

SEQ ID NO: 7540965 - DNA, 22 bp, Homo sapiens
ttttctgaagtttaagacattt

SEQ ID NO: 7540966 - DNA, 22 bp, Homo sapiens
ttttccaaattagaagtagaga

SEQ ID NO: 7540967 - DNA, 22 bp, Homo sapiens
ttttccaaagtaccatgtccct

SEQ ID NO: 7540968 - DNA, 19 bp, Homo sapiens
ttttccacagaaatatgtt

SEQ ID NO: 7540969 - DNA, 19 bp, Homo sapiens
ttttccacagaaatatgtt

SEQ ID NO: 7540970 - DNA, 22 bp, Homo sapiens
ttttccaaattagaagtagaga

SEQ ID NO: 7540971 - DNA, 22 bp, Homo sapiens
ttttccaaattagaagtagaga

SEQ ID NO: 7540972 - DNA, 22 bp, Homo sapiens
ttttcatttttgtagatgcaag

SEQ ID NO: 7540973 - DNA, 22 bp, Homo sapiens
ttttctattcattgtctatggt

SEQ ID NO: 7540974 - DNA, 22 bp, Homo sapiens
ttttctattcattgtctatggt

SEQ ID NO: 7540975 - DNA, 22 bp, Homo sapiens
ttttctattcattgtctatggt

SEQ ID NO: 7540976 - DNA, 22 bp, Homo sapiens
ttttctattcattgtctatggt

SEQ ID NO: 7540977 - DNA, 22 bp, Homo sapiens
ttttccaccttctagagattgt

SEQ ID NO: 7540978 - DNA, 22 bp, Homo sapiens
ttttccaccttctagagattgt

SEQ ID NO: 7540979 - DNA, 22 bp, Homo sapiens
ttttccacctggttccagggct

SEQ ID NO: 7540980 - DNA, 22 bp, Homo sapiens
ttttccacagcaccataagatt

SEQ ID NO: 7540981 - DNA, 22 bp, Homo sapiens
ttttccacagcaccataagatt

SEQ ID NO: 7540982 - DNA, 22 bp, Homo sapiens
ttttcattgttcctcgagcatt

SEQ ID NO: 7540983 - DNA, 22 bp, Homo sapiens
ttttcatttacattagggaaga

SEQ ID NO: 7540984 - DNA, 22 bp, Homo sapiens
ttttcatttacattagggaaga

SEQ ID NO: 7540985 - DNA, 22 bp, Homo sapiens
ttttcatttacattagggaaga

SEQ ID NO: 7540986 - DNA, 22 bp, Homo sapiens
ttttcatttacattagggaaga

SEQ ID NO: 7540987 - DNA, 22 bp, Homo sapiens
ttttcatttacattagggaaga

SEQ ID NO: 7540988 - DNA, 22 bp, Homo sapiens
ttttcatttacattagggaaga

SEQ ID NO: 7540989 - DNA, 22 bp, Homo sapiens
ttttcatttacattagggaaga

SEQ ID NO: 7540990 - DNA, 22 bp, Homo sapiens
ttttcatttttgtagatgcaag

SEQ ID NO: 7540991 - DNA, 22 bp, Homo sapiens
ttttcatttttgtagatgcaag

SEQ ID NO: 7540992 - DNA, 22 bp, Homo sapiens
ttttcatttttgtagatgcaag

SEQ ID NO: 7540993 - DNA, 22 bp, Homo sapiens
ttttcatttttgtagatgcaag

SEQ ID NO: 7540994 - DNA, 22 bp, Homo sapiens
ttttcatttttgtagatgcaag

SEQ ID NO: 7540995 - DNA, 22 bp, Homo sapiens
ttttcatttttgtagatgcaag

SEQ ID NO: 7540996 - DNA, 22 bp, Homo sapiens
ttttcatttttgtagatgcaag

SEQ ID NO: 7540997 - DNA, 22 bp, Homo sapiens
ttttcatttttgtagatgcaag

SEQ ID NO: 7540998 - DNA, 22 bp, Homo sapiens
ttttcatttttgtagatgcaag

SEQ ID NO: 7540999 - DNA, 22 bp, Homo sapiens
ttttctgacctatctacattta

SEQ ID NO: 7541000 - DNA, 22 bp, Homo sapiens
ttttctgactctattgaggtat

SEQ ID NO: 7541001 - DNA, 22 bp, Homo sapiens
ttttctgcctgcgtgtttagga

SEQ ID NO: 7541002 - DNA, 22 bp, Homo sapiens
ttttctgcctgcgtgtttagga

SEQ ID NO: 7541003 - DNA, 22 bp, Homo sapiens
ttttctgagctcagtgacttac

SEQ ID NO: 7541004 - DNA, 22 bp, Homo sapiens
ttttctgcctgcgtgtttagga

SEQ ID NO: 7541005 - DNA, 21 bp, Homo sapiens
ttttctggagtatgtctcctc

SEQ ID NO: 7541006 - DNA, 22 bp, Homo sapiens
ttttctgcggtgtgaatggcct

SEQ ID NO: 7541007 - DNA, 22 bp, Homo sapiens
ttttctgtaagaggactttaat

SEQ ID NO: 7541008 - DNA, 22 bp, Homo sapiens
ttttctgtaagaggactttaat

SEQ ID NO: 7541009 - DNA, 22 bp, Homo sapiens
ttttctgtaagaggactttaat

SEQ ID NO: 7541010 - DNA, 22 bp, Homo sapiens
ttttctgtaagaggactttaat

SEQ ID NO: 7541011 - DNA, 22 bp, Homo sapiens
ttttctgtaagaggactttaat

SEQ ID NO: 7541012 - DNA, 22 bp, Homo sapiens
ttttctgtattattgtgcttca

SEQ ID NO: 7541013 - DNA, 22 bp, Homo sapiens
ttttctgtattattgtgcttca

SEQ ID NO: 7541014 - DNA, 22 bp, Homo sapiens
ttttctgtattattgtgcttca

SEQ ID NO: 7541015 - DNA, 22 bp, Homo sapiens
ttttctgtattattgtgcttca

SEQ ID NO: 7541016 - DNA, 22 bp, Homo sapiens
ttttctgtgtatccaggcttcc

SEQ ID NO: 7541017 - DNA, 22 bp, Homo sapiens
ttttctgtttgcttcaagacat

SEQ ID NO: 7541018 - DNA, 22 bp, Homo sapiens
ttttctgttacaaagtacagcg

SEQ ID NO: 7541019 - DNA, 22 bp, Homo sapiens
ttttctgttacaaagtacagcg

SEQ ID NO: 7541020 - DNA, 22 bp, Homo sapiens
ttttctgttacaaagtacagcg

SEQ ID NO: 7541021 - DNA, 22 bp, Homo sapiens
ttttctgtgtatccaggcttcc

SEQ ID NO: 7541022 - DNA, 22 bp, Homo sapiens
ttttctgtgtgtccctcgacag

SEQ ID NO: 7541023 - DNA, 22 bp, Homo sapiens
ttttctgttacaaagtacagcg

SEQ ID NO: 7541024 - DNA, 22 bp, Homo sapiens
ttttctgtgtgtccctcgacag

SEQ ID NO: 7541025 - DNA, 22 bp, Homo sapiens
ttttctgtggtcagagcttgag

SEQ ID NO: 7541026 - DNA, 22 bp, Homo sapiens
ttttctgtgccctgctagctgg

SEQ ID NO: 7541027 - DNA, 22 bp, Homo sapiens
ttttctgtgccctgctagctgg

SEQ ID NO: 7541028 - DNA, 20 bp, Homo sapiens
ttttctgtgccaagaaaact

SEQ ID NO: 7541029 - DNA, 20 bp, Homo sapiens
ttttctgtgccaagaaaact

SEQ ID NO: 7541030 - DNA, 20 bp, Homo sapiens
ttttctgtgccaagaaaact

SEQ ID NO: 7541031 - DNA, 22 bp, Homo sapiens
ttttctgtgattctgaggttgg

SEQ ID NO: 7541032 - DNA, 22 bp, Homo sapiens
ttttctgtgattctgaggttgg

SEQ ID NO: 7541033 - DNA, 22 bp, Homo sapiens
ttttcttatggtgaagcacaaa

SEQ ID NO: 7541034 - DNA, 22 bp, Homo sapiens
ttttcttatggtgaagcacaaa

SEQ ID NO: 7541035 - DNA, 22 bp, Homo sapiens
ttttcttatggtgaagcacaaa

SEQ ID NO: 7541036 - DNA, 22 bp, Homo sapiens
ttttcttatggtgaagcacaaa

SEQ ID NO: 7541037 - DNA, 22 bp, Homo sapiens
ttttcttatggtgaagcacaaa

SEQ ID NO: 7541038 - DNA, 22 bp, Homo sapiens
ttttcttatggtgaagcacaaa

SEQ ID NO: 7541039 - DNA, 22 bp, Homo sapiens
ttttcttatggtgaagcacaaa

SEQ ID NO: 7541040 - DNA, 22 bp, Homo sapiens
ttttcttatggtgaagcacaaa

SEQ ID NO: 7541041 - DNA, 22 bp, Homo sapiens
ttttcttatggtgaagcacaaa

SEQ ID NO: 7541042 - DNA, 22 bp, Homo sapiens
ttttcttatagagcttaaagtt

SEQ ID NO: 7541043 - DNA, 22 bp, Homo sapiens
ttttcttatagagcttaaagtt

SEQ ID NO: 7541044 - DNA, 22 bp, Homo sapiens
ttttcttatagagcttaaagtt

SEQ ID NO: 7541045 - DNA, 22 bp, Homo sapiens
ttttcttatagagcttaaagtt

SEQ ID NO: 7541046 - DNA, 22 bp, Homo sapiens
ttttcttatggtgaagcacaaa

SEQ ID NO: 7541047 - DNA, 22 bp, Homo sapiens
ttttcttatggtgaagcacaaa

SEQ ID NO: 7541048 - DNA, 22 bp, Homo sapiens
ttttcttatggtgaagcacaaa

SEQ ID NO: 7541049 - DNA, 22 bp, Homo sapiens
ttttcttatgtgcagctatatg

SEQ ID NO: 7541050 - DNA, 22 bp, Homo sapiens
ttttcttatgtgcagctatatg

SEQ ID NO: 7541051 - DNA, 22 bp, Homo sapiens
ttttcttatggtgaagcacaaa

SEQ ID NO: 7541052 - DNA, 22 bp, Homo sapiens
ttttcttatgtgcagctatatg

SEQ ID NO: 7541053 - DNA, 22 bp, Homo sapiens
ttttcttatgtgcagctatatg

SEQ ID NO: 7541054 - DNA, 22 bp, Homo sapiens
ttttcttatgtgcagctatatg

SEQ ID NO: 7541055 - DNA, 22 bp, Homo sapiens
ttttcttatgtgcagctatatg

SEQ ID NO: 7541056 - DNA, 22 bp, Homo sapiens
ttttcttatgtgcagctatatg

SEQ ID NO: 7541057 - DNA, 22 bp, Homo sapiens
ttttcttatgtgcagctatatg

SEQ ID NO: 7541058 - DNA, 22 bp, Homo sapiens
ttttcttatgtgcagctatatg

SEQ ID NO: 7541059 - DNA, 22 bp, Homo sapiens
ttttcttaggtgctccaagtag

SEQ ID NO: 7541060 - DNA, 22 bp, Homo sapiens
ttttcttaggtgctccaagtag

SEQ ID NO: 7541061 - DNA, 22 bp, Homo sapiens
ttttcttaggtgctccaagtag

SEQ ID NO: 7541062 - DNA, 22 bp, Homo sapiens
ttttcttaggtgctccaagtag

SEQ ID NO: 7541063 - DNA, 22 bp, Homo sapiens
ttttcttaggtgctccaagtag

SEQ ID NO: 7541064 - DNA, 22 bp, Homo sapiens
ttttcttaggtgctccaagtag

SEQ ID NO: 7541065 - DNA, 22 bp, Homo sapiens
ttttcttaggtgctccaagtag

SEQ ID NO: 7541066 - DNA, 22 bp, Homo sapiens
ttttcttatagagcttaaagtt

SEQ ID NO: 7541067 - DNA, 22 bp, Homo sapiens
ttttcttatagagcttaaagtt

SEQ ID NO: 7541068 - DNA, 22 bp, Homo sapiens
ttttcttatagagcttaaagtt

SEQ ID NO: 7541069 - DNA, 22 bp, Homo sapiens
ttttcttaggtgctccaagtag

SEQ ID NO: 7541070 - DNA, 22 bp, Homo sapiens
ttttcttatagagcttaaagtt

SEQ ID NO: 7541071 - DNA, 22 bp, Homo sapiens
ttttcttatagagcttaaagtt

SEQ ID NO: 7541072 - DNA, 22 bp, Homo sapiens
ttttcttatagagcttaaagtt

SEQ ID NO: 7541073 - DNA, 22 bp, Homo sapiens
ttttcttatagagcttaaagtt

SEQ ID NO: 7541074 - DNA, 22 bp, Homo sapiens
ttttcttactgtctgtgatcct

SEQ ID NO: 7541075 - DNA, 22 bp, Homo sapiens
ttttcttactgtctgtgatcct

SEQ ID NO: 7541076 - DNA, 22 bp, Homo sapiens
ttttcttactgtctgtgatcct

SEQ ID NO: 7541077 - DNA, 22 bp, Homo sapiens
ttttcttactgtctgtgatcct

SEQ ID NO: 7541078 - DNA, 22 bp, Homo sapiens
ttttctgtttgcttcaagacat

SEQ ID NO: 7541079 - DNA, 22 bp, Homo sapiens
ttttctgtttgcttcaagacat

SEQ ID NO: 7541080 - DNA, 22 bp, Homo sapiens
ttttcttactgtctgtgatcct

SEQ ID NO: 7541081 - DNA, 22 bp, Homo sapiens
ttttcttactgtctgtgatcct

SEQ ID NO: 7541082 - DNA, 22 bp, Homo sapiens
ttttcttactgtctgtgatcct

SEQ ID NO: 7541083 - DNA, 22 bp, Homo sapiens
ttttcttactgtctgtgatcct

SEQ ID NO: 7541084 - DNA, 22 bp, Homo sapiens
ttttcttactgtctgtgatcct

SEQ ID NO: 7541085 - DNA, 22 bp, Homo sapiens
ttttcttactgtctgtgatcct

SEQ ID NO: 7541086 - DNA, 22 bp, Homo sapiens
tttgtaaatagcagtactcatg

SEQ ID NO: 7541087 - DNA, 22 bp, Homo sapiens
tttgtaaatagcagtactcatg

SEQ ID NO: 7541088 - DNA, 22 bp, Homo sapiens
tttgtaaatagcagtactcatg

SEQ ID NO: 7541089 - DNA, 22 bp, Homo sapiens
tttgtaaatagcagtactcatg

SEQ ID NO: 7541090 - DNA, 22 bp, Homo sapiens
tttgtaaatagcagtactcatg

SEQ ID NO: 7541091 - DNA, 22 bp, Homo sapiens
tttgtaaatagcagtactcatg

SEQ ID NO: 7541092 - DNA, 22 bp, Homo sapiens
tttgtaaatagcagtactcatg

SEQ ID NO: 7541093 - DNA, 22 bp, Homo sapiens
tttgtaaatagcagtactcatg

SEQ ID NO: 7541094 - DNA, 22 bp, Homo sapiens
tttgtaacatcccaacaaattt

SEQ ID NO: 7541095 - DNA, 22 bp, Homo sapiens
tttgtaacatcccaacaaattt

SEQ ID NO: 7541096 - DNA, 22 bp, Homo sapiens
tttgtaaatagcagtactcatg

SEQ ID NO: 7541097 - DNA, 22 bp, Homo sapiens
tttgtaaatagcagtactcatg

SEQ ID NO: 7541098 - DNA, 22 bp, Homo sapiens
tttgtaaatagcagtactcatg

SEQ ID NO: 7541099 - DNA, 22 bp, Homo sapiens
tttgtaaagtctgttctgagtt

SEQ ID NO: 7541100 - DNA, 22 bp, Homo sapiens
tttgtaaagtctgttctgagtt

SEQ ID NO: 7541101 - DNA, 22 bp, Homo sapiens
tttgtaaaggcctgaatttcag

SEQ ID NO: 7541102 - DNA, 22 bp, Homo sapiens
tttgtaaaggcctgaatttcag

SEQ ID NO: 7541103 - DNA, 22 bp, Homo sapiens
tttgtaaatagcagtactcatg

SEQ ID NO: 7541104 - DNA, 22 bp, Homo sapiens
tttgtaaagtctgttctgagtt

SEQ ID NO: 7541105 - DNA, 22 bp, Homo sapiens
tttgtaaaaggaggaagcatgg

SEQ ID NO: 7541106 - DNA, 22 bp, Homo sapiens
tttgtaaaaggaggaagcatgg

SEQ ID NO: 7541107 - DNA, 22 bp, Homo sapiens
tttgtaaaaggaggaagcatgg

SEQ ID NO: 7541108 - DNA, 22 bp, Homo sapiens
tttgtaaaaggaggaagcatgg

SEQ ID NO: 7541109 - DNA, 22 bp, Homo sapiens
tttgtaaaaggaggaagcatgg

SEQ ID NO: 7541110 - DNA, 22 bp, Homo sapiens
tttgtaaaaggaggaagcatgg

SEQ ID NO: 7541111 - DNA, 22 bp, Homo sapiens
tttgtaaaaggaggaagcatgg

SEQ ID NO: 7541112 - DNA, 22 bp, Homo sapiens
tttgtaaaggcctgaatttcag

SEQ ID NO: 7541113 - DNA, 22 bp, Homo sapiens
tttgtaaaggcctgaatttcag

SEQ ID NO: 7541114 - DNA, 22 bp, Homo sapiens
tttgtaaaggcctgaatttcag

SEQ ID NO: 7541115 - DNA, 22 bp, Homo sapiens
tttgtaaaggcctgaatttcag

SEQ ID NO: 7541116 - DNA, 22 bp, Homo sapiens
tttgtaaaattagggaattcaa

SEQ ID NO: 7541117 - DNA, 22 bp, Homo sapiens
tttgtaaaattagggaattcaa

SEQ ID NO: 7541118 - DNA, 22 bp, Homo sapiens
tttgtaaaattagggaattcaa

SEQ ID NO: 7541119 - DNA, 22 bp, Homo sapiens
tttgtaaaaggaggaagcatgg

SEQ ID NO: 7541120 - DNA, 22 bp, Homo sapiens
tttgtgtggcgttggccggcgg

SEQ ID NO: 7541121 - DNA, 22 bp, Homo sapiens
tttgtgtgggggaaacaaggta

SEQ ID NO: 7541122 - DNA, 22 bp, Homo sapiens
tttgtgtggtggatactgggta

SEQ ID NO: 7541123 - DNA, 22 bp, Homo sapiens
tttgtgtggatggaaggcagta

SEQ ID NO: 7541124 - DNA, 22 bp, Homo sapiens
tttgtgtgcttggtattgaaga

SEQ ID NO: 7541125 - DNA, 22 bp, Homo sapiens
tttgtgtgcttggtattgaaga

SEQ ID NO: 7541126 - DNA, 22 bp, Homo sapiens
tttgtgtgcttggtattgaaga

SEQ ID NO: 7541127 - DNA, 22 bp, Homo sapiens
tttgtgtgtatatgtatataga

SEQ ID NO: 7541128 - DNA, 22 bp, Homo sapiens
tttgtgtgtatatgtatataga

SEQ ID NO: 7541129 - DNA, 22 bp, Homo sapiens
tttgtgtgtgtataggaaagga

SEQ ID NO: 7541130 - DNA, 22 bp, Homo sapiens
tttgtgttaaatgttaaattca

SEQ ID NO: 7541131 - DNA, 21 bp, Homo sapiens
tttgtgtgtcacgtgcacagg

SEQ ID NO: 7541132 - DNA, 22 bp, Homo sapiens
tttgtaagcaagttaacatttt

SEQ ID NO: 7541133 - DNA, 22 bp, Homo sapiens
tttgtaagcaagttaacatttt

SEQ ID NO: 7541134 - DNA, 22 bp, Homo sapiens
tttgtaactttagaattgatcc

SEQ ID NO: 7541135 - DNA, 22 bp, Homo sapiens
tttgtaactttagaattgatcc

SEQ ID NO: 7541136 - DNA, 22 bp, Homo sapiens
tttgtaactctccctttgtata

SEQ ID NO: 7541137 - DNA, 22 bp, Homo sapiens
tttgtaacattatggactgctt

SEQ ID NO: 7541138 - DNA, 22 bp, Homo sapiens
tttgtgtcgtcactgtcttctc

SEQ ID NO: 7541139 - DNA, 19 bp, Homo sapiens
tttgtaagtccttactgat

SEQ ID NO: 7541140 - DNA, 22 bp, Homo sapiens
tttgtaaggctaaataatattc

SEQ ID NO: 7541141 - DNA, 22 bp, Homo sapiens
tttgttataacaataaaaagtc

SEQ ID NO: 7541142 - DNA, 22 bp, Homo sapiens
tttgttataacaataaaaagtc

SEQ ID NO: 7541143 - DNA, 22 bp, Homo sapiens
tttgttcaaaaattataagata

SEQ ID NO: 7541144 - DNA, 22 bp, Homo sapiens
tttgttcaaaaattataagata

SEQ ID NO: 7541145 - DNA, 22 bp, Homo sapiens
tttgttataacaataaaaagtc

SEQ ID NO: 7541146 - DNA, 22 bp, Homo sapiens
tttgttataacaataaaaagtc

SEQ ID NO: 7541147 - DNA, 22 bp, Homo sapiens
tttgttcaaaaattataagata

SEQ ID NO: 7541148 - DNA, 22 bp, Homo sapiens
tttgttcaaacagaccctttgt

SEQ ID NO: 7541149 - DNA, 22 bp, Homo sapiens
tttgttcaaaaattataagata

SEQ ID NO: 7541150 - DNA, 22 bp, Homo sapiens
tttgttcaacatcacttccacc

SEQ ID NO: 7541151 - DNA, 22 bp, Homo sapiens
tttgttcaacatcacttccacc

SEQ ID NO: 7541152 - DNA, 22 bp, Homo sapiens
tttgttcaaggaatagtaaatg

SEQ ID NO: 7541153 - DNA, 22 bp, Homo sapiens
tttgttcaaggaatagtaaatg

SEQ ID NO: 7541154 - DNA, 22 bp, Homo sapiens
tttgttcaaggaatagtaaatg

SEQ ID NO: 7541155 - DNA, 22 bp, Homo sapiens
tttgttcaaggaatagtaaatg

SEQ ID NO: 7541156 - DNA, 22 bp, Homo sapiens
tttgttcaaattttcctatctg

SEQ ID NO: 7541157 - DNA, 22 bp, Homo sapiens
tttgttcaacaggtgaaataga

SEQ ID NO: 7541158 - DNA, 22 bp, Homo sapiens
tttgttcaacaggtgaaataga

SEQ ID NO: 7541159 - DNA, 22 bp, Homo sapiens
tttgttcaacaggtgaaataga

SEQ ID NO: 7541160 - DNA, 22 bp, Homo sapiens
tttgttcaacaggtgaaataga

SEQ ID NO: 7541161 - DNA, 22 bp, Homo sapiens
tttgttcaacaggtgaaataga

SEQ ID NO: 7541162 - DNA, 22 bp, Homo sapiens
tttgttaattcttatgttagag

SEQ ID NO: 7541163 - DNA, 22 bp, Homo sapiens
tttgttaattcttatgttagag

SEQ ID NO: 7541164 - DNA, 22 bp, Homo sapiens
tttgttacaaagaaagaagagc

SEQ ID NO: 7541165 - DNA, 22 bp, Homo sapiens
tttgttacattaaaaagtaggt

SEQ ID NO: 7541166 - DNA, 22 bp, Homo sapiens
tttgttacattaaaaagtaggt

SEQ ID NO: 7541167 - DNA, 22 bp, Homo sapiens
tttgttactatagcatagagtg

SEQ ID NO: 7541168 - DNA, 22 bp, Homo sapiens
tttgttacaaagaaagaagagc

SEQ ID NO: 7541169 - DNA, 22 bp, Homo sapiens
tttgttaaggagtattgcttct

SEQ ID NO: 7541170 - DNA, 22 bp, Homo sapiens
tttgttaaggagtattgcttct

SEQ ID NO: 7541171 - DNA, 22 bp, Homo sapiens
tttgttaaggagtattgcttct

SEQ ID NO: 7541172 - DNA, 22 bp, Homo sapiens
tttgttaaggagtattgcttct

SEQ ID NO: 7541173 - DNA, 22 bp, Homo sapiens
tttgttaaggagtattgcttct

SEQ ID NO: 7541174 - DNA, 22 bp, Homo sapiens
tttgttaagatgctgttctgct

SEQ ID NO: 7541175 - DNA, 22 bp, Homo sapiens
tttgttaagatgctgttctgct

SEQ ID NO: 7541176 - DNA, 22 bp, Homo sapiens
tttgttaaatatttattgagtg

SEQ ID NO: 7541177 - DNA, 22 bp, Homo sapiens
tttgttaagatgctgttctgct

SEQ ID NO: 7541178 - DNA, 22 bp, Homo sapiens
tttgttaaggagtattgcttct

SEQ ID NO: 7541179 - DNA, 22 bp, Homo sapiens
tttgtgttttcactagcagtgt

SEQ ID NO: 7541180 - DNA, 22 bp, Homo sapiens
tttgtgttttcccatactattg

SEQ ID NO: 7541181 - DNA, 22 bp, Homo sapiens
tttgtgttttcccatactattg

SEQ ID NO: 7541182 - DNA, 22 bp, Homo sapiens
tttgtgttttcccatactattg

SEQ ID NO: 7541183 - DNA, 22 bp, Homo sapiens
tttgttaaaatgcagattctgt

SEQ ID NO: 7541184 - DNA, 22 bp, Homo sapiens
tttgttaaaatgcagattctgt

SEQ ID NO: 7541185 - DNA, 22 bp, Homo sapiens
tttgtgttttagctggtgaggc

SEQ ID NO: 7541186 - DNA, 22 bp, Homo sapiens
tttgtgttttcactagcagtgt

SEQ ID NO: 7541187 - DNA, 22 bp, Homo sapiens
tttgtgttttagctggtgaggc

SEQ ID NO: 7541188 - DNA, 22 bp, Homo sapiens
tttgtgttttagctggtgaggc

SEQ ID NO: 7541189 - DNA, 22 bp, Homo sapiens
tttgttaaaatgcagattctgt

SEQ ID NO: 7541190 - DNA, 22 bp, Homo sapiens
tttgttaaaatgcagattctgt

SEQ ID NO: 7541191 - DNA, 22 bp, Homo sapiens
tttgttaaaatgcagattctgt

SEQ ID NO: 7541192 - DNA, 22 bp, Homo sapiens
tttgttaaaatgcagattctgt

SEQ ID NO: 7541193 - DNA, 22 bp, Homo sapiens
tttgttaaaatgcagattctgt

SEQ ID NO: 7541194 - DNA, 22 bp, Homo sapiens
tttgttaaaatgcagattctgt

SEQ ID NO: 7541195 - DNA, 22 bp, Homo sapiens
tttgttaaaatgcagattctgt

SEQ ID NO: 7541196 - DNA, 22 bp, Homo sapiens
tttgttaaatatttattgagtg

SEQ ID NO: 7541197 - DNA, 22 bp, Homo sapiens
tttgttaaaatgcagattctgt

SEQ ID NO: 7541198 - DNA, 22 bp, Homo sapiens
tttgtgttggaagaaatgctac

SEQ ID NO: 7541199 - DNA, 22 bp, Homo sapiens
tttgtgttggaagaaatgctac

SEQ ID NO: 7541200 - DNA, 22 bp, Homo sapiens
tttgtgttggaagaaatgctac

SEQ ID NO: 7541201 - DNA, 22 bp, Homo sapiens
tttgtgttgtacttctgtgcat

SEQ ID NO: 7541202 - DNA, 22 bp, Homo sapiens
tttgtgttgtacttctgtgcat

SEQ ID NO: 7541203 - DNA, 22 bp, Homo sapiens
tttgtgttaaatgttaaattca

SEQ ID NO: 7541204 - DNA, 22 bp, Homo sapiens
tttgtgttaaatgttaaattca

SEQ ID NO: 7541205 - DNA, 22 bp, Homo sapiens
tttgtgttaaatgttaaattca

SEQ ID NO: 7541206 - DNA, 22 bp, Homo sapiens
tttgtgttggaagaaatgctac

SEQ ID NO: 7541207 - DNA, 22 bp, Homo sapiens
tttgtgtttaatacaaggacct

SEQ ID NO: 7541208 - DNA, 22 bp, Homo sapiens
tttgtgtttatgaagttattct

SEQ ID NO: 7541209 - DNA, 22 bp, Homo sapiens
tttgtgttgttttaagccacta

SEQ ID NO: 7541210 - DNA, 22 bp, Homo sapiens
tttgtgtttgtacaatgcacta

SEQ ID NO: 7541211 - DNA, 22 bp, Homo sapiens
tttgtgtttgtacaatgcacta

SEQ ID NO: 7541212 - DNA, 22 bp, Homo sapiens
tttgtgtttatgaagttattct

SEQ ID NO: 7541213 - DNA, 22 bp, Homo sapiens
ttttaatcatgcttctatgtcc

SEQ ID NO: 7541214 - DNA, 22 bp, Homo sapiens
ttttaatcatgcttctatgtcc

SEQ ID NO: 7541215 - DNA, 22 bp, Homo sapiens
ttttaatcatgcttctatgtcc

SEQ ID NO: 7541216 - DNA, 22 bp, Homo sapiens
ttttaatcatgcttctatgtcc

SEQ ID NO: 7541217 - DNA, 22 bp, Homo sapiens
ttttaatactgctattgtagga

SEQ ID NO: 7541218 - DNA, 22 bp, Homo sapiens
ttttaagaaatgtatgactgtc

SEQ ID NO: 7541219 - DNA, 22 bp, Homo sapiens
ttttaagaaatgtatgactgtc

SEQ ID NO: 7541220 - DNA, 22 bp, Homo sapiens
ttttaagaaatgtatgactgtc

SEQ ID NO: 7541221 - DNA, 22 bp, Homo sapiens
ttttaagaaatgtatgactgtc

SEQ ID NO: 7541222 - DNA, 22 bp, Homo sapiens
ttttaatcctcttggtatctta

SEQ ID NO: 7541223 - DNA, 22 bp, Homo sapiens
ttttaatcctcttggtatctta

SEQ ID NO: 7541224 - DNA, 22 bp, Homo sapiens
ttttaatcctcttggtatctta

SEQ ID NO: 7541225 - DNA, 22 bp, Homo sapiens
ttttaatccatctggtaaacct

SEQ ID NO: 7541226 - DNA, 22 bp, Homo sapiens
ttttaatgggcgactattatgg

SEQ ID NO: 7541227 - DNA, 22 bp, Homo sapiens
ttttaatgggcgactattatgg

SEQ ID NO: 7541228 - DNA, 22 bp, Homo sapiens
ttttaatgggcgactattatgg

SEQ ID NO: 7541229 - DNA, 22 bp, Homo sapiens
ttttaatgggcgactattatgg

SEQ ID NO: 7541230 - DNA, 22 bp, Homo sapiens
ttttaatgggcgactattatgg

SEQ ID NO: 7541231 - DNA, 22 bp, Homo sapiens
ttttaatgggcgactattatgg

SEQ ID NO: 7541232 - DNA, 22 bp, Homo sapiens
ttttaatgtgctctgcaatgat

SEQ ID NO: 7541233 - DNA, 22 bp, Homo sapiens
ttttaatgtgctctgcaatgat

SEQ ID NO: 7541234 - DNA, 22 bp, Homo sapiens
ttttaatgggcgactattatgg

SEQ ID NO: 7541235 - DNA, 22 bp, Homo sapiens
ttttaatgtgctctgcaatgat

SEQ ID NO: 7541236 - DNA, 22 bp, Homo sapiens
ttttaatgtgctctgcaatgat

SEQ ID NO: 7541237 - DNA, 22 bp, Homo sapiens
ttttaatgtgctctgcaatgat

SEQ ID NO: 7541238 - DNA, 22 bp, Homo sapiens
ttttaatgtgctctgcaatgat

SEQ ID NO: 7541239 - DNA, 22 bp, Homo sapiens
ttttaatgtgctctgcaatgat

SEQ ID NO: 7541240 - DNA, 22 bp, Homo sapiens
ttttaattcaaagtgaatagtg

SEQ ID NO: 7541241 - DNA, 22 bp, Homo sapiens
ttttaattcaaagtgaatagtg

SEQ ID NO: 7541242 - DNA, 22 bp, Homo sapiens
ttttaatgtgctctgcaatgat

SEQ ID NO: 7541243 - DNA, 22 bp, Homo sapiens
ttttaattcaaagtgaatagtg

SEQ ID NO: 7541244 - DNA, 22 bp, Homo sapiens
ttttaattcaaagtgaatagtg

SEQ ID NO: 7541245 - DNA, 22 bp, Homo sapiens
ttttaattcaaagtgaatagtg

SEQ ID NO: 7541246 - DNA, 22 bp, Homo sapiens
ttttaattcaaagtgaatagtg

SEQ ID NO: 7541247 - DNA, 22 bp, Homo sapiens
ttttaattcaaagtgaatagtg

SEQ ID NO: 7541248 - DNA, 22 bp, Homo sapiens
ttttaattcaaagtgaatagtg

SEQ ID NO: 7541249 - DNA, 22 bp, Homo sapiens
ttttaattcaaagtgaatagtg

SEQ ID NO: 7541250 - DNA, 22 bp, Homo sapiens
ttttaattgcaattatggtccc

SEQ ID NO: 7541251 - DNA, 22 bp, Homo sapiens
ttttaattgcaattatggtccc

SEQ ID NO: 7541252 - DNA, 22 bp, Homo sapiens
ttttaattcaaagtgaatagtg

SEQ ID NO: 7541253 - DNA, 22 bp, Homo sapiens
ttttaattcaaagtgaatagtg

SEQ ID NO: 7541254 - DNA, 22 bp, Homo sapiens
ttttatgtaatccttactgtcg

SEQ ID NO: 7541255 - DNA, 22 bp, Homo sapiens
ttttatgtaatccttactgtcg

SEQ ID NO: 7541256 - DNA, 22 bp, Homo sapiens
ttttatgtaatccttactgtcg

SEQ ID NO: 7541257 - DNA, 22 bp, Homo sapiens
ttttatgtaataaactgtacac

SEQ ID NO: 7541258 - DNA, 22 bp, Homo sapiens
ttttatgtaatccttactgtcg

SEQ ID NO: 7541259 - DNA, 22 bp, Homo sapiens
ttttatgtaatccttactgtcg

SEQ ID NO: 7541260 - DNA, 22 bp, Homo sapiens
ttttatgtaatccttactgtcg

SEQ ID NO: 7541261 - DNA, 22 bp, Homo sapiens
ttttatgtgtcaaagcagtggt

SEQ ID NO: 7541262 - DNA, 22 bp, Homo sapiens
ttttatgtgtcaaagcagtggt

SEQ ID NO: 7541263 - DNA, 22 bp, Homo sapiens
ttttatgtgtcaaagcagtggt

SEQ ID NO: 7541264 - DNA, 22 bp, Homo sapiens
ttttatgtgctggactggcagt

SEQ ID NO: 7541265 - DNA, 22 bp, Homo sapiens
ttttatgtgctggactggcagt

SEQ ID NO: 7541266 - DNA, 22 bp, Homo sapiens
ttttatgtgctggactggcagt

SEQ ID NO: 7541267 - DNA, 22 bp, Homo sapiens
ttttatgtgctggactggcagt

SEQ ID NO: 7541268 - DNA, 22 bp, Homo sapiens
ttttatgtcataaggacactca

SEQ ID NO: 7541269 - DNA, 22 bp, Homo sapiens
ttttatgtcataaggacactca

SEQ ID NO: 7541270 - DNA, 22 bp, Homo sapiens
ttttatgtcataaggacactca

SEQ ID NO: 7541271 - DNA, 23 bp, Homo sapiens
ttttaatttggacataagaagat

SEQ ID NO: 7541272 - DNA, 23 bp, Homo sapiens
ttttaatttggacataagaagat

SEQ ID NO: 7541273 - DNA, 23 bp, Homo sapiens
ttttaatttggacataagaagat

SEQ ID NO: 7541274 - DNA, 18 bp, Homo sapiens
ttttaatttcaggggtgg

SEQ ID NO: 7541275 - DNA, 18 bp, Homo sapiens
ttttaatttcaggggtgg

SEQ ID NO: 7541276 - DNA, 18 bp, Homo sapiens
ttttaatttcaggggtgg

SEQ ID NO: 7541277 - DNA, 22 bp, Homo sapiens
ttttaattgcaattatggtccc

SEQ ID NO: 7541278 - DNA, 22 bp, Homo sapiens
ttttaattgcaattatggtccc

SEQ ID NO: 7541279 - DNA, 22 bp, Homo sapiens
ttttaattgcaattatggtccc

SEQ ID NO: 7541280 - DNA, 22 bp, Homo sapiens
ttttatgattgagctggctaca

SEQ ID NO: 7541281 - DNA, 22 bp, Homo sapiens
ttttatgattgagctggctaca

SEQ ID NO: 7541282 - DNA, 23 bp, Homo sapiens
ttttaatttggacataagaagat

SEQ ID NO: 7541283 - DNA, 22 bp, Homo sapiens
ttttatgagtgtccctctgtgg

SEQ ID NO: 7541284 - DNA, 21 bp, Homo sapiens
ttttatgcataggaaatatat

SEQ ID NO: 7541285 - DNA, 21 bp, Homo sapiens
ttttatgcataggaaatatat

SEQ ID NO: 7541286 - DNA, 22 bp, Homo sapiens
ttttatgcaagttatgattaaa

SEQ ID NO: 7541287 - DNA, 21 bp, Homo sapiens
ttttatgcataggaaatatat

SEQ ID NO: 7541288 - DNA, 22 bp, Homo sapiens
ttttatgcaagttatgattaaa

SEQ ID NO: 7541289 - DNA, 22 bp, Homo sapiens
ttttatgcaagttatgattaaa

SEQ ID NO: 7541290 - DNA, 22 bp, Homo sapiens
ttttatgcaagttatgattaaa

SEQ ID NO: 7541291 - DNA, 22 bp, Homo sapiens
ttttaaatctccagttgacccc

SEQ ID NO: 7541292 - DNA, 22 bp, Homo sapiens
ttttaaatctccagttgacccc

SEQ ID NO: 7541293 - DNA, 22 bp, Homo sapiens
ttttaaatctccagttgacccc

SEQ ID NO: 7541294 - DNA, 22 bp, Homo sapiens
ttttaaatctccagttgacccc

SEQ ID NO: 7541295 - DNA, 22 bp, Homo sapiens
ttttaaatctccagttgacccc

SEQ ID NO: 7541296 - DNA, 22 bp, Homo sapiens
ttttaaatctccagttgacccc

SEQ ID NO: 7541297 - DNA, 22 bp, Homo sapiens
ttttaaatctccagttgacccc

SEQ ID NO: 7541298 - DNA, 22 bp, Homo sapiens
ttttaaatctccagttgacccc

SEQ ID NO: 7541299 - DNA, 22 bp, Homo sapiens
ttttaaatctccagttgacccc

SEQ ID NO: 7541300 - DNA, 22 bp, Homo sapiens
ttttaaaggctgtatgaccaag

SEQ ID NO: 7541301 - DNA, 22 bp, Homo sapiens
ttttaaaggctgtatgaccaag

SEQ ID NO: 7541302 - DNA, 22 bp, Homo sapiens
ttttaaaggctgtatgaccaag

SEQ ID NO: 7541303 - DNA, 22 bp, Homo sapiens
ttttaaaggctgtatgaccaag

SEQ ID NO: 7541304 - DNA, 22 bp, Homo sapiens
ttttaaaggctgtatgaccaag

SEQ ID NO: 7541305 - DNA, 22 bp, Homo sapiens
ttttaaaggctgtatgaccaag

SEQ ID NO: 7541306 - DNA, 22 bp, Homo sapiens
ttttaaatctccagttgacccc

SEQ ID NO: 7541307 - DNA, 22 bp, Homo sapiens
ttttaaatctccagttgacccc

SEQ ID NO: 7541308 - DNA, 22 bp, Homo sapiens
ttttaaatctccagttgacccc

SEQ ID NO: 7541309 - DNA, 22 bp, Homo sapiens
ttttaaaggctgtatgaccaag

SEQ ID NO: 7541310 - DNA, 22 bp, Homo sapiens
ttttaacactcagcactatctc

SEQ ID NO: 7541311 - DNA, 22 bp, Homo sapiens
ttttaacactcagcactatctc

SEQ ID NO: 7541312 - DNA, 22 bp, Homo sapiens
ttttaacactcagcactatctc

SEQ ID NO: 7541313 - DNA, 22 bp, Homo sapiens
ttttaacactcagcactatctc

SEQ ID NO: 7541314 - DNA, 21 bp, Homo sapiens
ttttaacaaggatttccctag

SEQ ID NO: 7541315 - DNA, 21 bp, Homo sapiens
ttttaacaaggatttccctag

SEQ ID NO: 7541316 - DNA, 22 bp, Homo sapiens
ttttaacactcagcactatctc

SEQ ID NO: 7541317 - DNA, 22 bp, Homo sapiens
ttttaacactcagcactatctc

SEQ ID NO: 7541318 - DNA, 21 bp, Homo sapiens
ttttaacaaggatttccctag

SEQ ID NO: 7541319 - DNA, 22 bp, Homo sapiens
ttttaagaaatgtatgactgtc

SEQ ID NO: 7541320 - DNA, 22 bp, Homo sapiens
ttttaagaaatgtatgactgtc

SEQ ID NO: 7541321 - DNA, 22 bp, Homo sapiens
ttttaagaaatgtatgactgtc

SEQ ID NO: 7541322 - DNA, 22 bp, Homo sapiens
ttttaacttaaaatacatagat

SEQ ID NO: 7541323 - DNA, 22 bp, Homo sapiens
ttttaagaaatgtatgactgtc

SEQ ID NO: 7541324 - DNA, 22 bp, Homo sapiens
ttttaagaaatgtatgactgtc

SEQ ID NO: 7541325 - DNA, 22 bp, Homo sapiens
ttttaacttaaaatacatagat

SEQ ID NO: 7541326 - DNA, 22 bp, Homo sapiens
ttttaacttaaaatacatagat

SEQ ID NO: 7541327 - DNA, 22 bp, Homo sapiens
ttttaacttaaaatacatagat

SEQ ID NO: 7541328 - DNA, 22 bp, Homo sapiens
ttttaacttaaaatacatagat

SEQ ID NO: 7541329 - DNA, 22 bp, Homo sapiens
ttttaaagagatgctgtgcata

SEQ ID NO: 7541330 - DNA, 22 bp, Homo sapiens
ttttaaagagatgctgtgcata

SEQ ID NO: 7541331 - DNA, 22 bp, Homo sapiens
ttttaaagagatgctgtgcata

SEQ ID NO: 7541332 - DNA, 22 bp, Homo sapiens
ttttaaagagatgctgtgcata

SEQ ID NO: 7541333 - DNA, 22 bp, Homo sapiens
ttttaaactgcagaatttagaa

SEQ ID NO: 7541334 - DNA, 22 bp, Homo sapiens
ttttaaactgcagaatttagaa

SEQ ID NO: 7541335 - DNA, 22 bp, Homo sapiens
ttttaaactgcagaatttagaa

SEQ ID NO: 7541336 - DNA, 22 bp, Homo sapiens
ttttaaactgcagaatttagaa

SEQ ID NO: 7541337 - DNA, 22 bp, Homo sapiens
ttttaaactgcagaatttagaa

SEQ ID NO: 7541338 - DNA, 22 bp, Homo sapiens
ttttaaactgcagaatttagaa

SEQ ID NO: 7541339 - DNA, 22 bp, Homo sapiens
ttttaaactgcagaatttagaa

SEQ ID NO: 7541340 - DNA, 22 bp, Homo sapiens
ttttaaactgcagaatttagaa

SEQ ID NO: 7541341 - DNA, 22 bp, Homo sapiens
ttttaaactgcagaatttagaa

SEQ ID NO: 7541342 - DNA, 22 bp, Homo sapiens
ttttaaactgcagaatttagaa

SEQ ID NO: 7541343 - DNA, 22 bp, Homo sapiens
tttgttcacagggttgttgtag

SEQ ID NO: 7541344 - DNA, 22 bp, Homo sapiens
tttgttcaatccagacaatagc

SEQ ID NO: 7541345 - DNA, 22 bp, Homo sapiens
tttgttcaatccagacaatagc

SEQ ID NO: 7541346 - DNA, 22 bp, Homo sapiens
tttgttcaatccagacaatagc

SEQ ID NO: 7541347 - DNA, 22 bp, Homo sapiens
tttgttcaatccagacaatagc

SEQ ID NO: 7541348 - DNA, 22 bp, Homo sapiens
tttgttcaatatgtgtttgtcc

SEQ ID NO: 7541349 - DNA, 22 bp, Homo sapiens
tttgttcaaggaatagtaaatg

SEQ ID NO: 7541350 - DNA, 22 bp, Homo sapiens
tttgttcaatatgtgtttgtcc

SEQ ID NO: 7541351 - DNA, 22 bp, Homo sapiens
ttttaaaggatactcttgtcta

SEQ ID NO: 7541352 - DNA, 22 bp, Homo sapiens
ttttaaaggatactcttgtcta

SEQ ID NO: 7541353 - DNA, 22 bp, Homo sapiens
ttttaaaggatactcttgtcta

SEQ ID NO: 7541354 - DNA, 22 bp, Homo sapiens
ttttaaaggatactcttgtcta

SEQ ID NO: 7541355 - DNA, 22 bp, Homo sapiens
ttttaaaggatactcttgtcta

SEQ ID NO: 7541356 - DNA, 22 bp, Homo sapiens
ttttaaaggatactcttgtcta

SEQ ID NO: 7541357 - DNA, 22 bp, Homo sapiens
ttttaaaggatactcttgtcta

SEQ ID NO: 7541358 - DNA, 22 bp, Homo sapiens
ttttaaaggatactcttgtcta

SEQ ID NO: 7541359 - DNA, 22 bp, Homo sapiens
ttttaaagagatgctgtgcata

SEQ ID NO: 7541360 - DNA, 22 bp, Homo sapiens
ttttaaaggcagattatggctt

SEQ ID NO: 7541361 - DNA, 22 bp, Homo sapiens
ttttaaaggcagattatggctt

SEQ ID NO: 7541362 - DNA, 22 bp, Homo sapiens
ttttaaaggatagctctggttg

SEQ ID NO: 7541363 - DNA, 22 bp, Homo sapiens
ttttaaaggatactcttgtcta

SEQ ID NO: 7541364 - DNA, 22 bp, Homo sapiens
ttttaaaggatagctctggttg

SEQ ID NO: 7541365 - DNA, 22 bp, Homo sapiens
ttttaaaggatagctctggttg

SEQ ID NO: 7541366 - DNA, 22 bp, Homo sapiens
tttttcagccatgaattacact

SEQ ID NO: 7541367 - DNA, 22 bp, Homo sapiens
tttttcagccatgaattacact

SEQ ID NO: 7541368 - DNA, 22 bp, Homo sapiens
tttttcatattcccctctctgg

SEQ ID NO: 7541369 - DNA, 22 bp, Homo sapiens
tttttcagccatgaattacact

SEQ ID NO: 7541370 - DNA, 22 bp, Homo sapiens
tttttcatattcccctctctgg

SEQ ID NO: 7541371 - DNA, 22 bp, Homo sapiens
tttttcatattcccctctctgg

SEQ ID NO: 7541372 - DNA, 22 bp, Homo sapiens
tttttcatattcccctctctgg

SEQ ID NO: 7541373 - DNA, 22 bp, Homo sapiens
tttttcatattcccctctctgg

SEQ ID NO: 7541374 - DNA, 22 bp, Homo sapiens
tttttcatattcccctctctgg

SEQ ID NO: 7541375 - DNA, 22 bp, Homo sapiens
tttttcatattcccctctctgg

SEQ ID NO: 7541376 - DNA, 22 bp, Homo sapiens
tttttcatctgattgataactc

SEQ ID NO: 7541377 - DNA, 22 bp, Homo sapiens
tttttcatctgattgataactc

SEQ ID NO: 7541378 - DNA, 22 bp, Homo sapiens
tttttcatctgattgataactc

SEQ ID NO: 7541379 - DNA, 22 bp, Homo sapiens
tttttcatctgattgataactc

SEQ ID NO: 7541380 - DNA, 22 bp, Homo sapiens
tttttcatctgattgataactc

SEQ ID NO: 7541381 - DNA, 22 bp, Homo sapiens
tttttcatctgattgataactc

SEQ ID NO: 7541382 - DNA, 22 bp, Homo sapiens
tttttcatctgattgataactc

SEQ ID NO: 7541383 - DNA, 22 bp, Homo sapiens
tttttcatctgattgataactc

SEQ ID NO: 7541384 - DNA, 22 bp, Homo sapiens
tttttcaagacaacctgcatgt

SEQ ID NO: 7541385 - DNA, 22 bp, Homo sapiens
tttttcaagacaacctgcatgt

SEQ ID NO: 7541386 - DNA, 22 bp, Homo sapiens
tttttcaagacaacctgcatgt

SEQ ID NO: 7541387 - DNA, 22 bp, Homo sapiens
tttttcaagacaacctgcatgt

SEQ ID NO: 7541388 - DNA, 22 bp, Homo sapiens
tttttcacacatgtggcttgat

SEQ ID NO: 7541389 - DNA, 22 bp, Homo sapiens
tttttatgcctacgctgaaaag

SEQ ID NO: 7541390 - DNA, 22 bp, Homo sapiens
tttttatcttgtatgtgtctct

SEQ ID NO: 7541391 - DNA, 22 bp, Homo sapiens
tttttatcttgtatgtgtctct

SEQ ID NO: 7541392 - DNA, 22 bp, Homo sapiens
tttttatcttgtatgtgtctct

SEQ ID NO: 7541393 - DNA, 22 bp, Homo sapiens
tttttatctacagattctcagc

SEQ ID NO: 7541394 - DNA, 22 bp, Homo sapiens
tttttatctacagattctcagc

SEQ ID NO: 7541395 - DNA, 22 bp, Homo sapiens
tttttatctacagattctcagc

SEQ ID NO: 7541396 - DNA, 22 bp, Homo sapiens
tttttatctacagattctcagc

SEQ ID NO: 7541397 - DNA, 22 bp, Homo sapiens
tttttatcttgtatgtgtctct

SEQ ID NO: 7541398 - DNA, 22 bp, Homo sapiens
tttttatctacagattctcagc

SEQ ID NO: 7541399 - DNA, 22 bp, Homo sapiens
tttttatctacagattctcagc

SEQ ID NO: 7541400 - DNA, 22 bp, Homo sapiens
tttttataggtcagggcaagtc

SEQ ID NO: 7541401 - DNA, 22 bp, Homo sapiens
tttttataggtcagggcaagtc

SEQ ID NO: 7541402 - DNA, 22 bp, Homo sapiens
tttttatatgaaggatagtgcg

SEQ ID NO: 7541403 - DNA, 22 bp, Homo sapiens
tttttatatgaaggatagtgcg

SEQ ID NO: 7541404 - DNA, 22 bp, Homo sapiens
tttttatactttgctcaagatt

SEQ ID NO: 7541405 - DNA, 22 bp, Homo sapiens
tttttatactttgctcaagatt

SEQ ID NO: 7541406 - DNA, 22 bp, Homo sapiens
tttttatactttgctcaagatt

SEQ ID NO: 7541407 - DNA, 22 bp, Homo sapiens
tttttatactttgctcaagatt

SEQ ID NO: 7541408 - DNA, 22 bp, Homo sapiens
tttttataggtcagggcaagtc

SEQ ID NO: 7541409 - DNA, 22 bp, Homo sapiens
tttttataggtcagggcaagtc

SEQ ID NO: 7541410 - DNA, 22 bp, Homo sapiens
tttttatactttgctcaagatt

SEQ ID NO: 7541411 - DNA, 22 bp, Homo sapiens
tttttatactttgctcaagatt

SEQ ID NO: 7541412 - DNA, 22 bp, Homo sapiens
tttttatactttgctcaagatt

SEQ ID NO: 7541413 - DNA, 22 bp, Homo sapiens
tttttatactttgctcaagatt

SEQ ID NO: 7541414 - DNA, 22 bp, Homo sapiens
tttttatactttgctcaagatt

SEQ ID NO: 7541415 - DNA, 22 bp, Homo sapiens
tttttataccacctctcactta

SEQ ID NO: 7541416 - DNA, 22 bp, Homo sapiens
tttttataccacctctcactta

SEQ ID NO: 7541417 - DNA, 22 bp, Homo sapiens
tttttataccacctctcactta

SEQ ID NO: 7541418 - DNA, 22 bp, Homo sapiens
tttttataccacctctcactta

SEQ ID NO: 7541419 - DNA, 22 bp, Homo sapiens
tttttataccacctctcactta

SEQ ID NO: 7541420 - DNA, 22 bp, Homo sapiens
tttttataactcttttgtgaca

SEQ ID NO: 7541421 - DNA, 22 bp, Homo sapiens
tttttataccacctctcactta

SEQ ID NO: 7541422 - DNA, 22 bp, Homo sapiens
tttttataccacctctcactta

SEQ ID NO: 7541423 - DNA, 22 bp, Homo sapiens
tttttataccacctctcactta

SEQ ID NO: 7541424 - DNA, 22 bp, Homo sapiens
tttttataactcttttgtgaca

SEQ ID NO: 7541425 - DNA, 22 bp, Homo sapiens
tttttataactcttttgtgaca

SEQ ID NO: 7541426 - DNA, 22 bp, Homo sapiens
tttttataactcttttgtgaca

SEQ ID NO: 7541427 - DNA, 22 bp, Homo sapiens
tttttataactcttttgtgaca

SEQ ID NO: 7541428 - DNA, 22 bp, Homo sapiens
tttttataactcttttgtgaca

SEQ ID NO: 7541429 - DNA, 23 bp, Homo sapiens
tttttagttacacctctgccacc

SEQ ID NO: 7541430 - DNA, 23 bp, Homo sapiens
tttttagttacacctctgccacc

SEQ ID NO: 7541431 - DNA, 22 bp, Homo sapiens
tttttagagtgttaccagtata

SEQ ID NO: 7541432 - DNA, 22 bp, Homo sapiens
tttttagagtgttaccagtata

SEQ ID NO: 7541433 - DNA, 22 bp, Homo sapiens
tttttagattactcagccacca

SEQ ID NO: 7541434 - DNA, 23 bp, Homo sapiens
tttttagttacacctctgccacc

SEQ ID NO: 7541435 - DNA, 23 bp, Homo sapiens
tttttagttacacctctgccacc

SEQ ID NO: 7541436 - DNA, 22 bp, Homo sapiens
tttttagtagaggtgggtttca

SEQ ID NO: 7541437 - DNA, 22 bp, Homo sapiens
tttttagattactcagccacca

SEQ ID NO: 7541438 - DNA, 22 bp, Homo sapiens
tttttagtagaggtgggtttca

SEQ ID NO: 7541439 - DNA, 22 bp, Homo sapiens
tttttagtagaggtgggtttca

SEQ ID NO: 7541440 - DNA, 22 bp, Homo sapiens
tttttagaattggctgagaatt

SEQ ID NO: 7541441 - DNA, 22 bp, Homo sapiens
tttttagaattggctgagaatt

SEQ ID NO: 7541442 - DNA, 22 bp, Homo sapiens
tttttagagtgttaccagtata

SEQ ID NO: 7541443 - DNA, 22 bp, Homo sapiens
tttttagagtgttaccagtata

SEQ ID NO: 7541444 - DNA, 22 bp, Homo sapiens
tttttagagtgttaccagtata

SEQ ID NO: 7541445 - DNA, 22 bp, Homo sapiens
tttttagagtgttaccagtata

SEQ ID NO: 7541446 - DNA, 22 bp, Homo sapiens
tttttagaattggctgagaatt

SEQ ID NO: 7541447 - DNA, 22 bp, Homo sapiens
tttttacagtcatggtcactca

SEQ ID NO: 7541448 - DNA, 22 bp, Homo sapiens
tttttacacttagcattgagcg

SEQ ID NO: 7541449 - DNA, 22 bp, Homo sapiens
tttttacacttagcattgagcg

SEQ ID NO: 7541450 - DNA, 22 bp, Homo sapiens
tttttacacttagcattgagcg

SEQ ID NO: 7541451 - DNA, 22 bp, Homo sapiens
tttttacacttagcattgagcg

SEQ ID NO: 7541452 - DNA, 22 bp, Homo sapiens
tttttacacttagcattgagcg

SEQ ID NO: 7541453 - DNA, 22 bp, Homo sapiens
tttttacagtcatggtcactca

SEQ ID NO: 7541454 - DNA, 22 bp, Homo sapiens
tttttacagtcatggtcactca

SEQ ID NO: 7541455 - DNA, 22 bp, Homo sapiens
tttttacagtcatggtcactca

SEQ ID NO: 7541456 - DNA, 22 bp, Homo sapiens
tttttacagtcatggtcactca

SEQ ID NO: 7541457 - DNA, 22 bp, Homo sapiens
tttttacacttagcattgagcg

SEQ ID NO: 7541458 - DNA, 22 bp, Homo sapiens
tttttacacttagcattgagcg

SEQ ID NO: 7541459 - DNA, 22 bp, Homo sapiens
tttttacacttagcattgagcg

SEQ ID NO: 7541460 - DNA, 22 bp, Homo sapiens
tttttacacttagcattgagcg

SEQ ID NO: 7541461 - DNA, 22 bp, Homo sapiens
tttttacacttagcattgagcg

SEQ ID NO: 7541462 - DNA, 19 bp, Homo sapiens
tttttacaagtaggtgtga

SEQ ID NO: 7541463 - DNA, 22 bp, Homo sapiens
ttttgtttgtgtccactgcagt

SEQ ID NO: 7541464 - DNA, 22 bp, Homo sapiens
ttttgtttgtgtccactgcagt

SEQ ID NO: 7541465 - DNA, 22 bp, Homo sapiens
ttttgtttgtgtccactgcagt

SEQ ID NO: 7541466 - DNA, 22 bp, Homo sapiens
ttttgtttaaaatcctggatgg

SEQ ID NO: 7541467 - DNA, 22 bp, Homo sapiens
ttttgtttaaaatcctggatgg

SEQ ID NO: 7541468 - DNA, 22 bp, Homo sapiens
ttttgtttaaaatcctggatgg

SEQ ID NO: 7541469 - DNA, 22 bp, Homo sapiens
ttttgtttaaaatcctggatgg

SEQ ID NO: 7541470 - DNA, 22 bp, Homo sapiens
ttttgttgtaatatacctatcc

SEQ ID NO: 7541471 - DNA, 22 bp, Homo sapiens
ttttgtttgtgtccactgcagt

SEQ ID NO: 7541472 - DNA, 22 bp, Homo sapiens
ttttgtttgtgtccactgcagt

SEQ ID NO: 7541473 - DNA, 22 bp, Homo sapiens
ttttgtttgtgtccactgcagt

SEQ ID NO: 7541474 - DNA, 22 bp, Homo sapiens
ttttgtttgtgtccactgcagt

SEQ ID NO: 7541475 - DNA, 22 bp, Homo sapiens
ttttgtttgtgtccactgcagt

SEQ ID NO: 7541476 - DNA, 22 bp, Homo sapiens
ttttgtttaaaatcctggatgg

SEQ ID NO: 7541477 - DNA, 22 bp, Homo sapiens
ttttgtttaaaatcctggatgg

SEQ ID NO: 7541478 - DNA, 22 bp, Homo sapiens
ttttcttcctggattttggcat

SEQ ID NO: 7541479 - DNA, 22 bp, Homo sapiens
ttttcttcctggattttggcat

SEQ ID NO: 7541480 - DNA, 22 bp, Homo sapiens
ttttcttcctggattttggcat

SEQ ID NO: 7541481 - DNA, 22 bp, Homo sapiens
ttttcttcctggattttggcat

SEQ ID NO: 7541482 - DNA, 22 bp, Homo sapiens
ttttcttatgtgcagctatatg

SEQ ID NO: 7541483 - DNA, 22 bp, Homo sapiens
ttttcttatgtgcagctatatg

SEQ ID NO: 7541484 - DNA, 22 bp, Homo sapiens
ttttcttatggtgaagcacaaa

SEQ ID NO: 7541485 - DNA, 22 bp, Homo sapiens
ttttcttcctggattttggcat

SEQ ID NO: 7541486 - DNA, 22 bp, Homo sapiens
ttttcttcctggattttggcat

SEQ ID NO: 7541487 - DNA, 22 bp, Homo sapiens
ttttcttcctggattttggcat

SEQ ID NO: 7541488 - DNA, 22 bp, Homo sapiens
ttttcttcggtgctgggttgat

SEQ ID NO: 7541489 - DNA, 22 bp, Homo sapiens
ttttgttggcttaagaaataca

SEQ ID NO: 7541490 - DNA, 22 bp, Homo sapiens
ttcattggctaaagacctggga

SEQ ID NO: 7541491 - DNA, 22 bp, Homo sapiens
ttcattggcacaggggcaggtt

SEQ ID NO: 7541492 - DNA, 22 bp, Homo sapiens
ttcattgcattccagcctgggt

SEQ ID NO: 7541493 - DNA, 22 bp, Homo sapiens
ttcattgcattccagcctgggt

SEQ ID NO: 7541494 - DNA, 22 bp, Homo sapiens
ttcattgcattccagcctgggt

SEQ ID NO: 7541495 - DNA, 22 bp, Homo sapiens
ttcattgcagttcttcaggtta

SEQ ID NO: 7541496 - DNA, 22 bp, Homo sapiens
ttcattgatttccttggaataa

SEQ ID NO: 7541497 - DNA, 22 bp, Homo sapiens
ttcattgcagttcttcaggtta

SEQ ID NO: 7541498 - DNA, 22 bp, Homo sapiens
ttcatacaatgggatattatga

SEQ ID NO: 7541499 - DNA, 22 bp, Homo sapiens
ttcattgatttccttggaataa

SEQ ID NO: 7541500 - DNA, 22 bp, Homo sapiens
ttcatacaatgggatattatga

SEQ ID NO: 7541501 - DNA, 22 bp, Homo sapiens
ttcatacaatgggatattatga

SEQ ID NO: 7541502 - DNA, 22 bp, Homo sapiens
ttcatacaatgggatattatga

SEQ ID NO: 7541503 - DNA, 22 bp, Homo sapiens
ttcatacaatgggatattatga

SEQ ID NO: 7541504 - DNA, 22 bp, Homo sapiens
ttcataatcaccaaaaactgga

SEQ ID NO: 7541505 - DNA, 22 bp, Homo sapiens
ttcataatcaccaaaaactgga

SEQ ID NO: 7541506 - DNA, 22 bp, Homo sapiens
ttcatacaatgggatattatga

SEQ ID NO: 7541507 - DNA, 22 bp, Homo sapiens
ttcatacaatgggatattatga

SEQ ID NO: 7541508 - DNA, 22 bp, Homo sapiens
ttcataatcaccaaaaactgga

SEQ ID NO: 7541509 - DNA, 22 bp, Homo sapiens
ttcataagttggtgttgacttt

SEQ ID NO: 7541510 - DNA, 19 bp, Homo sapiens
ttcataagtttagtgaggg

SEQ ID NO: 7541511 - DNA, 22 bp, Homo sapiens
ttcataagggtggccatataaa

SEQ ID NO: 7541512 - DNA, 22 bp, Homo sapiens
ttcattgtagcttgactaatta

SEQ ID NO: 7541513 - DNA, 22 bp, Homo sapiens
ttcattgtactttaagagatgc

SEQ ID NO: 7541514 - DNA, 22 bp, Homo sapiens
ttcattgtagcttgactaatta

SEQ ID NO: 7541515 - DNA, 22 bp, Homo sapiens
ttcattgtagcttgactaatta

SEQ ID NO: 7541516 - DNA, 22 bp, Homo sapiens
ttcattgtctctgtttgccttc

SEQ ID NO: 7541517 - DNA, 22 bp, Homo sapiens
ttcattggtactaggacaggac

SEQ ID NO: 7541518 - DNA, 22 bp, Homo sapiens
ttcattggtcctgctcctggac

SEQ ID NO: 7541519 - DNA, 22 bp, Homo sapiens
ttcattgtactttaagagatgc

SEQ ID NO: 7541520 - DNA, 22 bp, Homo sapiens
ttcattggtcctgctcctggac

SEQ ID NO: 7541521 - DNA, 22 bp, Homo sapiens
ttcattgtactttaagagatgc

SEQ ID NO: 7541522 - DNA, 22 bp, Homo sapiens
ttcatttaatcagaatctctaa

SEQ ID NO: 7541523 - DNA, 22 bp, Homo sapiens
ttcatttaatcagaatctctaa

SEQ ID NO: 7541524 - DNA, 22 bp, Homo sapiens
ttcatttaatcagaatctctaa

SEQ ID NO: 7541525 - DNA, 22 bp, Homo sapiens
ttcatttaatcagaatctctaa

SEQ ID NO: 7541526 - DNA, 22 bp, Homo sapiens
ttcatttaatcagaatctctaa

SEQ ID NO: 7541527 - DNA, 22 bp, Homo sapiens
ttcatttaatcagaatctctaa

SEQ ID NO: 7541528 - DNA, 22 bp, Homo sapiens
ttcatttaatcagaatctctaa

SEQ ID NO: 7541529 - DNA, 22 bp, Homo sapiens
ttcatttaatcagaatctctaa

SEQ ID NO: 7541530 - DNA, 22 bp, Homo sapiens
ttcattgttggctagctacctc

SEQ ID NO: 7541531 - DNA, 22 bp, Homo sapiens
ttcattgtgattcttggctagc

SEQ ID NO: 7541532 - DNA, 22 bp, Homo sapiens
ttcattgtgattcttggctagc

SEQ ID NO: 7541533 - DNA, 22 bp, Homo sapiens
ttcattgtgtctatttttatct

SEQ ID NO: 7541534 - DNA, 22 bp, Homo sapiens
ttcattgtgaacacattctgcc

SEQ ID NO: 7541535 - DNA, 22 bp, Homo sapiens
ttcattgtcttggaaaacccat

SEQ ID NO: 7541536 - DNA, 22 bp, Homo sapiens
ttcatttaatcagaatctctaa

SEQ ID NO: 7541537 - DNA, 22 bp, Homo sapiens
ttcatttaatcagaatctctaa

SEQ ID NO: 7541538 - DNA, 22 bp, Homo sapiens
ttcatttaatttgtgtattaac

SEQ ID NO: 7541539 - DNA, 22 bp, Homo sapiens
ttcatttaatttgtgtattaac

SEQ ID NO: 7541540 - DNA, 22 bp, Homo sapiens
ttcatttaatttgtgtattaac

SEQ ID NO: 7541541 - DNA, 22 bp, Homo sapiens
ttcatttaatttgtgtattaac

SEQ ID NO: 7541542 - DNA, 22 bp, Homo sapiens
ttcatttaatttgtgtattaac

SEQ ID NO: 7541543 - DNA, 22 bp, Homo sapiens
ttcatttaatttgtgtattaac

SEQ ID NO: 7541544 - DNA, 22 bp, Homo sapiens
ttcatttaatttgtgtattaac

SEQ ID NO: 7541545 - DNA, 22 bp, Homo sapiens
ttcatttaatttgtgtattaac

SEQ ID NO: 7541546 - DNA, 22 bp, Homo sapiens
ttcatttaatttgtgtattaac

SEQ ID NO: 7541547 - DNA, 23 bp, Homo sapiens
ttcatttaggagttcataagagc

SEQ ID NO: 7541548 - DNA, 23 bp, Homo sapiens
ttcatttaggagttcataagagc

SEQ ID NO: 7541549 - DNA, 23 bp, Homo sapiens
ttcatttaggagttcataagagc

SEQ ID NO: 7541550 - DNA, 22 bp, Homo sapiens
ttcatttagcatgctaaacctg

SEQ ID NO: 7541551 - DNA, 23 bp, Homo sapiens
ttcatttaggagttcataagagc

SEQ ID NO: 7541552 - DNA, 22 bp, Homo sapiens
ttcatttgagtttatagttgct

SEQ ID NO: 7541553 - DNA, 22 bp, Homo sapiens
ttcatttgagtttatagttgct

SEQ ID NO: 7541554 - DNA, 22 bp, Homo sapiens
ttcatttgagtttatagttgct

SEQ ID NO: 7541555 - DNA, 22 bp, Homo sapiens
ttcatttgccatcagtgtaatg

SEQ ID NO: 7541556 - DNA, 22 bp, Homo sapiens
ttcatttgccatcagtgtaatg

SEQ ID NO: 7541557 - DNA, 22 bp, Homo sapiens
ttcatttgcactggattactgg

SEQ ID NO: 7541558 - DNA, 22 bp, Homo sapiens
ttcatttgcactggattactgg

SEQ ID NO: 7541559 - DNA, 22 bp, Homo sapiens
ttcatttattcagcaggtattt

SEQ ID NO: 7541560 - DNA, 22 bp, Homo sapiens
ttcatttattcagcaggtattt

SEQ ID NO: 7541561 - DNA, 22 bp, Homo sapiens
ttcatttattcagcaggtattt

SEQ ID NO: 7541562 - DNA, 22 bp, Homo sapiens
ttcatttgagtttatagttgct

SEQ ID NO: 7541563 - DNA, 22 bp, Homo sapiens
ttcatttgagtttatagttgct

SEQ ID NO: 7541564 - DNA, 22 bp, Homo sapiens
ttcatttattcagcaggtattt

SEQ ID NO: 7541565 - DNA, 23 bp, Homo sapiens
ttcatttaggagttcataagagc

SEQ ID NO: 7541566 - DNA, 23 bp, Homo sapiens
ttcatttaggagttcataagagc

SEQ ID NO: 7541567 - DNA, 22 bp, Homo sapiens
ttcataaacaaattaaggcctg

SEQ ID NO: 7541568 - DNA, 22 bp, Homo sapiens
ttcataaacaactgatggtaat

SEQ ID NO: 7541569 - DNA, 22 bp, Homo sapiens
ttcataaacaactgatggtaat

SEQ ID NO: 7541570 - DNA, 22 bp, Homo sapiens
ttcataaacaactgatggtaat

SEQ ID NO: 7541571 - DNA, 22 bp, Homo sapiens
ttcagttttctttagaatgtag

SEQ ID NO: 7541572 - DNA, 22 bp, Homo sapiens
ttcagttttctttagaatgtag

SEQ ID NO: 7541573 - DNA, 22 bp, Homo sapiens
ttcagttttgcttttaatcatg

SEQ ID NO: 7541574 - DNA, 22 bp, Homo sapiens
ttcagttttgcttttaatcatg

SEQ ID NO: 7541575 - DNA, 22 bp, Homo sapiens
ttcagttttgcttttaatcatg

SEQ ID NO: 7541576 - DNA, 22 bp, Homo sapiens
ttcagttttctttagaatgtag

SEQ ID NO: 7541577 - DNA, 22 bp, Homo sapiens
ttcagttttgcttttaatcatg

SEQ ID NO: 7541578 - DNA, 22 bp, Homo sapiens
ttcagttttgcttttaatcatg

SEQ ID NO: 7541579 - DNA, 21 bp, Homo sapiens
ttcataaaccattctcatgca

SEQ ID NO: 7541580 - DNA, 21 bp, Homo sapiens
ttcataaaccattctcatgca

SEQ ID NO: 7541581 - DNA, 21 bp, Homo sapiens
ttcataaaccattctcatgca

SEQ ID NO: 7541582 - DNA, 22 bp, Homo sapiens
ttcataaacaactgatggtaat

SEQ ID NO: 7541583 - DNA, 21 bp, Homo sapiens
ttcataaaccattctcatgca

SEQ ID NO: 7541584 - DNA, 19 bp, Homo sapiens
ttcataacttttatatcct

SEQ ID NO: 7541585 - DNA, 19 bp, Homo sapiens
ttcataacttttatatcct

SEQ ID NO: 7541586 - DNA, 23 bp, Homo sapiens
ttcataactcaaggtgatataat

SEQ ID NO: 7541587 - DNA, 22 bp, Homo sapiens
ttcagtttgtttgactgttaga

SEQ ID NO: 7541588 - DNA, 22 bp, Homo sapiens
ttcagtttgtttgactgttaga

SEQ ID NO: 7541589 - DNA, 22 bp, Homo sapiens
ttcagtttgtttgactgttaga

SEQ ID NO: 7541590 - DNA, 22 bp, Homo sapiens
ttcagtttgctacaagcaacat

SEQ ID NO: 7541591 - DNA, 22 bp, Homo sapiens
ttcagtttgctacaagcaacat

SEQ ID NO: 7541592 - DNA, 22 bp, Homo sapiens
ttcagtttgtttgactgttaga

SEQ ID NO: 7541593 - DNA, 22 bp, Homo sapiens
ttcagtttcaaatcctgtgaag

SEQ ID NO: 7541594 - DNA, 22 bp, Homo sapiens
ttcagtttgtttgactgttaga

SEQ ID NO: 7541595 - DNA, 22 bp, Homo sapiens
ttcagtttcaaatcctggatgc

SEQ ID NO: 7541596 - DNA, 22 bp, Homo sapiens
ttcagtttcaaatcctgtgaag

SEQ ID NO: 7541597 - DNA, 22 bp, Homo sapiens
ttcagtttgctacaagcaacat

SEQ ID NO: 7541598 - DNA, 22 bp, Homo sapiens
ttcagtttcaaatcctgtgaag

SEQ ID NO: 7541599 - DNA, 22 bp, Homo sapiens
ttcagtttcaaatcctggatgc

SEQ ID NO: 7541600 - DNA, 22 bp, Homo sapiens
ttcagtttatacctgttgatta

SEQ ID NO: 7541601 - DNA, 22 bp, Homo sapiens
ttcagtttatacctgttgatta

SEQ ID NO: 7541602 - DNA, 22 bp, Homo sapiens
ttcagtttatacctgttgatta

SEQ ID NO: 7541603 - DNA, 22 bp, Homo sapiens
ttcagttttattgtactgctat

SEQ ID NO: 7541604 - DNA, 22 bp, Homo sapiens
ttcagttttattgtactgctat

SEQ ID NO: 7541605 - DNA, 22 bp, Homo sapiens
ttcagttttattgtactgctat

SEQ ID NO: 7541606 - DNA, 22 bp, Homo sapiens
ttcagttttattgtactgctat

SEQ ID NO: 7541607 - DNA, 22 bp, Homo sapiens
ttcagttttccctcctgcaggt

SEQ ID NO: 7541608 - DNA, 22 bp, Homo sapiens
ttcagttttccctcctgcaggt

SEQ ID NO: 7541609 - DNA, 22 bp, Homo sapiens
ttcagttttccctcctgcaggt

SEQ ID NO: 7541610 - DNA, 22 bp, Homo sapiens
ttcagttttccctcctgcaggt

SEQ ID NO: 7541611 - DNA, 22 bp, Homo sapiens
ttcagttttccctcctgcaggt

SEQ ID NO: 7541612 - DNA, 22 bp, Homo sapiens
ttcagttttctttagaatgtag

SEQ ID NO: 7541613 - DNA, 22 bp, Homo sapiens
ttcagttttctttagaatgtag

SEQ ID NO: 7541614 - DNA, 22 bp, Homo sapiens
ttcagttttctttagaatgtag

SEQ ID NO: 7541615 - DNA, 22 bp, Homo sapiens
ttcagttctacaagagctttgt

SEQ ID NO: 7541616 - DNA, 22 bp, Homo sapiens
ttcagttccttatcatagggtt

SEQ ID NO: 7541617 - DNA, 22 bp, Homo sapiens
ttcagttggccatacccctaga

SEQ ID NO: 7541618 - DNA, 22 bp, Homo sapiens
ttcagttccatttcaggtgggt

SEQ ID NO: 7541619 - DNA, 22 bp, Homo sapiens
ttcagttccttgtgcgaattcc

SEQ ID NO: 7541620 - DNA, 22 bp, Homo sapiens
ttcagtgtttgtagagataact

SEQ ID NO: 7541621 - DNA, 22 bp, Homo sapiens
ttcagtgtttgtagagataact

SEQ ID NO: 7541622 - DNA, 22 bp, Homo sapiens
ttcagtgtttgtagagataact

SEQ ID NO: 7541623 - DNA, 22 bp, Homo sapiens
ttcagtgtttgtagagataact

SEQ ID NO: 7541624 - DNA, 22 bp, Homo sapiens
ttcagtgtttgtagagataact

SEQ ID NO: 7541625 - DNA, 22 bp, Homo sapiens
ttcagttcacatgtatcatggc

SEQ ID NO: 7541626 - DNA, 22 bp, Homo sapiens
ttcagttcacatgtatcatggc

SEQ ID NO: 7541627 - DNA, 22 bp, Homo sapiens
ttcagtgttcttttctgttagc

SEQ ID NO: 7541628 - DNA, 22 bp, Homo sapiens
ttcagtgttcttttctgttagc

SEQ ID NO: 7541629 - DNA, 22 bp, Homo sapiens
ttcagtgttcttttctgttagc

SEQ ID NO: 7541630 - DNA, 22 bp, Homo sapiens
ttcagtgttactcaaggggcag

SEQ ID NO: 7541631 - DNA, 22 bp, Homo sapiens
ttcagtgttactcaaggggcag

SEQ ID NO: 7541632 - DNA, 22 bp, Homo sapiens
ttcagtgttaatcttgggagaa

SEQ ID NO: 7541633 - DNA, 22 bp, Homo sapiens
ttcagtgttaatcttgggagaa

SEQ ID NO: 7541634 - DNA, 22 bp, Homo sapiens
ttcagtgttaatcttgggagaa

SEQ ID NO: 7541635 - DNA, 22 bp, Homo sapiens
ttcagtgttaaattcaaagagt

SEQ ID NO: 7541636 - DNA, 22 bp, Homo sapiens
ttcagtgtggtgcacagttttg

SEQ ID NO: 7541637 - DNA, 22 bp, Homo sapiens
ttcagtgtgtcagtttcagcag

SEQ ID NO: 7541638 - DNA, 22 bp, Homo sapiens
ttcagtgtgtgatacctgctgt

SEQ ID NO: 7541639 - DNA, 22 bp, Homo sapiens
ttcagtgtgtcagtttcagcag

SEQ ID NO: 7541640 - DNA, 22 bp, Homo sapiens
ttcagtgtggtgcacagttttg

SEQ ID NO: 7541641 - DNA, 22 bp, Homo sapiens
ttcagtgtggtgcacagttttg

SEQ ID NO: 7541642 - DNA, 22 bp, Homo sapiens
ttcagtgttaaattcaaagagt

SEQ ID NO: 7541643 - DNA, 22 bp, Homo sapiens
ttcagtgttaaattcaaagagt

SEQ ID NO: 7541644 - DNA, 22 bp, Homo sapiens
ttcagtgttaaattcaaagagt

SEQ ID NO: 7541645 - DNA, 22 bp, Homo sapiens
ttcagtgttaaattcaaagagt

SEQ ID NO: 7541646 - DNA, 22 bp, Homo sapiens
ttcagtgttaaattcaaagagt

SEQ ID NO: 7541647 - DNA, 22 bp, Homo sapiens
ttcagtgttaaattcaaagagt

SEQ ID NO: 7541648 - DNA, 22 bp, Homo sapiens
ttcagtgtgtgatacctgctgt

SEQ ID NO: 7541649 - DNA, 22 bp, Homo sapiens
ttcagtgtgtgatacctgctgt

SEQ ID NO: 7541650 - DNA, 22 bp, Homo sapiens
ttcagtgtggtgcacagttttg

SEQ ID NO: 7541651 - DNA, 22 bp, Homo sapiens
ttcagtgtggtgcacagttttg

SEQ ID NO: 7541652 - DNA, 22 bp, Homo sapiens
ttcagtgtggtgcacagttttg

SEQ ID NO: 7541653 - DNA, 22 bp, Homo sapiens
ttcagtgtggcccatgaagagg

SEQ ID NO: 7541654 - DNA, 22 bp, Homo sapiens
ttcagtgtggcccatgaagagg

SEQ ID NO: 7541655 - DNA, 22 bp, Homo sapiens
ttcagtgtggcccatgaagagg

SEQ ID NO: 7541656 - DNA, 22 bp, Homo sapiens
ttcagtgtggcccatgaagagg

SEQ ID NO: 7541657 - DNA, 22 bp, Homo sapiens
ttcagtgtggaatgtgaactgc

SEQ ID NO: 7541658 - DNA, 22 bp, Homo sapiens
ttcagtgtggaatgtgaactgc

SEQ ID NO: 7541659 - DNA, 22 bp, Homo sapiens
ttcagtgtggaatgtgaactgc

SEQ ID NO: 7541660 - DNA, 22 bp, Homo sapiens
ttcagtgtgcttcaggacgtta

SEQ ID NO: 7541661 - DNA, 22 bp, Homo sapiens
ttcagtgtggaatgtgaactgc

SEQ ID NO: 7541662 - DNA, 22 bp, Homo sapiens
ttcatttgtggtgaatgaagtg

SEQ ID NO: 7541663 - DNA, 22 bp, Homo sapiens
ttcatttgtctgctatagatcc

SEQ ID NO: 7541664 - DNA, 22 bp, Homo sapiens
ttcatttgtctgctatagatcc

SEQ ID NO: 7541665 - DNA, 22 bp, Homo sapiens
ttcatttgtggttatttacaat

SEQ ID NO: 7541666 - DNA, 22 bp, Homo sapiens
ttcatttgtggttatttacaat

SEQ ID NO: 7541667 - DNA, 22 bp, Homo sapiens
ttcatttgtggtgaatgaagtg

SEQ ID NO: 7541668 - DNA, 22 bp, Homo sapiens
ttcatttgtggtgaatgaagtg

SEQ ID NO: 7541669 - DNA, 22 bp, Homo sapiens
ttcatttgtggttatttacaat

SEQ ID NO: 7541670 - DNA, 22 bp, Homo sapiens
ttcatttgtggttatttacaat

SEQ ID NO: 7541671 - DNA, 22 bp, Homo sapiens
ttcatttgtggttatttacaat

SEQ ID NO: 7541672 - DNA, 22 bp, Homo sapiens
ttcatttgtctgctatagatcc

SEQ ID NO: 7541673 - DNA, 22 bp, Homo sapiens
ttcatttgtctgctatagatcc

SEQ ID NO: 7541674 - DNA, 22 bp, Homo sapiens
ttcatttgtctgctatagatcc

SEQ ID NO: 7541675 - DNA, 22 bp, Homo sapiens
ttcatttgtccaaatactatgt

SEQ ID NO: 7541676 - DNA, 22 bp, Homo sapiens
ttcatttgtccaaatactatgt

SEQ ID NO: 7541677 - DNA, 22 bp, Homo sapiens
ttcatttgtccaaatactatgt

SEQ ID NO: 7541678 - DNA, 22 bp, Homo sapiens
ttcatttgtccaaatactatgt

SEQ ID NO: 7541679 - DNA, 23 bp, Homo sapiens
ttcatttgtctacttcacttgtt

SEQ ID NO: 7541680 - DNA, 23 bp, Homo sapiens
ttcatttgtctacttcacttgtt

SEQ ID NO: 7541681 - DNA, 22 bp, Homo sapiens
ttcatttgtaactctgttaggg

SEQ ID NO: 7541682 - DNA, 22 bp, Homo sapiens
ttcatttgtaactctgttaggg

SEQ ID NO: 7541683 - DNA, 22 bp, Homo sapiens
ttcatttgggatgagtcagaag

SEQ ID NO: 7541684 - DNA, 22 bp, Homo sapiens
ttcatttgggatgagtcagaag

SEQ ID NO: 7541685 - DNA, 22 bp, Homo sapiens
ttcatttgtccaaatactatgt

SEQ ID NO: 7541686 - DNA, 22 bp, Homo sapiens
ttcatttgtccaaatactatgt

SEQ ID NO: 7541687 - DNA, 19 bp, Homo sapiens
ttcatttgtatctgctcac

SEQ ID NO: 7541688 - DNA, 19 bp, Homo sapiens
ttcatttgtatctgctcac

SEQ ID NO: 7541689 - DNA, 22 bp, Homo sapiens
ttcatttgtaactctgttaggg

SEQ ID NO: 7541690 - DNA, 22 bp, Homo sapiens
ttcatttggcctctgcttaaaa

SEQ ID NO: 7541691 - DNA, 22 bp, Homo sapiens
ttcatttggcctctgcttaaaa

SEQ ID NO: 7541692 - DNA, 20 bp, Homo sapiens
ttcatttgggaaaatctgcg

SEQ ID NO: 7541693 - DNA, 22 bp, Homo sapiens
ttcatttgccatcagtgtaatg

SEQ ID NO: 7541694 - DNA, 22 bp, Homo sapiens
ttcatttgccatcagtgtaatg

SEQ ID NO: 7541695 - DNA, 22 bp, Homo sapiens
ttcatttgccatcagtgtaatg

SEQ ID NO: 7541696 - DNA, 22 bp, Homo sapiens
ttcatttgccatcagtgtaatg

SEQ ID NO: 7541697 - DNA, 22 bp, Homo sapiens
ttcatttttaccgcgtgtcaaa

SEQ ID NO: 7541698 - DNA, 22 bp, Homo sapiens
ttcatttttaccgcgtgtcaaa

SEQ ID NO: 7541699 - DNA, 22 bp, Homo sapiens
ttcatttttaccgcgtgtcaaa

SEQ ID NO: 7541700 - DNA, 22 bp, Homo sapiens
ttccaggaacaaactcacctta

SEQ ID NO: 7541701 - DNA, 22 bp, Homo sapiens
ttcattttctttcacgctgctg

SEQ ID NO: 7541702 - DNA, 22 bp, Homo sapiens
ttcattttctttcacgctgctg

SEQ ID NO: 7541703 - DNA, 22 bp, Homo sapiens
ttcattttctttcacgctgctg

SEQ ID NO: 7541704 - DNA, 22 bp, Homo sapiens
ttcattttctttcacgctgctg

SEQ ID NO: 7541705 - DNA, 22 bp, Homo sapiens
ttcatttgttgacagagacatg

SEQ ID NO: 7541706 - DNA, 22 bp, Homo sapiens
ttcatttgttgacagagacatg

SEQ ID NO: 7541707 - DNA, 21 bp, Homo sapiens
ttcatttgttatagacaaagt

SEQ ID NO: 7541708 - DNA, 22 bp, Homo sapiens
ttcatttgtgtgcctgatgcaa

SEQ ID NO: 7541709 - DNA, 22 bp, Homo sapiens
ttcatttgtgtgcctgatgcaa

SEQ ID NO: 7541710 - DNA, 22 bp, Homo sapiens
ttcattttataaaccctgctga

SEQ ID NO: 7541711 - DNA, 22 bp, Homo sapiens
ttcattttataaaccctgctga

SEQ ID NO: 7541712 - DNA, 22 bp, Homo sapiens
ttccaggaacagatgaaggttg

SEQ ID NO: 7541713 - DNA, 22 bp, Homo sapiens
ttccaggaacagatgaaggttg

SEQ ID NO: 7541714 - DNA, 22 bp, Homo sapiens
ttccaggaacactctgtgtccc

SEQ ID NO: 7541715 - DNA, 22 bp, Homo sapiens
ttccaggaacactctgtgtccc

SEQ ID NO: 7541716 - DNA, 22 bp, Homo sapiens
ttccaggaagacatctcaggaa

SEQ ID NO: 7541717 - DNA, 22 bp, Homo sapiens
ttccaggaagacatctcaggaa

SEQ ID NO: 7541718 - DNA, 22 bp, Homo sapiens
ttccaggaagacatctcaggaa

SEQ ID NO: 7541719 - DNA, 22 bp, Homo sapiens
ttccaggaacagatgaaggttg

SEQ ID NO: 7541720 - DNA, 22 bp, Homo sapiens
ttccaggaagattcaacaaaag

SEQ ID NO: 7541721 - DNA, 22 bp, Homo sapiens
ttccaggaagcagttagcagcc

SEQ ID NO: 7541722 - DNA, 22 bp, Homo sapiens
ttccaggaagcagttagcagcc

SEQ ID NO: 7541723 - DNA, 22 bp, Homo sapiens
ttccaggaagcagttagcagcc

SEQ ID NO: 7541724 - DNA, 23 bp, Homo sapiens
ttccaggcagagcagggattaga

SEQ ID NO: 7541725 - DNA, 22 bp, Homo sapiens
ttccaggcagaacaatcatgct

SEQ ID NO: 7541726 - DNA, 22 bp, Homo sapiens
ttccaggaattcagctctcagt

SEQ ID NO: 7541727 - DNA, 22 bp, Homo sapiens
ttccaggaattcagctctcagt

SEQ ID NO: 7541728 - DNA, 22 bp, Homo sapiens
ttccaggaagtgactatgtcat

SEQ ID NO: 7541729 - DNA, 22 bp, Homo sapiens
ttccaggaagtgactatgtcat

SEQ ID NO: 7541730 - DNA, 22 bp, Homo sapiens
ttccaggaagctctcggcctct

SEQ ID NO: 7541731 - DNA, 22 bp, Homo sapiens
ttccaggaagctctcggcctct

SEQ ID NO: 7541732 - DNA, 22 bp, Homo sapiens
ttccaggaagctctcggcctct

SEQ ID NO: 7541733 - DNA, 22 bp, Homo sapiens
ttccagtgatgggcaatttggt

SEQ ID NO: 7541734 - DNA, 22 bp, Homo sapiens
ttccagtgggctgggagtaagg

SEQ ID NO: 7541735 - DNA, 22 bp, Homo sapiens
ttccagtgatatattagtgcaa

SEQ ID NO: 7541736 - DNA, 22 bp, Homo sapiens
ttccagtgggaaagcatagcca

SEQ ID NO: 7541737 - DNA, 22 bp, Homo sapiens
ttccagtgtgcttttatgttag

SEQ ID NO: 7541738 - DNA, 22 bp, Homo sapiens
ttccagtgtgcttttatgttag

SEQ ID NO: 7541739 - DNA, 22 bp, Homo sapiens
ttccagtgggctgggagtaagg

SEQ ID NO: 7541740 - DNA, 22 bp, Homo sapiens
ttccagtgaccatagagtatgg

SEQ ID NO: 7541741 - DNA, 22 bp, Homo sapiens
ttccagtgactaagcttctgct

SEQ ID NO: 7541742 - DNA, 23 bp, Homo sapiens
ttccagtgagactgagaggtctt

SEQ ID NO: 7541743 - DNA, 22 bp, Homo sapiens
ttccagttcaaattggccaata

SEQ ID NO: 7541744 - DNA, 22 bp, Homo sapiens
ttccagttaaggaagctattct

SEQ ID NO: 7541745 - DNA, 22 bp, Homo sapiens
ttccagttaaggaagctattct

SEQ ID NO: 7541746 - DNA, 22 bp, Homo sapiens
ttccagttcactccatttctgg

SEQ ID NO: 7541747 - DNA, 22 bp, Homo sapiens
ttccagttcactccatttctgg

SEQ ID NO: 7541748 - DNA, 22 bp, Homo sapiens
ttccagttcccatgaggattaa

SEQ ID NO: 7541749 - DNA, 19 bp, Homo sapiens
ttccagttctaatctcttc

SEQ ID NO: 7541750 - DNA, 22 bp, Homo sapiens
ttccagtgaccatagagtatgg

SEQ ID NO: 7541751 - DNA, 22 bp, Homo sapiens
ttccagtgaccatagagtatgg

SEQ ID NO: 7541752 - DNA, 22 bp, Homo sapiens
ttccagtgaaacatgaggtgtg

SEQ ID NO: 7541753 - DNA, 22 bp, Homo sapiens
ttccagtctttccaacatttca

SEQ ID NO: 7541754 - DNA, 22 bp, Homo sapiens
ttccagtgaaacatgaggtgtg

SEQ ID NO: 7541755 - DNA, 22 bp, Homo sapiens
ttccagtgaaacatgaggtgtg

SEQ ID NO: 7541756 - DNA, 22 bp, Homo sapiens
ttccagtctggcctgtgcttag

SEQ ID NO: 7541757 - DNA, 22 bp, Homo sapiens
ttccagtctggcctgtgcttag

SEQ ID NO: 7541758 - DNA, 22 bp, Homo sapiens
ttccagtctttccaacatttca

SEQ ID NO: 7541759 - DNA, 22 bp, Homo sapiens
ttccagtctggcctgtgcttag

SEQ ID NO: 7541760 - DNA, 22 bp, Homo sapiens
ttccagtctagtacctggatgc

SEQ ID NO: 7541761 - DNA, 22 bp, Homo sapiens
ttccagtctggcctgtgcttag

SEQ ID NO: 7541762 - DNA, 22 bp, Homo sapiens
ttccagtcgcttaaacctgagc

SEQ ID NO: 7541763 - DNA, 22 bp, Homo sapiens
ttccagtctagtacctggatgc

SEQ ID NO: 7541764 - DNA, 18 bp, Homo sapiens
ttccagtagctgtatcac

SEQ ID NO: 7541765 - DNA, 18 bp, Homo sapiens
ttccagtagctgtatcac

SEQ ID NO: 7541766 - DNA, 22 bp, Homo sapiens
ttccagtacccagcgaaggcac

SEQ ID NO: 7541767 - DNA, 19 bp, Homo sapiens
ttccagtagattagatagc

SEQ ID NO: 7541768 - DNA, 22 bp, Homo sapiens
ttccaggtgttgctgtcttcct

SEQ ID NO: 7541769 - DNA, 22 bp, Homo sapiens
ttccagtaatgtgactttgagc

SEQ ID NO: 7541770 - DNA, 22 bp, Homo sapiens
ttccagtcaagtaagaatatct

SEQ ID NO: 7541771 - DNA, 22 bp, Homo sapiens
ttccagtcacaaaacatattaa

SEQ ID NO: 7541772 - DNA, 22 bp, Homo sapiens
ttccagtcagggcaaactgcca

SEQ ID NO: 7541773 - DNA, 22 bp, Homo sapiens
ttccagtcagtgtgagtttatt

SEQ ID NO: 7541774 - DNA, 22 bp, Homo sapiens
ttccagtcagtgtgagtttatt

SEQ ID NO: 7541775 - DNA, 22 bp, Homo sapiens
ttccagtccagggctgtttcca

SEQ ID NO: 7541776 - DNA, 22 bp, Homo sapiens
ttccagtccagggctgtttcca

SEQ ID NO: 7541777 - DNA, 22 bp, Homo sapiens
ttccagtccagggctgtttcca

SEQ ID NO: 7541778 - DNA, 22 bp, Homo sapiens
ttccaggctcttccaggctgtc

SEQ ID NO: 7541779 - DNA, 22 bp, Homo sapiens
ttccaggctcccttggaggtgt

SEQ ID NO: 7541780 - DNA, 22 bp, Homo sapiens
ttccaggctcttccaggctgtc

SEQ ID NO: 7541781 - DNA, 22 bp, Homo sapiens
ttccaggctcttccaggctgtc

SEQ ID NO: 7541782 - DNA, 22 bp, Homo sapiens
ttccaggctcttccaggctgtc

SEQ ID NO: 7541783 - DNA, 22 bp, Homo sapiens
ttccaggctcttccaggctgtc

SEQ ID NO: 7541784 - DNA, 22 bp, Homo sapiens
ttccaggctgatgggccacagg

SEQ ID NO: 7541785 - DNA, 22 bp, Homo sapiens
ttccaggctgatgggccacagg

SEQ ID NO: 7541786 - DNA, 22 bp, Homo sapiens
ttccaggctgatgggccacagg

SEQ ID NO: 7541787 - DNA, 22 bp, Homo sapiens
ttccaggctatccggtgaaggg

SEQ ID NO: 7541788 - DNA, 22 bp, Homo sapiens
ttccaggcgcacgtcggcctta

SEQ ID NO: 7541789 - DNA, 22 bp, Homo sapiens
ttccaggcgcacgtcggcctta

SEQ ID NO: 7541790 - DNA, 22 bp, Homo sapiens
ttccaggcgcacgtcggcctta

SEQ ID NO: 7541791 - DNA, 22 bp, Homo sapiens
ttccaggccagaatggtcacat

SEQ ID NO: 7541792 - DNA, 22 bp, Homo sapiens
ttccaggctattccctttggag

SEQ ID NO: 7541793 - DNA, 22 bp, Homo sapiens
ttccaggccagaatggtcacat

SEQ ID NO: 7541794 - DNA, 22 bp, Homo sapiens
ttccaggccagaatggtcacat

SEQ ID NO: 7541795 - DNA, 22 bp, Homo sapiens
ttccaggcattacagggtttgc

SEQ ID NO: 7541796 - DNA, 22 bp, Homo sapiens
ttccaggcattaaagtttctcc

SEQ ID NO: 7541797 - DNA, 22 bp, Homo sapiens
ttccagggctaggtaatgggta

SEQ ID NO: 7541798 - DNA, 22 bp, Homo sapiens
ttccaggggcagcagtgatggt

SEQ ID NO: 7541799 - DNA, 22 bp, Homo sapiens
ttccaggggcagcagtgatggt

SEQ ID NO: 7541800 - DNA, 22 bp, Homo sapiens
ttccagggctaggtaatgggta

SEQ ID NO: 7541801 - DNA, 22 bp, Homo sapiens
ttccagggttaatttatatggt

SEQ ID NO: 7541802 - DNA, 22 bp, Homo sapiens
ttccagggttaatttatatggt

SEQ ID NO: 7541803 - DNA, 22 bp, Homo sapiens
ttccaggggcagcagtgatggt

SEQ ID NO: 7541804 - DNA, 22 bp, Homo sapiens
ttccaggtcgccataggtttga

SEQ ID NO: 7541805 - DNA, 19 bp, Homo sapiens
ttccaggtgctgtggggag

SEQ ID NO: 7541806 - DNA, 22 bp, Homo sapiens
ttccagggctaattcctgtgga

SEQ ID NO: 7541807 - DNA, 22 bp, Homo sapiens
ttccagggctaattcctgtgga

SEQ ID NO: 7541808 - DNA, 22 bp, Homo sapiens
ttccagggcagcaagtgaatgg

SEQ ID NO: 7541809 - DNA, 22 bp, Homo sapiens
ttccagggaagagcaaggcagt

SEQ ID NO: 7541810 - DNA, 22 bp, Homo sapiens
ttccagggaagagcaaggcagt

SEQ ID NO: 7541811 - DNA, 22 bp, Homo sapiens
ttccaggcttctctggggcgtc

SEQ ID NO: 7541812 - DNA, 22 bp, Homo sapiens
ttccaggctgcagttgtagtta

SEQ ID NO: 7541813 - DNA, 22 bp, Homo sapiens
ttccaggctgcagttgtagtta

SEQ ID NO: 7541814 - DNA, 22 bp, Homo sapiens
ttccaggctgcagttttctagt

SEQ ID NO: 7541815 - DNA, 22 bp, Homo sapiens
ttccaggctgcagttttctagt

SEQ ID NO: 7541816 - DNA, 22 bp, Homo sapiens
ttccaggctgcacagttgggac

SEQ ID NO: 7541817 - DNA, 22 bp, Homo sapiens
ttcacaggatatatgtgcaggg

SEQ ID NO: 7541818 - DNA, 22 bp, Homo sapiens
ttcacaggatatatgtgcaggg

SEQ ID NO: 7541819 - DNA, 22 bp, Homo sapiens
ttcacaggcttggaggtggggg

SEQ ID NO: 7541820 - DNA, 22 bp, Homo sapiens
ttcacagcttaataaggctcag

SEQ ID NO: 7541821 - DNA, 22 bp, Homo sapiens
ttcacaggaatgtaggggtctt

SEQ ID NO: 7541822 - DNA, 22 bp, Homo sapiens
ttcacaggagggtggatgcatg

SEQ ID NO: 7541823 - DNA, 22 bp, Homo sapiens
ttcacagggccactggcaggag

SEQ ID NO: 7541824 - DNA, 22 bp, Homo sapiens
ttcacagggcagcagctgagcc

SEQ ID NO: 7541825 - DNA, 22 bp, Homo sapiens
ttcacagggcagcagctgagcc

SEQ ID NO: 7541826 - DNA, 22 bp, Homo sapiens
ttcagacttcttgactggcttt

SEQ ID NO: 7541827 - DNA, 22 bp, Homo sapiens
ttcagagaaactgaggtttaga

SEQ ID NO: 7541828 - DNA, 22 bp, Homo sapiens
ttcagagaaactgaggtttaga

SEQ ID NO: 7541829 - DNA, 22 bp, Homo sapiens
ttcagagaagcaaaggcagatt

SEQ ID NO: 7541830 - DNA, 22 bp, Homo sapiens
ttcagagaacttcatggaagag

SEQ ID NO: 7541831 - DNA, 22 bp, Homo sapiens
ttcagagaacttcatggaagag

SEQ ID NO: 7541832 - DNA, 22 bp, Homo sapiens
ttcagagaacttcatggaagag

SEQ ID NO: 7541833 - DNA, 22 bp, Homo sapiens
ttcagagaacttcatggaagag

SEQ ID NO: 7541834 - DNA, 22 bp, Homo sapiens
ttcagagaaagcagatttactc

SEQ ID NO: 7541835 - DNA, 22 bp, Homo sapiens
ttcagagaaagcagatttactc

SEQ ID NO: 7541836 - DNA, 22 bp, Homo sapiens
ttcagagaaaggaaagccggat

SEQ ID NO: 7541837 - DNA, 22 bp, Homo sapiens
ttcagagatgacacctggtgtt

SEQ ID NO: 7541838 - DNA, 22 bp, Homo sapiens
ttcagagagtttgtgagtcctt

SEQ ID NO: 7541839 - DNA, 20 bp, Homo sapiens
ttcagagatagggtctttaa

SEQ ID NO: 7541840 - DNA, 20 bp, Homo sapiens
ttcagagatagggtctttaa

SEQ ID NO: 7541841 - DNA, 22 bp, Homo sapiens
ttcagagagtttgtgagtcctt

SEQ ID NO: 7541842 - DNA, 22 bp, Homo sapiens
ttcagagagtttgtgagtcctt

SEQ ID NO: 7541843 - DNA, 22 bp, Homo sapiens
ttcagagagtccagtatgcagt

SEQ ID NO: 7541844 - DNA, 22 bp, Homo sapiens
ttcagagagtccagtatgcagt

SEQ ID NO: 7541845 - DNA, 22 bp, Homo sapiens
ttcagagagtccagtatgcagt

SEQ ID NO: 7541846 - DNA, 22 bp, Homo sapiens
ttcagagatgacacctggtgtt

SEQ ID NO: 7541847 - DNA, 22 bp, Homo sapiens
ttcagagatgacacctggtgtt

SEQ ID NO: 7541848 - DNA, 22 bp, Homo sapiens
ttcagagatggaaggcagaatg

SEQ ID NO: 7541849 - DNA, 22 bp, Homo sapiens
ttcagagatggaaggcagaatg

SEQ ID NO: 7541850 - DNA, 22 bp, Homo sapiens
ttcagagccacttcaagtctaa

SEQ ID NO: 7541851 - DNA, 22 bp, Homo sapiens
ttcagagcatctctaaagccag

SEQ ID NO: 7541852 - DNA, 22 bp, Homo sapiens
ttcagagatggaaggcagaatg

SEQ ID NO: 7541853 - DNA, 22 bp, Homo sapiens
ttcagagaattggataattcgt

SEQ ID NO: 7541854 - DNA, 22 bp, Homo sapiens
ttcagagacagcaaccaggaca

SEQ ID NO: 7541855 - DNA, 22 bp, Homo sapiens
ttcagagacagcaaccaggaca

SEQ ID NO: 7541856 - DNA, 22 bp, Homo sapiens
ttcagagacatgttctagatca

SEQ ID NO: 7541857 - DNA, 22 bp, Homo sapiens
ttcagagaattggataattcgt

SEQ ID NO: 7541858 - DNA, 22 bp, Homo sapiens
ttcagagaagtgcacaaaatca

SEQ ID NO: 7541859 - DNA, 22 bp, Homo sapiens
ttcagagaagtgcacaaaatca

SEQ ID NO: 7541860 - DNA, 22 bp, Homo sapiens
ttcagagaagtgcacaaaatca

SEQ ID NO: 7541861 - DNA, 22 bp, Homo sapiens
ttcagagaagcaaaggcagatt

SEQ ID NO: 7541862 - DNA, 22 bp, Homo sapiens
ttcagagaagcaaaggcagatt

SEQ ID NO: 7541863 - DNA, 22 bp, Homo sapiens
ttcagagagtacagttgctggc

SEQ ID NO: 7541864 - DNA, 22 bp, Homo sapiens
ttcagagagtacagttgctggc

SEQ ID NO: 7541865 - DNA, 22 bp, Homo sapiens
ttcagagagtacagttgctggc

SEQ ID NO: 7541866 - DNA, 22 bp, Homo sapiens
ttcagagagaaaccagtgggaa

SEQ ID NO: 7541867 - DNA, 22 bp, Homo sapiens
ttcagagagaccaagtggcgtg

SEQ ID NO: 7541868 - DNA, 22 bp, Homo sapiens
ttcagagagaccaagtggcgtg

SEQ ID NO: 7541869 - DNA, 22 bp, Homo sapiens
ttcagagagaccaagtggcgtg

SEQ ID NO: 7541870 - DNA, 22 bp, Homo sapiens
ttcagagacatgttctagatca

SEQ ID NO: 7541871 - DNA, 22 bp, Homo sapiens
ttcagagagaaaccagtgggaa

SEQ ID NO: 7541872 - DNA, 22 bp, Homo sapiens
ttcagagagaaaccagtgggaa

SEQ ID NO: 7541873 - DNA, 22 bp, Homo sapiens
ttcagagagaaaccagtgggaa

SEQ ID NO: 7541874 - DNA, 22 bp, Homo sapiens
ttcagcaactgagtgtctttta

SEQ ID NO: 7541875 - DNA, 22 bp, Homo sapiens
ttcagcaactgagtgtctttta

SEQ ID NO: 7541876 - DNA, 22 bp, Homo sapiens
ttcagcaactcaaacctattag

SEQ ID NO: 7541877 - DNA, 22 bp, Homo sapiens
ttcagcaacctataaatcccag

SEQ ID NO: 7541878 - DNA, 22 bp, Homo sapiens
ttcagcaacctataaatcccag

SEQ ID NO: 7541879 - DNA, 22 bp, Homo sapiens
ttcagcaaccagaaaggctggg

SEQ ID NO: 7541880 - DNA, 22 bp, Homo sapiens
ttcagcaagaccaccatgtacc

SEQ ID NO: 7541881 - DNA, 22 bp, Homo sapiens
ttcagcaagaccaccatgtacc

SEQ ID NO: 7541882 - DNA, 22 bp, Homo sapiens
ttcagcaagaccaccatgtacc

SEQ ID NO: 7541883 - DNA, 22 bp, Homo sapiens
ttcagcaagaatttactgagct

SEQ ID NO: 7541884 - DNA, 22 bp, Homo sapiens
ttcagcaatgggatggtgcagg

SEQ ID NO: 7541885 - DNA, 22 bp, Homo sapiens
ttcagcaatgggatggtgcagg

SEQ ID NO: 7541886 - DNA, 22 bp, Homo sapiens
ttcagcaatgggatggtgcagg

SEQ ID NO: 7541887 - DNA, 22 bp, Homo sapiens
ttcagcaaggcatgtgcaggag

SEQ ID NO: 7541888 - DNA, 21 bp, Homo sapiens
ttcagcaagcactctggacac

SEQ ID NO: 7541889 - DNA, 21 bp, Homo sapiens
ttcagcaagcactctggacac

SEQ ID NO: 7541890 - DNA, 22 bp, Homo sapiens
ttcagcaagtgtctctactgtc

SEQ ID NO: 7541891 - DNA, 22 bp, Homo sapiens
ttcagagccagcaacactaggc

SEQ ID NO: 7541892 - DNA, 22 bp, Homo sapiens
ttcagagctggtgtctacagct

SEQ ID NO: 7541893 - DNA, 22 bp, Homo sapiens
ttcagcaaatggcttgagataa

SEQ ID NO: 7541894 - DNA, 22 bp, Homo sapiens
ttcagcaaatggactgttcagg

SEQ ID NO: 7541895 - DNA, 22 bp, Homo sapiens
ttcagcaaatggcttgagataa

SEQ ID NO: 7541896 - DNA, 22 bp, Homo sapiens
ttcagcaaatggcttgagataa

SEQ ID NO: 7541897 - DNA, 22 bp, Homo sapiens
ttcagagcttagaatggactac

SEQ ID NO: 7541898 - DNA, 18 bp, Homo sapiens
ttcagcagcagacacact

SEQ ID NO: 7541899 - DNA, 21 bp, Homo sapiens
ttcagcagcatgttgtctgtt

SEQ ID NO: 7541900 - DNA, 21 bp, Homo sapiens
ttcagcagcatgttgtctgtt

SEQ ID NO: 7541901 - DNA, 18 bp, Homo sapiens
ttcagcagcagacacact

SEQ ID NO: 7541902 - DNA, 22 bp, Homo sapiens
ttcagtgtccctagtagaagtt

SEQ ID NO: 7541903 - DNA, 22 bp, Homo sapiens
ttcagtgtccctagtagaagtt

SEQ ID NO: 7541904 - DNA, 22 bp, Homo sapiens
ttcagtgtccctagtagaagtt

SEQ ID NO: 7541905 - DNA, 22 bp, Homo sapiens
ttcagtgtcacaagagcaagcc

SEQ ID NO: 7541906 - DNA, 22 bp, Homo sapiens
ttcagtgtgaagcttctgaaag

SEQ ID NO: 7541907 - DNA, 22 bp, Homo sapiens
ttcagtgtgaagcttctgaaag

SEQ ID NO: 7541908 - DNA, 22 bp, Homo sapiens
ttcagtgtgaagcttctgaaag

SEQ ID NO: 7541909 - DNA, 22 bp, Homo sapiens
ttcagtgtgcctaagtcagttg

SEQ ID NO: 7541910 - DNA, 22 bp, Homo sapiens
ttcagtgtgcctaagtcagttg

SEQ ID NO: 7541911 - DNA, 22 bp, Homo sapiens
ttcagtgtgaagcttctgaaag

SEQ ID NO: 7541912 - DNA, 22 bp, Homo sapiens
ttcagtgtgcctaagtcagttg

SEQ ID NO: 7541913 - DNA, 22 bp, Homo sapiens
ttcagtgtgcctaagtcagttg

SEQ ID NO: 7541914 - DNA, 22 bp, Homo sapiens
ttcagtgtgcctaagtcagttg

SEQ ID NO: 7541915 - DNA, 22 bp, Homo sapiens
ttcagtgtgcttcaggacgtta

SEQ ID NO: 7541916 - DNA, 22 bp, Homo sapiens
ttcagtgtgcttcaggacgtta

SEQ ID NO: 7541917 - DNA, 19 bp, Homo sapiens
ttcagtgtgctggctcctg

SEQ ID NO: 7541918 - DNA, 19 bp, Homo sapiens
ttcagtgtgctggctcctg

SEQ ID NO: 7541919 - DNA, 22 bp, Homo sapiens
ttcagcagagaaattacataat

SEQ ID NO: 7541920 - DNA, 22 bp, Homo sapiens
ttcagcagagaaattacataat

SEQ ID NO: 7541921 - DNA, 22 bp, Homo sapiens
ttcagcagatccctaagtcctg

SEQ ID NO: 7541922 - DNA, 18 bp, Homo sapiens
ttcagcagcagacacact

SEQ ID NO: 7541923 - DNA, 18 bp, Homo sapiens
ttcagcagcagacacact

SEQ ID NO: 7541924 - DNA, 22 bp, Homo sapiens
ttcagcactgttatggatttgc

SEQ ID NO: 7541925 - DNA, 22 bp, Homo sapiens
ttcagcactgactgagtggtta

SEQ ID NO: 7541926 - DNA, 22 bp, Homo sapiens
ttcagcacaagactagacaggt

SEQ ID NO: 7541927 - DNA, 22 bp, Homo sapiens
ttcagcaattttttaagctaat

SEQ ID NO: 7541928 - DNA, 22 bp, Homo sapiens
ttcagcaccctctgaggcatcc

SEQ ID NO: 7541929 - DNA, 22 bp, Homo sapiens
ttcagcaccacttccagagaag

SEQ ID NO: 7541930 - DNA, 22 bp, Homo sapiens
ttcagcacagttcaagatggta

SEQ ID NO: 7541931 - DNA, 20 bp, Homo sapiens
ttcacagaggactcaggtca

SEQ ID NO: 7541932 - DNA, 20 bp, Homo sapiens
ttcacagaggactcaggtca

SEQ ID NO: 7541933 - DNA, 22 bp, Homo sapiens
ttcacagagttatttttatgct

SEQ ID NO: 7541934 - DNA, 22 bp, Homo sapiens
ttcacagagttatttttatgct

SEQ ID NO: 7541935 - DNA, 22 bp, Homo sapiens
ttcacagagcttgttcatggcc

SEQ ID NO: 7541936 - DNA, 22 bp, Homo sapiens
ttcacagagcgggatgctggga

SEQ ID NO: 7541937 - DNA, 22 bp, Homo sapiens
ttcacagagcttgttcatggcc

SEQ ID NO: 7541938 - DNA, 20 bp, Homo sapiens
ttcacagaggactcaggtca

SEQ ID NO: 7541939 - DNA, 22 bp, Homo sapiens
ttcacagagagtatgcagagaa

SEQ ID NO: 7541940 - DNA, 22 bp, Homo sapiens
ttcacagagagtatgcagagaa

SEQ ID NO: 7541941 - DNA, 22 bp, Homo sapiens
ttcacagagagtatgcagagaa

SEQ ID NO: 7541942 - DNA, 22 bp, Homo sapiens
ttcacagagagaactcaaacca

SEQ ID NO: 7541943 - DNA, 22 bp, Homo sapiens
ttcacagagagaactcaaacca

SEQ ID NO: 7541944 - DNA, 22 bp, Homo sapiens
ttcacagagcactgccaagtac

SEQ ID NO: 7541945 - DNA, 22 bp, Homo sapiens
ttcacagagcgggatgctggga

SEQ ID NO: 7541946 - DNA, 22 bp, Homo sapiens
ttcacagagagtatgcagagaa

SEQ ID NO: 7541947 - DNA, 22 bp, Homo sapiens
ttcacagagcactgccaagtac

SEQ ID NO: 7541948 - DNA, 22 bp, Homo sapiens
ttcacagatgcctgatgtgtgg

SEQ ID NO: 7541949 - DNA, 21 bp, Homo sapiens
ttcacagatgggaaaactgag

SEQ ID NO: 7541950 - DNA, 22 bp, Homo sapiens
ttcacagatgcctgatgtgtgg

SEQ ID NO: 7541951 - DNA, 22 bp, Homo sapiens
ttcacagatgagaaaattgagg

SEQ ID NO: 7541952 - DNA, 21 bp, Homo sapiens
ttcacagatgggaaaactgag

SEQ ID NO: 7541953 - DNA, 21 bp, Homo sapiens
ttcacagatgggaaaactgag

SEQ ID NO: 7541954 - DNA, 21 bp, Homo sapiens
ttcacagatgggaaaactgag

SEQ ID NO: 7541955 - DNA, 21 bp, Homo sapiens
ttcacagatgggaaaactgag

SEQ ID NO: 7541956 - DNA, 22 bp, Homo sapiens
ttcacagatgagaaaattgagg

SEQ ID NO: 7541957 - DNA, 22 bp, Homo sapiens
ttcacagatgagaaaattgagg

SEQ ID NO: 7541958 - DNA, 22 bp, Homo sapiens
ttcacagatgagaaaattgagg

SEQ ID NO: 7541959 - DNA, 18 bp, Homo sapiens
ttcacagatccacaggaa

SEQ ID NO: 7541960 - DNA, 22 bp, Homo sapiens
ttcacagatgagaaaattgagg

SEQ ID NO: 7541961 - DNA, 22 bp, Homo sapiens
ttcacagataacacaggcaaat

SEQ ID NO: 7541962 - DNA, 22 bp, Homo sapiens
ttcacagataacacaggcaaat

SEQ ID NO: 7541963 - DNA, 22 bp, Homo sapiens
ttcacagatttccctgcacatg

SEQ ID NO: 7541964 - DNA, 22 bp, Homo sapiens
ttcacagattgactggattcct

SEQ ID NO: 7541965 - DNA, 23 bp, Homo sapiens
ttcacagattaaatatttcttct

SEQ ID NO: 7541966 - DNA, 22 bp, Homo sapiens
ttcacagcctctgccccaggca

SEQ ID NO: 7541967 - DNA, 22 bp, Homo sapiens
ttcacagcctctgccccaggca

SEQ ID NO: 7541968 - DNA, 22 bp, Homo sapiens
ttcacagcctctgccccaggca

SEQ ID NO: 7541969 - DNA, 22 bp, Homo sapiens
ttcacagctaagagctaagtaa

SEQ ID NO: 7541970 - DNA, 22 bp, Homo sapiens
ttcacagctaagagctaagtaa

SEQ ID NO: 7541971 - DNA, 22 bp, Homo sapiens
ttcacagcctctgccccaggca

SEQ ID NO: 7541972 - DNA, 22 bp, Homo sapiens
ttcacagatttccctgcacatg

SEQ ID NO: 7541973 - DNA, 23 bp, Homo sapiens
ttcacagattaaatatttcttct

SEQ ID NO: 7541974 - DNA, 22 bp, Homo sapiens
ttcacagatgtattggaactcc

SEQ ID NO: 7541975 - DNA, 22 bp, Homo sapiens
ttcacagatgtattggaactcc

SEQ ID NO: 7541976 - DNA, 21 bp, Homo sapiens
ttcacagatgggaaaactgag

SEQ ID NO: 7541977 - DNA, 22 bp, Homo sapiens
ttcacagatgtattggaactcc

SEQ ID NO: 7541978 - DNA, 22 bp, Homo sapiens
ttcacagctcatactgttctca

SEQ ID NO: 7541979 - DNA, 22 bp, Homo sapiens
ttcacagctcatactgttctca

SEQ ID NO: 7541980 - DNA, 22 bp, Homo sapiens
ttcacagctcatactgttctca

SEQ ID NO: 7541981 - DNA, 22 bp, Homo sapiens
ttcacagctaagagctaagtaa

SEQ ID NO: 7541982 - DNA, 22 bp, Homo sapiens
ttcacagctaagagctaagtaa

SEQ ID NO: 7541983 - DNA, 22 bp, Homo sapiens
ttcacagctaagagctaagtaa

SEQ ID NO: 7541984 - DNA, 22 bp, Homo sapiens
ttcacagctccttttactcaac

SEQ ID NO: 7541985 - DNA, 22 bp, Homo sapiens
ttcacagctcatactgttctca

SEQ ID NO: 7541986 - DNA, 22 bp, Homo sapiens
ttcacagctccttttactcaac

SEQ ID NO: 7541987 - DNA, 22 bp, Homo sapiens
ttcacagctccttttactcaac

SEQ ID NO: 7541988 - DNA, 22 bp, Homo sapiens
ttcacagctccttttactcaac

SEQ ID NO: 7541989 - DNA, 19 bp, Homo sapiens
ttcacagctctgtgtcagt

SEQ ID NO: 7541990 - DNA, 22 bp, Homo sapiens
ttcacagctccttttactcaac

SEQ ID NO: 7541991 - DNA, 22 bp, Homo sapiens
ttcacagcttaataaggctcag

SEQ ID NO: 7541992 - DNA, 19 bp, Homo sapiens
ttcacagctctgtgtcagt

SEQ ID NO: 7541993 - DNA, 19 bp, Homo sapiens
ttcacagctctgtgtcagt

SEQ ID NO: 7541994 - DNA, 19 bp, Homo sapiens
ttcacagctctgtgtcagt

SEQ ID NO: 7541995 - DNA, 19 bp, Homo sapiens
ttcacagctctgtgtcagt

SEQ ID NO: 7541996 - DNA, 22 bp, Homo sapiens
ttcacagcttaataaggctcag

SEQ ID NO: 7541997 - DNA, 18 bp, Homo sapiens
ttcacaggaaatgtcttt

SEQ ID NO: 7541998 - DNA, 22 bp, Homo sapiens
ttcacaataggagcatgcaaat

SEQ ID NO: 7541999 - DNA, 22 bp, Homo sapiens
ttcacaatctggcttagcattg

SEQ ID NO: 7542000 - DNA, 23 bp, Homo sapiens
ttcaaagcttaagctctttccac

SEQ ID NO: 7542001 - DNA, 23 bp, Homo sapiens
ttcaaagcttaagctctttccac

SEQ ID NO: 7542002 - DNA, 22 bp, Homo sapiens
ttcacaataggagcatgcaaat

SEQ ID NO: 7542003 - DNA, 22 bp, Homo sapiens
ttcacaataggagcatgcaaat

SEQ ID NO: 7542004 - DNA, 22 bp, Homo sapiens
ttcacaataggagcatgcaaat

SEQ ID NO: 7542005 - DNA, 22 bp, Homo sapiens
ttcacaatctggcttagcattg

SEQ ID NO: 7542006 - DNA, 22 bp, Homo sapiens
ttcacaatctggcttagcattg

SEQ ID NO: 7542007 - DNA, 22 bp, Homo sapiens
ttcacaatgccagcaaccactt

SEQ ID NO: 7542008 - DNA, 22 bp, Homo sapiens
ttcacaatgccagcaaccactt

SEQ ID NO: 7542009 - DNA, 22 bp, Homo sapiens
ttcacaatgccagcaaccactt

SEQ ID NO: 7542010 - DNA, 22 bp, Homo sapiens
ttcacaatgccttgttgatggt

SEQ ID NO: 7542011 - DNA, 22 bp, Homo sapiens
ttcacaatgccttgttgatggt

SEQ ID NO: 7542012 - DNA, 22 bp, Homo sapiens
ttcacaatggcaaaccattaaa

SEQ ID NO: 7542013 - DNA, 22 bp, Homo sapiens
ttcacaatggcaaaccattaaa

SEQ ID NO: 7542014 - DNA, 22 bp, Homo sapiens
ttcacagactttccatagattg

SEQ ID NO: 7542015 - DNA, 22 bp, Homo sapiens
ttcacaattaactttatactta

SEQ ID NO: 7542016 - DNA, 22 bp, Homo sapiens
ttcacagactttccatagattg

SEQ ID NO: 7542017 - DNA, 22 bp, Homo sapiens
ttcacaattaactttatactta

SEQ ID NO: 7542018 - DNA, 22 bp, Homo sapiens
ttcacaattaactttatactta

SEQ ID NO: 7542019 - DNA, 22 bp, Homo sapiens
ttcacaatggcaaaccattaaa

SEQ ID NO: 7542020 - DNA, 22 bp, Homo sapiens
ttcacaattaactttatactta

SEQ ID NO: 7542021 - DNA, 22 bp, Homo sapiens
ttcacaattaactttatactta

SEQ ID NO: 7542022 - DNA, 22 bp, Homo sapiens
ttcaaagattagcatacgcaat

SEQ ID NO: 7542023 - DNA, 22 bp, Homo sapiens
ttcaaagattttcccaaagctc

SEQ ID NO: 7542024 - DNA, 22 bp, Homo sapiens
ttcaaagcaagacacaattcct

SEQ ID NO: 7542025 - DNA, 22 bp, Homo sapiens
ttcaaagcaagacacaattcct

SEQ ID NO: 7542026 - DNA, 22 bp, Homo sapiens
ttcaaagctgcagactcctggg

SEQ ID NO: 7542027 - DNA, 22 bp, Homo sapiens
ttcaaagcaatagaaagagtga

SEQ ID NO: 7542028 - DNA, 22 bp, Homo sapiens
ttcaaagcaatagaaagagtga

SEQ ID NO: 7542029 - DNA, 22 bp, Homo sapiens
ttcaaagcaatagaaagagtga

SEQ ID NO: 7542030 - DNA, 22 bp, Homo sapiens
ttcaaagcagagggtcaataca

SEQ ID NO: 7542031 - DNA, 22 bp, Homo sapiens
ttcaaagatggagggatagatt

SEQ ID NO: 7542032 - DNA, 22 bp, Homo sapiens
ttcaaagatggagggatagatt

SEQ ID NO: 7542033 - DNA, 23 bp, Homo sapiens
ttcaaagatcttctgaaatctgt

SEQ ID NO: 7542034 - DNA, 22 bp, Homo sapiens
ttcaaagataattaccaaacat

SEQ ID NO: 7542035 - DNA, 22 bp, Homo sapiens
ttcaaagataattaccaaacat

SEQ ID NO: 7542036 - DNA, 23 bp, Homo sapiens
ttcaaagatcttctgaaatctgt

SEQ ID NO: 7542037 - DNA, 22 bp, Homo sapiens
ttcaaagagaaattgtattttc

SEQ ID NO: 7542038 - DNA, 21 bp, Homo sapiens
ttcaaagacttgatgctgacc

SEQ ID NO: 7542039 - DNA, 22 bp, Homo sapiens
ttcaaagagaaattgtattttc

SEQ ID NO: 7542040 - DNA, 21 bp, Homo sapiens
ttcaaagacttgatgctgacc

SEQ ID NO: 7542041 - DNA, 22 bp, Homo sapiens
ttcaaagaccttacttggcaaa

SEQ ID NO: 7542042 - DNA, 22 bp, Homo sapiens
ttcaaactgtgtaatttataaa

SEQ ID NO: 7542043 - DNA, 22 bp, Homo sapiens
ttcaaacttaaggagcagcaga

SEQ ID NO: 7542044 - DNA, 22 bp, Homo sapiens
ttcaaagaattttgagacctga

SEQ ID NO: 7542045 - DNA, 22 bp, Homo sapiens
ttcaaagaccttacttggcaaa

SEQ ID NO: 7542046 - DNA, 20 bp, Homo sapiens
ttcaaagaccctcaggtcca

SEQ ID NO: 7542047 - DNA, 20 bp, Homo sapiens
ttcaaagaccctcaggtcca

SEQ ID NO: 7542048 - DNA, 20 bp, Homo sapiens
ttcaaagaccctcaggtcca

SEQ ID NO: 7542049 - DNA, 22 bp, Homo sapiens
ttcaaagataatgtagcatttt

SEQ ID NO: 7542050 - DNA, 22 bp, Homo sapiens
ttcaaagataattaccaaacat

SEQ ID NO: 7542051 - DNA, 22 bp, Homo sapiens
ttcaaagataatgtagcatttt

SEQ ID NO: 7542052 - DNA, 22 bp, Homo sapiens
ttcaaagataattaccaaacat

SEQ ID NO: 7542053 - DNA, 22 bp, Homo sapiens
ttcaaagagttgggtgtctggg

SEQ ID NO: 7542054 - DNA, 22 bp, Homo sapiens
ttcaaagagttgggtgtctggg

SEQ ID NO: 7542055 - DNA, 22 bp, Homo sapiens
ttcaaagataatgtagcatttt

SEQ ID NO: 7542056 - DNA, 22 bp, Homo sapiens
ttcaaagataatgtagcatttt

SEQ ID NO: 7542057 - DNA, 22 bp, Homo sapiens
ttcaaagataatgtagcatttt

SEQ ID NO: 7542058 - DNA, 22 bp, Homo sapiens
ttcaaagataatgtagcatttt

SEQ ID NO: 7542059 - DNA, 21 bp, Homo sapiens
ttcaaagagtgggcattgtca

SEQ ID NO: 7542060 - DNA, 21 bp, Homo sapiens
ttcaaagagtgggcattgtca

SEQ ID NO: 7542061 - DNA, 21 bp, Homo sapiens
ttcaaagagtgggcattgtca

SEQ ID NO: 7542062 - DNA, 22 bp, Homo sapiens
ttattatagattatgcaagatt

SEQ ID NO: 7542063 - DNA, 22 bp, Homo sapiens
ttattataatgagggataaaaa

SEQ ID NO: 7542064 - DNA, 22 bp, Homo sapiens
ttattatagattatgcaagatt

SEQ ID NO: 7542065 - DNA, 22 bp, Homo sapiens
ttattatagattatgcaagatt

SEQ ID NO: 7542066 - DNA, 22 bp, Homo sapiens
ttattatagattatgcaagatt

SEQ ID NO: 7542067 - DNA, 22 bp, Homo sapiens
ttattatagattatgcaagatt

SEQ ID NO: 7542068 - DNA, 22 bp, Homo sapiens
ttattatagattatgcaagatt

SEQ ID NO: 7542069 - DNA, 22 bp, Homo sapiens
ttattatagattatgcaagatt

SEQ ID NO: 7542070 - DNA, 22 bp, Homo sapiens
ttattatagattatgcaagatt

SEQ ID NO: 7542071 - DNA, 22 bp, Homo sapiens
ttattatggtatttctttgcag

SEQ ID NO: 7542072 - DNA, 22 bp, Homo sapiens
ttattatggtatttctttgcag

SEQ ID NO: 7542073 - DNA, 22 bp, Homo sapiens
ttattatgccattacctccctg

SEQ ID NO: 7542074 - DNA, 22 bp, Homo sapiens
ttattatagattatgcaagatt

SEQ ID NO: 7542075 - DNA, 22 bp, Homo sapiens
ttattatggcagttttctaggt

SEQ ID NO: 7542076 - DNA, 22 bp, Homo sapiens
ttattcttttctccagaatccc

SEQ ID NO: 7542077 - DNA, 22 bp, Homo sapiens
ttattctttaaacatatatgtt

SEQ ID NO: 7542078 - DNA, 22 bp, Homo sapiens
ttattcttttctccagaatccc

SEQ ID NO: 7542079 - DNA, 22 bp, Homo sapiens
ttattcttttctccagaatccc

SEQ ID NO: 7542080 - DNA, 22 bp, Homo sapiens
ttattctttaaacatatatgtt

SEQ ID NO: 7542081 - DNA, 22 bp, Homo sapiens
ttattctttaaacatatatgtt

SEQ ID NO: 7542082 - DNA, 22 bp, Homo sapiens
ttattctttaaacatatatgtt

SEQ ID NO: 7542083 - DNA, 22 bp, Homo sapiens
ttattatgtggatgaaagatgt

SEQ ID NO: 7542084 - DNA, 22 bp, Homo sapiens
ttattctttaaacatatatgtt

SEQ ID NO: 7542085 - DNA, 22 bp, Homo sapiens
ttattctttaaacatatatgtt

SEQ ID NO: 7542086 - DNA, 22 bp, Homo sapiens
ttattctttaaacatatatgtt

SEQ ID NO: 7542087 - DNA, 22 bp, Homo sapiens
ttattatgtgctagagaatgta

SEQ ID NO: 7542088 - DNA, 22 bp, Homo sapiens
ttattatgtgctagagaatgta

SEQ ID NO: 7542089 - DNA, 22 bp, Homo sapiens
ttattatgtgctagagaatgta

SEQ ID NO: 7542090 - DNA, 22 bp, Homo sapiens
ttattatgtggatgaaagatgt

SEQ ID NO: 7542091 - DNA, 22 bp, Homo sapiens
ttattatgtggatgaaagatgt

SEQ ID NO: 7542092 - DNA, 22 bp, Homo sapiens
ttattacactgaaagaattgcg

SEQ ID NO: 7542093 - DNA, 22 bp, Homo sapiens
ttattacactgaaagaattgcg

SEQ ID NO: 7542094 - DNA, 22 bp, Homo sapiens
ttattacactgaaagaattgcg

SEQ ID NO: 7542095 - DNA, 22 bp, Homo sapiens
ttattacactgaaagaattgcg

SEQ ID NO: 7542096 - DNA, 22 bp, Homo sapiens
ttattacactgaaagaattgcg

SEQ ID NO: 7542097 - DNA, 22 bp, Homo sapiens
ttattacaatgcagaaaataga

SEQ ID NO: 7542098 - DNA, 22 bp, Homo sapiens
ttattacaatgcagaaaataga

SEQ ID NO: 7542099 - DNA, 22 bp, Homo sapiens
ttattacaatgcagaaaataga

SEQ ID NO: 7542100 - DNA, 22 bp, Homo sapiens
ttattacactgaaagaattgcg

SEQ ID NO: 7542101 - DNA, 22 bp, Homo sapiens
ttattacactgaaagaattgcg

SEQ ID NO: 7542102 - DNA, 22 bp, Homo sapiens
ttattacaatgcagaaaataga

SEQ ID NO: 7542103 - DNA, 22 bp, Homo sapiens
ttattactgtattaatccagag

SEQ ID NO: 7542104 - DNA, 22 bp, Homo sapiens
ttattagagatatttggttagg

SEQ ID NO: 7542105 - DNA, 22 bp, Homo sapiens
ttattagagtgctttgagaaag

SEQ ID NO: 7542106 - DNA, 22 bp, Homo sapiens
ttattacagtcccagggagtag

SEQ ID NO: 7542107 - DNA, 22 bp, Homo sapiens
ttattactgtattaatccagag

SEQ ID NO: 7542108 - DNA, 22 bp, Homo sapiens
ttattacagtcccagggagtag

SEQ ID NO: 7542109 - DNA, 22 bp, Homo sapiens
ttattaccaagttgcaggggat

SEQ ID NO: 7542110 - DNA, 23 bp, Homo sapiens
ttattaccactccttgggggcct

SEQ ID NO: 7542111 - DNA, 22 bp, Homo sapiens
ttattataatgagggataaaaa

SEQ ID NO: 7542112 - DNA, 22 bp, Homo sapiens
ttattataatgagggataaaaa

SEQ ID NO: 7542113 - DNA, 22 bp, Homo sapiens
ttattagtgttgatattaggat

SEQ ID NO: 7542114 - DNA, 22 bp, Homo sapiens
ttattaggaaaaggtcagatgt

SEQ ID NO: 7542115 - DNA, 22 bp, Homo sapiens
ttattagatctgttagggatcc

SEQ ID NO: 7542116 - DNA, 22 bp, Homo sapiens
ttattagagtgctttgagaaag

SEQ ID NO: 7542117 - DNA, 22 bp, Homo sapiens
ttattagctgggcttcagggtg

SEQ ID NO: 7542118 - DNA, 22 bp, Homo sapiens
ttattagatctgttagggatcc

SEQ ID NO: 7542119 - DNA, 22 bp, Homo sapiens
ttattaaaatgcggatttggct

SEQ ID NO: 7542120 - DNA, 22 bp, Homo sapiens
ttattaaaatgcggatttggct

SEQ ID NO: 7542121 - DNA, 22 bp, Homo sapiens
ttattaaaatgcggatttggct

SEQ ID NO: 7542122 - DNA, 22 bp, Homo sapiens
ttatatgattgaagtgcataag

SEQ ID NO: 7542123 - DNA, 22 bp, Homo sapiens
ttatatgattgaagtgcataag

SEQ ID NO: 7542124 - DNA, 22 bp, Homo sapiens
ttatatgattgaagtgcataag

SEQ ID NO: 7542125 - DNA, 22 bp, Homo sapiens
ttatatgattgagcatcttggt

SEQ ID NO: 7542126 - DNA, 22 bp, Homo sapiens
ttatatgaactggactttagga

SEQ ID NO: 7542127 - DNA, 22 bp, Homo sapiens
ttatatgaactggactttagga

SEQ ID NO: 7542128 - DNA, 22 bp, Homo sapiens
ttatatctttttacatctctcc

SEQ ID NO: 7542129 - DNA, 20 bp, Homo sapiens
ttatatcataatgtgccaat

SEQ ID NO: 7542130 - DNA, 22 bp, Homo sapiens
ttatatgagtatcatatcactt

SEQ ID NO: 7542131 - DNA, 22 bp, Homo sapiens
ttatatgagtatcatatcactt

SEQ ID NO: 7542132 - DNA, 22 bp, Homo sapiens
ttatatgagtatcatatcactt

SEQ ID NO: 7542133 - DNA, 22 bp, Homo sapiens
ttatatatcttgatttgttcca

SEQ ID NO: 7542134 - DNA, 22 bp, Homo sapiens
ttatatcagaaggtgagattga

SEQ ID NO: 7542135 - DNA, 22 bp, Homo sapiens
ttatatcagaaggtgagattga

SEQ ID NO: 7542136 - DNA, 20 bp, Homo sapiens
ttatatcataatgtgccaat

SEQ ID NO: 7542137 - DNA, 22 bp, Homo sapiens
ttatatatcttgatttgttcca

SEQ ID NO: 7542138 - DNA, 22 bp, Homo sapiens
ttatatatcttgatttgttcca

SEQ ID NO: 7542139 - DNA, 22 bp, Homo sapiens
ttatatatcttgatttgttcca

SEQ ID NO: 7542140 - DNA, 22 bp, Homo sapiens
ttatatatcttgatttgttcca

SEQ ID NO: 7542141 - DNA, 22 bp, Homo sapiens
ttatatatcttgatttgttcca

SEQ ID NO: 7542142 - DNA, 22 bp, Homo sapiens
ttatatatcttgatttgttcca

SEQ ID NO: 7542143 - DNA, 22 bp, Homo sapiens
ttatatatcttgatttgttcca

SEQ ID NO: 7542144 - DNA, 22 bp, Homo sapiens
ttatatatcttgatttgttcca

SEQ ID NO: 7542145 - DNA, 22 bp, Homo sapiens
ttatatatatgtagaggtcacg

SEQ ID NO: 7542146 - DNA, 22 bp, Homo sapiens
ttatatatatgtagaggtcacg

SEQ ID NO: 7542147 - DNA, 22 bp, Homo sapiens
ttatatatatgtagaggtcacg

SEQ ID NO: 7542148 - DNA, 22 bp, Homo sapiens
ttatatatatgtagaggtcacg

SEQ ID NO: 7542149 - DNA, 22 bp, Homo sapiens
ttatatatatgtagaggtcacg

SEQ ID NO: 7542150 - DNA, 19 bp, Homo sapiens
ttatatacttggtttctct

SEQ ID NO: 7542151 - DNA, 19 bp, Homo sapiens
ttatatacttggtttctct

SEQ ID NO: 7542152 - DNA, 22 bp, Homo sapiens
ttattaatgagtacaagttatt

SEQ ID NO: 7542153 - DNA, 22 bp, Homo sapiens
ttattaatgagtacaagttatt

SEQ ID NO: 7542154 - DNA, 22 bp, Homo sapiens
ttattaatgagtacaagttatt

SEQ ID NO: 7542155 - DNA, 22 bp, Homo sapiens
ttattaatgagtacaagttatt

SEQ ID NO: 7542156 - DNA, 22 bp, Homo sapiens
ttattaatgagtacaagttatt

SEQ ID NO: 7542157 - DNA, 22 bp, Homo sapiens
ttattaatgagtacaagttatt

SEQ ID NO: 7542158 - DNA, 22 bp, Homo sapiens
ttattaatgagtacaagttatt

SEQ ID NO: 7542159 - DNA, 22 bp, Homo sapiens
ttattaatgagtacaagttatt

SEQ ID NO: 7542160 - DNA, 22 bp, Homo sapiens
ttattaatgagtacaagttatt

SEQ ID NO: 7542161 - DNA, 22 bp, Homo sapiens
ttattaatcttatctttggaaa

SEQ ID NO: 7542162 - DNA, 22 bp, Homo sapiens
ttattaatcttatctttggaaa

SEQ ID NO: 7542163 - DNA, 22 bp, Homo sapiens
ttattacaatgcagaaaataga

SEQ ID NO: 7542164 - DNA, 22 bp, Homo sapiens
ttattacaatgcagaaaataga

SEQ ID NO: 7542165 - DNA, 22 bp, Homo sapiens
ttattacaatgcagaaaataga

SEQ ID NO: 7542166 - DNA, 22 bp, Homo sapiens
ttattacaatgcagaaaataga

SEQ ID NO: 7542167 - DNA, 22 bp, Homo sapiens
ttattacaatgcagaaaataga

SEQ ID NO: 7542168 - DNA, 22 bp, Homo sapiens
ttattacaatgcagaaaataga

SEQ ID NO: 7542169 - DNA, 22 bp, Homo sapiens
ttattacaatgcagaaaataga

SEQ ID NO: 7542170 - DNA, 22 bp, Homo sapiens
ttattacaatgcagaaaataga

SEQ ID NO: 7542171 - DNA, 22 bp, Homo sapiens
ttattacaatgcagaaaataga

SEQ ID NO: 7542172 - DNA, 22 bp, Homo sapiens
ttattacaatgcagaaaataga

SEQ ID NO: 7542173 - DNA, 22 bp, Homo sapiens
ttattaagtgcctacaataaag

SEQ ID NO: 7542174 - DNA, 22 bp, Homo sapiens
ttattaaaatgcggatttggct

SEQ ID NO: 7542175 - DNA, 22 bp, Homo sapiens
ttattaagtgcctacaataaag

SEQ ID NO: 7542176 - DNA, 22 bp, Homo sapiens
ttattaagtgcctacaataaag

SEQ ID NO: 7542177 - DNA, 22 bp, Homo sapiens
ttattaagtgcgtactgtatgc

SEQ ID NO: 7542178 - DNA, 22 bp, Homo sapiens
ttattaagtgcgtactgtatgc

SEQ ID NO: 7542179 - DNA, 22 bp, Homo sapiens
ttattaagtgcgtactgtatgc

SEQ ID NO: 7542180 - DNA, 22 bp, Homo sapiens
ttattaagtgcgtactgtatgc

SEQ ID NO: 7542181 - DNA, 22 bp, Homo sapiens
ttattaagtgcgtactgtatgc

SEQ ID NO: 7542182 - DNA, 22 bp, Homo sapiens
ttattaataaagtggcatagcc

SEQ ID NO: 7542183 - DNA, 22 bp, Homo sapiens
ttattaatacatgcacctgcat

SEQ ID NO: 7542184 - DNA, 22 bp, Homo sapiens
ttattaatcttatctttggaaa

SEQ ID NO: 7542185 - DNA, 22 bp, Homo sapiens
ttattaatcttatctttggaaa

SEQ ID NO: 7542186 - DNA, 22 bp, Homo sapiens
ttattaatcttatctttggaaa

SEQ ID NO: 7542187 - DNA, 22 bp, Homo sapiens
ttattaatcttatctttggaaa

SEQ ID NO: 7542188 - DNA, 22 bp, Homo sapiens
ttattaatacatgcacctgcat

SEQ ID NO: 7542189 - DNA, 22 bp, Homo sapiens
ttattaatacatgcacctgcat

SEQ ID NO: 7542190 - DNA, 22 bp, Homo sapiens
ttattaataaagtggcatagcc

SEQ ID NO: 7542191 - DNA, 22 bp, Homo sapiens
ttattaataaagtggcatagcc

SEQ ID NO: 7542192 - DNA, 22 bp, Homo sapiens
ttattaataaagtggcatagcc

SEQ ID NO: 7542193 - DNA, 22 bp, Homo sapiens
ttattaataaagtggcatagcc

SEQ ID NO: 7542194 - DNA, 22 bp, Homo sapiens
ttattaataaagtggcatagcc

SEQ ID NO: 7542195 - DNA, 22 bp, Homo sapiens
ttattaatacatgcacctgcat

SEQ ID NO: 7542196 - DNA, 21 bp, Homo sapiens
ttattgagacatttgtggaaa

SEQ ID NO: 7542197 - DNA, 22 bp, Homo sapiens
ttattgagaccgtaagtcaggt

SEQ ID NO: 7542198 - DNA, 22 bp, Homo sapiens
ttattgagagctgttttatggc

SEQ ID NO: 7542199 - DNA, 22 bp, Homo sapiens
ttattgacttgtttgtcctggt

SEQ ID NO: 7542200 - DNA, 22 bp, Homo sapiens
ttattgacttgtttgtcctggt

SEQ ID NO: 7542201 - DNA, 22 bp, Homo sapiens
ttattgacttgtttgtcctggt

SEQ ID NO: 7542202 - DNA, 22 bp, Homo sapiens
ttattgacttattaattgtgct

SEQ ID NO: 7542203 - DNA, 22 bp, Homo sapiens
ttattgactgatcagagaggga

SEQ ID NO: 7542204 - DNA, 22 bp, Homo sapiens
ttattgactgaaatgagagtga

SEQ ID NO: 7542205 - DNA, 22 bp, Homo sapiens
ttattgactgaaatgagagtga

SEQ ID NO: 7542206 - DNA, 22 bp, Homo sapiens
ttattgaaggaactgaaataaa

SEQ ID NO: 7542207 - DNA, 22 bp, Homo sapiens
ttattgaaggaactgaaataaa

SEQ ID NO: 7542208 - DNA, 22 bp, Homo sapiens
ttattgaaggaactgaaataaa

SEQ ID NO: 7542209 - DNA, 22 bp, Homo sapiens
ttattgaaggaactgaaataaa

SEQ ID NO: 7542210 - DNA, 21 bp, Homo sapiens
ttattgaatgtttaccgtgtg

SEQ ID NO: 7542211 - DNA, 22 bp, Homo sapiens
ttattgacacatctggatgttt

SEQ ID NO: 7542212 - DNA, 22 bp, Homo sapiens
ttattgactcccagcttttcca

SEQ ID NO: 7542213 - DNA, 22 bp, Homo sapiens
ttattgactcccagcttttcca

SEQ ID NO: 7542214 - DNA, 22 bp, Homo sapiens
ttattgactatttgctatgtgt

SEQ ID NO: 7542215 - DNA, 22 bp, Homo sapiens
ttattgactatttgctatgtgt

SEQ ID NO: 7542216 - DNA, 22 bp, Homo sapiens
ttattcttttctccagaatccc

SEQ ID NO: 7542217 - DNA, 22 bp, Homo sapiens
ttattgaaatggaagctataac

SEQ ID NO: 7542218 - DNA, 22 bp, Homo sapiens
ttattgaaggaactgaaataaa

SEQ ID NO: 7542219 - DNA, 22 bp, Homo sapiens
ttattgaaggaactgaaataaa

SEQ ID NO: 7542220 - DNA, 22 bp, Homo sapiens
ttattgaagcaagcttttctga

SEQ ID NO: 7542221 - DNA, 22 bp, Homo sapiens
ttattgaaatggaagctataac

SEQ ID NO: 7542222 - DNA, 22 bp, Homo sapiens
ttattgagcacctactatgtgt

SEQ ID NO: 7542223 - DNA, 22 bp, Homo sapiens
ttattgctctattatggcctaa

SEQ ID NO: 7542224 - DNA, 22 bp, Homo sapiens
ttattgctctattatggcctaa

SEQ ID NO: 7542225 - DNA, 22 bp, Homo sapiens
ttattgctgatagtgtttataa

SEQ ID NO: 7542226 - DNA, 22 bp, Homo sapiens
ttattgctgatagtgtttataa

SEQ ID NO: 7542227 - DNA, 22 bp, Homo sapiens
ttattgctgatagtgtttataa

SEQ ID NO: 7542228 - DNA, 22 bp, Homo sapiens
ttattgctgctaacattttatg

SEQ ID NO: 7542229 - DNA, 22 bp, Homo sapiens
ttattgagcaactctggggctc

SEQ ID NO: 7542230 - DNA, 22 bp, Homo sapiens
ttattgagcacatagtatgtgg

SEQ ID NO: 7542231 - DNA, 22 bp, Homo sapiens
ttattgagcacatagtatgtgg

SEQ ID NO: 7542232 - DNA, 22 bp, Homo sapiens
ttattgagcacctactatgtgt

SEQ ID NO: 7542233 - DNA, 22 bp, Homo sapiens
ttattgagcacctactatgtgt

SEQ ID NO: 7542234 - DNA, 22 bp, Homo sapiens
ttattggagctggaggctgttt

SEQ ID NO: 7542235 - DNA, 22 bp, Homo sapiens
ttattggaaaagggctgtaatt

SEQ ID NO: 7542236 - DNA, 22 bp, Homo sapiens
ttattgcttttgtgcaggtgag

SEQ ID NO: 7542237 - DNA, 22 bp, Homo sapiens
ttattggattcttgccccaggt

SEQ ID NO: 7542238 - DNA, 22 bp, Homo sapiens
ttattggagctggaggctgttt

SEQ ID NO: 7542239 - DNA, 22 bp, Homo sapiens
ttattgctgctaacattttatg

SEQ ID NO: 7542240 - DNA, 22 bp, Homo sapiens
ttattgctgctaacattttatg

SEQ ID NO: 7542241 - DNA, 22 bp, Homo sapiens
ttattgctgctaacattttatg

SEQ ID NO: 7542242 - DNA, 22 bp, Homo sapiens
ttattgctgctaacattttatg

SEQ ID NO: 7542243 - DNA, 22 bp, Homo sapiens
ttattgctggcaccttcaattc

SEQ ID NO: 7542244 - DNA, 22 bp, Homo sapiens
ttattgctggcaccttcaattc

SEQ ID NO: 7542245 - DNA, 22 bp, Homo sapiens
ttattgcttatgattaggtgtt

SEQ ID NO: 7542246 - DNA, 23 bp, Homo sapiens
ttattgctttccctgccttcctg

SEQ ID NO: 7542247 - DNA, 22 bp, Homo sapiens
ttattgctttggaaaacactca

SEQ ID NO: 7542248 - DNA, 22 bp, Homo sapiens
ttattgctttggaaaacactca

SEQ ID NO: 7542249 - DNA, 22 bp, Homo sapiens
ttattggccaactgccttggag

SEQ ID NO: 7542250 - DNA, 22 bp, Homo sapiens
ttattggccaactgccttggag

SEQ ID NO: 7542251 - DNA, 22 bp, Homo sapiens
ttattgggtcccaacaagttgc

SEQ ID NO: 7542252 - DNA, 18 bp, Homo sapiens
ttattggtgctgctgttc

SEQ ID NO: 7542253 - DNA, 18 bp, Homo sapiens
ttattggtgctgctgttc

SEQ ID NO: 7542254 - DNA, 22 bp, Homo sapiens
ttattgtagcactttggcagtg

SEQ ID NO: 7542255 - DNA, 22 bp, Homo sapiens
ttattgtagcactttggcagtg

SEQ ID NO: 7542256 - DNA, 22 bp, Homo sapiens
ttattgtagcactttggcagtg

SEQ ID NO: 7542257 - DNA, 22 bp, Homo sapiens
ttattgtaggcctattgtagaa

SEQ ID NO: 7542258 - DNA, 22 bp, Homo sapiens
ttattgtaggcctattgtagaa

SEQ ID NO: 7542259 - DNA, 22 bp, Homo sapiens
ttattgtaggcctattgtagaa

SEQ ID NO: 7542260 - DNA, 22 bp, Homo sapiens
ttattgtaggcctattgtagaa

SEQ ID NO: 7542261 - DNA, 17 bp, Homo sapiens
ttattgtcaaggttcca

SEQ ID NO: 7542262 - DNA, 22 bp, Homo sapiens
ttattgtcctacttattgtctt

SEQ ID NO: 7542263 - DNA, 22 bp, Homo sapiens
ttattgtcctacttattgtctt

SEQ ID NO: 7542264 - DNA, 22 bp, Homo sapiens
ttattgtcttaaatttggtctt

SEQ ID NO: 7542265 - DNA, 22 bp, Homo sapiens
ttattgtcttaaatttggtctt

SEQ ID NO: 7542266 - DNA, 22 bp, Homo sapiens
ttattgtcaaaaacaggacact

SEQ ID NO: 7542267 - DNA, 23 bp, Homo sapiens
ttcaaacagctacaagggggtgg

SEQ ID NO: 7542268 - DNA, 22 bp, Homo sapiens
ttcaaacaggggtcagggagat

SEQ ID NO: 7542269 - DNA, 22 bp, Homo sapiens
ttcaaacaggggtcagggagat

SEQ ID NO: 7542270 - DNA, 22 bp, Homo sapiens
ttcaaacaggggtcagggagat

SEQ ID NO: 7542271 - DNA, 22 bp, Homo sapiens
ttcaaacagatgactctgctct

SEQ ID NO: 7542272 - DNA, 22 bp, Homo sapiens
ttcaaacagatgactctgctct

SEQ ID NO: 7542273 - DNA, 22 bp, Homo sapiens
ttcaaacagatgactctgctct

SEQ ID NO: 7542274 - DNA, 22 bp, Homo sapiens
ttcaaacagatgactctgctct

SEQ ID NO: 7542275 - DNA, 22 bp, Homo sapiens
ttcaaacagatgactctgctct

SEQ ID NO: 7542276 - DNA, 22 bp, Homo sapiens
ttcaaacactggcttagccaat

SEQ ID NO: 7542277 - DNA, 22 bp, Homo sapiens
ttcaaacactggcttagccaat

SEQ ID NO: 7542278 - DNA, 22 bp, Homo sapiens
ttcaaacactggcttagccaat

SEQ ID NO: 7542279 - DNA, 22 bp, Homo sapiens
ttcaaacactggcttagccaat

SEQ ID NO: 7542280 - DNA, 22 bp, Homo sapiens
ttcaaacactgctttgagaggg

SEQ ID NO: 7542281 - DNA, 22 bp, Homo sapiens
ttcaaacactgctttgagaggg

SEQ ID NO: 7542282 - DNA, 22 bp, Homo sapiens
ttcaaacactgctttgagaggg

SEQ ID NO: 7542283 - DNA, 22 bp, Homo sapiens
ttcaaacactggcttagccaat

SEQ ID NO: 7542284 - DNA, 22 bp, Homo sapiens
ttcaaacactgttggcactggg

SEQ ID NO: 7542285 - DNA, 22 bp, Homo sapiens
ttcaaacactgttggcactggg

SEQ ID NO: 7542286 - DNA, 22 bp, Homo sapiens
ttattgtggcagaggtatggtt

SEQ ID NO: 7542287 - DNA, 22 bp, Homo sapiens
ttattgtgggtaggttgtgaaa

SEQ ID NO: 7542288 - DNA, 18 bp, Homo sapiens
ttattgtggtcacagcac

SEQ ID NO: 7542289 - DNA, 18 bp, Homo sapiens
ttattgtggtcacagcac

SEQ ID NO: 7542290 - DNA, 22 bp, Homo sapiens
ttattgtggactactgttctgg

SEQ ID NO: 7542291 - DNA, 22 bp, Homo sapiens
ttattgtggcagaggtatggtt

SEQ ID NO: 7542292 - DNA, 22 bp, Homo sapiens
ttattgtgaggaataagtgaga

SEQ ID NO: 7542293 - DNA, 22 bp, Homo sapiens
ttattgtcttaaatttggtctt

SEQ ID NO: 7542294 - DNA, 22 bp, Homo sapiens
ttattgtgaggaataagtgaga

SEQ ID NO: 7542295 - DNA, 22 bp, Homo sapiens
ttattgtggactactgttctgg

SEQ ID NO: 7542296 - DNA, 22 bp, Homo sapiens
ttattgtggactactgttctgg

SEQ ID NO: 7542297 - DNA, 22 bp, Homo sapiens
ttattgtggactactgttctgg

SEQ ID NO: 7542298 - DNA, 22 bp, Homo sapiens
ttattgtgtgcgttagcctatg

SEQ ID NO: 7542299 - DNA, 22 bp, Homo sapiens
ttattgtgtgcgttagcctatg

SEQ ID NO: 7542300 - DNA, 22 bp, Homo sapiens
ttattgtgtacttcctctgtgc

SEQ ID NO: 7542301 - DNA, 22 bp, Homo sapiens
ttattgtgtacttcctctgtgc

SEQ ID NO: 7542302 - DNA, 22 bp, Homo sapiens
ttattgtgtcttggtttatctt

SEQ ID NO: 7542303 - DNA, 22 bp, Homo sapiens
ttattgttaggcttttggaatt

SEQ ID NO: 7542304 - DNA, 22 bp, Homo sapiens
ttattgttaggcttttggaatt

SEQ ID NO: 7542305 - DNA, 22 bp, Homo sapiens
ttcaaacacagacagcagcatg

SEQ ID NO: 7542306 - DNA, 22 bp, Homo sapiens
ttcaaacacagacagcagcatg

SEQ ID NO: 7542307 - DNA, 22 bp, Homo sapiens
ttcaaacacagacagcagcatg

SEQ ID NO: 7542308 - DNA, 22 bp, Homo sapiens
ttcaaacacagacagcagcatg

SEQ ID NO: 7542309 - DNA, 22 bp, Homo sapiens
ttcaaacagttgcacaacttat

SEQ ID NO: 7542310 - DNA, 22 bp, Homo sapiens
ttcaaacattcaaataaaccgg

SEQ ID NO: 7542311 - DNA, 22 bp, Homo sapiens
ttcaaacattcaaataaaccgg

SEQ ID NO: 7542312 - DNA, 22 bp, Homo sapiens
ttcaaacattcaaataaaccgg

SEQ ID NO: 7542313 - DNA, 22 bp, Homo sapiens
ttcaaacattcaaataaaccgg

SEQ ID NO: 7542314 - DNA, 22 bp, Homo sapiens
ttcaaacagttgcacaacttat

SEQ ID NO: 7542315 - DNA, 22 bp, Homo sapiens
ttcaaacagttgcacaacttat

SEQ ID NO: 7542316 - DNA, 22 bp, Homo sapiens
ttcaaacagttgcacaacttat

SEQ ID NO: 7542317 - DNA, 22 bp, Homo sapiens
ttcaaacagttgcacaacttat

SEQ ID NO: 7542318 - DNA, 22 bp, Homo sapiens
ttcaaacagttgcacaacttat

SEQ ID NO: 7542319 - DNA, 22 bp, Homo sapiens
ttcaaacagttgcacaacttat

SEQ ID NO: 7542320 - DNA, 22 bp, Homo sapiens
ttcaaacagttgcacaacttat

SEQ ID NO: 7542321 - DNA, 22 bp, Homo sapiens
ttcaaacagttgcacaacttat

SEQ ID NO: 7542322 - DNA, 22 bp, Homo sapiens
ttcaaacagtgtagaatatatg

SEQ ID NO: 7542323 - DNA, 22 bp, Homo sapiens
ttcaaacagtgtagaatatatg

SEQ ID NO: 7542324 - DNA, 22 bp, Homo sapiens
ttcaaacagtgtagaatatatg

SEQ ID NO: 7542325 - DNA, 22 bp, Homo sapiens
ttcaaacagtgtagaatatatg

SEQ ID NO: 7542326 - DNA, 22 bp, Homo sapiens
ttcaaacagtgtagaatatatg

SEQ ID NO: 7542327 - DNA, 22 bp, Homo sapiens
ttcaaacagtgtagaatatatg

SEQ ID NO: 7542328 - DNA, 22 bp, Homo sapiens
ttcaaactatgacttcagctac

SEQ ID NO: 7542329 - DNA, 22 bp, Homo sapiens
ttcaaactagttaaaagtcaga

SEQ ID NO: 7542330 - DNA, 22 bp, Homo sapiens
ttcaaactcacactagggagac

SEQ ID NO: 7542331 - DNA, 22 bp, Homo sapiens
ttcaaactctgagtagttctgc

SEQ ID NO: 7542332 - DNA, 22 bp, Homo sapiens
ttcaaactgaggagaggatggc

SEQ ID NO: 7542333 - DNA, 22 bp, Homo sapiens
ttcaaactcttgctctgctagt

SEQ ID NO: 7542334 - DNA, 22 bp, Homo sapiens
ttcaaactagttaaaagtcaga

SEQ ID NO: 7542335 - DNA, 22 bp, Homo sapiens
ttcaaacctatctaagaaatag

SEQ ID NO: 7542336 - DNA, 22 bp, Homo sapiens
ttcaaaccttcacttgcagagt

SEQ ID NO: 7542337 - DNA, 22 bp, Homo sapiens
ttcaaacattcaaataaaccgg

SEQ ID NO: 7542338 - DNA, 22 bp, Homo sapiens
ttcaaaccatggcacaggaagg

SEQ ID NO: 7542339 - DNA, 22 bp, Homo sapiens
ttcaaaccatggcacaggaagg

SEQ ID NO: 7542340 - DNA, 22 bp, Homo sapiens
ttcaaacctatctaagaaatag

SEQ ID NO: 7542341 - DNA, 22 bp, Homo sapiens
ttaggaaagttcttcagacatg

SEQ ID NO: 7542342 - DNA, 22 bp, Homo sapiens
ttaggaaagttcttcagacatg

SEQ ID NO: 7542343 - DNA, 22 bp, Homo sapiens
ttaggaaagttcttcagacatg

SEQ ID NO: 7542344 - DNA, 22 bp, Homo sapiens
ttaggaaagttcttcagacatg

SEQ ID NO: 7542345 - DNA, 22 bp, Homo sapiens
ttaggaaagtctcttggctggg

SEQ ID NO: 7542346 - DNA, 22 bp, Homo sapiens
ttaggaaagtctcttggctggg

SEQ ID NO: 7542347 - DNA, 22 bp, Homo sapiens
ttaggaaagggttttctaacag

SEQ ID NO: 7542348 - DNA, 22 bp, Homo sapiens
ttaggaaagggttttctaacag

SEQ ID NO: 7542349 - DNA, 22 bp, Homo sapiens
ttaggaaaggaacattgaaacg

SEQ ID NO: 7542350 - DNA, 22 bp, Homo sapiens
ttaggaaaggaacattgaaacg

SEQ ID NO: 7542351 - DNA, 22 bp, Homo sapiens
ttaggaaaggaacattgaaacg

SEQ ID NO: 7542352 - DNA, 22 bp, Homo sapiens
ttaggaaagcattgtgtaaaag

SEQ ID NO: 7542353 - DNA, 22 bp, Homo sapiens
ttaggaaagcattgtgtaaaag

SEQ ID NO: 7542354 - DNA, 22 bp, Homo sapiens
ttaggaaagcattgtgtaaaag

SEQ ID NO: 7542355 - DNA, 22 bp, Homo sapiens
ttaggaaaggaacattgaaacg

SEQ ID NO: 7542356 - DNA, 22 bp, Homo sapiens
ttaggaaaggaacattgaaacg

SEQ ID NO: 7542357 - DNA, 22 bp, Homo sapiens
ttaggaaaggaacattgaaacg

SEQ ID NO: 7542358 - DNA, 22 bp, Homo sapiens
ttaggaaaggaacattgaaacg

SEQ ID NO: 7542359 - DNA, 22 bp, Homo sapiens
ttaggaaaggaacattgaaacg

SEQ ID NO: 7542360 - DNA, 22 bp, Homo sapiens
ttaggaaagaagcagctaggag

SEQ ID NO: 7542361 - DNA, 22 bp, Homo sapiens
ttaggaaagaagcagctaggag

SEQ ID NO: 7542362 - DNA, 22 bp, Homo sapiens
ttaggaaacgctgctattgact

SEQ ID NO: 7542363 - DNA, 22 bp, Homo sapiens
ttaggaaacgctgctattgact

SEQ ID NO: 7542364 - DNA, 22 bp, Homo sapiens
ttatacagtttatacttagaat

SEQ ID NO: 7542365 - DNA, 22 bp, Homo sapiens
ttaggaaagttcttcagacatg

SEQ ID NO: 7542366 - DNA, 22 bp, Homo sapiens
ttaggaaatcactttgctcacc

SEQ ID NO: 7542367 - DNA, 22 bp, Homo sapiens
ttatacatgtgttttgagatga

SEQ ID NO: 7542368 - DNA, 22 bp, Homo sapiens
ttatacatgtgttttgagatga

SEQ ID NO: 7542369 - DNA, 22 bp, Homo sapiens
ttatacatgtgttttgagatga

SEQ ID NO: 7542370 - DNA, 22 bp, Homo sapiens
ttatacatgtgttttgagatga

SEQ ID NO: 7542371 - DNA, 22 bp, Homo sapiens
ttatacatgtgttttgagatga

SEQ ID NO: 7542372 - DNA, 21 bp, Homo sapiens
ttatacatatgttctctgcct

SEQ ID NO: 7542373 - DNA, 22 bp, Homo sapiens
ttatacatgtgttttgagatga

SEQ ID NO: 7542374 - DNA, 22 bp, Homo sapiens
ttatacatgtttataaggttga

SEQ ID NO: 7542375 - DNA, 22 bp, Homo sapiens
ttatacatgtttataaggttga

SEQ ID NO: 7542376 - DNA, 22 bp, Homo sapiens
ttatactaaaacgcattgaatt

SEQ ID NO: 7542377 - DNA, 22 bp, Homo sapiens
ttatactaaaacgcattgaatt

SEQ ID NO: 7542378 - DNA, 22 bp, Homo sapiens
ttatacatgtgttttgagatga

SEQ ID NO: 7542379 - DNA, 22 bp, Homo sapiens
ttatacatgtttataaggttga

SEQ ID NO: 7542380 - DNA, 22 bp, Homo sapiens
ttatacatgtttataaggttga

SEQ ID NO: 7542381 - DNA, 22 bp, Homo sapiens
ttaggaaacgctgctattgact

SEQ ID NO: 7542382 - DNA, 19 bp, Homo sapiens
ttaggaaaccactttcctt

SEQ ID NO: 7542383 - DNA, 19 bp, Homo sapiens
ttaggaaaccactttcctt

SEQ ID NO: 7542384 - DNA, 19 bp, Homo sapiens
ttaggaaaccactttcctt

SEQ ID NO: 7542385 - DNA, 22 bp, Homo sapiens
ttaggaaacatcatttttgctg

SEQ ID NO: 7542386 - DNA, 22 bp, Homo sapiens
ttaggaaacagtagcctttgct

SEQ ID NO: 7542387 - DNA, 22 bp, Homo sapiens
ttaggaaacaaatacacccagt

SEQ ID NO: 7542388 - DNA, 22 bp, Homo sapiens
ttaggaaaatggagtcctttta

SEQ ID NO: 7542389 - DNA, 22 bp, Homo sapiens
ttaggaaacaaatacacccagt

SEQ ID NO: 7542390 - DNA, 22 bp, Homo sapiens
ttaggaaaatggagtcctttta

SEQ ID NO: 7542391 - DNA, 22 bp, Homo sapiens
ttaggaaaatgaaattacctgt

SEQ ID NO: 7542392 - DNA, 22 bp, Homo sapiens
ttaggaaaatgaaattacctgt

SEQ ID NO: 7542393 - DNA, 22 bp, Homo sapiens
ttaggaaaagaagacatttcta

SEQ ID NO: 7542394 - DNA, 22 bp, Homo sapiens
ttaggaaaatcatgagagatga

SEQ ID NO: 7542395 - DNA, 22 bp, Homo sapiens
ttaggaaaagaagacatttcta

SEQ ID NO: 7542396 - DNA, 22 bp, Homo sapiens
ttaggaaaagaagacatttcta

SEQ ID NO: 7542397 - DNA, 22 bp, Homo sapiens
ttaggaaaagaagacatttcta

SEQ ID NO: 7542398 - DNA, 22 bp, Homo sapiens
ttagcttttttgcagatgtcct

SEQ ID NO: 7542399 - DNA, 22 bp, Homo sapiens
ttagctttcctactaataaata

SEQ ID NO: 7542400 - DNA, 22 bp, Homo sapiens
ttagctttcctactaataaata

SEQ ID NO: 7542401 - DNA, 22 bp, Homo sapiens
ttagctttcatgaacctggtcg

SEQ ID NO: 7542402 - DNA, 22 bp, Homo sapiens
ttagctttcatgaacctggtcg

SEQ ID NO: 7542403 - DNA, 21 bp, Homo sapiens
ttagctttctagaatctttgt

SEQ ID NO: 7542404 - DNA, 21 bp, Homo sapiens
ttagctttctagaatctttgt

SEQ ID NO: 7542405 - DNA, 22 bp, Homo sapiens
ttagctttcttggagaattaca

SEQ ID NO: 7542406 - DNA, 22 bp, Homo sapiens
ttagctttctttggcagacgtg

SEQ ID NO: 7542407 - DNA, 22 bp, Homo sapiens
ttagctttcttggagaattaca

SEQ ID NO: 7542408 - DNA, 22 bp, Homo sapiens
ttagctttggattgcatttagt

SEQ ID NO: 7542409 - DNA, 22 bp, Homo sapiens
ttagcttttaagtgtgctacat

SEQ ID NO: 7542410 - DNA, 22 bp, Homo sapiens
ttagcttttaagtgtgctacat

SEQ ID NO: 7542411 - DNA, 22 bp, Homo sapiens
ttagcttttaagtgtgctacat

SEQ ID NO: 7542412 - DNA, 22 bp, Homo sapiens
ttagcttttaagtgtgctacat

SEQ ID NO: 7542413 - DNA, 22 bp, Homo sapiens
ttagcttttctctatgttggct

SEQ ID NO: 7542414 - DNA, 22 bp, Homo sapiens
ttagcttttcacttgcattatc

SEQ ID NO: 7542415 - DNA, 22 bp, Homo sapiens
ttagcttttcacttgcattatc

SEQ ID NO: 7542416 - DNA, 22 bp, Homo sapiens
ttagcttttcacttgcattatc

SEQ ID NO: 7542417 - DNA, 22 bp, Homo sapiens
ttagcttttcacttgcattatc

SEQ ID NO: 7542418 - DNA, 22 bp, Homo sapiens
ttagcttttgagaatgatttct

SEQ ID NO: 7542419 - DNA, 22 bp, Homo sapiens
ttagcttttgagaatgatttct

SEQ ID NO: 7542420 - DNA, 22 bp, Homo sapiens
ttagcttttgagaatgatttct

SEQ ID NO: 7542421 - DNA, 22 bp, Homo sapiens
ttatagcagcatgatttacaat

SEQ ID NO: 7542422 - DNA, 22 bp, Homo sapiens
ttatagcagcatgatttacaat

SEQ ID NO: 7542423 - DNA, 22 bp, Homo sapiens
ttatagcagcatgatttacaat

SEQ ID NO: 7542424 - DNA, 22 bp, Homo sapiens
ttatagatttttatgaagtctg

SEQ ID NO: 7542425 - DNA, 22 bp, Homo sapiens
ttatagatgccttgagtaaatg

SEQ ID NO: 7542426 - DNA, 22 bp, Homo sapiens
ttatagcagcatgatttataat

SEQ ID NO: 7542427 - DNA, 22 bp, Homo sapiens
ttatagcagcatgatttataat

SEQ ID NO: 7542428 - DNA, 22 bp, Homo sapiens
ttatagcagcatgatttataat

SEQ ID NO: 7542429 - DNA, 22 bp, Homo sapiens
ttatagcagcatgatttacaat

SEQ ID NO: 7542430 - DNA, 22 bp, Homo sapiens
ttatagcagcatgatttatagt

SEQ ID NO: 7542431 - DNA, 22 bp, Homo sapiens
ttatagcagcatgatttatagt

SEQ ID NO: 7542432 - DNA, 22 bp, Homo sapiens
ttatagcagcatgatttatagt

SEQ ID NO: 7542433 - DNA, 22 bp, Homo sapiens
ttatagcaggtgactaatgagt

SEQ ID NO: 7542434 - DNA, 22 bp, Homo sapiens
ttatagaacggttctgtgcaaa

SEQ ID NO: 7542435 - DNA, 22 bp, Homo sapiens
ttatagaatccagttgttgtat

SEQ ID NO: 7542436 - DNA, 22 bp, Homo sapiens
ttatagaatggtggattttctg

SEQ ID NO: 7542437 - DNA, 22 bp, Homo sapiens
ttatagaatggtggattttctg

SEQ ID NO: 7542438 - DNA, 22 bp, Homo sapiens
ttatagaatggtggattttctg

SEQ ID NO: 7542439 - DNA, 22 bp, Homo sapiens
ttatagatgccttgagtaaatg

SEQ ID NO: 7542440 - DNA, 22 bp, Homo sapiens
ttatagatgccttgagtaaatg

SEQ ID NO: 7542441 - DNA, 22 bp, Homo sapiens
ttatagatctaaatgtgaaggg

SEQ ID NO: 7542442 - DNA, 23 bp, Homo sapiens
ttatagagcagatgcaatgtgaa

SEQ ID NO: 7542443 - DNA, 22 bp, Homo sapiens
ttatagatctaaatgtgaaggg

SEQ ID NO: 7542444 - DNA, 22 bp, Homo sapiens
ttatagaatgtttccaatgcct

SEQ ID NO: 7542445 - DNA, 22 bp, Homo sapiens
ttatagaatgtttccaatgcct

SEQ ID NO: 7542446 - DNA, 22 bp, Homo sapiens
ttatagaaaatgtgggaaatga

SEQ ID NO: 7542447 - DNA, 22 bp, Homo sapiens
ttatagaaaatgtgggaaatga

SEQ ID NO: 7542448 - DNA, 22 bp, Homo sapiens
ttatagaaaatgtgggaaatga

SEQ ID NO: 7542449 - DNA, 22 bp, Homo sapiens
ttatagaaaatgtgggaaatga

SEQ ID NO: 7542450 - DNA, 22 bp, Homo sapiens
ttatagaaaatgtgggaaatga

SEQ ID NO: 7542451 - DNA, 22 bp, Homo sapiens
ttatactttatactacatcatt

SEQ ID NO: 7542452 - DNA, 22 bp, Homo sapiens
ttatactttatactacatcatt

SEQ ID NO: 7542453 - DNA, 22 bp, Homo sapiens
ttatagaacggttctgtgcaaa

SEQ ID NO: 7542454 - DNA, 22 bp, Homo sapiens
ttatagaacagcctcctctaga

SEQ ID NO: 7542455 - DNA, 22 bp, Homo sapiens
ttatagaaggagcattcactta

SEQ ID NO: 7542456 - DNA, 22 bp, Homo sapiens
ttatagaaggagcattcactta

SEQ ID NO: 7542457 - DNA, 22 bp, Homo sapiens
ttatagaaggagcattcactta

SEQ ID NO: 7542458 - DNA, 22 bp, Homo sapiens
ttatagaaggagcattcactta

SEQ ID NO: 7542459 - DNA, 22 bp, Homo sapiens
ttatagaaggagcattcactta

SEQ ID NO: 7542460 - DNA, 22 bp, Homo sapiens
ttatagaaggagcattcactta

SEQ ID NO: 7542461 - DNA, 22 bp, Homo sapiens
ttatagaatccagttgttgtat

SEQ ID NO: 7542462 - DNA, 22 bp, Homo sapiens
ttatagaatccagttgttgtat

SEQ ID NO: 7542463 - DNA, 22 bp, Homo sapiens
ttatagaaggagcattcactta

SEQ ID NO: 7542464 - DNA, 22 bp, Homo sapiens
ttatagaaggagcattcactta

SEQ ID NO: 7542465 - DNA, 22 bp, Homo sapiens
ttatataaagataacttttctt

SEQ ID NO: 7542466 - DNA, 22 bp, Homo sapiens
ttatataaagataacttttctt

SEQ ID NO: 7542467 - DNA, 22 bp, Homo sapiens
ttatataaagataacttttctt

SEQ ID NO: 7542468 - DNA, 22 bp, Homo sapiens
ttatataaagataacttttctt

SEQ ID NO: 7542469 - DNA, 22 bp, Homo sapiens
ttatataaagataacttttctt

SEQ ID NO: 7542470 - DNA, 22 bp, Homo sapiens
ttatataaagataacttttctt

SEQ ID NO: 7542471 - DNA, 22 bp, Homo sapiens
ttatataaagataacttttctt

SEQ ID NO: 7542472 - DNA, 22 bp, Homo sapiens
ttatataaagataacttttctt

SEQ ID NO: 7542473 - DNA, 22 bp, Homo sapiens
ttatatactgtggtagtactgt

SEQ ID NO: 7542474 - DNA, 22 bp, Homo sapiens
ttatatactgtggtagtactgt

SEQ ID NO: 7542475 - DNA, 22 bp, Homo sapiens
ttatatactgtggtagtactgt

SEQ ID NO: 7542476 - DNA, 22 bp, Homo sapiens
ttatatactgtggtagtactgt

SEQ ID NO: 7542477 - DNA, 19 bp, Homo sapiens
ttatatacttggtttctct

SEQ ID NO: 7542478 - DNA, 19 bp, Homo sapiens
ttatatacttggtttctct

SEQ ID NO: 7542479 - DNA, 22 bp, Homo sapiens
ttatataactcaggtgggctca

SEQ ID NO: 7542480 - DNA, 22 bp, Homo sapiens
ttatataactcaggtgggctca

SEQ ID NO: 7542481 - DNA, 22 bp, Homo sapiens
ttatataactcaggtgggctca

SEQ ID NO: 7542482 - DNA, 22 bp, Homo sapiens
ttatagggtttctgggagtggg

SEQ ID NO: 7542483 - DNA, 22 bp, Homo sapiens
ttataggtccactgcaatttgc

SEQ ID NO: 7542484 - DNA, 22 bp, Homo sapiens
ttatagtatgtgcatatgtgtg

SEQ ID NO: 7542485 - DNA, 22 bp, Homo sapiens
ttatagtatgtgcatatgtgtg

SEQ ID NO: 7542486 - DNA, 22 bp, Homo sapiens
ttatagtatgtgcatatgtgtg

SEQ ID NO: 7542487 - DNA, 22 bp, Homo sapiens
ttataggccatctaagtaattt

SEQ ID NO: 7542488 - DNA, 22 bp, Homo sapiens
ttataggaaaagttctagaaaa

SEQ ID NO: 7542489 - DNA, 22 bp, Homo sapiens
ttataggaaaagttctagaaaa

SEQ ID NO: 7542490 - DNA, 22 bp, Homo sapiens
ttataggaaaagttctagaaaa

SEQ ID NO: 7542491 - DNA, 22 bp, Homo sapiens
ttatagttagtaggtcattaaa

SEQ ID NO: 7542492 - DNA, 22 bp, Homo sapiens
ttatagttagtaggtcattaaa

SEQ ID NO: 7542493 - DNA, 22 bp, Homo sapiens
ttatagtgcataattaacatgg

SEQ ID NO: 7542494 - DNA, 22 bp, Homo sapiens
ttatagtgggcccaacatggcg

SEQ ID NO: 7542495 - DNA, 22 bp, Homo sapiens
ttatagtattaggtactcaaca

SEQ ID NO: 7542496 - DNA, 22 bp, Homo sapiens
ttatagtattaggtactcaaca

SEQ ID NO: 7542497 - DNA, 21 bp, Homo sapiens
tcctgctgctcctgtcgtgtt

SEQ ID NO: 7542498 - DNA, 21 bp, Homo sapiens
tcctgctgctcctgtcgtgtt

SEQ ID NO: 7542499 - DNA, 21 bp, Homo sapiens
tcctgctgctcctgtcgtgtt

SEQ ID NO: 7542500 - DNA, 21 bp, Homo sapiens
tcctgctgctcctgtcgtgtt

SEQ ID NO: 7542501 - DNA, 22 bp, Homo sapiens
tcctgctgctcttgggaaacct

SEQ ID NO: 7542502 - DNA, 22 bp, Homo sapiens
tcctgctggaaacttcctcttg

SEQ ID NO: 7542503 - DNA, 22 bp, Homo sapiens
tcctgctggaagtagggaatga

SEQ ID NO: 7542504 - DNA, 22 bp, Homo sapiens
tcctgctggaaacttcctcttg

SEQ ID NO: 7542505 - DNA, 22 bp, Homo sapiens
ttagccaggggagcagcttgtc

SEQ ID NO: 7542506 - DNA, 22 bp, Homo sapiens
ttagccaaacaggtgaaattga

SEQ ID NO: 7542507 - DNA, 22 bp, Homo sapiens
tcctgctggaatggaaaatgaa

SEQ ID NO: 7542508 - DNA, 22 bp, Homo sapiens
tcctgctggaatggaaaatgaa

SEQ ID NO: 7542509 - DNA, 22 bp, Homo sapiens
tcctgctggaagtagggaatga

SEQ ID NO: 7542510 - DNA, 22 bp, Homo sapiens
tcctgctggaagtagggaatga

SEQ ID NO: 7542511 - DNA, 22 bp, Homo sapiens
tcctgctggaagtagggaatga

SEQ ID NO: 7542512 - DNA, 22 bp, Homo sapiens
tcctgctggaagtagggaatga

SEQ ID NO: 7542513 - DNA, 22 bp, Homo sapiens
ttagccattctgataggtatgt

SEQ ID NO: 7542514 - DNA, 21 bp, Homo sapiens
ttagccattgggacattcagc

SEQ ID NO: 7542515 - DNA, 22 bp, Homo sapiens
ttagccagtgaaatggagaaat

SEQ ID NO: 7542516 - DNA, 22 bp, Homo sapiens
ttagccataattgtttttccca

SEQ ID NO: 7542517 - DNA, 22 bp, Homo sapiens
ttagcttgcaaatggaaatgat

SEQ ID NO: 7542518 - DNA, 22 bp, Homo sapiens
ttagcttgtgccatatgaaact

SEQ ID NO: 7542519 - DNA, 22 bp, Homo sapiens
ttagcttgtgccatatgaaact

SEQ ID NO: 7542520 - DNA, 22 bp, Homo sapiens
ttagctttagagccattactgg

SEQ ID NO: 7542521 - DNA, 22 bp, Homo sapiens
ttagcttcctacaactgctgca

SEQ ID NO: 7542522 - DNA, 22 bp, Homo sapiens
ttagcttcttacatttcatcct

SEQ ID NO: 7542523 - DNA, 22 bp, Homo sapiens
ttagctttcagcctttctcacc

SEQ ID NO: 7542524 - DNA, 22 bp, Homo sapiens
ttagctttatatatttggatcg

SEQ ID NO: 7542525 - DNA, 22 bp, Homo sapiens
ttagctttagagccattactgg

SEQ ID NO: 7542526 - DNA, 22 bp, Homo sapiens
ttagctttagagccattactgg

SEQ ID NO: 7542527 - DNA, 22 bp, Homo sapiens
ttagctttcagcctttctcacc

SEQ ID NO: 7542528 - DNA, 22 bp, Homo sapiens
ttagctttcagcctttctcacc

SEQ ID NO: 7542529 - DNA, 22 bp, Homo sapiens
ttagctttcagcctttctcacc

SEQ ID NO: 7542530 - DNA, 22 bp, Homo sapiens
ttagctttcagcctttctcacc

SEQ ID NO: 7542531 - DNA, 22 bp, Homo sapiens
ttagctgagattaagtgaactt

SEQ ID NO: 7542532 - DNA, 22 bp, Homo sapiens
ttagctgagattaagtgaactt

SEQ ID NO: 7542533 - DNA, 22 bp, Homo sapiens
ttagctgcattatcaaagttat

SEQ ID NO: 7542534 - DNA, 22 bp, Homo sapiens
ttagctgaaaaaattcatgcaa

SEQ ID NO: 7542535 - DNA, 22 bp, Homo sapiens
ttagctgactgtgtgatttggc

SEQ ID NO: 7542536 - DNA, 22 bp, Homo sapiens
ttagctgccctcagatccaagt

SEQ ID NO: 7542537 - DNA, 22 bp, Homo sapiens
ttagctgctgagataattatat

SEQ ID NO: 7542538 - DNA, 22 bp, Homo sapiens
ttagctgctgattaaatatgtt

SEQ ID NO: 7542539 - DNA, 22 bp, Homo sapiens
ttagctgtggaagcttcagcca

SEQ ID NO: 7542540 - DNA, 22 bp, Homo sapiens
ttagctgtggaagcttcagcca

SEQ ID NO: 7542541 - DNA, 22 bp, Homo sapiens
ttagcttaattaaataatcagt

SEQ ID NO: 7542542 - DNA, 22 bp, Homo sapiens
ttagctgaaaaaattcatgcaa

SEQ ID NO: 7542543 - DNA, 22 bp, Homo sapiens
ttagctctttgtagctatttct

SEQ ID NO: 7542544 - DNA, 22 bp, Homo sapiens
ttagctcagaaaatttaaactt

SEQ ID NO: 7542545 - DNA, 22 bp, Homo sapiens
ttagctcagaaaatttaaactt

SEQ ID NO: 7542546 - DNA, 22 bp, Homo sapiens
ttagctcagaaaatttaaactt

SEQ ID NO: 7542547 - DNA, 22 bp, Homo sapiens
ttagctcagaaaatttaaactt

SEQ ID NO: 7542548 - DNA, 22 bp, Homo sapiens
ttagctcagaaaatttaaactt

SEQ ID NO: 7542549 - DNA, 22 bp, Homo sapiens
ttagctaaaccacagagattct

SEQ ID NO: 7542550 - DNA, 22 bp, Homo sapiens
ttagctaaactgtaactagaat

SEQ ID NO: 7542551 - DNA, 22 bp, Homo sapiens
ttagctaaactgtaactagaat

SEQ ID NO: 7542552 - DNA, 22 bp, Homo sapiens
ttagcgcacatcacagggggaa

SEQ ID NO: 7542553 - DNA, 22 bp, Homo sapiens
ttagccatttgaggtcttcatt

SEQ ID NO: 7542554 - DNA, 22 bp, Homo sapiens
ttagccttagaagcttagcaaa

SEQ ID NO: 7542555 - DNA, 20 bp, Homo sapiens
tcctgctgaccttcacaagc

SEQ ID NO: 7542556 - DNA, 20 bp, Homo sapiens
tcctgctgaccttcacaagc

SEQ ID NO: 7542557 - DNA, 22 bp, Homo sapiens
tcctgctgaccagtaaatgaat

SEQ ID NO: 7542558 - DNA, 22 bp, Homo sapiens
tcctgctgaccagtaaatgaat

SEQ ID NO: 7542559 - DNA, 22 bp, Homo sapiens
tcctgctgacaaggaaagcatg

SEQ ID NO: 7542560 - DNA, 22 bp, Homo sapiens
tcctgctgacaaggaaagcatg

SEQ ID NO: 7542561 - DNA, 20 bp, Homo sapiens
tcctgctgaccttcacaagc

SEQ ID NO: 7542562 - DNA, 20 bp, Homo sapiens
tcctgctgaccttcacaagc

SEQ ID NO: 7542563 - DNA, 21 bp, Homo sapiens
tcctgctgagaaacagatggt

SEQ ID NO: 7542564 - DNA, 21 bp, Homo sapiens
tcctgctgagaaacagatggt

SEQ ID NO: 7542565 - DNA, 21 bp, Homo sapiens
tcctgctgagaaacagatggt

SEQ ID NO: 7542566 - DNA, 23 bp, Homo sapiens
tcctgctgaaagctccagctggc

SEQ ID NO: 7542567 - DNA, 22 bp, Homo sapiens
tcctgctgacaaggaaagcatg

SEQ ID NO: 7542568 - DNA, 22 bp, Homo sapiens
tcctgctgacaaggaaagcatg

SEQ ID NO: 7542569 - DNA, 22 bp, Homo sapiens
tcctgccttagagcaaggaaaa

SEQ ID NO: 7542570 - DNA, 22 bp, Homo sapiens
tcctgccttagagcaaggaaaa

SEQ ID NO: 7542571 - DNA, 22 bp, Homo sapiens
tcctgcctgtttacctgtactt

SEQ ID NO: 7542572 - DNA, 22 bp, Homo sapiens
tcctgcctgtttacctgtactt

SEQ ID NO: 7542573 - DNA, 22 bp, Homo sapiens
tcctgcctgtttacctgtactt

SEQ ID NO: 7542574 - DNA, 22 bp, Homo sapiens
tcctgcctgtttacctgtactt

SEQ ID NO: 7542575 - DNA, 22 bp, Homo sapiens
tcctgccttagagcaaggaaaa

SEQ ID NO: 7542576 - DNA, 22 bp, Homo sapiens
tcctgctgagcatgttctgccc

SEQ ID NO: 7542577 - DNA, 22 bp, Homo sapiens
tcctgctgagcatgttctgccc

SEQ ID NO: 7542578 - DNA, 22 bp, Homo sapiens
tcctgctgagcatgttctgccc

SEQ ID NO: 7542579 - DNA, 22 bp, Homo sapiens
tcctgctgagcatgttctgccc

SEQ ID NO: 7542580 - DNA, 22 bp, Homo sapiens
tcctgctgagcgtctgtcattt

SEQ ID NO: 7542581 - DNA, 22 bp, Homo sapiens
tcctgctgagcgtctgtcattt

SEQ ID NO: 7542582 - DNA, 22 bp, Homo sapiens
tcctgctgagcgtctgtcattt

SEQ ID NO: 7542583 - DNA, 22 bp, Homo sapiens
tcctgctgagcatgttctgccc

SEQ ID NO: 7542584 - DNA, 22 bp, Homo sapiens
tcctgctgagcgtctgtcattt

SEQ ID NO: 7542585 - DNA, 20 bp, Homo sapiens
tcctgctgccacctcttctt

SEQ ID NO: 7542586 - DNA, 20 bp, Homo sapiens
tcctgctgccacctcttctt

SEQ ID NO: 7542587 - DNA, 22 bp, Homo sapiens
tcctgctgctacctggcccacg

SEQ ID NO: 7542588 - DNA, 22 bp, Homo sapiens
tcctgctgctacctggcccacg

SEQ ID NO: 7542589 - DNA, 22 bp, Homo sapiens
tcctgctgctcacctttttgtc

SEQ ID NO: 7542590 - DNA, 22 bp, Homo sapiens
tcctgctgctcacctttttgtc

SEQ ID NO: 7542591 - DNA, 22 bp, Homo sapiens
tcctgctgctacctggcccacg

SEQ ID NO: 7542592 - DNA, 22 bp, Homo sapiens
tcctgctgctacctggcccacg

SEQ ID NO: 7542593 - DNA, 22 bp, Homo sapiens
tcctgctgccatttcaagtgct

SEQ ID NO: 7542594 - DNA, 20 bp, Homo sapiens
tcctgctgccacctcttctt

SEQ ID NO: 7542595 - DNA, 22 bp, Homo sapiens
tcctgctgccatttcaagtgct

SEQ ID NO: 7542596 - DNA, 22 bp, Homo sapiens
tcctgctgccatttcaagtgct

SEQ ID NO: 7542597 - DNA, 18 bp, Homo sapiens
tcctgcctgtgccccagg

SEQ ID NO: 7542598 - DNA, 18 bp, Homo sapiens
tcctgcctgtgccccagg

SEQ ID NO: 7542599 - DNA, 18 bp, Homo sapiens
tcctgcctgtgccccagg

SEQ ID NO: 7542600 - DNA, 18 bp, Homo sapiens
tcctgcctgtgccccagg

SEQ ID NO: 7542601 - DNA, 18 bp, Homo sapiens
tcctgcctgtgccccagg

SEQ ID NO: 7542602 - DNA, 18 bp, Homo sapiens
tcctgcctgtgccccagg

SEQ ID NO: 7542603 - DNA, 19 bp, Homo sapiens
tcctgcctggggccgcctg

SEQ ID NO: 7542604 - DNA, 22 bp, Homo sapiens
tcctgcctgtttacctgtactt

SEQ ID NO: 7542605 - DNA, 22 bp, Homo sapiens
tcctgcctgtttacctgtactt

SEQ ID NO: 7542606 - DNA, 22 bp, Homo sapiens
tcctgcctgtttacctgtactt

SEQ ID NO: 7542607 - DNA, 22 bp, Homo sapiens
tcctgcctgtttacctgtactt

SEQ ID NO: 7542608 - DNA, 19 bp, Homo sapiens
tcctgcctggggccgcctg

SEQ ID NO: 7542609 - DNA, 19 bp, Homo sapiens
tcctgcctggggccgcctg

SEQ ID NO: 7542610 - DNA, 19 bp, Homo sapiens
tcctgcctggggccgcctg

SEQ ID NO: 7542611 - DNA, 19 bp, Homo sapiens
tcctgcctggggccgcctg

SEQ ID NO: 7542612 - DNA, 18 bp, Homo sapiens
tcctgcctgcgggctccc

SEQ ID NO: 7542613 - DNA, 18 bp, Homo sapiens
tcctgcctgcgggctccc

SEQ ID NO: 7542614 - DNA, 19 bp, Homo sapiens
tcctgcctggggccgcctg

SEQ ID NO: 7542615 - DNA, 18 bp, Homo sapiens
tcctgcctgcgggctccc

SEQ ID NO: 7542616 - DNA, 18 bp, Homo sapiens
tcctgcctgcgggctccc

SEQ ID NO: 7542617 - DNA, 18 bp, Homo sapiens
tcctgcctgcgggctccc

SEQ ID NO: 7542618 - DNA, 22 bp, Homo sapiens
tcctgcctgcaatcccagcact

SEQ ID NO: 7542619 - DNA, 18 bp, Homo sapiens
tcctgcctgcgggctccc

SEQ ID NO: 7542620 - DNA, 22 bp, Homo sapiens
ttcttcaaaatccagcatgatt

SEQ ID NO: 7542621 - DNA, 22 bp, Homo sapiens
ttcttcaaaatccagcatgatt

SEQ ID NO: 7542622 - DNA, 22 bp, Homo sapiens
ttcttcaaaatccagcatgatt

SEQ ID NO: 7542623 - DNA, 22 bp, Homo sapiens
ttcttcaaaatccagcatgatt

SEQ ID NO: 7542624 - DNA, 22 bp, Homo sapiens
ttcttcaaaatccagcatgatt

SEQ ID NO: 7542625 - DNA, 22 bp, Homo sapiens
ttcttcaaaatccagcatgatt

SEQ ID NO: 7542626 - DNA, 22 bp, Homo sapiens
ttcttcaaaacaacactggcct

SEQ ID NO: 7542627 - DNA, 22 bp, Homo sapiens
ttcttattttcctgaggaagaa

SEQ ID NO: 7542628 - DNA, 22 bp, Homo sapiens
ttcttattttcctgaggaagaa

SEQ ID NO: 7542629 - DNA, 22 bp, Homo sapiens
ttcttcaaaacaacactggcct

SEQ ID NO: 7542630 - DNA, 22 bp, Homo sapiens
ttcttcaaaacaacactggcct

SEQ ID NO: 7542631 - DNA, 22 bp, Homo sapiens
ttcttcaaagtaatagagacta

SEQ ID NO: 7542632 - DNA, 22 bp, Homo sapiens
ttcttcaaagtaatagagacta

SEQ ID NO: 7542633 - DNA, 22 bp, Homo sapiens
ttcttcaaagtaatagagacta

SEQ ID NO: 7542634 - DNA, 22 bp, Homo sapiens
ttcttcaaagatgtctgttgga

SEQ ID NO: 7542635 - DNA, 22 bp, Homo sapiens
ttcttcaaagatgtctgttgga

SEQ ID NO: 7542636 - DNA, 22 bp, Homo sapiens
ttcttcaaacaaaagtggcatg

SEQ ID NO: 7542637 - DNA, 22 bp, Homo sapiens
ttcttcaaacaaaagtggcatg

SEQ ID NO: 7542638 - DNA, 22 bp, Homo sapiens
ttcttcaaacaaaagtggcatg

SEQ ID NO: 7542639 - DNA, 23 bp, Homo sapiens
ttcttatttactttggaatctcc

SEQ ID NO: 7542640 - DNA, 22 bp, Homo sapiens
ttcttattcttgaaatgtggga

SEQ ID NO: 7542641 - DNA, 22 bp, Homo sapiens
ttcttattgggagaccttttct

SEQ ID NO: 7542642 - DNA, 22 bp, Homo sapiens
ttcttattgggagaccttttct

SEQ ID NO: 7542643 - DNA, 22 bp, Homo sapiens
ttcttattgggagaccttttct

SEQ ID NO: 7542644 - DNA, 22 bp, Homo sapiens
ttcttattgggagaccttttct

SEQ ID NO: 7542645 - DNA, 22 bp, Homo sapiens
ttcttattttcctgaggaagaa

SEQ ID NO: 7542646 - DNA, 22 bp, Homo sapiens
ttcttatttcccccttcatcat

SEQ ID NO: 7542647 - DNA, 22 bp, Homo sapiens
ttcttatttcccccttcatcat

SEQ ID NO: 7542648 - DNA, 23 bp, Homo sapiens
ttcttatttactttggaatctcc

SEQ ID NO: 7542649 - DNA, 22 bp, Homo sapiens
ttcttatttcccccttcatcat

SEQ ID NO: 7542650 - DNA, 22 bp, Homo sapiens
ttcttattcttgaaatgtggga

SEQ ID NO: 7542651 - DNA, 22 bp, Homo sapiens
ttcttattgggagaccttttct

SEQ ID NO: 7542652 - DNA, 22 bp, Homo sapiens
ttcttattatgtgctctgtgaa

SEQ ID NO: 7542653 - DNA, 22 bp, Homo sapiens
ttcttattatgtgctctgtgaa

SEQ ID NO: 7542654 - DNA, 22 bp, Homo sapiens
ttcttattcttgaaatgtggga

SEQ ID NO: 7542655 - DNA, 22 bp, Homo sapiens
ttcttattcttgaaatgtggga

SEQ ID NO: 7542656 - DNA, 22 bp, Homo sapiens
ttcttattatgtgctctgtgaa

SEQ ID NO: 7542657 - DNA, 22 bp, Homo sapiens
ttcttcaattcccatcccggtc

SEQ ID NO: 7542658 - DNA, 22 bp, Homo sapiens
ttcttcaattcccatcccggtc

SEQ ID NO: 7542659 - DNA, 22 bp, Homo sapiens
ttcttcaattttccatatactg

SEQ ID NO: 7542660 - DNA, 22 bp, Homo sapiens
ttcttcaatgtgccctgttttc

SEQ ID NO: 7542661 - DNA, 22 bp, Homo sapiens
ttcttcaattattggaaagaaa

SEQ ID NO: 7542662 - DNA, 22 bp, Homo sapiens
ttcttcaattattggaaagaaa

SEQ ID NO: 7542663 - DNA, 22 bp, Homo sapiens
ttcttcaagggtaaaggcaacg

SEQ ID NO: 7542664 - DNA, 22 bp, Homo sapiens
ttcttcaagtctggtccagctt

SEQ ID NO: 7542665 - DNA, 22 bp, Homo sapiens
ttcttcaatgtgccctgttttc

SEQ ID NO: 7542666 - DNA, 22 bp, Homo sapiens
ttcttcaataaattcccataag

SEQ ID NO: 7542667 - DNA, 22 bp, Homo sapiens
ttcttcaataaattcccataag

SEQ ID NO: 7542668 - DNA, 22 bp, Homo sapiens
ttcttcagactactgatgattg

SEQ ID NO: 7542669 - DNA, 22 bp, Homo sapiens
ttcttcagactactgatgattg

SEQ ID NO: 7542670 - DNA, 22 bp, Homo sapiens
ttctttggtgggagattgaggt

SEQ ID NO: 7542671 - DNA, 22 bp, Homo sapiens
ttctttggtgggagattgaggt

SEQ ID NO: 7542672 - DNA, 22 bp, Homo sapiens
ttcttcaaatgctgaaagtcta

SEQ ID NO: 7542673 - DNA, 22 bp, Homo sapiens
ttcttcaaatgctgaaagtcta

SEQ ID NO: 7542674 - DNA, 22 bp, Homo sapiens
ttcttcaaagtccttattcctt

SEQ ID NO: 7542675 - DNA, 22 bp, Homo sapiens
ttcttcaacaaggacactgtta

SEQ ID NO: 7542676 - DNA, 22 bp, Homo sapiens
ttcttcaacaaggacactgtta

SEQ ID NO: 7542677 - DNA, 22 bp, Homo sapiens
ttcttcaacaaggacactgtta

SEQ ID NO: 7542678 - DNA, 22 bp, Homo sapiens
ttcttcaagggtaaaggcaacg

SEQ ID NO: 7542679 - DNA, 22 bp, Homo sapiens
ttcttcaagggtaaaggcaacg

SEQ ID NO: 7542680 - DNA, 22 bp, Homo sapiens
ttcttcaaccatctacataaac

SEQ ID NO: 7542681 - DNA, 22 bp, Homo sapiens
ttcttcaaccatctacataaac

SEQ ID NO: 7542682 - DNA, 22 bp, Homo sapiens
ttcttcaaccatctacataaac

SEQ ID NO: 7542683 - DNA, 22 bp, Homo sapiens
ttcttcaaccatctacataaac

SEQ ID NO: 7542684 - DNA, 22 bp, Homo sapiens
ttcttcaaccatctacataaac

SEQ ID NO: 7542685 - DNA, 22 bp, Homo sapiens
ttctttgtgctgaagaagccct

SEQ ID NO: 7542686 - DNA, 22 bp, Homo sapiens
ttctttgtgctgaagaagccct

SEQ ID NO: 7542687 - DNA, 22 bp, Homo sapiens
ttctttgtgcatccaattttct

SEQ ID NO: 7542688 - DNA, 22 bp, Homo sapiens
ttctttgtgcatccaattttct

SEQ ID NO: 7542689 - DNA, 22 bp, Homo sapiens
ttctttgtagcaaaacgtgtat

SEQ ID NO: 7542690 - DNA, 22 bp, Homo sapiens
ttctttgtaacctttgggaact

SEQ ID NO: 7542691 - DNA, 22 bp, Homo sapiens
ttctttgtggcagtgagctggg

SEQ ID NO: 7542692 - DNA, 22 bp, Homo sapiens
ttctttgtggcagtgagctggg

SEQ ID NO: 7542693 - DNA, 22 bp, Homo sapiens
ttctttgtggcagtgagctggg

SEQ ID NO: 7542694 - DNA, 23 bp, Homo sapiens
ttctttgtggataatctccagtg

SEQ ID NO: 7542695 - DNA, 23 bp, Homo sapiens
ttctttgtggataatctccagtg

SEQ ID NO: 7542696 - DNA, 22 bp, Homo sapiens
ttctttgtgctgaagaagccct

SEQ ID NO: 7542697 - DNA, 19 bp, Homo sapiens
ttctttggtggtggtgacc

SEQ ID NO: 7542698 - DNA, 19 bp, Homo sapiens
ttctttggtggtggtgacc

SEQ ID NO: 7542699 - DNA, 22 bp, Homo sapiens
ttctttggtgttacccagctca

SEQ ID NO: 7542700 - DNA, 22 bp, Homo sapiens
ttctttggtgttacccagctca

SEQ ID NO: 7542701 - DNA, 19 bp, Homo sapiens
ttctttggtggtggtgacc

SEQ ID NO: 7542702 - DNA, 22 bp, Homo sapiens
ttctttgtaaagccacagtcct

SEQ ID NO: 7542703 - DNA, 22 bp, Homo sapiens
ttctttggtgttacccagctca

SEQ ID NO: 7542704 - DNA, 22 bp, Homo sapiens
ttctttgtaaagccacagtcct

SEQ ID NO: 7542705 - DNA, 22 bp, Homo sapiens
ttctttgtaacctttgggaact

SEQ ID NO: 7542706 - DNA, 20 bp, Homo sapiens
ttctttgttccttacatttg

SEQ ID NO: 7542707 - DNA, 20 bp, Homo sapiens
ttctttgttccttacatttg

SEQ ID NO: 7542708 - DNA, 20 bp, Homo sapiens
ttctttgttccttacatttg

SEQ ID NO: 7542709 - DNA, 20 bp, Homo sapiens
ttctttgttccttacatttg

SEQ ID NO: 7542710 - DNA, 22 bp, Homo sapiens
ttctttgtggcagtgagctggg

SEQ ID NO: 7542711 - DNA, 20 bp, Homo sapiens
ttctttgttccttacatttg

SEQ ID NO: 7542712 - DNA, 20 bp, Homo sapiens
ttctttgttccttacatttg

SEQ ID NO: 7542713 - DNA, 22 bp, Homo sapiens
ttctttgttgagcaagtaggac

SEQ ID NO: 7542714 - DNA, 22 bp, Homo sapiens
ttctttgttgtactttcctaca

SEQ ID NO: 7542715 - DNA, 22 bp, Homo sapiens
ttctttgttgtactttcctaca

SEQ ID NO: 7542716 - DNA, 22 bp, Homo sapiens
ttctttgttgagcaagtaggac

SEQ ID NO: 7542717 - DNA, 22 bp, Homo sapiens
ttctttgttgtactttcctaca

SEQ ID NO: 7542718 - DNA, 22 bp, Homo sapiens
ttctttgttgtactttcctaca

SEQ ID NO: 7542719 - DNA, 22 bp, Homo sapiens
ttctttgttgtactttcctaca

SEQ ID NO: 7542720 - DNA, 22 bp, Homo sapiens
ttctttgttgtactttcctaca

SEQ ID NO: 7542721 - DNA, 22 bp, Homo sapiens
ttctttgttgtactttcctaca

SEQ ID NO: 7542722 - DNA, 22 bp, Homo sapiens
ttctttgtttgataagtatgct

SEQ ID NO: 7542723 - DNA, 22 bp, Homo sapiens
ttctttgtttgataagtatgct

SEQ ID NO: 7542724 - DNA, 22 bp, Homo sapiens
ttctttgtttgataagtatgct

SEQ ID NO: 7542725 - DNA, 22 bp, Homo sapiens
ttctttgtttgataagtatgct

SEQ ID NO: 7542726 - DNA, 22 bp, Homo sapiens
ttcttttaaaagagagcagaaa

SEQ ID NO: 7542727 - DNA, 22 bp, Homo sapiens
ttcttttaaaagagagcagaaa

SEQ ID NO: 7542728 - DNA, 22 bp, Homo sapiens
ttcttttaaaagagagcagaaa

SEQ ID NO: 7542729 - DNA, 22 bp, Homo sapiens
ttcttttaatgtctggctttca

SEQ ID NO: 7542730 - DNA, 22 bp, Homo sapiens
ttcttttaatgtctggctttca

SEQ ID NO: 7542731 - DNA, 22 bp, Homo sapiens
ttcttttaatgtctggctttca

SEQ ID NO: 7542732 - DNA, 22 bp, Homo sapiens
ttcttttaatgtctggctttca

SEQ ID NO: 7542733 - DNA, 22 bp, Homo sapiens
ttcttttaatgtctggctttca

SEQ ID NO: 7542734 - DNA, 22 bp, Homo sapiens
ttcttttaatgttctgaagttt

SEQ ID NO: 7542735 - DNA, 22 bp, Homo sapiens
ttcttttaatgttctgaagttt

SEQ ID NO: 7542736 - DNA, 22 bp, Homo sapiens
ttcttttaatgttctgaagttt

SEQ ID NO: 7542737 - DNA, 22 bp, Homo sapiens
ttcttttaatagagatcctgtg

SEQ ID NO: 7542738 - DNA, 22 bp, Homo sapiens
ttcttttaaaagagagcagaaa

SEQ ID NO: 7542739 - DNA, 22 bp, Homo sapiens
ttcttttaatagagatcctgtg

SEQ ID NO: 7542740 - DNA, 22 bp, Homo sapiens
ttcttttaatagagatcctgtg

SEQ ID NO: 7542741 - DNA, 22 bp, Homo sapiens
ttcttttaatgtctggctttca

SEQ ID NO: 7542742 - DNA, 22 bp, Homo sapiens
ttcttttaatgtctggctttca

SEQ ID NO: 7542743 - DNA, 17 bp, Homo sapiens
ttcttttctgagccttg

SEQ ID NO: 7542744 - DNA, 17 bp, Homo sapiens
ttcttttctgagccttg

SEQ ID NO: 7542745 - DNA, 22 bp, Homo sapiens
ttcttttaattgtgggggagtg

SEQ ID NO: 7542746 - DNA, 22 bp, Homo sapiens
ttcttttaatgttctgaagttt

SEQ ID NO: 7542747 - DNA, 22 bp, Homo sapiens
ttcttttaatgttctgaagttt

SEQ ID NO: 7542748 - DNA, 22 bp, Homo sapiens
ttcttttaatgttctgaagttt

SEQ ID NO: 7542749 - DNA, 22 bp, Homo sapiens
ttcttttaatgttctgaagttt

SEQ ID NO: 7542750 - DNA, 22 bp, Homo sapiens
ttcttttctgcagctggtattt

SEQ ID NO: 7542751 - DNA, 22 bp, Homo sapiens
ttcttttcttggcaggagtaga

SEQ ID NO: 7542752 - DNA, 22 bp, Homo sapiens
ttcttttctgcagctggtattt

SEQ ID NO: 7542753 - DNA, 22 bp, Homo sapiens
ttcttttctgcagctggtattt

SEQ ID NO: 7542754 - DNA, 22 bp, Homo sapiens
ttcttttctgcagctggtattt

SEQ ID NO: 7542755 - DNA, 17 bp, Homo sapiens
ttcttttctgagccttg

SEQ ID NO: 7542756 - DNA, 22 bp, Homo sapiens
ttgaaatgctctttggaatcta

SEQ ID NO: 7542757 - DNA, 22 bp, Homo sapiens
ttgaaatggaagtgaaaattct

SEQ ID NO: 7542758 - DNA, 22 bp, Homo sapiens
ttgaaatggcagcagctgacct

SEQ ID NO: 7542759 - DNA, 22 bp, Homo sapiens
ttgaaatgcatcatcatttaga

SEQ ID NO: 7542760 - DNA, 22 bp, Homo sapiens
ttgaaatgcatcatcatttaga

SEQ ID NO: 7542761 - DNA, 22 bp, Homo sapiens
ttgaaatgcagattccaatcca

SEQ ID NO: 7542762 - DNA, 22 bp, Homo sapiens
ttgaaatgcagattccaatcca

SEQ ID NO: 7542763 - DNA, 22 bp, Homo sapiens
ttgaaatgcagattccaatcca

SEQ ID NO: 7542764 - DNA, 22 bp, Homo sapiens
ttgaaatgatctatttcagtag

SEQ ID NO: 7542765 - DNA, 22 bp, Homo sapiens
ttgaaatgatctatttcagtag

SEQ ID NO: 7542766 - DNA, 22 bp, Homo sapiens
ttgaaatgagcaaactgtcagc

SEQ ID NO: 7542767 - DNA, 22 bp, Homo sapiens
ttgaaatgagcaaactgtcagc

SEQ ID NO: 7542768 - DNA, 22 bp, Homo sapiens
ttgaaatgagactaattgattg

SEQ ID NO: 7542769 - DNA, 22 bp, Homo sapiens
ttgaaatgagactaattgattg

SEQ ID NO: 7542770 - DNA, 22 bp, Homo sapiens
ttgaaatgagactaattgattg

SEQ ID NO: 7542771 - DNA, 22 bp, Homo sapiens
ttgaaatgagactaattgattg

SEQ ID NO: 7542772 - DNA, 22 bp, Homo sapiens
ttgaaatgagcaaactgtcagc

SEQ ID NO: 7542773 - DNA, 22 bp, Homo sapiens
ttgaaatgagcaaactgtcagc

SEQ ID NO: 7542774 - DNA, 22 bp, Homo sapiens
ttgaaatcaggaaagttccagg

SEQ ID NO: 7542775 - DNA, 22 bp, Homo sapiens
ttgaaatcttccacagcccaag

SEQ ID NO: 7542776 - DNA, 22 bp, Homo sapiens
ttgaaatcttccacagcccaag

SEQ ID NO: 7542777 - DNA, 22 bp, Homo sapiens
ttgaaatgaaatatttaagctc

SEQ ID NO: 7542778 - DNA, 22 bp, Homo sapiens
ttgaaatgaaatatttaagctc

SEQ ID NO: 7542779 - DNA, 22 bp, Homo sapiens
ttgaaatcaccactagcatttg

SEQ ID NO: 7542780 - DNA, 22 bp, Homo sapiens
ttgaaatcaggaaagttccagg

SEQ ID NO: 7542781 - DNA, 22 bp, Homo sapiens
ttgaaatcaggaaagttccagg

SEQ ID NO: 7542782 - DNA, 22 bp, Homo sapiens
ttgaaatcaccactagcatttg

SEQ ID NO: 7542783 - DNA, 22 bp, Homo sapiens
ttgaaatcaccactagcatttg

SEQ ID NO: 7542784 - DNA, 22 bp, Homo sapiens
ttgaaatcaccactagcatttg

SEQ ID NO: 7542785 - DNA, 22 bp, Homo sapiens
ttgaaatatggattgaccttga

SEQ ID NO: 7542786 - DNA, 22 bp, Homo sapiens
ttgaaagggatatatctttctg

SEQ ID NO: 7542787 - DNA, 22 bp, Homo sapiens
ttgaaagggatatatctttctg

SEQ ID NO: 7542788 - DNA, 22 bp, Homo sapiens
ttgaaagggttaaagtggtaaa

SEQ ID NO: 7542789 - DNA, 20 bp, Homo sapiens
ttcttttgataagcttgaca

SEQ ID NO: 7542790 - DNA, 20 bp, Homo sapiens
ttcttttgataagcttgaca

SEQ ID NO: 7542791 - DNA, 20 bp, Homo sapiens
ttcttttgataagcttgaca

SEQ ID NO: 7542792 - DNA, 20 bp, Homo sapiens
ttcttttgataagcttgaca

SEQ ID NO: 7542793 - DNA, 20 bp, Homo sapiens
ttcttttgataagcttgaca

SEQ ID NO: 7542794 - DNA, 22 bp, Homo sapiens
ttcttttgcaagactattgatt

SEQ ID NO: 7542795 - DNA, 20 bp, Homo sapiens
ttcttttgataagcttgaca

SEQ ID NO: 7542796 - DNA, 22 bp, Homo sapiens
ttcttttgcaagactattgatt

SEQ ID NO: 7542797 - DNA, 22 bp, Homo sapiens
ttcttttggactcaaagagaac

SEQ ID NO: 7542798 - DNA, 22 bp, Homo sapiens
ttcttttggactcaaagagaac

SEQ ID NO: 7542799 - DNA, 22 bp, Homo sapiens
ttcttttgcaagactattgatt

SEQ ID NO: 7542800 - DNA, 22 bp, Homo sapiens
ttcttttggactcaaagagaac

SEQ ID NO: 7542801 - DNA, 22 bp, Homo sapiens
ttcttttctttaggcattgtgt

SEQ ID NO: 7542802 - DNA, 22 bp, Homo sapiens
ttcttttctttaggcattgtgt

SEQ ID NO: 7542803 - DNA, 22 bp, Homo sapiens
ttcttttctttaggcattgtgt

SEQ ID NO: 7542804 - DNA, 22 bp, Homo sapiens
ttcttttctttaggcattgtgt

SEQ ID NO: 7542805 - DNA, 22 bp, Homo sapiens
ttcttttctttaggcattgtgt

SEQ ID NO: 7542806 - DNA, 22 bp, Homo sapiens
ttcttttctttaggcattgtgt

SEQ ID NO: 7542807 - DNA, 22 bp, Homo sapiens
ttcttttcttggcaggagtaga

SEQ ID NO: 7542808 - DNA, 22 bp, Homo sapiens
ttcttttcttggcaggagtaga

SEQ ID NO: 7542809 - DNA, 22 bp, Homo sapiens
ttcttttcttggcaggagtaga

SEQ ID NO: 7542810 - DNA, 22 bp, Homo sapiens
ttcttttcttggcaggagtaga

SEQ ID NO: 7542811 - DNA, 22 bp, Homo sapiens
ttcttttggactcaaagagaac

SEQ ID NO: 7542812 - DNA, 22 bp, Homo sapiens
ttcttttggactcaaagagaac

SEQ ID NO: 7542813 - DNA, 22 bp, Homo sapiens
ttcttttgggaattacgtatgc

SEQ ID NO: 7542814 - DNA, 22 bp, Homo sapiens
ttctttttaaagtgtgtatgca

SEQ ID NO: 7542815 - DNA, 22 bp, Homo sapiens
ttctttttaaagtgtgtatgca

SEQ ID NO: 7542816 - DNA, 22 bp, Homo sapiens
ttctttttaaagtgtgtatgca

SEQ ID NO: 7542817 - DNA, 22 bp, Homo sapiens
ttctttttaaagtgtgtatgca

SEQ ID NO: 7542818 - DNA, 22 bp, Homo sapiens
ttctttttaaagtgtgtatgca

SEQ ID NO: 7542819 - DNA, 22 bp, Homo sapiens
ttctttttaaagtgtgtatgca

SEQ ID NO: 7542820 - DNA, 22 bp, Homo sapiens
ttctttttaaagtgtgtatgca

SEQ ID NO: 7542821 - DNA, 22 bp, Homo sapiens
ttctttttaaagtgtgtatgca

SEQ ID NO: 7542822 - DNA, 22 bp, Homo sapiens
ttctttttaaagtgtgtatgca

SEQ ID NO: 7542823 - DNA, 22 bp, Homo sapiens
ttctttttaaagtgtgtatgca

SEQ ID NO: 7542824 - DNA, 22 bp, Homo sapiens
ttctttttaaagtgtgtatgca

SEQ ID NO: 7542825 - DNA, 22 bp, Homo sapiens
ttgaaaggcacaggcacctggg

SEQ ID NO: 7542826 - DNA, 22 bp, Homo sapiens
ttgaaaggcctgtttatccagc

SEQ ID NO: 7542827 - DNA, 22 bp, Homo sapiens
ttgaaaggaatacagaggccta

SEQ ID NO: 7542828 - DNA, 22 bp, Homo sapiens
ttgaaaggcacaggcacctggg

SEQ ID NO: 7542829 - DNA, 23 bp, Homo sapiens
ttgaatttctcttgcaatattta

SEQ ID NO: 7542830 - DNA, 22 bp, Homo sapiens
ttgaatttagattgtatgttga

SEQ ID NO: 7542831 - DNA, 23 bp, Homo sapiens
ttgaatttctcttgcaatattta

SEQ ID NO: 7542832 - DNA, 23 bp, Homo sapiens
ttgaatttctcttgcaatattta

SEQ ID NO: 7542833 - DNA, 23 bp, Homo sapiens
ttgaatttctcttgcaatattta

SEQ ID NO: 7542834 - DNA, 22 bp, Homo sapiens
ttgaatttagattgtatgttga

SEQ ID NO: 7542835 - DNA, 22 bp, Homo sapiens
ttgaatttagattgtatgttga

SEQ ID NO: 7542836 - DNA, 22 bp, Homo sapiens
ttgaatttagattgtatgttga

SEQ ID NO: 7542837 - DNA, 22 bp, Homo sapiens
ttgaatttagattgtatgttga

SEQ ID NO: 7542838 - DNA, 22 bp, Homo sapiens
ttgaagaaagtcatatataatg

SEQ ID NO: 7542839 - DNA, 22 bp, Homo sapiens
ttgaagaaagtcatatataatg

SEQ ID NO: 7542840 - DNA, 22 bp, Homo sapiens
ttgaagaaagtcatatataatg

SEQ ID NO: 7542841 - DNA, 22 bp, Homo sapiens
ttgaagaaagtcatatataatg

SEQ ID NO: 7542842 - DNA, 22 bp, Homo sapiens
ttgaagaaagtcatatataatg

SEQ ID NO: 7542843 - DNA, 22 bp, Homo sapiens
ttgaagaaattattttatatag

SEQ ID NO: 7542844 - DNA, 22 bp, Homo sapiens
ttgaagaaattattttatatag

SEQ ID NO: 7542845 - DNA, 22 bp, Homo sapiens
ttgaagaaattattttatatag

SEQ ID NO: 7542846 - DNA, 22 bp, Homo sapiens
ttgaagaaagtcatatataatg

SEQ ID NO: 7542847 - DNA, 18 bp, Homo sapiens
ttgaattcttctacatgt

SEQ ID NO: 7542848 - DNA, 22 bp, Homo sapiens
ttgaattatttgtttgcaagct

SEQ ID NO: 7542849 - DNA, 22 bp, Homo sapiens
ttgaagaaattattttatatag

SEQ ID NO: 7542850 - DNA, 22 bp, Homo sapiens
ttgaagaaagtcatatataatg

SEQ ID NO: 7542851 - DNA, 22 bp, Homo sapiens
ttgaactagaagctttggaact

SEQ ID NO: 7542852 - DNA, 22 bp, Homo sapiens
ttgaactaataggtatcttgta

SEQ ID NO: 7542853 - DNA, 17 bp, Homo sapiens
ttgaacctagacacctt

SEQ ID NO: 7542854 - DNA, 22 bp, Homo sapiens
ttgaaccaggaacaattagctc

SEQ ID NO: 7542855 - DNA, 22 bp, Homo sapiens
ttgaacattagaataagtaatt

SEQ ID NO: 7542856 - DNA, 22 bp, Homo sapiens
ttgaacattaacttcagtctat

SEQ ID NO: 7542857 - DNA, 22 bp, Homo sapiens
ttgaacaatttggtatacaaac

SEQ ID NO: 7542858 - DNA, 22 bp, Homo sapiens
ttgaacaatttggtatacaaac

SEQ ID NO: 7542859 - DNA, 22 bp, Homo sapiens
ttgaacaatttggtatacaaac

SEQ ID NO: 7542860 - DNA, 22 bp, Homo sapiens
ttgaacaatttggtatacaaac

SEQ ID NO: 7542861 - DNA, 22 bp, Homo sapiens
ttgaacaatttggtatacaaac

SEQ ID NO: 7542862 - DNA, 22 bp, Homo sapiens
ttgaacaatcaaaagaattcat

SEQ ID NO: 7542863 - DNA, 22 bp, Homo sapiens
ttgaacaatcaaaagaattcat

SEQ ID NO: 7542864 - DNA, 19 bp, Homo sapiens
ttgaaattgtttgatatgg

SEQ ID NO: 7542865 - DNA, 22 bp, Homo sapiens
ttgaaattttaggccttgcaat

SEQ ID NO: 7542866 - DNA, 22 bp, Homo sapiens
ttgaacattaacttcagtctat

SEQ ID NO: 7542867 - DNA, 22 bp, Homo sapiens
ttgaacattaacttcagtctat

SEQ ID NO: 7542868 - DNA, 22 bp, Homo sapiens
ttgaacagtcctaagagaccct

SEQ ID NO: 7542869 - DNA, 22 bp, Homo sapiens
ttgaacagctgttacattgtta

SEQ ID NO: 7542870 - DNA, 19 bp, Homo sapiens
ttgaacactttcttcaagg

SEQ ID NO: 7542871 - DNA, 19 bp, Homo sapiens
ttgaacactttcttcaagg

SEQ ID NO: 7542872 - DNA, 22 bp, Homo sapiens
ttgaaattgggtgtggctgtca

SEQ ID NO: 7542873 - DNA, 19 bp, Homo sapiens
ttgaaattgtttgatatgg

SEQ ID NO: 7542874 - DNA, 19 bp, Homo sapiens
ttgaaattgtttgatatgg

SEQ ID NO: 7542875 - DNA, 19 bp, Homo sapiens
ttgaaattgtttgatatgg

SEQ ID NO: 7542876 - DNA, 19 bp, Homo sapiens
ttgaaattgtttgatatgg

SEQ ID NO: 7542877 - DNA, 22 bp, Homo sapiens
ttgaaatggcagcagctgacct

SEQ ID NO: 7542878 - DNA, 22 bp, Homo sapiens
ttgaaatggcagcagctgacct

SEQ ID NO: 7542879 - DNA, 22 bp, Homo sapiens
ttgaaatggcagcagctgacct

SEQ ID NO: 7542880 - DNA, 22 bp, Homo sapiens
ttgaaatgtagtcctgccttca

SEQ ID NO: 7542881 - DNA, 22 bp, Homo sapiens
ttgaaatgtagtcctgccttca

SEQ ID NO: 7542882 - DNA, 20 bp, Homo sapiens
ttcttagtagagcatgtatt

SEQ ID NO: 7542883 - DNA, 22 bp, Homo sapiens
ttcttagtcatctgagccagcc

SEQ ID NO: 7542884 - DNA, 22 bp, Homo sapiens
ttcttagtccatccctcctttg

SEQ ID NO: 7542885 - DNA, 19 bp, Homo sapiens
ttcttagtctcatgcatga

SEQ ID NO: 7542886 - DNA, 22 bp, Homo sapiens
ttcttagtggtagtcatctttg

SEQ ID NO: 7542887 - DNA, 22 bp, Homo sapiens
ttcttaggggcagtcgggtcag

SEQ ID NO: 7542888 - DNA, 22 bp, Homo sapiens
ttcttagctccagcttcatgtt

SEQ ID NO: 7542889 - DNA, 20 bp, Homo sapiens
ttcttagtagagcatgtatt

SEQ ID NO: 7542890 - DNA, 20 bp, Homo sapiens
ttcttagtagagcatgtatt

SEQ ID NO: 7542891 - DNA, 22 bp, Homo sapiens
ttcttagagatggttaaaaata

SEQ ID NO: 7542892 - DNA, 22 bp, Homo sapiens
ttcttagatgattaatgatggg

SEQ ID NO: 7542893 - DNA, 22 bp, Homo sapiens
ttcttagatgattaatgatggg

SEQ ID NO: 7542894 - DNA, 22 bp, Homo sapiens
ttcttagagatggttaaaaata

SEQ ID NO: 7542895 - DNA, 22 bp, Homo sapiens
ttcttagagatggttaaaaata

SEQ ID NO: 7542896 - DNA, 22 bp, Homo sapiens
ttcttagaagaaacatctaaaa

SEQ ID NO: 7542897 - DNA, 22 bp, Homo sapiens
ttcttagaagaaacatctaaaa

SEQ ID NO: 7542898 - DNA, 22 bp, Homo sapiens
ttcttactagtatgtttcagca

SEQ ID NO: 7542899 - DNA, 22 bp, Homo sapiens
ttcttactatgatttgagcctc

SEQ ID NO: 7542900 - DNA, 22 bp, Homo sapiens
ttcttactatgatttgagcctc

SEQ ID NO: 7542901 - DNA, 22 bp, Homo sapiens
ttcttagtggtagtcatctttg

SEQ ID NO: 7542902 - DNA, 22 bp, Homo sapiens
ttcttataagttaatatttcca

SEQ ID NO: 7542903 - DNA, 22 bp, Homo sapiens
ttcttagttcaactaaaattta

SEQ ID NO: 7542904 - DNA, 22 bp, Homo sapiens
ttcttataagataggcctcagg

SEQ ID NO: 7542905 - DNA, 22 bp, Homo sapiens
ttcttatagaagcaaccattgt

SEQ ID NO: 7542906 - DNA, 22 bp, Homo sapiens
ttcttataagttaatatttcca

SEQ ID NO: 7542907 - DNA, 22 bp, Homo sapiens
ttcttataagttaatatttcca

SEQ ID NO: 7542908 - DNA, 22 bp, Homo sapiens
ttcttataagttaatatttcca

SEQ ID NO: 7542909 - DNA, 22 bp, Homo sapiens
ttcttataagttaatatttcca

SEQ ID NO: 7542910 - DNA, 22 bp, Homo sapiens
ttcttataagttaatatttcca

SEQ ID NO: 7542911 - DNA, 22 bp, Homo sapiens
ttcttataagttaatatttcca

SEQ ID NO: 7542912 - DNA, 22 bp, Homo sapiens
ttcttatagaagcaaccattgt

SEQ ID NO: 7542913 - DNA, 22 bp, Homo sapiens
ttcttatattgggtcatggata

SEQ ID NO: 7542914 - DNA, 22 bp, Homo sapiens
ttcttatagaagcaaccattgt

SEQ ID NO: 7542915 - DNA, 22 bp, Homo sapiens
ttcttatagaagcaaccattgt

SEQ ID NO: 7542916 - DNA, 22 bp, Homo sapiens
ttcttatagaagcaaccattgt

SEQ ID NO: 7542917 - DNA, 22 bp, Homo sapiens
ttcttatgttcacataattcca

SEQ ID NO: 7542918 - DNA, 22 bp, Homo sapiens
ttcttatgttcacataattcca

SEQ ID NO: 7542919 - DNA, 22 bp, Homo sapiens
ttcttatgttcacataattcca

SEQ ID NO: 7542920 - DNA, 22 bp, Homo sapiens
ttcttatgttcacataattcca

SEQ ID NO: 7542921 - DNA, 22 bp, Homo sapiens
ttctgtgtgccagagttgtgct

SEQ ID NO: 7542922 - DNA, 22 bp, Homo sapiens
ttctgtgtgccagagttgtgct

SEQ ID NO: 7542923 - DNA, 22 bp, Homo sapiens
ttctgtgtgccagagttgtgct

SEQ ID NO: 7542924 - DNA, 22 bp, Homo sapiens
ttctgtgtgcttactggtgttc

SEQ ID NO: 7542925 - DNA, 22 bp, Homo sapiens
ttctgtgtgcttactggtgttc

SEQ ID NO: 7542926 - DNA, 19 bp, Homo sapiens
ttctgtgttaattccttta

SEQ ID NO: 7542927 - DNA, 19 bp, Homo sapiens
ttctgtgttaattccttta

SEQ ID NO: 7542928 - DNA, 22 bp, Homo sapiens
ttctgtgtgtctcagcaagctg

SEQ ID NO: 7542929 - DNA, 22 bp, Homo sapiens
ttctgtgtgtctcagcaagctg

SEQ ID NO: 7542930 - DNA, 22 bp, Homo sapiens
ttctgtgtgtctcagcaagctg

SEQ ID NO: 7542931 - DNA, 22 bp, Homo sapiens
ttctgtgtgggtagctcctgtt

SEQ ID NO: 7542932 - DNA, 22 bp, Homo sapiens
ttctgtgttgtgacattctaga

SEQ ID NO: 7542933 - DNA, 22 bp, Homo sapiens
ttctgtgttgtgacattctaga

SEQ ID NO: 7542934 - DNA, 22 bp, Homo sapiens
ttctgttacaagtgaaaaaatg

SEQ ID NO: 7542935 - DNA, 22 bp, Homo sapiens
ttctgtgttctgtgcaatgagc

SEQ ID NO: 7542936 - DNA, 22 bp, Homo sapiens
ttctgtgttctgtgcaatgagc

SEQ ID NO: 7542937 - DNA, 22 bp, Homo sapiens
ttcttacattagtctgtgcttt

SEQ ID NO: 7542938 - DNA, 22 bp, Homo sapiens
ttcttactacatttgcaggcta

SEQ ID NO: 7542939 - DNA, 22 bp, Homo sapiens
ttcttactagtatgtttcagca

SEQ ID NO: 7542940 - DNA, 22 bp, Homo sapiens
ttcttactagtatgtttcagca

SEQ ID NO: 7542941 - DNA, 22 bp, Homo sapiens
ttcttacattactttacatgtg

SEQ ID NO: 7542942 - DNA, 22 bp, Homo sapiens
ttcttacattactttacatgtg

SEQ ID NO: 7542943 - DNA, 22 bp, Homo sapiens
ttcttacattactttacatgtg

SEQ ID NO: 7542944 - DNA, 22 bp, Homo sapiens
ttctgttacaagtgaaaaaatg

SEQ ID NO: 7542945 - DNA, 22 bp, Homo sapiens
ttcttacattactttacatgtg

SEQ ID NO: 7542946 - DNA, 22 bp, Homo sapiens
ttctgtgcgtaggcgatgcagt

SEQ ID NO: 7542947 - DNA, 22 bp, Homo sapiens
ttctgtgcgtaggcgatgcagt

SEQ ID NO: 7542948 - DNA, 17 bp, Homo sapiens
ttctgtgcttcctggct

SEQ ID NO: 7542949 - DNA, 22 bp, Homo sapiens
ttctgtggaatatgaactagca

SEQ ID NO: 7542950 - DNA, 18 bp, Homo sapiens
ttctgtgcatctttctat

SEQ ID NO: 7542951 - DNA, 22 bp, Homo sapiens
ttctgtgattgacatgtggctt

SEQ ID NO: 7542952 - DNA, 22 bp, Homo sapiens
ttctgtgattagttgtctggct

SEQ ID NO: 7542953 - DNA, 22 bp, Homo sapiens
ttctgtgaatcttttttcccac

SEQ ID NO: 7542954 - DNA, 22 bp, Homo sapiens
ttctgtgaatcttttttcccac

SEQ ID NO: 7542955 - DNA, 22 bp, Homo sapiens
ttctgtgaaactaaagagagga

SEQ ID NO: 7542956 - DNA, 22 bp, Homo sapiens
ttctgtgaatcttttttcccac

SEQ ID NO: 7542957 - DNA, 22 bp, Homo sapiens
ttctgtgaatggccatgacaag

SEQ ID NO: 7542958 - DNA, 22 bp, Homo sapiens
ttctgtgaatggccatgacaag

SEQ ID NO: 7542959 - DNA, 22 bp, Homo sapiens
ttctgtgaatggccatgacaag

SEQ ID NO: 7542960 - DNA, 22 bp, Homo sapiens
ttctgtgactcctcagagattt

SEQ ID NO: 7542961 - DNA, 22 bp, Homo sapiens
ttctgtgaggacttctcaagga

SEQ ID NO: 7542962 - DNA, 22 bp, Homo sapiens
ttctgtggttgaaaggagagat

SEQ ID NO: 7542963 - DNA, 22 bp, Homo sapiens
ttctgtggttgaaaggagagat

SEQ ID NO: 7542964 - DNA, 22 bp, Homo sapiens
ttctgtggtctcccatgtctgt

SEQ ID NO: 7542965 - DNA, 22 bp, Homo sapiens
ttctgtgggtaatacctcatac

SEQ ID NO: 7542966 - DNA, 22 bp, Homo sapiens
ttctgtgggtaatacctcatac

SEQ ID NO: 7542967 - DNA, 22 bp, Homo sapiens
ttctgtggtctcccatgtctgt

SEQ ID NO: 7542968 - DNA, 22 bp, Homo sapiens
ttctgtggcagtttgggaggtg

SEQ ID NO: 7542969 - DNA, 22 bp, Homo sapiens
ttctgtggctgggagcctggct

SEQ ID NO: 7542970 - DNA, 22 bp, Homo sapiens
ttctgtggcagtttgggaggtg

SEQ ID NO: 7542971 - DNA, 22 bp, Homo sapiens
ttctgtggctgggagcctggct

SEQ ID NO: 7542972 - DNA, 22 bp, Homo sapiens
ttctgtggaggtttggaacatt

SEQ ID NO: 7542973 - DNA, 22 bp, Homo sapiens
ttctgtggaggtttggaacatt

SEQ ID NO: 7542974 - DNA, 22 bp, Homo sapiens
ttctgtggaatatgaactagca

SEQ ID NO: 7542975 - DNA, 22 bp, Homo sapiens
ttctgtgtcttcttgttctgtg

SEQ ID NO: 7542976 - DNA, 22 bp, Homo sapiens
ttctgtgtcttcttgttctgtg

SEQ ID NO: 7542977 - DNA, 22 bp, Homo sapiens
ttctgtggttgaaaggagagat

SEQ ID NO: 7542978 - DNA, 22 bp, Homo sapiens
ttctgtgtgccagagttgtgct

SEQ ID NO: 7542979 - DNA, 22 bp, Homo sapiens
ttctgtgtgccagagttgtgct

SEQ ID NO: 7542980 - DNA, 22 bp, Homo sapiens
ttctgtgtcttcttgttctgtg

SEQ ID NO: 7542981 - DNA, 22 bp, Homo sapiens
ttctgtgtcttcttgttctgtg

SEQ ID NO: 7542982 - DNA, 22 bp, Homo sapiens
ttctgtctgatggtgccagaac

SEQ ID NO: 7542983 - DNA, 22 bp, Homo sapiens
ttctgtctgatggtgccagaac

SEQ ID NO: 7542984 - DNA, 22 bp, Homo sapiens
ttctgtctctgtgtttacatta

SEQ ID NO: 7542985 - DNA, 22 bp, Homo sapiens
ttctgtctctgtgtttacatta

SEQ ID NO: 7542986 - DNA, 22 bp, Homo sapiens
ttctgtctgatggtgccagaac

SEQ ID NO: 7542987 - DNA, 22 bp, Homo sapiens
ttctgtctggaaaaggacatag

SEQ ID NO: 7542988 - DNA, 22 bp, Homo sapiens
ttctgtctggaaaaggacatag

SEQ ID NO: 7542989 - DNA, 22 bp, Homo sapiens
ttctgtctggaaaaggacatag

SEQ ID NO: 7542990 - DNA, 22 bp, Homo sapiens
ttctgtctgatggtgccagaac

SEQ ID NO: 7542991 - DNA, 19 bp, Homo sapiens
ttctgtaaggacattaatc

SEQ ID NO: 7542992 - DNA, 19 bp, Homo sapiens
ttctgtaagggagagaggg

SEQ ID NO: 7542993 - DNA, 22 bp, Homo sapiens
ttctgtaagggatttattctga

SEQ ID NO: 7542994 - DNA, 22 bp, Homo sapiens
ttctgtaagggatttattctga

SEQ ID NO: 7542995 - DNA, 22 bp, Homo sapiens
ttctgtaagggatttattctga

SEQ ID NO: 7542996 - DNA, 22 bp, Homo sapiens
ttctgtaagggatttattctga

SEQ ID NO: 7542997 - DNA, 22 bp, Homo sapiens
ttctgtaattctgttagtttca

SEQ ID NO: 7542998 - DNA, 22 bp, Homo sapiens
ttctgtaattctgttagtttca

SEQ ID NO: 7542999 - DNA, 22 bp, Homo sapiens
ttctgtacccaacatttttact

SEQ ID NO: 7543000 - DNA, 22 bp, Homo sapiens
ttctgtgaaactaaagagagga

SEQ ID NO: 7543001 - DNA, 23 bp, Homo sapiens
ttctgtcttgctgtcagctttct

SEQ ID NO: 7543002 - DNA, 23 bp, Homo sapiens
ttctgtcttgctgtcagctttct

SEQ ID NO: 7543003 - DNA, 22 bp, Homo sapiens
ttctgtcttctcggttgtttac

SEQ ID NO: 7543004 - DNA, 22 bp, Homo sapiens
ttctgtcttctcggttgtttac

SEQ ID NO: 7543005 - DNA, 22 bp, Homo sapiens
ttctgtcttctcggttgtttac

SEQ ID NO: 7543006 - DNA, 22 bp, Homo sapiens
ttctgtcttctcggttgtttac

SEQ ID NO: 7543007 - DNA, 22 bp, Homo sapiens
ttctgtcttcccactgaggagc

SEQ ID NO: 7543008 - DNA, 22 bp, Homo sapiens
ttctgtcttcccactgaggagc

SEQ ID NO: 7543009 - DNA, 22 bp, Homo sapiens
ttctgtcttcccactgaggagc

SEQ ID NO: 7543010 - DNA, 22 bp, Homo sapiens
ttctgtcttcccactgaggagc

SEQ ID NO: 7543011 - DNA, 22 bp, Homo sapiens
ttctgtctgtaaacttctcaat

SEQ ID NO: 7543012 - DNA, 22 bp, Homo sapiens
ttctgtctgtaaacttctcaat

SEQ ID NO: 7543013 - DNA, 22 bp, Homo sapiens
ttctgtctgtaaacttctcaat

SEQ ID NO: 7543014 - DNA, 22 bp, Homo sapiens
ttctgtctgtaaacttctcaat

SEQ ID NO: 7543015 - DNA, 22 bp, Homo sapiens
ttctgtctgtaaacttctcaat

SEQ ID NO: 7543016 - DNA, 22 bp, Homo sapiens
ttctgtctgtaaacttctcaat

SEQ ID NO: 7543017 - DNA, 22 bp, Homo sapiens
ttctgtctgtaaacttctcaat

SEQ ID NO: 7543018 - DNA, 19 bp, Homo sapiens
ttctggacagcagaaacca

SEQ ID NO: 7543019 - DNA, 19 bp, Homo sapiens
ttctggacagcagaaacca

SEQ ID NO: 7543020 - DNA, 22 bp, Homo sapiens
ttctggaattcttgcagccact

SEQ ID NO: 7543021 - DNA, 22 bp, Homo sapiens
ttctggaattcttgcagccact

SEQ ID NO: 7543022 - DNA, 22 bp, Homo sapiens
ttctggacttgccttgctgatg

SEQ ID NO: 7543023 - DNA, 23 bp, Homo sapiens
ttctggacattgggcaatagcag

SEQ ID NO: 7543024 - DNA, 22 bp, Homo sapiens
ttctggagaaaattctgtcatt

SEQ ID NO: 7543025 - DNA, 22 bp, Homo sapiens
ttctggagaaaattctgtcatt

SEQ ID NO: 7543026 - DNA, 22 bp, Homo sapiens
ttctggagaaaattctgtcatt

SEQ ID NO: 7543027 - DNA, 22 bp, Homo sapiens
ttctggaatgcctgttctaatt

SEQ ID NO: 7543028 - DNA, 22 bp, Homo sapiens
ttctggaatgcctgttctaatt

SEQ ID NO: 7543029 - DNA, 22 bp, Homo sapiens
ttctggaatgcctgttctaatt

SEQ ID NO: 7543030 - DNA, 22 bp, Homo sapiens
ttctggaattcttgcagccact

SEQ ID NO: 7543031 - DNA, 22 bp, Homo sapiens
ttctggaatgcctgttctaatt

SEQ ID NO: 7543032 - DNA, 22 bp, Homo sapiens
ttctggaattcttgcagccact

SEQ ID NO: 7543033 - DNA, 22 bp, Homo sapiens
ttctggaatatttgacacaatt

SEQ ID NO: 7543034 - DNA, 22 bp, Homo sapiens
ttctggaatcctcaaaacatga

SEQ ID NO: 7543035 - DNA, 22 bp, Homo sapiens
ttctggaatatttgacacaatt

SEQ ID NO: 7543036 - DNA, 22 bp, Homo sapiens
ttctggaatcctcaaaacatga

SEQ ID NO: 7543037 - DNA, 22 bp, Homo sapiens
ttctggaatcctcaaaacatga

SEQ ID NO: 7543038 - DNA, 22 bp, Homo sapiens
ttctggagagaagaccagtgtg

SEQ ID NO: 7543039 - DNA, 22 bp, Homo sapiens
ttctggagagaaaccttacaaa

SEQ ID NO: 7543040 - DNA, 22 bp, Homo sapiens
ttctggagacccagcaacaggg

SEQ ID NO: 7543041 - DNA, 22 bp, Homo sapiens
ttctggagacccagcaacaggg

SEQ ID NO: 7543042 - DNA, 22 bp, Homo sapiens
ttctggagacccagcaacaggg

SEQ ID NO: 7543043 - DNA, 22 bp, Homo sapiens
ttctggagacccagcaacaggg

SEQ ID NO: 7543044 - DNA, 22 bp, Homo sapiens
ttctggagacccagcaacaggg

SEQ ID NO: 7543045 - DNA, 22 bp, Homo sapiens
ttctggagacccagcaacaggg

SEQ ID NO: 7543046 - DNA, 23 bp, Homo sapiens
ttctggagaaaggaccatagctt

SEQ ID NO: 7543047 - DNA, 22 bp, Homo sapiens
ttctggagaataatcagcattg

SEQ ID NO: 7543048 - DNA, 23 bp, Homo sapiens
ttctggagaaaggaccatagctt

SEQ ID NO: 7543049 - DNA, 22 bp, Homo sapiens
ttctggagaatcaccaccaggc

SEQ ID NO: 7543050 - DNA, 22 bp, Homo sapiens
ttctggagaataatcagcattg

SEQ ID NO: 7543051 - DNA, 22 bp, Homo sapiens
ttctggagaataatcagcattg

SEQ ID NO: 7543052 - DNA, 22 bp, Homo sapiens
ttctggagaataatcagcattg

SEQ ID NO: 7543053 - DNA, 22 bp, Homo sapiens
ttctggagaataatcagcattg

SEQ ID NO: 7543054 - DNA, 22 bp, Homo sapiens
ttctggagattgagaaggcatt

SEQ ID NO: 7543055 - DNA, 22 bp, Homo sapiens
ttctggagattgagaaggcatt

SEQ ID NO: 7543056 - DNA, 22 bp, Homo sapiens
ttctggagattgagaaggcatt

SEQ ID NO: 7543057 - DNA, 22 bp, Homo sapiens
ttctggagattgagaaggcatt

SEQ ID NO: 7543058 - DNA, 22 bp, Homo sapiens
ttctggagattgagaaggcatt

SEQ ID NO: 7543059 - DNA, 22 bp, Homo sapiens
ttctggagattgagaaggcatt

SEQ ID NO: 7543060 - DNA, 22 bp, Homo sapiens
ttctggagatctgcctatggga

SEQ ID NO: 7543061 - DNA, 22 bp, Homo sapiens
ttctggagatgacttttagaaa

SEQ ID NO: 7543062 - DNA, 22 bp, Homo sapiens
ttctggagatagtcaggcatta

SEQ ID NO: 7543063 - DNA, 22 bp, Homo sapiens
ttctggagatagtcaggcatta

SEQ ID NO: 7543064 - DNA, 22 bp, Homo sapiens
ttctggagatagtcaggcatta

SEQ ID NO: 7543065 - DNA, 22 bp, Homo sapiens
ttctggagatagtcaggcatta

SEQ ID NO: 7543066 - DNA, 22 bp, Homo sapiens
ttctggagaggaacagaaaggt

SEQ ID NO: 7543067 - DNA, 22 bp, Homo sapiens
ttctggagaggaacagaaaggt

SEQ ID NO: 7543068 - DNA, 22 bp, Homo sapiens
ttctggagaggaacagaaaggt

SEQ ID NO: 7543069 - DNA, 22 bp, Homo sapiens
ttctggagaggaacagaaaggt

SEQ ID NO: 7543070 - DNA, 22 bp, Homo sapiens
ttctggagaggaacagaaaggt

SEQ ID NO: 7543071 - DNA, 22 bp, Homo sapiens
ttctggagccgggcctgggcag

SEQ ID NO: 7543072 - DNA, 22 bp, Homo sapiens
ttctggagccccaagatctgta

SEQ ID NO: 7543073 - DNA, 22 bp, Homo sapiens
ttctggagccccaagatctgta

SEQ ID NO: 7543074 - DNA, 22 bp, Homo sapiens
ttctggagccccaagatctgta

SEQ ID NO: 7543075 - DNA, 22 bp, Homo sapiens
ttctggagccgggcctgggcag

SEQ ID NO: 7543076 - DNA, 22 bp, Homo sapiens
ttctggagccgggcctgggcag

SEQ ID NO: 7543077 - DNA, 22 bp, Homo sapiens
ttctggagctaaagtccactct

SEQ ID NO: 7543078 - DNA, 22 bp, Homo sapiens
ttctggagctaaagtccactct

SEQ ID NO: 7543079 - DNA, 22 bp, Homo sapiens
ttctggagctctcgaccccact

SEQ ID NO: 7543080 - DNA, 22 bp, Homo sapiens
ttctggagctaaagtccactct

SEQ ID NO: 7543081 - DNA, 19 bp, Homo sapiens
ttctgtaaggacattaatc

SEQ ID NO: 7543082 - DNA, 22 bp, Homo sapiens
ttctgtaagctaccaagtttgt

SEQ ID NO: 7543083 - DNA, 22 bp, Homo sapiens
ttctgtaagctaccaagtttgt

SEQ ID NO: 7543084 - DNA, 22 bp, Homo sapiens
ttctgtaagctaccaagtttgt

SEQ ID NO: 7543085 - DNA, 22 bp, Homo sapiens
ttctgtaaacatcaagtgcctg

SEQ ID NO: 7543086 - DNA, 22 bp, Homo sapiens
ttctgtaagctaccaagtttgt

SEQ ID NO: 7543087 - DNA, 22 bp, Homo sapiens
ttctgtaaacatcaagtgcctg

SEQ ID NO: 7543088 - DNA, 22 bp, Homo sapiens
ttctgtaagctaccaagtttgt

SEQ ID NO: 7543089 - DNA, 22 bp, Homo sapiens
ttctctggggactgtctctatt

SEQ ID NO: 7543090 - DNA, 22 bp, Homo sapiens
ttctctggggactgtctctatt

SEQ ID NO: 7543091 - DNA, 22 bp, Homo sapiens
ttctctggggactgtctctatt

SEQ ID NO: 7543092 - DNA, 22 bp, Homo sapiens
ttctctggggacttggttggag

SEQ ID NO: 7543093 - DNA, 22 bp, Homo sapiens
ttctctggggacttggttggag

SEQ ID NO: 7543094 - DNA, 22 bp, Homo sapiens
ttctctggggttcagtatctct

SEQ ID NO: 7543095 - DNA, 22 bp, Homo sapiens
ttctctggggttcagtatctct

SEQ ID NO: 7543096 - DNA, 22 bp, Homo sapiens
ttctctggggttcagtatctct

SEQ ID NO: 7543097 - DNA, 22 bp, Homo sapiens
ttctctgggttaggggaactat

SEQ ID NO: 7543098 - DNA, 22 bp, Homo sapiens
ttctctgggttaggggaactat

SEQ ID NO: 7543099 - DNA, 22 bp, Homo sapiens
ttctctgggttaggggaactat

SEQ ID NO: 7543100 - DNA, 16 bp, Homo sapiens
ttctctggggttgtgc

SEQ ID NO: 7543101 - DNA, 22 bp, Homo sapiens
ttctctggacagtgaagagagg

SEQ ID NO: 7543102 - DNA, 22 bp, Homo sapiens
ttctctggacagtgaagagagg

SEQ ID NO: 7543103 - DNA, 22 bp, Homo sapiens
ttctctggacagtgaagagagg

SEQ ID NO: 7543104 - DNA, 22 bp, Homo sapiens
ttctctggacagtgaagagagg

SEQ ID NO: 7543105 - DNA, 22 bp, Homo sapiens
ttctctgggacaggaacagttt

SEQ ID NO: 7543106 - DNA, 19 bp, Homo sapiens
ttctctggactagatgctg

SEQ ID NO: 7543107 - DNA, 22 bp, Homo sapiens
ttctctgggatctggcaaaagg

SEQ ID NO: 7543108 - DNA, 22 bp, Homo sapiens
ttctctgggatctggcaaaagg

SEQ ID NO: 7543109 - DNA, 22 bp, Homo sapiens
ttctctgggacaggaacagttt

SEQ ID NO: 7543110 - DNA, 22 bp, Homo sapiens
ttctctgggacaggaacagttt

SEQ ID NO: 7543111 - DNA, 22 bp, Homo sapiens
ttctctgggatctggcaaaagg

SEQ ID NO: 7543112 - DNA, 22 bp, Homo sapiens
ttctggaaatgcacaactaatt

SEQ ID NO: 7543113 - DNA, 22 bp, Homo sapiens
ttctggaaatgcacaactaatt

SEQ ID NO: 7543114 - DNA, 22 bp, Homo sapiens
ttctggaaatgcacaactaatt

SEQ ID NO: 7543115 - DNA, 22 bp, Homo sapiens
ttctggaaatgaatgctaggaa

SEQ ID NO: 7543116 - DNA, 22 bp, Homo sapiens
ttctggaaatgcacaactaatt

SEQ ID NO: 7543117 - DNA, 18 bp, Homo sapiens
ttctctggtggatgttat

SEQ ID NO: 7543118 - DNA, 22 bp, Homo sapiens
ttctggaaatgttgctgaggcc

SEQ ID NO: 7543119 - DNA, 22 bp, Homo sapiens
ttctggaaatgggtatagagca

SEQ ID NO: 7543120 - DNA, 22 bp, Homo sapiens
ttctggaaatgggtatagagca

SEQ ID NO: 7543121 - DNA, 22 bp, Homo sapiens
ttctggaaatgggtatagagca

SEQ ID NO: 7543122 - DNA, 22 bp, Homo sapiens
ttctggaaatgcacaactaatt

SEQ ID NO: 7543123 - DNA, 22 bp, Homo sapiens
ttctggaaatgggtatagagca

SEQ ID NO: 7543124 - DNA, 22 bp, Homo sapiens
ttctggaaatgggtatagagca

SEQ ID NO: 7543125 - DNA, 22 bp, Homo sapiens
ttctggaacatagcaagaagtt

SEQ ID NO: 7543126 - DNA, 22 bp, Homo sapiens
ttctggaaatgttgctgaggcc

SEQ ID NO: 7543127 - DNA, 22 bp, Homo sapiens
ttctggaaatgttgctgaggcc

SEQ ID NO: 7543128 - DNA, 22 bp, Homo sapiens
ttctggaacatagcaagaagtt

SEQ ID NO: 7543129 - DNA, 22 bp, Homo sapiens
ttctggaacatagcaagaagtt

SEQ ID NO: 7543130 - DNA, 22 bp, Homo sapiens
ttctggaagtgttagaatctgg

SEQ ID NO: 7543131 - DNA, 22 bp, Homo sapiens
ttctggaagttggaaatagcag

SEQ ID NO: 7543132 - DNA, 22 bp, Homo sapiens
ttctggaagttggaaatagcag

SEQ ID NO: 7543133 - DNA, 22 bp, Homo sapiens
ttctggaagttggaaatagcag

SEQ ID NO: 7543134 - DNA, 22 bp, Homo sapiens
ttctggaagttggaaatagcag

SEQ ID NO: 7543135 - DNA, 22 bp, Homo sapiens
ttctggaagtggaatttttgta

SEQ ID NO: 7543136 - DNA, 22 bp, Homo sapiens
ttctggaagtggaatttttgta

SEQ ID NO: 7543137 - DNA, 22 bp, Homo sapiens
ttctggaagtgttagaatctgg

SEQ ID NO: 7543138 - DNA, 22 bp, Homo sapiens
ttctggaagtgttagaatctgg

SEQ ID NO: 7543139 - DNA, 22 bp, Homo sapiens
ttctggaatactaagttccttt

SEQ ID NO: 7543140 - DNA, 22 bp, Homo sapiens
ttctggaatatttgacacaatt

SEQ ID NO: 7543141 - DNA, 22 bp, Homo sapiens
ttctggaatatttgacacaatt

SEQ ID NO: 7543142 - DNA, 22 bp, Homo sapiens
ttctggaatatttgacacaatt

SEQ ID NO: 7543143 - DNA, 22 bp, Homo sapiens
ttctggaatactaagttccttt

SEQ ID NO: 7543144 - DNA, 22 bp, Homo sapiens
ttctggaatactaagttccttt

SEQ ID NO: 7543145 - DNA, 22 bp, Homo sapiens
ttctggaatactaagttccttt

SEQ ID NO: 7543146 - DNA, 22 bp, Homo sapiens
ttctggaagttggaaatagcag

SEQ ID NO: 7543147 - DNA, 22 bp, Homo sapiens
ttctggaagttttctcctgtgg

SEQ ID NO: 7543148 - DNA, 22 bp, Homo sapiens
ttctggaagttttctcctgtgg

SEQ ID NO: 7543149 - DNA, 22 bp, Homo sapiens
ttctggaagttttctcctgtgg

SEQ ID NO: 7543150 - DNA, 22 bp, Homo sapiens
ttccttggtgtaactgctccta

SEQ ID NO: 7543151 - DNA, 22 bp, Homo sapiens
ttccttggtgcgcctgctgcag

SEQ ID NO: 7543152 - DNA, 22 bp, Homo sapiens
ttccttggtgcgcctgctgcag

SEQ ID NO: 7543153 - DNA, 22 bp, Homo sapiens
ttccttggtgcccgatgtattt

SEQ ID NO: 7543154 - DNA, 22 bp, Homo sapiens
ttccttggtgcccgatgtattt

SEQ ID NO: 7543155 - DNA, 22 bp, Homo sapiens
ttccttggtgcgcctgctgcag

SEQ ID NO: 7543156 - DNA, 22 bp, Homo sapiens
ttccttggtgcccgatgtattt

SEQ ID NO: 7543157 - DNA, 22 bp, Homo sapiens
ttccttggtagggacaactctg

SEQ ID NO: 7543158 - DNA, 22 bp, Homo sapiens
ttccttggtagagagaatattt

SEQ ID NO: 7543159 - DNA, 22 bp, Homo sapiens
ttccttggtagagagaatattt

SEQ ID NO: 7543160 - DNA, 22 bp, Homo sapiens
ttccttggtagggacaactctg

SEQ ID NO: 7543161 - DNA, 22 bp, Homo sapiens
ttccttggtagggacaactctg

SEQ ID NO: 7543162 - DNA, 22 bp, Homo sapiens
ttccttggtacagagtagcttt

SEQ ID NO: 7543163 - DNA, 22 bp, Homo sapiens
ttccttggtagagagaatattt

SEQ ID NO: 7543164 - DNA, 22 bp, Homo sapiens
ttccttggtacagagtagcttt

SEQ ID NO: 7543165 - DNA, 22 bp, Homo sapiens
ttccttggtacagagtagcttt

SEQ ID NO: 7543166 - DNA, 22 bp, Homo sapiens
ttccttggtacagagtagcttt

SEQ ID NO: 7543167 - DNA, 22 bp, Homo sapiens
ttccttggccccatgcccaggg

SEQ ID NO: 7543168 - DNA, 22 bp, Homo sapiens
ttccttgggaaatgctcgttta

SEQ ID NO: 7543169 - DNA, 22 bp, Homo sapiens
ttccttgggaaatgctcgttta

SEQ ID NO: 7543170 - DNA, 22 bp, Homo sapiens
ttccttgggagaaaaaatatat

SEQ ID NO: 7543171 - DNA, 22 bp, Homo sapiens
ttccttgggagaaaaaatatat

SEQ ID NO: 7543172 - DNA, 17 bp, Homo sapiens
ttccttgggtgctgggt

SEQ ID NO: 7543173 - DNA, 17 bp, Homo sapiens
ttccttgggtgctgggt

SEQ ID NO: 7543174 - DNA, 22 bp, Homo sapiens
ttccttgggtgcctacttagag

SEQ ID NO: 7543175 - DNA, 22 bp, Homo sapiens
ttccttgggtgcctacttagag

SEQ ID NO: 7543176 - DNA, 22 bp, Homo sapiens
ttccttgggagaaaaaatatat

SEQ ID NO: 7543177 - DNA, 22 bp, Homo sapiens
ttccttgggtgcctacttagag

SEQ ID NO: 7543178 - DNA, 18 bp, Homo sapiens
ttccttggtaacatatgc

SEQ ID NO: 7543179 - DNA, 18 bp, Homo sapiens
ttccttggtaacatatgc

SEQ ID NO: 7543180 - DNA, 18 bp, Homo sapiens
ttccttggtaacatatgc

SEQ ID NO: 7543181 - DNA, 22 bp, Homo sapiens
ttccttgggttctgatgtgttt

SEQ ID NO: 7543182 - DNA, 17 bp, Homo sapiens
ttccttgggtgctgggt

SEQ ID NO: 7543183 - DNA, 22 bp, Homo sapiens
ttccttgggttctgatgtgttt

SEQ ID NO: 7543184 - DNA, 22 bp, Homo sapiens
ttccttgggttctgatgtgttt

SEQ ID NO: 7543185 - DNA, 17 bp, Homo sapiens
ttccttgggtgctgggt

SEQ ID NO: 7543186 - DNA, 22 bp, Homo sapiens
ttctcagatccatcagaagtcc

SEQ ID NO: 7543187 - DNA, 22 bp, Homo sapiens
ttccttgttctacatccctgcc

SEQ ID NO: 7543188 - DNA, 22 bp, Homo sapiens
ttccttgttctacatccctgcc

SEQ ID NO: 7543189 - DNA, 21 bp, Homo sapiens
ttctcagatcgagtagtgaga

SEQ ID NO: 7543190 - DNA, 22 bp, Homo sapiens
ttctcagatccatcagaagtcc

SEQ ID NO: 7543191 - DNA, 21 bp, Homo sapiens
ttctcagatcgagtagtgaga

SEQ ID NO: 7543192 - DNA, 22 bp, Homo sapiens
ttccttgtaagacctatttttg

SEQ ID NO: 7543193 - DNA, 22 bp, Homo sapiens
ttccttggtgtaactgctccta

SEQ ID NO: 7543194 - DNA, 22 bp, Homo sapiens
ttccttgtaagacctatttttg

SEQ ID NO: 7543195 - DNA, 22 bp, Homo sapiens
ttccttggtgtaactgctccta

SEQ ID NO: 7543196 - DNA, 22 bp, Homo sapiens
ttccttgtgagggctctcttcc

SEQ ID NO: 7543197 - DNA, 22 bp, Homo sapiens
ttccttgtgagggctctcttcc

SEQ ID NO: 7543198 - DNA, 22 bp, Homo sapiens
ttccttgtgagggctctcttcc

SEQ ID NO: 7543199 - DNA, 22 bp, Homo sapiens
ttccttgtggaaactatggacg

SEQ ID NO: 7543200 - DNA, 22 bp, Homo sapiens
ttccttgttaatagtgtctgga

SEQ ID NO: 7543201 - DNA, 22 bp, Homo sapiens
ttccttgttcctaggagatcaa

SEQ ID NO: 7543202 - DNA, 22 bp, Homo sapiens
ttccttgttcctaggagatcaa

SEQ ID NO: 7543203 - DNA, 22 bp, Homo sapiens
ttccttgttctacatccctgcc

SEQ ID NO: 7543204 - DNA, 22 bp, Homo sapiens
ttccttgttaatagtgtctgga

SEQ ID NO: 7543205 - DNA, 22 bp, Homo sapiens
ttccttgtggaaactatggacg

SEQ ID NO: 7543206 - DNA, 22 bp, Homo sapiens
ttccttgtgtaaactctccatc

SEQ ID NO: 7543207 - DNA, 22 bp, Homo sapiens
ttccttgtgtaaactctccatc

SEQ ID NO: 7543208 - DNA, 22 bp, Homo sapiens
ttctcaggctgtggagccgtct

SEQ ID NO: 7543209 - DNA, 22 bp, Homo sapiens
ttctcaggctgtggagccgtct

SEQ ID NO: 7543210 - DNA, 22 bp, Homo sapiens
ttctcaggctgtggagccgtct

SEQ ID NO: 7543211 - DNA, 22 bp, Homo sapiens
ttctcaggctctgagaccctat

SEQ ID NO: 7543212 - DNA, 22 bp, Homo sapiens
ttctcaggcctttgggatggga

SEQ ID NO: 7543213 - DNA, 22 bp, Homo sapiens
ttctcaggcctttgggatggga

SEQ ID NO: 7543214 - DNA, 22 bp, Homo sapiens
ttctcaggcccctgcctggact

SEQ ID NO: 7543215 - DNA, 22 bp, Homo sapiens
ttctcaggcccctgcctggact

SEQ ID NO: 7543216 - DNA, 22 bp, Homo sapiens
ttctcagggcatctcatgaccc

SEQ ID NO: 7543217 - DNA, 22 bp, Homo sapiens
ttctcagggcatctcatgaccc

SEQ ID NO: 7543218 - DNA, 22 bp, Homo sapiens
ttctcagggccctgtgttagct

SEQ ID NO: 7543219 - DNA, 22 bp, Homo sapiens
ttctcagggccctgtgttagct

SEQ ID NO: 7543220 - DNA, 22 bp, Homo sapiens
ttctcagggtagaggtgacact

SEQ ID NO: 7543221 - DNA, 22 bp, Homo sapiens
ttctcagggccctgtgttagct

SEQ ID NO: 7543222 - DNA, 22 bp, Homo sapiens
ttctcagggtctggatggcctg

SEQ ID NO: 7543223 - DNA, 22 bp, Homo sapiens
ttctcagggtagaggtgacact

SEQ ID NO: 7543224 - DNA, 22 bp, Homo sapiens
ttctcagggtctggatggcctg

SEQ ID NO: 7543225 - DNA, 22 bp, Homo sapiens
ttctcagggtctggatggcctg

SEQ ID NO: 7543226 - DNA, 22 bp, Homo sapiens
ttctcagggtctggatggcctg

SEQ ID NO: 7543227 - DNA, 23 bp, Homo sapiens
ttctcaggagcccccaggtcagg

SEQ ID NO: 7543228 - DNA, 22 bp, Homo sapiens
ttctcaggactcctgcctgctt

SEQ ID NO: 7543229 - DNA, 23 bp, Homo sapiens
ttctcaggagcccccaggtcagg

SEQ ID NO: 7543230 - DNA, 22 bp, Homo sapiens
ttctcaggcacttcttccccgc

SEQ ID NO: 7543231 - DNA, 23 bp, Homo sapiens
ttctcaggagcccccaggtcagg

SEQ ID NO: 7543232 - DNA, 22 bp, Homo sapiens
ttctcaggcccctgcctggact

SEQ ID NO: 7543233 - DNA, 22 bp, Homo sapiens
ttctcaggcacttcttccccgc

SEQ ID NO: 7543234 - DNA, 22 bp, Homo sapiens
ttctcaggaactcagtgtcagc

SEQ ID NO: 7543235 - DNA, 22 bp, Homo sapiens
ttctcaggaactcagtgtcagc

SEQ ID NO: 7543236 - DNA, 22 bp, Homo sapiens
ttctcaggactcctgcctgctt

SEQ ID NO: 7543237 - DNA, 22 bp, Homo sapiens
ttctcaggaactcagtgtcagc

SEQ ID NO: 7543238 - DNA, 22 bp, Homo sapiens
ttctcagatgattcagataaac

SEQ ID NO: 7543239 - DNA, 22 bp, Homo sapiens
ttctcagatgattcagataaac

SEQ ID NO: 7543240 - DNA, 22 bp, Homo sapiens
ttctcagatgattcagataaac

SEQ ID NO: 7543241 - DNA, 21 bp, Homo sapiens
ttctcagatcgagtagtgaga

SEQ ID NO: 7543242 - DNA, 21 bp, Homo sapiens
ttctcagatcgagtagtgaga

SEQ ID NO: 7543243 - DNA, 22 bp, Homo sapiens
ttctcaggaactcagtgtcagc

SEQ ID NO: 7543244 - DNA, 22 bp, Homo sapiens
ttctcaggaactcagtgtcagc

SEQ ID NO: 7543245 - DNA, 22 bp, Homo sapiens
ttctcaggaactcagtgtcagc

SEQ ID NO: 7543246 - DNA, 22 bp, Homo sapiens
ttctcagctttccttgcagtta

SEQ ID NO: 7543247 - DNA, 22 bp, Homo sapiens
ttctcagctttccttgcagtta

SEQ ID NO: 7543248 - DNA, 22 bp, Homo sapiens
ttctcagattccccttttaata

SEQ ID NO: 7543249 - DNA, 22 bp, Homo sapiens
ttctcagggtttgtgcaggctt

SEQ ID NO: 7543250 - DNA, 22 bp, Homo sapiens
ttctcagggttggcctcaaatc

SEQ ID NO: 7543251 - DNA, 22 bp, Homo sapiens
ttctcagggtcttgtgcaaggg

SEQ ID NO: 7543252 - DNA, 22 bp, Homo sapiens
ttctcagggtcttgtgcaaggg

SEQ ID NO: 7543253 - DNA, 22 bp, Homo sapiens
ttctcagggtcttgtgcaaggg

SEQ ID NO: 7543254 - DNA, 22 bp, Homo sapiens
ttctcagggtctggatggcctg

SEQ ID NO: 7543255 - DNA, 22 bp, Homo sapiens
ttctcagggtctggatggcctg

SEQ ID NO: 7543256 - DNA, 22 bp, Homo sapiens
ttctcagggtcttgtgcaaggg

SEQ ID NO: 7543257 - DNA, 22 bp, Homo sapiens
ttctcaggtagtgctgatgctg

SEQ ID NO: 7543258 - DNA, 22 bp, Homo sapiens
ttctcagggttggcctcaaatc

SEQ ID NO: 7543259 - DNA, 22 bp, Homo sapiens
ttctcaggtagtgctgatgctg

SEQ ID NO: 7543260 - DNA, 22 bp, Homo sapiens
ttctcaggtagtgctgatgctg

SEQ ID NO: 7543261 - DNA, 22 bp, Homo sapiens
ttctcagggtttgtgcaggctt

SEQ ID NO: 7543262 - DNA, 22 bp, Homo sapiens
ttctcaggtcaccagggtgcca

SEQ ID NO: 7543263 - DNA, 22 bp, Homo sapiens
ttctccaacacaagcatgatgt

SEQ ID NO: 7543264 - DNA, 22 bp, Homo sapiens
ttctcaggtcaccagggtgcca

SEQ ID NO: 7543265 - DNA, 22 bp, Homo sapiens
ttctccaactcttttaagtaat

SEQ ID NO: 7543266 - DNA, 22 bp, Homo sapiens
ttctccaactcttttaagtaat

SEQ ID NO: 7543267 - DNA, 22 bp, Homo sapiens
ttctccaagatgaagctgtgta

SEQ ID NO: 7543268 - DNA, 22 bp, Homo sapiens
ttctccaagatgaagctgtgta

SEQ ID NO: 7543269 - DNA, 22 bp, Homo sapiens
ttctccaagatgaagctgtgta

SEQ ID NO: 7543270 - DNA, 22 bp, Homo sapiens
ttctccaaggttcatatttatc

SEQ ID NO: 7543271 - DNA, 22 bp, Homo sapiens
ttctccaaggttcatatttatc

SEQ ID NO: 7543272 - DNA, 22 bp, Homo sapiens
ttctccaagtagaagctaagtt

SEQ ID NO: 7543273 - DNA, 22 bp, Homo sapiens
ttctccaatagctgctcatggc

SEQ ID NO: 7543274 - DNA, 22 bp, Homo sapiens
ttctccaatagctgctcatggc

SEQ ID NO: 7543275 - DNA, 22 bp, Homo sapiens
ttctccaatagctgctcatggc

SEQ ID NO: 7543276 - DNA, 22 bp, Homo sapiens
ttctccaatagctgctcatggc

SEQ ID NO: 7543277 - DNA, 20 bp, Homo sapiens
ttctccacagggtggaggag

SEQ ID NO: 7543278 - DNA, 20 bp, Homo sapiens
ttctccacagggtggaggag

SEQ ID NO: 7543279 - DNA, 22 bp, Homo sapiens
ttctccaagggatttctgcctt

SEQ ID NO: 7543280 - DNA, 22 bp, Homo sapiens
ttctccaagggatttctgcctt

SEQ ID NO: 7543281 - DNA, 22 bp, Homo sapiens
ttctccaaggatacagtcctgt

SEQ ID NO: 7543282 - DNA, 22 bp, Homo sapiens
ttctccaaggatacagtcctgt

SEQ ID NO: 7543283 - DNA, 22 bp, Homo sapiens
ttctccaaggatacagtcctgt

SEQ ID NO: 7543284 - DNA, 22 bp, Homo sapiens
ttctccaaggatacagtcctgt

SEQ ID NO: 7543285 - DNA, 22 bp, Homo sapiens
ttctccaaggatacagtcctgt

SEQ ID NO: 7543286 - DNA, 22 bp, Homo sapiens
ttctccacatggtgtgctgtga

SEQ ID NO: 7543287 - DNA, 22 bp, Homo sapiens
ttctccacatggtgtgctgtga

SEQ ID NO: 7543288 - DNA, 22 bp, Homo sapiens
ttctccacccactcttttgttg

SEQ ID NO: 7543289 - DNA, 22 bp, Homo sapiens
ttctccacccactcttttgttg

SEQ ID NO: 7543290 - DNA, 18 bp, Homo sapiens
ttctccagaaaacatagc

SEQ ID NO: 7543291 - DNA, 22 bp, Homo sapiens
ttctccagaccactgcctctgt

SEQ ID NO: 7543292 - DNA, 22 bp, Homo sapiens
ttctccagaccactgcctctgt

SEQ ID NO: 7543293 - DNA, 22 bp, Homo sapiens
ttctccagaccactgcctctgt

SEQ ID NO: 7543294 - DNA, 22 bp, Homo sapiens
ttctccagacaggcagagggaa

SEQ ID NO: 7543295 - DNA, 22 bp, Homo sapiens
ttctccagaccactgcctctgt

SEQ ID NO: 7543296 - DNA, 22 bp, Homo sapiens
ttctccagaccactgcctctgt

SEQ ID NO: 7543297 - DNA, 22 bp, Homo sapiens
ttctccagaccctcctgcagac

SEQ ID NO: 7543298 - DNA, 22 bp, Homo sapiens
ttctccagaccctcctgcagac

SEQ ID NO: 7543299 - DNA, 22 bp, Homo sapiens
ttctccagaccactgcctctgt

SEQ ID NO: 7543300 - DNA, 22 bp, Homo sapiens
ttctccagaccctcctgcagac

SEQ ID NO: 7543301 - DNA, 22 bp, Homo sapiens
ttctccagagggctctgcagga

SEQ ID NO: 7543302 - DNA, 22 bp, Homo sapiens
ttctccagagggctctgcagga

SEQ ID NO: 7543303 - DNA, 22 bp, Homo sapiens
ttctccagagggctctgcagga

SEQ ID NO: 7543304 - DNA, 22 bp, Homo sapiens
ttctccagaccttgtgactatg

SEQ ID NO: 7543305 - DNA, 22 bp, Homo sapiens
ttctccagaccctcctgcagac

SEQ ID NO: 7543306 - DNA, 22 bp, Homo sapiens
ttctctaagagatgcagaagtt

SEQ ID NO: 7543307 - DNA, 22 bp, Homo sapiens
ttctcctgcccttggacttcca

SEQ ID NO: 7543308 - DNA, 22 bp, Homo sapiens
ttctcctgagttcccaggtcta

SEQ ID NO: 7543309 - DNA, 22 bp, Homo sapiens
ttctctaagagttatatgaatt

SEQ ID NO: 7543310 - DNA, 22 bp, Homo sapiens
ttctctaagagttatatgaatt

SEQ ID NO: 7543311 - DNA, 22 bp, Homo sapiens
ttctcctgagttcccaggtcta

SEQ ID NO: 7543312 - DNA, 22 bp, Homo sapiens
ttctcctgagttcccaggtcta

SEQ ID NO: 7543313 - DNA, 23 bp, Homo sapiens
ttctcctgaggaagcagggactg

SEQ ID NO: 7543314 - DNA, 23 bp, Homo sapiens
ttctcctgaggaagcagggactg

SEQ ID NO: 7543315 - DNA, 22 bp, Homo sapiens
ttctcctctgttggccttccct

SEQ ID NO: 7543316 - DNA, 22 bp, Homo sapiens
ttctcctctgttggccttccct

SEQ ID NO: 7543317 - DNA, 22 bp, Homo sapiens
ttctcctctgttggccttccct

SEQ ID NO: 7543318 - DNA, 22 bp, Homo sapiens
ttctccagaggtggctagagtt

SEQ ID NO: 7543319 - DNA, 22 bp, Homo sapiens
ttctccagaggtggctagagtt

SEQ ID NO: 7543320 - DNA, 22 bp, Homo sapiens
ttctctagttttgacgaggatt

SEQ ID NO: 7543321 - DNA, 22 bp, Homo sapiens
ttctctatgtgtgttgtagttt

SEQ ID NO: 7543322 - DNA, 22 bp, Homo sapiens
ttctctatgtgtgttgtagttt

SEQ ID NO: 7543323 - DNA, 19 bp, Homo sapiens
ttctctattatgtcttctc

SEQ ID NO: 7543324 - DNA, 22 bp, Homo sapiens
ttctctcagttaaactttgtga

SEQ ID NO: 7543325 - DNA, 22 bp, Homo sapiens
ttctctcagttaaactttgtga

SEQ ID NO: 7543326 - DNA, 22 bp, Homo sapiens
ttctctatgtgtgttgtagttt

SEQ ID NO: 7543327 - DNA, 22 bp, Homo sapiens
ttctctattacagaaatggaat

SEQ ID NO: 7543328 - DNA, 22 bp, Homo sapiens
ttctctattacagaaatggaat

SEQ ID NO: 7543329 - DNA, 20 bp, Homo sapiens
ttctctagccttcccctggg

SEQ ID NO: 7543330 - DNA, 20 bp, Homo sapiens
ttctctagccttcccctggg

SEQ ID NO: 7543331 - DNA, 22 bp, Homo sapiens
ttctctagcagatcataatgaa

SEQ ID NO: 7543332 - DNA, 23 bp, Homo sapiens
ttctctagatgaggtgaagatgg

SEQ ID NO: 7543333 - DNA, 22 bp, Homo sapiens
ttctctaggttttagatgaaga

SEQ ID NO: 7543334 - DNA, 22 bp, Homo sapiens
ttctctaggttttagatgaaga

SEQ ID NO: 7543335 - DNA, 22 bp, Homo sapiens
ttctctaggagttctgggatca

SEQ ID NO: 7543336 - DNA, 22 bp, Homo sapiens
ttctctaggactttggagtcct

SEQ ID NO: 7543337 - DNA, 22 bp, Homo sapiens
ttctctaatggtgatgattaga

SEQ ID NO: 7543338 - DNA, 21 bp, Homo sapiens
ttctctacctctagtgctgta

SEQ ID NO: 7543339 - DNA, 22 bp, Homo sapiens
ttctctacttgagattttaatg

SEQ ID NO: 7543340 - DNA, 22 bp, Homo sapiens
ttctctacttcacaagggatgg

SEQ ID NO: 7543341 - DNA, 22 bp, Homo sapiens
ttctctacttcacaagggatgg

SEQ ID NO: 7543342 - DNA, 22 bp, Homo sapiens
ttctctaatacattttgacaaa

SEQ ID NO: 7543343 - DNA, 22 bp, Homo sapiens
ttctctaatggtgatgattaga

SEQ ID NO: 7543344 - DNA, 22 bp, Homo sapiens
ttctctaatggtgatgattaga

SEQ ID NO: 7543345 - DNA, 22 bp, Homo sapiens
ttctctaagccttagtttcttc

SEQ ID NO: 7543346 - DNA, 22 bp, Homo sapiens
ttctctaagccttagtttcttc

SEQ ID NO: 7543347 - DNA, 22 bp, Homo sapiens
ttctctaagccttagtttcttc

SEQ ID NO: 7543348 - DNA, 22 bp, Homo sapiens
ttctctaagagttatatgaatt

SEQ ID NO: 7543349 - DNA, 22 bp, Homo sapiens
ttctctaagagttatatgaatt

SEQ ID NO: 7543350 - DNA, 22 bp, Homo sapiens
ttctctaagccttagtttcttc

SEQ ID NO: 7543351 - DNA, 22 bp, Homo sapiens
ttctctaagctggctgaggtct

SEQ ID NO: 7543352 - DNA, 22 bp, Homo sapiens
ttctctaatacattttgacaaa

SEQ ID NO: 7543353 - DNA, 22 bp, Homo sapiens
ttctctcccatgaagcttctat

SEQ ID NO: 7543354 - DNA, 22 bp, Homo sapiens
ttctctcccatgaagcttctat

SEQ ID NO: 7543355 - DNA, 22 bp, Homo sapiens
ttctctcccatgaagcttctat

SEQ ID NO: 7543356 - DNA, 21 bp, Homo sapiens
ttctctccatatgcccagccc

SEQ ID NO: 7543357 - DNA, 21 bp, Homo sapiens
ttctctccatatgcccagccc

SEQ ID NO: 7543358 - DNA, 22 bp, Homo sapiens
ttctctccagtcctggattctg

SEQ ID NO: 7543359 - DNA, 22 bp, Homo sapiens
ttctctccagtcctggattctg

SEQ ID NO: 7543360 - DNA, 22 bp, Homo sapiens
ttctctcattcaaattaaagtg

SEQ ID NO: 7543361 - DNA, 22 bp, Homo sapiens
ttctctcattcaaattaaagtg

SEQ ID NO: 7543362 - DNA, 22 bp, Homo sapiens
ttctctcattcaaattaaagtg

SEQ ID NO: 7543363 - DNA, 22 bp, Homo sapiens
ttctctcagttaaactttgtga

SEQ ID NO: 7543364 - DNA, 22 bp, Homo sapiens
ttctctccagactgcagtgggt

SEQ ID NO: 7543365 - DNA, 22 bp, Homo sapiens
ttctctccagactgcagtgggt

SEQ ID NO: 7543366 - DNA, 22 bp, Homo sapiens
ttctctccagactgcagtgggt

SEQ ID NO: 7543367 - DNA, 22 bp, Homo sapiens
ttctctccagactgcagtgggt

SEQ ID NO: 7543368 - DNA, 22 bp, Homo sapiens
ttctctccagtcctggattctg

SEQ ID NO: 7543369 - DNA, 22 bp, Homo sapiens
ttctctctgagagcatctggaa

SEQ ID NO: 7543370 - DNA, 22 bp, Homo sapiens
ttctctctgagagcatctggaa

SEQ ID NO: 7543371 - DNA, 22 bp, Homo sapiens
ttctctcctcctagaggctttt

SEQ ID NO: 7543372 - DNA, 22 bp, Homo sapiens
ttctctctgagagcatctggaa

SEQ ID NO: 7543373 - DNA, 22 bp, Homo sapiens
ttctctctgagagcatctggaa

SEQ ID NO: 7543374 - DNA, 22 bp, Homo sapiens
ttctctcctcctagaggctttt

SEQ ID NO: 7543375 - DNA, 22 bp, Homo sapiens
ttctctcctcctagaggctttt

SEQ ID NO: 7543376 - DNA, 22 bp, Homo sapiens
ttctctcctcctagaggctttt

SEQ ID NO: 7543377 - DNA, 22 bp, Homo sapiens
ttctctcctcctagaggctttt

SEQ ID NO: 7543378 - DNA, 22 bp, Homo sapiens
ttctctcccatgaagcttctat

SEQ ID NO: 7543379 - DNA, 22 bp, Homo sapiens
ttctctcccatgaagcttctat

SEQ ID NO: 7543380 - DNA, 22 bp, Homo sapiens
ttctctcccatgaagcttctat

SEQ ID NO: 7543381 - DNA, 22 bp, Homo sapiens
ttctctcctacccagtatccat

SEQ ID NO: 7543382 - DNA, 22 bp, Homo sapiens
ttctctcctacccagtatccat

SEQ ID NO: 7543383 - DNA, 22 bp, Homo sapiens
ttctctcctacccagtatccat

SEQ ID NO: 7543384 - DNA, 22 bp, Homo sapiens
ttctctgctctcacatacagaa

SEQ ID NO: 7543385 - DNA, 22 bp, Homo sapiens
ttctctggaactgaaacaagat

SEQ ID NO: 7543386 - DNA, 22 bp, Homo sapiens
ttctctggaactgaaacaagat

SEQ ID NO: 7543387 - DNA, 22 bp, Homo sapiens
ttctctggaaggctctacggga

SEQ ID NO: 7543388 - DNA, 22 bp, Homo sapiens
ttctctggaactgaaacaagat

SEQ ID NO: 7543389 - DNA, 22 bp, Homo sapiens
ttctctggaactgaaacaagat

SEQ ID NO: 7543390 - DNA, 22 bp, Homo sapiens
ttctctggaaggctctacggga

SEQ ID NO: 7543391 - DNA, 22 bp, Homo sapiens
ttctctgcattgtaaagagcca

SEQ ID NO: 7543392 - DNA, 22 bp, Homo sapiens
ttctctgctataggcagggagg

SEQ ID NO: 7543393 - DNA, 22 bp, Homo sapiens
ttctctgctacatactagggct

SEQ ID NO: 7543394 - DNA, 22 bp, Homo sapiens
ttctctgcagctcctggctggg

SEQ ID NO: 7543395 - DNA, 22 bp, Homo sapiens
ttctctgcagcttaggcccagt

SEQ ID NO: 7543396 - DNA, 22 bp, Homo sapiens
ttctctgagtacgtttcagtgt

SEQ ID NO: 7543397 - DNA, 22 bp, Homo sapiens
ttctctgatcttgctagactga

SEQ ID NO: 7543398 - DNA, 22 bp, Homo sapiens
ttctctgacccccttaaatatt

SEQ ID NO: 7543399 - DNA, 22 bp, Homo sapiens
ttctctgagatagactaagtgg

SEQ ID NO: 7543400 - DNA, 22 bp, Homo sapiens
ttctctgaaggttgtggaacta

SEQ ID NO: 7543401 - DNA, 22 bp, Homo sapiens
ttctctgacccccttaaatatt

SEQ ID NO: 7543402 - DNA, 17 bp, Homo sapiens
ttctctgagctgtattg

SEQ ID NO: 7543403 - DNA, 22 bp, Homo sapiens
ttctctcttactgccatgctgt

SEQ ID NO: 7543404 - DNA, 22 bp, Homo sapiens
ttctctcttactgccatgctgt

SEQ ID NO: 7543405 - DNA, 22 bp, Homo sapiens
ttctctcttactgccatgctgt

SEQ ID NO: 7543406 - DNA, 22 bp, Homo sapiens
ttctctcttactgccatgctgt

SEQ ID NO: 7543407 - DNA, 22 bp, Homo sapiens
ttctctcttactgccatgctgt

SEQ ID NO: 7543408 - DNA, 22 bp, Homo sapiens
ttctctctgttatggattttac

SEQ ID NO: 7543409 - DNA, 22 bp, Homo sapiens
ttctctctgttatggattttac

SEQ ID NO: 7543410 - DNA, 22 bp, Homo sapiens
ttctctctgtgtcattatggac

SEQ ID NO: 7543411 - DNA, 22 bp, Homo sapiens
ttctctctgtggtcccattttg

SEQ ID NO: 7543412 - DNA, 22 bp, Homo sapiens
ttctctctgtggtcccattttg

SEQ ID NO: 7543413 - DNA, 22 bp, Homo sapiens
ttctctctggacctgggatgcg

SEQ ID NO: 7543414 - DNA, 22 bp, Homo sapiens
ttctctctggacctgggatgcg

SEQ ID NO: 7543415 - DNA, 22 bp, Homo sapiens
ttctctctgtgtcattatggac

SEQ ID NO: 7543416 - DNA, 22 bp, Homo sapiens
ttctctctgtgtcattatggac

SEQ ID NO: 7543417 - DNA, 22 bp, Homo sapiens
ttctctctgtggtcccattttg

SEQ ID NO: 7543418 - DNA, 22 bp, Homo sapiens
ttctctcttttgggtaggaggt

SEQ ID NO: 7543419 - DNA, 22 bp, Homo sapiens
ttctctcttttgggtaggaggt

SEQ ID NO: 7543420 - DNA, 22 bp, Homo sapiens
ttctctcttccagttcccactt

SEQ ID NO: 7543421 - DNA, 22 bp, Homo sapiens
ttctctcttccagttcccactt

SEQ ID NO: 7543422 - DNA, 22 bp, Homo sapiens
ttctctcttactgccatgctgt

SEQ ID NO: 7543423 - DNA, 22 bp, Homo sapiens
ttctctcttactgccatgctgt

SEQ ID NO: 7543424 - DNA, 22 bp, Homo sapiens
ttctctcttccagttcccactt

SEQ ID NO: 7543425 - DNA, 22 bp, Homo sapiens
ttctctcttccagttcccactt

SEQ ID NO: 7543426 - DNA, 22 bp, Homo sapiens
ttctctgaaggccatgctcact

SEQ ID NO: 7543427 - DNA, 22 bp, Homo sapiens
ttctctgaaggttgtggaacta

SEQ ID NO: 7543428 - DNA, 22 bp, Homo sapiens
ttctctcttttgggtaggaggt

SEQ ID NO: 7543429 - DNA, 22 bp, Homo sapiens
ttctctcttttgggtaggaggt

SEQ ID NO: 7543430 - DNA, 22 bp, Homo sapiens
ttctctgaaggccatgctcact

SEQ ID NO: 7543431 - DNA, 22 bp, Homo sapiens
ttctctgaaggccatgctcact

SEQ ID NO: 7543432 - DNA, 22 bp, Homo sapiens
ttcctgcgcccttctcgcccgc

SEQ ID NO: 7543433 - DNA, 22 bp, Homo sapiens
ttcctgcctacatgccttatgc

SEQ ID NO: 7543434 - DNA, 22 bp, Homo sapiens
ttcctgcgcccttctcgcccgc

SEQ ID NO: 7543435 - DNA, 22 bp, Homo sapiens
ttcctgctccatttgctgagct

SEQ ID NO: 7543436 - DNA, 22 bp, Homo sapiens
ttcctgctccatttgctgagct

SEQ ID NO: 7543437 - DNA, 22 bp, Homo sapiens
ttcctggaaattatgctcacct

SEQ ID NO: 7543438 - DNA, 22 bp, Homo sapiens
ttcctggaaattatgctcacct

SEQ ID NO: 7543439 - DNA, 22 bp, Homo sapiens
ttcctgcttcctggcctcacaa

SEQ ID NO: 7543440 - DNA, 22 bp, Homo sapiens
ttcctgcttcctggcctcacaa

SEQ ID NO: 7543441 - DNA, 22 bp, Homo sapiens
ttcctgcttcctggcctcacaa

SEQ ID NO: 7543442 - DNA, 22 bp, Homo sapiens
ttcctgcttcctggcctcacaa

SEQ ID NO: 7543443 - DNA, 22 bp, Homo sapiens
ttcctgcccctgagagctccca

SEQ ID NO: 7543444 - DNA, 22 bp, Homo sapiens
ttcctgccctgcctgtgccact

SEQ ID NO: 7543445 - DNA, 22 bp, Homo sapiens
ttcctgcctacatgccttatgc

SEQ ID NO: 7543446 - DNA, 22 bp, Homo sapiens
ttcctgcctacatgccttatgc

SEQ ID NO: 7543447 - DNA, 22 bp, Homo sapiens
ttcctgcccctgagagctccca

SEQ ID NO: 7543448 - DNA, 22 bp, Homo sapiens
ttcctgcccctgagagctccca

SEQ ID NO: 7543449 - DNA, 22 bp, Homo sapiens
ttcctgcagcaaggagaagctg

SEQ ID NO: 7543450 - DNA, 22 bp, Homo sapiens
ttcctgcccctgagagctccca

SEQ ID NO: 7543451 - DNA, 22 bp, Homo sapiens
ttcctggagagttttcccaaag

SEQ ID NO: 7543452 - DNA, 21 bp, Homo sapiens
ttcctggaggcagaaacgtga

SEQ ID NO: 7543453 - DNA, 21 bp, Homo sapiens
ttcctggaggcagaaacgtga

SEQ ID NO: 7543454 - DNA, 22 bp, Homo sapiens
ttcctggagagttttcccaaag

SEQ ID NO: 7543455 - DNA, 22 bp, Homo sapiens
ttcctggagagttttcccaaag

SEQ ID NO: 7543456 - DNA, 22 bp, Homo sapiens
ttcctggagagttttcccaaag

SEQ ID NO: 7543457 - DNA, 17 bp, Homo sapiens
ttcctggaagtcattcc

SEQ ID NO: 7543458 - DNA, 17 bp, Homo sapiens
ttcctggaagtcattcc

SEQ ID NO: 7543459 - DNA, 17 bp, Homo sapiens
ttcctggaagtcattcc

SEQ ID NO: 7543460 - DNA, 22 bp, Homo sapiens
ttcctggaaattatgctcacct

SEQ ID NO: 7543461 - DNA, 22 bp, Homo sapiens
ttcctggcaaagtgagcatcac

SEQ ID NO: 7543462 - DNA, 21 bp, Homo sapiens
ttcctggaggcagaaacgtga

SEQ ID NO: 7543463 - DNA, 22 bp, Homo sapiens
ttcctggcaaagtgagcatcac

SEQ ID NO: 7543464 - DNA, 22 bp, Homo sapiens
ttcctggcacatagttagtgct

SEQ ID NO: 7543465 - DNA, 22 bp, Homo sapiens
ttcctggcaccaccacttctag

SEQ ID NO: 7543466 - DNA, 22 bp, Homo sapiens
ttcctggcaccctggacccggc

SEQ ID NO: 7543467 - DNA, 22 bp, Homo sapiens
ttcctggcacatagttagtgct

SEQ ID NO: 7543468 - DNA, 22 bp, Homo sapiens
ttcctggcacccttgttagcct

SEQ ID NO: 7543469 - DNA, 22 bp, Homo sapiens
ttcctggcatagagagggcaca

SEQ ID NO: 7543470 - DNA, 22 bp, Homo sapiens
ttcctggccccacccctggaga

SEQ ID NO: 7543471 - DNA, 22 bp, Homo sapiens
ttcctggccccacccctggaga

SEQ ID NO: 7543472 - DNA, 22 bp, Homo sapiens
ttcctggccaagcagagtggaa

SEQ ID NO: 7543473 - DNA, 22 bp, Homo sapiens
ttcctggccaagcagagtggaa

SEQ ID NO: 7543474 - DNA, 22 bp, Homo sapiens
ttcctggcctctctctgagcag

SEQ ID NO: 7543475 - DNA, 22 bp, Homo sapiens
ttcctggcctaaggtaggtgac

SEQ ID NO: 7543476 - DNA, 22 bp, Homo sapiens
ttcctggcctctctctgagcag

SEQ ID NO: 7543477 - DNA, 22 bp, Homo sapiens
ttcctggcctctctctgagcag

SEQ ID NO: 7543478 - DNA, 22 bp, Homo sapiens
ttcctggcctctctctgagcag

SEQ ID NO: 7543479 - DNA, 21 bp, Homo sapiens
ttcctggcggcagaaacgtga

SEQ ID NO: 7543480 - DNA, 22 bp, Homo sapiens
ttcctggctcacagcagtgggg

SEQ ID NO: 7543481 - DNA, 22 bp, Homo sapiens
ttcctggctcacagcagtgggg

SEQ ID NO: 7543482 - DNA, 22 bp, Homo sapiens
ttcctggctcacagcagtgggg

SEQ ID NO: 7543483 - DNA, 21 bp, Homo sapiens
ttcctggggacttccgtggga

SEQ ID NO: 7543484 - DNA, 21 bp, Homo sapiens
ttcctggggacttccgtggga

SEQ ID NO: 7543485 - DNA, 21 bp, Homo sapiens
ttcctggggacttccgtggga

SEQ ID NO: 7543486 - DNA, 21 bp, Homo sapiens
ttcctggggacttccgtggga

SEQ ID NO: 7543487 - DNA, 22 bp, Homo sapiens
ttcctggggcgactgtatctga

SEQ ID NO: 7543488 - DNA, 22 bp, Homo sapiens
ttcctggggcgactgtatctga

SEQ ID NO: 7543489 - DNA, 22 bp, Homo sapiens
ttcctgagcttttaacctagtc

SEQ ID NO: 7543490 - DNA, 22 bp, Homo sapiens
ttcctgaggaggaccaggacca

SEQ ID NO: 7543491 - DNA, 22 bp, Homo sapiens
ttcctgaggaggaccaggacca

SEQ ID NO: 7543492 - DNA, 22 bp, Homo sapiens
ttcctgagcttttaacctagtc

SEQ ID NO: 7543493 - DNA, 22 bp, Homo sapiens
ttcctgaggaggaccaggacca

SEQ ID NO: 7543494 - DNA, 22 bp, Homo sapiens
ttcctgagcaccagacactgca

SEQ ID NO: 7543495 - DNA, 22 bp, Homo sapiens
ttcctgagcaccagacactgca

SEQ ID NO: 7543496 - DNA, 22 bp, Homo sapiens
ttcctgagcaccagacactgca

SEQ ID NO: 7543497 - DNA, 22 bp, Homo sapiens
ttcctgaggctcatcggagtcg

SEQ ID NO: 7543498 - DNA, 22 bp, Homo sapiens
ttcctgagggacttttgagatt

SEQ ID NO: 7543499 - DNA, 22 bp, Homo sapiens
ttcctgaggaggaccaggacca

SEQ ID NO: 7543500 - DNA, 22 bp, Homo sapiens
ttcctgagggccccagaggagg

SEQ ID NO: 7543501 - DNA, 22 bp, Homo sapiens
ttcctgagggccccagaggagg

SEQ ID NO: 7543502 - DNA, 22 bp, Homo sapiens
ttcctgagggacttttgagatt

SEQ ID NO: 7543503 - DNA, 22 bp, Homo sapiens
ttcctgagggccccagaggagg

SEQ ID NO: 7543504 - DNA, 22 bp, Homo sapiens
ttcctgagggccccagaggagg

SEQ ID NO: 7543505 - DNA, 22 bp, Homo sapiens
ttcctgagtcccgggtaaagat

SEQ ID NO: 7543506 - DNA, 22 bp, Homo sapiens
ttcctgagtcccgggtaaagat

SEQ ID NO: 7543507 - DNA, 22 bp, Homo sapiens
ttcctgagtcccgggtaaagat

SEQ ID NO: 7543508 - DNA, 22 bp, Homo sapiens
ttcctgaggtgattctaatgtg

SEQ ID NO: 7543509 - DNA, 22 bp, Homo sapiens
ttcctgaggtgattctaatgtg

SEQ ID NO: 7543510 - DNA, 23 bp, Homo sapiens
ttcctgagtgctggagagagtgc

SEQ ID NO: 7543511 - DNA, 22 bp, Homo sapiens
ttcctgagtcgccgagtctatg

SEQ ID NO: 7543512 - DNA, 22 bp, Homo sapiens
ttcctgagtcgccgagtctatg

SEQ ID NO: 7543513 - DNA, 22 bp, Homo sapiens
ttcctgatcccccaggacaaag

SEQ ID NO: 7543514 - DNA, 22 bp, Homo sapiens
ttcctgataatgagattttccc

SEQ ID NO: 7543515 - DNA, 23 bp, Homo sapiens
ttcctgagtgctggagagagtgc

SEQ ID NO: 7543516 - DNA, 23 bp, Homo sapiens
ttcctgagtgctggagagagtgc

SEQ ID NO: 7543517 - DNA, 22 bp, Homo sapiens
ttcctgataatgagattttccc

SEQ ID NO: 7543518 - DNA, 22 bp, Homo sapiens
ttcctgatagaacactttccaa

SEQ ID NO: 7543519 - DNA, 22 bp, Homo sapiens
ttcctgcaaagccagatgtcga

SEQ ID NO: 7543520 - DNA, 22 bp, Homo sapiens
ttcctgatgcacacagtcattt

SEQ ID NO: 7543521 - DNA, 22 bp, Homo sapiens
ttcctgcagcaaggagaagctg

SEQ ID NO: 7543522 - DNA, 22 bp, Homo sapiens
ttcctgcacagttaagtgctca

SEQ ID NO: 7543523 - DNA, 22 bp, Homo sapiens
ttcctgcagcaaggagaagctg

SEQ ID NO: 7543524 - DNA, 22 bp, Homo sapiens
ttcctgcacagcccttcctgag

SEQ ID NO: 7543525 - DNA, 22 bp, Homo sapiens
ttcctgcacagcccttcctgag

SEQ ID NO: 7543526 - DNA, 22 bp, Homo sapiens
ttcctgcaagatctttaaggag

SEQ ID NO: 7543527 - DNA, 22 bp, Homo sapiens
ttcctgcaagatctttaaggag

SEQ ID NO: 7543528 - DNA, 22 bp, Homo sapiens
ttccagttggcactgcaattta

SEQ ID NO: 7543529 - DNA, 22 bp, Homo sapiens
ttccagttggcactgcaattta

SEQ ID NO: 7543530 - DNA, 22 bp, Homo sapiens
ttccagttggtagaatgtaagg

SEQ ID NO: 7543531 - DNA, 19 bp, Homo sapiens
ttccagttctaatctcttc

SEQ ID NO: 7543532 - DNA, 22 bp, Homo sapiens
ttccagttctggctttgccact

SEQ ID NO: 7543533 - DNA, 22 bp, Homo sapiens
ttccagttctatgaattcaaga

SEQ ID NO: 7543534 - DNA, 22 bp, Homo sapiens
ttccagttctggctttgccact

SEQ ID NO: 7543535 - DNA, 22 bp, Homo sapiens
ttccagttcttctgtaagcact

SEQ ID NO: 7543536 - DNA, 22 bp, Homo sapiens
ttcctgaatataaagacactag

SEQ ID NO: 7543537 - DNA, 17 bp, Homo sapiens
ttccagtttagtattgt

SEQ ID NO: 7543538 - DNA, 22 bp, Homo sapiens
ttccagtttgcagttgacacta

SEQ ID NO: 7543539 - DNA, 17 bp, Homo sapiens
ttccagtttagtattgt

SEQ ID NO: 7543540 - DNA, 17 bp, Homo sapiens
ttccagtttagtattgt

SEQ ID NO: 7543541 - DNA, 17 bp, Homo sapiens
ttccagtttagtattgt

SEQ ID NO: 7543542 - DNA, 22 bp, Homo sapiens
ttccagttggtagaatgtaagg

SEQ ID NO: 7543543 - DNA, 22 bp, Homo sapiens
ttccagttgtcataaagctagg

SEQ ID NO: 7543544 - DNA, 22 bp, Homo sapiens
ttccagttgtcataaagctagg

SEQ ID NO: 7543545 - DNA, 17 bp, Homo sapiens
ttccagtttagtattgt

SEQ ID NO: 7543546 - DNA, 22 bp, Homo sapiens
ttcctgaatcccaaggagagct

SEQ ID NO: 7543547 - DNA, 22 bp, Homo sapiens
ttcctgaatgctgttgtgctgt

SEQ ID NO: 7543548 - DNA, 22 bp, Homo sapiens
ttcctgaatataaagacactag

SEQ ID NO: 7543549 - DNA, 22 bp, Homo sapiens
ttcctgaatcccaaggagagct

SEQ ID NO: 7543550 - DNA, 22 bp, Homo sapiens
ttcctgaatcccaaggagagct

SEQ ID NO: 7543551 - DNA, 22 bp, Homo sapiens
ttcctgaatgctgttgtgctgt

SEQ ID NO: 7543552 - DNA, 22 bp, Homo sapiens
ttcctgaattgagctttagaaa

SEQ ID NO: 7543553 - DNA, 22 bp, Homo sapiens
ttcctgaattgagctttagaaa

SEQ ID NO: 7543554 - DNA, 22 bp, Homo sapiens
ttcctgagaacatggcagctta

SEQ ID NO: 7543555 - DNA, 22 bp, Homo sapiens
ttcctgagaacatggcagctta

SEQ ID NO: 7543556 - DNA, 22 bp, Homo sapiens
ttcctgagaaatttgtacctgg

SEQ ID NO: 7543557 - DNA, 22 bp, Homo sapiens
ttcctgagaccctcacagtgat

SEQ ID NO: 7543558 - DNA, 22 bp, Homo sapiens
ttcctgagaccctcacagtgat

SEQ ID NO: 7543559 - DNA, 22 bp, Homo sapiens
ttcctgagaacatggcagctta

SEQ ID NO: 7543560 - DNA, 22 bp, Homo sapiens
ttcctgagaccctcacagtgat

SEQ ID NO: 7543561 - DNA, 22 bp, Homo sapiens
ttcctgagaacatggcagctta

SEQ ID NO: 7543562 - DNA, 22 bp, Homo sapiens
ttcctgagaccctcacagtgat

SEQ ID NO: 7543563 - DNA, 22 bp, Homo sapiens
ttcctggtctatttagaattgc

SEQ ID NO: 7543564 - DNA, 22 bp, Homo sapiens
ttcctggtctgtgccattcaga

SEQ ID NO: 7543565 - DNA, 22 bp, Homo sapiens
ttcctggtctgtgccattcaga

SEQ ID NO: 7543566 - DNA, 22 bp, Homo sapiens
ttcctggtcctattatatacac

SEQ ID NO: 7543567 - DNA, 22 bp, Homo sapiens
ttcctggtcctattatatacac

SEQ ID NO: 7543568 - DNA, 22 bp, Homo sapiens
ttcctggtcccgttcttcactg

SEQ ID NO: 7543569 - DNA, 22 bp, Homo sapiens
ttcctggtcccgttcttcactg

SEQ ID NO: 7543570 - DNA, 22 bp, Homo sapiens
ttcctggtagtaagacatctgg

SEQ ID NO: 7543571 - DNA, 22 bp, Homo sapiens
ttcctggtcactgctgttccct

SEQ ID NO: 7543572 - DNA, 22 bp, Homo sapiens
ttcctggtagtaagacatctgg

SEQ ID NO: 7543573 - DNA, 22 bp, Homo sapiens
ttcctggtaaattatgtccagg

SEQ ID NO: 7543574 - DNA, 22 bp, Homo sapiens
ttcctggtaaattatgtccagg

SEQ ID NO: 7543575 - DNA, 22 bp, Homo sapiens
ttcctggtaacaatctcaaagt

SEQ ID NO: 7543576 - DNA, 22 bp, Homo sapiens
ttcctggtaaattatgtccagg

SEQ ID NO: 7543577 - DNA, 22 bp, Homo sapiens
ttcctggtgacctcactggtag

SEQ ID NO: 7543578 - DNA, 22 bp, Homo sapiens
ttcctggtgagatttcgttctg

SEQ ID NO: 7543579 - DNA, 22 bp, Homo sapiens
ttcctggtgacctcactggtag

SEQ ID NO: 7543580 - DNA, 22 bp, Homo sapiens
ttcctggtggctttgccaactg

SEQ ID NO: 7543581 - DNA, 22 bp, Homo sapiens
ttcctggtgagatttcgttctg

SEQ ID NO: 7543582 - DNA, 22 bp, Homo sapiens
ttcctgtagttgtgcaatgtac

SEQ ID NO: 7543583 - DNA, 22 bp, Homo sapiens
ttcctgtagttgtgcaatgtac

SEQ ID NO: 7543584 - DNA, 20 bp, Homo sapiens
ttcctgtaaccggcagctgc

SEQ ID NO: 7543585 - DNA, 22 bp, Homo sapiens
ttcctggtttatggaaagcatg

SEQ ID NO: 7543586 - DNA, 22 bp, Homo sapiens
ttcctggtttatacctgtatca

SEQ ID NO: 7543587 - DNA, 22 bp, Homo sapiens
ttcctggttggattctgattaa

SEQ ID NO: 7543588 - DNA, 22 bp, Homo sapiens
ttcctggggtactggagaaaat

SEQ ID NO: 7543589 - DNA, 22 bp, Homo sapiens
ttcctggggtgaagatattttt

SEQ ID NO: 7543590 - DNA, 22 bp, Homo sapiens
ttcctggggtgaagatattttt

SEQ ID NO: 7543591 - DNA, 22 bp, Homo sapiens
ttcctggggggatagatttcac

SEQ ID NO: 7543592 - DNA, 22 bp, Homo sapiens
ttcctggggggatagatttcac

SEQ ID NO: 7543593 - DNA, 22 bp, Homo sapiens
ttcctggggggatagatttcac

SEQ ID NO: 7543594 - DNA, 22 bp, Homo sapiens
ttcctggggtactggagaaaat

SEQ ID NO: 7543595 - DNA, 22 bp, Homo sapiens
ttcctggggcttagcaatggag

SEQ ID NO: 7543596 - DNA, 22 bp, Homo sapiens
ttcctggggctccagctaccag

SEQ ID NO: 7543597 - DNA, 22 bp, Homo sapiens
ttcctggggctccagctaccag

SEQ ID NO: 7543598 - DNA, 22 bp, Homo sapiens
ttcctggggcttagcaatggag

SEQ ID NO: 7543599 - DNA, 22 bp, Homo sapiens
ttcctgggggcagcagtcttga

SEQ ID NO: 7543600 - DNA, 22 bp, Homo sapiens
ttcctgggggcagcagtcttga

SEQ ID NO: 7543601 - DNA, 22 bp, Homo sapiens
ttcctggggcttagcaatggag

SEQ ID NO: 7543602 - DNA, 22 bp, Homo sapiens
ttcctgggtggtcctggtagag

SEQ ID NO: 7543603 - DNA, 22 bp, Homo sapiens
ttcctgggtggtcctggtagag

SEQ ID NO: 7543604 - DNA, 22 bp, Homo sapiens
ttcctgggtggtcctggtagag

SEQ ID NO: 7543605 - DNA, 19 bp, Homo sapiens
ttcctggggttccattgtg

SEQ ID NO: 7543606 - DNA, 19 bp, Homo sapiens
ttcctggggttccattgtg

SEQ ID NO: 7543607 - DNA, 19 bp, Homo sapiens
ttcctggggttccattgtg

SEQ ID NO: 7543608 - DNA, 19 bp, Homo sapiens
ttcctggggttccattgtg

SEQ ID NO: 7543609 - DNA, 22 bp, Homo sapiens
ttcctgggtttacgtattgggt

SEQ ID NO: 7543610 - DNA, 22 bp, Homo sapiens
ttcctgggtttacgtattgggt

SEQ ID NO: 7543611 - DNA, 22 bp, Homo sapiens
ttcctgggttgtgcattgtaca

SEQ ID NO: 7543612 - DNA, 22 bp, Homo sapiens
ttcctgggttccctctcattct

SEQ ID NO: 7543613 - DNA, 22 bp, Homo sapiens
ttcctgggttccctctcattct

SEQ ID NO: 7543614 - DNA, 22 bp, Homo sapiens
ttcctgggttgtgcattgtaca

SEQ ID NO: 7543615 - DNA, 22 bp, Homo sapiens
ttcctgggttgtgcattgtaca

SEQ ID NO: 7543616 - DNA, 22 bp, Homo sapiens
ttcctgggttgtgcattgtaca

SEQ ID NO: 7543617 - DNA, 22 bp, Homo sapiens
ttccttctggaggctccagggg

SEQ ID NO: 7543618 - DNA, 22 bp, Homo sapiens
ttccttctggaggctccagggg

SEQ ID NO: 7543619 - DNA, 22 bp, Homo sapiens
ttccttctggaggctccagggg

SEQ ID NO: 7543620 - DNA, 22 bp, Homo sapiens
ttccttcttcattgtgttacag

SEQ ID NO: 7543621 - DNA, 22 bp, Homo sapiens
ttccttctggaagcttcagggg

SEQ ID NO: 7543622 - DNA, 22 bp, Homo sapiens
ttccttctggagcccggggagc

SEQ ID NO: 7543623 - DNA, 22 bp, Homo sapiens
ttccttctggaagcttcagggg

SEQ ID NO: 7543624 - DNA, 18 bp, Homo sapiens
ttccttctgatgtatatg

SEQ ID NO: 7543625 - DNA, 20 bp, Homo sapiens
ttcctgtatacaaagagttc

SEQ ID NO: 7543626 - DNA, 22 bp, Homo sapiens
ttcctgtagttgtgcaatgtac

SEQ ID NO: 7543627 - DNA, 22 bp, Homo sapiens
ttcctgtatctgcttcttacta

SEQ ID NO: 7543628 - DNA, 18 bp, Homo sapiens
ttccttctgatgtatatg

SEQ ID NO: 7543629 - DNA, 22 bp, Homo sapiens
ttcctgtatctgcttcttacta

SEQ ID NO: 7543630 - DNA, 22 bp, Homo sapiens
ttccttcttcctttagtaacca

SEQ ID NO: 7543631 - DNA, 22 bp, Homo sapiens
ttccttcttcctttagtaacca

SEQ ID NO: 7543632 - DNA, 22 bp, Homo sapiens
ttccttcttcctttagtaacca

SEQ ID NO: 7543633 - DNA, 22 bp, Homo sapiens
ttccttcttccaaacccatcat

SEQ ID NO: 7543634 - DNA, 22 bp, Homo sapiens
ttccttcttgtaatgatctgcc

SEQ ID NO: 7543635 - DNA, 22 bp, Homo sapiens
ttccttcttgtaatgatctgcc

SEQ ID NO: 7543636 - DNA, 22 bp, Homo sapiens
ttccttcttgtaatgatctgcc

SEQ ID NO: 7543637 - DNA, 22 bp, Homo sapiens
ttccttcttccagaggctgccc

SEQ ID NO: 7543638 - DNA, 22 bp, Homo sapiens
ttccttcttccagaggctgccc

SEQ ID NO: 7543639 - DNA, 22 bp, Homo sapiens
ttccttcttccaaacccatcat

SEQ ID NO: 7543640 - DNA, 22 bp, Homo sapiens
ttccttcttccaaacccatcat

SEQ ID NO: 7543641 - DNA, 22 bp, Homo sapiens
ttccttcttccaaacccatcat

SEQ ID NO: 7543642 - DNA, 22 bp, Homo sapiens
ttccttcttccaaacccatcat

SEQ ID NO: 7543643 - DNA, 22 bp, Homo sapiens
ttccttcttccaaacccatcat

SEQ ID NO: 7543644 - DNA, 22 bp, Homo sapiens
ttccttggatacaagtaacttt

SEQ ID NO: 7543645 - DNA, 20 bp, Homo sapiens
ttccttggattgtgtcttga

SEQ ID NO: 7543646 - DNA, 22 bp, Homo sapiens
ttccttggatacaagtaacttt

SEQ ID NO: 7543647 - DNA, 22 bp, Homo sapiens
ttccttggatacaagtaacttt

SEQ ID NO: 7543648 - DNA, 22 bp, Homo sapiens
ttccttggagtcaaacagggag

SEQ ID NO: 7543649 - DNA, 22 bp, Homo sapiens
ttccttggagttaagaccctgg

SEQ ID NO: 7543650 - DNA, 22 bp, Homo sapiens
ttccttggagtcaaacagggag

SEQ ID NO: 7543651 - DNA, 22 bp, Homo sapiens
ttccttggagttaagaccctgg

SEQ ID NO: 7543652 - DNA, 22 bp, Homo sapiens
ttccttggagttaagaccctgg

SEQ ID NO: 7543653 - DNA, 22 bp, Homo sapiens
ttccttggccacactggtgctt

SEQ ID NO: 7543654 - DNA, 22 bp, Homo sapiens
ttccttggccacactggtgctt

SEQ ID NO: 7543655 - DNA, 22 bp, Homo sapiens
ttccttggccacactggtgctt

SEQ ID NO: 7543656 - DNA, 20 bp, Homo sapiens
ttccttggattgtgtcttga

SEQ ID NO: 7543657 - DNA, 22 bp, Homo sapiens
ttccttggccacactggtgctt

SEQ ID NO: 7543658 - DNA, 22 bp, Homo sapiens
ttccttggccccatgcccaggg

SEQ ID NO: 7543659 - DNA, 22 bp, Homo sapiens
ttccttggccccatgcccaggg

SEQ ID NO: 7543660 - DNA, 22 bp, Homo sapiens
ttccttgattagtacatgaagg

SEQ ID NO: 7543661 - DNA, 22 bp, Homo sapiens
ttccttgattagtacatgaagg

SEQ ID NO: 7543662 - DNA, 18 bp, Homo sapiens
ttccttgattagagagaa

SEQ ID NO: 7543663 - DNA, 22 bp, Homo sapiens
ttccttggaaagagacgtcgct

SEQ ID NO: 7543664 - DNA, 22 bp, Homo sapiens
ttccttgcctcggggtaccttg

SEQ ID NO: 7543665 - DNA, 22 bp, Homo sapiens
ttccttgccctctgggatcttg

SEQ ID NO: 7543666 - DNA, 22 bp, Homo sapiens
ttccttgccctctgggatcttg

SEQ ID NO: 7543667 - DNA, 22 bp, Homo sapiens
ttccttggaaattctgacttca

SEQ ID NO: 7543668 - DNA, 22 bp, Homo sapiens
ttccttggaaagagacgtcgct

SEQ ID NO: 7543669 - DNA, 22 bp, Homo sapiens
ttccttggaaattctgacttca

SEQ ID NO: 7543670 - DNA, 22 bp, Homo sapiens
ttccttggaagggtaattgcaa

SEQ ID NO: 7543671 - DNA, 22 bp, Homo sapiens
ttccttggagcgctaaagctct

SEQ ID NO: 7543672 - DNA, 22 bp, Homo sapiens
ttccttggagtcaaacagggag

SEQ ID NO: 7543673 - DNA, 22 bp, Homo sapiens
ttccttggagcgctaaagctct

SEQ ID NO: 7543674 - DNA, 22 bp, Homo sapiens
ttccttggaagggtaattgcaa

SEQ ID NO: 7543675 - DNA, 22 bp, Homo sapiens
ttccttggaagggtaattgcaa

SEQ ID NO: 7543676 - DNA, 22 bp, Homo sapiens
ttccttggagcgctaaagctct

SEQ ID NO: 7543677 - DNA, 22 bp, Homo sapiens
ttccttggagcgctaaagctct

SEQ ID NO: 7543678 - DNA, 18 bp, Homo sapiens
ttccttgattagagagaa

SEQ ID NO: 7543679 - DNA, 18 bp, Homo sapiens
ttccttgattagagagaa

SEQ ID NO: 7543680 - DNA, 22 bp, Homo sapiens
ttccttgaggtattcagtttta

SEQ ID NO: 7543681 - DNA, 22 bp, Homo sapiens
ttccttgaggtattcagtttta

SEQ ID NO: 7543682 - DNA, 22 bp, Homo sapiens
ttccttgagatgactgtcttgt

SEQ ID NO: 7543683 - DNA, 22 bp, Homo sapiens
ttccttgagaaaggcacaagtt

SEQ ID NO: 7543684 - DNA, 22 bp, Homo sapiens
ttccttgagaaaggcacaagtt

SEQ ID NO: 7543685 - DNA, 22 bp, Homo sapiens
ttccttgagaaaggcacaagtt

SEQ ID NO: 7543686 - DNA, 22 bp, Homo sapiens
ttccttgaccactgcataatga

SEQ ID NO: 7543687 - DNA, 22 bp, Homo sapiens
ttccttgaatgagtcatggaaa

SEQ ID NO: 7543688 - DNA, 22 bp, Homo sapiens
ttccttgaatgagtcatggaaa

SEQ ID NO: 7543689 - DNA, 22 bp, Homo sapiens
ttccttgaaagctggacatggg

SEQ ID NO: 7543690 - DNA, 22 bp, Homo sapiens
ttccttcttttacaccataaat

SEQ ID NO: 7543691 - DNA, 22 bp, Homo sapiens
ttccttgaaagctggacatggg

SEQ ID NO: 7543692 - DNA, 22 bp, Homo sapiens
ttccttgaaagtttgaactgac

SEQ ID NO: 7543693 - DNA, 22 bp, Homo sapiens
ttccttcttttacaccataaat

SEQ ID NO: 7543694 - DNA, 22 bp, Homo sapiens
ttccttcttttacaccataaat

SEQ ID NO: 7543695 - DNA, 22 bp, Homo sapiens
ttccttctttgtggtagaaagt

SEQ ID NO: 7543696 - DNA, 22 bp, Homo sapiens
ttccttctttgtggtagaaagt

SEQ ID NO: 7543697 - DNA, 22 bp, Homo sapiens
tttagagagaaataaatgagat

SEQ ID NO: 7543698 - DNA, 22 bp, Homo sapiens
tttagagagaaataaatgagat

SEQ ID NO: 7543699 - DNA, 22 bp, Homo sapiens
tttagagagcactgtagacact

SEQ ID NO: 7543700 - DNA, 22 bp, Homo sapiens
tttagagagcactgtagacact

SEQ ID NO: 7543701 - DNA, 22 bp, Homo sapiens
tttagagagaaataaatgagat

SEQ ID NO: 7543702 - DNA, 22 bp, Homo sapiens
tttagagagaattttcaaagtg

SEQ ID NO: 7543703 - DNA, 22 bp, Homo sapiens
tttagagaggctctgtaaaatg

SEQ ID NO: 7543704 - DNA, 22 bp, Homo sapiens
tttagagaggctctgtaaaatg

SEQ ID NO: 7543705 - DNA, 22 bp, Homo sapiens
tttagagagcactgtagacact

SEQ ID NO: 7543706 - DNA, 22 bp, Homo sapiens
tttagagaattagaacagtact

SEQ ID NO: 7543707 - DNA, 22 bp, Homo sapiens
tttagagacacactggcatttg

SEQ ID NO: 7543708 - DNA, 22 bp, Homo sapiens
tttagagaccctctgctatttt

SEQ ID NO: 7543709 - DNA, 17 bp, Homo sapiens
tttagaatacaatgttt

SEQ ID NO: 7543710 - DNA, 22 bp, Homo sapiens
tttagagaattagaacagtact

SEQ ID NO: 7543711 - DNA, 22 bp, Homo sapiens
tttagagaattagaacagtact

SEQ ID NO: 7543712 - DNA, 22 bp, Homo sapiens
tttagagaattagaacagtact

SEQ ID NO: 7543713 - DNA, 22 bp, Homo sapiens
tttagaggggaaagtggctggt

SEQ ID NO: 7543714 - DNA, 22 bp, Homo sapiens
tttagaggggaaagtggctggt

SEQ ID NO: 7543715 - DNA, 22 bp, Homo sapiens
tttagaggcatcttgcttttct

SEQ ID NO: 7543716 - DNA, 22 bp, Homo sapiens
tttagagtcattttatattgac

SEQ ID NO: 7543717 - DNA, 22 bp, Homo sapiens
tttagagtaaaaactgtgacct

SEQ ID NO: 7543718 - DNA, 22 bp, Homo sapiens
tttagaggttagaggctgatag

SEQ ID NO: 7543719 - DNA, 22 bp, Homo sapiens
tttagagagtgtaaaaatatat

SEQ ID NO: 7543720 - DNA, 22 bp, Homo sapiens
tttagagagtgtaaaaatatat

SEQ ID NO: 7543721 - DNA, 22 bp, Homo sapiens
tttagagagtgtaaaaatatat

SEQ ID NO: 7543722 - DNA, 22 bp, Homo sapiens
tttagagagtgtaaaaatatat

SEQ ID NO: 7543723 - DNA, 22 bp, Homo sapiens
tttagagatgggagacaggaaa

SEQ ID NO: 7543724 - DNA, 22 bp, Homo sapiens
tttagagcagggtgtggcacat

SEQ ID NO: 7543725 - DNA, 22 bp, Homo sapiens
tttagaggaggaagaaattttg

SEQ ID NO: 7543726 - DNA, 22 bp, Homo sapiens
tttagagcccatgtgagtgtga

SEQ ID NO: 7543727 - DNA, 22 bp, Homo sapiens
tttagagctgtgctgccacatg

SEQ ID NO: 7543728 - DNA, 22 bp, Homo sapiens
tttagcaagtatttactgacta

SEQ ID NO: 7543729 - DNA, 22 bp, Homo sapiens
tttagcaaggtaggtccatgga

SEQ ID NO: 7543730 - DNA, 22 bp, Homo sapiens
tttagcaaggagaaataatcct

SEQ ID NO: 7543731 - DNA, 22 bp, Homo sapiens
tttagcaaggtaggtccatgga

SEQ ID NO: 7543732 - DNA, 22 bp, Homo sapiens
tttagcaagattgagccgtctt

SEQ ID NO: 7543733 - DNA, 22 bp, Homo sapiens
tttagcaaggagaaataatcct

SEQ ID NO: 7543734 - DNA, 22 bp, Homo sapiens
tttagcaagatgccctggcttt

SEQ ID NO: 7543735 - DNA, 22 bp, Homo sapiens
tttagcaagatgccctggcttt

SEQ ID NO: 7543736 - DNA, 21 bp, Homo sapiens
tttagcaagagtatagtgcat

SEQ ID NO: 7543737 - DNA, 22 bp, Homo sapiens
tttagcaacgaagcactcgaca

SEQ ID NO: 7543738 - DNA, 22 bp, Homo sapiens
tttagcaaaggtagggttcaga

SEQ ID NO: 7543739 - DNA, 22 bp, Homo sapiens
tttagcaaactttggagtttgt

SEQ ID NO: 7543740 - DNA, 20 bp, Homo sapiens
tttagcaaaagggactgctc

SEQ ID NO: 7543741 - DNA, 22 bp, Homo sapiens
tttagcaaaacattatgtctgt

SEQ ID NO: 7543742 - DNA, 22 bp, Homo sapiens
tttagcaaaacattatgtctgt

SEQ ID NO: 7543743 - DNA, 22 bp, Homo sapiens
tttagcaaaacattatgtctgt

SEQ ID NO: 7543744 - DNA, 22 bp, Homo sapiens
tttagcaaaggtgtcttgggca

SEQ ID NO: 7543745 - DNA, 22 bp, Homo sapiens
tttagcaaatatttctgttgat

SEQ ID NO: 7543746 - DNA, 22 bp, Homo sapiens
tttagcaaattactcacagggt

SEQ ID NO: 7543747 - DNA, 22 bp, Homo sapiens
tttagcaaattagcacctctaa

SEQ ID NO: 7543748 - DNA, 22 bp, Homo sapiens
tttagcaaattagcacctctaa

SEQ ID NO: 7543749 - DNA, 22 bp, Homo sapiens
tttagcaaattactcacagggt

SEQ ID NO: 7543750 - DNA, 22 bp, Homo sapiens
tttagataatgctcaagcaatt

SEQ ID NO: 7543751 - DNA, 22 bp, Homo sapiens
tttagatgctgtatgttatttc

SEQ ID NO: 7543752 - DNA, 22 bp, Homo sapiens
tttagataatgctcaagcaatt

SEQ ID NO: 7543753 - DNA, 22 bp, Homo sapiens
tttagagtttctaaatggaatt

SEQ ID NO: 7543754 - DNA, 22 bp, Homo sapiens
tttagagtttctaaatggaatt

SEQ ID NO: 7543755 - DNA, 22 bp, Homo sapiens
tttagcaaaacattatgtctgt

SEQ ID NO: 7543756 - DNA, 22 bp, Homo sapiens
tttagcaaaaaagctctgcgta

SEQ ID NO: 7543757 - DNA, 22 bp, Homo sapiens
tttagattgtgacctcccccca

SEQ ID NO: 7543758 - DNA, 22 bp, Homo sapiens
tttagattgtgacctcccccca

SEQ ID NO: 7543759 - DNA, 22 bp, Homo sapiens
tttagattgtgacctcccccca

SEQ ID NO: 7543760 - DNA, 22 bp, Homo sapiens
tttagagttgagtattcattgg

SEQ ID NO: 7543761 - DNA, 22 bp, Homo sapiens
tttagagttggtcccctgtgag

SEQ ID NO: 7543762 - DNA, 22 bp, Homo sapiens
tttagagtccttgctcttattc

SEQ ID NO: 7543763 - DNA, 22 bp, Homo sapiens
tttagagtccaagttcttcact

SEQ ID NO: 7543764 - DNA, 22 bp, Homo sapiens
tttaccaaatagattatgtcag

SEQ ID NO: 7543765 - DNA, 20 bp, Homo sapiens
tttacattttgaaacagtga

SEQ ID NO: 7543766 - DNA, 20 bp, Homo sapiens
tttacattttgaaacagtga

SEQ ID NO: 7543767 - DNA, 20 bp, Homo sapiens
tttacattttgaaacagtga

SEQ ID NO: 7543768 - DNA, 20 bp, Homo sapiens
tttacattttgaaacagtga

SEQ ID NO: 7543769 - DNA, 22 bp, Homo sapiens
tttacatttccctctgtcagtt

SEQ ID NO: 7543770 - DNA, 20 bp, Homo sapiens
tttacattttgaaacagtga

SEQ ID NO: 7543771 - DNA, 20 bp, Homo sapiens
tttacattttgaaacagtga

SEQ ID NO: 7543772 - DNA, 20 bp, Homo sapiens
tttacattttgaaacagtga

SEQ ID NO: 7543773 - DNA, 20 bp, Homo sapiens
tttacattttgaaacagtga

SEQ ID NO: 7543774 - DNA, 20 bp, Homo sapiens
tttacattttgaaacagtga

SEQ ID NO: 7543775 - DNA, 20 bp, Homo sapiens
tttacattttgaaacagtga

SEQ ID NO: 7543776 - DNA, 20 bp, Homo sapiens
tttacattttgaaacagtga

SEQ ID NO: 7543777 - DNA, 22 bp, Homo sapiens
tttacagtgagagcttagtgag

SEQ ID NO: 7543778 - DNA, 22 bp, Homo sapiens
tttacagtgagagcttagtgag

SEQ ID NO: 7543779 - DNA, 22 bp, Homo sapiens
tttacagtgagagcttagtgag

SEQ ID NO: 7543780 - DNA, 22 bp, Homo sapiens
tttacagtctgtctagcaatgt

SEQ ID NO: 7543781 - DNA, 22 bp, Homo sapiens
tttacagtgagagcttagtgag

SEQ ID NO: 7543782 - DNA, 22 bp, Homo sapiens
tttacagtgagagcttagtgag

SEQ ID NO: 7543783 - DNA, 22 bp, Homo sapiens
tttacagtgtcttgttgactgt

SEQ ID NO: 7543784 - DNA, 22 bp, Homo sapiens
tttacagtgtcttgttgactgt

SEQ ID NO: 7543785 - DNA, 22 bp, Homo sapiens
tttacagtctgtctagcaatgt

SEQ ID NO: 7543786 - DNA, 22 bp, Homo sapiens
tttacagtctgtctagcaatgt

SEQ ID NO: 7543787 - DNA, 22 bp, Homo sapiens
tttacagtgagagcttagtgag

SEQ ID NO: 7543788 - DNA, 22 bp, Homo sapiens
tttacagtctgtctagcaatgt

SEQ ID NO: 7543789 - DNA, 22 bp, Homo sapiens
tttacagtctgtctagcaatgt

SEQ ID NO: 7543790 - DNA, 22 bp, Homo sapiens
tttacagtctgtctagcaatgt

SEQ ID NO: 7543791 - DNA, 22 bp, Homo sapiens
tttacagtctgtctagcaatgt

SEQ ID NO: 7543792 - DNA, 22 bp, Homo sapiens
tttacagtctgtctagcaatgt

SEQ ID NO: 7543793 - DNA, 22 bp, Homo sapiens
tttagaagttcacacatttaaa

SEQ ID NO: 7543794 - DNA, 22 bp, Homo sapiens
tttagaagttcacacatttaaa

SEQ ID NO: 7543795 - DNA, 17 bp, Homo sapiens
tttagaatacaatgttt

SEQ ID NO: 7543796 - DNA, 17 bp, Homo sapiens
tttagaatacaatgttt

SEQ ID NO: 7543797 - DNA, 21 bp, Homo sapiens
tttaccacatggtcctcattt

SEQ ID NO: 7543798 - DNA, 22 bp, Homo sapiens
tttagaagggctggtcagaaat

SEQ ID NO: 7543799 - DNA, 22 bp, Homo sapiens
tttagaagggctggtcagaaat

SEQ ID NO: 7543800 - DNA, 22 bp, Homo sapiens
tttagaagggctggtcagaaat

SEQ ID NO: 7543801 - DNA, 22 bp, Homo sapiens
tttagaaggactacagtgtgat

SEQ ID NO: 7543802 - DNA, 22 bp, Homo sapiens
tttaccaagagttgtcactgtt

SEQ ID NO: 7543803 - DNA, 22 bp, Homo sapiens
tttaccaagagttgtcactgtt

SEQ ID NO: 7543804 - DNA, 22 bp, Homo sapiens
tttaccaagctttaattacata

SEQ ID NO: 7543805 - DNA, 22 bp, Homo sapiens
tttaccaagatagcatctggtt

SEQ ID NO: 7543806 - DNA, 22 bp, Homo sapiens
tttaccaaatagattatgtcag

SEQ ID NO: 7543807 - DNA, 22 bp, Homo sapiens
tttaccaaagtactctgaggca

SEQ ID NO: 7543808 - DNA, 22 bp, Homo sapiens
tttaccaaatgagactattgtt

SEQ ID NO: 7543809 - DNA, 22 bp, Homo sapiens
tttaccaaatgagactattgtt

SEQ ID NO: 7543810 - DNA, 22 bp, Homo sapiens
tttaccaaatgagactattgtt

SEQ ID NO: 7543811 - DNA, 20 bp, Homo sapiens
tttaccaactcaccagtatc

SEQ ID NO: 7543812 - DNA, 20 bp, Homo sapiens
tttaccaactcaccagtatc

SEQ ID NO: 7543813 - DNA, 20 bp, Homo sapiens
tttaccaactcaccagtatc

SEQ ID NO: 7543814 - DNA, 22 bp, Homo sapiens
tttaccacaattttaaacaatg

SEQ ID NO: 7543815 - DNA, 22 bp, Homo sapiens
tttaccacagaaaaaagtaact

SEQ ID NO: 7543816 - DNA, 22 bp, Homo sapiens
tttaccaaggcatagtaatctc

SEQ ID NO: 7543817 - DNA, 22 bp, Homo sapiens
tttaccaaggcatagtaatctc

SEQ ID NO: 7543818 - DNA, 22 bp, Homo sapiens
tttaccaagctttaattacata

SEQ ID NO: 7543819 - DNA, 22 bp, Homo sapiens
tttaccaagctttaattacata

SEQ ID NO: 7543820 - DNA, 22 bp, Homo sapiens
tttaccaagctttaattacata

SEQ ID NO: 7543821 - DNA, 22 bp, Homo sapiens
tttaccaagctttaattacata

SEQ ID NO: 7543822 - DNA, 22 bp, Homo sapiens
tttatattgtaaaaatggttct

SEQ ID NO: 7543823 - DNA, 22 bp, Homo sapiens
tttatattgtaaaaatggttct

SEQ ID NO: 7543824 - DNA, 22 bp, Homo sapiens
tttatattgtaaaaatggttct

SEQ ID NO: 7543825 - DNA, 22 bp, Homo sapiens
tttatattgtaaaaatggttct

SEQ ID NO: 7543826 - DNA, 22 bp, Homo sapiens
tttatattgggagtcgttttga

SEQ ID NO: 7543827 - DNA, 22 bp, Homo sapiens
tttatattgggagtcgttttga

SEQ ID NO: 7543828 - DNA, 22 bp, Homo sapiens
tttatattgggagtcgttttga

SEQ ID NO: 7543829 - DNA, 22 bp, Homo sapiens
tttatattgggagtcgttttga

SEQ ID NO: 7543830 - DNA, 22 bp, Homo sapiens
tttatatttcccaggattggcc

SEQ ID NO: 7543831 - DNA, 22 bp, Homo sapiens
tttatatttcccaggattggcc

SEQ ID NO: 7543832 - DNA, 22 bp, Homo sapiens
tttatatttcccaggattggcc

SEQ ID NO: 7543833 - DNA, 22 bp, Homo sapiens
tttatatttcccaggattggcc

SEQ ID NO: 7543834 - DNA, 22 bp, Homo sapiens
tttatattgtaaaaatggttct

SEQ ID NO: 7543835 - DNA, 22 bp, Homo sapiens
tttatattgtaaaaatggttct

SEQ ID NO: 7543836 - DNA, 22 bp, Homo sapiens
tttatattgtaaaaatggttct

SEQ ID NO: 7543837 - DNA, 22 bp, Homo sapiens
tttatattgtaaaaatggttct

SEQ ID NO: 7543838 - DNA, 22 bp, Homo sapiens
tttatattgtaaaaatggttct

SEQ ID NO: 7543839 - DNA, 22 bp, Homo sapiens
tttatattgtaaaaatggttct

SEQ ID NO: 7543840 - DNA, 22 bp, Homo sapiens
tttatatatggctggtctggat

SEQ ID NO: 7543841 - DNA, 22 bp, Homo sapiens
tttatatatggctggtctggat

SEQ ID NO: 7543842 - DNA, 22 bp, Homo sapiens
tttatatatggctggtctggat

SEQ ID NO: 7543843 - DNA, 22 bp, Homo sapiens
tttatatatggctggtctggat

SEQ ID NO: 7543844 - DNA, 22 bp, Homo sapiens
tttatatagagatttgtgcatg

SEQ ID NO: 7543845 - DNA, 22 bp, Homo sapiens
tttatatagagatttgtgcatg

SEQ ID NO: 7543846 - DNA, 22 bp, Homo sapiens
tttatatagagatttgtgcatg

SEQ ID NO: 7543847 - DNA, 22 bp, Homo sapiens
tttatattgggagtcgttttga

SEQ ID NO: 7543848 - DNA, 22 bp, Homo sapiens
tttatattgggagtcgttttga

SEQ ID NO: 7543849 - DNA, 22 bp, Homo sapiens
tttatattgggagtcgttttga

SEQ ID NO: 7543850 - DNA, 22 bp, Homo sapiens
tttatatatggctggtctggat

SEQ ID NO: 7543851 - DNA, 23 bp, Homo sapiens
tttatattcctaatgtcttgagc

SEQ ID NO: 7543852 - DNA, 22 bp, Homo sapiens
tttatattgggagtcgttttga

SEQ ID NO: 7543853 - DNA, 22 bp, Homo sapiens
tttagcatcgaagtaaatttag

SEQ ID NO: 7543854 - DNA, 22 bp, Homo sapiens
tttagcatatttaaggaatgat

SEQ ID NO: 7543855 - DNA, 22 bp, Homo sapiens
tttagcatccaaggttatgact

SEQ ID NO: 7543856 - DNA, 22 bp, Homo sapiens
tttatatagagatttgtgcatg

SEQ ID NO: 7543857 - DNA, 22 bp, Homo sapiens
tttatatagagatttgtgcatg

SEQ ID NO: 7543858 - DNA, 22 bp, Homo sapiens
tttatatagagatttgtgcatg

SEQ ID NO: 7543859 - DNA, 22 bp, Homo sapiens
tttatatagagatttgtgcatg

SEQ ID NO: 7543860 - DNA, 22 bp, Homo sapiens
tttagcagtatatttaaagcca

SEQ ID NO: 7543861 - DNA, 22 bp, Homo sapiens
tttagcagctggtgttaccata

SEQ ID NO: 7543862 - DNA, 22 bp, Homo sapiens
tttagcaggcagggatgggtgt

SEQ ID NO: 7543863 - DNA, 22 bp, Homo sapiens
tttagcatatcctataaaacta

SEQ ID NO: 7543864 - DNA, 22 bp, Homo sapiens
tttagcagtgaagtgaagtgaa

SEQ ID NO: 7543865 - DNA, 22 bp, Homo sapiens
tttagcagcaaataagtagtgc

SEQ ID NO: 7543866 - DNA, 22 bp, Homo sapiens
tttagcagcaaataagtagtgc

SEQ ID NO: 7543867 - DNA, 22 bp, Homo sapiens
tttagcagatctatgtatgtga

SEQ ID NO: 7543868 - DNA, 22 bp, Homo sapiens
tttagcagagcatatgatatcc

SEQ ID NO: 7543869 - DNA, 22 bp, Homo sapiens
tttagcagagcatatgatatcc

SEQ ID NO: 7543870 - DNA, 22 bp, Homo sapiens
tttagcagagcatatgatatcc

SEQ ID NO: 7543871 - DNA, 22 bp, Homo sapiens
tttagcagaatttctctagaag

SEQ ID NO: 7543872 - DNA, 22 bp, Homo sapiens
tttagcagaatttctctagaag

SEQ ID NO: 7543873 - DNA, 22 bp, Homo sapiens
tttagcagaaactcattaaatt

SEQ ID NO: 7543874 - DNA, 22 bp, Homo sapiens
tttagcagaaactcattaaatt

SEQ ID NO: 7543875 - DNA, 22 bp, Homo sapiens
tttagcactgaaagtccaggaa

SEQ ID NO: 7543876 - DNA, 16 bp, Homo sapiens
tttagcactggcatac

SEQ ID NO: 7543877 - DNA, 22 bp, Homo sapiens
tttagcacggtaacacataaag

SEQ ID NO: 7543878 - DNA, 23 bp, Homo sapiens
tttagcacgtcgcccagggaggc

SEQ ID NO: 7543879 - DNA, 22 bp, Homo sapiens
tttagcactaatcagctgtggc

SEQ ID NO: 7543880 - DNA, 22 bp, Homo sapiens
tttagcaccttcactttctctg

SEQ ID NO: 7543881 - DNA, 22 bp, Homo sapiens
tttagcaatttctaaaagtgtt

SEQ ID NO: 7543882 - DNA, 20 bp, Homo sapiens
tttagcacattgtacaaaac

SEQ ID NO: 7543883 - DNA, 22 bp, Homo sapiens
tttagcaatatcataaggaaga

SEQ ID NO: 7543884 - DNA, 22 bp, Homo sapiens
tttagcaattattaagggttga

SEQ ID NO: 7543885 - DNA, 22 bp, Homo sapiens
tttagcaattagaatccagcat

SEQ ID NO: 7543886 - DNA, 22 bp, Homo sapiens
tttagcaatttctaaaagtgtt

SEQ ID NO: 7543887 - DNA, 22 bp, Homo sapiens
tttagcaattagaatccagcat

SEQ ID NO: 7543888 - DNA, 22 bp, Homo sapiens
tttagcaattattaagggttga

SEQ ID NO: 7543889 - DNA, 22 bp, Homo sapiens
tttagcacagaactccactcac

SEQ ID NO: 7543890 - DNA, 22 bp, Homo sapiens
tttagcaataaagggatattaa

SEQ ID NO: 7543891 - DNA, 22 bp, Homo sapiens
tttagcaataaagggatattaa

SEQ ID NO: 7543892 - DNA, 22 bp, Homo sapiens
tttagcaatatcataaggaaga

SEQ ID NO: 7543893 - DNA, 22 bp, Homo sapiens
tttagcaagtatttactgacta

SEQ ID NO: 7543894 - DNA, 22 bp, Homo sapiens
tttagcaagttctctgagagaa

SEQ ID NO: 7543895 - DNA, 22 bp, Homo sapiens
tttatcatcttgtttttaaagc

SEQ ID NO: 7543896 - DNA, 22 bp, Homo sapiens
tttatcatcttgtttttaaagc

SEQ ID NO: 7543897 - DNA, 21 bp, Homo sapiens
tttatcatcacgagcttgagc

SEQ ID NO: 7543898 - DNA, 22 bp, Homo sapiens
tttatcatcttgtttttaaagc

SEQ ID NO: 7543899 - DNA, 22 bp, Homo sapiens
tttatcatcttgtttttaaagc

SEQ ID NO: 7543900 - DNA, 22 bp, Homo sapiens
tttatcatcttgtttttaaagc

SEQ ID NO: 7543901 - DNA, 23 bp, Homo sapiens
tttatccaactctgtaatctctc

SEQ ID NO: 7543902 - DNA, 22 bp, Homo sapiens
tttatccaagcacaatttctaa

SEQ ID NO: 7543903 - DNA, 22 bp, Homo sapiens
tttatccaagggttttaactgt

SEQ ID NO: 7543904 - DNA, 22 bp, Homo sapiens
tttatccacagtatccaaaatc

SEQ ID NO: 7543905 - DNA, 22 bp, Homo sapiens
tttatccagaatcaggattttt

SEQ ID NO: 7543906 - DNA, 22 bp, Homo sapiens
tttatccagaatcaggattttt

SEQ ID NO: 7543907 - DNA, 22 bp, Homo sapiens
tttatccactcatccatgcctc

SEQ ID NO: 7543908 - DNA, 22 bp, Homo sapiens
tttatccactcatccatgcctc

SEQ ID NO: 7543909 - DNA, 22 bp, Homo sapiens
tttatccaccttaccctgttcc

SEQ ID NO: 7543910 - DNA, 22 bp, Homo sapiens
tttatccacagtatccaaaatc

SEQ ID NO: 7543911 - DNA, 22 bp, Homo sapiens
tttatccaccagggactaggac

SEQ ID NO: 7543912 - DNA, 20 bp, Homo sapiens
tttatcaggcacttactatt

SEQ ID NO: 7543913 - DNA, 22 bp, Homo sapiens
tttatcagaggctatgtttcat

SEQ ID NO: 7543914 - DNA, 21 bp, Homo sapiens
tttatcatcacgagcttgagc

SEQ ID NO: 7543915 - DNA, 21 bp, Homo sapiens
tttatcatcacgagcttgagc

SEQ ID NO: 7543916 - DNA, 22 bp, Homo sapiens
tttatcagtagcaaagttttaa

SEQ ID NO: 7543917 - DNA, 22 bp, Homo sapiens
tttatcagtagcaaagttttaa

SEQ ID NO: 7543918 - DNA, 22 bp, Homo sapiens
tttatcagaagttagagaaaga

SEQ ID NO: 7543919 - DNA, 22 bp, Homo sapiens
tttatcagaagttagagaaaga

SEQ ID NO: 7543920 - DNA, 22 bp, Homo sapiens
tttatcaaacaaattatccagc

SEQ ID NO: 7543921 - DNA, 22 bp, Homo sapiens
tttatcaaacaaattatccagc

SEQ ID NO: 7543922 - DNA, 22 bp, Homo sapiens
tttatcaaacaaattatccagc

SEQ ID NO: 7543923 - DNA, 22 bp, Homo sapiens
tttatcaaacaaattatccagc

SEQ ID NO: 7543924 - DNA, 22 bp, Homo sapiens
tttatcaaacaaattatccagc

SEQ ID NO: 7543925 - DNA, 22 bp, Homo sapiens
tttatcaaacaaattatccagc

SEQ ID NO: 7543926 - DNA, 22 bp, Homo sapiens
tttatctgagctgatagatagt

SEQ ID NO: 7543927 - DNA, 22 bp, Homo sapiens
tttatctgacctcacttcttaa

SEQ ID NO: 7543928 - DNA, 22 bp, Homo sapiens
tttatctgagctgatagatagt

SEQ ID NO: 7543929 - DNA, 22 bp, Homo sapiens
tttatctctgcatagaagtgat

SEQ ID NO: 7543930 - DNA, 22 bp, Homo sapiens
tttatctcttttgaccaagatt

SEQ ID NO: 7543931 - DNA, 22 bp, Homo sapiens
tttatctgacctcacttcttaa

SEQ ID NO: 7543932 - DNA, 22 bp, Homo sapiens
tttatctgaatatgctccccac

SEQ ID NO: 7543933 - DNA, 22 bp, Homo sapiens
tttattcaagatgaggttcatg

SEQ ID NO: 7543934 - DNA, 22 bp, Homo sapiens
tttattcaagatgaggttcatg

SEQ ID NO: 7543935 - DNA, 22 bp, Homo sapiens
tttattcaagatgaggttcatg

SEQ ID NO: 7543936 - DNA, 22 bp, Homo sapiens
tttattcaagatgaggttcatg

SEQ ID NO: 7543937 - DNA, 22 bp, Homo sapiens
tttatctgaggaaagcagacaa

SEQ ID NO: 7543938 - DNA, 22 bp, Homo sapiens
tttatctgaggaaagcagacaa

SEQ ID NO: 7543939 - DNA, 22 bp, Homo sapiens
tttatccagcagctattcaaaa

SEQ ID NO: 7543940 - DNA, 22 bp, Homo sapiens
tttatccagcagctattcaaaa

SEQ ID NO: 7543941 - DNA, 22 bp, Homo sapiens
tttatccagtgttggaattttt

SEQ ID NO: 7543942 - DNA, 22 bp, Homo sapiens
tttatccagtgttggaattttt

SEQ ID NO: 7543943 - DNA, 22 bp, Homo sapiens
tttatccatatcattaaaatct

SEQ ID NO: 7543944 - DNA, 22 bp, Homo sapiens
tttatccatatcattaaaatct

SEQ ID NO: 7543945 - DNA, 22 bp, Homo sapiens
tttatccatcatctgctgaagg

SEQ ID NO: 7543946 - DNA, 22 bp, Homo sapiens
tttatccatcatctgctgaagg

SEQ ID NO: 7543947 - DNA, 22 bp, Homo sapiens
tttatccatcatctgctgaagg

SEQ ID NO: 7543948 - DNA, 22 bp, Homo sapiens
tttatccatcatctgctgaagg

SEQ ID NO: 7543949 - DNA, 22 bp, Homo sapiens
tttatccattggttagaaaatc

SEQ ID NO: 7543950 - DNA, 22 bp, Homo sapiens
tttatctattgtattgttgatg

SEQ ID NO: 7543951 - DNA, 22 bp, Homo sapiens
tttatccattggttagaaaatc

SEQ ID NO: 7543952 - DNA, 22 bp, Homo sapiens
tttatccattggttagaaaatc

SEQ ID NO: 7543953 - DNA, 22 bp, Homo sapiens
tttatccatgctcccgttgatg

SEQ ID NO: 7543954 - DNA, 22 bp, Homo sapiens
tttatccattcaccagttgaac

SEQ ID NO: 7543955 - DNA, 22 bp, Homo sapiens
tttatccattcaccagttgaac

SEQ ID NO: 7543956 - DNA, 22 bp, Homo sapiens
tttatctattgtattgttgatg

SEQ ID NO: 7543957 - DNA, 22 bp, Homo sapiens
tttatctattgtattgttgatg

SEQ ID NO: 7543958 - DNA, 22 bp, Homo sapiens
tttatctcttttgaccaagatt

SEQ ID NO: 7543959 - DNA, 22 bp, Homo sapiens
tttaagatttcttctcctgaga

SEQ ID NO: 7543960 - DNA, 22 bp, Homo sapiens
tttaagatttcttctcctgaga

SEQ ID NO: 7543961 - DNA, 22 bp, Homo sapiens
tttaagattcagtaaggcaaac

SEQ ID NO: 7543962 - DNA, 22 bp, Homo sapiens
tttaagattcagtaaggcaaac

SEQ ID NO: 7543963 - DNA, 22 bp, Homo sapiens
tttaagatggtattttataaag

SEQ ID NO: 7543964 - DNA, 22 bp, Homo sapiens
tttaagattcagtaaggcaaac

SEQ ID NO: 7543965 - DNA, 22 bp, Homo sapiens
tttaagattcagtaaggcaaac

SEQ ID NO: 7543966 - DNA, 22 bp, Homo sapiens
tttaagattcagtaaggcaaac

SEQ ID NO: 7543967 - DNA, 22 bp, Homo sapiens
tttaagattcagtaaggcaaac

SEQ ID NO: 7543968 - DNA, 22 bp, Homo sapiens
tttaagattcagtaaggcaaac

SEQ ID NO: 7543969 - DNA, 22 bp, Homo sapiens
tttaagcacagggataaagtta

SEQ ID NO: 7543970 - DNA, 22 bp, Homo sapiens
tttaagcacagggataaagtta

SEQ ID NO: 7543971 - DNA, 22 bp, Homo sapiens
tttaagcacagggataaagtta

SEQ ID NO: 7543972 - DNA, 22 bp, Homo sapiens
tttaagcacagggataaagtta

SEQ ID NO: 7543973 - DNA, 19 bp, Homo sapiens
tttaagcaatagtatcttg

SEQ ID NO: 7543974 - DNA, 19 bp, Homo sapiens
tttaagcaatagtatcttg

SEQ ID NO: 7543975 - DNA, 19 bp, Homo sapiens
tttaagcaatagtatcttg

SEQ ID NO: 7543976 - DNA, 22 bp, Homo sapiens
tttaagcaagttgacatagcat

SEQ ID NO: 7543977 - DNA, 19 bp, Homo sapiens
tttaagcaatagtatcttg

SEQ ID NO: 7543978 - DNA, 22 bp, Homo sapiens
tttaagcaagttgacatagcat

SEQ ID NO: 7543979 - DNA, 22 bp, Homo sapiens
tttaagcaagttgacatagcat

SEQ ID NO: 7543980 - DNA, 22 bp, Homo sapiens
tttaagatttcttctcctgaga

SEQ ID NO: 7543981 - DNA, 22 bp, Homo sapiens
tttaagcaagttgacatagcat

SEQ ID NO: 7543982 - DNA, 22 bp, Homo sapiens
tttaagcaagttgacatagcat

SEQ ID NO: 7543983 - DNA, 22 bp, Homo sapiens
tttaagcagagaaatgatgtat

SEQ ID NO: 7543984 - DNA, 22 bp, Homo sapiens
tttaagcagagaaatgatgtat

SEQ ID NO: 7543985 - DNA, 22 bp, Homo sapiens
tttaagcagagaaatgatgtat

SEQ ID NO: 7543986 - DNA, 22 bp, Homo sapiens
tttaagcagagaaatgatgtat

SEQ ID NO: 7543987 - DNA, 22 bp, Homo sapiens
tttaagcagagaaatgatgtat

SEQ ID NO: 7543988 - DNA, 22 bp, Homo sapiens
tttaagcacagggataaagtta

SEQ ID NO: 7543989 - DNA, 22 bp, Homo sapiens
tttaagcacagggataaagtta

SEQ ID NO: 7543990 - DNA, 22 bp, Homo sapiens
tttaagctaatgtcataattag

SEQ ID NO: 7543991 - DNA, 22 bp, Homo sapiens
tttaagctgtggcattaattct

SEQ ID NO: 7543992 - DNA, 22 bp, Homo sapiens
tttaagctaatgtcataattag

SEQ ID NO: 7543993 - DNA, 22 bp, Homo sapiens
tttaagcagagaaatgatgtat

SEQ ID NO: 7543994 - DNA, 22 bp, Homo sapiens
tttaaggaaaaaatgtacttag

SEQ ID NO: 7543995 - DNA, 22 bp, Homo sapiens
tttaagctaatgtcataattag

SEQ ID NO: 7543996 - DNA, 22 bp, Homo sapiens
tttaagctgtggcattaattct

SEQ ID NO: 7543997 - DNA, 22 bp, Homo sapiens
tttaaggagctactcaccgtca

SEQ ID NO: 7543998 - DNA, 22 bp, Homo sapiens
tttaaggaggggctcacgtggg

SEQ ID NO: 7543999 - DNA, 22 bp, Homo sapiens
tttaaggatgatgtgatatata

SEQ ID NO: 7544000 - DNA, 22 bp, Homo sapiens
tttaagggtggaggaacaaatg

SEQ ID NO: 7544001 - DNA, 22 bp, Homo sapiens
tttaagggtggaggaacaaatg

SEQ ID NO: 7544002 - DNA, 22 bp, Homo sapiens
tttaagggatattttgatagct

SEQ ID NO: 7544003 - DNA, 22 bp, Homo sapiens
tttaagggatattttgatagct

SEQ ID NO: 7544004 - DNA, 22 bp, Homo sapiens
tttaagggattgtgattttcac

SEQ ID NO: 7544005 - DNA, 22 bp, Homo sapiens
tttaagggattgtgattttcac

SEQ ID NO: 7544006 - DNA, 22 bp, Homo sapiens
tttaaggtggacatctaagtca

SEQ ID NO: 7544007 - DNA, 22 bp, Homo sapiens
tttaaggtggacatctaagtca

SEQ ID NO: 7544008 - DNA, 21 bp, Homo sapiens
tttaaggccagcaggaggtga

SEQ ID NO: 7544009 - DNA, 22 bp, Homo sapiens
tttaaggccttgagggaaattt

SEQ ID NO: 7544010 - DNA, 22 bp, Homo sapiens
tttaaggccttgagggaaattt

SEQ ID NO: 7544011 - DNA, 22 bp, Homo sapiens
tttaaggcttcaatttttggta

SEQ ID NO: 7544012 - DNA, 22 bp, Homo sapiens
tttaaggcttcaatttttggta

SEQ ID NO: 7544013 - DNA, 22 bp, Homo sapiens
tttaaggcttcaatttttggta

SEQ ID NO: 7544014 - DNA, 22 bp, Homo sapiens
tttaaggcttcactggagtggg

SEQ ID NO: 7544015 - DNA, 22 bp, Homo sapiens
tttaaggcttcactggagtggg

SEQ ID NO: 7544016 - DNA, 22 bp, Homo sapiens
tttaaggcttcactggagtggg

SEQ ID NO: 7544017 - DNA, 22 bp, Homo sapiens
tttaaggcttgtcttgcggttt

SEQ ID NO: 7544018 - DNA, 22 bp, Homo sapiens
tttaaggcttgtcttgcggttt

SEQ ID NO: 7544019 - DNA, 22 bp, Homo sapiens
tttaaggatgatgtgatatata

SEQ ID NO: 7544020 - DNA, 22 bp, Homo sapiens
tttaaggatgtaaaggaagaag

SEQ ID NO: 7544021 - DNA, 22 bp, Homo sapiens
tttaaggatgtaaaggaagaag

SEQ ID NO: 7544022 - DNA, 22 bp, Homo sapiens
tttaaggatgtaaaggaagaag

SEQ ID NO: 7544023 - DNA, 22 bp, Homo sapiens
tttaaggcagtgaaactattct

SEQ ID NO: 7544024 - DNA, 22 bp, Homo sapiens
tttaaggcagtgaaactattct

SEQ ID NO: 7544025 - DNA, 22 bp, Homo sapiens
tttaaggcagtgaaactattct

SEQ ID NO: 7544026 - DNA, 21 bp, Homo sapiens
tttaaggccagcaggaggtga

SEQ ID NO: 7544027 - DNA, 22 bp, Homo sapiens
tttaaggcaatatagaattcat

SEQ ID NO: 7544028 - DNA, 22 bp, Homo sapiens
tttaaggcaatatagaattcat

SEQ ID NO: 7544029 - DNA, 22 bp, Homo sapiens
tttaaggcaatatagaattcat

SEQ ID NO: 7544030 - DNA, 22 bp, Homo sapiens
tttaaggcaatatagaattcat

SEQ ID NO: 7544031 - DNA, 22 bp, Homo sapiens
tttaaggcagtgaaactattct

SEQ ID NO: 7544032 - DNA, 22 bp, Homo sapiens
tttaaggcagtgaaactattct

SEQ ID NO: 7544033 - DNA, 16 bp, Homo sapiens
tttaatctctcaggaa

SEQ ID NO: 7544034 - DNA, 22 bp, Homo sapiens
tttaatcttcaaaatagtctta

SEQ ID NO: 7544035 - DNA, 22 bp, Homo sapiens
tttaatcttcaaaatagtctta

SEQ ID NO: 7544036 - DNA, 22 bp, Homo sapiens
tttaatcttcaaaatagtctta

SEQ ID NO: 7544037 - DNA, 22 bp, Homo sapiens
tttaatgaataattcaaatctg

SEQ ID NO: 7544038 - DNA, 22 bp, Homo sapiens
tttaatgaataattcaaatctg

SEQ ID NO: 7544039 - DNA, 22 bp, Homo sapiens
tttaatgaataattcaaatctg

SEQ ID NO: 7544040 - DNA, 23 bp, Homo sapiens
tttaatgaccaatagaaggaaca

SEQ ID NO: 7544041 - DNA, 23 bp, Homo sapiens
tttaatgaccaatagaaggaaca

SEQ ID NO: 7544042 - DNA, 22 bp, Homo sapiens
tttaagtgatgaaatgcagata

SEQ ID NO: 7544043 - DNA, 22 bp, Homo sapiens
tttaatctattccctaaacacc

SEQ ID NO: 7544044 - DNA, 22 bp, Homo sapiens
tttaagtgatgaaatgcagata

SEQ ID NO: 7544045 - DNA, 22 bp, Homo sapiens
tttaatctattccctaaacacc

SEQ ID NO: 7544046 - DNA, 22 bp, Homo sapiens
tttaatctcccactctcagcct

SEQ ID NO: 7544047 - DNA, 22 bp, Homo sapiens
tttaatctattccctaaacacc

SEQ ID NO: 7544048 - DNA, 22 bp, Homo sapiens
tttaagtgaaatgtaatacagt

SEQ ID NO: 7544049 - DNA, 22 bp, Homo sapiens
tttaagtgatgaaatgcagata

SEQ ID NO: 7544050 - DNA, 22 bp, Homo sapiens
tttaagtgatgaaatgcagata

SEQ ID NO: 7544051 - DNA, 22 bp, Homo sapiens
tttaagtgaaatgtaatacagt

SEQ ID NO: 7544052 - DNA, 22 bp, Homo sapiens
tttaagtgaaatgtaatacagt

SEQ ID NO: 7544053 - DNA, 22 bp, Homo sapiens
tttaagtgaaatgtaatacagt

SEQ ID NO: 7544054 - DNA, 22 bp, Homo sapiens
tttaagtaataaagtagcagct

SEQ ID NO: 7544055 - DNA, 22 bp, Homo sapiens
tttaagtcatggagaattgtgg

SEQ ID NO: 7544056 - DNA, 22 bp, Homo sapiens
tttacagtctctatagtcaaaa

SEQ ID NO: 7544057 - DNA, 22 bp, Homo sapiens
tttacagtctctatagtcaaaa

SEQ ID NO: 7544058 - DNA, 22 bp, Homo sapiens
tttacagtctctatagtcaaaa

SEQ ID NO: 7544059 - DNA, 22 bp, Homo sapiens
tttacagtctctatagtcaaaa

SEQ ID NO: 7544060 - DNA, 22 bp, Homo sapiens
tttacagtctctatagtcaaaa

SEQ ID NO: 7544061 - DNA, 22 bp, Homo sapiens
tttacagtctctatagtcaaaa

SEQ ID NO: 7544062 - DNA, 22 bp, Homo sapiens
tttacagtctctatagtcaaaa

SEQ ID NO: 7544063 - DNA, 22 bp, Homo sapiens
tttacagtctgtctagcaatgt

SEQ ID NO: 7544064 - DNA, 22 bp, Homo sapiens
tttacagtctgtctagcaatgt

SEQ ID NO: 7544065 - DNA, 22 bp, Homo sapiens
tttacagtctgtctagcaatgt

SEQ ID NO: 7544066 - DNA, 22 bp, Homo sapiens
tttacagtctatgttgaattaa

SEQ ID NO: 7544067 - DNA, 22 bp, Homo sapiens
tttacagtctatgttgaattaa

SEQ ID NO: 7544068 - DNA, 22 bp, Homo sapiens
tttacagtctatgttgaattaa

SEQ ID NO: 7544069 - DNA, 22 bp, Homo sapiens
tttacagtctatgttgaattaa

SEQ ID NO: 7544070 - DNA, 22 bp, Homo sapiens
tttacagtcaccaaactttgct

SEQ ID NO: 7544071 - DNA, 22 bp, Homo sapiens
tttacagtatagtaggactcat

SEQ ID NO: 7544072 - DNA, 22 bp, Homo sapiens
tttacagtccccaggtgaggat

SEQ ID NO: 7544073 - DNA, 22 bp, Homo sapiens
tttacagtcaccaaactttgct

SEQ ID NO: 7544074 - DNA, 22 bp, Homo sapiens
tttacagtaaggtggatggtac

SEQ ID NO: 7544075 - DNA, 22 bp, Homo sapiens
tttacagtaaggtggatggtac

SEQ ID NO: 7544076 - DNA, 22 bp, Homo sapiens
tttacagggttcaagaatgaaa

SEQ ID NO: 7544077 - DNA, 22 bp, Homo sapiens
tttacagggttcaagaatgaaa

SEQ ID NO: 7544078 - DNA, 23 bp, Homo sapiens
tttacagggcactcttatgcagc

SEQ ID NO: 7544079 - DNA, 23 bp, Homo sapiens
tttacagggcactcttatgcagc

SEQ ID NO: 7544080 - DNA, 22 bp, Homo sapiens
tttacagggttcaagaatgaaa

SEQ ID NO: 7544081 - DNA, 22 bp, Homo sapiens
tttacagggttcaagaatgaaa

SEQ ID NO: 7544082 - DNA, 22 bp, Homo sapiens
tttaatgtgagtccctttcaag

SEQ ID NO: 7544083 - DNA, 22 bp, Homo sapiens
tttacagcttctatactatgtg

SEQ ID NO: 7544084 - DNA, 22 bp, Homo sapiens
tttacagcttctatactatgtg

SEQ ID NO: 7544085 - DNA, 22 bp, Homo sapiens
tttaatgtgagtccctttcaag

SEQ ID NO: 7544086 - DNA, 22 bp, Homo sapiens
tttaatgtgacatcttttagag

SEQ ID NO: 7544087 - DNA, 22 bp, Homo sapiens
tttaatgtattctttggaacca

SEQ ID NO: 7544088 - DNA, 22 bp, Homo sapiens
tttaatgtattctttggaacca

SEQ ID NO: 7544089 - DNA, 22 bp, Homo sapiens
tttaatgtagcgtgaaatgatt

SEQ ID NO: 7544090 - DNA, 22 bp, Homo sapiens
tttaatgtgacatcttttagag

SEQ ID NO: 7544091 - DNA, 22 bp, Homo sapiens
tttacaggattaccctggctgc

SEQ ID NO: 7544092 - DNA, 22 bp, Homo sapiens
tttacaggattaccctggctgc

SEQ ID NO: 7544093 - DNA, 22 bp, Homo sapiens
tttacaggaagctgaaaaacat

SEQ ID NO: 7544094 - DNA, 22 bp, Homo sapiens
tttacagcttctatactatgtg

SEQ ID NO: 7544095 - DNA, 19 bp, Homo sapiens
tttacagggaatggagacc

SEQ ID NO: 7544096 - DNA, 22 bp, Homo sapiens
tttacagggaatattttggctt

SEQ ID NO: 7544097 - DNA, 19 bp, Homo sapiens
tttacagggaatggagacc

SEQ ID NO: 7544098 - DNA, 19 bp, Homo sapiens
tttacagggaatggagacc

SEQ ID NO: 7544099 - DNA, 22 bp, Homo sapiens
tttaatggcaagaaggctgcag

SEQ ID NO: 7544100 - DNA, 22 bp, Homo sapiens
tttaatggcaagaaggctgcag

SEQ ID NO: 7544101 - DNA, 22 bp, Homo sapiens
tttaatgcccaaggctttgatg

SEQ ID NO: 7544102 - DNA, 22 bp, Homo sapiens
tttaatgcaatttctggtctgc

SEQ ID NO: 7544103 - DNA, 22 bp, Homo sapiens
tttaatgcaatttctggtctgc

SEQ ID NO: 7544104 - DNA, 22 bp, Homo sapiens
tttaatgatagtcttacgaaaa

SEQ ID NO: 7544105 - DNA, 22 bp, Homo sapiens
tttaatgatagtcttacgaaaa

SEQ ID NO: 7544106 - DNA, 22 bp, Homo sapiens
tttaatgtagcgtgaaatgatt

SEQ ID NO: 7544107 - DNA, 22 bp, Homo sapiens
tttaatgatagtcttacgaaaa

SEQ ID NO: 7544108 - DNA, 22 bp, Homo sapiens
tttaatgatagtcttacgaaaa

SEQ ID NO: 7544109 - DNA, 22 bp, Homo sapiens
tttaatgatagctgtttcacat

SEQ ID NO: 7544110 - DNA, 22 bp, Homo sapiens
tttaaatgtttaaaactcgtga

SEQ ID NO: 7544111 - DNA, 22 bp, Homo sapiens
tttaaatgtttaaaactcgtga

SEQ ID NO: 7544112 - DNA, 22 bp, Homo sapiens
tttaaatgtttatagagagtac

SEQ ID NO: 7544113 - DNA, 22 bp, Homo sapiens
tttaaatgtttaaaactcgtga

SEQ ID NO: 7544114 - DNA, 22 bp, Homo sapiens
tttaaatgtttatagagagtac

SEQ ID NO: 7544115 - DNA, 22 bp, Homo sapiens
tttaaatgtttatagagagtac

SEQ ID NO: 7544116 - DNA, 22 bp, Homo sapiens
tttaaatgtttatagagagtac

SEQ ID NO: 7544117 - DNA, 22 bp, Homo sapiens
tttaaatgttcatgatactgaa

SEQ ID NO: 7544118 - DNA, 22 bp, Homo sapiens
tttaaatgttcatgatactgaa

SEQ ID NO: 7544119 - DNA, 22 bp, Homo sapiens
tttaaatgtttaaaactcgtga

SEQ ID NO: 7544120 - DNA, 22 bp, Homo sapiens
tttaaatgtttaaaactcgtga

SEQ ID NO: 7544121 - DNA, 22 bp, Homo sapiens
tttaaatgtttaaaactcgtga

SEQ ID NO: 7544122 - DNA, 22 bp, Homo sapiens
tttaagatggtattttataaag

SEQ ID NO: 7544123 - DNA, 22 bp, Homo sapiens
tttaagatggtattttataaag

SEQ ID NO: 7544124 - DNA, 22 bp, Homo sapiens
tttaagatggtattttataaag

SEQ ID NO: 7544125 - DNA, 22 bp, Homo sapiens
tttaagatggtattttataaag

SEQ ID NO: 7544126 - DNA, 22 bp, Homo sapiens
tttaagatggtattttataaag

SEQ ID NO: 7544127 - DNA, 22 bp, Homo sapiens
tttaaatgtttatagagagtac

SEQ ID NO: 7544128 - DNA, 22 bp, Homo sapiens
tttaaatgtttatagagagtac

SEQ ID NO: 7544129 - DNA, 22 bp, Homo sapiens
tttaaatggcattttcccagat

SEQ ID NO: 7544130 - DNA, 22 bp, Homo sapiens
tttaaatggcattttcccagat

SEQ ID NO: 7544131 - DNA, 22 bp, Homo sapiens
tttaaatgctttaagcaagggt

SEQ ID NO: 7544132 - DNA, 22 bp, Homo sapiens
tttaaatggcattttcccagat

SEQ ID NO: 7544133 - DNA, 22 bp, Homo sapiens
tttaaatggcattttcccagat

SEQ ID NO: 7544134 - DNA, 22 bp, Homo sapiens
tttaaatgtgttcttagtagct

SEQ ID NO: 7544135 - DNA, 22 bp, Homo sapiens
tttaaatgtgttcttagtagct

SEQ ID NO: 7544136 - DNA, 22 bp, Homo sapiens
tttaaatggcattttcccagat

SEQ ID NO: 7544137 - DNA, 22 bp, Homo sapiens
tttaaatggcattttcccagat

SEQ ID NO: 7544138 - DNA, 22 bp, Homo sapiens
tttaaatgtgttcttagtagct

SEQ ID NO: 7544139 - DNA, 22 bp, Homo sapiens
tttaaatgtgttcttagtagct

SEQ ID NO: 7544140 - DNA, 22 bp, Homo sapiens
tttaaatgtgttcttagtagct

SEQ ID NO: 7544141 - DNA, 22 bp, Homo sapiens
tttaaatgtgttcttagtagct

SEQ ID NO: 7544142 - DNA, 22 bp, Homo sapiens
tttaaatgtgttcttagtagct

SEQ ID NO: 7544143 - DNA, 22 bp, Homo sapiens
tttaaatgtgttcttagtagct

SEQ ID NO: 7544144 - DNA, 22 bp, Homo sapiens
tttaaatgtgttcttagtagct

SEQ ID NO: 7544145 - DNA, 22 bp, Homo sapiens
tttaaatgttcatgatactgaa

SEQ ID NO: 7544146 - DNA, 22 bp, Homo sapiens
tttaaatgttcatgatactgaa

SEQ ID NO: 7544147 - DNA, 22 bp, Homo sapiens
tttaaatgtgttcttagtagct

SEQ ID NO: 7544148 - DNA, 22 bp, Homo sapiens
tttaaatgttcatgatactgaa

SEQ ID NO: 7544149 - DNA, 22 bp, Homo sapiens
tttaaatgttcatgatactgaa

SEQ ID NO: 7544150 - DNA, 22 bp, Homo sapiens
tttaaataggactcctgggggt

SEQ ID NO: 7544151 - DNA, 22 bp, Homo sapiens
tttaaatgcagacgttgattca

SEQ ID NO: 7544152 - DNA, 22 bp, Homo sapiens
tttaaatgcagacgttgattca

SEQ ID NO: 7544153 - DNA, 22 bp, Homo sapiens
tttaaatgcagacgttgattca

SEQ ID NO: 7544154 - DNA, 22 bp, Homo sapiens
tttaaataggactcctgggggt

SEQ ID NO: 7544155 - DNA, 22 bp, Homo sapiens
tttaaataggactcctgggggt

SEQ ID NO: 7544156 - DNA, 22 bp, Homo sapiens
tttaaataggactcctgggggt

SEQ ID NO: 7544157 - DNA, 22 bp, Homo sapiens
tttaaataggactcctgggggt

SEQ ID NO: 7544158 - DNA, 22 bp, Homo sapiens
tttaaataggactcctgggggt

SEQ ID NO: 7544159 - DNA, 22 bp, Homo sapiens
tttaaataggactcctgggggt

SEQ ID NO: 7544160 - DNA, 22 bp, Homo sapiens
tttaaataggactcctgggggt

SEQ ID NO: 7544161 - DNA, 22 bp, Homo sapiens
tttaaataggactcctgggggt

SEQ ID NO: 7544162 - DNA, 22 bp, Homo sapiens
tttaaatgcagacgttgattca

SEQ ID NO: 7544163 - DNA, 22 bp, Homo sapiens
tttaaatgcagacgttgattca

SEQ ID NO: 7544164 - DNA, 22 bp, Homo sapiens
tttaaatgcagacgttgattca

SEQ ID NO: 7544165 - DNA, 22 bp, Homo sapiens
tttaaatgcagacgttgattca

SEQ ID NO: 7544166 - DNA, 22 bp, Homo sapiens
tttaaatgcagacgttgattca

SEQ ID NO: 7544167 - DNA, 22 bp, Homo sapiens
tttaaatgctttaagcaagggt

SEQ ID NO: 7544168 - DNA, 22 bp, Homo sapiens
tttaaatgctttaagcaagggt

SEQ ID NO: 7544169 - DNA, 22 bp, Homo sapiens
tttaaagtggtccatttcagaa

SEQ ID NO: 7544170 - DNA, 22 bp, Homo sapiens
tttaaagtggtccatttcagaa

SEQ ID NO: 7544171 - DNA, 22 bp, Homo sapiens
tttaaagtggtccatttcagaa

SEQ ID NO: 7544172 - DNA, 22 bp, Homo sapiens
tttaaagtggtccatttcagaa

SEQ ID NO: 7544173 - DNA, 22 bp, Homo sapiens
tttaaagtggtccatttcagaa

SEQ ID NO: 7544174 - DNA, 22 bp, Homo sapiens
tttaaagtgctgctcctatcct

SEQ ID NO: 7544175 - DNA, 22 bp, Homo sapiens
tttaaagtgctgctcctatcct

SEQ ID NO: 7544176 - DNA, 22 bp, Homo sapiens
tttaaagtgctgctcctatcct

SEQ ID NO: 7544177 - DNA, 22 bp, Homo sapiens
tttaaagtgctgctcctatcct

SEQ ID NO: 7544178 - DNA, 19 bp, Homo sapiens
tttaaagtgactggtattt

SEQ ID NO: 7544179 - DNA, 22 bp, Homo sapiens
tttaaagtttttgcacattctg

SEQ ID NO: 7544180 - DNA, 22 bp, Homo sapiens
tttaaataggactcctgggggt

SEQ ID NO: 7544181 - DNA, 22 bp, Homo sapiens
tttaaagtggtccatttcagaa

SEQ ID NO: 7544182 - DNA, 22 bp, Homo sapiens
tttaaagtttttgcacattctg

SEQ ID NO: 7544183 - DNA, 22 bp, Homo sapiens
tttaaagtttttgcacattctg

SEQ ID NO: 7544184 - DNA, 22 bp, Homo sapiens
tttaaataggactcctgggggt

SEQ ID NO: 7544185 - DNA, 22 bp, Homo sapiens
tttaaataggactcctgggggt

SEQ ID NO: 7544186 - DNA, 22 bp, Homo sapiens
tttaaataggactcctgggggt

SEQ ID NO: 7544187 - DNA, 22 bp, Homo sapiens
tttaaataggactcctgggggt

SEQ ID NO: 7544188 - DNA, 22 bp, Homo sapiens
tttaaagaaattcctcatcttt

SEQ ID NO: 7544189 - DNA, 22 bp, Homo sapiens
tttaaagaaattcctcatcttt

SEQ ID NO: 7544190 - DNA, 22 bp, Homo sapiens
tttaaagaaattcctcatcttt

SEQ ID NO: 7544191 - DNA, 22 bp, Homo sapiens
tttaaagaaattcctcatcttt

SEQ ID NO: 7544192 - DNA, 22 bp, Homo sapiens
tttaaagaaattcctcatcttt

SEQ ID NO: 7544193 - DNA, 22 bp, Homo sapiens
tttaaagaaattcctcatcttt

SEQ ID NO: 7544194 - DNA, 22 bp, Homo sapiens
tttaaagaaattcctcatcttt

SEQ ID NO: 7544195 - DNA, 22 bp, Homo sapiens
tttaaagagaatgtgaaggagt

SEQ ID NO: 7544196 - DNA, 22 bp, Homo sapiens
tttaaagagaatgtgaaggagt

SEQ ID NO: 7544197 - DNA, 22 bp, Homo sapiens
tttaaagagaatgtgaaggagt

SEQ ID NO: 7544198 - DNA, 21 bp, Homo sapiens
tttaaagaataggaagggagg

SEQ ID NO: 7544199 - DNA, 19 bp, Homo sapiens
tttaaagtgactggtattt

SEQ ID NO: 7544200 - DNA, 22 bp, Homo sapiens
tttaaaggatagtgtaaacgct

SEQ ID NO: 7544201 - DNA, 21 bp, Homo sapiens
tttaaagaataggaagggagg

SEQ ID NO: 7544202 - DNA, 22 bp, Homo sapiens
tttaaaggccttgctgagccac

SEQ ID NO: 7544203 - DNA, 22 bp, Homo sapiens
tttaaaggccttgctgagccac

SEQ ID NO: 7544204 - DNA, 22 bp, Homo sapiens
tttaaagagaatgtgaaggagt

SEQ ID NO: 7544205 - DNA, 22 bp, Homo sapiens
tttaaagagaatgtgaaggagt

SEQ ID NO: 7544206 - DNA, 17 bp, Homo sapiens
tttaaactactacaagg

SEQ ID NO: 7544207 - DNA, 22 bp, Homo sapiens
tttaaactaacagtacacgttg

SEQ ID NO: 7544208 - DNA, 17 bp, Homo sapiens
tttaaactactacaagg

SEQ ID NO: 7544209 - DNA, 17 bp, Homo sapiens
tttaaactactacaagg

SEQ ID NO: 7544210 - DNA, 22 bp, Homo sapiens
tttaaactaacagtacacgttg

SEQ ID NO: 7544211 - DNA, 22 bp, Homo sapiens
tttaaactaacagtacacgttg

SEQ ID NO: 7544212 - DNA, 22 bp, Homo sapiens
tttaaactaacagtacacgttg

SEQ ID NO: 7544213 - DNA, 22 bp, Homo sapiens
tttaaactgttgattttatgaa

SEQ ID NO: 7544214 - DNA, 22 bp, Homo sapiens
tttaaactgttgattttatgaa

SEQ ID NO: 7544215 - DNA, 22 bp, Homo sapiens
tttaaagaaattcctcatcttt

SEQ ID NO: 7544216 - DNA, 22 bp, Homo sapiens
tttaaactgttgattttatgaa

SEQ ID NO: 7544217 - DNA, 17 bp, Homo sapiens
tttaaactactacaagg

SEQ ID NO: 7544218 - DNA, 17 bp, Homo sapiens
tttaaactactacaagg

SEQ ID NO: 7544219 - DNA, 17 bp, Homo sapiens
tttaaactactacaagg

SEQ ID NO: 7544220 - DNA, 17 bp, Homo sapiens
tttaaactactacaagg

SEQ ID NO: 7544221 - DNA, 22 bp, Homo sapiens
tttaaacatcttgttgccttaa

SEQ ID NO: 7544222 - DNA, 22 bp, Homo sapiens
tttaaacatcttgttgccttaa

SEQ ID NO: 7544223 - DNA, 17 bp, Homo sapiens
ttgtgtgtagttctgat

SEQ ID NO: 7544224 - DNA, 17 bp, Homo sapiens
ttgtgtgtagttctgat

SEQ ID NO: 7544225 - DNA, 22 bp, Homo sapiens
tttaaacatcttgttgccttaa

SEQ ID NO: 7544226 - DNA, 22 bp, Homo sapiens
tttaaacatcttgttgccttaa

SEQ ID NO: 7544227 - DNA, 22 bp, Homo sapiens
tttaaacatcttgttgccttaa

SEQ ID NO: 7544228 - DNA, 22 bp, Homo sapiens
tttaaacatcttgttgccttaa

SEQ ID NO: 7544229 - DNA, 22 bp, Homo sapiens
tttaaacatcttgttgccttaa

SEQ ID NO: 7544230 - DNA, 17 bp, Homo sapiens
ttgtgtgtagttctgat

SEQ ID NO: 7544231 - DNA, 22 bp, Homo sapiens
ttgtgtgtagactcagccattg

SEQ ID NO: 7544232 - DNA, 17 bp, Homo sapiens
ttgtgtgtagttctgat

SEQ ID NO: 7544233 - DNA, 22 bp, Homo sapiens
ttgtgtgctgagggcctgctgt

SEQ ID NO: 7544234 - DNA, 22 bp, Homo sapiens
ttgtgtgtactggttatgggca

SEQ ID NO: 7544235 - DNA, 22 bp, Homo sapiens
ttgtgtgcataaattctgatgt

SEQ ID NO: 7544236 - DNA, 22 bp, Homo sapiens
ttgtgtgctgagggcctgctgt

SEQ ID NO: 7544237 - DNA, 22 bp, Homo sapiens
ttgtgtgataagtctcttgtgc

SEQ ID NO: 7544238 - DNA, 22 bp, Homo sapiens
ttgtgtcttaaagattaaatgg

SEQ ID NO: 7544239 - DNA, 22 bp, Homo sapiens
ttgtgtcttaaagattaaatgg

SEQ ID NO: 7544240 - DNA, 22 bp, Homo sapiens
ttgtgtgtactggttatgggca

SEQ ID NO: 7544241 - DNA, 22 bp, Homo sapiens
ttgtgtgtactggttatgggca

SEQ ID NO: 7544242 - DNA, 22 bp, Homo sapiens
ttgtgtgtactggttatgggca

SEQ ID NO: 7544243 - DNA, 22 bp, Homo sapiens
ttgtgtgtagactcagccattg

SEQ ID NO: 7544244 - DNA, 22 bp, Homo sapiens
ttgtgtgtagactcagccattg

SEQ ID NO: 7544245 - DNA, 22 bp, Homo sapiens
ttgtgtgtagactcagccattg

SEQ ID NO: 7544246 - DNA, 22 bp, Homo sapiens
ttgtgtgtactggttatgggca

SEQ ID NO: 7544247 - DNA, 22 bp, Homo sapiens
tttcaagaattgaagaggattt

SEQ ID NO: 7544248 - DNA, 22 bp, Homo sapiens
tttcaagaagcaaattaaagtc

SEQ ID NO: 7544249 - DNA, 22 bp, Homo sapiens
tttcaagaagcaaattaaagtc

SEQ ID NO: 7544250 - DNA, 22 bp, Homo sapiens
tttcaagaagcaaattaaagtc

SEQ ID NO: 7544251 - DNA, 22 bp, Homo sapiens
tttcaagaacagcagcattcca

SEQ ID NO: 7544252 - DNA, 22 bp, Homo sapiens
tttcaagaacaacattcattca

SEQ ID NO: 7544253 - DNA, 22 bp, Homo sapiens
tttcaagaacaacattcattca

SEQ ID NO: 7544254 - DNA, 22 bp, Homo sapiens
tttcaagaacaacattcattca

SEQ ID NO: 7544255 - DNA, 22 bp, Homo sapiens
tttcaagaacaacattcattca

SEQ ID NO: 7544256 - DNA, 22 bp, Homo sapiens
tttcaactcatgctaaaggaag

SEQ ID NO: 7544257 - DNA, 22 bp, Homo sapiens
tttcaactcatgctaaaggaag

SEQ ID NO: 7544258 - DNA, 22 bp, Homo sapiens
tttcaactcatgctaaaggaag

SEQ ID NO: 7544259 - DNA, 22 bp, Homo sapiens
tttcaactagcccctaagtcct

SEQ ID NO: 7544260 - DNA, 22 bp, Homo sapiens
tttcaactagcccctaagtcct

SEQ ID NO: 7544261 - DNA, 23 bp, Homo sapiens
tttcaactcctgccattatttct

SEQ ID NO: 7544262 - DNA, 22 bp, Homo sapiens
tttcaactcatgctaaaggaag

SEQ ID NO: 7544263 - DNA, 22 bp, Homo sapiens
tttcaactcatgctaaaggaag

SEQ ID NO: 7544264 - DNA, 23 bp, Homo sapiens
tttcaactcctgccattatttct

SEQ ID NO: 7544265 - DNA, 23 bp, Homo sapiens
tttcaactcctgccattatttct

SEQ ID NO: 7544266 - DNA, 23 bp, Homo sapiens
tttcaactcctgccattatttct

SEQ ID NO: 7544267 - DNA, 23 bp, Homo sapiens
tttcaactcctgccattatttct

SEQ ID NO: 7544268 - DNA, 22 bp, Homo sapiens
tttcaacttgaagaattgatac

SEQ ID NO: 7544269 - DNA, 22 bp, Homo sapiens
tttcaacttgaagaattgatac

SEQ ID NO: 7544270 - DNA, 22 bp, Homo sapiens
tttcaagagcaggaaaaaggtc

SEQ ID NO: 7544271 - DNA, 22 bp, Homo sapiens
tttcaagagaaaactaacctat

SEQ ID NO: 7544272 - DNA, 22 bp, Homo sapiens
tttcaagagcaggaaaaaggtc

SEQ ID NO: 7544273 - DNA, 22 bp, Homo sapiens
tttcaagagcaggaaaaaggtc

SEQ ID NO: 7544274 - DNA, 22 bp, Homo sapiens
tttcaagagcaggaaaaaggtc

SEQ ID NO: 7544275 - DNA, 22 bp, Homo sapiens
tttcaagagggaactgaacaca

SEQ ID NO: 7544276 - DNA, 22 bp, Homo sapiens
tttcaagagggaactgaacaca

SEQ ID NO: 7544277 - DNA, 22 bp, Homo sapiens
tttcaagactcattgagtattg

SEQ ID NO: 7544278 - DNA, 22 bp, Homo sapiens
tttcaagactcattgagtattg

SEQ ID NO: 7544279 - DNA, 22 bp, Homo sapiens
tttcaagagaaaactaacctat

SEQ ID NO: 7544280 - DNA, 22 bp, Homo sapiens
tttcaagactcattgagtattg

SEQ ID NO: 7544281 - DNA, 22 bp, Homo sapiens
tttcaagactcattgagtattg

SEQ ID NO: 7544282 - DNA, 22 bp, Homo sapiens
tttcaacaggatgataataggc

SEQ ID NO: 7544283 - DNA, 22 bp, Homo sapiens
tttcaacaggatgataataggc

SEQ ID NO: 7544284 - DNA, 22 bp, Homo sapiens
tttcaacaggatgataataggc

SEQ ID NO: 7544285 - DNA, 23 bp, Homo sapiens
tttcaacaggcagagaagactta

SEQ ID NO: 7544286 - DNA, 23 bp, Homo sapiens
tttcaacaggcagagaagactta

SEQ ID NO: 7544287 - DNA, 22 bp, Homo sapiens
tttcaacataatgcctgctagg

SEQ ID NO: 7544288 - DNA, 22 bp, Homo sapiens
tttcaacagggcacaggtgcca

SEQ ID NO: 7544289 - DNA, 22 bp, Homo sapiens
tttcaacataatgcctgctagg

SEQ ID NO: 7544290 - DNA, 22 bp, Homo sapiens
tttcaacagctctcaaatgatc

SEQ ID NO: 7544291 - DNA, 22 bp, Homo sapiens
tttcaacagctctcaaatgatc

SEQ ID NO: 7544292 - DNA, 22 bp, Homo sapiens
tttcaacagctctcaaatgatc

SEQ ID NO: 7544293 - DNA, 22 bp, Homo sapiens
tttcaacagctctcaaatgatc

SEQ ID NO: 7544294 - DNA, 22 bp, Homo sapiens
tttcaacaggatgataataggc

SEQ ID NO: 7544295 - DNA, 22 bp, Homo sapiens
tttcaacaggatgataataggc

SEQ ID NO: 7544296 - DNA, 22 bp, Homo sapiens
tttcaacaggatgataataggc

SEQ ID NO: 7544297 - DNA, 22 bp, Homo sapiens
tttcaacaggatgataataggc

SEQ ID NO: 7544298 - DNA, 22 bp, Homo sapiens
tttcaacaggatgataataggc

SEQ ID NO: 7544299 - DNA, 22 bp, Homo sapiens
tttcaacatataccataatgcc

SEQ ID NO: 7544300 - DNA, 22 bp, Homo sapiens
tttcaacatataccataatgcc

SEQ ID NO: 7544301 - DNA, 22 bp, Homo sapiens
tttcaacatataccataatgcc

SEQ ID NO: 7544302 - DNA, 22 bp, Homo sapiens
tttcaacatataccataatgcc

SEQ ID NO: 7544303 - DNA, 22 bp, Homo sapiens
tttcaacatataccataatgcc

SEQ ID NO: 7544304 - DNA, 22 bp, Homo sapiens
tttcaacatataccataatgcc

SEQ ID NO: 7544305 - DNA, 22 bp, Homo sapiens
tttcaacataatgcctgctagg

SEQ ID NO: 7544306 - DNA, 22 bp, Homo sapiens
tttcaacataatgcctgctagg

SEQ ID NO: 7544307 - DNA, 22 bp, Homo sapiens
tttcaacatacctcagtgtatg

SEQ ID NO: 7544308 - DNA, 22 bp, Homo sapiens
tttcaacatacctcagtgtatg

SEQ ID NO: 7544309 - DNA, 22 bp, Homo sapiens
tttcaacatacctcagtgtatg

SEQ ID NO: 7544310 - DNA, 22 bp, Homo sapiens
tttcaacatacctcagtgtatg

SEQ ID NO: 7544311 - DNA, 22 bp, Homo sapiens
tttcaacatcacctagcagttc

SEQ ID NO: 7544312 - DNA, 22 bp, Homo sapiens
tttcaacatcacctagcagttc

SEQ ID NO: 7544313 - DNA, 22 bp, Homo sapiens
tttcaacatcacctagcagttc

SEQ ID NO: 7544314 - DNA, 22 bp, Homo sapiens
tttcaacatcacctagcagttc

SEQ ID NO: 7544315 - DNA, 22 bp, Homo sapiens
tttcaacatcacctagcagttc

SEQ ID NO: 7544316 - DNA, 22 bp, Homo sapiens
tttcaacatcacctagcagttc

SEQ ID NO: 7544317 - DNA, 17 bp, Homo sapiens
tttcaacatcactcagc

SEQ ID NO: 7544318 - DNA, 22 bp, Homo sapiens
tttcaacgtgtaatcttattta

SEQ ID NO: 7544319 - DNA, 22 bp, Homo sapiens
tttcaacatcacctagcagttc

SEQ ID NO: 7544320 - DNA, 22 bp, Homo sapiens
tttcacacaacgtgaatatact

SEQ ID NO: 7544321 - DNA, 22 bp, Homo sapiens
tttcacaattttaaggagcaaa

SEQ ID NO: 7544322 - DNA, 22 bp, Homo sapiens
tttcacaattttaaggagcaaa

SEQ ID NO: 7544323 - DNA, 22 bp, Homo sapiens
tttcacaattttaaggagcaaa

SEQ ID NO: 7544324 - DNA, 22 bp, Homo sapiens
tttcacaattttaaggagcaaa

SEQ ID NO: 7544325 - DNA, 22 bp, Homo sapiens
tttcacaattttaaggagcaaa

SEQ ID NO: 7544326 - DNA, 22 bp, Homo sapiens
tttcacaattttaaggagcaaa

SEQ ID NO: 7544327 - DNA, 22 bp, Homo sapiens
tttcacactagtcagaatacca

SEQ ID NO: 7544328 - DNA, 22 bp, Homo sapiens
tttcacactgcagcatcagaga

SEQ ID NO: 7544329 - DNA, 22 bp, Homo sapiens
tttcacactgcagcatcagaga

SEQ ID NO: 7544330 - DNA, 22 bp, Homo sapiens
tttcacacccactaggactgtt

SEQ ID NO: 7544331 - DNA, 22 bp, Homo sapiens
tttcacactagtcagaatacca

SEQ ID NO: 7544332 - DNA, 22 bp, Homo sapiens
tttcacactagtcagaatacca

SEQ ID NO: 7544333 - DNA, 23 bp, Homo sapiens
tttcacaatgagcattacagaat

SEQ ID NO: 7544334 - DNA, 23 bp, Homo sapiens
tttcacaatgagcattacagaat

SEQ ID NO: 7544335 - DNA, 23 bp, Homo sapiens
tttcacaatgagcattacagaat

SEQ ID NO: 7544336 - DNA, 23 bp, Homo sapiens
tttcacaatgagcattacagaat

SEQ ID NO: 7544337 - DNA, 23 bp, Homo sapiens
tttcacaatgagcattacagaat

SEQ ID NO: 7544338 - DNA, 20 bp, Homo sapiens
tttcacaatgaacatgtctc

SEQ ID NO: 7544339 - DNA, 22 bp, Homo sapiens
tttcaagcaggatcaaagcaaa

SEQ ID NO: 7544340 - DNA, 22 bp, Homo sapiens
tttcaagcataactgggaagag

SEQ ID NO: 7544341 - DNA, 22 bp, Homo sapiens
tttcacaatgcaatcctacttc

SEQ ID NO: 7544342 - DNA, 23 bp, Homo sapiens
tttcacaatgagcattacagaat

SEQ ID NO: 7544343 - DNA, 23 bp, Homo sapiens
tttcacaatgagcattacagaat

SEQ ID NO: 7544344 - DNA, 23 bp, Homo sapiens
tttcacaatgagcattacagaat

SEQ ID NO: 7544345 - DNA, 23 bp, Homo sapiens
tttcacaatgagcattacagaat

SEQ ID NO: 7544346 - DNA, 23 bp, Homo sapiens
tttcacaatgagcattacagaat

SEQ ID NO: 7544347 - DNA, 22 bp, Homo sapiens
tttcacagaggaggaagctgag

SEQ ID NO: 7544348 - DNA, 22 bp, Homo sapiens
tttcacagagaaatataacagg

SEQ ID NO: 7544349 - DNA, 22 bp, Homo sapiens
tttcacagagaatattgccttg

SEQ ID NO: 7544350 - DNA, 22 bp, Homo sapiens
tttcacagagaaatataacagg

SEQ ID NO: 7544351 - DNA, 22 bp, Homo sapiens
tttcacagagaaatataacagg

SEQ ID NO: 7544352 - DNA, 22 bp, Homo sapiens
tttcacagagaaatataacagg

SEQ ID NO: 7544353 - DNA, 22 bp, Homo sapiens
tttcacagatataagatttcac

SEQ ID NO: 7544354 - DNA, 22 bp, Homo sapiens
tttcacagaggaggaagctgag

SEQ ID NO: 7544355 - DNA, 22 bp, Homo sapiens
tttcacagatataagatttcac

SEQ ID NO: 7544356 - DNA, 22 bp, Homo sapiens
tttcacagatataagatttcac

SEQ ID NO: 7544357 - DNA, 22 bp, Homo sapiens
tttcacagatataagatttcac

SEQ ID NO: 7544358 - DNA, 22 bp, Homo sapiens
tttcacagatataagatttcac

SEQ ID NO: 7544359 - DNA, 22 bp, Homo sapiens
tttcacagatcctacagcttgt

SEQ ID NO: 7544360 - DNA, 22 bp, Homo sapiens
tttcacagatgttttggagtct

SEQ ID NO: 7544361 - DNA, 22 bp, Homo sapiens
tttcacagatcctacagcttgt

SEQ ID NO: 7544362 - DNA, 22 bp, Homo sapiens
tttcacagatcctacagcttgt

SEQ ID NO: 7544363 - DNA, 22 bp, Homo sapiens
tttcacactgcagcatcagaga

SEQ ID NO: 7544364 - DNA, 22 bp, Homo sapiens
tttcacagaaagaagctagttt

SEQ ID NO: 7544365 - DNA, 22 bp, Homo sapiens
tttcacagaaagaagctagttt

SEQ ID NO: 7544366 - DNA, 22 bp, Homo sapiens
tttcacagaaaggataacatta

SEQ ID NO: 7544367 - DNA, 22 bp, Homo sapiens
tttcacagaaagacaacagata

SEQ ID NO: 7544368 - DNA, 22 bp, Homo sapiens
tttcacagaaagaagctagttt

SEQ ID NO: 7544369 - DNA, 22 bp, Homo sapiens
tttcacagaaagacaacagata

SEQ ID NO: 7544370 - DNA, 22 bp, Homo sapiens
tttcacagaaagacaacagata

SEQ ID NO: 7544371 - DNA, 22 bp, Homo sapiens
tttcacagaaagacaacagata

SEQ ID NO: 7544372 - DNA, 22 bp, Homo sapiens
tttcacagaaaggataacatta

SEQ ID NO: 7544373 - DNA, 22 bp, Homo sapiens
tttcacagaaaggataacatta

SEQ ID NO: 7544374 - DNA, 23 bp, Homo sapiens
tttcacagaaggattgtagggcc

SEQ ID NO: 7544375 - DNA, 23 bp, Homo sapiens
tttcacagaaggattgtagggcc

SEQ ID NO: 7544376 - DNA, 22 bp, Homo sapiens
tttcacagaactcactaaggag

SEQ ID NO: 7544377 - DNA, 22 bp, Homo sapiens
tttcacagaactcactaaggag

SEQ ID NO: 7544378 - DNA, 22 bp, Homo sapiens
tttcacagaactcactaaggag

SEQ ID NO: 7544379 - DNA, 22 bp, Homo sapiens
tttcacagaactcactaaggag

SEQ ID NO: 7544380 - DNA, 22 bp, Homo sapiens
tttattgcatacacaaatgtca

SEQ ID NO: 7544381 - DNA, 19 bp, Homo sapiens
tttcaaagggcataagcct

SEQ ID NO: 7544382 - DNA, 19 bp, Homo sapiens
tttcaaagggcataagcct

SEQ ID NO: 7544383 - DNA, 22 bp, Homo sapiens
tttcaaaggtggaagagtgaat

SEQ ID NO: 7544384 - DNA, 22 bp, Homo sapiens
tttattgcatacacaaatgtca

SEQ ID NO: 7544385 - DNA, 22 bp, Homo sapiens
tttattgcatacacaaatgtca

SEQ ID NO: 7544386 - DNA, 22 bp, Homo sapiens
tttattgcactgtctcaatacc

SEQ ID NO: 7544387 - DNA, 22 bp, Homo sapiens
tttattgcatacacaaatgtca

SEQ ID NO: 7544388 - DNA, 22 bp, Homo sapiens
tttattgagtatctactatgtg

SEQ ID NO: 7544389 - DNA, 22 bp, Homo sapiens
tttattgcactgtctcaatacc

SEQ ID NO: 7544390 - DNA, 22 bp, Homo sapiens
tttattgcactgtctcaatacc

SEQ ID NO: 7544391 - DNA, 22 bp, Homo sapiens
tttattgagtatctactatgtg

SEQ ID NO: 7544392 - DNA, 22 bp, Homo sapiens
tttattgagtatctactatgtg

SEQ ID NO: 7544393 - DNA, 22 bp, Homo sapiens
tttattgagtatctactatgtg

SEQ ID NO: 7544394 - DNA, 20 bp, Homo sapiens
tttattgagcacgtactgtg

SEQ ID NO: 7544395 - DNA, 20 bp, Homo sapiens
tttattgagcacgtactgtg

SEQ ID NO: 7544396 - DNA, 22 bp, Homo sapiens
tttattgagcacccgttgtgcg

SEQ ID NO: 7544397 - DNA, 20 bp, Homo sapiens
tttattgagcacgtactgtg

SEQ ID NO: 7544398 - DNA, 20 bp, Homo sapiens
tttattgagcacgtactgtg

SEQ ID NO: 7544399 - DNA, 22 bp, Homo sapiens
tttattgacccaaagcgagagt

SEQ ID NO: 7544400 - DNA, 22 bp, Homo sapiens
tttattgacccaaagcgagagt

SEQ ID NO: 7544401 - DNA, 22 bp, Homo sapiens
tttattgaattgtaaccctatt

SEQ ID NO: 7544402 - DNA, 22 bp, Homo sapiens
tttattgacccaaagcgagagt

SEQ ID NO: 7544403 - DNA, 22 bp, Homo sapiens
tttattgagcacccgttgtgcg

SEQ ID NO: 7544404 - DNA, 22 bp, Homo sapiens
tttattgagcacccgttgtgcg

SEQ ID NO: 7544405 - DNA, 22 bp, Homo sapiens
tttattgacttcagtgagtctt

SEQ ID NO: 7544406 - DNA, 22 bp, Homo sapiens
tttattgacttcagtgagtctt

SEQ ID NO: 7544407 - DNA, 22 bp, Homo sapiens
tttattgacttcagtgagtctt

SEQ ID NO: 7544408 - DNA, 22 bp, Homo sapiens
tttattgacttcagtgagtctt

SEQ ID NO: 7544409 - DNA, 22 bp, Homo sapiens
tttattgacccaaagcgagagt

SEQ ID NO: 7544410 - DNA, 22 bp, Homo sapiens
tttattgacttcagtgagtctt

SEQ ID NO: 7544411 - DNA, 22 bp, Homo sapiens
tttattgacttcagtgagtctt

SEQ ID NO: 7544412 - DNA, 22 bp, Homo sapiens
tttcaacagctctcaaatgatc

SEQ ID NO: 7544413 - DNA, 22 bp, Homo sapiens
tttcaacagctctcaaatgatc

SEQ ID NO: 7544414 - DNA, 22 bp, Homo sapiens
tttcaacagctctcaaatgatc

SEQ ID NO: 7544415 - DNA, 22 bp, Homo sapiens
tttcaacagaatatgatcagag

SEQ ID NO: 7544416 - DNA, 22 bp, Homo sapiens
tttcaacagaatatgatcagag

SEQ ID NO: 7544417 - DNA, 22 bp, Homo sapiens
tttcaacagatctgtcttcagg

SEQ ID NO: 7544418 - DNA, 22 bp, Homo sapiens
tttcaacaccagagaccatgcg

SEQ ID NO: 7544419 - DNA, 22 bp, Homo sapiens
tttcaacaccagagaccatgcg

SEQ ID NO: 7544420 - DNA, 22 bp, Homo sapiens
tttcaacagaatatgatcagag

SEQ ID NO: 7544421 - DNA, 22 bp, Homo sapiens
tttcaacaccagagaccatgcg

SEQ ID NO: 7544422 - DNA, 22 bp, Homo sapiens
tttcaaaggttttgtcatgtct

SEQ ID NO: 7544423 - DNA, 22 bp, Homo sapiens
tttcaaagtaaggattttcatc

SEQ ID NO: 7544424 - DNA, 22 bp, Homo sapiens
tttcaaagtaaggattttcatc

SEQ ID NO: 7544425 - DNA, 22 bp, Homo sapiens
tttcaaagtaaggattttcatc

SEQ ID NO: 7544426 - DNA, 22 bp, Homo sapiens
tttcaaaggttttgtcatgtct

SEQ ID NO: 7544427 - DNA, 22 bp, Homo sapiens
tttcaaaggttttgtcatgtct

SEQ ID NO: 7544428 - DNA, 22 bp, Homo sapiens
tttcaaaggttttgtcatgtct

SEQ ID NO: 7544429 - DNA, 22 bp, Homo sapiens
tttcaaaggtggaagagtgaat

SEQ ID NO: 7544430 - DNA, 23 bp, Homo sapiens
tttcaacaatgcttagagaaaac

SEQ ID NO: 7544431 - DNA, 23 bp, Homo sapiens
tttcaacaatgcttagagaaaac

SEQ ID NO: 7544432 - DNA, 23 bp, Homo sapiens
tttcaacaatgcttagagaaaac

SEQ ID NO: 7544433 - DNA, 23 bp, Homo sapiens
tttcaacaatgcttagagaaaac

SEQ ID NO: 7544434 - DNA, 23 bp, Homo sapiens
tttcaacaatgcttagagaaaac

SEQ ID NO: 7544435 - DNA, 22 bp, Homo sapiens
tttattctgtgctacatgaaga

SEQ ID NO: 7544436 - DNA, 22 bp, Homo sapiens
tttattctgtgctacatgaaga

SEQ ID NO: 7544437 - DNA, 22 bp, Homo sapiens
tttattctctagttggtcagat

SEQ ID NO: 7544438 - DNA, 22 bp, Homo sapiens
tttattctctagttggtcagat

SEQ ID NO: 7544439 - DNA, 23 bp, Homo sapiens
tttattctcagatacataggtct

SEQ ID NO: 7544440 - DNA, 23 bp, Homo sapiens
tttattctcagatacataggtct

SEQ ID NO: 7544441 - DNA, 21 bp, Homo sapiens
tttattctcagatacagggag

SEQ ID NO: 7544442 - DNA, 23 bp, Homo sapiens
tttattctcagatacataggtct

SEQ ID NO: 7544443 - DNA, 22 bp, Homo sapiens
tttattctgtgctacatgaaga

SEQ ID NO: 7544444 - DNA, 22 bp, Homo sapiens
tttattctgtgctacatgaaga

SEQ ID NO: 7544445 - DNA, 22 bp, Homo sapiens
tttattctgtgctacatgaaga

SEQ ID NO: 7544446 - DNA, 22 bp, Homo sapiens
tttattctgtgctacatgaaga

SEQ ID NO: 7544447 - DNA, 22 bp, Homo sapiens
tttattctgtgctacatgaaga

SEQ ID NO: 7544448 - DNA, 22 bp, Homo sapiens
tttattctgtgctacatgaaga

SEQ ID NO: 7544449 - DNA, 22 bp, Homo sapiens
tttattctgtgctacatgaaga

SEQ ID NO: 7544450 - DNA, 22 bp, Homo sapiens
tttattgaacacttgcactggc

SEQ ID NO: 7544451 - DNA, 22 bp, Homo sapiens
tttattgaacacttgcactggc

SEQ ID NO: 7544452 - DNA, 22 bp, Homo sapiens
tttattgaacacttgcactggc

SEQ ID NO: 7544453 - DNA, 22 bp, Homo sapiens
tttattgaacacttgcactggc

SEQ ID NO: 7544454 - DNA, 22 bp, Homo sapiens
tttattgaacacttgcactggc

SEQ ID NO: 7544455 - DNA, 22 bp, Homo sapiens
tttattgaacacttgcactggc

SEQ ID NO: 7544456 - DNA, 22 bp, Homo sapiens
tttattgaacacttgcactggc

SEQ ID NO: 7544457 - DNA, 22 bp, Homo sapiens
tttattgaattgtaaccctatt

SEQ ID NO: 7544458 - DNA, 22 bp, Homo sapiens
tttattgaattgtaaccctatt

SEQ ID NO: 7544459 - DNA, 22 bp, Homo sapiens
tttattcttgagagtgagaaga

SEQ ID NO: 7544460 - DNA, 22 bp, Homo sapiens
tttattcttgagagtgagaaga

SEQ ID NO: 7544461 - DNA, 22 bp, Homo sapiens
tttattcttgagagtgagaaga

SEQ ID NO: 7544462 - DNA, 22 bp, Homo sapiens
tttattcttgagagtgagaaga

SEQ ID NO: 7544463 - DNA, 22 bp, Homo sapiens
tttattcttgagagtgagaaga

SEQ ID NO: 7544464 - DNA, 22 bp, Homo sapiens
tttattcttgagagtgagaaga

SEQ ID NO: 7544465 - DNA, 22 bp, Homo sapiens
tttattctagctcagaatagtt

SEQ ID NO: 7544466 - DNA, 19 bp, Homo sapiens
tttattcacctttaccttg

SEQ ID NO: 7544467 - DNA, 19 bp, Homo sapiens
tttattcacctttaccttg

SEQ ID NO: 7544468 - DNA, 19 bp, Homo sapiens
tttattcacctttaccttg

SEQ ID NO: 7544469 - DNA, 22 bp, Homo sapiens
tttattctagctcagaatagtt

SEQ ID NO: 7544470 - DNA, 22 bp, Homo sapiens
tttattctagctcagaatagtt

SEQ ID NO: 7544471 - DNA, 22 bp, Homo sapiens
tttattctagctcagaatagtt

SEQ ID NO: 7544472 - DNA, 22 bp, Homo sapiens
tttattctagctcagaatagtt

SEQ ID NO: 7544473 - DNA, 22 bp, Homo sapiens
tttattctagctcagaatagtt

SEQ ID NO: 7544474 - DNA, 20 bp, Homo sapiens
tttattcacagagaagagtt

SEQ ID NO: 7544475 - DNA, 20 bp, Homo sapiens
tttattcacagagaagagtt

SEQ ID NO: 7544476 - DNA, 20 bp, Homo sapiens
tttattcacagagaagagtt

SEQ ID NO: 7544477 - DNA, 20 bp, Homo sapiens
tttattcacagagaagagtt

SEQ ID NO: 7544478 - DNA, 20 bp, Homo sapiens
tttattcacagagaagagtt

SEQ ID NO: 7544479 - DNA, 20 bp, Homo sapiens
tttattcacagagaagagtt

SEQ ID NO: 7544480 - DNA, 22 bp, Homo sapiens
tttattctataggcattaagca

SEQ ID NO: 7544481 - DNA, 22 bp, Homo sapiens
tttattctagctcagaatagtt

SEQ ID NO: 7544482 - DNA, 22 bp, Homo sapiens
tttattctataggcattaagca

SEQ ID NO: 7544483 - DNA, 22 bp, Homo sapiens
tttattctagctcagaatagtt

SEQ ID NO: 7544484 - DNA, 22 bp, Homo sapiens
tttattctataggcattaagca

SEQ ID NO: 7544485 - DNA, 22 bp, Homo sapiens
tttattctataggcattaagca

SEQ ID NO: 7544486 - DNA, 22 bp, Homo sapiens
tttattctataggcattaagca

SEQ ID NO: 7544487 - DNA, 22 bp, Homo sapiens
tttattctataggcattaagca

SEQ ID NO: 7544488 - DNA, 22 bp, Homo sapiens
tttattctagctcagaatagtt

SEQ ID NO: 7544489 - DNA, 22 bp, Homo sapiens
tttattctagctcagaatagtt

SEQ ID NO: 7544490 - DNA, 22 bp, Homo sapiens
tttattctagctcagaatagtt

SEQ ID NO: 7544491 - DNA, 21 bp, Homo sapiens
tttattctcagatacagggag

SEQ ID NO: 7544492 - DNA, 21 bp, Homo sapiens
tttattctcagatacagggag

SEQ ID NO: 7544493 - DNA, 22 bp, Homo sapiens
tttattctataggcattaagca

SEQ ID NO: 7544494 - DNA, 22 bp, Homo sapiens
tttattctataggcattaagca

SEQ ID NO: 7544495 - DNA, 22 bp, Homo sapiens
tttattctataggcattaagca

SEQ ID NO: 7544496 - DNA, 22 bp, Homo sapiens
tttcattattcatgctagttat

SEQ ID NO: 7544497 - DNA, 22 bp, Homo sapiens
tttcattcatgtgttaaaggtg

SEQ ID NO: 7544498 - DNA, 22 bp, Homo sapiens
tttcattcatgtgttaaaggtg

SEQ ID NO: 7544499 - DNA, 22 bp, Homo sapiens
tttcattcagcaccctgaggtg

SEQ ID NO: 7544500 - DNA, 22 bp, Homo sapiens
tttcattatgttcctggaagag

SEQ ID NO: 7544501 - DNA, 22 bp, Homo sapiens
tttcattatacagcttcataaa

SEQ ID NO: 7544502 - DNA, 22 bp, Homo sapiens
tttcattattcatgctagttat

SEQ ID NO: 7544503 - DNA, 22 bp, Homo sapiens
tttcattatgttcctggaagag

SEQ ID NO: 7544504 - DNA, 22 bp, Homo sapiens
tttcattatgttcctggaagag

SEQ ID NO: 7544505 - DNA, 22 bp, Homo sapiens
tttcattatgttcctggaagag

SEQ ID NO: 7544506 - DNA, 22 bp, Homo sapiens
tttcattgaactaaagaatctg

SEQ ID NO: 7544507 - DNA, 21 bp, Homo sapiens
tttcattgaatgagataaggt

SEQ ID NO: 7544508 - DNA, 22 bp, Homo sapiens
tttcattgaactaaagaatctg

SEQ ID NO: 7544509 - DNA, 22 bp, Homo sapiens
tttcattgaactaaagaatctg

SEQ ID NO: 7544510 - DNA, 22 bp, Homo sapiens
tttcattcagcaccctgaggtg

SEQ ID NO: 7544511 - DNA, 22 bp, Homo sapiens
tttcattcattatacagtagag

SEQ ID NO: 7544512 - DNA, 22 bp, Homo sapiens
tttcattcattatacagtagag

SEQ ID NO: 7544513 - DNA, 22 bp, Homo sapiens
tttcattcattatacagtagag

SEQ ID NO: 7544514 - DNA, 22 bp, Homo sapiens
tttcattcattatacagtagag

SEQ ID NO: 7544515 - DNA, 22 bp, Homo sapiens
tttcattgagactatagacatc

SEQ ID NO: 7544516 - DNA, 22 bp, Homo sapiens
tttcattgagactatagacatc

SEQ ID NO: 7544517 - DNA, 22 bp, Homo sapiens
tttcattgagaatataagattt

SEQ ID NO: 7544518 - DNA, 18 bp, Homo sapiens
tttcattgagtgtgatat

SEQ ID NO: 7544519 - DNA, 22 bp, Homo sapiens
tttcattgagactatagacatc

SEQ ID NO: 7544520 - DNA, 21 bp, Homo sapiens
tttcattgaatgagataaggt

SEQ ID NO: 7544521 - DNA, 21 bp, Homo sapiens
tttcattgaatgagataaggt

SEQ ID NO: 7544522 - DNA, 21 bp, Homo sapiens
tttcattgaatgagataaggt

SEQ ID NO: 7544523 - DNA, 22 bp, Homo sapiens
tttcattgagaatataagattt

SEQ ID NO: 7544524 - DNA, 22 bp, Homo sapiens
tttcattgagaatataagattt

SEQ ID NO: 7544525 - DNA, 22 bp, Homo sapiens
tttcattgagaatataagattt

SEQ ID NO: 7544526 - DNA, 22 bp, Homo sapiens
tttcattgacagttgggggaaa

SEQ ID NO: 7544527 - DNA, 22 bp, Homo sapiens
tttcattgatgggtgatagaaa

SEQ ID NO: 7544528 - DNA, 22 bp, Homo sapiens
tttcattgatgggtgatagaaa

SEQ ID NO: 7544529 - DNA, 22 bp, Homo sapiens
tttcattgcagagtctgtgtgc

SEQ ID NO: 7544530 - DNA, 21 bp, Homo sapiens
tttcccagcagagatagctgg

SEQ ID NO: 7544531 - DNA, 21 bp, Homo sapiens
tttcccagcagagatagctgg

SEQ ID NO: 7544532 - DNA, 19 bp, Homo sapiens
tttcccagcccttgctgtg

SEQ ID NO: 7544533 - DNA, 19 bp, Homo sapiens
tttcccagcccttgctgtg

SEQ ID NO: 7544534 - DNA, 19 bp, Homo sapiens
tttcccagcccttgctgtg

SEQ ID NO: 7544535 - DNA, 19 bp, Homo sapiens
tttcccagtcccaggagtg

SEQ ID NO: 7544536 - DNA, 22 bp, Homo sapiens
tttcccaggctggaatgcagtg

SEQ ID NO: 7544537 - DNA, 22 bp, Homo sapiens
tttcccaggctggaatgcagtg

SEQ ID NO: 7544538 - DNA, 22 bp, Homo sapiens
tttcccaggccctcagggctgc

SEQ ID NO: 7544539 - DNA, 22 bp, Homo sapiens
tttcccaggccctcagggctgc

SEQ ID NO: 7544540 - DNA, 22 bp, Homo sapiens
tttcccaggccctcagggctgc

SEQ ID NO: 7544541 - DNA, 22 bp, Homo sapiens
tttcccagcctcctttgcagct

SEQ ID NO: 7544542 - DNA, 21 bp, Homo sapiens
tttcccagctgaaaataaatg

SEQ ID NO: 7544543 - DNA, 22 bp, Homo sapiens
tttcccagcctcagctcagcag

SEQ ID NO: 7544544 - DNA, 22 bp, Homo sapiens
tttccccaggtagatagataat

SEQ ID NO: 7544545 - DNA, 22 bp, Homo sapiens
tttccccaggtagatagataat

SEQ ID NO: 7544546 - DNA, 22 bp, Homo sapiens
tttcccattctaattactcatt

SEQ ID NO: 7544547 - DNA, 22 bp, Homo sapiens
tttcccatggcagaagccctgt

SEQ ID NO: 7544548 - DNA, 22 bp, Homo sapiens
tttcccattctaattactcatt

SEQ ID NO: 7544549 - DNA, 22 bp, Homo sapiens
tttcccatcttagcagattaaa

SEQ ID NO: 7544550 - DNA, 22 bp, Homo sapiens
tttcccatcttagcagattaaa

SEQ ID NO: 7544551 - DNA, 22 bp, Homo sapiens
tttcccatggcagaagccctgt

SEQ ID NO: 7544552 - DNA, 22 bp, Homo sapiens
tttcccatccatagccctgcaa

SEQ ID NO: 7544553 - DNA, 22 bp, Homo sapiens
tttcccagttccctgctctata

SEQ ID NO: 7544554 - DNA, 22 bp, Homo sapiens
tttcccatccatagccctgcaa

SEQ ID NO: 7544555 - DNA, 22 bp, Homo sapiens
tttcccatccatagccctgcaa

SEQ ID NO: 7544556 - DNA, 22 bp, Homo sapiens
tttcccagttccctgctctata

SEQ ID NO: 7544557 - DNA, 22 bp, Homo sapiens
tttcccagttccctgctctata

SEQ ID NO: 7544558 - DNA, 22 bp, Homo sapiens
tttcccagttccctgctctata

SEQ ID NO: 7544559 - DNA, 22 bp, Homo sapiens
tttcccagttccctgctctata

SEQ ID NO: 7544560 - DNA, 22 bp, Homo sapiens
tttcccagttagtgaagacatg

SEQ ID NO: 7544561 - DNA, 22 bp, Homo sapiens
tttcccagttagtgaagacatg

SEQ ID NO: 7544562 - DNA, 22 bp, Homo sapiens
tttcatgtgcaattagcaatat

SEQ ID NO: 7544563 - DNA, 22 bp, Homo sapiens
tttcatgtctgaattctttagt

SEQ ID NO: 7544564 - DNA, 22 bp, Homo sapiens
tttcatgtctgaattctttagt

SEQ ID NO: 7544565 - DNA, 22 bp, Homo sapiens
tttcatgtctgaattctttagt

SEQ ID NO: 7544566 - DNA, 22 bp, Homo sapiens
tttcatgtctgaattctttagt

SEQ ID NO: 7544567 - DNA, 22 bp, Homo sapiens
tttcatgtctgaattctttagt

SEQ ID NO: 7544568 - DNA, 22 bp, Homo sapiens
tttcatgtctgaattctttagt

SEQ ID NO: 7544569 - DNA, 22 bp, Homo sapiens
tttcatgtcattccatttcaga

SEQ ID NO: 7544570 - DNA, 22 bp, Homo sapiens
tttcatgtcattccatttcaga

SEQ ID NO: 7544571 - DNA, 22 bp, Homo sapiens
tttcatgtcattccatttcaga

SEQ ID NO: 7544572 - DNA, 22 bp, Homo sapiens
tttcatgtcattccatttcaga

SEQ ID NO: 7544573 - DNA, 22 bp, Homo sapiens
tttcatgtacttttttgataga

SEQ ID NO: 7544574 - DNA, 22 bp, Homo sapiens
tttcatgtatttcccaaagctt

SEQ ID NO: 7544575 - DNA, 22 bp, Homo sapiens
tttcatgtcattccatttcaga

SEQ ID NO: 7544576 - DNA, 22 bp, Homo sapiens
tttcatgtcattccatttcaga

SEQ ID NO: 7544577 - DNA, 22 bp, Homo sapiens
tttcatgtaatcatttaggtgg

SEQ ID NO: 7544578 - DNA, 22 bp, Homo sapiens
tttcatgtaatcatttaggtgg

SEQ ID NO: 7544579 - DNA, 22 bp, Homo sapiens
tttcatgtaatcatttaggtgg

SEQ ID NO: 7544580 - DNA, 22 bp, Homo sapiens
tttcatgtacttttttgataga

SEQ ID NO: 7544581 - DNA, 22 bp, Homo sapiens
tttcatgtacttttttgataga

SEQ ID NO: 7544582 - DNA, 22 bp, Homo sapiens
tttcatgtactgtcgaagttga

SEQ ID NO: 7544583 - DNA, 22 bp, Homo sapiens
tttcatgtacttttttgataga

SEQ ID NO: 7544584 - DNA, 22 bp, Homo sapiens
tttcatgtacttttttgataga

SEQ ID NO: 7544585 - DNA, 22 bp, Homo sapiens
tttcatgtacttttttgataga

SEQ ID NO: 7544586 - DNA, 22 bp, Homo sapiens
tttcatgtacttttttgataga

SEQ ID NO: 7544587 - DNA, 22 bp, Homo sapiens
tttcatgtacttttttgataga

SEQ ID NO: 7544588 - DNA, 22 bp, Homo sapiens
tttcatgtatttcccaaagctt

SEQ ID NO: 7544589 - DNA, 22 bp, Homo sapiens
tttcatgtatttcccaaagctt

SEQ ID NO: 7544590 - DNA, 22 bp, Homo sapiens
tttcatgtgcaattagcaatat

SEQ ID NO: 7544591 - DNA, 22 bp, Homo sapiens
tttcatgtgcatttaggttcat

SEQ ID NO: 7544592 - DNA, 22 bp, Homo sapiens
tttcatgtgcatttaggttcat

SEQ ID NO: 7544593 - DNA, 22 bp, Homo sapiens
tttcatgtgcaattagcaatat

SEQ ID NO: 7544594 - DNA, 22 bp, Homo sapiens
tttcatgtgcaattagcaatat

SEQ ID NO: 7544595 - DNA, 22 bp, Homo sapiens
tttcatgtgcaattagcaatat

SEQ ID NO: 7544596 - DNA, 22 bp, Homo sapiens
tttcatgtggcgatgtctctgg

SEQ ID NO: 7544597 - DNA, 22 bp, Homo sapiens
tttcatgtggcgatgtctctgg

SEQ ID NO: 7544598 - DNA, 22 bp, Homo sapiens
tttcatgtgcatttaggttcat

SEQ ID NO: 7544599 - DNA, 22 bp, Homo sapiens
tttcatgtggcgatgtctctgg

SEQ ID NO: 7544600 - DNA, 22 bp, Homo sapiens
tttcatgtgttgaatgtgtaca

SEQ ID NO: 7544601 - DNA, 22 bp, Homo sapiens
tttcatgtgttgaatgtgtaca

SEQ ID NO: 7544602 - DNA, 22 bp, Homo sapiens
tttcatgtgttgaatgtgtaca

SEQ ID NO: 7544603 - DNA, 22 bp, Homo sapiens
tttcatgtggcgatgtctctgg

SEQ ID NO: 7544604 - DNA, 22 bp, Homo sapiens
tttcatgtgttgaatgtgtaca

SEQ ID NO: 7544605 - DNA, 22 bp, Homo sapiens
tttcatgttacagtgtaaaagt

SEQ ID NO: 7544606 - DNA, 22 bp, Homo sapiens
tttcatgttacagtgtaaaagt

SEQ ID NO: 7544607 - DNA, 22 bp, Homo sapiens
tttcatgttacagtgtaaaagt

SEQ ID NO: 7544608 - DNA, 22 bp, Homo sapiens
tttcatgttacagtgtaaaagt

SEQ ID NO: 7544609 - DNA, 22 bp, Homo sapiens
tttcattatacagcttcataaa

SEQ ID NO: 7544610 - DNA, 22 bp, Homo sapiens
tttcatgatccatttacaaaat

SEQ ID NO: 7544611 - DNA, 22 bp, Homo sapiens
tttcatgagtggaagaagtgta

SEQ ID NO: 7544612 - DNA, 22 bp, Homo sapiens
tttcatgagtggaagaagtgta

SEQ ID NO: 7544613 - DNA, 22 bp, Homo sapiens
tttcatgatccatttacaaaat

SEQ ID NO: 7544614 - DNA, 22 bp, Homo sapiens
tttcatgatccatttacaaaat

SEQ ID NO: 7544615 - DNA, 22 bp, Homo sapiens
tttcatgattaacttagtgaat

SEQ ID NO: 7544616 - DNA, 22 bp, Homo sapiens
tttcatgattaacttagtgaat

SEQ ID NO: 7544617 - DNA, 22 bp, Homo sapiens
tttcatgcacaaatgagcaagg

SEQ ID NO: 7544618 - DNA, 22 bp, Homo sapiens
tttcatgtaatcatttaggtgg

SEQ ID NO: 7544619 - DNA, 22 bp, Homo sapiens
tttcatggctaggactagagtg

SEQ ID NO: 7544620 - DNA, 22 bp, Homo sapiens
tttcatgattaacttagtgaat

SEQ ID NO: 7544621 - DNA, 22 bp, Homo sapiens
tttcatgctcatggaacacagc

SEQ ID NO: 7544622 - DNA, 22 bp, Homo sapiens
tttcatgcctggaattgccctt

SEQ ID NO: 7544623 - DNA, 22 bp, Homo sapiens
tttcatgcctggaattgccctt

SEQ ID NO: 7544624 - DNA, 22 bp, Homo sapiens
tttcatgcctcttgagaaagat

SEQ ID NO: 7544625 - DNA, 22 bp, Homo sapiens
tttcatgcctgtggtgcagtgt

SEQ ID NO: 7544626 - DNA, 22 bp, Homo sapiens
tttcatgctacctggcagtgac

SEQ ID NO: 7544627 - DNA, 22 bp, Homo sapiens
tttcatgctcatggaacacagc

SEQ ID NO: 7544628 - DNA, 22 bp, Homo sapiens
tttcatgagattcctccacatc

SEQ ID NO: 7544629 - DNA, 22 bp, Homo sapiens
tttcatgagattcctccacatc

SEQ ID NO: 7544630 - DNA, 22 bp, Homo sapiens
tttcatcttgattctatatggc

SEQ ID NO: 7544631 - DNA, 22 bp, Homo sapiens
tttcatgaggctgcataaggag

SEQ ID NO: 7544632 - DNA, 22 bp, Homo sapiens
tttcatgaggggcaaaatctca

SEQ ID NO: 7544633 - DNA, 22 bp, Homo sapiens
tttcatgaggtctttcagcaag

SEQ ID NO: 7544634 - DNA, 22 bp, Homo sapiens
tttcatgaggggcaaaatctca

SEQ ID NO: 7544635 - DNA, 22 bp, Homo sapiens
tttcagagctgagatgccacag

SEQ ID NO: 7544636 - DNA, 22 bp, Homo sapiens
tttcagagctcagcagctagag

SEQ ID NO: 7544637 - DNA, 22 bp, Homo sapiens
tttcagagctcagcagctagag

SEQ ID NO: 7544638 - DNA, 22 bp, Homo sapiens
tttcagagctcagcagctagag

SEQ ID NO: 7544639 - DNA, 22 bp, Homo sapiens
tttcagagctctaggctctcag

SEQ ID NO: 7544640 - DNA, 22 bp, Homo sapiens
tttcagagctctaggctctcag

SEQ ID NO: 7544641 - DNA, 19 bp, Homo sapiens
tttcagacatttcaaattt

SEQ ID NO: 7544642 - DNA, 22 bp, Homo sapiens
tttcagactcatctcaagcttt

SEQ ID NO: 7544643 - DNA, 19 bp, Homo sapiens
tttcagacatttcaaattt

SEQ ID NO: 7544644 - DNA, 21 bp, Homo sapiens
tttcagacctatctttgaagg

SEQ ID NO: 7544645 - DNA, 21 bp, Homo sapiens
tttcagacctatctttgaagg

SEQ ID NO: 7544646 - DNA, 22 bp, Homo sapiens
tttcagactgctgtgtgaaact

SEQ ID NO: 7544647 - DNA, 22 bp, Homo sapiens
tttcagagaaagcccaaagact

SEQ ID NO: 7544648 - DNA, 22 bp, Homo sapiens
tttcagagaactgagtccttgc

SEQ ID NO: 7544649 - DNA, 22 bp, Homo sapiens
tttcagagaactgagtccttgc

SEQ ID NO: 7544650 - DNA, 22 bp, Homo sapiens
tttcagactccaaattcataag

SEQ ID NO: 7544651 - DNA, 22 bp, Homo sapiens
tttcagactccaaattcataag

SEQ ID NO: 7544652 - DNA, 22 bp, Homo sapiens
tttcagactccaaattcataag

SEQ ID NO: 7544653 - DNA, 22 bp, Homo sapiens
tttcagactgctgtgtgaaact

SEQ ID NO: 7544654 - DNA, 22 bp, Homo sapiens
tttcagagaattagaagctgat

SEQ ID NO: 7544655 - DNA, 22 bp, Homo sapiens
tttcagagaattagaagctgat

SEQ ID NO: 7544656 - DNA, 22 bp, Homo sapiens
tttcagagaattagaagctgat

SEQ ID NO: 7544657 - DNA, 22 bp, Homo sapiens
tttcagagaattagaagctgat

SEQ ID NO: 7544658 - DNA, 22 bp, Homo sapiens
tttcagagaggcttcaaatctt

SEQ ID NO: 7544659 - DNA, 22 bp, Homo sapiens
tttcagagagatcaacatagct

SEQ ID NO: 7544660 - DNA, 22 bp, Homo sapiens
tttcagagagatcaacatagct

SEQ ID NO: 7544661 - DNA, 22 bp, Homo sapiens
tttcagagaggcttcaaatctt

SEQ ID NO: 7544662 - DNA, 22 bp, Homo sapiens
tttcagagaggcttcaaatctt

SEQ ID NO: 7544663 - DNA, 22 bp, Homo sapiens
tttcagagatgcagaattcagg

SEQ ID NO: 7544664 - DNA, 22 bp, Homo sapiens
tttcagagatgtctagcctatt

SEQ ID NO: 7544665 - DNA, 22 bp, Homo sapiens
tttcagagatgcagaattcagg

SEQ ID NO: 7544666 - DNA, 22 bp, Homo sapiens
tttcagagatgcagaattcagg

SEQ ID NO: 7544667 - DNA, 22 bp, Homo sapiens
tttcagagatgtctagcctatt

SEQ ID NO: 7544668 - DNA, 22 bp, Homo sapiens
tttcagagatgtctagcctatt

SEQ ID NO: 7544669 - DNA, 22 bp, Homo sapiens
tttcagagcctgcaatcccaat

SEQ ID NO: 7544670 - DNA, 22 bp, Homo sapiens
tttcagagcctttatctctcta

SEQ ID NO: 7544671 - DNA, 22 bp, Homo sapiens
tttcagagcctttatctctcta

SEQ ID NO: 7544672 - DNA, 22 bp, Homo sapiens
tttcagaaaacttatcatcagt

SEQ ID NO: 7544673 - DNA, 22 bp, Homo sapiens
tttcagaaaacttatcatcagt

SEQ ID NO: 7544674 - DNA, 22 bp, Homo sapiens
tttcagaaaacttatcatcagt

SEQ ID NO: 7544675 - DNA, 22 bp, Homo sapiens
tttcagaaaacttatcatcagt

SEQ ID NO: 7544676 - DNA, 22 bp, Homo sapiens
tttcagaaaacttatcatcagt

SEQ ID NO: 7544677 - DNA, 22 bp, Homo sapiens
tttcagaaaacttatcatcagt

SEQ ID NO: 7544678 - DNA, 22 bp, Homo sapiens
tttcagaaaacttatcatcagt

SEQ ID NO: 7544679 - DNA, 22 bp, Homo sapiens
tttcagaaacgattatgaacac

SEQ ID NO: 7544680 - DNA, 22 bp, Homo sapiens
tttcagaaacgattatgaacac

SEQ ID NO: 7544681 - DNA, 22 bp, Homo sapiens
tttcagaaacgattatgaacac

SEQ ID NO: 7544682 - DNA, 22 bp, Homo sapiens
tttcagaaacgattatgaacac

SEQ ID NO: 7544683 - DNA, 22 bp, Homo sapiens
tttcagaaacgattatgaacac

SEQ ID NO: 7544684 - DNA, 22 bp, Homo sapiens
tttcagaaagctgaacatatga

SEQ ID NO: 7544685 - DNA, 22 bp, Homo sapiens
tttcagaaagctgaacatatga

SEQ ID NO: 7544686 - DNA, 22 bp, Homo sapiens
tttcagaaagctgaacatatga

SEQ ID NO: 7544687 - DNA, 22 bp, Homo sapiens
tttcagaaagcatcatcaaagt

SEQ ID NO: 7544688 - DNA, 22 bp, Homo sapiens
tttcagaaagcatcatcaaagt

SEQ ID NO: 7544689 - DNA, 22 bp, Homo sapiens
tttcagaaagcatcatcaaagt

SEQ ID NO: 7544690 - DNA, 22 bp, Homo sapiens
tttcagaaagcatcatcaaagt

SEQ ID NO: 7544691 - DNA, 22 bp, Homo sapiens
tttcagaaagcatcatcaaagt

SEQ ID NO: 7544692 - DNA, 22 bp, Homo sapiens
tttcagaaagcatcatcaaagt

SEQ ID NO: 7544693 - DNA, 22 bp, Homo sapiens
tttcagaaagcatcatcaaagt

SEQ ID NO: 7544694 - DNA, 22 bp, Homo sapiens
tttcagaaagcatcatcaaagt

SEQ ID NO: 7544695 - DNA, 22 bp, Homo sapiens
tttcagaaagcatcatcaaagt

SEQ ID NO: 7544696 - DNA, 22 bp, Homo sapiens
tttcagaatatcgattcagtga

SEQ ID NO: 7544697 - DNA, 22 bp, Homo sapiens
tttcagaaatggcactgaaatc

SEQ ID NO: 7544698 - DNA, 22 bp, Homo sapiens
tttcagaaatggcactgaaatc

SEQ ID NO: 7544699 - DNA, 22 bp, Homo sapiens
tttcagaaatggcactgaaatc

SEQ ID NO: 7544700 - DNA, 22 bp, Homo sapiens
tttcagaaatggcactgaaatc

SEQ ID NO: 7544701 - DNA, 22 bp, Homo sapiens
tttcagaaatggcactgaaatc

SEQ ID NO: 7544702 - DNA, 22 bp, Homo sapiens
tttcagaaatggcactgaaatc

SEQ ID NO: 7544703 - DNA, 22 bp, Homo sapiens
tttcagaaatggcactgaaatc

SEQ ID NO: 7544704 - DNA, 22 bp, Homo sapiens
tttcagaaatggcactgaaatc

SEQ ID NO: 7544705 - DNA, 22 bp, Homo sapiens
tttcagaaatggcactgaaatc

SEQ ID NO: 7544706 - DNA, 22 bp, Homo sapiens
tttcagaaatggcactgaaatc

SEQ ID NO: 7544707 - DNA, 22 bp, Homo sapiens
tttcagaaagctgaacatatga

SEQ ID NO: 7544708 - DNA, 22 bp, Homo sapiens
tttcagaaagctgaacatatga

SEQ ID NO: 7544709 - DNA, 22 bp, Homo sapiens
tttcagaaagctgaacatatga

SEQ ID NO: 7544710 - DNA, 22 bp, Homo sapiens
tttcagaaatcaaaaccagggt

SEQ ID NO: 7544711 - DNA, 22 bp, Homo sapiens
tttcagaaatcaaaaccagggt

SEQ ID NO: 7544712 - DNA, 22 bp, Homo sapiens
tttcagaaatcaaaaccagggt

SEQ ID NO: 7544713 - DNA, 22 bp, Homo sapiens
tttcagaaagctgaacatatga

SEQ ID NO: 7544714 - DNA, 22 bp, Homo sapiens
tttcagaaatcaaaaccagggt

SEQ ID NO: 7544715 - DNA, 22 bp, Homo sapiens
tttcagaaatcaaaaccagggt

SEQ ID NO: 7544716 - DNA, 22 bp, Homo sapiens
tttcactgttaggagtatgcta

SEQ ID NO: 7544717 - DNA, 22 bp, Homo sapiens
tttcactgttaggagtatgcta

SEQ ID NO: 7544718 - DNA, 22 bp, Homo sapiens
tttcactgttaggagtatgcta

SEQ ID NO: 7544719 - DNA, 22 bp, Homo sapiens
tttcactgggcttgcagaaatc

SEQ ID NO: 7544720 - DNA, 22 bp, Homo sapiens
tttcactgggcttgcagaaatc

SEQ ID NO: 7544721 - DNA, 22 bp, Homo sapiens
tttcactgggcttgcagaaatc

SEQ ID NO: 7544722 - DNA, 22 bp, Homo sapiens
tttcactgggcttgcagaaatc

SEQ ID NO: 7544723 - DNA, 20 bp, Homo sapiens
tttcactgtggtgctggaga

SEQ ID NO: 7544724 - DNA, 20 bp, Homo sapiens
tttcactgtggtgctggaga

SEQ ID NO: 7544725 - DNA, 22 bp, Homo sapiens
tttcactgtgttggtcaggccg

SEQ ID NO: 7544726 - DNA, 22 bp, Homo sapiens
tttcactggaattttaacattt

SEQ ID NO: 7544727 - DNA, 22 bp, Homo sapiens
tttcactagaacgttcttgttt

SEQ ID NO: 7544728 - DNA, 22 bp, Homo sapiens
tttcacctcagtctttttatat

SEQ ID NO: 7544729 - DNA, 22 bp, Homo sapiens
tttcacctcagtctttttatat

SEQ ID NO: 7544730 - DNA, 22 bp, Homo sapiens
tttcacctcagtctttttatat

SEQ ID NO: 7544731 - DNA, 22 bp, Homo sapiens
tttcacctcagtctttttatat

SEQ ID NO: 7544732 - DNA, 20 bp, Homo sapiens
tttcactggcttgataaggt

SEQ ID NO: 7544733 - DNA, 20 bp, Homo sapiens
tttcactggcttgataaggt

SEQ ID NO: 7544734 - DNA, 20 bp, Homo sapiens
tttcactggcttgataaggt

SEQ ID NO: 7544735 - DNA, 22 bp, Homo sapiens
tttcactggaattttaacattt

SEQ ID NO: 7544736 - DNA, 22 bp, Homo sapiens
tttcactggaattttaacattt

SEQ ID NO: 7544737 - DNA, 22 bp, Homo sapiens
tttcacattttatacttaagcc

SEQ ID NO: 7544738 - DNA, 22 bp, Homo sapiens
tttcaccaaggtaacctttgat

SEQ ID NO: 7544739 - DNA, 22 bp, Homo sapiens
tttcacattttatacttaagcc

SEQ ID NO: 7544740 - DNA, 22 bp, Homo sapiens
tttcaccacagaggcaagacaa

SEQ ID NO: 7544741 - DNA, 22 bp, Homo sapiens
tttcaccacagaggcaagacaa

SEQ ID NO: 7544742 - DNA, 22 bp, Homo sapiens
tttcacatttgttttaagaagt

SEQ ID NO: 7544743 - DNA, 22 bp, Homo sapiens
tttcacattttatacttaagcc

SEQ ID NO: 7544744 - DNA, 23 bp, Homo sapiens
tttcacagcttttattctgcatc

SEQ ID NO: 7544745 - DNA, 23 bp, Homo sapiens
tttcacagcttttattctgcatc

SEQ ID NO: 7544746 - DNA, 23 bp, Homo sapiens
tttcacagcttttattctgcatc

SEQ ID NO: 7544747 - DNA, 23 bp, Homo sapiens
tttcacagcttttattctgcatc

SEQ ID NO: 7544748 - DNA, 22 bp, Homo sapiens
tttcacagcttccacttaagga

SEQ ID NO: 7544749 - DNA, 22 bp, Homo sapiens
tttcacagcttccacttaagga

SEQ ID NO: 7544750 - DNA, 22 bp, Homo sapiens
tttcacagcttccacttaagga

SEQ ID NO: 7544751 - DNA, 22 bp, Homo sapiens
tttcacagctgtcttccgtctc

SEQ ID NO: 7544752 - DNA, 22 bp, Homo sapiens
tttcacagctgtcttccgtctc

SEQ ID NO: 7544753 - DNA, 22 bp, Homo sapiens
tttcacagctgtcttccgtctc

SEQ ID NO: 7544754 - DNA, 22 bp, Homo sapiens
tttcacagctgggtggcagagt

SEQ ID NO: 7544755 - DNA, 22 bp, Homo sapiens
tttcacagctgggtggcagagt

SEQ ID NO: 7544756 - DNA, 22 bp, Homo sapiens
tttcacagctgggtggcagagt

SEQ ID NO: 7544757 - DNA, 22 bp, Homo sapiens
tttcacagctgggtggcagagt

SEQ ID NO: 7544758 - DNA, 22 bp, Homo sapiens
tttcacagctgggaagagatat

SEQ ID NO: 7544759 - DNA, 22 bp, Homo sapiens
tttcacagctgggtggcagagt

SEQ ID NO: 7544760 - DNA, 22 bp, Homo sapiens
tttcacagctgggtggcagagt

SEQ ID NO: 7544761 - DNA, 22 bp, Homo sapiens
tttcacagctgggtggcagagt

SEQ ID NO: 7544762 - DNA, 22 bp, Homo sapiens
tttcacagctagtgagcttcta

SEQ ID NO: 7544763 - DNA, 22 bp, Homo sapiens
tttcacagcgtctttctcttgc

SEQ ID NO: 7544764 - DNA, 22 bp, Homo sapiens
tttcacagctagtgagcttcta

SEQ ID NO: 7544765 - DNA, 22 bp, Homo sapiens
tttcacagctagtgagcttcta

SEQ ID NO: 7544766 - DNA, 22 bp, Homo sapiens
tttcacagctgatacctcttcc

SEQ ID NO: 7544767 - DNA, 22 bp, Homo sapiens
tttcacagctgggaagagatat

SEQ ID NO: 7544768 - DNA, 22 bp, Homo sapiens
tttcacagctgggaagagatat

SEQ ID NO: 7544769 - DNA, 18 bp, Homo sapiens
tttcacagattcatgact

SEQ ID NO: 7544770 - DNA, 18 bp, Homo sapiens
tttcacagattcatgact

SEQ ID NO: 7544771 - DNA, 22 bp, Homo sapiens
tttcacagatgttttggagtct

SEQ ID NO: 7544772 - DNA, 22 bp, Homo sapiens
tttcacagcagaatttctgagg

SEQ ID NO: 7544773 - DNA, 22 bp, Homo sapiens
tttcacagcagaatttctgagg

SEQ ID NO: 7544774 - DNA, 22 bp, Homo sapiens
tttcacagcagaatttctgagg

SEQ ID NO: 7544775 - DNA, 22 bp, Homo sapiens
tttcacagcagaatttctgagg

SEQ ID NO: 7544776 - DNA, 22 bp, Homo sapiens
tttcacagcaacactgtctgca

SEQ ID NO: 7544777 - DNA, 18 bp, Homo sapiens
tttcacagattcatgact

SEQ ID NO: 7544778 - DNA, 22 bp, Homo sapiens
tttcacagcaacactgtctgca

SEQ ID NO: 7544779 - DNA, 22 bp, Homo sapiens
tttcacagcatataggtgtact

SEQ ID NO: 7544780 - DNA, 22 bp, Homo sapiens
tttcacagcatataggtgtact

SEQ ID NO: 7544781 - DNA, 22 bp, Homo sapiens
tttcacagcagtgtgctgcttt

SEQ ID NO: 7544782 - DNA, 22 bp, Homo sapiens
tttcacagcagtgtgctgcttt

SEQ ID NO: 7544783 - DNA, 22 bp, Homo sapiens
tttcacagcagtgtgctgcttt

SEQ ID NO: 7544784 - DNA, 22 bp, Homo sapiens
tttcacagcagaatttctgagg

SEQ ID NO: 7544785 - DNA, 22 bp, Homo sapiens
tttcacagcgtctttctcttgc

SEQ ID NO: 7544786 - DNA, 22 bp, Homo sapiens
tttcacagcgtctttctcttgc

SEQ ID NO: 7544787 - DNA, 22 bp, Homo sapiens
tttcacagcatataggtgtact

SEQ ID NO: 7544788 - DNA, 22 bp, Homo sapiens
tttcacagcatataggtgtact

SEQ ID NO: 7544789 - DNA, 23 bp, Homo sapiens
ttggaaatggggagaacagattc

SEQ ID NO: 7544790 - DNA, 23 bp, Homo sapiens
ttggaaatggggagaacagattc

SEQ ID NO: 7544791 - DNA, 23 bp, Homo sapiens
ttggaaatggggagaacagattc

SEQ ID NO: 7544792 - DNA, 22 bp, Homo sapiens
ttggaaatgcatttgttattat

SEQ ID NO: 7544793 - DNA, 22 bp, Homo sapiens
ttggaaatggctgtagttatga

SEQ ID NO: 7544794 - DNA, 22 bp, Homo sapiens
ttggaaatggctgtagttatga

SEQ ID NO: 7544795 - DNA, 22 bp, Homo sapiens
ttggaaatggctgtagttatga

SEQ ID NO: 7544796 - DNA, 22 bp, Homo sapiens
ttggaaattgcaagtgatttgc

SEQ ID NO: 7544797 - DNA, 22 bp, Homo sapiens
ttggaaattgcaagtgatttgc

SEQ ID NO: 7544798 - DNA, 22 bp, Homo sapiens
ttggaaattgcaagtgatttgc

SEQ ID NO: 7544799 - DNA, 22 bp, Homo sapiens
ttggaaatgtagaaaagcagat

SEQ ID NO: 7544800 - DNA, 22 bp, Homo sapiens
ttggaacaatcacatccttgct

SEQ ID NO: 7544801 - DNA, 22 bp, Homo sapiens
ttggaacaatcacatccttgct

SEQ ID NO: 7544802 - DNA, 22 bp, Homo sapiens
ttggaacaatcacatccttgct

SEQ ID NO: 7544803 - DNA, 21 bp, Homo sapiens
ttggaacaagcagcagtttgc

SEQ ID NO: 7544804 - DNA, 22 bp, Homo sapiens
ttggaaatgatttctattatta

SEQ ID NO: 7544805 - DNA, 22 bp, Homo sapiens
ttggaaatacgagtagtatcat

SEQ ID NO: 7544806 - DNA, 22 bp, Homo sapiens
ttggaaatgatttctattatta

SEQ ID NO: 7544807 - DNA, 22 bp, Homo sapiens
ttggaaatgatttctattatta

SEQ ID NO: 7544808 - DNA, 22 bp, Homo sapiens
ttggaaatgcaaatatattgaa

SEQ ID NO: 7544809 - DNA, 22 bp, Homo sapiens
ttggaaatgcaaatatattgaa

SEQ ID NO: 7544810 - DNA, 22 bp, Homo sapiens
ttggaaatgcaaatatattgaa

SEQ ID NO: 7544811 - DNA, 22 bp, Homo sapiens
ttggaaatgcaaatatattgaa

SEQ ID NO: 7544812 - DNA, 22 bp, Homo sapiens
ttggaaatacagcagttacttt

SEQ ID NO: 7544813 - DNA, 22 bp, Homo sapiens
ttggaaatacagcagttacttt

SEQ ID NO: 7544814 - DNA, 22 bp, Homo sapiens
ttggaaagtttttactgaagac

SEQ ID NO: 7544815 - DNA, 22 bp, Homo sapiens
ttggaaagtttttactgaagac

SEQ ID NO: 7544816 - DNA, 22 bp, Homo sapiens
ttggaaatacgagtagtatcat

SEQ ID NO: 7544817 - DNA, 22 bp, Homo sapiens
ttggaaatacgagtagtatcat

SEQ ID NO: 7544818 - DNA, 22 bp, Homo sapiens
ttggaaatacagcagttacttt

SEQ ID NO: 7544819 - DNA, 22 bp, Homo sapiens
ttggaaatacagcagttacttt

SEQ ID NO: 7544820 - DNA, 22 bp, Homo sapiens
ttggacactgagactagcaagc

SEQ ID NO: 7544821 - DNA, 21 bp, Homo sapiens
ttggacactccctgtgctgtg

SEQ ID NO: 7544822 - DNA, 22 bp, Homo sapiens
ttggacagaatttatcttcagt

SEQ ID NO: 7544823 - DNA, 22 bp, Homo sapiens
ttggacagaatttatcttcagt

SEQ ID NO: 7544824 - DNA, 22 bp, Homo sapiens
ttggacagaattttgtgtgtgt

SEQ ID NO: 7544825 - DNA, 22 bp, Homo sapiens
ttggacagaattttgtgtgtgt

SEQ ID NO: 7544826 - DNA, 22 bp, Homo sapiens
ttggacagcacagacatagaat

SEQ ID NO: 7544827 - DNA, 20 bp, Homo sapiens
ttggacagacgcattgacac

SEQ ID NO: 7544828 - DNA, 22 bp, Homo sapiens
ttggacagtaaattgtgcttaa

SEQ ID NO: 7544829 - DNA, 22 bp, Homo sapiens
ttggacagtaaattgtgcttaa

SEQ ID NO: 7544830 - DNA, 21 bp, Homo sapiens
ttggaatttgggagctatgtg

SEQ ID NO: 7544831 - DNA, 22 bp, Homo sapiens
ttggaattttccaggtacagtg

SEQ ID NO: 7544832 - DNA, 22 bp, Homo sapiens
ttggaattttccaggtacagtg

SEQ ID NO: 7544833 - DNA, 21 bp, Homo sapiens
ttggaatttgggagctatgtg

SEQ ID NO: 7544834 - DNA, 22 bp, Homo sapiens
ttggaatttgcttcagctaata

SEQ ID NO: 7544835 - DNA, 22 bp, Homo sapiens
ttggaatttgcttcagctaata

SEQ ID NO: 7544836 - DNA, 22 bp, Homo sapiens
ttggaatttcatgtaagtgact

SEQ ID NO: 7544837 - DNA, 22 bp, Homo sapiens
ttggaatttcatgtaagtgact

SEQ ID NO: 7544838 - DNA, 22 bp, Homo sapiens
ttggaatttgagaccaagaaaa

SEQ ID NO: 7544839 - DNA, 22 bp, Homo sapiens
ttggaattgaggatttacatag

SEQ ID NO: 7544840 - DNA, 22 bp, Homo sapiens
ttggaattgaggatttacatag

SEQ ID NO: 7544841 - DNA, 22 bp, Homo sapiens
ttggaattgaggatttacatag

SEQ ID NO: 7544842 - DNA, 22 bp, Homo sapiens
ttggaacacaatgtttctttca

SEQ ID NO: 7544843 - DNA, 22 bp, Homo sapiens
ttggaacacaatgtttctttca

SEQ ID NO: 7544844 - DNA, 22 bp, Homo sapiens
ttggaacacagcagctgatttt

SEQ ID NO: 7544845 - DNA, 22 bp, Homo sapiens
ttggaacacaatgtttctttca

SEQ ID NO: 7544846 - DNA, 22 bp, Homo sapiens
ttggaacacagcagctgatttt

SEQ ID NO: 7544847 - DNA, 22 bp, Homo sapiens
ttggaattcctgttgtttcgtc

SEQ ID NO: 7544848 - DNA, 22 bp, Homo sapiens
ttggaattgctattgataacaa

SEQ ID NO: 7544849 - DNA, 22 bp, Homo sapiens
ttggaattgctcataagagaga

SEQ ID NO: 7544850 - DNA, 22 bp, Homo sapiens
ttggaattggacatgttgaagg

SEQ ID NO: 7544851 - DNA, 22 bp, Homo sapiens
ttggaattgctattgataacaa

SEQ ID NO: 7544852 - DNA, 22 bp, Homo sapiens
ttggaattgtgaactaagtgat

SEQ ID NO: 7544853 - DNA, 22 bp, Homo sapiens
ttggaattggacatgttgaagg

SEQ ID NO: 7544854 - DNA, 22 bp, Homo sapiens
ttggaatttagtaaaataatgc

SEQ ID NO: 7544855 - DNA, 22 bp, Homo sapiens
ttggaatttcatgtaagtgact

SEQ ID NO: 7544856 - DNA, 22 bp, Homo sapiens
ttggaatttagtaaaataatgc

SEQ ID NO: 7544857 - DNA, 22 bp, Homo sapiens
ttggaaactttcaagcataatg

SEQ ID NO: 7544858 - DNA, 22 bp, Homo sapiens
ttggaaactttcaagcataatg

SEQ ID NO: 7544859 - DNA, 22 bp, Homo sapiens
ttggaaagaagggctgagcaag

SEQ ID NO: 7544860 - DNA, 22 bp, Homo sapiens
ttggaaagaagggctgagcaag

SEQ ID NO: 7544861 - DNA, 22 bp, Homo sapiens
ttggaaacttggatggaaaacc

SEQ ID NO: 7544862 - DNA, 22 bp, Homo sapiens
ttggaaacgtcaccttttcctt

SEQ ID NO: 7544863 - DNA, 22 bp, Homo sapiens
ttggaaacgtcaccttttcctt

SEQ ID NO: 7544864 - DNA, 22 bp, Homo sapiens
ttggaaagaccgaattcctgtt

SEQ ID NO: 7544865 - DNA, 22 bp, Homo sapiens
ttggaaagaagggctgagcaag

SEQ ID NO: 7544866 - DNA, 22 bp, Homo sapiens
ttggaaagggaggaatgtagac

SEQ ID NO: 7544867 - DNA, 22 bp, Homo sapiens
ttggaaagggatatctgtactt

SEQ ID NO: 7544868 - DNA, 22 bp, Homo sapiens
ttggaaaggtgcttttgtctgt

SEQ ID NO: 7544869 - DNA, 22 bp, Homo sapiens
ttggaaagggaggaatgtagac

SEQ ID NO: 7544870 - DNA, 22 bp, Homo sapiens
ttggaaaggagattctattgtg

SEQ ID NO: 7544871 - DNA, 22 bp, Homo sapiens
ttggaaaggagattctattgtg

SEQ ID NO: 7544872 - DNA, 22 bp, Homo sapiens
ttggaaagcccattatttggac

SEQ ID NO: 7544873 - DNA, 22 bp, Homo sapiens
ttgcttcagagggagacacttt

SEQ ID NO: 7544874 - DNA, 22 bp, Homo sapiens
ttgctttattgggtttactgcc

SEQ ID NO: 7544875 - DNA, 22 bp, Homo sapiens
ttgctttattgggtttactgcc

SEQ ID NO: 7544876 - DNA, 22 bp, Homo sapiens
ttgctttattgggtttactgcc

SEQ ID NO: 7544877 - DNA, 22 bp, Homo sapiens
ttgctttatttggcatgccact

SEQ ID NO: 7544878 - DNA, 23 bp, Homo sapiens
ttgctttcatcatgagatgctcc

SEQ ID NO: 7544879 - DNA, 22 bp, Homo sapiens
ttgctttatttggcatgccact

SEQ ID NO: 7544880 - DNA, 23 bp, Homo sapiens
ttgctttcatcatgagatgctcc

SEQ ID NO: 7544881 - DNA, 22 bp, Homo sapiens
ttgcttatttgattaaatgtct

SEQ ID NO: 7544882 - DNA, 22 bp, Homo sapiens
ttgcttatttgattaaatgtct

SEQ ID NO: 7544883 - DNA, 22 bp, Homo sapiens
ttgcttcactacttctaggctc

SEQ ID NO: 7544884 - DNA, 22 bp, Homo sapiens
ttgcttcagagggagacacttt

SEQ ID NO: 7544885 - DNA, 22 bp, Homo sapiens
ttgcttcagagggagacacttt

SEQ ID NO: 7544886 - DNA, 22 bp, Homo sapiens
ttgcttcactgagttatgcctg

SEQ ID NO: 7544887 - DNA, 22 bp, Homo sapiens
ttggaaacgtcaccttttcctt

SEQ ID NO: 7544888 - DNA, 22 bp, Homo sapiens
ttggaaacgtcaccttttcctt

SEQ ID NO: 7544889 - DNA, 22 bp, Homo sapiens
ttggaaacgtcaccttttcctt

SEQ ID NO: 7544890 - DNA, 22 bp, Homo sapiens
ttggaaaatgtatttctagaag

SEQ ID NO: 7544891 - DNA, 22 bp, Homo sapiens
ttggaaaatgtatttctagaag

SEQ ID NO: 7544892 - DNA, 22 bp, Homo sapiens
ttggaaaatgtatttctagaag

SEQ ID NO: 7544893 - DNA, 22 bp, Homo sapiens
ttggaaaatgtatttctagaag

SEQ ID NO: 7544894 - DNA, 22 bp, Homo sapiens
ttggaaaatgaggcacagagag

SEQ ID NO: 7544895 - DNA, 22 bp, Homo sapiens
ttggaaaatgaggcacagagag

SEQ ID NO: 7544896 - DNA, 22 bp, Homo sapiens
ttggaaaatgtatttctagaag

SEQ ID NO: 7544897 - DNA, 22 bp, Homo sapiens
ttgctttccgtcatgtgctaat

SEQ ID NO: 7544898 - DNA, 22 bp, Homo sapiens
ttgcattccatggttttccttc

SEQ ID NO: 7544899 - DNA, 22 bp, Homo sapiens
ttgcattccatggttttccttc

SEQ ID NO: 7544900 - DNA, 22 bp, Homo sapiens
ttgcattacatttgctcagtct

SEQ ID NO: 7544901 - DNA, 23 bp, Homo sapiens
ttgcattaatgtggaggcacagg

SEQ ID NO: 7544902 - DNA, 22 bp, Homo sapiens
ttgcatgtttttgtaatacacc

SEQ ID NO: 7544903 - DNA, 22 bp, Homo sapiens
ttgcatgtttttgtaatacacc

SEQ ID NO: 7544904 - DNA, 22 bp, Homo sapiens
ttgcatgtttttgtaatacacc

SEQ ID NO: 7544905 - DNA, 22 bp, Homo sapiens
ttgcatgttgtttaatttcgag

SEQ ID NO: 7544906 - DNA, 22 bp, Homo sapiens
ttgcatgttgtttaatttcgag

SEQ ID NO: 7544907 - DNA, 22 bp, Homo sapiens
ttgcatgttgggctcatcctct

SEQ ID NO: 7544908 - DNA, 22 bp, Homo sapiens
ttgcatgttatttaatctgtat

SEQ ID NO: 7544909 - DNA, 22 bp, Homo sapiens
ttgcatgttccaaagaattttg

SEQ ID NO: 7544910 - DNA, 22 bp, Homo sapiens
ttgcatgttccaaagaattttg

SEQ ID NO: 7544911 - DNA, 22 bp, Homo sapiens
ttgcatgttatttaatctgtat

SEQ ID NO: 7544912 - DNA, 22 bp, Homo sapiens
ttgcatgttatttaatctgtat

SEQ ID NO: 7544913 - DNA, 22 bp, Homo sapiens
ttgcatgtgtgcatatatttgc

SEQ ID NO: 7544914 - DNA, 22 bp, Homo sapiens
ttgcatgtgtgcatatatttgc

SEQ ID NO: 7544915 - DNA, 22 bp, Homo sapiens
ttgcatgtgtataaaagttgga

SEQ ID NO: 7544916 - DNA, 22 bp, Homo sapiens
ttgcatgtgtaatttttctaaa

SEQ ID NO: 7544917 - DNA, 22 bp, Homo sapiens
ttgcatgtgtataaaagttgga

SEQ ID NO: 7544918 - DNA, 22 bp, Homo sapiens
ttgcatgtgactctatttatgc

SEQ ID NO: 7544919 - DNA, 22 bp, Homo sapiens
ttgcatgtgactctatttatgc

SEQ ID NO: 7544920 - DNA, 22 bp, Homo sapiens
ttgcatgtgtaaggttgtttat

SEQ ID NO: 7544921 - DNA, 22 bp, Homo sapiens
ttgcatgtggtaggtcgttcta

SEQ ID NO: 7544922 - DNA, 22 bp, Homo sapiens
ttgcatgtgtaatttttctaaa

SEQ ID NO: 7544923 - DNA, 22 bp, Homo sapiens
ttgcattgaatgcacattttta

SEQ ID NO: 7544924 - DNA, 22 bp, Homo sapiens
ttgcattgaaaatatattttaa

SEQ ID NO: 7544925 - DNA, 22 bp, Homo sapiens
ttgcattgaatgcacattttta

SEQ ID NO: 7544926 - DNA, 22 bp, Homo sapiens
ttgcattgcttggtcttcaaga

SEQ ID NO: 7544927 - DNA, 20 bp, Homo sapiens
ttgcattggatgtgcaggtg

SEQ ID NO: 7544928 - DNA, 19 bp, Homo sapiens
ttgcattgtagttggactg

SEQ ID NO: 7544929 - DNA, 22 bp, Homo sapiens
ttgcattgttgcaatgaagtat

SEQ ID NO: 7544930 - DNA, 22 bp, Homo sapiens
ttgcatttaagtagatgttaca

SEQ ID NO: 7544931 - DNA, 22 bp, Homo sapiens
ttgctctgcagtccagacagta

SEQ ID NO: 7544932 - DNA, 22 bp, Homo sapiens
ttgctctgattaggtggaaaca

SEQ ID NO: 7544933 - DNA, 22 bp, Homo sapiens
ttgctctgcagtccagacagta

SEQ ID NO: 7544934 - DNA, 22 bp, Homo sapiens
ttgctctgtaataatctggggt

SEQ ID NO: 7544935 - DNA, 22 bp, Homo sapiens
ttgctctgaacccagggcacca

SEQ ID NO: 7544936 - DNA, 22 bp, Homo sapiens
ttgctctgactggagtgcagtg

SEQ ID NO: 7544937 - DNA, 22 bp, Homo sapiens
ttgctctgactggagtgcagtg

SEQ ID NO: 7544938 - DNA, 22 bp, Homo sapiens
ttgctctgaacccagggcacca

SEQ ID NO: 7544939 - DNA, 22 bp, Homo sapiens
ttgctctgactggagtgcagtg

SEQ ID NO: 7544940 - DNA, 22 bp, Homo sapiens
ttgctctgactggagtgcagtg

SEQ ID NO: 7544941 - DNA, 22 bp, Homo sapiens
ttgctctgattaggtggaaaca

SEQ ID NO: 7544942 - DNA, 18 bp, Homo sapiens
ttgctcttctatgtcaat

SEQ ID NO: 7544943 - DNA, 22 bp, Homo sapiens
ttgctcttgaaaattgatgctg

SEQ ID NO: 7544944 - DNA, 22 bp, Homo sapiens
ttgctctgtccagccagcaggt

SEQ ID NO: 7544945 - DNA, 22 bp, Homo sapiens
ttgctctgtccagccagcaggt

SEQ ID NO: 7544946 - DNA, 22 bp, Homo sapiens
ttgctctgtccagccagcaggt

SEQ ID NO: 7544947 - DNA, 22 bp, Homo sapiens
ttgctctgtaataatctggggt

SEQ ID NO: 7544948 - DNA, 22 bp, Homo sapiens
ttgctctgtcagggcctcagtc

SEQ ID NO: 7544949 - DNA, 22 bp, Homo sapiens
ttgctctgtcagggcctcagtc

SEQ ID NO: 7544950 - DNA, 22 bp, Homo sapiens
ttgctctgtcagggcctcagtc

SEQ ID NO: 7544951 - DNA, 22 bp, Homo sapiens
ttgctctgtcagggcctcagtc

SEQ ID NO: 7544952 - DNA, 22 bp, Homo sapiens
ttgctctgtcagggcctcagtc

SEQ ID NO: 7544953 - DNA, 22 bp, Homo sapiens
ttgctctgtcagggcctcagtc

SEQ ID NO: 7544954 - DNA, 22 bp, Homo sapiens
ttgcatttcactttcagtaggc

SEQ ID NO: 7544955 - DNA, 22 bp, Homo sapiens
ttgctcatatttgcatgtgttt

SEQ ID NO: 7544956 - DNA, 22 bp, Homo sapiens
ttgcatttcactttcagtaggc

SEQ ID NO: 7544957 - DNA, 22 bp, Homo sapiens
ttgctcattccgtgagaagatc

SEQ ID NO: 7544958 - DNA, 22 bp, Homo sapiens
ttgctcattccgtgagaagatc

SEQ ID NO: 7544959 - DNA, 22 bp, Homo sapiens
ttgctccaggctgcagactctg

SEQ ID NO: 7544960 - DNA, 22 bp, Homo sapiens
ttgctccaggctgcagactctg

SEQ ID NO: 7544961 - DNA, 22 bp, Homo sapiens
ttgcatttactgcaccgtgagt

SEQ ID NO: 7544962 - DNA, 22 bp, Homo sapiens
ttgcatttcactttcagtaggc

SEQ ID NO: 7544963 - DNA, 22 bp, Homo sapiens
ttgcatttcactttcagtaggc

SEQ ID NO: 7544964 - DNA, 22 bp, Homo sapiens
ttgcatttcaattgctcaggaa

SEQ ID NO: 7544965 - DNA, 22 bp, Homo sapiens
ttgctctgaacccagggcacca

SEQ ID NO: 7544966 - DNA, 22 bp, Homo sapiens
ttgctctcggggaggctgcagg

SEQ ID NO: 7544967 - DNA, 22 bp, Homo sapiens
ttgctctcggggaggctgcagg

SEQ ID NO: 7544968 - DNA, 22 bp, Homo sapiens
ttgctctccagaggctcacagc

SEQ ID NO: 7544969 - DNA, 22 bp, Homo sapiens
ttgctctcagaggaggaggccg

SEQ ID NO: 7544970 - DNA, 22 bp, Homo sapiens
ttgctctatgtttgtaaacaga

SEQ ID NO: 7544971 - DNA, 22 bp, Homo sapiens
ttgctctatgtttgtaaacaga

SEQ ID NO: 7544972 - DNA, 19 bp, Homo sapiens
ttgctcccaccccagtttt

SEQ ID NO: 7544973 - DNA, 23 bp, Homo sapiens
ttgctgagataaagaatgcaggg

SEQ ID NO: 7544974 - DNA, 23 bp, Homo sapiens
ttgctgagataaagaatgcaggg

SEQ ID NO: 7544975 - DNA, 22 bp, Homo sapiens
ttgctgacctttgctctccgtt

SEQ ID NO: 7544976 - DNA, 22 bp, Homo sapiens
ttgctgacctttgctctccgtt

SEQ ID NO: 7544977 - DNA, 22 bp, Homo sapiens
ttgctgagagcgtgtcaacaag

SEQ ID NO: 7544978 - DNA, 22 bp, Homo sapiens
ttgctgttacaattatttaccc

SEQ ID NO: 7544979 - DNA, 20 bp, Homo sapiens
ttgctgttgccaagattttg

SEQ ID NO: 7544980 - DNA, 22 bp, Homo sapiens
ttgctgttacaattatttaccc

SEQ ID NO: 7544981 - DNA, 20 bp, Homo sapiens
ttgctgttgccaagattttg

SEQ ID NO: 7544982 - DNA, 20 bp, Homo sapiens
ttgctgttgccaagattttg

SEQ ID NO: 7544983 - DNA, 22 bp, Homo sapiens
ttgctgtttaatgatgtcttat

SEQ ID NO: 7544984 - DNA, 22 bp, Homo sapiens
ttgctgttttacatctggtggg

SEQ ID NO: 7544985 - DNA, 21 bp, Homo sapiens
ttgctgttttcccaatgcagt

SEQ ID NO: 7544986 - DNA, 22 bp, Homo sapiens
ttgctgttttacttacaagctc

SEQ ID NO: 7544987 - DNA, 21 bp, Homo sapiens
ttgctgttttcccaatgcagt

SEQ ID NO: 7544988 - DNA, 22 bp, Homo sapiens
ttgcttaattctgaaaatatag

SEQ ID NO: 7544989 - DNA, 23 bp, Homo sapiens
ttgcttagagacctcctcatcag

SEQ ID NO: 7544990 - DNA, 23 bp, Homo sapiens
ttgcttagagacctcctcatcag

SEQ ID NO: 7544991 - DNA, 23 bp, Homo sapiens
ttgcttagagacctcctcatcag

SEQ ID NO: 7544992 - DNA, 22 bp, Homo sapiens
ttgcttatagagagtttcatac

SEQ ID NO: 7544993 - DNA, 22 bp, Homo sapiens
ttgcttatgcctcttgacaaag

SEQ ID NO: 7544994 - DNA, 21 bp, Homo sapiens
ttgcttatggcactgctttgc

SEQ ID NO: 7544995 - DNA, 22 bp, Homo sapiens
ttgcttatttgattaaatgtct

SEQ ID NO: 7544996 - DNA, 21 bp, Homo sapiens
ttgcttatggcactgctttgc

SEQ ID NO: 7544997 - DNA, 22 bp, Homo sapiens
ttgctgaaagtggcaagaagta

SEQ ID NO: 7544998 - DNA, 22 bp, Homo sapiens
ttgctgaaagtggcaagaagta

SEQ ID NO: 7544999 - DNA, 22 bp, Homo sapiens
ttgctgaaaggtagctgtgtgg

SEQ ID NO: 7545000 - DNA, 22 bp, Homo sapiens
ttgctgaaaacaggtcatcagg

SEQ ID NO: 7545001 - DNA, 22 bp, Homo sapiens
ttgctgaagttgctcagctcca

SEQ ID NO: 7545002 - DNA, 22 bp, Homo sapiens
ttgctgaagtatgaaaaagaca

SEQ ID NO: 7545003 - DNA, 22 bp, Homo sapiens
ttgcaggaaactgagtgtgagc

SEQ ID NO: 7545004 - DNA, 22 bp, Homo sapiens
ttgcaggaaactgagtgtgagc

SEQ ID NO: 7545005 - DNA, 22 bp, Homo sapiens
ttgcaggaaactgagtgtgagc

SEQ ID NO: 7545006 - DNA, 22 bp, Homo sapiens
ttgcaggaaactgagtgtgagc

SEQ ID NO: 7545007 - DNA, 22 bp, Homo sapiens
ttgcaggaagcacaagtctgag

SEQ ID NO: 7545008 - DNA, 22 bp, Homo sapiens
ttgcaggaagcacaagtctgag

SEQ ID NO: 7545009 - DNA, 22 bp, Homo sapiens
ttgcagcttcttgcatcagaaa

SEQ ID NO: 7545010 - DNA, 22 bp, Homo sapiens
ttgcagcttcttgcatcagaaa

SEQ ID NO: 7545011 - DNA, 22 bp, Homo sapiens
ttgcagcttcgagtctatctgt

SEQ ID NO: 7545012 - DNA, 22 bp, Homo sapiens
ttgcagcttctaccactgtttc

SEQ ID NO: 7545013 - DNA, 22 bp, Homo sapiens
ttgcagcttctaccactgtttc

SEQ ID NO: 7545014 - DNA, 22 bp, Homo sapiens
ttgcagcttctaacagcttcag

SEQ ID NO: 7545015 - DNA, 22 bp, Homo sapiens
ttgcagcttctaacagcttcag

SEQ ID NO: 7545016 - DNA, 22 bp, Homo sapiens
ttgcagcttctaccactgtttc

SEQ ID NO: 7545017 - DNA, 22 bp, Homo sapiens
ttgcagcttcttgcatcagaaa

SEQ ID NO: 7545018 - DNA, 22 bp, Homo sapiens
ttgcaggattttagagatgaca

SEQ ID NO: 7545019 - DNA, 22 bp, Homo sapiens
ttgcaggattttagagatgaca

SEQ ID NO: 7545020 - DNA, 22 bp, Homo sapiens
ttgcaggacaatgatggtccct

SEQ ID NO: 7545021 - DNA, 22 bp, Homo sapiens
ttgcaggaagcacaagtctgag

SEQ ID NO: 7545022 - DNA, 22 bp, Homo sapiens
ttgcaggaagcacaagtctgag

SEQ ID NO: 7545023 - DNA, 22 bp, Homo sapiens
ttgcaggacaatgatggtccct

SEQ ID NO: 7545024 - DNA, 22 bp, Homo sapiens
ttgcagggaaatagaaataaac

SEQ ID NO: 7545025 - DNA, 22 bp, Homo sapiens
ttgcagggaaatagaaataaac

SEQ ID NO: 7545026 - DNA, 22 bp, Homo sapiens
ttgcagggaaacagtttaggaa

SEQ ID NO: 7545027 - DNA, 22 bp, Homo sapiens
ttgcagggaaatcagtgaggat

SEQ ID NO: 7545028 - DNA, 22 bp, Homo sapiens
ttgcagggaaatcagtgaggat

SEQ ID NO: 7545029 - DNA, 22 bp, Homo sapiens
ttgcagggaaatcagtgaggat

SEQ ID NO: 7545030 - DNA, 22 bp, Homo sapiens
ttgcagggacctgcagaaagct

SEQ ID NO: 7545031 - DNA, 22 bp, Homo sapiens
ttgcagggataaaacaagtgaa

SEQ ID NO: 7545032 - DNA, 23 bp, Homo sapiens
ttgcagggatggagttcaaaatg

SEQ ID NO: 7545033 - DNA, 22 bp, Homo sapiens
ttgcagggataaaacaagtgaa

SEQ ID NO: 7545034 - DNA, 22 bp, Homo sapiens
ttgcagggataaaacaagtgaa

SEQ ID NO: 7545035 - DNA, 22 bp, Homo sapiens
ttgcagggattaccttattttt

SEQ ID NO: 7545036 - DNA, 22 bp, Homo sapiens
ttgcagggcaaatggtcagata

SEQ ID NO: 7545037 - DNA, 22 bp, Homo sapiens
ttgcagattaaaacactgagct

SEQ ID NO: 7545038 - DNA, 19 bp, Homo sapiens
ttgcagcaaagttaggacc

SEQ ID NO: 7545039 - DNA, 22 bp, Homo sapiens
ttgcagcagggtgaattcactc

SEQ ID NO: 7545040 - DNA, 20 bp, Homo sapiens
ttgcagcagtgaggtgaagg

SEQ ID NO: 7545041 - DNA, 22 bp, Homo sapiens
ttgcagcagggtgaattcactc

SEQ ID NO: 7545042 - DNA, 20 bp, Homo sapiens
ttgcagcagtgaggtgaagg

SEQ ID NO: 7545043 - DNA, 22 bp, Homo sapiens
ttgcagcaaggtcatgaaatgt

SEQ ID NO: 7545044 - DNA, 22 bp, Homo sapiens
ttgcagcaaggtcatgaaatgt

SEQ ID NO: 7545045 - DNA, 19 bp, Homo sapiens
ttgcagcaaagttaggacc

SEQ ID NO: 7545046 - DNA, 22 bp, Homo sapiens
ttgcagcaaggtcatgaaatgt

SEQ ID NO: 7545047 - DNA, 22 bp, Homo sapiens
ttgcagcagctctttgaatgtt

SEQ ID NO: 7545048 - DNA, 22 bp, Homo sapiens
ttgcagctagaagattcactgt

SEQ ID NO: 7545049 - DNA, 22 bp, Homo sapiens
ttgcagctagaagattcactgt

SEQ ID NO: 7545050 - DNA, 22 bp, Homo sapiens
ttgcagctagaagattcactgt

SEQ ID NO: 7545051 - DNA, 22 bp, Homo sapiens
ttgcagctagaagattcactgt

SEQ ID NO: 7545052 - DNA, 22 bp, Homo sapiens
ttgcagctccattttaatggct

SEQ ID NO: 7545053 - DNA, 22 bp, Homo sapiens
ttgcagctctctgaaggttgca

SEQ ID NO: 7545054 - DNA, 22 bp, Homo sapiens
ttgcagctctctgaaggttgca

SEQ ID NO: 7545055 - DNA, 22 bp, Homo sapiens
ttgcagctctgatccagggacc

SEQ ID NO: 7545056 - DNA, 22 bp, Homo sapiens
ttgcagctctgatccagggacc

SEQ ID NO: 7545057 - DNA, 22 bp, Homo sapiens
ttgcagctccattttaatggct

SEQ ID NO: 7545058 - DNA, 22 bp, Homo sapiens
ttgcagctctgatccagggacc

SEQ ID NO: 7545059 - DNA, 22 bp, Homo sapiens
ttgcagctctgatccagggacc

SEQ ID NO: 7545060 - DNA, 22 bp, Homo sapiens
ttgcagctgaggaaattgaagc

SEQ ID NO: 7545061 - DNA, 22 bp, Homo sapiens
ttgcagctgaggaaattgaagc

SEQ ID NO: 7545062 - DNA, 22 bp, Homo sapiens
ttgcagcttcaagcaggttgac

SEQ ID NO: 7545063 - DNA, 22 bp, Homo sapiens
ttgcagcttcgagtctatctgt

SEQ ID NO: 7545064 - DNA, 22 bp, Homo sapiens
ttgcagcttcgagtctatctgt

SEQ ID NO: 7545065 - DNA, 22 bp, Homo sapiens
ttgcagcttctaacagcttcag

SEQ ID NO: 7545066 - DNA, 22 bp, Homo sapiens
ttgcagcttctaacagcttcag

SEQ ID NO: 7545067 - DNA, 22 bp, Homo sapiens
ttgcagctgttgcaaagtctct

SEQ ID NO: 7545068 - DNA, 22 bp, Homo sapiens
ttgcagcttagtgatgttatct

SEQ ID NO: 7545069 - DNA, 22 bp, Homo sapiens
ttgcagcttagtgatgttatct

SEQ ID NO: 7545070 - DNA, 22 bp, Homo sapiens
ttgcagcttcaagcaggttgac

SEQ ID NO: 7545071 - DNA, 22 bp, Homo sapiens
ttgcagcttcaagcaggttgac

SEQ ID NO: 7545072 - DNA, 22 bp, Homo sapiens
ttgcagctgcagtaaatgttca

SEQ ID NO: 7545073 - DNA, 22 bp, Homo sapiens
ttgcagctgcagtaaatgttca

SEQ ID NO: 7545074 - DNA, 22 bp, Homo sapiens
ttgcagctgctgttcctcatgg

SEQ ID NO: 7545075 - DNA, 22 bp, Homo sapiens
ttgcagctgctgttcctcatgg

SEQ ID NO: 7545076 - DNA, 22 bp, Homo sapiens
ttgcagctgctgttcctcatgg

SEQ ID NO: 7545077 - DNA, 22 bp, Homo sapiens
ttgcagctggtggtggccgtgt

SEQ ID NO: 7545078 - DNA, 22 bp, Homo sapiens
ttgcagctggtggtggccgtgt

SEQ ID NO: 7545079 - DNA, 22 bp, Homo sapiens
ttgcagctgtgagctttacacg

SEQ ID NO: 7545080 - DNA, 22 bp, Homo sapiens
ttgcagctgtgagctttacacg

SEQ ID NO: 7545081 - DNA, 22 bp, Homo sapiens
ttgcagctgtgagctttacacg

SEQ ID NO: 7545082 - DNA, 22 bp, Homo sapiens
ttgcagctgttactgatagata

SEQ ID NO: 7545083 - DNA, 22 bp, Homo sapiens
ttgcagctgttactgatagata

SEQ ID NO: 7545084 - DNA, 22 bp, Homo sapiens
ttgcagctgttgcaaagtctct

SEQ ID NO: 7545085 - DNA, 22 bp, Homo sapiens
ttgcagttgctgtatttaagga

SEQ ID NO: 7545086 - DNA, 22 bp, Homo sapiens
ttgcagttgctgtatttaagga

SEQ ID NO: 7545087 - DNA, 22 bp, Homo sapiens
ttgcagttgcatatgcccctac

SEQ ID NO: 7545088 - DNA, 22 bp, Homo sapiens
ttgcagttgcatatgcccctac

SEQ ID NO: 7545089 - DNA, 22 bp, Homo sapiens
ttgcagttgctgtatttaagga

SEQ ID NO: 7545090 - DNA, 23 bp, Homo sapiens
ttgcatggagcctgggattcctc

SEQ ID NO: 7545091 - DNA, 22 bp, Homo sapiens
ttgcagttaaaaatcattagtt

SEQ ID NO: 7545092 - DNA, 22 bp, Homo sapiens
ttgcagtcacactctaaagtag

SEQ ID NO: 7545093 - DNA, 22 bp, Homo sapiens
ttgcagtaggtggagtgaattt

SEQ ID NO: 7545094 - DNA, 22 bp, Homo sapiens
ttgcaggttttgccattagaag

SEQ ID NO: 7545095 - DNA, 22 bp, Homo sapiens
ttgcaggttgaatcagcagact

SEQ ID NO: 7545096 - DNA, 22 bp, Homo sapiens
ttgcaggttgaatcagcagact

SEQ ID NO: 7545097 - DNA, 22 bp, Homo sapiens
ttgcaggttttgccattagaag

SEQ ID NO: 7545098 - DNA, 22 bp, Homo sapiens
ttgcatgtcctacatctgtgtc

SEQ ID NO: 7545099 - DNA, 22 bp, Homo sapiens
ttgcatgtcctacatctgtgtc

SEQ ID NO: 7545100 - DNA, 22 bp, Homo sapiens
ttgcatgtccagggtattgtgg

SEQ ID NO: 7545101 - DNA, 22 bp, Homo sapiens
ttgcatgtccagggtattgtgg

SEQ ID NO: 7545102 - DNA, 22 bp, Homo sapiens
ttgcatgtatgtgatctgttca

SEQ ID NO: 7545103 - DNA, 22 bp, Homo sapiens
ttgcatgtatgtgatctgttca

SEQ ID NO: 7545104 - DNA, 23 bp, Homo sapiens
ttgcatgtagcccatgagtaact

SEQ ID NO: 7545105 - DNA, 23 bp, Homo sapiens
ttgcatgtagcccatgagtaact

SEQ ID NO: 7545106 - DNA, 22 bp, Homo sapiens
ttgcatgtagaatactcaactt

SEQ ID NO: 7545107 - DNA, 22 bp, Homo sapiens
ttgcatggtaataaaatgtgac

SEQ ID NO: 7545108 - DNA, 22 bp, Homo sapiens
ttgcatgtacgtacagagagag

SEQ ID NO: 7545109 - DNA, 22 bp, Homo sapiens
ttgcatgggcaacaggaggtgg

SEQ ID NO: 7545110 - DNA, 22 bp, Homo sapiens
ttgcatggctgtgaaaatttgg

SEQ ID NO: 7545111 - DNA, 22 bp, Homo sapiens
ttgcagggttgaccaataggct

SEQ ID NO: 7545112 - DNA, 22 bp, Homo sapiens
ttgcagggttgaccaataggct

SEQ ID NO: 7545113 - DNA, 22 bp, Homo sapiens
ttgcagggttgacactgcctgc

SEQ ID NO: 7545114 - DNA, 22 bp, Homo sapiens
ttgcagggttgacactgcctgc

SEQ ID NO: 7545115 - DNA, 22 bp, Homo sapiens
ttgcagggttaaagtaaggtag

SEQ ID NO: 7545116 - DNA, 18 bp, Homo sapiens
ttgcaggtacctctatct

SEQ ID NO: 7545117 - DNA, 18 bp, Homo sapiens
ttgcaggtacctctatct

SEQ ID NO: 7545118 - DNA, 22 bp, Homo sapiens
ttgcaggtatatttacttttcc

SEQ ID NO: 7545119 - DNA, 22 bp, Homo sapiens
ttgcaggtccggaacctcgccg

SEQ ID NO: 7545120 - DNA, 22 bp, Homo sapiens
ttgcaggtctccatgagtgcga

SEQ ID NO: 7545121 - DNA, 22 bp, Homo sapiens
ttgcaggtctccatgagtgcga

SEQ ID NO: 7545122 - DNA, 22 bp, Homo sapiens
ttgcaggtctgggggtcctggt

SEQ ID NO: 7545123 - DNA, 22 bp, Homo sapiens
ttgcaggtgagggaaatgactg

SEQ ID NO: 7545124 - DNA, 22 bp, Homo sapiens
ttgcaggtgaaatgggcctggc

SEQ ID NO: 7545125 - DNA, 22 bp, Homo sapiens
ttgcaggtggtttggccataga

SEQ ID NO: 7545126 - DNA, 22 bp, Homo sapiens
ttgcaggttagagacctgtgga

SEQ ID NO: 7545127 - DNA, 22 bp, Homo sapiens
ttgcaggttcaagaaactgatt

SEQ ID NO: 7545128 - DNA, 22 bp, Homo sapiens
ttgcagggcatctatgtctggt

SEQ ID NO: 7545129 - DNA, 22 bp, Homo sapiens
ttgcagggcatcgcgtacttct

SEQ ID NO: 7545130 - DNA, 22 bp, Homo sapiens
ttgcagggcaggaccatggaca

SEQ ID NO: 7545131 - DNA, 22 bp, Homo sapiens
ttgcagggcaggaccatggaca

SEQ ID NO: 7545132 - DNA, 22 bp, Homo sapiens
ttgcagggcaaatggtcagata

SEQ ID NO: 7545133 - DNA, 22 bp, Homo sapiens
ttgcaggggaaggagcagagct

SEQ ID NO: 7545134 - DNA, 22 bp, Homo sapiens
ttgcagggcttggggattacag

SEQ ID NO: 7545135 - DNA, 22 bp, Homo sapiens
ttgcagggctggaacatggaat

SEQ ID NO: 7545136 - DNA, 22 bp, Homo sapiens
ttgcagggctggaacatggaat

SEQ ID NO: 7545137 - DNA, 22 bp, Homo sapiens
ttgcagggccttggcttcttcc

SEQ ID NO: 7545138 - DNA, 22 bp, Homo sapiens
ttgcagggtcccagaggcctgg

SEQ ID NO: 7545139 - DNA, 22 bp, Homo sapiens
ttgcagggtcccagaggcctgg

SEQ ID NO: 7545140 - DNA, 22 bp, Homo sapiens
ttgcagggtcccagaggcctgg

SEQ ID NO: 7545141 - DNA, 22 bp, Homo sapiens
ttgcagggtacattcttagaat

SEQ ID NO: 7545142 - DNA, 22 bp, Homo sapiens
ttgcagggtcctgtggctctcc

SEQ ID NO: 7545143 - DNA, 22 bp, Homo sapiens
ttgcagggttaaagtaaggtag

SEQ ID NO: 7545144 - DNA, 22 bp, Homo sapiens
ttgcagggtcctgtggctctcc

SEQ ID NO: 7545145 - DNA, 22 bp, Homo sapiens
ttgcagggtcctgtggctctcc

SEQ ID NO: 7545146 - DNA, 22 bp, Homo sapiens
ttgcaggggagaggaacaaaca

SEQ ID NO: 7545147 - DNA, 22 bp, Homo sapiens
ttgcaggggaaggagcagagct

SEQ ID NO: 7545148 - DNA, 22 bp, Homo sapiens
ttgcaggggaaggagcagagct

SEQ ID NO: 7545149 - DNA, 22 bp, Homo sapiens
ttgcagagaggttaggaactca

SEQ ID NO: 7545150 - DNA, 22 bp, Homo sapiens
ttgcagagatcagcaggtttga

SEQ ID NO: 7545151 - DNA, 22 bp, Homo sapiens
ttgcagagaggttaggaactca

SEQ ID NO: 7545152 - DNA, 22 bp, Homo sapiens
ttgcagagaggttaggaactca

SEQ ID NO: 7545153 - DNA, 22 bp, Homo sapiens
ttgcagagatcagcaggtttga

SEQ ID NO: 7545154 - DNA, 22 bp, Homo sapiens
ttgcagagatcagcaggtttga

SEQ ID NO: 7545155 - DNA, 22 bp, Homo sapiens
ttgcagagcagtaggaatatag

SEQ ID NO: 7545156 - DNA, 22 bp, Homo sapiens
ttgcagagccatgaggctggct

SEQ ID NO: 7545157 - DNA, 22 bp, Homo sapiens
ttgcagagcagtaggaatatag

SEQ ID NO: 7545158 - DNA, 22 bp, Homo sapiens
ttgcagagccatgaggctggct

SEQ ID NO: 7545159 - DNA, 22 bp, Homo sapiens
ttgcagagccatgaggctggct

SEQ ID NO: 7545160 - DNA, 22 bp, Homo sapiens
ttgcagaggcaaaaatgaactc

SEQ ID NO: 7545161 - DNA, 22 bp, Homo sapiens
ttgcagaggcaaaaatgaactc

SEQ ID NO: 7545162 - DNA, 22 bp, Homo sapiens
ttgcagagtggttgtgaggatt

SEQ ID NO: 7545163 - DNA, 22 bp, Homo sapiens
ttgcagagtggttgtgaggatt

SEQ ID NO: 7545164 - DNA, 22 bp, Homo sapiens
ttgcagatatatggagtgcatt

SEQ ID NO: 7545165 - DNA, 22 bp, Homo sapiens
ttgcagatatttccgatgctat

SEQ ID NO: 7545166 - DNA, 22 bp, Homo sapiens
ttgcagagtggttgtgaggatt

SEQ ID NO: 7545167 - DNA, 22 bp, Homo sapiens
ttgcagatcagctttcattgtc

SEQ ID NO: 7545168 - DNA, 22 bp, Homo sapiens
ttgcagacccttactgctagag

SEQ ID NO: 7545169 - DNA, 22 bp, Homo sapiens
ttgcagacccttactgctagag

SEQ ID NO: 7545170 - DNA, 22 bp, Homo sapiens
ttgcagacagtgagagtgaaag

SEQ ID NO: 7545171 - DNA, 22 bp, Homo sapiens
ttgcagacttacttcgagaaat

SEQ ID NO: 7545172 - DNA, 22 bp, Homo sapiens
ttgcagacttacttcgagaaat

SEQ ID NO: 7545173 - DNA, 22 bp, Homo sapiens
ttgcagagaggttaggaactca

SEQ ID NO: 7545174 - DNA, 22 bp, Homo sapiens
ttgcagaattaagcagagagcc

SEQ ID NO: 7545175 - DNA, 22 bp, Homo sapiens
ttgcagaatacttattctgtat

SEQ ID NO: 7545176 - DNA, 22 bp, Homo sapiens
ttgcagaatacttattctgtat

SEQ ID NO: 7545177 - DNA, 22 bp, Homo sapiens
ttgcagaagggcacagtgatca

SEQ ID NO: 7545178 - DNA, 22 bp, Homo sapiens
ttgcagaagggcacagtgatca

SEQ ID NO: 7545179 - DNA, 22 bp, Homo sapiens
ttgcagaagggcacagtgatca

SEQ ID NO: 7545180 - DNA, 22 bp, Homo sapiens
ttgcagaacttaaagacagagt

SEQ ID NO: 7545181 - DNA, 21 bp, Homo sapiens
ttgcacagaaaaccatagaga

SEQ ID NO: 7545182 - DNA, 21 bp, Homo sapiens
ttgcacagaaaaccatagaga

SEQ ID NO: 7545183 - DNA, 22 bp, Homo sapiens
ttgacacagttttctcattaag

SEQ ID NO: 7545184 - DNA, 22 bp, Homo sapiens
ttgacagaaatgtatttgcatg

SEQ ID NO: 7545185 - DNA, 22 bp, Homo sapiens
ttgacagaatgttacatataga

SEQ ID NO: 7545186 - DNA, 22 bp, Homo sapiens
ttgacagaaatgtatttgcatg

SEQ ID NO: 7545187 - DNA, 22 bp, Homo sapiens
ttgacactaagatttccaaaca

SEQ ID NO: 7545188 - DNA, 22 bp, Homo sapiens
ttgacacattagagcttgtaaa

SEQ ID NO: 7545189 - DNA, 22 bp, Homo sapiens
ttgacacagatcaatattcaac

SEQ ID NO: 7545190 - DNA, 22 bp, Homo sapiens
ttgacacagttttctcattaag

SEQ ID NO: 7545191 - DNA, 22 bp, Homo sapiens
ttgacacagtcaacttgatttt

SEQ ID NO: 7545192 - DNA, 22 bp, Homo sapiens
ttgacagagctaggtcaactct

SEQ ID NO: 7545193 - DNA, 22 bp, Homo sapiens
ttgacagatgtgaaagtgagca

SEQ ID NO: 7545194 - DNA, 22 bp, Homo sapiens
ttgacagagaaaagtgtgactt

SEQ ID NO: 7545195 - DNA, 22 bp, Homo sapiens
ttgacagaatgttacatataga

SEQ ID NO: 7545196 - DNA, 22 bp, Homo sapiens
ttgacagaatgttacatataga

SEQ ID NO: 7545197 - DNA, 22 bp, Homo sapiens
ttgacagagctaggtcaactct

SEQ ID NO: 7545198 - DNA, 22 bp, Homo sapiens
ttgacagagaaaagtgtgactt

SEQ ID NO: 7545199 - DNA, 22 bp, Homo sapiens
ttgacagagctaggtcaactct

SEQ ID NO: 7545200 - DNA, 22 bp, Homo sapiens
ttgcaattgctatggagagcgt

SEQ ID NO: 7545201 - DNA, 22 bp, Homo sapiens
ttgcaattagttacaaaagtgg

SEQ ID NO: 7545202 - DNA, 23 bp, Homo sapiens
ttgacagtaggtggttttcattg

SEQ ID NO: 7545203 - DNA, 22 bp, Homo sapiens
ttgacaggaaatatggtggcag

SEQ ID NO: 7545204 - DNA, 22 bp, Homo sapiens
ttgacagctacggagcagctgt

SEQ ID NO: 7545205 - DNA, 21 bp, Homo sapiens
ttgacaggaaagaggggagat

SEQ ID NO: 7545206 - DNA, 22 bp, Homo sapiens
ttgacaggaaaaagtttaggat

SEQ ID NO: 7545207 - DNA, 21 bp, Homo sapiens
ttgcacacagtgtttctggtt

SEQ ID NO: 7545208 - DNA, 22 bp, Homo sapiens
ttgcacaccagttttgatgtgg

SEQ ID NO: 7545209 - DNA, 22 bp, Homo sapiens
ttgcaattgctatggagagcgt

SEQ ID NO: 7545210 - DNA, 22 bp, Homo sapiens
ttgacaggatataaagacataa

SEQ ID NO: 7545211 - DNA, 22 bp, Homo sapiens
ttgcaattgctatggagagcgt

SEQ ID NO: 7545212 - DNA, 22 bp, Homo sapiens
ttgcaattgctatggagagcgt

SEQ ID NO: 7545213 - DNA, 22 bp, Homo sapiens
ttgcaattgctatggagagcgt

SEQ ID NO: 7545214 - DNA, 22 bp, Homo sapiens
ttgcaattgctatggagagcgt

SEQ ID NO: 7545215 - DNA, 22 bp, Homo sapiens
ttgacaaaaacctcatttcacc

SEQ ID NO: 7545216 - DNA, 22 bp, Homo sapiens
ttgacaaaaacctcatttcacc

SEQ ID NO: 7545217 - DNA, 22 bp, Homo sapiens
ttgacaaaaataacacagcata

SEQ ID NO: 7545218 - DNA, 22 bp, Homo sapiens
ttgacaaaaataacacagcata

SEQ ID NO: 7545219 - DNA, 22 bp, Homo sapiens
ttgacaaaaataacacagcata

SEQ ID NO: 7545220 - DNA, 22 bp, Homo sapiens
ttgacaaaaataacacagcata

SEQ ID NO: 7545221 - DNA, 23 bp, Homo sapiens
ttgaatttctcttgcaatattta

SEQ ID NO: 7545222 - DNA, 22 bp, Homo sapiens
ttgacaaaaacctcatttcacc

SEQ ID NO: 7545223 - DNA, 22 bp, Homo sapiens
ttgacaaaaacctcatttcacc

SEQ ID NO: 7545224 - DNA, 22 bp, Homo sapiens
ttgacaaaaacctcatttcacc

SEQ ID NO: 7545225 - DNA, 22 bp, Homo sapiens
ttgacaaaaacctcatttcacc

SEQ ID NO: 7545226 - DNA, 22 bp, Homo sapiens
ttgacaaaaacctcatttcacc

SEQ ID NO: 7545227 - DNA, 22 bp, Homo sapiens
ttgacaaaaacctcatttcacc

SEQ ID NO: 7545228 - DNA, 22 bp, Homo sapiens
ttgacaaaaacctcatttcacc

SEQ ID NO: 7545229 - DNA, 22 bp, Homo sapiens
ttgacaaaaacctcatttcacc

SEQ ID NO: 7545230 - DNA, 22 bp, Homo sapiens
ttgacaaagatatattcatgct

SEQ ID NO: 7545231 - DNA, 22 bp, Homo sapiens
ttgacaaagatatattcatgct

SEQ ID NO: 7545232 - DNA, 22 bp, Homo sapiens
ttgacaaaacaacacagatttc

SEQ ID NO: 7545233 - DNA, 22 bp, Homo sapiens
ttgacaaaacaacacagatttc

SEQ ID NO: 7545234 - DNA, 22 bp, Homo sapiens
ttgacaaaaataacacagcata

SEQ ID NO: 7545235 - DNA, 22 bp, Homo sapiens
ttgacaaaaataacacagcata

SEQ ID NO: 7545236 - DNA, 22 bp, Homo sapiens
ttgacaaaacaacacagatttc

SEQ ID NO: 7545237 - DNA, 22 bp, Homo sapiens
ttgacaaaacaacacagatttc

SEQ ID NO: 7545238 - DNA, 22 bp, Homo sapiens
ttgacaaaacaacacagatttc

SEQ ID NO: 7545239 - DNA, 22 bp, Homo sapiens
ttgacaaaacaacacagatttc

SEQ ID NO: 7545240 - DNA, 22 bp, Homo sapiens
ttgacaaaacaacacagatttc

SEQ ID NO: 7545241 - DNA, 22 bp, Homo sapiens
ttgacaaaacaacacagatttc

SEQ ID NO: 7545242 - DNA, 22 bp, Homo sapiens
ttgacaaaacaacacagatttc

SEQ ID NO: 7545243 - DNA, 22 bp, Homo sapiens
ttgacaaaggaccttgctattt

SEQ ID NO: 7545244 - DNA, 22 bp, Homo sapiens
ttgacaaaggaccttgctattt

SEQ ID NO: 7545245 - DNA, 22 bp, Homo sapiens
ttgacaaaggaccttgctattt

SEQ ID NO: 7545246 - DNA, 22 bp, Homo sapiens
ttgacaaagtttagtaataatc

SEQ ID NO: 7545247 - DNA, 22 bp, Homo sapiens
ttgacaaaggctgagaggaaaa

SEQ ID NO: 7545248 - DNA, 22 bp, Homo sapiens
ttgacaaaggctgagaggaaaa

SEQ ID NO: 7545249 - DNA, 22 bp, Homo sapiens
ttgacaaaggctgagaggaaaa

SEQ ID NO: 7545250 - DNA, 22 bp, Homo sapiens
ttgacaaaggaattgaatctct

SEQ ID NO: 7545251 - DNA, 22 bp, Homo sapiens
ttgacaaaggaattgaatctct

SEQ ID NO: 7545252 - DNA, 22 bp, Homo sapiens
ttgacaaaggaattgaatctct

SEQ ID NO: 7545253 - DNA, 22 bp, Homo sapiens
ttgacaaagatatattcatgct

SEQ ID NO: 7545254 - DNA, 22 bp, Homo sapiens
ttgacaaagatatattcatgct

SEQ ID NO: 7545255 - DNA, 22 bp, Homo sapiens
ttgacaaagatatattcatgct

SEQ ID NO: 7545256 - DNA, 22 bp, Homo sapiens
ttgacaaagatatattcatgct

SEQ ID NO: 7545257 - DNA, 22 bp, Homo sapiens
ttgacaaagatatattcatgct

SEQ ID NO: 7545258 - DNA, 22 bp, Homo sapiens
ttgacaaatacccattagacca

SEQ ID NO: 7545259 - DNA, 22 bp, Homo sapiens
ttgacaaatacccattagacca

SEQ ID NO: 7545260 - DNA, 22 bp, Homo sapiens
ttgacaaagtttagtaataatc

SEQ ID NO: 7545261 - DNA, 22 bp, Homo sapiens
ttgacaaagtttagtaataatc

SEQ ID NO: 7545262 - DNA, 22 bp, Homo sapiens
ttgacaaagtttagtaataatc

SEQ ID NO: 7545263 - DNA, 22 bp, Homo sapiens
ttgacaaagtttagtaataatc

SEQ ID NO: 7545264 - DNA, 22 bp, Homo sapiens
ttgacaaagtttagtaataatc

SEQ ID NO: 7545265 - DNA, 22 bp, Homo sapiens
ttgacaaagtttagtaataatc

SEQ ID NO: 7545266 - DNA, 22 bp, Homo sapiens
ttgacaaagtttagtaataatc

SEQ ID NO: 7545267 - DNA, 22 bp, Homo sapiens
ttgacaatccctgttagaagtg

SEQ ID NO: 7545268 - DNA, 22 bp, Homo sapiens
ttgacaagcgaagtaccataat

SEQ ID NO: 7545269 - DNA, 22 bp, Homo sapiens
ttgacaaggagccattgcatct

SEQ ID NO: 7545270 - DNA, 22 bp, Homo sapiens
ttgacacagatcaatattcaac

SEQ ID NO: 7545271 - DNA, 22 bp, Homo sapiens
ttgacacagatcaatattcaac

SEQ ID NO: 7545272 - DNA, 22 bp, Homo sapiens
ttgacacagatcaatattcaac

SEQ ID NO: 7545273 - DNA, 22 bp, Homo sapiens
ttgacacagatcaatattcaac

SEQ ID NO: 7545274 - DNA, 22 bp, Homo sapiens
ttgacacaatcatggcagacat

SEQ ID NO: 7545275 - DNA, 22 bp, Homo sapiens
ttgacacaatcatggcagacat

SEQ ID NO: 7545276 - DNA, 22 bp, Homo sapiens
ttgacacaaacagtgatgtagt

SEQ ID NO: 7545277 - DNA, 22 bp, Homo sapiens
ttgacacaaacagtgatgtagt

SEQ ID NO: 7545278 - DNA, 22 bp, Homo sapiens
ttgacacaaacagtgatgtagt

SEQ ID NO: 7545279 - DNA, 22 bp, Homo sapiens
ttgacacaatgtatattttcaa

SEQ ID NO: 7545280 - DNA, 22 bp, Homo sapiens
ttgacacaatgtatattttcaa

SEQ ID NO: 7545281 - DNA, 22 bp, Homo sapiens
ttgacacaatgtatattttcaa

SEQ ID NO: 7545282 - DNA, 22 bp, Homo sapiens
ttgacacaatgtatattttcaa

SEQ ID NO: 7545283 - DNA, 22 bp, Homo sapiens
ttgacaatccctgttagaagtg

SEQ ID NO: 7545284 - DNA, 22 bp, Homo sapiens
ttgacaatgtcctttgaatttc

SEQ ID NO: 7545285 - DNA, 22 bp, Homo sapiens
ttgacaatgtcctttgaatttc

SEQ ID NO: 7545286 - DNA, 22 bp, Homo sapiens
ttgacaattgggagatataaag

SEQ ID NO: 7545287 - DNA, 22 bp, Homo sapiens
ttgacaatgtcctttgaatttc

SEQ ID NO: 7545288 - DNA, 22 bp, Homo sapiens
ttgtaagtcacaccagggcagg

SEQ ID NO: 7545289 - DNA, 22 bp, Homo sapiens
ttgtaatgagtggatcttaggg

SEQ ID NO: 7545290 - DNA, 22 bp, Homo sapiens
ttgtaatggagcaaacaggttg

SEQ ID NO: 7545291 - DNA, 22 bp, Homo sapiens
ttgtaaggtccttctgctgcag

SEQ ID NO: 7545292 - DNA, 22 bp, Homo sapiens
ttgtaagagagaattgcaaatt

SEQ ID NO: 7545293 - DNA, 22 bp, Homo sapiens
ttgtaagagagaattgcaaatt

SEQ ID NO: 7545294 - DNA, 22 bp, Homo sapiens
ttgtaagatggataggaacagc

SEQ ID NO: 7545295 - DNA, 22 bp, Homo sapiens
ttgtaagatggataggaacagc

SEQ ID NO: 7545296 - DNA, 22 bp, Homo sapiens
ttgtacaagtattatgtgaaca

SEQ ID NO: 7545297 - DNA, 22 bp, Homo sapiens
ttgtacaagtattatgtgaaca

SEQ ID NO: 7545298 - DNA, 22 bp, Homo sapiens
ttgtacaagtattatgtgaaca

SEQ ID NO: 7545299 - DNA, 22 bp, Homo sapiens
ttgtacaagtattatgtgaaca

SEQ ID NO: 7545300 - DNA, 22 bp, Homo sapiens
ttgtacaagttttgagcttaag

SEQ ID NO: 7545301 - DNA, 22 bp, Homo sapiens
ttgtacaagttttgagcttaag

SEQ ID NO: 7545302 - DNA, 22 bp, Homo sapiens
ttgtacaagttttgagcttaag

SEQ ID NO: 7545303 - DNA, 22 bp, Homo sapiens
ttgtacaagttttgagcttaag

SEQ ID NO: 7545304 - DNA, 22 bp, Homo sapiens
ttgtacagaccctgaaaagctc

SEQ ID NO: 7545305 - DNA, 22 bp, Homo sapiens
ttgtacagaccctgaaaagctc

SEQ ID NO: 7545306 - DNA, 22 bp, Homo sapiens
ttgtacagaccctgaaaagctc

SEQ ID NO: 7545307 - DNA, 19 bp, Homo sapiens
ttgtacagcaaccaaccct

SEQ ID NO: 7545308 - DNA, 19 bp, Homo sapiens
ttgtacagcaaccaaccct

SEQ ID NO: 7545309 - DNA, 19 bp, Homo sapiens
ttgtacagcaaccaaccct

SEQ ID NO: 7545310 - DNA, 22 bp, Homo sapiens
ttgtacagattttcctcggtct

SEQ ID NO: 7545311 - DNA, 22 bp, Homo sapiens
ttgtacagattttcctcggtct

SEQ ID NO: 7545312 - DNA, 22 bp, Homo sapiens
ttgtacactgttgatgggaatg

SEQ ID NO: 7545313 - DNA, 22 bp, Homo sapiens
ttgtacactgttgatgggaatg

SEQ ID NO: 7545314 - DNA, 22 bp, Homo sapiens
ttgtacactctttttattccgt

SEQ ID NO: 7545315 - DNA, 22 bp, Homo sapiens
ttgtacactctttttattccgt

SEQ ID NO: 7545316 - DNA, 22 bp, Homo sapiens
ttgtacagaaaaaattcttggt

SEQ ID NO: 7545317 - DNA, 22 bp, Homo sapiens
ttgtacagaaactgcatttgga

SEQ ID NO: 7545318 - DNA, 22 bp, Homo sapiens
ttgtacagaaactgcatttgga

SEQ ID NO: 7545319 - DNA, 22 bp, Homo sapiens
ttgtacagaaaaaattcttggt

SEQ ID NO: 7545320 - DNA, 22 bp, Homo sapiens
ttgtacagaaaaaattcttggt

SEQ ID NO: 7545321 - DNA, 22 bp, Homo sapiens
ttgtacacagcttgcggctata

SEQ ID NO: 7545322 - DNA, 21 bp, Homo sapiens
ttgtacacccacagatcagcc

SEQ ID NO: 7545323 - DNA, 21 bp, Homo sapiens
ttgtacacccacagatcagcc

SEQ ID NO: 7545324 - DNA, 22 bp, Homo sapiens
ttgtacacaattcttaacatac

SEQ ID NO: 7545325 - DNA, 22 bp, Homo sapiens
ttgtacacacaacaggaggtaa

SEQ ID NO: 7545326 - DNA, 22 bp, Homo sapiens
ttgtacacacaacaggaggtaa

SEQ ID NO: 7545327 - DNA, 22 bp, Homo sapiens
ttgtacacacaggaacaaacgt

SEQ ID NO: 7545328 - DNA, 22 bp, Homo sapiens
ttgtacacacaggaacaaacgt

SEQ ID NO: 7545329 - DNA, 22 bp, Homo sapiens
ttgtacacacaggaacaaacgt

SEQ ID NO: 7545330 - DNA, 22 bp, Homo sapiens
ttgtacacaattcttaacatac

SEQ ID NO: 7545331 - DNA, 22 bp, Homo sapiens
ttgtacacaattcttaacatac

SEQ ID NO: 7545332 - DNA, 22 bp, Homo sapiens
ttgtacacaattcttaacatac

SEQ ID NO: 7545333 - DNA, 22 bp, Homo sapiens
ttgtacaggttcctagggtgga

SEQ ID NO: 7545334 - DNA, 22 bp, Homo sapiens
ttgtacaggttcctagggtgga

SEQ ID NO: 7545335 - DNA, 22 bp, Homo sapiens
ttgtacaggttcctagggtgga

SEQ ID NO: 7545336 - DNA, 22 bp, Homo sapiens
ttgtacagggaagtaatacaag

SEQ ID NO: 7545337 - DNA, 22 bp, Homo sapiens
ttgtacataatgaaaggaggct

SEQ ID NO: 7545338 - DNA, 22 bp, Homo sapiens
ttgtacagtttaagtgggtgaa

SEQ ID NO: 7545339 - DNA, 22 bp, Homo sapiens
ttgtacagtttaagtgggtgaa

SEQ ID NO: 7545340 - DNA, 22 bp, Homo sapiens
ttgtacagtttaagtgggtgaa

SEQ ID NO: 7545341 - DNA, 22 bp, Homo sapiens
ttgtacagggaagtaatacaag

SEQ ID NO: 7545342 - DNA, 22 bp, Homo sapiens
ttgtacagggaagtaatacaag

SEQ ID NO: 7545343 - DNA, 23 bp, Homo sapiens
ttgtacagcccagattcctcttc

SEQ ID NO: 7545344 - DNA, 23 bp, Homo sapiens
ttgtacagcccagattcctcttc

SEQ ID NO: 7545345 - DNA, 23 bp, Homo sapiens
ttgtacagcccagattcctcttc

SEQ ID NO: 7545346 - DNA, 23 bp, Homo sapiens
ttgtacagcccagattcctcttc

SEQ ID NO: 7545347 - DNA, 22 bp, Homo sapiens
ttgtacagggaagtaatacaag

SEQ ID NO: 7545348 - DNA, 22 bp, Homo sapiens
ttgtacagggaagtaatacaag

SEQ ID NO: 7545349 - DNA, 22 bp, Homo sapiens
ttgtacagggaagtaatacaag

SEQ ID NO: 7545350 - DNA, 22 bp, Homo sapiens
ttgtacagggaagtaatacaag

SEQ ID NO: 7545351 - DNA, 22 bp, Homo sapiens
ttgtactatcaccatgtcatgt

SEQ ID NO: 7545352 - DNA, 22 bp, Homo sapiens
ttgtactatcaccatgtcatgt

SEQ ID NO: 7545353 - DNA, 21 bp, Homo sapiens
ttgtaccttagagcacaccct

SEQ ID NO: 7545354 - DNA, 21 bp, Homo sapiens
ttgtaccttagagcacaccct

SEQ ID NO: 7545355 - DNA, 23 bp, Homo sapiens
ttgtacctaattactagttccag

SEQ ID NO: 7545356 - DNA, 22 bp, Homo sapiens
ttgtacattctatgggtttgga

SEQ ID NO: 7545357 - DNA, 22 bp, Homo sapiens
ttgtacataatgaaaggaggct

SEQ ID NO: 7545358 - DNA, 22 bp, Homo sapiens
ttgtacatttgttcagttctga

SEQ ID NO: 7545359 - DNA, 22 bp, Homo sapiens
ttgtaccaacctaatagttcat

SEQ ID NO: 7545360 - DNA, 22 bp, Homo sapiens
ttgtacattctgaatctgtcct

SEQ ID NO: 7545361 - DNA, 22 bp, Homo sapiens
ttgtacattctgaatctgtcct

SEQ ID NO: 7545362 - DNA, 22 bp, Homo sapiens
ttgtatttctccactttctgtt

SEQ ID NO: 7545363 - DNA, 22 bp, Homo sapiens
ttgtatttctccactttctgtt

SEQ ID NO: 7545364 - DNA, 22 bp, Homo sapiens
ttgtatttctccactttctgtt

SEQ ID NO: 7545365 - DNA, 22 bp, Homo sapiens
ttgtatttctccactttctgtt

SEQ ID NO: 7545366 - DNA, 22 bp, Homo sapiens
ttgtatttcgatgcacgtgtag

SEQ ID NO: 7545367 - DNA, 22 bp, Homo sapiens
ttgtatttcgatgcacgtgtag

SEQ ID NO: 7545368 - DNA, 22 bp, Homo sapiens
ttgtatttcgatgcacgtgtag

SEQ ID NO: 7545369 - DNA, 22 bp, Homo sapiens
ttgtatttcctataacctttct

SEQ ID NO: 7545370 - DNA, 22 bp, Homo sapiens
ttgtatttcgatgcacgtgtag

SEQ ID NO: 7545371 - DNA, 22 bp, Homo sapiens
ttgtattttttcctggcggtgg

SEQ ID NO: 7545372 - DNA, 22 bp, Homo sapiens
ttgtattttttcctggcggtgg

SEQ ID NO: 7545373 - DNA, 22 bp, Homo sapiens
ttgtattttttcctggcggtgg

SEQ ID NO: 7545374 - DNA, 22 bp, Homo sapiens
ttgtattttttcctggcggtgg

SEQ ID NO: 7545375 - DNA, 23 bp, Homo sapiens
ttgtatttttagtagagacaggg

SEQ ID NO: 7545376 - DNA, 22 bp, Homo sapiens
ttgtatttctccactttctgtt

SEQ ID NO: 7545377 - DNA, 22 bp, Homo sapiens
ttgtatttctccactttctgtt

SEQ ID NO: 7545378 - DNA, 22 bp, Homo sapiens
ttgtaaatgaccttttctaatt

SEQ ID NO: 7545379 - DNA, 22 bp, Homo sapiens
ttgtaaatagtagtaagatgcc

SEQ ID NO: 7545380 - DNA, 22 bp, Homo sapiens
ttgtaaatgaccttttctaatt

SEQ ID NO: 7545381 - DNA, 22 bp, Homo sapiens
ttgtaaatgaccttttctaatt

SEQ ID NO: 7545382 - DNA, 22 bp, Homo sapiens
ttgtaaatagtagtaagatgcc

SEQ ID NO: 7545383 - DNA, 22 bp, Homo sapiens
ttgtaaatagtagtaagatgcc

SEQ ID NO: 7545384 - DNA, 22 bp, Homo sapiens
ttgtaaatagtagtaagatgcc

SEQ ID NO: 7545385 - DNA, 22 bp, Homo sapiens
ttgtaaatagtagtaagatgcc

SEQ ID NO: 7545386 - DNA, 22 bp, Homo sapiens
ttgtaaatagtagtaagatgcc

SEQ ID NO: 7545387 - DNA, 22 bp, Homo sapiens
ttgtaaacttgtttgaaggtat

SEQ ID NO: 7545388 - DNA, 22 bp, Homo sapiens
ttgtaaagctttgagactacat

SEQ ID NO: 7545389 - DNA, 21 bp, Homo sapiens
ttgtaaaggtttagaagaatg

SEQ ID NO: 7545390 - DNA, 22 bp, Homo sapiens
ttgtaaacatctgttgcttaga

SEQ ID NO: 7545391 - DNA, 22 bp, Homo sapiens
ttgtaaacatagagatttaggt

SEQ ID NO: 7545392 - DNA, 20 bp, Homo sapiens
ttgggcctgtcagcactccc

SEQ ID NO: 7545393 - DNA, 22 bp, Homo sapiens
ttgtaaacatagagatttaggt

SEQ ID NO: 7545394 - DNA, 20 bp, Homo sapiens
ttgggcctgtcagcactccc

SEQ ID NO: 7545395 - DNA, 22 bp, Homo sapiens
ttgtaaactgctgcaggagtgc

SEQ ID NO: 7545396 - DNA, 22 bp, Homo sapiens
ttgtaaactggatagacctatt

SEQ ID NO: 7545397 - DNA, 22 bp, Homo sapiens
ttgtaaactgttaaaagccaga

SEQ ID NO: 7545398 - DNA, 22 bp, Homo sapiens
ttgtaaactgttaaaagccaga

SEQ ID NO: 7545399 - DNA, 22 bp, Homo sapiens
ttgtaaacttgtttgaaggtat

SEQ ID NO: 7545400 - DNA, 22 bp, Homo sapiens
ttgggcctcggccaaggacggg

SEQ ID NO: 7545401 - DNA, 22 bp, Homo sapiens
ttgggcctcggccaaggacggg

SEQ ID NO: 7545402 - DNA, 22 bp, Homo sapiens
ttgggcctcactctagaaggca

SEQ ID NO: 7545403 - DNA, 22 bp, Homo sapiens
ttgggccctgctctgagttgct

SEQ ID NO: 7545404 - DNA, 22 bp, Homo sapiens
ttgggccctgctctgagttgct

SEQ ID NO: 7545405 - DNA, 22 bp, Homo sapiens
ttgggccctgctctgagttgct

SEQ ID NO: 7545406 - DNA, 22 bp, Homo sapiens
ttgggcctctcaaagtgctggg

SEQ ID NO: 7545407 - DNA, 22 bp, Homo sapiens
ttgggcctctcaaagtgctggg

SEQ ID NO: 7545408 - DNA, 22 bp, Homo sapiens
ttgggcctctcaaagtgctggg

SEQ ID NO: 7545409 - DNA, 22 bp, Homo sapiens
ttgggcctgatcggaataagga

SEQ ID NO: 7545410 - DNA, 22 bp, Homo sapiens
ttgggcctgatcggaataagga

SEQ ID NO: 7545411 - DNA, 22 bp, Homo sapiens
ttgggcctgatcggaataagga

SEQ ID NO: 7545412 - DNA, 22 bp, Homo sapiens
ttgggcctggggtagtgtcgga

SEQ ID NO: 7545413 - DNA, 22 bp, Homo sapiens
ttgggcctggggtagtgtcgga

SEQ ID NO: 7545414 - DNA, 22 bp, Homo sapiens
ttgggcctggggtagtgtcgga

SEQ ID NO: 7545415 - DNA, 22 bp, Homo sapiens
ttgtaagactgtagaatgcaaa

SEQ ID NO: 7545416 - DNA, 22 bp, Homo sapiens
ttgtaagactgtagaatgcaaa

SEQ ID NO: 7545417 - DNA, 22 bp, Homo sapiens
ttgtaagaatatgaatacaaat

SEQ ID NO: 7545418 - DNA, 22 bp, Homo sapiens
ttgtaacttaagttttgcatat

SEQ ID NO: 7545419 - DNA, 22 bp, Homo sapiens
ttgtaacatcaccatcaaaatc

SEQ ID NO: 7545420 - DNA, 22 bp, Homo sapiens
ttgtaacatcaccatcaaaatc

SEQ ID NO: 7545421 - DNA, 22 bp, Homo sapiens
ttgtaacatcaccatcaaaatc

SEQ ID NO: 7545422 - DNA, 22 bp, Homo sapiens
ttgtaacagtagctgtcagctc

SEQ ID NO: 7545423 - DNA, 22 bp, Homo sapiens
ttgtaacatcaccatcaaaatc

SEQ ID NO: 7545424 - DNA, 22 bp, Homo sapiens
ttgtaacatcaccatcaaaatc

SEQ ID NO: 7545425 - DNA, 22 bp, Homo sapiens
ttgtaacatcaccatcaaaatc

SEQ ID NO: 7545426 - DNA, 22 bp, Homo sapiens
ttgtaacaggtactaaataact

SEQ ID NO: 7545427 - DNA, 22 bp, Homo sapiens
ttgtaacaggtactaaataact

SEQ ID NO: 7545428 - DNA, 22 bp, Homo sapiens
ttgtaacagtagctgtcagctc

SEQ ID NO: 7545429 - DNA, 22 bp, Homo sapiens
ttgtaacaggtactaaataact

SEQ ID NO: 7545430 - DNA, 22 bp, Homo sapiens
ttgtaacaggtactaaataact

SEQ ID NO: 7545431 - DNA, 22 bp, Homo sapiens
ttgtaacaggcactctgtgcca

SEQ ID NO: 7545432 - DNA, 22 bp, Homo sapiens
ttgtaacaggtactaaataact

SEQ ID NO: 7545433 - DNA, 22 bp, Homo sapiens
ttgtaacaggtactaaataact

SEQ ID NO: 7545434 - DNA, 22 bp, Homo sapiens
ttgtaacaggtactaaataact

SEQ ID NO: 7545435 - DNA, 22 bp, Homo sapiens
ttgtaacagctgcttaatagag

SEQ ID NO: 7545436 - DNA, 22 bp, Homo sapiens
ttgtaacagctgcttaatagag

SEQ ID NO: 7545437 - DNA, 22 bp, Homo sapiens
ttgtaacagctgcttaatagag

SEQ ID NO: 7545438 - DNA, 22 bp, Homo sapiens
ttgtaacacttttctattaata

SEQ ID NO: 7545439 - DNA, 22 bp, Homo sapiens
ttgtaacacttttctattaata

SEQ ID NO: 7545440 - DNA, 22 bp, Homo sapiens
ttgtaacacttttctattaata

SEQ ID NO: 7545441 - DNA, 22 bp, Homo sapiens
ttgtaacacttttctattaata

SEQ ID NO: 7545442 - DNA, 22 bp, Homo sapiens
ttgtaacagctgcttaatagag

SEQ ID NO: 7545443 - DNA, 22 bp, Homo sapiens
ttgtaacagctgtttatatagt

SEQ ID NO: 7545444 - DNA, 22 bp, Homo sapiens
ttgtaacagctgtttatatagt

SEQ ID NO: 7545445 - DNA, 22 bp, Homo sapiens
ttgtaacagctgtttatatagt

SEQ ID NO: 7545446 - DNA, 22 bp, Homo sapiens
ttgtaacagctgtttatatagt

SEQ ID NO: 7545447 - DNA, 22 bp, Homo sapiens
ttgtaacagctgtttatatagt

SEQ ID NO: 7545448 - DNA, 22 bp, Homo sapiens
ttgtaacagctgtttatatagt

SEQ ID NO: 7545449 - DNA, 22 bp, Homo sapiens
ttgtaacaggcactctgtgcca

SEQ ID NO: 7545450 - DNA, 22 bp, Homo sapiens
ttgtaacaatctgtcataaatg

SEQ ID NO: 7545451 - DNA, 22 bp, Homo sapiens
ttgtaacaatctgtcataaatg

SEQ ID NO: 7545452 - DNA, 22 bp, Homo sapiens
ttgtaacaatctgtcataaatg

SEQ ID NO: 7545453 - DNA, 22 bp, Homo sapiens
ttgtaacaatctgtcataaatg

SEQ ID NO: 7545454 - DNA, 22 bp, Homo sapiens
ttgtaacactcccactcttctt

SEQ ID NO: 7545455 - DNA, 21 bp, Homo sapiens
ttgtaaatggctttttccttc

SEQ ID NO: 7545456 - DNA, 22 bp, Homo sapiens
ttgtaacaaagacactccaaaa

SEQ ID NO: 7545457 - DNA, 22 bp, Homo sapiens
ttgtaacaaagacactccaaaa

SEQ ID NO: 7545458 - DNA, 22 bp, Homo sapiens
ttgtaacaatctgtcataaatg

SEQ ID NO: 7545459 - DNA, 22 bp, Homo sapiens
ttgtaacaatctgtcataaatg

SEQ ID NO: 7545460 - DNA, 22 bp, Homo sapiens
ttgtcaagaaaaatggatgaag

SEQ ID NO: 7545461 - DNA, 22 bp, Homo sapiens
ttgtcaagattgagagatgact

SEQ ID NO: 7545462 - DNA, 22 bp, Homo sapiens
ttgtcaagaaaaatggatgaag

SEQ ID NO: 7545463 - DNA, 22 bp, Homo sapiens
ttgtcaagattgagagatgact

SEQ ID NO: 7545464 - DNA, 22 bp, Homo sapiens
ttgtcaaggcttttaatattct

SEQ ID NO: 7545465 - DNA, 22 bp, Homo sapiens
ttgtcaagtaaggctgacattt

SEQ ID NO: 7545466 - DNA, 22 bp, Homo sapiens
ttgtcaagtaaggctgacattt

SEQ ID NO: 7545467 - DNA, 19 bp, Homo sapiens
ttgtcacaattcatcaggt

SEQ ID NO: 7545468 - DNA, 19 bp, Homo sapiens
ttgtcacaattcatcaggt

SEQ ID NO: 7545469 - DNA, 20 bp, Homo sapiens
ttgtcacagctttccatcag

SEQ ID NO: 7545470 - DNA, 22 bp, Homo sapiens
ttgtcacattcaagttttatat

SEQ ID NO: 7545471 - DNA, 22 bp, Homo sapiens
ttgtcacattcaagttttatat

SEQ ID NO: 7545472 - DNA, 20 bp, Homo sapiens
ttgtcacagctttccatcag

SEQ ID NO: 7545473 - DNA, 22 bp, Homo sapiens
ttgtcacatgtagttcattctc

SEQ ID NO: 7545474 - DNA, 17 bp, Homo sapiens
ttgtcacaggtggtggt

SEQ ID NO: 7545475 - DNA, 22 bp, Homo sapiens
ttgtcatagcttcatgggtagc

SEQ ID NO: 7545476 - DNA, 22 bp, Homo sapiens
ttgtcagggactggaaaagaaa

SEQ ID NO: 7545477 - DNA, 22 bp, Homo sapiens
ttgtcatcatcctctttggggt

SEQ ID NO: 7545478 - DNA, 22 bp, Homo sapiens
ttgtcatgagtcacaaaaataa

SEQ ID NO: 7545479 - DNA, 22 bp, Homo sapiens
ttgtcatgatccttctgttagg

SEQ ID NO: 7545480 - DNA, 22 bp, Homo sapiens
ttgtcatggatggaagggatat

SEQ ID NO: 7545481 - DNA, 22 bp, Homo sapiens
ttgtcattggggttatttgtta

SEQ ID NO: 7545482 - DNA, 22 bp, Homo sapiens
ttgtcattggggttatttgtta

SEQ ID NO: 7545483 - DNA, 22 bp, Homo sapiens
ttgtcattggggttatttgtta

SEQ ID NO: 7545484 - DNA, 22 bp, Homo sapiens
ttgtccaaggtcccacagttag

SEQ ID NO: 7545485 - DNA, 22 bp, Homo sapiens
ttgtccaaagtaacacatctag

SEQ ID NO: 7545486 - DNA, 22 bp, Homo sapiens
ttgtccagaaaaaagccaaggg

SEQ ID NO: 7545487 - DNA, 19 bp, Homo sapiens
ttgtccagaaaggcattgc

SEQ ID NO: 7545488 - DNA, 19 bp, Homo sapiens
ttgtccagaaaggcattgc

SEQ ID NO: 7545489 - DNA, 22 bp, Homo sapiens
ttgtccattttattggatggtg

SEQ ID NO: 7545490 - DNA, 22 bp, Homo sapiens
ttgtccattgtgacaagtgtgg

SEQ ID NO: 7545491 - DNA, 22 bp, Homo sapiens
ttgtccattttattggatggtg

SEQ ID NO: 7545492 - DNA, 22 bp, Homo sapiens
ttgtccatctgtatttcccatg

SEQ ID NO: 7545493 - DNA, 22 bp, Homo sapiens
ttgtccatggacagcaccacag

SEQ ID NO: 7545494 - DNA, 22 bp, Homo sapiens
ttgtccatggacagcaccacag

SEQ ID NO: 7545495 - DNA, 22 bp, Homo sapiens
ttgtccagaacatcggggttgc

SEQ ID NO: 7545496 - DNA, 22 bp, Homo sapiens
ttgtccagagccaggctgtcgg

SEQ ID NO: 7545497 - DNA, 22 bp, Homo sapiens
ttgtccagcagctcagtctacg

SEQ ID NO: 7545498 - DNA, 22 bp, Homo sapiens
ttgtccagcagctcagtctacg

SEQ ID NO: 7545499 - DNA, 23 bp, Homo sapiens
ttgtccagctggtttgggccaca

SEQ ID NO: 7545500 - DNA, 23 bp, Homo sapiens
ttgtccagctggtttgggccaca

SEQ ID NO: 7545501 - DNA, 23 bp, Homo sapiens
ttgtccagctggtttgggccaca

SEQ ID NO: 7545502 - DNA, 23 bp, Homo sapiens
ttgtccagctggtttgggccaca

SEQ ID NO: 7545503 - DNA, 22 bp, Homo sapiens
ttgtccagtttctagaggcctc

SEQ ID NO: 7545504 - DNA, 22 bp, Homo sapiens
ttgtccatctgtatttcccatg

SEQ ID NO: 7545505 - DNA, 22 bp, Homo sapiens
ttgtcctggaggttaatagagt

SEQ ID NO: 7545506 - DNA, 22 bp, Homo sapiens
ttgtcctggaggttaatagagt

SEQ ID NO: 7545507 - DNA, 23 bp, Homo sapiens
ttgtcctgccgatctctgagaat

SEQ ID NO: 7545508 - DNA, 23 bp, Homo sapiens
ttgtcctgccgatctctgagaat

SEQ ID NO: 7545509 - DNA, 22 bp, Homo sapiens
ttgtcctggaggttaatagagt

SEQ ID NO: 7545510 - DNA, 22 bp, Homo sapiens
ttgtcctgtcaggctgggggct

SEQ ID NO: 7545511 - DNA, 22 bp, Homo sapiens
ttgtcctgtgatttcagggcct

SEQ ID NO: 7545512 - DNA, 23 bp, Homo sapiens
ttgtcctgccgatctctgagaat

SEQ ID NO: 7545513 - DNA, 22 bp, Homo sapiens
ttgtcctgcaacctcacatggc

SEQ ID NO: 7545514 - DNA, 22 bp, Homo sapiens
ttgtcctgattttgcaacttct

SEQ ID NO: 7545515 - DNA, 22 bp, Homo sapiens
ttgtcctgcaacctcacatggc

SEQ ID NO: 7545516 - DNA, 22 bp, Homo sapiens
ttgtcctgcaacctcacatggc

SEQ ID NO: 7545517 - DNA, 22 bp, Homo sapiens
ttgtcctgcaacctcacatggc

SEQ ID NO: 7545518 - DNA, 22 bp, Homo sapiens
ttgtgggatctccctgttgctc

SEQ ID NO: 7545519 - DNA, 22 bp, Homo sapiens
ttgtgggatggctcttcccaaa

SEQ ID NO: 7545520 - DNA, 22 bp, Homo sapiens
ttgtgggatctccctgttgctc

SEQ ID NO: 7545521 - DNA, 16 bp, Homo sapiens
ttgtggcttttgcaca

SEQ ID NO: 7545522 - DNA, 20 bp, Homo sapiens
ttgtgtaggtctaatgcata

SEQ ID NO: 7545523 - DNA, 20 bp, Homo sapiens
ttgtgtaggtctaatgcata

SEQ ID NO: 7545524 - DNA, 22 bp, Homo sapiens
ttgtgtagctaaaaccaagaaa

SEQ ID NO: 7545525 - DNA, 22 bp, Homo sapiens
ttgtgtagctaaaaccaagaaa

SEQ ID NO: 7545526 - DNA, 22 bp, Homo sapiens
ttgtgtatttcctgaaggtaag

SEQ ID NO: 7545527 - DNA, 22 bp, Homo sapiens
ttgtgtattttttgatactaac

SEQ ID NO: 7545528 - DNA, 22 bp, Homo sapiens
ttgtgtcatgttccattgaaaa

SEQ ID NO: 7545529 - DNA, 22 bp, Homo sapiens
ttgtgtatttcctgaaggtaag

SEQ ID NO: 7545530 - DNA, 22 bp, Homo sapiens
ttgtggctgtcgagaattgagg

SEQ ID NO: 7545531 - DNA, 22 bp, Homo sapiens
ttgtggctgtcgagaattgagg

SEQ ID NO: 7545532 - DNA, 22 bp, Homo sapiens
ttgtggctgtgcaccgctgcct

SEQ ID NO: 7545533 - DNA, 22 bp, Homo sapiens
ttgtggcttctacgcccacagg

SEQ ID NO: 7545534 - DNA, 22 bp, Homo sapiens
ttgtggctcgtgagatgttagg

SEQ ID NO: 7545535 - DNA, 22 bp, Homo sapiens
ttgtggctcgtgagatgttagg

SEQ ID NO: 7545536 - DNA, 22 bp, Homo sapiens
ttgtggctcgtgagatgttagg

SEQ ID NO: 7545537 - DNA, 22 bp, Homo sapiens
ttgtggctcttgaggctctcgt

SEQ ID NO: 7545538 - DNA, 22 bp, Homo sapiens
ttgtggctcatcttcagctccc

SEQ ID NO: 7545539 - DNA, 22 bp, Homo sapiens
ttgtggcatgtgagaactagaa

SEQ ID NO: 7545540 - DNA, 22 bp, Homo sapiens
ttgtggcatgtgagaactagaa

SEQ ID NO: 7545541 - DNA, 22 bp, Homo sapiens
ttgtcctgtgatttcagggcct

SEQ ID NO: 7545542 - DNA, 22 bp, Homo sapiens
ttgtcctgtgtctgtttggatt

SEQ ID NO: 7545543 - DNA, 22 bp, Homo sapiens
ttgtcctgtgtctgtttggatt

SEQ ID NO: 7545544 - DNA, 22 bp, Homo sapiens
ttgtcctgttacttgtttggat

SEQ ID NO: 7545545 - DNA, 22 bp, Homo sapiens
ttgtgtctatggtttgagcatc

SEQ ID NO: 7545546 - DNA, 22 bp, Homo sapiens
ttgtgtctggaatgcgtggagc

SEQ ID NO: 7545547 - DNA, 22 bp, Homo sapiens
ttgtgtctatggtttgagcatc

SEQ ID NO: 7545548 - DNA, 23 bp, Homo sapiens
ttgtgtctacttcctatctaggg

SEQ ID NO: 7545549 - DNA, 23 bp, Homo sapiens
ttgtgtctacttcctatctaggg

SEQ ID NO: 7545550 - DNA, 23 bp, Homo sapiens
ttgtgtctacttcctatctaggg

SEQ ID NO: 7545551 - DNA, 23 bp, Homo sapiens
ttgtgtctacttcctatctaggg

SEQ ID NO: 7545552 - DNA, 23 bp, Homo sapiens
ttgtgtctacttcctatctaggg

SEQ ID NO: 7545553 - DNA, 22 bp, Homo sapiens
ttgtgtctaaataaggagacct

SEQ ID NO: 7545554 - DNA, 22 bp, Homo sapiens
ttgtgtctaaataaggagacct

SEQ ID NO: 7545555 - DNA, 22 bp, Homo sapiens
ttgtgtctaaataaggagacct

SEQ ID NO: 7545556 - DNA, 22 bp, Homo sapiens
ttgtgtctggatttcagctttc

SEQ ID NO: 7545557 - DNA, 22 bp, Homo sapiens
ttgtgtctatggtttgagcatc

SEQ ID NO: 7545558 - DNA, 22 bp, Homo sapiens
ttgtgtctggaatgcgtggagc

SEQ ID NO: 7545559 - DNA, 22 bp, Homo sapiens
ttgtgtctgggggagtgacatc

SEQ ID NO: 7545560 - DNA, 22 bp, Homo sapiens
ttgtgtctggatttcagctttc

SEQ ID NO: 7545561 - DNA, 22 bp, Homo sapiens
ttgtgtctggatttcagctttc

SEQ ID NO: 7545562 - DNA, 22 bp, Homo sapiens
ttgtgtcttaaagattaaatgg

SEQ ID NO: 7545563 - DNA, 22 bp, Homo sapiens
ttgtgtctgggggagtgacatc

SEQ ID NO: 7545564 - DNA, 22 bp, Homo sapiens
ttgtgtctgggggagtgacatc

SEQ ID NO: 7545565 - DNA, 22 bp, Homo sapiens
ttgtgtctgggggagtgacatc

SEQ ID NO: 7545566 - DNA, 22 bp, Homo sapiens
ttgtgtctaaataaggagacct

SEQ ID NO: 7545567 - DNA, 22 bp, Homo sapiens
ttgtgtcctaagcaccagatgg

SEQ ID NO: 7545568 - DNA, 22 bp, Homo sapiens
ttgtgtccccctttgagagcca

SEQ ID NO: 7545569 - DNA, 22 bp, Homo sapiens
ttgggacatgtaagctggaagt

SEQ ID NO: 7545570 - DNA, 22 bp, Homo sapiens
ttgggacattatcagtctgcag

SEQ ID NO: 7545571 - DNA, 22 bp, Homo sapiens
ttgggacattatcagtctgcag

SEQ ID NO: 7545572 - DNA, 22 bp, Homo sapiens
ttgggacattatcagtctgcag

SEQ ID NO: 7545573 - DNA, 22 bp, Homo sapiens
ttgggacattatcagtctgcag

SEQ ID NO: 7545574 - DNA, 22 bp, Homo sapiens
ttgggacattatcagtctgcag

SEQ ID NO: 7545575 - DNA, 22 bp, Homo sapiens
ttgggacatctggcatacagtt

SEQ ID NO: 7545576 - DNA, 22 bp, Homo sapiens
ttgggacatgtaagctggaagt

SEQ ID NO: 7545577 - DNA, 22 bp, Homo sapiens
ttgggacatgtaagctggaagt

SEQ ID NO: 7545578 - DNA, 22 bp, Homo sapiens
ttgggacatctggcatacagtt

SEQ ID NO: 7545579 - DNA, 17 bp, Homo sapiens
ttgggagagaaaggtat

SEQ ID NO: 7545580 - DNA, 17 bp, Homo sapiens
ttgggagagaaaggtat

SEQ ID NO: 7545581 - DNA, 22 bp, Homo sapiens
ttgggagacaaaggctctgtct

SEQ ID NO: 7545582 - DNA, 22 bp, Homo sapiens
ttgggagacaaaggctctgtct

SEQ ID NO: 7545583 - DNA, 22 bp, Homo sapiens
ttgggagacaaaggctctgtct

SEQ ID NO: 7545584 - DNA, 22 bp, Homo sapiens
ttgggagacaaaggctctgtct

SEQ ID NO: 7545585 - DNA, 17 bp, Homo sapiens
ttgggagagaaaggtat

SEQ ID NO: 7545586 - DNA, 17 bp, Homo sapiens
ttgggagagaaaggtat

SEQ ID NO: 7545587 - DNA, 22 bp, Homo sapiens
ttgggagacaaaggctctgtct

SEQ ID NO: 7545588 - DNA, 22 bp, Homo sapiens
ttgggagacaaaggctctgtct

SEQ ID NO: 7545589 - DNA, 22 bp, Homo sapiens
ttgggagaaatagttgatccgc

SEQ ID NO: 7545590 - DNA, 22 bp, Homo sapiens
ttgggagaaggctgggacttta

SEQ ID NO: 7545591 - DNA, 22 bp, Homo sapiens
ttgggagaaatagttgatccgc

SEQ ID NO: 7545592 - DNA, 22 bp, Homo sapiens
ttgggagaaatagttgatccgc

SEQ ID NO: 7545593 - DNA, 22 bp, Homo sapiens
ttgggagaaatagttgatccgc

SEQ ID NO: 7545594 - DNA, 22 bp, Homo sapiens
ttgggagaaggctgggacttta

SEQ ID NO: 7545595 - DNA, 22 bp, Homo sapiens
ttgggagctggaagcaaggcct

SEQ ID NO: 7545596 - DNA, 22 bp, Homo sapiens
ttgggagcttggacttagtgtg

SEQ ID NO: 7545597 - DNA, 22 bp, Homo sapiens
ttgggagcttggacttagtgtg

SEQ ID NO: 7545598 - DNA, 22 bp, Homo sapiens
ttgggagcaaataggaaagagg

SEQ ID NO: 7545599 - DNA, 22 bp, Homo sapiens
ttgggagcatttagaaaagacg

SEQ ID NO: 7545600 - DNA, 22 bp, Homo sapiens
ttgggagctggaagcaaggcct

SEQ ID NO: 7545601 - DNA, 22 bp, Homo sapiens
ttgggagctggaagcaaggcct

SEQ ID NO: 7545602 - DNA, 22 bp, Homo sapiens
ttgggagattcattgagccaag

SEQ ID NO: 7545603 - DNA, 22 bp, Homo sapiens
ttgggagattcattgagccaag

SEQ ID NO: 7545604 - DNA, 22 bp, Homo sapiens
ttgggagattcattgagccaag

SEQ ID NO: 7545605 - DNA, 22 bp, Homo sapiens
ttgggagattcattgagccaag

SEQ ID NO: 7545606 - DNA, 22 bp, Homo sapiens
ttgggagattcattgagccaag

SEQ ID NO: 7545607 - DNA, 22 bp, Homo sapiens
ttgggagatattgttctttaca

SEQ ID NO: 7545608 - DNA, 22 bp, Homo sapiens
ttgggagatattgttctttaca

SEQ ID NO: 7545609 - DNA, 22 bp, Homo sapiens
ttgggagatggggagataatat

SEQ ID NO: 7545610 - DNA, 22 bp, Homo sapiens
ttgggagatggggagataatat

SEQ ID NO: 7545611 - DNA, 22 bp, Homo sapiens
ttgggagatggggagataatat

SEQ ID NO: 7545612 - DNA, 17 bp, Homo sapiens
ttgggagagaaaggtat

SEQ ID NO: 7545613 - DNA, 22 bp, Homo sapiens
ttgggagagtttacatcctttt

SEQ ID NO: 7545614 - DNA, 22 bp, Homo sapiens
ttgggagagtttacatcctttt

SEQ ID NO: 7545615 - DNA, 22 bp, Homo sapiens
ttgggagagtttacatcctttt

SEQ ID NO: 7545616 - DNA, 22 bp, Homo sapiens
ttgggagatagggtaatttagc

SEQ ID NO: 7545617 - DNA, 22 bp, Homo sapiens
ttgggagatagggtaatttagc

SEQ ID NO: 7545618 - DNA, 22 bp, Homo sapiens
ttgggagatagggtaatttagc

SEQ ID NO: 7545619 - DNA, 22 bp, Homo sapiens
ttgggagatattgttctttaca

SEQ ID NO: 7545620 - DNA, 22 bp, Homo sapiens
ttgggagatattgttctttaca

SEQ ID NO: 7545621 - DNA, 22 bp, Homo sapiens
ttgggccactttagtttcctta

SEQ ID NO: 7545622 - DNA, 22 bp, Homo sapiens
ttgggccactttagtttcctta

SEQ ID NO: 7545623 - DNA, 20 bp, Homo sapiens
ttgggccacactgattcagc

SEQ ID NO: 7545624 - DNA, 22 bp, Homo sapiens
ttgggccaaagatgtccttgtt

SEQ ID NO: 7545625 - DNA, 22 bp, Homo sapiens
ttgggccaaatagctatttact

SEQ ID NO: 7545626 - DNA, 22 bp, Homo sapiens
ttgggccaaatagctatttact

SEQ ID NO: 7545627 - DNA, 22 bp, Homo sapiens
ttgggccaaggcagatctccaa

SEQ ID NO: 7545628 - DNA, 22 bp, Homo sapiens
ttgggccaaggcagatctccaa

SEQ ID NO: 7545629 - DNA, 22 bp, Homo sapiens
ttgggcagtctggctgcagagt

SEQ ID NO: 7545630 - DNA, 22 bp, Homo sapiens
ttgggcagtctggctgcagagt

SEQ ID NO: 7545631 - DNA, 22 bp, Homo sapiens
ttgggcagtctggctgcagagt

SEQ ID NO: 7545632 - DNA, 22 bp, Homo sapiens
ttgggcagtctggctgcagagt

SEQ ID NO: 7545633 - DNA, 22 bp, Homo sapiens
ttgggcagtgattagttcatga

SEQ ID NO: 7545634 - DNA, 22 bp, Homo sapiens
ttgggcagtgattagttcatga

SEQ ID NO: 7545635 - DNA, 22 bp, Homo sapiens
ttgggcagtgattagttcatga

SEQ ID NO: 7545636 - DNA, 22 bp, Homo sapiens
ttgggcagtgattagttcatga

SEQ ID NO: 7545637 - DNA, 22 bp, Homo sapiens
ttgggccaaagatgtccttgtt

SEQ ID NO: 7545638 - DNA, 22 bp, Homo sapiens
ttgggccaaagatgtccttgtt

SEQ ID NO: 7545639 - DNA, 22 bp, Homo sapiens
ttgggcagtgattagttcatga

SEQ ID NO: 7545640 - DNA, 22 bp, Homo sapiens
ttgggcagtgattagttcatga

SEQ ID NO: 7545641 - DNA, 22 bp, Homo sapiens
ttgggcagggaaaggacaggca

SEQ ID NO: 7545642 - DNA, 22 bp, Homo sapiens
ttgggcagggaaaggacaggca

SEQ ID NO: 7545643 - DNA, 22 bp, Homo sapiens
ttgggcagggaaaggacaggca

SEQ ID NO: 7545644 - DNA, 22 bp, Homo sapiens
ttgggcagggaaaggacaggca

SEQ ID NO: 7545645 - DNA, 22 bp, Homo sapiens
ttgggagcttggccgagatgta

SEQ ID NO: 7545646 - DNA, 22 bp, Homo sapiens
ttgggaggtaatggagccaagt

SEQ ID NO: 7545647 - DNA, 22 bp, Homo sapiens
ttgggaggtaatggagccaagt

SEQ ID NO: 7545648 - DNA, 22 bp, Homo sapiens
ttgggaggtaatggagccaagt

SEQ ID NO: 7545649 - DNA, 22 bp, Homo sapiens
ttgggaggtaatggagccaagt

SEQ ID NO: 7545650 - DNA, 22 bp, Homo sapiens
ttgggcagggaaaggacaggca

SEQ ID NO: 7545651 - DNA, 22 bp, Homo sapiens
ttgggcagggaaaggacaggca

SEQ ID NO: 7545652 - DNA, 22 bp, Homo sapiens
ttgggcaggtgaagagagggct

SEQ ID NO: 7545653 - DNA, 22 bp, Homo sapiens
ttgggcaggtgaagagagggct

SEQ ID NO: 7545654 - DNA, 22 bp, Homo sapiens
ttgggcaggtgaagagagggct

SEQ ID NO: 7545655 - DNA, 22 bp, Homo sapiens
ttgggcaggtgaagagagggct

SEQ ID NO: 7545656 - DNA, 22 bp, Homo sapiens
ttgggcaggtgaagagagggct

SEQ ID NO: 7545657 - DNA, 22 bp, Homo sapiens
ttgggcaggtgtggctctcctt

SEQ ID NO: 7545658 - DNA, 22 bp, Homo sapiens
ttgggcagtagcctcttggtgt

SEQ ID NO: 7545659 - DNA, 22 bp, Homo sapiens
ttgggcagtagcctcttggtgt

SEQ ID NO: 7545660 - DNA, 22 bp, Homo sapiens
ttgggcagtagcctcttggtgt

SEQ ID NO: 7545661 - DNA, 22 bp, Homo sapiens
ttgggcagtagcctcttggtgt

SEQ ID NO: 7545662 - DNA, 22 bp, Homo sapiens
ttgggcaggtgtggctctcctt

SEQ ID NO: 7545663 - DNA, 22 bp, Homo sapiens
ttgggcaggtgtggctctcctt

SEQ ID NO: 7545664 - DNA, 22 bp, Homo sapiens
ttggccatctaagcccagccac

SEQ ID NO: 7545665 - DNA, 22 bp, Homo sapiens
ttggccatctaagcccagccac

SEQ ID NO: 7545666 - DNA, 22 bp, Homo sapiens
ttggccagtggaaagaggagga

SEQ ID NO: 7545667 - DNA, 22 bp, Homo sapiens
ttggccatctaagcccagccac

SEQ ID NO: 7545668 - DNA, 22 bp, Homo sapiens
ttggccagtggaaagaggagga

SEQ ID NO: 7545669 - DNA, 22 bp, Homo sapiens
ttggccagtggaaagaggagga

SEQ ID NO: 7545670 - DNA, 22 bp, Homo sapiens
ttggccagtggaaagaggagga

SEQ ID NO: 7545671 - DNA, 22 bp, Homo sapiens
ttggccagtgaaccaggcctgg

SEQ ID NO: 7545672 - DNA, 22 bp, Homo sapiens
ttggccagtgaaccaggcctgg

SEQ ID NO: 7545673 - DNA, 22 bp, Homo sapiens
ttggccagtgcttgtgattttc

SEQ ID NO: 7545674 - DNA, 22 bp, Homo sapiens
ttggccagtgaaccaggcctgg

SEQ ID NO: 7545675 - DNA, 22 bp, Homo sapiens
ttggccagtgcttgtgattttc

SEQ ID NO: 7545676 - DNA, 22 bp, Homo sapiens
ttggccagtgaaccaggcctgg

SEQ ID NO: 7545677 - DNA, 22 bp, Homo sapiens
ttggccaggtgtccagcccagg

SEQ ID NO: 7545678 - DNA, 22 bp, Homo sapiens
ttggccaggtgtccagcccagg

SEQ ID NO: 7545679 - DNA, 22 bp, Homo sapiens
ttggccaggtgtccagcccagg

SEQ ID NO: 7545680 - DNA, 22 bp, Homo sapiens
ttggccaggtgtaggtcacacc

SEQ ID NO: 7545681 - DNA, 22 bp, Homo sapiens
ttggcatcagtgtaggacctgt

SEQ ID NO: 7545682 - DNA, 22 bp, Homo sapiens
ttggccagcagctctggcttag

SEQ ID NO: 7545683 - DNA, 22 bp, Homo sapiens
ttggccagcagctctggcttag

SEQ ID NO: 7545684 - DNA, 22 bp, Homo sapiens
ttggcatccactttgcaagttt

SEQ ID NO: 7545685 - DNA, 22 bp, Homo sapiens
ttggcatccactttgcaagttt

SEQ ID NO: 7545686 - DNA, 22 bp, Homo sapiens
ttggcatgttcttcatttggtg

SEQ ID NO: 7545687 - DNA, 22 bp, Homo sapiens
ttggcataccttagtggtggag

SEQ ID NO: 7545688 - DNA, 22 bp, Homo sapiens
ttggcataccttagtggtggag

SEQ ID NO: 7545689 - DNA, 22 bp, Homo sapiens
ttggcataccttagtggtggag

SEQ ID NO: 7545690 - DNA, 22 bp, Homo sapiens
ttggcataaaactcttcaaaat

SEQ ID NO: 7545691 - DNA, 17 bp, Homo sapiens
ttggcagtttggcggcc

SEQ ID NO: 7545692 - DNA, 22 bp, Homo sapiens
ttggccaggtgtaggtcacacc

SEQ ID NO: 7545693 - DNA, 22 bp, Homo sapiens
ttggccaggtccatttctccat

SEQ ID NO: 7545694 - DNA, 22 bp, Homo sapiens
ttggccagctctggaaagtggt

SEQ ID NO: 7545695 - DNA, 22 bp, Homo sapiens
ttggccagcgacgaccttctta

SEQ ID NO: 7545696 - DNA, 22 bp, Homo sapiens
ttggccagcagctctggcttag

SEQ ID NO: 7545697 - DNA, 22 bp, Homo sapiens
ttggccagcgacgaccttctta

SEQ ID NO: 7545698 - DNA, 22 bp, Homo sapiens
ttggccagcagctctggcttag

SEQ ID NO: 7545699 - DNA, 22 bp, Homo sapiens
ttggccagcagctctggcttag

SEQ ID NO: 7545700 - DNA, 22 bp, Homo sapiens
ttggccagcgacgaccttctta

SEQ ID NO: 7545701 - DNA, 22 bp, Homo sapiens
ttggcccactctcagaatgtgg

SEQ ID NO: 7545702 - DNA, 22 bp, Homo sapiens
ttggcccacagtaccatgctgt

SEQ ID NO: 7545703 - DNA, 22 bp, Homo sapiens
ttggcccactctcagaatgtgg

SEQ ID NO: 7545704 - DNA, 22 bp, Homo sapiens
ttggcccacagtaccatgctgt

SEQ ID NO: 7545705 - DNA, 22 bp, Homo sapiens
ttggcccacagtaccatgctgt

SEQ ID NO: 7545706 - DNA, 22 bp, Homo sapiens
ttggccatgacaggacaggaag

SEQ ID NO: 7545707 - DNA, 22 bp, Homo sapiens
ttggccatctaagcccagccac

SEQ ID NO: 7545708 - DNA, 22 bp, Homo sapiens
ttgggaaggcgtggaagcagaa

SEQ ID NO: 7545709 - DNA, 22 bp, Homo sapiens
ttgggaaggcgtggaagcagaa

SEQ ID NO: 7545710 - DNA, 22 bp, Homo sapiens
ttgggaaggcgtggaagcagaa

SEQ ID NO: 7545711 - DNA, 22 bp, Homo sapiens
ttgggacagaaaaggagaagat

SEQ ID NO: 7545712 - DNA, 22 bp, Homo sapiens
ttgggacagagctggggctgga

SEQ ID NO: 7545713 - DNA, 22 bp, Homo sapiens
ttgggacagagctggggctgga

SEQ ID NO: 7545714 - DNA, 22 bp, Homo sapiens
ttgggacagagctggggctgga

SEQ ID NO: 7545715 - DNA, 22 bp, Homo sapiens
ttgggacagcaaccatctgcta

SEQ ID NO: 7545716 - DNA, 22 bp, Homo sapiens
ttgggacagcaacggttctgtt

SEQ ID NO: 7545717 - DNA, 22 bp, Homo sapiens
ttgggacagcaacggttctgtt

SEQ ID NO: 7545718 - DNA, 22 bp, Homo sapiens
ttgggacagctgtggtagtgag

SEQ ID NO: 7545719 - DNA, 22 bp, Homo sapiens
ttgggacagaaaaggagaagat

SEQ ID NO: 7545720 - DNA, 22 bp, Homo sapiens
ttgggaagtttaatgacagact

SEQ ID NO: 7545721 - DNA, 22 bp, Homo sapiens
ttgggaagtttaatgacagact

SEQ ID NO: 7545722 - DNA, 21 bp, Homo sapiens
ttggcagtcagaaatgtgagg

SEQ ID NO: 7545723 - DNA, 22 bp, Homo sapiens
ttggcagtcagtcttggtgctt

SEQ ID NO: 7545724 - DNA, 21 bp, Homo sapiens
ttggcagtcagaaatgtgagg

SEQ ID NO: 7545725 - DNA, 22 bp, Homo sapiens
ttggcagtcaccatcgtgtaga

SEQ ID NO: 7545726 - DNA, 22 bp, Homo sapiens
ttggcagtcaccatcgtgtaga

SEQ ID NO: 7545727 - DNA, 22 bp, Homo sapiens
ttggcagtagtggtagtacatt

SEQ ID NO: 7545728 - DNA, 22 bp, Homo sapiens
ttggcagtctcagtcagatggc

SEQ ID NO: 7545729 - DNA, 22 bp, Homo sapiens
ttggcagtctcagtcagatggc

SEQ ID NO: 7545730 - DNA, 22 bp, Homo sapiens
ttggcagtctcagtcagatggc

SEQ ID NO: 7545731 - DNA, 22 bp, Homo sapiens
ttggcagtgactgcgggccccg

SEQ ID NO: 7545732 - DNA, 22 bp, Homo sapiens
ttggcagtcagtcttggtgctt

SEQ ID NO: 7545733 - DNA, 22 bp, Homo sapiens
ttggcagtcagtcttggtgctt

SEQ ID NO: 7545734 - DNA, 22 bp, Homo sapiens
ttggcagtccaggattaatata

SEQ ID NO: 7545735 - DNA, 22 bp, Homo sapiens
ttggcagtgatgcagcttgttc

SEQ ID NO: 7545736 - DNA, 22 bp, Homo sapiens
ttggcagtgatgcagcttgttc

SEQ ID NO: 7545737 - DNA, 22 bp, Homo sapiens
ttggcagtgctttaatttccag

SEQ ID NO: 7545738 - DNA, 22 bp, Homo sapiens
ttggcagtgtcactagggagcc

SEQ ID NO: 7545739 - DNA, 20 bp, Homo sapiens
ttggcagttaagaatcttac

SEQ ID NO: 7545740 - DNA, 22 bp, Homo sapiens
ttggcagtgtctgcaaaatgga

SEQ ID NO: 7545741 - DNA, 20 bp, Homo sapiens
ttggcagttaagaatcttac

SEQ ID NO: 7545742 - DNA, 20 bp, Homo sapiens
ttggcagttaagaatcttac

SEQ ID NO: 7545743 - DNA, 22 bp, Homo sapiens
ttggcagtgtcactagggagcc

SEQ ID NO: 7545744 - DNA, 22 bp, Homo sapiens
ttggcagtgtctgcaaaatgga

SEQ ID NO: 7545745 - DNA, 22 bp, Homo sapiens
ttggcagtaaaagaaaatgctt

SEQ ID NO: 7545746 - DNA, 22 bp, Homo sapiens
ttggcagtagtctcggctaccc

SEQ ID NO: 7545747 - DNA, 22 bp, Homo sapiens
ttggcagtagtggtagtacatt

SEQ ID NO: 7545748 - DNA, 22 bp, Homo sapiens
ttggcagggctgcttgtctagg

SEQ ID NO: 7545749 - DNA, 22 bp, Homo sapiens
ttggcagtaaaagaaaatgctt

SEQ ID NO: 7545750 - DNA, 22 bp, Homo sapiens
ttggcagggctgcttgtctagg

SEQ ID NO: 7545751 - DNA, 22 bp, Homo sapiens
ttggcagggccaggctctctct

SEQ ID NO: 7545752 - DNA, 22 bp, Homo sapiens
ttggcagggcatcagacacgtg

SEQ ID NO: 7545753 - DNA, 22 bp, Homo sapiens
ttggcagggccaggctctctct

SEQ ID NO: 7545754 - DNA, 22 bp, Homo sapiens
ttggcaggaatattgcagaggt

SEQ ID NO: 7545755 - DNA, 22 bp, Homo sapiens
ttggcaggaatattgcagaggt

SEQ ID NO: 7545756 - DNA, 22 bp, Homo sapiens
ttggcaggaatattgcagaggt

SEQ ID NO: 7545757 - DNA, 22 bp, Homo sapiens
ttggcaggaggcttcagttcct

SEQ ID NO: 7545758 - DNA, 22 bp, Homo sapiens
ttggcaggaggcttcagttcct

SEQ ID NO: 7545759 - DNA, 22 bp, Homo sapiens
ttggcagggcatcagacacgtg

SEQ ID NO: 7545760 - DNA, 22 bp, Homo sapiens
ttggcaggatgatagctttgtg

SEQ ID NO: 7545761 - DNA, 22 bp, Homo sapiens
ttggcaggatgatagctttgtg

SEQ ID NO: 7545762 - DNA, 22 bp, Homo sapiens
ttggcagggcatcagacacgtg

SEQ ID NO: 7545763 - DNA, 22 bp, Homo sapiens
ttggcagggcatcagacacgtg

SEQ ID NO: 7545764 - DNA, 19 bp, Homo sapiens
ttggcagctgagatcctgc

SEQ ID NO: 7545765 - DNA, 19 bp, Homo sapiens
ttggcagctgagatcctgc

SEQ ID NO: 7545766 - DNA, 22 bp, Homo sapiens
ttggcagctcttgatggcaccc

SEQ ID NO: 7545767 - DNA, 19 bp, Homo sapiens
ttggcagctgagatcctgc

SEQ ID NO: 7545768 - DNA, 22 bp, Homo sapiens
ttggcagctgcacagactccat

SEQ ID NO: 7545769 - DNA, 22 bp, Homo sapiens
ttggcagctgcacagactccat

SEQ ID NO: 7545770 - DNA, 22 bp, Homo sapiens
ttggcagctgcacagactccat

SEQ ID NO: 7545771 - DNA, 22 bp, Homo sapiens
ttggcagctgttggaccttgac

SEQ ID NO: 7545772 - DNA, 22 bp, Homo sapiens
ttggcaggaatattgcagaggt

SEQ ID NO: 7545773 - DNA, 22 bp, Homo sapiens
ttggcaggaatattgcagaggt

SEQ ID NO: 7545774 - DNA, 22 bp, Homo sapiens
ttggcagctgttggaccttgac

SEQ ID NO: 7545775 - DNA, 20 bp, Homo sapiens
ttggcagcttcagggtacta

SEQ ID NO: 7545776 - DNA, 20 bp, Homo sapiens
ttggcagcttcagggtacta

SEQ ID NO: 7545777 - DNA, 22 bp, Homo sapiens
ttggcagccaggacccgcctgg

SEQ ID NO: 7545778 - DNA, 22 bp, Homo sapiens
ttggcagccaggacccgcctgg

SEQ ID NO: 7545779 - DNA, 22 bp, Homo sapiens
ttggcagcccagcttactagca

SEQ ID NO: 7545780 - DNA, 22 bp, Homo sapiens
ttggcagcccagcttactagca

SEQ ID NO: 7545781 - DNA, 22 bp, Homo sapiens
ttggcagccctgacccaatggg

SEQ ID NO: 7545782 - DNA, 22 bp, Homo sapiens
ttggcagccctgacccaatggg

SEQ ID NO: 7545783 - DNA, 22 bp, Homo sapiens
ttggcagcggggaccctggctg

SEQ ID NO: 7545784 - DNA, 22 bp, Homo sapiens
ttggcagcggggaccctggctg

SEQ ID NO: 7545785 - DNA, 23 bp, Homo sapiens
ttggcagcgggtcaggctgtggg

SEQ ID NO: 7545786 - DNA, 23 bp, Homo sapiens
ttggcagcgggtcaggctgtggg

SEQ ID NO: 7545787 - DNA, 22 bp, Homo sapiens
ttggcagctacttccccagtgc

SEQ ID NO: 7545788 - DNA, 22 bp, Homo sapiens
ttggcagctacttccccagtgc

SEQ ID NO: 7545789 - DNA, 22 bp, Homo sapiens
ttggcagctacttccccagtgc

SEQ ID NO: 7545790 - DNA, 22 bp, Homo sapiens
ttggcagctcttgatggcaccc

SEQ ID NO: 7545791 - DNA, 22 bp, Homo sapiens
ttggagctaccaggaagggctg

SEQ ID NO: 7545792 - DNA, 22 bp, Homo sapiens
ttggagctaccaggaagggctg

SEQ ID NO: 7545793 - DNA, 22 bp, Homo sapiens
ttggaggaaagaaggttgatat

SEQ ID NO: 7545794 - DNA, 22 bp, Homo sapiens
ttggaggaagctcatgggggat

SEQ ID NO: 7545795 - DNA, 22 bp, Homo sapiens
ttggaggaaattgcttttgtgg

SEQ ID NO: 7545796 - DNA, 22 bp, Homo sapiens
ttggaggaggcattggaggatt

SEQ ID NO: 7545797 - DNA, 22 bp, Homo sapiens
ttggaggaggcattggaggatt

SEQ ID NO: 7545798 - DNA, 22 bp, Homo sapiens
ttggaggaggcattggaggatt

SEQ ID NO: 7545799 - DNA, 20 bp, Homo sapiens
ttggcagcagttccaagtga

SEQ ID NO: 7545800 - DNA, 22 bp, Homo sapiens
ttggcagcagggagttggccgc

SEQ ID NO: 7545801 - DNA, 20 bp, Homo sapiens
ttggcagcagttccaagtga

SEQ ID NO: 7545802 - DNA, 22 bp, Homo sapiens
ttggcagcatacagttggattg

SEQ ID NO: 7545803 - DNA, 22 bp, Homo sapiens
ttggcagcatacagttggattg

SEQ ID NO: 7545804 - DNA, 22 bp, Homo sapiens
ttggcagcatccaagtctcggg

SEQ ID NO: 7545805 - DNA, 22 bp, Homo sapiens
ttggcagcatccaagtctcggg

SEQ ID NO: 7545806 - DNA, 22 bp, Homo sapiens
ttggcagcattccagccaagca

SEQ ID NO: 7545807 - DNA, 22 bp, Homo sapiens
ttggcagcattccagccaagca

SEQ ID NO: 7545808 - DNA, 22 bp, Homo sapiens
ttggcagcattccagccaagca

SEQ ID NO: 7545809 - DNA, 22 bp, Homo sapiens
ttggacagtactttaaagcaga

SEQ ID NO: 7545810 - DNA, 22 bp, Homo sapiens
ttggacagtgcagatctacacg

SEQ ID NO: 7545811 - DNA, 22 bp, Homo sapiens
ttggacagtgcagatctacacg

SEQ ID NO: 7545812 - DNA, 22 bp, Homo sapiens
ttggacagtgcagatctacacg

SEQ ID NO: 7545813 - DNA, 22 bp, Homo sapiens
ttggacagttgtagccagcaga

SEQ ID NO: 7545814 - DNA, 22 bp, Homo sapiens
ttggacagttgtagccagcaga

SEQ ID NO: 7545815 - DNA, 22 bp, Homo sapiens
ttggacataggtggtaatagtg

SEQ ID NO: 7545816 - DNA, 22 bp, Homo sapiens
ttggaccagtggattatggtgg

SEQ ID NO: 7545817 - DNA, 17 bp, Homo sapiens
ttggaccagattctaaa

SEQ ID NO: 7545818 - DNA, 22 bp, Homo sapiens
ttggaccaaggtctgctctttc

SEQ ID NO: 7545819 - DNA, 23 bp, Homo sapiens
ttggaccactactgttttctctt

SEQ ID NO: 7545820 - DNA, 18 bp, Homo sapiens
ttggacctgtgtcagggc

SEQ ID NO: 7545821 - DNA, 22 bp, Homo sapiens
ttggaccattgacctgatctac

SEQ ID NO: 7545822 - DNA, 22 bp, Homo sapiens
ttggacctcagttattctatca

SEQ ID NO: 7545823 - DNA, 22 bp, Homo sapiens
ttggaccatggtagggaacttg

SEQ ID NO: 7545824 - DNA, 21 bp, Homo sapiens
ttggaccatacaagttatgca

SEQ ID NO: 7545825 - DNA, 22 bp, Homo sapiens
ttggacggtggaggcaacttgg

SEQ ID NO: 7545826 - DNA, 22 bp, Homo sapiens
ttggacgctcctaagaccaagc

SEQ ID NO: 7545827 - DNA, 22 bp, Homo sapiens
ttggacctcagttattctatca

SEQ ID NO: 7545828 - DNA, 22 bp, Homo sapiens
ttggagaatgttttcctgcagt

SEQ ID NO: 7545829 - DNA, 22 bp, Homo sapiens
ttggagaatgttttcctgcagt

SEQ ID NO: 7545830 - DNA, 21 bp, Homo sapiens
ttggagaagtgctatcagtat

SEQ ID NO: 7545831 - DNA, 21 bp, Homo sapiens
ttggagaagtgctatcagtat

SEQ ID NO: 7545832 - DNA, 22 bp, Homo sapiens
ttggagaatgttttcctgcagt

SEQ ID NO: 7545833 - DNA, 22 bp, Homo sapiens
ttggagaatgttttcctgcagt

SEQ ID NO: 7545834 - DNA, 22 bp, Homo sapiens
ttggagaatgttttcctgcagt

SEQ ID NO: 7545835 - DNA, 22 bp, Homo sapiens
ttggagagaggctgctcaggct

SEQ ID NO: 7545836 - DNA, 22 bp, Homo sapiens
ttggagagaggctgctcaggct

SEQ ID NO: 7545837 - DNA, 22 bp, Homo sapiens
ttggagaactggcatttttaat

SEQ ID NO: 7545838 - DNA, 22 bp, Homo sapiens
ttggagagaggctgctcaggct

SEQ ID NO: 7545839 - DNA, 22 bp, Homo sapiens
ttggagagaggctgctcaggct

SEQ ID NO: 7545840 - DNA, 22 bp, Homo sapiens
ttggagagaggctgctcaggct

SEQ ID NO: 7545841 - DNA, 22 bp, Homo sapiens
ttggagagaggctgctcaggct

SEQ ID NO: 7545842 - DNA, 22 bp, Homo sapiens
ttggagagattatcagaccagc

SEQ ID NO: 7545843 - DNA, 22 bp, Homo sapiens
ttggagagattatcagaccagc

SEQ ID NO: 7545844 - DNA, 22 bp, Homo sapiens
ttggagagattatcagaccagc

SEQ ID NO: 7545845 - DNA, 22 bp, Homo sapiens
ttggagagattatcagaccagc

SEQ ID NO: 7545846 - DNA, 22 bp, Homo sapiens
ttggagagatttaggtctcagt

SEQ ID NO: 7545847 - DNA, 22 bp, Homo sapiens
ttggagagatttaggtctcagt

SEQ ID NO: 7545848 - DNA, 22 bp, Homo sapiens
ttggagatatcacaccttcaca

SEQ ID NO: 7545849 - DNA, 22 bp, Homo sapiens
ttggagatatcacaccttcaca

SEQ ID NO: 7545850 - DNA, 22 bp, Homo sapiens
ttggagatatcacaccttcaca

SEQ ID NO: 7545851 - DNA, 22 bp, Homo sapiens
ttggagatatcacaccttcaca

SEQ ID NO: 7545852 - DNA, 22 bp, Homo sapiens
ttggagatatcacaccttcaca

SEQ ID NO: 7545853 - DNA, 22 bp, Homo sapiens
ttggagagttaattgacagtta

SEQ ID NO: 7545854 - DNA, 22 bp, Homo sapiens
ttggagagttaattgacagtta

SEQ ID NO: 7545855 - DNA, 22 bp, Homo sapiens
ttggagagttaattgacagtta

SEQ ID NO: 7545856 - DNA, 22 bp, Homo sapiens
ttggagagttaattgacagtta

SEQ ID NO: 7545857 - DNA, 22 bp, Homo sapiens
ttggagagttaattgacagtta

SEQ ID NO: 7545858 - DNA, 22 bp, Homo sapiens
ttggagagttaattgacagtta

SEQ ID NO: 7545859 - DNA, 22 bp, Homo sapiens
ttggagagttaattgacagtta

SEQ ID NO: 7545860 - DNA, 22 bp, Homo sapiens
ttggagatgtaaaattcagaga

SEQ ID NO: 7545861 - DNA, 22 bp, Homo sapiens
ttggagatgtaaaattcagaga

SEQ ID NO: 7545862 - DNA, 22 bp, Homo sapiens
ttggagatatgtgaaaaaaaca

SEQ ID NO: 7545863 - DNA, 22 bp, Homo sapiens
ttggagatatgtgaaaaaaaca

SEQ ID NO: 7545864 - DNA, 22 bp, Homo sapiens
ttggagatatcacaccttcaca

SEQ ID NO: 7545865 - DNA, 22 bp, Homo sapiens
ttggagatatcacaccttcaca

SEQ ID NO: 7545866 - DNA, 22 bp, Homo sapiens
ttggagccctgaggatctggat

SEQ ID NO: 7545867 - DNA, 22 bp, Homo sapiens
ttggagccctgaggatctggat

SEQ ID NO: 7545868 - DNA, 22 bp, Homo sapiens
ttggagccatgcccagctctct

SEQ ID NO: 7545869 - DNA, 22 bp, Homo sapiens
ttggagccatgcccagctctct

SEQ ID NO: 7545870 - DNA, 22 bp, Homo sapiens
ttggagccctgaggatctggat

SEQ ID NO: 7545871 - DNA, 22 bp, Homo sapiens
ttggagagatttaggtctcagt

SEQ ID NO: 7545872 - DNA, 22 bp, Homo sapiens
ttggagagcagtaaaccacact

SEQ ID NO: 7545873 - DNA, 22 bp, Homo sapiens
ttggagagcagtaaaccacact

SEQ ID NO: 7545874 - DNA, 22 bp, Homo sapiens
ttggagagcagtaaaccacact

SEQ ID NO: 7545875 - DNA, 22 bp, Homo sapiens
ttggagagatttaggtctcagt

SEQ ID NO: 7545876 - DNA, 22 bp, Homo sapiens
ttggagagatttaggtctcagt

SEQ ID NO: 7545877 - DNA, 22 bp, Homo sapiens
ttggagaggcagtcttgctctg

SEQ ID NO: 7545878 - DNA, 22 bp, Homo sapiens
ttggagaggcagtcttgctctg

SEQ ID NO: 7545879 - DNA, 22 bp, Homo sapiens
ttggagaggcagtcttgctctg

SEQ ID NO: 7545880 - DNA, 22 bp, Homo sapiens
ttggagagggcttggatcacac

SEQ ID NO: 7545881 - DNA, 22 bp, Homo sapiens
ttggagagggcttggatcacac

SEQ ID NO: 7545882 - DNA, 22 bp, Homo sapiens
ttggagagggcttggatcacac

SEQ ID NO: 7545883 - DNA, 22 bp, Homo sapiens
ttggagagggcttggatcacac

SEQ ID NO: 7545884 - DNA, 22 bp, Homo sapiens
ttggagagggcttggatcacac

SEQ ID NO: 7545885 - DNA, 23 bp, Homo sapiens
ttggagagggtgagtagtgtcag

SEQ ID NO: 7545886 - DNA, 23 bp, Homo sapiens
ttggagagggtgagtagtgtcag

SEQ ID NO: 7545887 - DNA, 22 bp, Homo sapiens
ttggagagtgatattcagatgc

SEQ ID NO: 7545888 - DNA, 22 bp, Homo sapiens
ttggagagtgatattcagatgc

SEQ ID NO: 7545889 - DNA, 22 bp, Homo sapiens
ttggagagtgatattcagatgc

SEQ ID NO: 7545890 - DNA, 22 bp, Homo sapiens
ttggagagtgatattcagatgc

SEQ ID NO: 7545891 - DNA, 22 bp, Homo sapiens
ttggagagtgatattcagatgc

SEQ ID NO: 7545892 - DNA, 23 bp, Homo sapiens
ttggagagggtgagtagtgtcag

SEQ ID NO: 7545893 - DNA, 20 bp, Homo sapiens
cagcagagacccatggggag

SEQ ID NO: 7545894 - DNA, 20 bp, Homo sapiens
cagcagagacccatggggag

SEQ ID NO: 7545895 - DNA, 20 bp, Homo sapiens
cagcagagacccatggggag

SEQ ID NO: 7545896 - DNA, 20 bp, Homo sapiens
cagcagagacccatggggag

SEQ ID NO: 7545897 - DNA, 22 bp, Homo sapiens
cagcagagacggtaagcagaac

SEQ ID NO: 7545898 - DNA, 22 bp, Homo sapiens
cagcagagacggtaagcagaac

SEQ ID NO: 7545899 - DNA, 22 bp, Homo sapiens
cagcagagacggtaagcagaac

SEQ ID NO: 7545900 - DNA, 20 bp, Homo sapiens
cagcagagacccatggggag

SEQ ID NO: 7545901 - DNA, 22 bp, Homo sapiens
cagcagagacggtaagcagaac

SEQ ID NO: 7545902 - DNA, 22 bp, Homo sapiens
cagcagagacggtaagcagaac

SEQ ID NO: 7545903 - DNA, 22 bp, Homo sapiens
gtaagcatctgtctcttctgca

SEQ ID NO: 7545904 - DNA, 22 bp, Homo sapiens
gtaagcagaggttaatgttaac

SEQ ID NO: 7545905 - DNA, 22 bp, Homo sapiens
gtaagcctctgctctatctggt

SEQ ID NO: 7545906 - DNA, 22 bp, Homo sapiens
gtaagcctgagaaacaccacct

SEQ ID NO: 7545907 - DNA, 17 bp, Homo sapiens
gtaaggcttgcagatgc

SEQ ID NO: 7545908 - DNA, 22 bp, Homo sapiens
gtaaggcttctggcccttaact

SEQ ID NO: 7545909 - DNA, 22 bp, Homo sapiens
gtaaggctaatgtctttgtggt

SEQ ID NO: 7545910 - DNA, 22 bp, Homo sapiens
gtaaggcttagggtgcctagat

SEQ ID NO: 7545911 - DNA, 22 bp, Homo sapiens
gtaaggcttagggtgcctagat

SEQ ID NO: 7545912 - DNA, 22 bp, Homo sapiens
gtaagcctggaatttttgactt

SEQ ID NO: 7545913 - DNA, 22 bp, Homo sapiens
gtaaggcaatagtaaggagtcc

SEQ ID NO: 7545914 - DNA, 22 bp, Homo sapiens
gtaaggctaatgtctttgtggt

SEQ ID NO: 7545915 - DNA, 22 bp, Homo sapiens
gtaagaaaaccttctttctaat

SEQ ID NO: 7545916 - DNA, 22 bp, Homo sapiens
gtaactttggatttagggtacc

SEQ ID NO: 7545917 - DNA, 22 bp, Homo sapiens
gtaagaagatgaatccaggctg

SEQ ID NO: 7545918 - DNA, 22 bp, Homo sapiens
gtaagacatagatttctcatga

SEQ ID NO: 7545919 - DNA, 22 bp, Homo sapiens
gtaagaggagtgggaagcctca

SEQ ID NO: 7545920 - DNA, 22 bp, Homo sapiens
gtaagaaaaccttctttctaat

SEQ ID NO: 7545921 - DNA, 22 bp, Homo sapiens
gtaacttatcatttcaatatag

SEQ ID NO: 7545922 - DNA, 22 bp, Homo sapiens
gtaactttggatttagggtacc

SEQ ID NO: 7545923 - DNA, 22 bp, Homo sapiens
gtaacttaccattgtagcatca

SEQ ID NO: 7545924 - DNA, 23 bp, Homo sapiens
gtaactggggaatttgagctatg

SEQ ID NO: 7545925 - DNA, 22 bp, Homo sapiens
gtaactggttttcttccctctc

SEQ ID NO: 7545926 - DNA, 22 bp, Homo sapiens
gtaagacaagcggactgccgtt

SEQ ID NO: 7545927 - DNA, 22 bp, Homo sapiens
gtaagaggagtgggaagcctca

SEQ ID NO: 7545928 - DNA, 22 bp, Homo sapiens
gtaagaggatcaaggcggtgca

SEQ ID NO: 7545929 - DNA, 22 bp, Homo sapiens
gtaagaggagtgggaagcctca

SEQ ID NO: 7545930 - DNA, 22 bp, Homo sapiens
gtaagaggatcaaggcggtgca

SEQ ID NO: 7545931 - DNA, 18 bp, Homo sapiens
gtaagcaaagactttata

SEQ ID NO: 7545932 - DNA, 22 bp, Homo sapiens
gtaagcaaacagcaaatgattt

SEQ ID NO: 7545933 - DNA, 22 bp, Homo sapiens
gtaagcaaacagcaaatgattt

SEQ ID NO: 7545934 - DNA, 22 bp, Homo sapiens
gtaagcaaacagcaaatgattt

SEQ ID NO: 7545935 - DNA, 22 bp, Homo sapiens
gtaagatttaaaatagcaattg

SEQ ID NO: 7545936 - DNA, 22 bp, Homo sapiens
ggtgtgaattggcatggtgctt

SEQ ID NO: 7545937 - DNA, 22 bp, Homo sapiens
ggtgtgacctcagtctgggtaa

SEQ ID NO: 7545938 - DNA, 22 bp, Homo sapiens
ggtgtgaaatgttcagtgttac

SEQ ID NO: 7545939 - DNA, 22 bp, Homo sapiens
ggtgtgactcgccctcagggac

SEQ ID NO: 7545940 - DNA, 22 bp, Homo sapiens
ggtgtgactcgccctcagggac

SEQ ID NO: 7545941 - DNA, 22 bp, Homo sapiens
ggtgtgattatgacatgtgact

SEQ ID NO: 7545942 - DNA, 22 bp, Homo sapiens
ggtgtgcatggcacagggcttg

SEQ ID NO: 7545943 - DNA, 22 bp, Homo sapiens
ggtgtgcagtagcaggaggcct

SEQ ID NO: 7545944 - DNA, 22 bp, Homo sapiens
ggtgtgcaggctatcacagaca

SEQ ID NO: 7545945 - DNA, 22 bp, Homo sapiens
ggtgtgcagtagcaggaggcct

SEQ ID NO: 7545946 - DNA, 22 bp, Homo sapiens
ggtgtgcagtagcaggaggcct

SEQ ID NO: 7545947 - DNA, 22 bp, Homo sapiens
ggtgtgattatgacatgtgact

SEQ ID NO: 7545948 - DNA, 22 bp, Homo sapiens
ggtgtgcacgaaggaccagcag

SEQ ID NO: 7545949 - DNA, 22 bp, Homo sapiens
gtaaacatgctgtgtactcagc

SEQ ID NO: 7545950 - DNA, 22 bp, Homo sapiens
gtaaacatcgacccaacagggg

SEQ ID NO: 7545951 - DNA, 22 bp, Homo sapiens
gtaacattattcatgagataca

SEQ ID NO: 7545952 - DNA, 22 bp, Homo sapiens
gtaaacatcagccactctattt

SEQ ID NO: 7545953 - DNA, 22 bp, Homo sapiens
gtaaacatcagccactctattt

SEQ ID NO: 7545954 - DNA, 22 bp, Homo sapiens
gtaaacatcagccactctattt

SEQ ID NO: 7545955 - DNA, 22 bp, Homo sapiens
gtaaacatcagccactctattt

SEQ ID NO: 7545956 - DNA, 22 bp, Homo sapiens
gtaacattttgagcagtaggct

SEQ ID NO: 7545957 - DNA, 22 bp, Homo sapiens
gtaacatttacagttcctagag

SEQ ID NO: 7545958 - DNA, 22 bp, Homo sapiens
gtaacatttacagttcctagag

SEQ ID NO: 7545959 - DNA, 16 bp, Homo sapiens
gtaacattctgtagcc

SEQ ID NO: 7545960 - DNA, 22 bp, Homo sapiens
gtaacatttacagttcctagag

SEQ ID NO: 7545961 - DNA, 22 bp, Homo sapiens
gtaacattctagaaacttaaca

SEQ ID NO: 7545962 - DNA, 22 bp, Homo sapiens
gtaacattctagaaacttaaca

SEQ ID NO: 7545963 - DNA, 22 bp, Homo sapiens
gtaacattctagaaacttaaca

SEQ ID NO: 7545964 - DNA, 22 bp, Homo sapiens
gtaactgggatttttcaatgtg

SEQ ID NO: 7545965 - DNA, 22 bp, Homo sapiens
gtaactggaaattcccaataag

SEQ ID NO: 7545966 - DNA, 22 bp, Homo sapiens
gtaactggaaattcccaataag

SEQ ID NO: 7545967 - DNA, 22 bp, Homo sapiens
gtaactgaggcagcttttaaga

SEQ ID NO: 7545968 - DNA, 23 bp, Homo sapiens
gtaactggggaatttgagctatg

SEQ ID NO: 7545969 - DNA, 22 bp, Homo sapiens
gtaactggttttcttccctctc

SEQ ID NO: 7545970 - DNA, 22 bp, Homo sapiens
gtaacgaataaacaagtgataa

SEQ ID NO: 7545971 - DNA, 20 bp, Homo sapiens
gtaactctggctaagtaaat

SEQ ID NO: 7545972 - DNA, 22 bp, Homo sapiens
gtaactctgggtagaactcatg

SEQ ID NO: 7545973 - DNA, 22 bp, Homo sapiens
gtaactctttggaaaacatttt

SEQ ID NO: 7545974 - DNA, 22 bp, Homo sapiens
ggtgtctgttgcctcctggtta

SEQ ID NO: 7545975 - DNA, 22 bp, Homo sapiens
ggtgtctgttgcctcctggtta

SEQ ID NO: 7545976 - DNA, 22 bp, Homo sapiens
ggtgtctgtgatggcatataac

SEQ ID NO: 7545977 - DNA, 22 bp, Homo sapiens
ggtgtctgttgcctcctggtta

SEQ ID NO: 7545978 - DNA, 19 bp, Homo sapiens
ggtgtgaagtgaggagtta

SEQ ID NO: 7545979 - DNA, 22 bp, Homo sapiens
ggtgtctgttgcctcctggtta

SEQ ID NO: 7545980 - DNA, 22 bp, Homo sapiens
ggtgtctgtgatggcatataac

SEQ ID NO: 7545981 - DNA, 22 bp, Homo sapiens
ggtgtctgttgcctcctggtta

SEQ ID NO: 7545982 - DNA, 22 bp, Homo sapiens
ggtgtctgtgatggcatataac

SEQ ID NO: 7545983 - DNA, 22 bp, Homo sapiens
ggtgtctggacagtgagccagg

SEQ ID NO: 7545984 - DNA, 22 bp, Homo sapiens
ggtgtctgtgatggcatataac

SEQ ID NO: 7545985 - DNA, 22 bp, Homo sapiens
ggtgtctgtgatggcatataac

SEQ ID NO: 7545986 - DNA, 22 bp, Homo sapiens
ggtgtctgcttccctccagctg

SEQ ID NO: 7545987 - DNA, 22 bp, Homo sapiens
ggtgtctgcttccctccagctg

SEQ ID NO: 7545988 - DNA, 22 bp, Homo sapiens
ggtgtctgcttccctccagctg

SEQ ID NO: 7545989 - DNA, 15 bp, Homo sapiens
ggtgtctgcagtgtg

SEQ ID NO: 7545990 - DNA, 15 bp, Homo sapiens
ggtgtctgcagtgtg

SEQ ID NO: 7545991 - DNA, 15 bp, Homo sapiens
ggtgtctgcagtgtg

SEQ ID NO: 7545992 - DNA, 22 bp, Homo sapiens
ggtgtctgattccaaggccaca

SEQ ID NO: 7545993 - DNA, 22 bp, Homo sapiens
ggtgtctggacagtgagccagg

SEQ ID NO: 7545994 - DNA, 22 bp, Homo sapiens
ggtgtctggacagtgagccagg

SEQ ID NO: 7545995 - DNA, 22 bp, Homo sapiens
ggtgtctggacagtgagccagg

SEQ ID NO: 7545996 - DNA, 22 bp, Homo sapiens
ggtgtctgcttccctccagctg

SEQ ID NO: 7545997 - DNA, 22 bp, Homo sapiens
ggtgtctgcttccctccagctg

SEQ ID NO: 7545998 - DNA, 22 bp, Homo sapiens
ggtgtctgatggtggcttctca

SEQ ID NO: 7545999 - DNA, 22 bp, Homo sapiens
ggtgtctgatggtggcttctca

SEQ ID NO: 7546000 - DNA, 22 bp, Homo sapiens
ggtgtctgatggtggcttctca

SEQ ID NO: 7546001 - DNA, 22 bp, Homo sapiens
ggtgtctgattccaaggccaca

SEQ ID NO: 7546002 - DNA, 22 bp, Homo sapiens
ggtgtctgattccaaggccaca

SEQ ID NO: 7546003 - DNA, 22 bp, Homo sapiens
ggtgtctgatggtggcttctca

SEQ ID NO: 7546004 - DNA, 22 bp, Homo sapiens
ggtgtctcagctgctggcaggg

SEQ ID NO: 7546005 - DNA, 22 bp, Homo sapiens
ggtgtctgatggtggcttctca

SEQ ID NO: 7546006 - DNA, 22 bp, Homo sapiens
ggtgtcctttgggggctccgag

SEQ ID NO: 7546007 - DNA, 20 bp, Homo sapiens
cagcagagacccatggggag

SEQ ID NO: 7546008 - DNA, 20 bp, Homo sapiens
cagcagagacccatggggag

SEQ ID NO: 7546009 - DNA, 20 bp, Homo sapiens
cagcagagacccatggggag

SEQ ID NO: 7546010 - DNA, 20 bp, Homo sapiens
cagcagagacccatggggag

SEQ ID NO: 7546011 - DNA, 20 bp, Homo sapiens
cagcagagacccatggggag

SEQ ID NO: 7546012 - DNA, 20 bp, Homo sapiens
cagcagagacccatggggag

SEQ ID NO: 7546013 - DNA, 20 bp, Homo sapiens
cagcagagacccatggggag

SEQ ID NO: 7546014 - DNA, 20 bp, Homo sapiens
cagcagagacccatggggag

SEQ ID NO: 7546015 - DNA, 22 bp, Homo sapiens
cagcagagaccaagtgatttga

SEQ ID NO: 7546016 - DNA, 22 bp, Homo sapiens
cagcagagaccaagtgatttga

SEQ ID NO: 7546017 - DNA, 20 bp, Homo sapiens
cagcagagacccatggggag

SEQ ID NO: 7546018 - DNA, 18 bp, Homo sapiens
cagcagagacattcaaaa

SEQ ID NO: 7546019 - DNA, 22 bp, Homo sapiens
cagcagagaccaagtgatttga

SEQ ID NO: 7546020 - DNA, 22 bp, Homo sapiens
cagcagagaccaagtgatttga

SEQ ID NO: 7546021 - DNA, 18 bp, Homo sapiens
cagcagagacattcaaaa

SEQ ID NO: 7546022 - DNA, 18 bp, Homo sapiens
cagcagagacattcaaaa

SEQ ID NO: 7546023 - DNA, 18 bp, Homo sapiens
cagcagagacattcaaaa

SEQ ID NO: 7546024 - DNA, 22 bp, Homo sapiens
cagcagagaaattacatatttg

SEQ ID NO: 7546025 - DNA, 22 bp, Homo sapiens
cagcagagaaattacatatttg

SEQ ID NO: 7546026 - DNA, 22 bp, Homo sapiens
cagcagagaaattacatatttg

SEQ ID NO: 7546027 - DNA, 22 bp, Homo sapiens
cagcagagaaattacatatttg

SEQ ID NO: 7546028 - DNA, 22 bp, Homo sapiens
cagcagagaaattacatatttg

SEQ ID NO: 7546029 - DNA, 22 bp, Homo sapiens
cagcagagaaattaaacttctg

SEQ ID NO: 7546030 - DNA, 22 bp, Homo sapiens
cagcagagaaattaaacttctg

SEQ ID NO: 7546031 - DNA, 18 bp, Homo sapiens
cagcagagacattcaaaa

SEQ ID NO: 7546032 - DNA, 18 bp, Homo sapiens
cagcagagacattcaaaa

SEQ ID NO: 7546033 - DNA, 18 bp, Homo sapiens
cagcagagacattcaaaa

SEQ ID NO: 7546034 - DNA, 18 bp, Homo sapiens
cagcagagacattcaaaa

SEQ ID NO: 7546035 - DNA, 22 bp, Homo sapiens
cagcagagaaattacatatttg

SEQ ID NO: 7546036 - DNA, 22 bp, Homo sapiens
cagcagagaaattacatatttg

SEQ ID NO: 7546037 - DNA, 22 bp, Homo sapiens
cagcagagaaattacatatttg

SEQ ID NO: 7546038 - DNA, 22 bp, Homo sapiens
cagcagaagtccgactccagtc

SEQ ID NO: 7546039 - DNA, 22 bp, Homo sapiens
cagcagaagtccgactccagtc

SEQ ID NO: 7546040 - DNA, 22 bp, Homo sapiens
cagcagaagtccgactccagtc

SEQ ID NO: 7546041 - DNA, 21 bp, Homo sapiens
cagcagaagcatctatggaag

SEQ ID NO: 7546042 - DNA, 21 bp, Homo sapiens
cagcagaagcatctatggaag

SEQ ID NO: 7546043 - DNA, 22 bp, Homo sapiens
cagcagaagtccgactccagtc

SEQ ID NO: 7546044 - DNA, 22 bp, Homo sapiens
cagcagaagtccgactccagtc

SEQ ID NO: 7546045 - DNA, 22 bp, Homo sapiens
cagcagaagtccgactccagtc

SEQ ID NO: 7546046 - DNA, 22 bp, Homo sapiens
cagcagactggagtaggcagtg

SEQ ID NO: 7546047 - DNA, 22 bp, Homo sapiens
cagcagactgaccttcaacccc

SEQ ID NO: 7546048 - DNA, 22 bp, Homo sapiens
cagcagaagtgcatttgtgatt

SEQ ID NO: 7546049 - DNA, 22 bp, Homo sapiens
cagcagaagtgcatttgtgatt

SEQ ID NO: 7546050 - DNA, 22 bp, Homo sapiens
cagcagaagtgcatttgtgatt

SEQ ID NO: 7546051 - DNA, 22 bp, Homo sapiens
cagcagaagtgcatttgtgatt

SEQ ID NO: 7546052 - DNA, 22 bp, Homo sapiens
cagcagaagtgcatttgtgatt

SEQ ID NO: 7546053 - DNA, 22 bp, Homo sapiens
cagcagagaaattaaacttctg

SEQ ID NO: 7546054 - DNA, 22 bp, Homo sapiens
cagcagagaaattaaacttctg

SEQ ID NO: 7546055 - DNA, 22 bp, Homo sapiens
cagcagagaaattaaacttctg

SEQ ID NO: 7546056 - DNA, 22 bp, Homo sapiens
cagcagagaaattaaacttctg

SEQ ID NO: 7546057 - DNA, 22 bp, Homo sapiens
cagcagactggagtaggcagtg

SEQ ID NO: 7546058 - DNA, 22 bp, Homo sapiens
cagcagacttactagaatgtaa

SEQ ID NO: 7546059 - DNA, 22 bp, Homo sapiens
cagcagactgaccttcaacccc

SEQ ID NO: 7546060 - DNA, 22 bp, Homo sapiens
cagcagactggagtaggcagtg

SEQ ID NO: 7546061 - DNA, 22 bp, Homo sapiens
cagatgcttggaggacacttgg

SEQ ID NO: 7546062 - DNA, 22 bp, Homo sapiens
cagatgcttggaggacacttgg

SEQ ID NO: 7546063 - DNA, 22 bp, Homo sapiens
cagatgcttgttggctggtctc

SEQ ID NO: 7546064 - DNA, 22 bp, Homo sapiens
cagatgcttgttggctggtctc

SEQ ID NO: 7546065 - DNA, 22 bp, Homo sapiens
cagatgcttgttggctggtctc

SEQ ID NO: 7546066 - DNA, 22 bp, Homo sapiens
cagatggaacacagaaaggaga

SEQ ID NO: 7546067 - DNA, 22 bp, Homo sapiens
cagatgcttttgattctggggt

SEQ ID NO: 7546068 - DNA, 22 bp, Homo sapiens
cagatgcttttgattctggggt

SEQ ID NO: 7546069 - DNA, 22 bp, Homo sapiens
cagatggaaggcatagaggttt

SEQ ID NO: 7546070 - DNA, 22 bp, Homo sapiens
cagatggaggataaaacatgca

SEQ ID NO: 7546071 - DNA, 22 bp, Homo sapiens
cagatggaggataaaacatgca

SEQ ID NO: 7546072 - DNA, 22 bp, Homo sapiens
cagatggagtcccgtggagttc

SEQ ID NO: 7546073 - DNA, 22 bp, Homo sapiens
cagatggaacacagaaaggaga

SEQ ID NO: 7546074 - DNA, 22 bp, Homo sapiens
cagatggaacacagaaaggaga

SEQ ID NO: 7546075 - DNA, 22 bp, Homo sapiens
cagatggaacacagaaaggaga

SEQ ID NO: 7546076 - DNA, 22 bp, Homo sapiens
cagatggaacacagaaaggaga

SEQ ID NO: 7546077 - DNA, 22 bp, Homo sapiens
cagatggaaggcatagaggttt

SEQ ID NO: 7546078 - DNA, 22 bp, Homo sapiens
cagatggaacacagaaaggaga

SEQ ID NO: 7546079 - DNA, 22 bp, Homo sapiens
cagatggattttgtaggctgat

SEQ ID NO: 7546080 - DNA, 16 bp, Homo sapiens
cagatggatctaactc

SEQ ID NO: 7546081 - DNA, 22 bp, Homo sapiens
cagatggaggataaaacatgca

SEQ ID NO: 7546082 - DNA, 22 bp, Homo sapiens
cagatggattttgtaggctgat

SEQ ID NO: 7546083 - DNA, 22 bp, Homo sapiens
cagatggcaacagctctgtgac

SEQ ID NO: 7546084 - DNA, 22 bp, Homo sapiens
ggtgctggttcagggtggctgt

SEQ ID NO: 7546085 - DNA, 22 bp, Homo sapiens
ggtgctggttcagggtggctgt

SEQ ID NO: 7546086 - DNA, 22 bp, Homo sapiens
ggtgctggttcagggtggctgt

SEQ ID NO: 7546087 - DNA, 22 bp, Homo sapiens
ggtgctggttcagggtggctgt

SEQ ID NO: 7546088 - DNA, 22 bp, Homo sapiens
cagatggcaacagctctgtgac

SEQ ID NO: 7546089 - DNA, 22 bp, Homo sapiens
cagatggcaacagctctgtgac

SEQ ID NO: 7546090 - DNA, 22 bp, Homo sapiens
ggtggcaggctggcattggcaa

SEQ ID NO: 7546091 - DNA, 22 bp, Homo sapiens
ggtggcaggctggcattggcaa

SEQ ID NO: 7546092 - DNA, 22 bp, Homo sapiens
ggtggcagggagtgtccctggg

SEQ ID NO: 7546093 - DNA, 22 bp, Homo sapiens
ggtggcagggagtgtccctggg

SEQ ID NO: 7546094 - DNA, 22 bp, Homo sapiens
ggtggcagggagtgtccctggg

SEQ ID NO: 7546095 - DNA, 22 bp, Homo sapiens
ggtggcagggagtgtccctggg

SEQ ID NO: 7546096 - DNA, 22 bp, Homo sapiens
ggtggcagggagtgtccctggg

SEQ ID NO: 7546097 - DNA, 22 bp, Homo sapiens
ggtgctggttcagggtggctgt

SEQ ID NO: 7546098 - DNA, 22 bp, Homo sapiens
ggtgctggttcagggtggctgt

SEQ ID NO: 7546099 - DNA, 22 bp, Homo sapiens
ggtgctggttcagggtggctgt

SEQ ID NO: 7546100 - DNA, 22 bp, Homo sapiens
ggtgctgtggcagctcctcctc

SEQ ID NO: 7546101 - DNA, 22 bp, Homo sapiens
ggtgctgtggcagctcctcctc

SEQ ID NO: 7546102 - DNA, 22 bp, Homo sapiens
ggtggcagggagtgtccctggg

SEQ ID NO: 7546103 - DNA, 18 bp, Homo sapiens
ggtggcaggtcagatgcc

SEQ ID NO: 7546104 - DNA, 22 bp, Homo sapiens
ggtggcagggagtgtccctggg

SEQ ID NO: 7546105 - DNA, 22 bp, Homo sapiens
ggtggcagggagtgtccctggg

SEQ ID NO: 7546106 - DNA, 18 bp, Homo sapiens
ggtggcaggtcagatgcc

SEQ ID NO: 7546107 - DNA, 18 bp, Homo sapiens
ggtggcaggtcagatgcc

SEQ ID NO: 7546108 - DNA, 18 bp, Homo sapiens
ggtggcaggtcagatgcc

SEQ ID NO: 7546109 - DNA, 18 bp, Homo sapiens
ggtggcaggtcagatgcc

SEQ ID NO: 7546110 - DNA, 18 bp, Homo sapiens
ggtggcaggtcagatgcc

SEQ ID NO: 7546111 - DNA, 22 bp, Homo sapiens
ggtggcagtagcactgggcctg

SEQ ID NO: 7546112 - DNA, 22 bp, Homo sapiens
ggtggcagtagcactgggcctg

SEQ ID NO: 7546113 - DNA, 22 bp, Homo sapiens
ggtggcagtagcactgggcctg

SEQ ID NO: 7546114 - DNA, 22 bp, Homo sapiens
ggtggcagtagcactgggcctg

SEQ ID NO: 7546115 - DNA, 18 bp, Homo sapiens
ggtggcaggtcagatgcc

SEQ ID NO: 7546116 - DNA, 18 bp, Homo sapiens
ggtggcaggtcagatgcc

SEQ ID NO: 7546117 - DNA, 22 bp, Homo sapiens
ggtggcagtagcactgggcctg

SEQ ID NO: 7546118 - DNA, 22 bp, Homo sapiens
ggtggcagtcttaagagatctt

SEQ ID NO: 7546119 - DNA, 22 bp, Homo sapiens
ggtggcagtcttaagagatctt

SEQ ID NO: 7546120 - DNA, 22 bp, Homo sapiens
ggtggcagtagcactgggcctg

SEQ ID NO: 7546121 - DNA, 22 bp, Homo sapiens
ggtggcagtagcactgggcctg

SEQ ID NO: 7546122 - DNA, 22 bp, Homo sapiens
ggtggcagtcttaagagatctt

SEQ ID NO: 7546123 - DNA, 22 bp, Homo sapiens
ggtggcagtcttaagagatctt

SEQ ID NO: 7546124 - DNA, 22 bp, Homo sapiens
ggtggcagtcttaagagatctt

SEQ ID NO: 7546125 - DNA, 22 bp, Homo sapiens
ggtggcagtagcactgggcctg

SEQ ID NO: 7546126 - DNA, 22 bp, Homo sapiens
ggtggcagtagcactgggcctg

SEQ ID NO: 7546127 - DNA, 22 bp, Homo sapiens
ggtggcagtagcactgggcctg

SEQ ID NO: 7546128 - DNA, 22 bp, Homo sapiens
ggtggcagtagcactgggcctg

SEQ ID NO: 7546129 - DNA, 22 bp, Homo sapiens
ggtggcagtcttaagagatctt

SEQ ID NO: 7546130 - DNA, 22 bp, Homo sapiens
ggtggcagtgcttgcgggtcta

SEQ ID NO: 7546131 - DNA, 22 bp, Homo sapiens
ggtggcagtgcttgcgggtcta

SEQ ID NO: 7546132 - DNA, 22 bp, Homo sapiens
ggtggcagtgcttgcgggtcta

SEQ ID NO: 7546133 - DNA, 22 bp, Homo sapiens
ggtggcagtgcttgcgggtcta

SEQ ID NO: 7546134 - DNA, 22 bp, Homo sapiens
ggtggcagtgcttgcgggtcta

SEQ ID NO: 7546135 - DNA, 22 bp, Homo sapiens
ggtggcagtgcttgcgggtcta

SEQ ID NO: 7546136 - DNA, 22 bp, Homo sapiens
ggtggcagtcttaagagatctt

SEQ ID NO: 7546137 - DNA, 22 bp, Homo sapiens
ggtggcagtcttaagagatctt

SEQ ID NO: 7546138 - DNA, 22 bp, Homo sapiens
cagcagaacaggcagggaagct

SEQ ID NO: 7546139 - DNA, 22 bp, Homo sapiens
cagcagaacaggcagggaagct

SEQ ID NO: 7546140 - DNA, 22 bp, Homo sapiens
cagcagaacagttaaagaaacc

SEQ ID NO: 7546141 - DNA, 22 bp, Homo sapiens
cagcagaacagttaaagaaacc

SEQ ID NO: 7546142 - DNA, 22 bp, Homo sapiens
cagcagaagcaacattcaggct

SEQ ID NO: 7546143 - DNA, 22 bp, Homo sapiens
cagcagaagcaacattcaggct

SEQ ID NO: 7546144 - DNA, 22 bp, Homo sapiens
cagcagaagcaacattcaggct

SEQ ID NO: 7546145 - DNA, 22 bp, Homo sapiens
cagcagaagcaacattcaggct

SEQ ID NO: 7546146 - DNA, 21 bp, Homo sapiens
cagcagaagcatctatggaag

SEQ ID NO: 7546147 - DNA, 21 bp, Homo sapiens
cagcagaagcatctatggaag

SEQ ID NO: 7546148 - DNA, 21 bp, Homo sapiens
cagcagaagcatctatggaag

SEQ ID NO: 7546149 - DNA, 22 bp, Homo sapiens
cagcactgctgctgtacacaca

SEQ ID NO: 7546150 - DNA, 22 bp, Homo sapiens
cagcactcccaggagaaccagc

SEQ ID NO: 7546151 - DNA, 22 bp, Homo sapiens
cagcactctggcttcgttaagt

SEQ ID NO: 7546152 - DNA, 22 bp, Homo sapiens
cagcactcccaggagaaccagc

SEQ ID NO: 7546153 - DNA, 22 bp, Homo sapiens
cagcactctggcttcgttaagt

SEQ ID NO: 7546154 - DNA, 22 bp, Homo sapiens
cagcactctggcttcgttaagt

SEQ ID NO: 7546155 - DNA, 22 bp, Homo sapiens
cagcactgctgctgtacacaca

SEQ ID NO: 7546156 - DNA, 22 bp, Homo sapiens
cagcagaacaggcagggaagct

SEQ ID NO: 7546157 - DNA, 22 bp, Homo sapiens
cagcagaacaggcagggaagct

SEQ ID NO: 7546158 - DNA, 22 bp, Homo sapiens
cagcagaacaggcagggaagct

SEQ ID NO: 7546159 - DNA, 20 bp, Homo sapiens
cagcagaaatggggtgggaa

SEQ ID NO: 7546160 - DNA, 20 bp, Homo sapiens
cagcagaaatggggtgggaa

SEQ ID NO: 7546161 - DNA, 22 bp, Homo sapiens
cagcactgctgctgtacacaca

SEQ ID NO: 7546162 - DNA, 18 bp, Homo sapiens
ggtgggaagccagggcct

SEQ ID NO: 7546163 - DNA, 22 bp, Homo sapiens
ggtgggaaggccactgaaggtt

SEQ ID NO: 7546164 - DNA, 22 bp, Homo sapiens
ggtgggaaggccactgaaggtt

SEQ ID NO: 7546165 - DNA, 18 bp, Homo sapiens
ggtgggaagccagggcct

SEQ ID NO: 7546166 - DNA, 22 bp, Homo sapiens
ggtgggaaggccactgaaggtt

SEQ ID NO: 7546167 - DNA, 22 bp, Homo sapiens
ggtgggaaggccactgaaggtt

SEQ ID NO: 7546168 - DNA, 22 bp, Homo sapiens
ggtgggaaggccactgaaggtt

SEQ ID NO: 7546169 - DNA, 22 bp, Homo sapiens
ggtgggaaggggccagtgtgcg

SEQ ID NO: 7546170 - DNA, 22 bp, Homo sapiens
ggtgggaaggggccagtgtgcg

SEQ ID NO: 7546171 - DNA, 22 bp, Homo sapiens
ggtgggaaggggccagtgtgcg

SEQ ID NO: 7546172 - DNA, 22 bp, Homo sapiens
cagcactatgacatttaattct

SEQ ID NO: 7546173 - DNA, 22 bp, Homo sapiens
cagcactcccaggagaaccagc

SEQ ID NO: 7546174 - DNA, 22 bp, Homo sapiens
cagcactatgacatttaattct

SEQ ID NO: 7546175 - DNA, 22 bp, Homo sapiens
ggtgggacaggtaggagtggct

SEQ ID NO: 7546176 - DNA, 22 bp, Homo sapiens
ggtgggacaggtaggagtggct

SEQ ID NO: 7546177 - DNA, 22 bp, Homo sapiens
ggtgggacaggtaggagtggct

SEQ ID NO: 7546178 - DNA, 22 bp, Homo sapiens
ggtggcagtggtctctgacaga

SEQ ID NO: 7546179 - DNA, 22 bp, Homo sapiens
ggtggcagtggtctctgacaga

SEQ ID NO: 7546180 - DNA, 22 bp, Homo sapiens
ggtggcagtggtctctgacaga

SEQ ID NO: 7546181 - DNA, 22 bp, Homo sapiens
ggtggcagtgcttgcgggtcta

SEQ ID NO: 7546182 - DNA, 22 bp, Homo sapiens
ggtggcagtggtctctgacaga

SEQ ID NO: 7546183 - DNA, 22 bp, Homo sapiens
ggtggcagttacaggggcaaat

SEQ ID NO: 7546184 - DNA, 22 bp, Homo sapiens
ggtggcagttacaggggcaaat

SEQ ID NO: 7546185 - DNA, 22 bp, Homo sapiens
ggtggcagttacaggggcaaat

SEQ ID NO: 7546186 - DNA, 22 bp, Homo sapiens
ggtggctgcttcctcaagagga

SEQ ID NO: 7546187 - DNA, 22 bp, Homo sapiens
ggtggctgcaccctggctaact

SEQ ID NO: 7546188 - DNA, 22 bp, Homo sapiens
ggtggctgcttcctcaagagga

SEQ ID NO: 7546189 - DNA, 22 bp, Homo sapiens
ggtggctggaggagctgatgga

SEQ ID NO: 7546190 - DNA, 22 bp, Homo sapiens
ggtggctggaggagctgatgga

SEQ ID NO: 7546191 - DNA, 22 bp, Homo sapiens
ggtggctggaggagctgatgga

SEQ ID NO: 7546192 - DNA, 22 bp, Homo sapiens
ggtggctggaggagctgatgga

SEQ ID NO: 7546193 - DNA, 22 bp, Homo sapiens
ggtggctggaggagctgatgga

SEQ ID NO: 7546194 - DNA, 22 bp, Homo sapiens
ggtggctggaggagctgatgga

SEQ ID NO: 7546195 - DNA, 22 bp, Homo sapiens
ggtggctggaggagctgatgga

SEQ ID NO: 7546196 - DNA, 18 bp, Homo sapiens
ggtgggaagccagggcct

SEQ ID NO: 7546197 - DNA, 22 bp, Homo sapiens
ggtggctgtgagcattatgtga

SEQ ID NO: 7546198 - DNA, 22 bp, Homo sapiens
ggtggctggttttataagaggt

SEQ ID NO: 7546199 - DNA, 22 bp, Homo sapiens
ggtggctggttttataagaggt

SEQ ID NO: 7546200 - DNA, 18 bp, Homo sapiens
ggtggctggggacggaca

SEQ ID NO: 7546201 - DNA, 18 bp, Homo sapiens
ggtggctggggacggaca

SEQ ID NO: 7546202 - DNA, 22 bp, Homo sapiens
ggtggctgggattagtagccca

SEQ ID NO: 7546203 - DNA, 18 bp, Homo sapiens
ggtggctggggacggaca

SEQ ID NO: 7546204 - DNA, 18 bp, Homo sapiens
ggtggctggggacggaca

SEQ ID NO: 7546205 - DNA, 22 bp, Homo sapiens
ggtggctgggattagtagccca

SEQ ID NO: 7546206 - DNA, 22 bp, Homo sapiens
ggtggctgggattagtagccca

SEQ ID NO: 7546207 - DNA, 22 bp, Homo sapiens
ggtggctggaggagctgatgga

SEQ ID NO: 7546208 - DNA, 22 bp, Homo sapiens
ggtggctgggattagtagccca

SEQ ID NO: 7546209 - DNA, 22 bp, Homo sapiens
ggtggctgggattagtagccca

SEQ ID NO: 7546210 - DNA, 22 bp, Homo sapiens
ggtggctggaggagctgatgga

SEQ ID NO: 7546211 - DNA, 22 bp, Homo sapiens
cagatgctatgtattatgtatg

SEQ ID NO: 7546212 - DNA, 22 bp, Homo sapiens
cagatgctatagtgctgccata

SEQ ID NO: 7546213 - DNA, 22 bp, Homo sapiens
cagatgctatagtgctgccata

SEQ ID NO: 7546214 - DNA, 22 bp, Homo sapiens
cagatgctgcctgggaatgtct

SEQ ID NO: 7546215 - DNA, 22 bp, Homo sapiens
cagatgctgctatttcaccctg

SEQ ID NO: 7546216 - DNA, 22 bp, Homo sapiens
cagatgctgctcacctgattat

SEQ ID NO: 7546217 - DNA, 22 bp, Homo sapiens
cagatgcttcgtgggtgagcac

SEQ ID NO: 7546218 - DNA, 22 bp, Homo sapiens
cagatgcttcgtgggtgagcac

SEQ ID NO: 7546219 - DNA, 22 bp, Homo sapiens
cagatgcttcgtgggtgagcac

SEQ ID NO: 7546220 - DNA, 20 bp, Homo sapiens
cagatgctggatcttggtcc

SEQ ID NO: 7546221 - DNA, 20 bp, Homo sapiens
cagatgctggatcttggtcc

SEQ ID NO: 7546222 - DNA, 22 bp, Homo sapiens
cagatgctggtatgggggaggt

SEQ ID NO: 7546223 - DNA, 22 bp, Homo sapiens
ggtgcagatctttctcttcagg

SEQ ID NO: 7546224 - DNA, 22 bp, Homo sapiens
ggtgcagcagtttgttcagctt

SEQ ID NO: 7546225 - DNA, 22 bp, Homo sapiens
ggtgcagcagtttgttcagctt

SEQ ID NO: 7546226 - DNA, 22 bp, Homo sapiens
ggtgcagagtccacagaaagct

SEQ ID NO: 7546227 - DNA, 22 bp, Homo sapiens
ggtgcagatctttctcttcagg

SEQ ID NO: 7546228 - DNA, 22 bp, Homo sapiens
ggtgcagcctccccagtgacag

SEQ ID NO: 7546229 - DNA, 22 bp, Homo sapiens
ggtgcagcctccccagtgacag

SEQ ID NO: 7546230 - DNA, 22 bp, Homo sapiens
ggtgcagcctccccagtgacag

SEQ ID NO: 7546231 - DNA, 22 bp, Homo sapiens
ggtgcagagtccacagaaagct

SEQ ID NO: 7546232 - DNA, 22 bp, Homo sapiens
ggtgcagagtccacagaaagct

SEQ ID NO: 7546233 - DNA, 22 bp, Homo sapiens
ggtgcagaggagccagctgggg

SEQ ID NO: 7546234 - DNA, 22 bp, Homo sapiens
ggtgcagagtccacagaaagct

SEQ ID NO: 7546235 - DNA, 22 bp, Homo sapiens
ggtgcagagtccacagaaagct

SEQ ID NO: 7546236 - DNA, 22 bp, Homo sapiens
ggtgcagctggacagagaagcc

SEQ ID NO: 7546237 - DNA, 22 bp, Homo sapiens
ggtgcaggaaaattacctggag

SEQ ID NO: 7546238 - DNA, 22 bp, Homo sapiens
cagatgctatagtgctgccata

SEQ ID NO: 7546239 - DNA, 22 bp, Homo sapiens
cagatgctatagtgctgccata

SEQ ID NO: 7546240 - DNA, 22 bp, Homo sapiens
ggtgcaggaaaattacctggag

SEQ ID NO: 7546241 - DNA, 22 bp, Homo sapiens
ggtgcagctggacagagaagcc

SEQ ID NO: 7546242 - DNA, 22 bp, Homo sapiens
ggtgcagctggacagagaagcc

SEQ ID NO: 7546243 - DNA, 22 bp, Homo sapiens
ggtgcagctgcagcctgggagc

SEQ ID NO: 7546244 - DNA, 22 bp, Homo sapiens
ggtgcagctgcagcctgggagc

SEQ ID NO: 7546245 - DNA, 22 bp, Homo sapiens
ggtgcagcctttgtttctactt

SEQ ID NO: 7546246 - DNA, 22 bp, Homo sapiens
ggtgcagcctttgtttctactt

SEQ ID NO: 7546247 - DNA, 22 bp, Homo sapiens
ggtgcaaaagtagttctgcttt

SEQ ID NO: 7546248 - DNA, 22 bp, Homo sapiens
ggtgagaggcagtgctgtggaa

SEQ ID NO: 7546249 - DNA, 22 bp, Homo sapiens
ggtgagaggcagaggacagctt

SEQ ID NO: 7546250 - DNA, 22 bp, Homo sapiens
ggtgagaggcagaggacagctt

SEQ ID NO: 7546251 - DNA, 22 bp, Homo sapiens
ggtgcaaagatggcagttgcaa

SEQ ID NO: 7546252 - DNA, 22 bp, Homo sapiens
ggtgcaaacgtaattgtggttt

SEQ ID NO: 7546253 - DNA, 22 bp, Homo sapiens
ggtgcaaacgtaattgtggttt

SEQ ID NO: 7546254 - DNA, 22 bp, Homo sapiens
ggtgcaaagggcctagagagtg

SEQ ID NO: 7546255 - DNA, 22 bp, Homo sapiens
ggtgcaaagggcctagagagtg

SEQ ID NO: 7546256 - DNA, 22 bp, Homo sapiens
ggtgcaagagctccaggccctg

SEQ ID NO: 7546257 - DNA, 22 bp, Homo sapiens
ggtgcacttcttgctagtcttt

SEQ ID NO: 7546258 - DNA, 22 bp, Homo sapiens
ggtgcacttcttgctagtcttt

SEQ ID NO: 7546259 - DNA, 22 bp, Homo sapiens
ggtgcaataaagttgtagaacc

SEQ ID NO: 7546260 - DNA, 22 bp, Homo sapiens
ggtgcaatggtgagggcagcca

SEQ ID NO: 7546261 - DNA, 19 bp, Homo sapiens
ggtgcactgggaatgcagc

SEQ ID NO: 7546262 - DNA, 22 bp, Homo sapiens
ggtgcagaagaaagcagtcatt

SEQ ID NO: 7546263 - DNA, 22 bp, Homo sapiens
ggtgcaagggttgagttgagtg

SEQ ID NO: 7546264 - DNA, 22 bp, Homo sapiens
ggtgcaagagctccaggccctg

SEQ ID NO: 7546265 - DNA, 22 bp, Homo sapiens
ggtgcaagggttgagttgagtg

SEQ ID NO: 7546266 - DNA, 22 bp, Homo sapiens
ggtgcaaggccaccatctagtg

SEQ ID NO: 7546267 - DNA, 22 bp, Homo sapiens
ggtgcaagtggctagggaccag

SEQ ID NO: 7546268 - DNA, 22 bp, Homo sapiens
ggtgcaagttttttgaggaagt

SEQ ID NO: 7546269 - DNA, 22 bp, Homo sapiens
ggtgcaagttttttgaggaagt

SEQ ID NO: 7546270 - DNA, 22 bp, Homo sapiens
ggtgcagaaggaagggagctgg

SEQ ID NO: 7546271 - DNA, 22 bp, Homo sapiens
ggtgcagaaggaagggagctgg

SEQ ID NO: 7546272 - DNA, 22 bp, Homo sapiens
ggtgcagaaggaagggagctgg

SEQ ID NO: 7546273 - DNA, 22 bp, Homo sapiens
ggtgcagaaggaagggagctgg

SEQ ID NO: 7546274 - DNA, 22 bp, Homo sapiens
ggtgcagaagaaagcagtcatt

SEQ ID NO: 7546275 - DNA, 22 bp, Homo sapiens
ggtgcagaagaaagcagtcatt

SEQ ID NO: 7546276 - DNA, 22 bp, Homo sapiens
ggtgcagaagaaagcagtcatt

SEQ ID NO: 7546277 - DNA, 22 bp, Homo sapiens
ggtgcagaagaaagcagtcatt

SEQ ID NO: 7546278 - DNA, 22 bp, Homo sapiens
ggtgcagaagaaagcagtcatt

SEQ ID NO: 7546279 - DNA, 22 bp, Homo sapiens
ggtgcagaagaaagcagtcatt

SEQ ID NO: 7546280 - DNA, 22 bp, Homo sapiens
ggtgcagaaggaagggagctgg

SEQ ID NO: 7546281 - DNA, 22 bp, Homo sapiens
ggtgcagaaggaagggagctgg

SEQ ID NO: 7546282 - DNA, 22 bp, Homo sapiens
ggtgcagaggagccagctgggg

SEQ ID NO: 7546283 - DNA, 22 bp, Homo sapiens
ggtgcagaggagccagctgggg

SEQ ID NO: 7546284 - DNA, 22 bp, Homo sapiens
ggtgcagaggagccagctgggg

SEQ ID NO: 7546285 - DNA, 22 bp, Homo sapiens
ggtgcagaggagccagctgggg

SEQ ID NO: 7546286 - DNA, 22 bp, Homo sapiens
ggtgcagaggagccagctgggg

SEQ ID NO: 7546287 - DNA, 22 bp, Homo sapiens
ggtgcagagcagtgtcagagca

SEQ ID NO: 7546288 - DNA, 22 bp, Homo sapiens
ggtgcagagcagtgtcagagca

SEQ ID NO: 7546289 - DNA, 22 bp, Homo sapiens
ggtgcagagcagtgtcagagca

SEQ ID NO: 7546290 - DNA, 22 bp, Homo sapiens
ggtgcagagcagtgtcagagca

SEQ ID NO: 7546291 - DNA, 22 bp, Homo sapiens
ggtgcagagcagtgtcagagca

SEQ ID NO: 7546292 - DNA, 22 bp, Homo sapiens
ggtgcagagcagtgtcagagca

SEQ ID NO: 7546293 - DNA, 22 bp, Homo sapiens
cagataaatagacttggtcaga

SEQ ID NO: 7546294 - DNA, 22 bp, Homo sapiens
cagataaatagacttggtcaga

SEQ ID NO: 7546295 - DNA, 22 bp, Homo sapiens
cagataaatagatagataaact

SEQ ID NO: 7546296 - DNA, 22 bp, Homo sapiens
cagataaatagatagataaact

SEQ ID NO: 7546297 - DNA, 22 bp, Homo sapiens
cagataaatagatagataaact

SEQ ID NO: 7546298 - DNA, 22 bp, Homo sapiens
cagataaatagatagataaact

SEQ ID NO: 7546299 - DNA, 22 bp, Homo sapiens
cagataaatagatagataaact

SEQ ID NO: 7546300 - DNA, 22 bp, Homo sapiens
cagataaatagatagataaact

SEQ ID NO: 7546301 - DNA, 22 bp, Homo sapiens
cagataaatagatagataaact

SEQ ID NO: 7546302 - DNA, 22 bp, Homo sapiens
cagataatccaagtagttttca

SEQ ID NO: 7546303 - DNA, 22 bp, Homo sapiens
cagatacagctagctccgtggc

SEQ ID NO: 7546304 - DNA, 22 bp, Homo sapiens
cagatacaggtttttgttagat

SEQ ID NO: 7546305 - DNA, 22 bp, Homo sapiens
cagatacaggtttttgttagat

SEQ ID NO: 7546306 - DNA, 22 bp, Homo sapiens
cagatacagctagctccgtggc

SEQ ID NO: 7546307 - DNA, 22 bp, Homo sapiens
cagataactgaaatatcatacc

SEQ ID NO: 7546308 - DNA, 22 bp, Homo sapiens
cagataacacaaagaaatgggc

SEQ ID NO: 7546309 - DNA, 22 bp, Homo sapiens
cagataataatatgacttcact

SEQ ID NO: 7546310 - DNA, 22 bp, Homo sapiens
cagataaatagacttggtcaga

SEQ ID NO: 7546311 - DNA, 22 bp, Homo sapiens
cagataaaggcttactagtagt

SEQ ID NO: 7546312 - DNA, 22 bp, Homo sapiens
cagataaaggcttactagtagt

SEQ ID NO: 7546313 - DNA, 22 bp, Homo sapiens
cagataaaggcttactagtagt

SEQ ID NO: 7546314 - DNA, 22 bp, Homo sapiens
cagataaaggcttactagtagt

SEQ ID NO: 7546315 - DNA, 22 bp, Homo sapiens
cagataaaggcttactagtagt

SEQ ID NO: 7546316 - DNA, 22 bp, Homo sapiens
cagataaaggcttactagtagt

SEQ ID NO: 7546317 - DNA, 22 bp, Homo sapiens
cagataaaggcttactagtagt

SEQ ID NO: 7546318 - DNA, 20 bp, Homo sapiens
cagataaacgggaaagaagc

SEQ ID NO: 7546319 - DNA, 22 bp, Homo sapiens
cagataaaattaatattaccaa

SEQ ID NO: 7546320 - DNA, 22 bp, Homo sapiens
cagataaaattaatattaccaa

SEQ ID NO: 7546321 - DNA, 22 bp, Homo sapiens
cagagttttgtgaacaacttgg

SEQ ID NO: 7546322 - DNA, 22 bp, Homo sapiens
cagagttttgtgaacaacttgg

SEQ ID NO: 7546323 - DNA, 22 bp, Homo sapiens
cagataaaattaatattaccaa

SEQ ID NO: 7546324 - DNA, 22 bp, Homo sapiens
cagataaaattaatattaccaa

SEQ ID NO: 7546325 - DNA, 20 bp, Homo sapiens
cagataaacgggaaagaagc

SEQ ID NO: 7546326 - DNA, 20 bp, Homo sapiens
cagataaacgggaaagaagc

SEQ ID NO: 7546327 - DNA, 20 bp, Homo sapiens
cagataaacgggaaagaagc

SEQ ID NO: 7546328 - DNA, 20 bp, Homo sapiens
cagataaacgggaaagaagc

SEQ ID NO: 7546329 - DNA, 22 bp, Homo sapiens
cagataaaattaatattaccaa

SEQ ID NO: 7546330 - DNA, 22 bp, Homo sapiens
cagataaaattaatattaccaa

SEQ ID NO: 7546331 - DNA, 22 bp, Homo sapiens
cagatacattaaaatgatgatt

SEQ ID NO: 7546332 - DNA, 22 bp, Homo sapiens
cagatacattaaaatgatgatt

SEQ ID NO: 7546333 - DNA, 22 bp, Homo sapiens
cagatacattaaaatgatgatt

SEQ ID NO: 7546334 - DNA, 22 bp, Homo sapiens
cagatacattaaaatgatgatt

SEQ ID NO: 7546335 - DNA, 22 bp, Homo sapiens
cagatacaggtttttgttagat

SEQ ID NO: 7546336 - DNA, 22 bp, Homo sapiens
cagatacattaaaatgatgatt

SEQ ID NO: 7546337 - DNA, 22 bp, Homo sapiens
cagatacattaaaatgatgatt

SEQ ID NO: 7546338 - DNA, 22 bp, Homo sapiens
cagatacattaaaatgatgatt

SEQ ID NO: 7546339 - DNA, 22 bp, Homo sapiens
cagatactgtaaaatttcagta

SEQ ID NO: 7546340 - DNA, 22 bp, Homo sapiens
cagatagaatgcaagacctctc

SEQ ID NO: 7546341 - DNA, 22 bp, Homo sapiens
cagataggaaaagctaggcata

SEQ ID NO: 7546342 - DNA, 22 bp, Homo sapiens
cagataggaaagggcatcccag

SEQ ID NO: 7546343 - DNA, 22 bp, Homo sapiens
cagataggaaaagctaggcata

SEQ ID NO: 7546344 - DNA, 22 bp, Homo sapiens
cagatagcgtttgagagcataa

SEQ ID NO: 7546345 - DNA, 22 bp, Homo sapiens
cagatagcaaatgggtaagcta

SEQ ID NO: 7546346 - DNA, 22 bp, Homo sapiens
cagatagaatgcaagacctctc

SEQ ID NO: 7546347 - DNA, 22 bp, Homo sapiens
cagatagaatgcaagacctctc

SEQ ID NO: 7546348 - DNA, 22 bp, Homo sapiens
cagatactgtaaaatttcagta

SEQ ID NO: 7546349 - DNA, 22 bp, Homo sapiens
cagatagcaatttgggcagggg

SEQ ID NO: 7546350 - DNA, 22 bp, Homo sapiens
cagatagcaatttgggcagggg

SEQ ID NO: 7546351 - DNA, 22 bp, Homo sapiens
cagatagcgtttgagagcataa

SEQ ID NO: 7546352 - DNA, 22 bp, Homo sapiens
cagatagcgtttgagagcataa

SEQ ID NO: 7546353 - DNA, 22 bp, Homo sapiens
ggtgagaggcagaggacagctt

SEQ ID NO: 7546354 - DNA, 22 bp, Homo sapiens
ggtgagaggcagaggacagctt

SEQ ID NO: 7546355 - DNA, 22 bp, Homo sapiens
ggtgagaggcagaggacagctt

SEQ ID NO: 7546356 - DNA, 22 bp, Homo sapiens
cagatatattttccttattagg

SEQ ID NO: 7546357 - DNA, 22 bp, Homo sapiens
cagatatattcatttgcagtgc

SEQ ID NO: 7546358 - DNA, 22 bp, Homo sapiens
cagatatattttatttggtcaa

SEQ ID NO: 7546359 - DNA, 22 bp, Homo sapiens
cagatatattttatttggtcaa

SEQ ID NO: 7546360 - DNA, 22 bp, Homo sapiens
cagatatattttccttattagg

SEQ ID NO: 7546361 - DNA, 22 bp, Homo sapiens
cagatatattttccttattagg

SEQ ID NO: 7546362 - DNA, 22 bp, Homo sapiens
cagatatagtggcttgcctggg

SEQ ID NO: 7546363 - DNA, 22 bp, Homo sapiens
cagatatattcatttgcagtgc

SEQ ID NO: 7546364 - DNA, 22 bp, Homo sapiens
cagatatattcatttgcagtgc

SEQ ID NO: 7546365 - DNA, 22 bp, Homo sapiens
cagatatatattcatcaggctg

SEQ ID NO: 7546366 - DNA, 20 bp, Homo sapiens
cagataggttagtgtttcag

SEQ ID NO: 7546367 - DNA, 22 bp, Homo sapiens
cagatataaatggatgtggtag

SEQ ID NO: 7546368 - DNA, 22 bp, Homo sapiens
cagatataaatggatgtggtag

SEQ ID NO: 7546369 - DNA, 22 bp, Homo sapiens
cagatataagaaagctattgtc

SEQ ID NO: 7546370 - DNA, 22 bp, Homo sapiens
cagatagtaacctttctagagc

SEQ ID NO: 7546371 - DNA, 22 bp, Homo sapiens
cagatagtaacctttctagagc

SEQ ID NO: 7546372 - DNA, 22 bp, Homo sapiens
cagatataaatggatgtggtag

SEQ ID NO: 7546373 - DNA, 22 bp, Homo sapiens
cagaggctgagcagtcagtttg

SEQ ID NO: 7546374 - DNA, 22 bp, Homo sapiens
cagaggctgagcagtcagtttg

SEQ ID NO: 7546375 - DNA, 22 bp, Homo sapiens
cagaggctgagcagtcagtttg

SEQ ID NO: 7546376 - DNA, 22 bp, Homo sapiens
cagaggctgagcagtcagtttg

SEQ ID NO: 7546377 - DNA, 22 bp, Homo sapiens
cagaggctgatggctgtagcca

SEQ ID NO: 7546378 - DNA, 21 bp, Homo sapiens
cagaggctgagagggcaatct

SEQ ID NO: 7546379 - DNA, 21 bp, Homo sapiens
cagaggctgagagggcaatct

SEQ ID NO: 7546380 - DNA, 21 bp, Homo sapiens
cagaggctgagagggcaatct

SEQ ID NO: 7546381 - DNA, 21 bp, Homo sapiens
cagaggctgagagggcaatct

SEQ ID NO: 7546382 - DNA, 22 bp, Homo sapiens
cagaggctgatggctgtagcca

SEQ ID NO: 7546383 - DNA, 22 bp, Homo sapiens
cagaggctgatggctgtagcca

SEQ ID NO: 7546384 - DNA, 22 bp, Homo sapiens
cagaggctgatggctgtagcca

SEQ ID NO: 7546385 - DNA, 22 bp, Homo sapiens
cagaggctgatggctgtagcca

SEQ ID NO: 7546386 - DNA, 22 bp, Homo sapiens
cagaggctgatggctgtagcca

SEQ ID NO: 7546387 - DNA, 22 bp, Homo sapiens
cagaggctgatggctgtagcca

SEQ ID NO: 7546388 - DNA, 22 bp, Homo sapiens
cagaggctgatgtgggatgggc

SEQ ID NO: 7546389 - DNA, 22 bp, Homo sapiens
cagaggctgatgtgggatgggc

SEQ ID NO: 7546390 - DNA, 22 bp, Homo sapiens
cagaggctgatgtgggatgggc

SEQ ID NO: 7546391 - DNA, 22 bp, Homo sapiens
cagaggctgatgtgggatgggc

SEQ ID NO: 7546392 - DNA, 22 bp, Homo sapiens
cagaggctgatgtgggatgggc

SEQ ID NO: 7546393 - DNA, 22 bp, Homo sapiens
cagaggctgaccctgctgttgt

SEQ ID NO: 7546394 - DNA, 22 bp, Homo sapiens
cagaggctgaccctgctgttgt

SEQ ID NO: 7546395 - DNA, 22 bp, Homo sapiens
cagaggctgaccctgctgttgt

SEQ ID NO: 7546396 - DNA, 21 bp, Homo sapiens
cagaggctgagagggcaatct

SEQ ID NO: 7546397 - DNA, 22 bp, Homo sapiens
cagaggctgaccctgctgttgt

SEQ ID NO: 7546398 - DNA, 22 bp, Homo sapiens
cagaggcctttctacagtgata

SEQ ID NO: 7546399 - DNA, 22 bp, Homo sapiens
cagaggctgaccctgctgttgt

SEQ ID NO: 7546400 - DNA, 22 bp, Homo sapiens
cagaggcctttctacagtgata

SEQ ID NO: 7546401 - DNA, 22 bp, Homo sapiens
cagaggcaggataagaactgcg

SEQ ID NO: 7546402 - DNA, 22 bp, Homo sapiens
cagaggcaggataagaactgcg

SEQ ID NO: 7546403 - DNA, 22 bp, Homo sapiens
cagaggcaggataagaactgcg

SEQ ID NO: 7546404 - DNA, 22 bp, Homo sapiens
cagaggcaggataagaactgcg

SEQ ID NO: 7546405 - DNA, 22 bp, Homo sapiens
cagaggcaggataagaactgcg

SEQ ID NO: 7546406 - DNA, 22 bp, Homo sapiens
cagaggcaggataagaactgcg

SEQ ID NO: 7546407 - DNA, 22 bp, Homo sapiens
cagaggcctttctacagtgata

SEQ ID NO: 7546408 - DNA, 22 bp, Homo sapiens
cagaggcctttctacagtgata

SEQ ID NO: 7546409 - DNA, 22 bp, Homo sapiens
cagaggcctttctacagtgata

SEQ ID NO: 7546410 - DNA, 22 bp, Homo sapiens
cagaggcctttctacagtgata

SEQ ID NO: 7546411 - DNA, 22 bp, Homo sapiens
ggggtagtcctggtgatggctg

SEQ ID NO: 7546412 - DNA, 22 bp, Homo sapiens
ggggtcaagctcagaatcctag

SEQ ID NO: 7546413 - DNA, 22 bp, Homo sapiens
ggggtatgcttagtaagtacca

SEQ ID NO: 7546414 - DNA, 22 bp, Homo sapiens
ggggtagtcctggtgatggctg

SEQ ID NO: 7546415 - DNA, 22 bp, Homo sapiens
ggggtagtaccttcgtatgctg

SEQ ID NO: 7546416 - DNA, 22 bp, Homo sapiens
ggggtaggtcatagcccctcta

SEQ ID NO: 7546417 - DNA, 22 bp, Homo sapiens
ggggtaggtcatagcccctcta

SEQ ID NO: 7546418 - DNA, 22 bp, Homo sapiens
ggggtaggtcatagcccctcta

SEQ ID NO: 7546419 - DNA, 22 bp, Homo sapiens
ggggtagggtgattgtgaagta

SEQ ID NO: 7546420 - DNA, 22 bp, Homo sapiens
ggggtagggtgattgtgaagta

SEQ ID NO: 7546421 - DNA, 22 bp, Homo sapiens
cagaggctgctctgggtggcat

SEQ ID NO: 7546422 - DNA, 22 bp, Homo sapiens
cagaggctgctctgggtggcat

SEQ ID NO: 7546423 - DNA, 22 bp, Homo sapiens
cagaggctgctctgggtggcat

SEQ ID NO: 7546424 - DNA, 22 bp, Homo sapiens
cagaggctgctctgggtggcat

SEQ ID NO: 7546425 - DNA, 22 bp, Homo sapiens
cagaggctgctctgggtggcat

SEQ ID NO: 7546426 - DNA, 22 bp, Homo sapiens
cagaggctgctctgggtggcat

SEQ ID NO: 7546427 - DNA, 22 bp, Homo sapiens
cagaggctgctctgggtggcat

SEQ ID NO: 7546428 - DNA, 22 bp, Homo sapiens
ggggtagggtgattgtgaagta

SEQ ID NO: 7546429 - DNA, 22 bp, Homo sapiens
ggggtagggtgattgtgaagta

SEQ ID NO: 7546430 - DNA, 22 bp, Homo sapiens
ggggtagggtgattgtgaagta

SEQ ID NO: 7546431 - DNA, 22 bp, Homo sapiens
ggggtagggtgattgtgaagta

SEQ ID NO: 7546432 - DNA, 22 bp, Homo sapiens
cagaggctgatgtgggatgggc

SEQ ID NO: 7546433 - DNA, 22 bp, Homo sapiens
cagaggctgatgtgggatgggc

SEQ ID NO: 7546434 - DNA, 22 bp, Homo sapiens
cagaggctgatgtgggatgggc

SEQ ID NO: 7546435 - DNA, 22 bp, Homo sapiens
cagaggctgatgtgggatgggc

SEQ ID NO: 7546436 - DNA, 22 bp, Homo sapiens
cagaggctgccagccatgtgca

SEQ ID NO: 7546437 - DNA, 22 bp, Homo sapiens
cagaggctgccagccatgtgca

SEQ ID NO: 7546438 - DNA, 22 bp, Homo sapiens
cagaggctgccagccatgtgca

SEQ ID NO: 7546439 - DNA, 22 bp, Homo sapiens
cagaggctgccagccatgtgca

SEQ ID NO: 7546440 - DNA, 22 bp, Homo sapiens
cagaggctgccagccatgtgca

SEQ ID NO: 7546441 - DNA, 22 bp, Homo sapiens
cagaggctgctctgggtggcat

SEQ ID NO: 7546442 - DNA, 22 bp, Homo sapiens
cagaggctgctctgggtggcat

SEQ ID NO: 7546443 - DNA, 22 bp, Homo sapiens
cagaggctgccagccatgtgca

SEQ ID NO: 7546444 - DNA, 22 bp, Homo sapiens
cagaggctgccagccatgtgca

SEQ ID NO: 7546445 - DNA, 22 bp, Homo sapiens
cagaggctgccagccatgtgca

SEQ ID NO: 7546446 - DNA, 22 bp, Homo sapiens
cagaggctgccagccatgtgca

SEQ ID NO: 7546447 - DNA, 22 bp, Homo sapiens
cagaggctgccagccatgtgca

SEQ ID NO: 7546448 - DNA, 19 bp, Homo sapiens
cagagtttgcaggcagagg

SEQ ID NO: 7546449 - DNA, 22 bp, Homo sapiens
cagagtttgcaagggcagaagc

SEQ ID NO: 7546450 - DNA, 22 bp, Homo sapiens
cagagtttgcaagggcagaagc

SEQ ID NO: 7546451 - DNA, 22 bp, Homo sapiens
cagagtttcggtaagcatagaa

SEQ ID NO: 7546452 - DNA, 22 bp, Homo sapiens
cagagtttaaacaaatgaaata

SEQ ID NO: 7546453 - DNA, 22 bp, Homo sapiens
cagagtttcggtaagcatagaa

SEQ ID NO: 7546454 - DNA, 22 bp, Homo sapiens
cagagttttatgtatgcatgta

SEQ ID NO: 7546455 - DNA, 22 bp, Homo sapiens
cagagttttgtgaacaacttgg

SEQ ID NO: 7546456 - DNA, 22 bp, Homo sapiens
cagagttttatgtatgcatgta

SEQ ID NO: 7546457 - DNA, 22 bp, Homo sapiens
cagagttttatgtatgcatgta

SEQ ID NO: 7546458 - DNA, 22 bp, Homo sapiens
cagagttttatgtatgcatgta

SEQ ID NO: 7546459 - DNA, 22 bp, Homo sapiens
cagagtttgcaagggcagaagc

SEQ ID NO: 7546460 - DNA, 19 bp, Homo sapiens
cagagtttgcaggcagagg

SEQ ID NO: 7546461 - DNA, 22 bp, Homo sapiens
cagagttttatcatacgtggat

SEQ ID NO: 7546462 - DNA, 22 bp, Homo sapiens
cagagtttaaacaaatgaaata

SEQ ID NO: 7546463 - DNA, 22 bp, Homo sapiens
cagagtttcggtaagcatagaa

SEQ ID NO: 7546464 - DNA, 22 bp, Homo sapiens
cagagtttaaacaaatgaaata

SEQ ID NO: 7546465 - DNA, 22 bp, Homo sapiens
cagagttcaaagcctgctggga

SEQ ID NO: 7546466 - DNA, 19 bp, Homo sapiens
cagagttacatggctgtgg

SEQ ID NO: 7546467 - DNA, 19 bp, Homo sapiens
cagagttacatggctgtgg

SEQ ID NO: 7546468 - DNA, 22 bp, Homo sapiens
cagagtgtttctttgggtgggt

SEQ ID NO: 7546469 - DNA, 16 bp, Homo sapiens
cagagtgtaaacagga

SEQ ID NO: 7546470 - DNA, 22 bp, Homo sapiens
cagagtggtgcaagggcagtgt

SEQ ID NO: 7546471 - DNA, 22 bp, Homo sapiens
cagagtggtgcaagggcagtgt

SEQ ID NO: 7546472 - DNA, 22 bp, Homo sapiens
cagagtgggctgtcagccacca

SEQ ID NO: 7546473 - DNA, 22 bp, Homo sapiens
cagagtggtgcaagggcagtgt

SEQ ID NO: 7546474 - DNA, 22 bp, Homo sapiens
cagagtgtggcatcttccaact

SEQ ID NO: 7546475 - DNA, 22 bp, Homo sapiens
cagagtggtgcaagggcagtgt

SEQ ID NO: 7546476 - DNA, 22 bp, Homo sapiens
cagagtggtgcaagggcagtgt

SEQ ID NO: 7546477 - DNA, 22 bp, Homo sapiens
cagagtgggctgtcagccacca

SEQ ID NO: 7546478 - DNA, 22 bp, Homo sapiens
ggggtgagctgggcctgtgcct

SEQ ID NO: 7546479 - DNA, 18 bp, Homo sapiens
cagagtgggccaagagac

SEQ ID NO: 7546480 - DNA, 22 bp, Homo sapiens
cagagtgaaaactgagctcaaa

SEQ ID NO: 7546481 - DNA, 18 bp, Homo sapiens
cagagtgggccaagagac

SEQ ID NO: 7546482 - DNA, 22 bp, Homo sapiens
cagagtgggctgtcagccacca

SEQ ID NO: 7546483 - DNA, 22 bp, Homo sapiens
cagagtgggctgtcagccacca

SEQ ID NO: 7546484 - DNA, 22 bp, Homo sapiens
ggggtcctggaggccagctgga

SEQ ID NO: 7546485 - DNA, 22 bp, Homo sapiens
ggggtctcactatgttacccag

SEQ ID NO: 7546486 - DNA, 22 bp, Homo sapiens
ggggtcggggcatagccactta

SEQ ID NO: 7546487 - DNA, 22 bp, Homo sapiens
ggggtcggggcatagccactta

SEQ ID NO: 7546488 - DNA, 22 bp, Homo sapiens
ggggtctgctgcggagcagaga

SEQ ID NO: 7546489 - DNA, 22 bp, Homo sapiens
ggggtctgctgcggagcagaga

SEQ ID NO: 7546490 - DNA, 22 bp, Homo sapiens
ggggtctgctgcggagcagaga

SEQ ID NO: 7546491 - DNA, 22 bp, Homo sapiens
ggggtctgctgcggagcagaga

SEQ ID NO: 7546492 - DNA, 22 bp, Homo sapiens
ggggtctcactatgttacccag

SEQ ID NO: 7546493 - DNA, 22 bp, Homo sapiens
ggggtctgcgccactgtctgcg

SEQ ID NO: 7546494 - DNA, 22 bp, Homo sapiens
ggggtcctggaggccagctgga

SEQ ID NO: 7546495 - DNA, 22 bp, Homo sapiens
ggggtcctcggagcctgggtct

SEQ ID NO: 7546496 - DNA, 21 bp, Homo sapiens
ggggtcaagtgaatggtgttg

SEQ ID NO: 7546497 - DNA, 21 bp, Homo sapiens
ggggtcaagtgaatggtgttg

SEQ ID NO: 7546498 - DNA, 22 bp, Homo sapiens
ggggtcacactgtggtgactgg

SEQ ID NO: 7546499 - DNA, 22 bp, Homo sapiens
ggggtccctgcaccagcatgtc

SEQ ID NO: 7546500 - DNA, 22 bp, Homo sapiens
ggggtcacactgtggtgactgg

SEQ ID NO: 7546501 - DNA, 22 bp, Homo sapiens
ggggtccctgcaccagcatgtc

SEQ ID NO: 7546502 - DNA, 22 bp, Homo sapiens
ggggtctgggttgctcggcctt

SEQ ID NO: 7546503 - DNA, 22 bp, Homo sapiens
ggggtctgggttgctcggcctt

SEQ ID NO: 7546504 - DNA, 23 bp, Homo sapiens
ggggtcttggaacaggtggccct

SEQ ID NO: 7546505 - DNA, 22 bp, Homo sapiens
ggggtctgggcttagctggaat

SEQ ID NO: 7546506 - DNA, 22 bp, Homo sapiens
ggggtctgggcttagctggaat

SEQ ID NO: 7546507 - DNA, 22 bp, Homo sapiens
ggggtctgggcttagctggaat

SEQ ID NO: 7546508 - DNA, 22 bp, Homo sapiens
cagagtgaaaactgagctcaaa

SEQ ID NO: 7546509 - DNA, 22 bp, Homo sapiens
ggggtgagctgggcctgtgcct

SEQ ID NO: 7546510 - DNA, 22 bp, Homo sapiens
ggggtgagctgggcctgtgcct

SEQ ID NO: 7546511 - DNA, 22 bp, Homo sapiens
ggggtgagatcaaggaagccct

SEQ ID NO: 7546512 - DNA, 22 bp, Homo sapiens
cagagtgaaaactgagctcaaa

SEQ ID NO: 7546513 - DNA, 22 bp, Homo sapiens
ggggtgagatcaaggaagccct

SEQ ID NO: 7546514 - DNA, 22 bp, Homo sapiens
ggggtgagatcaaggaagccct

SEQ ID NO: 7546515 - DNA, 22 bp, Homo sapiens
ggggtgagatcaaggaagccct

SEQ ID NO: 7546516 - DNA, 22 bp, Homo sapiens
ggggtgagatcaaggaagccct

SEQ ID NO: 7546517 - DNA, 22 bp, Homo sapiens
ggggtgagatcaaggaagccct

SEQ ID NO: 7546518 - DNA, 22 bp, Homo sapiens
ggggtgagctgggcctgtgcct

SEQ ID NO: 7546519 - DNA, 22 bp, Homo sapiens
ggggtgagatcaaggaagccct

SEQ ID NO: 7546520 - DNA, 22 bp, Homo sapiens
gggggagctgttattggcaggg

SEQ ID NO: 7546521 - DNA, 22 bp, Homo sapiens
gggggagctgttattggcaggg

SEQ ID NO: 7546522 - DNA, 22 bp, Homo sapiens
gggggaggtgaatgcaataagg

SEQ ID NO: 7546523 - DNA, 22 bp, Homo sapiens
gggggaggtgaatgcaataagg

SEQ ID NO: 7546524 - DNA, 22 bp, Homo sapiens
gggggaggtgaatgcaataagg

SEQ ID NO: 7546525 - DNA, 22 bp, Homo sapiens
gggggaggtgaatgcaataagg

SEQ ID NO: 7546526 - DNA, 22 bp, Homo sapiens
gggggagctgttattggcaggg

SEQ ID NO: 7546527 - DNA, 23 bp, Homo sapiens
gggggagctggactcctagatcc

SEQ ID NO: 7546528 - DNA, 23 bp, Homo sapiens
gggggagctggactcctagatcc

SEQ ID NO: 7546529 - DNA, 22 bp, Homo sapiens
gggggagctagtccagctgagg

SEQ ID NO: 7546530 - DNA, 22 bp, Homo sapiens
gggggagctagtccagctgagg

SEQ ID NO: 7546531 - DNA, 22 bp, Homo sapiens
gggggagctagtccagctgagg

SEQ ID NO: 7546532 - DNA, 22 bp, Homo sapiens
gggggaggtgaatgcaataagg

SEQ ID NO: 7546533 - DNA, 22 bp, Homo sapiens
gggggaggtgaatgcaataagg

SEQ ID NO: 7546534 - DNA, 22 bp, Homo sapiens
gggggaggtgaatgcaataagg

SEQ ID NO: 7546535 - DNA, 22 bp, Homo sapiens
gggggaggtgaatgcaataagg

SEQ ID NO: 7546536 - DNA, 22 bp, Homo sapiens
gggggaggtgaatgcaataagg

SEQ ID NO: 7546537 - DNA, 22 bp, Homo sapiens
gggggaggtgaatgcaataagg

SEQ ID NO: 7546538 - DNA, 22 bp, Homo sapiens
gggggaggtgaatgcaataagg

SEQ ID NO: 7546539 - DNA, 22 bp, Homo sapiens
gggggaggtgaatgcaataagg

SEQ ID NO: 7546540 - DNA, 22 bp, Homo sapiens
cagaggacctgtgtggccagag

SEQ ID NO: 7546541 - DNA, 22 bp, Homo sapiens
cagaggaccattgtatgtattg

SEQ ID NO: 7546542 - DNA, 22 bp, Homo sapiens
cagaggaccattgtatgtattg

SEQ ID NO: 7546543 - DNA, 22 bp, Homo sapiens
cagaggacctgtgtggccagag

SEQ ID NO: 7546544 - DNA, 22 bp, Homo sapiens
cagaggacctgtgtggccagag

SEQ ID NO: 7546545 - DNA, 22 bp, Homo sapiens
cagaggaccagaaaggggccca

SEQ ID NO: 7546546 - DNA, 22 bp, Homo sapiens
cagaggacatgaaaactcgctc

SEQ ID NO: 7546547 - DNA, 22 bp, Homo sapiens
cagaggacaatagaatggaaag

SEQ ID NO: 7546548 - DNA, 22 bp, Homo sapiens
cagaggaccagaaaggggccca

SEQ ID NO: 7546549 - DNA, 22 bp, Homo sapiens
cagaggaccagaaaggggccca

SEQ ID NO: 7546550 - DNA, 22 bp, Homo sapiens
cagaggacttcccactcatctg

SEQ ID NO: 7546551 - DNA, 22 bp, Homo sapiens
cagaggacttcccactcatctg

SEQ ID NO: 7546552 - DNA, 22 bp, Homo sapiens
ggggcgcgtcagttccccgcct

SEQ ID NO: 7546553 - DNA, 22 bp, Homo sapiens
ggggcgccccgagggtgcgcac

SEQ ID NO: 7546554 - DNA, 22 bp, Homo sapiens
ggggcggggctctgagaagcat

SEQ ID NO: 7546555 - DNA, 22 bp, Homo sapiens
ggggcggggctctgagaagcat

SEQ ID NO: 7546556 - DNA, 22 bp, Homo sapiens
ggggcggggctctgagaagcat

SEQ ID NO: 7546557 - DNA, 22 bp, Homo sapiens
ggggcggggctctgagaagcat

SEQ ID NO: 7546558 - DNA, 22 bp, Homo sapiens
ggggcggggctctgagaagcat

SEQ ID NO: 7546559 - DNA, 22 bp, Homo sapiens
ggggcggggctctgagaagcat

SEQ ID NO: 7546560 - DNA, 22 bp, Homo sapiens
cagaggaaggctctgggaatgt

SEQ ID NO: 7546561 - DNA, 22 bp, Homo sapiens
cagaggaaggctctgggaatgt

SEQ ID NO: 7546562 - DNA, 22 bp, Homo sapiens
cagaggaaggctctgggaatgt

SEQ ID NO: 7546563 - DNA, 22 bp, Homo sapiens
cagaggaaggctctgggaatgt

SEQ ID NO: 7546564 - DNA, 22 bp, Homo sapiens
cagaggaagctgggtgtggagt

SEQ ID NO: 7546565 - DNA, 22 bp, Homo sapiens
cagaggaaggctctgggaatgt

SEQ ID NO: 7546566 - DNA, 22 bp, Homo sapiens
cagaggaaggctctgggaatgt

SEQ ID NO: 7546567 - DNA, 22 bp, Homo sapiens
cagaggaagctgggtgtggagt

SEQ ID NO: 7546568 - DNA, 22 bp, Homo sapiens
cagaggaagctgggtgtggagt

SEQ ID NO: 7546569 - DNA, 22 bp, Homo sapiens
cagaggaagctgggtgtggagt

SEQ ID NO: 7546570 - DNA, 22 bp, Homo sapiens
cagaggaagctgggtgtggagt

SEQ ID NO: 7546571 - DNA, 22 bp, Homo sapiens
cagaggaagctgggtgtggagt

SEQ ID NO: 7546572 - DNA, 22 bp, Homo sapiens
cagaggaagctgggtgtggagt

SEQ ID NO: 7546573 - DNA, 22 bp, Homo sapiens
cagaggaagcagacacatcttg

SEQ ID NO: 7546574 - DNA, 22 bp, Homo sapiens
cagaggaagcagacacatcttg

SEQ ID NO: 7546575 - DNA, 22 bp, Homo sapiens
cagaggaagagatacaagccct

SEQ ID NO: 7546576 - DNA, 22 bp, Homo sapiens
cagaggaagagatacaagccct

SEQ ID NO: 7546577 - DNA, 22 bp, Homo sapiens
cagaggaagcagacacatcttg

SEQ ID NO: 7546578 - DNA, 22 bp, Homo sapiens
cagaggaagcagacacatcttg

SEQ ID NO: 7546579 - DNA, 22 bp, Homo sapiens
cagaggaagcagacacatcttg

SEQ ID NO: 7546580 - DNA, 22 bp, Homo sapiens
cagaggaagctgggtgtggagt

SEQ ID NO: 7546581 - DNA, 22 bp, Homo sapiens
cagaggaagctgggtgtggagt

SEQ ID NO: 7546582 - DNA, 22 bp, Homo sapiens
cagaggaagctgggtgtggagt

SEQ ID NO: 7546583 - DNA, 22 bp, Homo sapiens
cagaggaagcagacacatcttg

SEQ ID NO: 7546584 - DNA, 22 bp, Homo sapiens
cagaggaagcagacacatcttg

SEQ ID NO: 7546585 - DNA, 22 bp, Homo sapiens
cagaggaagcagacacatcttg

SEQ ID NO: 7546586 - DNA, 22 bp, Homo sapiens
cagaggaagttccttgatgaga

SEQ ID NO: 7546587 - DNA, 22 bp, Homo sapiens
cagaggaagttccttgatgaga

SEQ ID NO: 7546588 - DNA, 22 bp, Homo sapiens
cagaggaagttccttgatgaga

SEQ ID NO: 7546589 - DNA, 22 bp, Homo sapiens
cagaggaagttccttgatgaga

SEQ ID NO: 7546590 - DNA, 22 bp, Homo sapiens
cagaggaagttccttgatgaga

SEQ ID NO: 7546591 - DNA, 22 bp, Homo sapiens
cagaggacaactggggcaagga

SEQ ID NO: 7546592 - DNA, 22 bp, Homo sapiens
cagaggacaactggggcaagga

SEQ ID NO: 7546593 - DNA, 22 bp, Homo sapiens
cagaggacaactggggcaagga

SEQ ID NO: 7546594 - DNA, 22 bp, Homo sapiens
cagaggaagttccttgatgaga

SEQ ID NO: 7546595 - DNA, 22 bp, Homo sapiens
cagaggacaactggggcaagga

SEQ ID NO: 7546596 - DNA, 22 bp, Homo sapiens
cagaggacaatagaatggaaag

SEQ ID NO: 7546597 - DNA, 22 bp, Homo sapiens
cagaggaagggtgctgcgaaag

SEQ ID NO: 7546598 - DNA, 22 bp, Homo sapiens
cagaggaagggtgctgcgaaag

SEQ ID NO: 7546599 - DNA, 22 bp, Homo sapiens
cagaggaagggtgctgcgaaag

SEQ ID NO: 7546600 - DNA, 22 bp, Homo sapiens
cagaggaaggctctgggaatgt

SEQ ID NO: 7546601 - DNA, 22 bp, Homo sapiens
cagaggaagggtgctgcgaaag

SEQ ID NO: 7546602 - DNA, 22 bp, Homo sapiens
cagaggaaggctctgggaatgt

SEQ ID NO: 7546603 - DNA, 22 bp, Homo sapiens
cagaggaaggctctgggaatgt

SEQ ID NO: 7546604 - DNA, 19 bp, Homo sapiens
cagaggcactttctcttag

SEQ ID NO: 7546605 - DNA, 19 bp, Homo sapiens
cagaggcactttctcttag

SEQ ID NO: 7546606 - DNA, 19 bp, Homo sapiens
cagaggcactttctcttag

SEQ ID NO: 7546607 - DNA, 19 bp, Homo sapiens
cagaggcactttctcttag

SEQ ID NO: 7546608 - DNA, 19 bp, Homo sapiens
cagaggcactttctcttag

SEQ ID NO: 7546609 - DNA, 22 bp, Homo sapiens
gggggcagtaaggatatggaaa

SEQ ID NO: 7546610 - DNA, 22 bp, Homo sapiens
gggggcagtaaggatatggaaa

SEQ ID NO: 7546611 - DNA, 22 bp, Homo sapiens
gggggcagtaaggatatggaaa

SEQ ID NO: 7546612 - DNA, 22 bp, Homo sapiens
gggggcagtaaggatatggaaa

SEQ ID NO: 7546613 - DNA, 22 bp, Homo sapiens
gggggcagtaaggatatggaaa

SEQ ID NO: 7546614 - DNA, 22 bp, Homo sapiens
gggggcagtaaggatatggaaa

SEQ ID NO: 7546615 - DNA, 22 bp, Homo sapiens
gggggcagtaacctcaaagtgt

SEQ ID NO: 7546616 - DNA, 22 bp, Homo sapiens
gggggcagtaacctcaaagtgt

SEQ ID NO: 7546617 - DNA, 22 bp, Homo sapiens
gggggcagtaacctcaaagtgt

SEQ ID NO: 7546618 - DNA, 22 bp, Homo sapiens
gggggcagtaacctcaaagtgt

SEQ ID NO: 7546619 - DNA, 22 bp, Homo sapiens
gggggcaggtctggaactttga

SEQ ID NO: 7546620 - DNA, 22 bp, Homo sapiens
gggggcaggtctggaactttga

SEQ ID NO: 7546621 - DNA, 22 bp, Homo sapiens
gggggcagtaacctcaaagtgt

SEQ ID NO: 7546622 - DNA, 22 bp, Homo sapiens
gggggcagtaacctcaaagtgt

SEQ ID NO: 7546623 - DNA, 22 bp, Homo sapiens
gggggcagtaacctcaaagtgt

SEQ ID NO: 7546624 - DNA, 22 bp, Homo sapiens
gggggcaggtctggaactttga

SEQ ID NO: 7546625 - DNA, 22 bp, Homo sapiens
gggggcaggtctggaactttga

SEQ ID NO: 7546626 - DNA, 22 bp, Homo sapiens
gggggcaggtctggaactttga

SEQ ID NO: 7546627 - DNA, 22 bp, Homo sapiens
gggggcaggtctggaactttga

SEQ ID NO: 7546628 - DNA, 22 bp, Homo sapiens
gggggcaggtctggaactttga

SEQ ID NO: 7546629 - DNA, 22 bp, Homo sapiens
gggggcagaatgtactcttgtc

SEQ ID NO: 7546630 - DNA, 22 bp, Homo sapiens
gggggcagaatgtactcttgtc

SEQ ID NO: 7546631 - DNA, 22 bp, Homo sapiens
gggggcagaatgtactcttgtc

SEQ ID NO: 7546632 - DNA, 22 bp, Homo sapiens
gggggcagaatgtactcttgtc

SEQ ID NO: 7546633 - DNA, 22 bp, Homo sapiens
gggggcagaatgtactcttgtc

SEQ ID NO: 7546634 - DNA, 22 bp, Homo sapiens
gggggcagaatgtactcttgtc

SEQ ID NO: 7546635 - DNA, 22 bp, Homo sapiens
gggggatgctcaggaggctgct

SEQ ID NO: 7546636 - DNA, 22 bp, Homo sapiens
gggggatgctcaggaggctgct

SEQ ID NO: 7546637 - DNA, 22 bp, Homo sapiens
gggggaggtgaatgcaataagg

SEQ ID NO: 7546638 - DNA, 22 bp, Homo sapiens
gggggatgctcaggaggctgct

SEQ ID NO: 7546639 - DNA, 22 bp, Homo sapiens
gggggatgctcaggaggctgct

SEQ ID NO: 7546640 - DNA, 22 bp, Homo sapiens
gggggatgctcaggaggctgct

SEQ ID NO: 7546641 - DNA, 22 bp, Homo sapiens
cagaggcaggaagatgggcagt

SEQ ID NO: 7546642 - DNA, 22 bp, Homo sapiens
cagaggcaggaagatgggcagt

SEQ ID NO: 7546643 - DNA, 22 bp, Homo sapiens
cagaggcaggaagatgggcagt

SEQ ID NO: 7546644 - DNA, 22 bp, Homo sapiens
cagaggcaggaagatgggcagt

SEQ ID NO: 7546645 - DNA, 22 bp, Homo sapiens
cagaggcaggaagatgggcagt

SEQ ID NO: 7546646 - DNA, 22 bp, Homo sapiens
cagaggcaggaagatgggcagt

SEQ ID NO: 7546647 - DNA, 22 bp, Homo sapiens
cagaggcaggaagatgggcagt

SEQ ID NO: 7546648 - DNA, 22 bp, Homo sapiens
cagaggcaggaagatgggcagt

SEQ ID NO: 7546649 - DNA, 22 bp, Homo sapiens
cagaggcagaggtcatctctgg

SEQ ID NO: 7546650 - DNA, 22 bp, Homo sapiens
cagaggcagccgggggagaacg

SEQ ID NO: 7546651 - DNA, 22 bp, Homo sapiens
cagaggcagccgggggagaacg

SEQ ID NO: 7546652 - DNA, 22 bp, Homo sapiens
cagaggcagccgggggagaacg

SEQ ID NO: 7546653 - DNA, 22 bp, Homo sapiens
cagaggcagccgggggagaacg

SEQ ID NO: 7546654 - DNA, 22 bp, Homo sapiens
cagaggcagccgggggagaacg

SEQ ID NO: 7546655 - DNA, 22 bp, Homo sapiens
cagaggcagccgggggagaacg

SEQ ID NO: 7546656 - DNA, 22 bp, Homo sapiens
cagaggcagaggtcatctctgg

SEQ ID NO: 7546657 - DNA, 22 bp, Homo sapiens
cagaggcagaggtcatctctgg

SEQ ID NO: 7546658 - DNA, 22 bp, Homo sapiens
cagaggcagaggtcatctctgg

SEQ ID NO: 7546659 - DNA, 22 bp, Homo sapiens
cagaggcagaggtcatctctgg

SEQ ID NO: 7546660 - DNA, 22 bp, Homo sapiens
cagaggcagaccctccagggcg

SEQ ID NO: 7546661 - DNA, 22 bp, Homo sapiens
cagaggcagaggtcatctctgg

SEQ ID NO: 7546662 - DNA, 22 bp, Homo sapiens
cagaggcagaatggagatttgg

SEQ ID NO: 7546663 - DNA, 22 bp, Homo sapiens
cagaggcagaccctccagggcg

SEQ ID NO: 7546664 - DNA, 22 bp, Homo sapiens
cagaggcagaccctccagggcg

SEQ ID NO: 7546665 - DNA, 22 bp, Homo sapiens
cagaggcagaccctccagggcg

SEQ ID NO: 7546666 - DNA, 22 bp, Homo sapiens
cagaggcagaccctccagggcg

SEQ ID NO: 7546667 - DNA, 22 bp, Homo sapiens
cagaggcagaatggagatttgg

SEQ ID NO: 7546668 - DNA, 22 bp, Homo sapiens
cagaggcagaatggagatttgg

SEQ ID NO: 7546669 - DNA, 22 bp, Homo sapiens
cagaggcagaatggagatttgg

SEQ ID NO: 7546670 - DNA, 22 bp, Homo sapiens
cagaggcagaatggagatttgg

SEQ ID NO: 7546671 - DNA, 22 bp, Homo sapiens
cagaggcagaatggagatttgg

SEQ ID NO: 7546672 - DNA, 22 bp, Homo sapiens
cagaggaacgtttggattgatt

SEQ ID NO: 7546673 - DNA, 22 bp, Homo sapiens
cagaggaacgtttggattgatt

SEQ ID NO: 7546674 - DNA, 22 bp, Homo sapiens
cagaggaacgtttggattgatt

SEQ ID NO: 7546675 - DNA, 22 bp, Homo sapiens
cagaggaacgtttggattgatt

SEQ ID NO: 7546676 - DNA, 22 bp, Homo sapiens
cagaggaacgtttggattgatt

SEQ ID NO: 7546677 - DNA, 22 bp, Homo sapiens
cagaggaagagatacaagccct

SEQ ID NO: 7546678 - DNA, 22 bp, Homo sapiens
cagaggaacgtttggattgatt

SEQ ID NO: 7546679 - DNA, 22 bp, Homo sapiens
cagaggaagagatacaagccct

SEQ ID NO: 7546680 - DNA, 22 bp, Homo sapiens
cagaggaagagatacaagccct

SEQ ID NO: 7546681 - DNA, 22 bp, Homo sapiens
cagaggaagagatacaagccct

SEQ ID NO: 7546682 - DNA, 22 bp, Homo sapiens
cagaggaagagatacaagccct

SEQ ID NO: 7546683 - DNA, 22 bp, Homo sapiens
cagaggaagagatacaagccct

SEQ ID NO: 7546684 - DNA, 22 bp, Homo sapiens
cagaggaagagatacaagccct

SEQ ID NO: 7546685 - DNA, 22 bp, Homo sapiens
cagaggaaatgggaaggagata

SEQ ID NO: 7546686 - DNA, 22 bp, Homo sapiens
cagaggaacgtttggattgatt

SEQ ID NO: 7546687 - DNA, 22 bp, Homo sapiens
cagaggaaatgggaaggagata

SEQ ID NO: 7546688 - DNA, 22 bp, Homo sapiens
cagaggaaatgggaaggagata

SEQ ID NO: 7546689 - DNA, 22 bp, Homo sapiens
cagaggaaatgggaaggagata

SEQ ID NO: 7546690 - DNA, 22 bp, Homo sapiens
cagaggaaatgggaaggagata

SEQ ID NO: 7546691 - DNA, 22 bp, Homo sapiens
cagaggaaatgggaaggagata

SEQ ID NO: 7546692 - DNA, 22 bp, Homo sapiens
cagaggaaatgggaaggagata

SEQ ID NO: 7546693 - DNA, 22 bp, Homo sapiens
cagaggaaatgggaaggagata

SEQ ID NO: 7546694 - DNA, 22 bp, Homo sapiens
cagaggaaatgggaaggagata

SEQ ID NO: 7546695 - DNA, 22 bp, Homo sapiens
cagaggaaagtatttctggaag

SEQ ID NO: 7546696 - DNA, 22 bp, Homo sapiens
cagaggaaagtatttctggaag

SEQ ID NO: 7546697 - DNA, 22 bp, Homo sapiens
cagaggaaagtatttctggaag

SEQ ID NO: 7546698 - DNA, 22 bp, Homo sapiens
cagaggaaatgggaaggagata

SEQ ID NO: 7546699 - DNA, 22 bp, Homo sapiens
cagaggaaatgggaaggagata

SEQ ID NO: 7546700 - DNA, 22 bp, Homo sapiens
cagaggaaagtatttctggaag

SEQ ID NO: 7546701 - DNA, 22 bp, Homo sapiens
cagaggaaagtatttctggaag

SEQ ID NO: 7546702 - DNA, 22 bp, Homo sapiens
cagaggaaagtatttctggaag

SEQ ID NO: 7546703 - DNA, 22 bp, Homo sapiens
cagaggaaagtatttctggaag

SEQ ID NO: 7546704 - DNA, 22 bp, Homo sapiens
cagagctttttacattaatgat

SEQ ID NO: 7546705 - DNA, 22 bp, Homo sapiens
cagagctttttacattaatgat

SEQ ID NO: 7546706 - DNA, 22 bp, Homo sapiens
cagagctttgtgtcagggctgt

SEQ ID NO: 7546707 - DNA, 22 bp, Homo sapiens
cagagctttgtgtcagggctgt

SEQ ID NO: 7546708 - DNA, 21 bp, Homo sapiens
cagagcttgctgagaggcctg

SEQ ID NO: 7546709 - DNA, 22 bp, Homo sapiens
cagagcttgaatgtccatggtt

SEQ ID NO: 7546710 - DNA, 22 bp, Homo sapiens
cagagcttgaatgtccatggtt

SEQ ID NO: 7546711 - DNA, 22 bp, Homo sapiens
cagagcttggctgtggttgtga

SEQ ID NO: 7546712 - DNA, 22 bp, Homo sapiens
cagagctttctgtcacattagt

SEQ ID NO: 7546713 - DNA, 22 bp, Homo sapiens
cagagctttggctagatggttg

SEQ ID NO: 7546714 - DNA, 22 bp, Homo sapiens
gggctctgcgctcagctccagc

SEQ ID NO: 7546715 - DNA, 22 bp, Homo sapiens
gggctctgcgctcagctccagc

SEQ ID NO: 7546716 - DNA, 22 bp, Homo sapiens
gggctctgcgctcagctccagc

SEQ ID NO: 7546717 - DNA, 22 bp, Homo sapiens
gggctctgcgctcagctccagc

SEQ ID NO: 7546718 - DNA, 22 bp, Homo sapiens
gggctctgcgctcagctccagc

SEQ ID NO: 7546719 - DNA, 22 bp, Homo sapiens
gggctctgcgctcagctccagc

SEQ ID NO: 7546720 - DNA, 22 bp, Homo sapiens
cagagctgtcatttgccagtga

SEQ ID NO: 7546721 - DNA, 22 bp, Homo sapiens
cagagctgtcatttgccagtga

SEQ ID NO: 7546722 - DNA, 22 bp, Homo sapiens
cagagctgtcatttgccagtga

SEQ ID NO: 7546723 - DNA, 22 bp, Homo sapiens
cagagctgtcatttgccagtga

SEQ ID NO: 7546724 - DNA, 22 bp, Homo sapiens
cagagctgtcatttgccagtga

SEQ ID NO: 7546725 - DNA, 21 bp, Homo sapiens
gggctctgccctcctggagct

SEQ ID NO: 7546726 - DNA, 21 bp, Homo sapiens
gggctctgccctcctggagct

SEQ ID NO: 7546727 - DNA, 21 bp, Homo sapiens
gggctctgccctcctggagct

SEQ ID NO: 7546728 - DNA, 21 bp, Homo sapiens
gggctctgccctcctggagct

SEQ ID NO: 7546729 - DNA, 22 bp, Homo sapiens
gggctctgcctggctgggagta

SEQ ID NO: 7546730 - DNA, 22 bp, Homo sapiens
gggctctgcctggctgggagta

SEQ ID NO: 7546731 - DNA, 20 bp, Homo sapiens
gggctctgcatccatcagcc

SEQ ID NO: 7546732 - DNA, 20 bp, Homo sapiens
gggctctgcatccatcagcc

SEQ ID NO: 7546733 - DNA, 20 bp, Homo sapiens
gggctctgcatccatcagcc

SEQ ID NO: 7546734 - DNA, 20 bp, Homo sapiens
gggctctgcatccatcagcc

SEQ ID NO: 7546735 - DNA, 21 bp, Homo sapiens
gggctctgccctcctggagct

SEQ ID NO: 7546736 - DNA, 21 bp, Homo sapiens
gggctctgccctcctggagct

SEQ ID NO: 7546737 - DNA, 21 bp, Homo sapiens
gggctctgccctcctggagct

SEQ ID NO: 7546738 - DNA, 21 bp, Homo sapiens
gggctctgccctcctggagct

SEQ ID NO: 7546739 - DNA, 20 bp, Homo sapiens
gggctctgcatccatcagcc

SEQ ID NO: 7546740 - DNA, 20 bp, Homo sapiens
gggctctgcatccatcagcc

SEQ ID NO: 7546741 - DNA, 20 bp, Homo sapiens
gggctctgcatccatcagcc

SEQ ID NO: 7546742 - DNA, 22 bp, Homo sapiens
gggctcaggcctggcctctcac

SEQ ID NO: 7546743 - DNA, 22 bp, Homo sapiens
gggctcaggcctggcctctcac

SEQ ID NO: 7546744 - DNA, 22 bp, Homo sapiens
gggctcaggcctggcctctcac

SEQ ID NO: 7546745 - DNA, 22 bp, Homo sapiens
gggctcaggcctggcctctcac

SEQ ID NO: 7546746 - DNA, 22 bp, Homo sapiens
gggctcaggcctggcctctcac

SEQ ID NO: 7546747 - DNA, 22 bp, Homo sapiens
gggctcaggcctggcctctcac

SEQ ID NO: 7546748 - DNA, 22 bp, Homo sapiens
gggctcaggagtttgaggctgc

SEQ ID NO: 7546749 - DNA, 22 bp, Homo sapiens
gggctcaggcctggcctctcac

SEQ ID NO: 7546750 - DNA, 22 bp, Homo sapiens
gggctcaggcctggcctctcac

SEQ ID NO: 7546751 - DNA, 22 bp, Homo sapiens
gggctcaggagtttgaggctgc

SEQ ID NO: 7546752 - DNA, 22 bp, Homo sapiens
gggctcaggagtttgaggctgc

SEQ ID NO: 7546753 - DNA, 22 bp, Homo sapiens
gggctcaggagtttgaggctgc

SEQ ID NO: 7546754 - DNA, 22 bp, Homo sapiens
gggctcaggagtttgaggctgc

SEQ ID NO: 7546755 - DNA, 22 bp, Homo sapiens
gggctcaggagtttgaggctgc

SEQ ID NO: 7546756 - DNA, 22 bp, Homo sapiens
gggctcaggagtttgaggctgc

SEQ ID NO: 7546757 - DNA, 22 bp, Homo sapiens
gggctcaggagtttgaggctgc

SEQ ID NO: 7546758 - DNA, 22 bp, Homo sapiens
gggctcagggacacatgtgtgt

SEQ ID NO: 7546759 - DNA, 22 bp, Homo sapiens
gggctcagggacacatgtgtgt

SEQ ID NO: 7546760 - DNA, 22 bp, Homo sapiens
gggctcagggacacatgtgtgt

SEQ ID NO: 7546761 - DNA, 22 bp, Homo sapiens
gggctcaggtcagggcatcagc

SEQ ID NO: 7546762 - DNA, 22 bp, Homo sapiens
gggctcaggtcagggcatcagc

SEQ ID NO: 7546763 - DNA, 22 bp, Homo sapiens
gggctcagggacacatgtgtgt

SEQ ID NO: 7546764 - DNA, 22 bp, Homo sapiens
gggctcagggacacatgtgtgt

SEQ ID NO: 7546765 - DNA, 22 bp, Homo sapiens
gggctcagggacacatgtgtgt

SEQ ID NO: 7546766 - DNA, 22 bp, Homo sapiens
gggctcagggacacatgtgtgt

SEQ ID NO: 7546767 - DNA, 22 bp, Homo sapiens
gggctcagggacacatgtgtgt

SEQ ID NO: 7546768 - DNA, 22 bp, Homo sapiens
gggctcagggacacatgtgtgt

SEQ ID NO: 7546769 - DNA, 22 bp, Homo sapiens
gggctcagtcctggttctaccc

SEQ ID NO: 7546770 - DNA, 22 bp, Homo sapiens
gggctcaggtcagggcatcagc

SEQ ID NO: 7546771 - DNA, 22 bp, Homo sapiens
gggctcaggtcagggcatcagc

SEQ ID NO: 7546772 - DNA, 22 bp, Homo sapiens
gggctcagtcctggttctaccc

SEQ ID NO: 7546773 - DNA, 22 bp, Homo sapiens
gggctcagtcctggttctaccc

SEQ ID NO: 7546774 - DNA, 22 bp, Homo sapiens
gggctcaggtcagggcatcagc

SEQ ID NO: 7546775 - DNA, 22 bp, Homo sapiens
gggctcaggtcagggcatcagc

SEQ ID NO: 7546776 - DNA, 22 bp, Homo sapiens
gggctcaggtcagggcatcagc

SEQ ID NO: 7546777 - DNA, 22 bp, Homo sapiens
gggctcaggtcagggcatcagc

SEQ ID NO: 7546778 - DNA, 22 bp, Homo sapiens
gggctcaggtcagggcatcagc

SEQ ID NO: 7546779 - DNA, 22 bp, Homo sapiens
gggctcaggtcagggcatcagc

SEQ ID NO: 7546780 - DNA, 22 bp, Homo sapiens
gggctcagtctggcgtggaatg

SEQ ID NO: 7546781 - DNA, 21 bp, Homo sapiens
gggctcagtggaaaagagtgt

SEQ ID NO: 7546782 - DNA, 21 bp, Homo sapiens
gggctcagtggaaaagagtgt

SEQ ID NO: 7546783 - DNA, 21 bp, Homo sapiens
gggctcagtggaaaagagtgt

SEQ ID NO: 7546784 - DNA, 22 bp, Homo sapiens
gggctcagtctggcgtggaatg

SEQ ID NO: 7546785 - DNA, 22 bp, Homo sapiens
gggctcagtctggcgtggaatg

SEQ ID NO: 7546786 - DNA, 22 bp, Homo sapiens
gggctcagtctgcggcgcgcgg

SEQ ID NO: 7546787 - DNA, 22 bp, Homo sapiens
gggctcagtctgcggcgcgcgg

SEQ ID NO: 7546788 - DNA, 22 bp, Homo sapiens
gggctcagtctgcggcgcgcgg

SEQ ID NO: 7546789 - DNA, 22 bp, Homo sapiens
gggctcagtctgcggcgcgcgg

SEQ ID NO: 7546790 - DNA, 22 bp, Homo sapiens
gggctcagtctgcggcgcgcgg

SEQ ID NO: 7546791 - DNA, 22 bp, Homo sapiens
gggctcagtctgcggcgcgcgg

SEQ ID NO: 7546792 - DNA, 22 bp, Homo sapiens
gggctcagtcggcaagcccctt

SEQ ID NO: 7546793 - DNA, 22 bp, Homo sapiens
gggctcagtcggcaagcccctt

SEQ ID NO: 7546794 - DNA, 22 bp, Homo sapiens
gggctcagtcggcaagcccctt

SEQ ID NO: 7546795 - DNA, 22 bp, Homo sapiens
gggctcagtcggcaagcccctt

SEQ ID NO: 7546796 - DNA, 22 bp, Homo sapiens
gggctctgcacgttctggcgtc

SEQ ID NO: 7546797 - DNA, 22 bp, Homo sapiens
gggctctgcacgttctggcgtc

SEQ ID NO: 7546798 - DNA, 22 bp, Homo sapiens
gggctctgcagagaactggctc

SEQ ID NO: 7546799 - DNA, 22 bp, Homo sapiens
gggctctgcagagaactggctc

SEQ ID NO: 7546800 - DNA, 22 bp, Homo sapiens
gggctctgcagagaactggctc

SEQ ID NO: 7546801 - DNA, 22 bp, Homo sapiens
gggctctgcagtgacttgaggg

SEQ ID NO: 7546802 - DNA, 22 bp, Homo sapiens
gggctctgcagtgacttgaggg

SEQ ID NO: 7546803 - DNA, 22 bp, Homo sapiens
gggctctgcagtgacttgaggg

SEQ ID NO: 7546804 - DNA, 22 bp, Homo sapiens
gggctctgcagtgacttgaggg

SEQ ID NO: 7546805 - DNA, 21 bp, Homo sapiens
gggctcagtggaaaagagtgt

SEQ ID NO: 7546806 - DNA, 21 bp, Homo sapiens
gggctcagtggaaaagagtgt

SEQ ID NO: 7546807 - DNA, 18 bp, Homo sapiens
gggctctgatccttcacc

SEQ ID NO: 7546808 - DNA, 18 bp, Homo sapiens
gggctctgatccttcacc

SEQ ID NO: 7546809 - DNA, 18 bp, Homo sapiens
gggctctgatccttcacc

SEQ ID NO: 7546810 - DNA, 18 bp, Homo sapiens
gggctctgatccttcacc

SEQ ID NO: 7546811 - DNA, 18 bp, Homo sapiens
gggctctgatccttcacc

SEQ ID NO: 7546812 - DNA, 22 bp, Homo sapiens
gggctctgcacgttctggcgtc

SEQ ID NO: 7546813 - DNA, 18 bp, Homo sapiens
gggctctgatccttcacc

SEQ ID NO: 7546814 - DNA, 22 bp, Homo sapiens
cagagcagcagagcttccatgg

SEQ ID NO: 7546815 - DNA, 22 bp, Homo sapiens
cagagcagcagagcttccatgg

SEQ ID NO: 7546816 - DNA, 22 bp, Homo sapiens
cagagcagcctccagggggagc

SEQ ID NO: 7546817 - DNA, 22 bp, Homo sapiens
cagagcagcctccagggggagc

SEQ ID NO: 7546818 - DNA, 22 bp, Homo sapiens
cagagcagcctccagggggagc

SEQ ID NO: 7546819 - DNA, 22 bp, Homo sapiens
cagagcagcctccagggggagc

SEQ ID NO: 7546820 - DNA, 22 bp, Homo sapiens
cagagcagcctccagggggagc

SEQ ID NO: 7546821 - DNA, 22 bp, Homo sapiens
cagagcagcctccagggggagc

SEQ ID NO: 7546822 - DNA, 22 bp, Homo sapiens
cagagcagcctccagggggagc

SEQ ID NO: 7546823 - DNA, 21 bp, Homo sapiens
cagagcagcgttctgctgtgg

SEQ ID NO: 7546824 - DNA, 21 bp, Homo sapiens
cagagcagcgttctgctgtgg

SEQ ID NO: 7546825 - DNA, 21 bp, Homo sapiens
cagagcagcgttctgctgtgg

SEQ ID NO: 7546826 - DNA, 21 bp, Homo sapiens
cagagcagcgttctgctgtgg

SEQ ID NO: 7546827 - DNA, 21 bp, Homo sapiens
cagagcagcgttctgctgtgg

SEQ ID NO: 7546828 - DNA, 21 bp, Homo sapiens
cagagcagcgttctgctgtgg

SEQ ID NO: 7546829 - DNA, 21 bp, Homo sapiens
cagagcagcgttctgctgtgg

SEQ ID NO: 7546830 - DNA, 21 bp, Homo sapiens
cagagcagcgttctgctgtgg

SEQ ID NO: 7546831 - DNA, 21 bp, Homo sapiens
cagagcagcgttctgctgtgg

SEQ ID NO: 7546832 - DNA, 22 bp, Homo sapiens
cagagcagcctccagggggagc

SEQ ID NO: 7546833 - DNA, 21 bp, Homo sapiens
cagagcagcgttctgctgtgg

SEQ ID NO: 7546834 - DNA, 22 bp, Homo sapiens
gggcgcgggaaggagcccgaga

SEQ ID NO: 7546835 - DNA, 17 bp, Homo sapiens
gggcgcgggtagagccc

SEQ ID NO: 7546836 - DNA, 22 bp, Homo sapiens
gggcgctgggtgtcgagactca

SEQ ID NO: 7546837 - DNA, 18 bp, Homo sapiens
gggcggaagggaagataa

SEQ ID NO: 7546838 - DNA, 22 bp, Homo sapiens
gggcgctgggtgtcgagactca

SEQ ID NO: 7546839 - DNA, 22 bp, Homo sapiens
gggcgcgcacgccagacagcct

SEQ ID NO: 7546840 - DNA, 22 bp, Homo sapiens
gggcgccgtgggaaacagccgg

SEQ ID NO: 7546841 - DNA, 22 bp, Homo sapiens
gggcgcgggaaggagcccgaga

SEQ ID NO: 7546842 - DNA, 22 bp, Homo sapiens
gggcgcgggaaggagcccgaga

SEQ ID NO: 7546843 - DNA, 17 bp, Homo sapiens
gggcgcgggtagagccc

SEQ ID NO: 7546844 - DNA, 22 bp, Homo sapiens
gggcgccgtgggaaacagccgg

SEQ ID NO: 7546845 - DNA, 22 bp, Homo sapiens
cagagcaggcccactgccctcc

SEQ ID NO: 7546846 - DNA, 22 bp, Homo sapiens
cagagcaggcccactgccctcc

SEQ ID NO: 7546847 - DNA, 22 bp, Homo sapiens
cagagcaggaatagggtgttga

SEQ ID NO: 7546848 - DNA, 22 bp, Homo sapiens
cagagcaggaatagggtgttga

SEQ ID NO: 7546849 - DNA, 22 bp, Homo sapiens
cagagcaggcccactgccctcc

SEQ ID NO: 7546850 - DNA, 22 bp, Homo sapiens
cagagcaggcccactgccctcc

SEQ ID NO: 7546851 - DNA, 22 bp, Homo sapiens
cagagcaggcccactgccctcc

SEQ ID NO: 7546852 - DNA, 22 bp, Homo sapiens
cagagcaggcccactgccctcc

SEQ ID NO: 7546853 - DNA, 21 bp, Homo sapiens
cagagcagcgttctgctgtgg

SEQ ID NO: 7546854 - DNA, 22 bp, Homo sapiens
cagagcaggaatagggtgttga

SEQ ID NO: 7546855 - DNA, 22 bp, Homo sapiens
cagagcaggaatagggtgttga

SEQ ID NO: 7546856 - DNA, 22 bp, Homo sapiens
cagagcaggaatagggtgttga

SEQ ID NO: 7546857 - DNA, 22 bp, Homo sapiens
cagagcaggaatagggtgttga

SEQ ID NO: 7546858 - DNA, 22 bp, Homo sapiens
gggccctgggattcagagcaag

SEQ ID NO: 7546859 - DNA, 22 bp, Homo sapiens
gggccctgggattcagagcaag

SEQ ID NO: 7546860 - DNA, 22 bp, Homo sapiens
gggccctgggattcagagcaag

SEQ ID NO: 7546861 - DNA, 18 bp, Homo sapiens
cagagcagaggtggagcg

SEQ ID NO: 7546862 - DNA, 22 bp, Homo sapiens
gggccctgggattcagagcaag

SEQ ID NO: 7546863 - DNA, 20 bp, Homo sapiens
gggccctgggattcagagca

SEQ ID NO: 7546864 - DNA, 20 bp, Homo sapiens
gggccctgggattcagagca

SEQ ID NO: 7546865 - DNA, 20 bp, Homo sapiens
gggccctgggattcagagca

SEQ ID NO: 7546866 - DNA, 20 bp, Homo sapiens
gggccctgggattcagagca

SEQ ID NO: 7546867 - DNA, 22 bp, Homo sapiens
gggccctggctttcctgttctt

SEQ ID NO: 7546868 - DNA, 22 bp, Homo sapiens
gggccctggctttcctgttctt

SEQ ID NO: 7546869 - DNA, 22 bp, Homo sapiens
gggccctggctttcctgttctt

SEQ ID NO: 7546870 - DNA, 22 bp, Homo sapiens
gggccctggctttcctgttctt

SEQ ID NO: 7546871 - DNA, 22 bp, Homo sapiens
gggccctggctttcctgttctt

SEQ ID NO: 7546872 - DNA, 18 bp, Homo sapiens
gggccctggcgtccgccc

SEQ ID NO: 7546873 - DNA, 18 bp, Homo sapiens
gggccctggcgtccgccc

SEQ ID NO: 7546874 - DNA, 18 bp, Homo sapiens
gggccctggcgtccgccc

SEQ ID NO: 7546875 - DNA, 18 bp, Homo sapiens
gggccctggcgtccgccc

SEQ ID NO: 7546876 - DNA, 18 bp, Homo sapiens
cagagcagaggtggagcg

SEQ ID NO: 7546877 - DNA, 22 bp, Homo sapiens
cagagcagagtgattgttctgg

SEQ ID NO: 7546878 - DNA, 22 bp, Homo sapiens
cagagcagagtgattgttctgg

SEQ ID NO: 7546879 - DNA, 22 bp, Homo sapiens
cagagcagagtgattgttctgg

SEQ ID NO: 7546880 - DNA, 18 bp, Homo sapiens
cagagcagaggtggagcg

SEQ ID NO: 7546881 - DNA, 18 bp, Homo sapiens
cagagcagaggtggagcg

SEQ ID NO: 7546882 - DNA, 18 bp, Homo sapiens
cagagcagaggtggagcg

SEQ ID NO: 7546883 - DNA, 22 bp, Homo sapiens
gggccctgggattcagagcaag

SEQ ID NO: 7546884 - DNA, 18 bp, Homo sapiens
cagagcagaggtggagcg

SEQ ID NO: 7546885 - DNA, 18 bp, Homo sapiens
cagagcagaggtggagcg

SEQ ID NO: 7546886 - DNA, 22 bp, Homo sapiens
cagagcagcagagcttccatgg

SEQ ID NO: 7546887 - DNA, 22 bp, Homo sapiens
cagagcagatttctaagtattg

SEQ ID NO: 7546888 - DNA, 22 bp, Homo sapiens
cagagcagatttctaagtattg

SEQ ID NO: 7546889 - DNA, 22 bp, Homo sapiens
cagagcagcagagcttccatgg

SEQ ID NO: 7546890 - DNA, 22 bp, Homo sapiens
cagagcagatttctaagtattg

SEQ ID NO: 7546891 - DNA, 22 bp, Homo sapiens
cagagcagcagagcttccatgg

SEQ ID NO: 7546892 - DNA, 22 bp, Homo sapiens
cagagcagcagagcttccatgg

SEQ ID NO: 7546893 - DNA, 22 bp, Homo sapiens
cagagcagcagagcttccatgg

SEQ ID NO: 7546894 - DNA, 22 bp, Homo sapiens
cagagcagcagagcttccatgg

SEQ ID NO: 7546895 - DNA, 22 bp, Homo sapiens
cagagcagcagagcttccatgg

SEQ ID NO: 7546896 - DNA, 22 bp, Homo sapiens
cagagcagcagagcttccatgg

SEQ ID NO: 7546897 - DNA, 22 bp, Homo sapiens
gggccctggccgaatccctctg

SEQ ID NO: 7546898 - DNA, 22 bp, Homo sapiens
gggccctggccgaatccctctg

SEQ ID NO: 7546899 - DNA, 22 bp, Homo sapiens
gggccctggatttaagcatgga

SEQ ID NO: 7546900 - DNA, 22 bp, Homo sapiens
gggccctggccgaatccctctg

SEQ ID NO: 7546901 - DNA, 22 bp, Homo sapiens
gggccctggccgaatccctctg

SEQ ID NO: 7546902 - DNA, 18 bp, Homo sapiens
gggccctggcgtccgccc

SEQ ID NO: 7546903 - DNA, 22 bp, Homo sapiens
gggccctggatttaagcatgga

SEQ ID NO: 7546904 - DNA, 22 bp, Homo sapiens
gggccctggatttaagcatgga

SEQ ID NO: 7546905 - DNA, 22 bp, Homo sapiens
gggccctggacgtggcggcaga

SEQ ID NO: 7546906 - DNA, 22 bp, Homo sapiens
gggccctggatttaagcatgga

SEQ ID NO: 7546907 - DNA, 22 bp, Homo sapiens
gggccctggacgtggcggcaga

SEQ ID NO: 7546908 - DNA, 22 bp, Homo sapiens
gggccctggacgtggcggcaga

SEQ ID NO: 7546909 - DNA, 22 bp, Homo sapiens
gggccctggacgtggcggcaga

SEQ ID NO: 7546910 - DNA, 22 bp, Homo sapiens
gggccctggacgtggcggcaga

SEQ ID NO: 7546911 - DNA, 22 bp, Homo sapiens
gggccctgcgtccggaagtctg

SEQ ID NO: 7546912 - DNA, 22 bp, Homo sapiens
gggccctgcgtccggaagtctg

SEQ ID NO: 7546913 - DNA, 22 bp, Homo sapiens
gggccctggacgtggcggcaga

SEQ ID NO: 7546914 - DNA, 22 bp, Homo sapiens
gggccctggacgtggcggcaga

SEQ ID NO: 7546915 - DNA, 22 bp, Homo sapiens
gggccctggacgtggcggcaga

SEQ ID NO: 7546916 - DNA, 22 bp, Homo sapiens
gggccctgcgtccggaagtctg

SEQ ID NO: 7546917 - DNA, 22 bp, Homo sapiens
gggccaggagtggagatatggg

SEQ ID NO: 7546918 - DNA, 22 bp, Homo sapiens
gggccaggagtggagatatggg

SEQ ID NO: 7546919 - DNA, 22 bp, Homo sapiens
gggccctgcgtccggaagtctg

SEQ ID NO: 7546920 - DNA, 22 bp, Homo sapiens
gggccctgcgtccggaagtctg

SEQ ID NO: 7546921 - DNA, 22 bp, Homo sapiens
gggccaggagtggagatatggg

SEQ ID NO: 7546922 - DNA, 22 bp, Homo sapiens
gggccaggagtggagatatggg

SEQ ID NO: 7546923 - DNA, 22 bp, Homo sapiens
gggccagctctgtgatgtaggg

SEQ ID NO: 7546924 - DNA, 22 bp, Homo sapiens
gggccaggagtggagatatggg

SEQ ID NO: 7546925 - DNA, 16 bp, Homo sapiens
cagagaggacagaggc

SEQ ID NO: 7546926 - DNA, 16 bp, Homo sapiens
cagagaggacagaggc

SEQ ID NO: 7546927 - DNA, 22 bp, Homo sapiens
gggccagctctgtgatgtaggg

SEQ ID NO: 7546928 - DNA, 22 bp, Homo sapiens
cagagagagtggggtgtggatt

SEQ ID NO: 7546929 - DNA, 22 bp, Homo sapiens
cagagagagtggggtgtggatt

SEQ ID NO: 7546930 - DNA, 22 bp, Homo sapiens
cagagagagtggggtgtggatt

SEQ ID NO: 7546931 - DNA, 22 bp, Homo sapiens
cagagagagtggggtgtggatt

SEQ ID NO: 7546932 - DNA, 22 bp, Homo sapiens
cagagagagtggggtgtggatt

SEQ ID NO: 7546933 - DNA, 22 bp, Homo sapiens
cagagagcacataggatacttt

SEQ ID NO: 7546934 - DNA, 22 bp, Homo sapiens
cagagagcacataggatacttt

SEQ ID NO: 7546935 - DNA, 22 bp, Homo sapiens
cagagagagtggggtgtggatt

SEQ ID NO: 7546936 - DNA, 22 bp, Homo sapiens
cagagagagtctgtccctgaag

SEQ ID NO: 7546937 - DNA, 22 bp, Homo sapiens
cagagagagtggggtgtggatt

SEQ ID NO: 7546938 - DNA, 22 bp, Homo sapiens
cagagagagtggggtgtggatt

SEQ ID NO: 7546939 - DNA, 22 bp, Homo sapiens
cagagagagtggggtgtggatt

SEQ ID NO: 7546940 - DNA, 22 bp, Homo sapiens
cagagagagtggggtgtggatt

SEQ ID NO: 7546941 - DNA, 22 bp, Homo sapiens
cagagagagtctgtccctgaag

SEQ ID NO: 7546942 - DNA, 22 bp, Homo sapiens
cagagagagtctgtccctgaag

SEQ ID NO: 7546943 - DNA, 22 bp, Homo sapiens
cagagagagtctgtccctgaag

SEQ ID NO: 7546944 - DNA, 22 bp, Homo sapiens
cagagagcttagtgtgctgcat

SEQ ID NO: 7546945 - DNA, 22 bp, Homo sapiens
cagagagcttgcccttgtatat

SEQ ID NO: 7546946 - DNA, 22 bp, Homo sapiens
cagagagcttagtgtgctgcat

SEQ ID NO: 7546947 - DNA, 22 bp, Homo sapiens
cagagagcttagtgtgctgcat

SEQ ID NO: 7546948 - DNA, 22 bp, Homo sapiens
cagagagcttgcccttgtatat

SEQ ID NO: 7546949 - DNA, 22 bp, Homo sapiens
cagagagcttgcccttgtatat

SEQ ID NO: 7546950 - DNA, 16 bp, Homo sapiens
cagagaggacagaggc

SEQ ID NO: 7546951 - DNA, 16 bp, Homo sapiens
cagagaggacagaggc

SEQ ID NO: 7546952 - DNA, 22 bp, Homo sapiens
cagagagcttgcccttgtatat

SEQ ID NO: 7546953 - DNA, 16 bp, Homo sapiens
cagagaggacagaggc

SEQ ID NO: 7546954 - DNA, 16 bp, Homo sapiens
cagagaggacagaggc

SEQ ID NO: 7546955 - DNA, 21 bp, Homo sapiens
cagagagctagaacttcatga

SEQ ID NO: 7546956 - DNA, 21 bp, Homo sapiens
cagagagctagaacttcatga

SEQ ID NO: 7546957 - DNA, 22 bp, Homo sapiens
cagagagcatgggaggcccgag

SEQ ID NO: 7546958 - DNA, 22 bp, Homo sapiens
cagagagcatgggaggcccgag

SEQ ID NO: 7546959 - DNA, 22 bp, Homo sapiens
cagagagcttagtgtgctgcat

SEQ ID NO: 7546960 - DNA, 22 bp, Homo sapiens
cagagagcttagtgtgctgcat

SEQ ID NO: 7546961 - DNA, 21 bp, Homo sapiens
cagagagctagaacttcatga

SEQ ID NO: 7546962 - DNA, 22 bp, Homo sapiens
cagagagcttagtgtgctgcat

SEQ ID NO: 7546963 - DNA, 22 bp, Homo sapiens
cagagagcttagtgtgctgcat

SEQ ID NO: 7546964 - DNA, 19 bp, Homo sapiens
cagagagaccaaggcgcca

SEQ ID NO: 7546965 - DNA, 19 bp, Homo sapiens
cagagagaccaaggcgcca

SEQ ID NO: 7546966 - DNA, 19 bp, Homo sapiens
cagagagaccaaggcgcca

SEQ ID NO: 7546967 - DNA, 22 bp, Homo sapiens
cagagagagcaggaaacctccg

SEQ ID NO: 7546968 - DNA, 22 bp, Homo sapiens
cagagagaatcttggcagctga

SEQ ID NO: 7546969 - DNA, 19 bp, Homo sapiens
cagagagaccaaggcgcca

SEQ ID NO: 7546970 - DNA, 19 bp, Homo sapiens
cagagagaccaaggcgcca

SEQ ID NO: 7546971 - DNA, 19 bp, Homo sapiens
cagagagaccaaggcgcca

SEQ ID NO: 7546972 - DNA, 22 bp, Homo sapiens
cagagagaatcttggcagctga

SEQ ID NO: 7546973 - DNA, 19 bp, Homo sapiens
cagagagaccaaggcgcca

SEQ ID NO: 7546974 - DNA, 22 bp, Homo sapiens
cagagagagcaggaaacctccg

SEQ ID NO: 7546975 - DNA, 22 bp, Homo sapiens
cagagagagcaggaaacctccg

SEQ ID NO: 7546976 - DNA, 22 bp, Homo sapiens
cagagagagcaggaaacctccg

SEQ ID NO: 7546977 - DNA, 19 bp, Homo sapiens
cagagagaccaaggcgcca

SEQ ID NO: 7546978 - DNA, 22 bp, Homo sapiens
cagagagagcaggaaacctccg

SEQ ID NO: 7546979 - DNA, 22 bp, Homo sapiens
cagagagagcaggaaacctccg

SEQ ID NO: 7546980 - DNA, 22 bp, Homo sapiens
cagagagagcaggaaacctccg

SEQ ID NO: 7546981 - DNA, 22 bp, Homo sapiens
cagagagaggccactgctatta

SEQ ID NO: 7546982 - DNA, 22 bp, Homo sapiens
cagagagaggccactgctatta

SEQ ID NO: 7546983 - DNA, 22 bp, Homo sapiens
cagagagaggccactgctatta

SEQ ID NO: 7546984 - DNA, 22 bp, Homo sapiens
cagagagaggccactgctatta

SEQ ID NO: 7546985 - DNA, 22 bp, Homo sapiens
cagagagagcaggaaacctccg

SEQ ID NO: 7546986 - DNA, 22 bp, Homo sapiens
cagagagaggccactgctatta

SEQ ID NO: 7546987 - DNA, 22 bp, Homo sapiens
cagagagaggccactgctatta

SEQ ID NO: 7546988 - DNA, 22 bp, Homo sapiens
cagagagaggggctgcctggcc

SEQ ID NO: 7546989 - DNA, 22 bp, Homo sapiens
cagagagaggggctgcctggcc

SEQ ID NO: 7546990 - DNA, 22 bp, Homo sapiens
cagagagaggggctgcctggcc

SEQ ID NO: 7546991 - DNA, 22 bp, Homo sapiens
cagagagaggggctgcctggcc

SEQ ID NO: 7546992 - DNA, 22 bp, Homo sapiens
cagagagaggggctgcctggcc

SEQ ID NO: 7546993 - DNA, 22 bp, Homo sapiens
cagagagaggggctgcctggcc

SEQ ID NO: 7546994 - DNA, 22 bp, Homo sapiens
cagagagaggtgccgataatgg

SEQ ID NO: 7546995 - DNA, 22 bp, Homo sapiens
cagagagaggggctgcctggcc

SEQ ID NO: 7546996 - DNA, 22 bp, Homo sapiens
cagagagaggggctgcctggcc

SEQ ID NO: 7546997 - DNA, 22 bp, Homo sapiens
cagagagagtcaaatctttgct

SEQ ID NO: 7546998 - DNA, 22 bp, Homo sapiens
cagagagagtcaaatctttgct

SEQ ID NO: 7546999 - DNA, 22 bp, Homo sapiens
cagagagagtctgtccctgaag

SEQ ID NO: 7547000 - DNA, 22 bp, Homo sapiens
cagagagagtctgtccctgaag

SEQ ID NO: 7547001 - DNA, 22 bp, Homo sapiens
cagagagagtctgtccctgaag

SEQ ID NO: 7547002 - DNA, 22 bp, Homo sapiens
cagagagagtctgtccctgaag

SEQ ID NO: 7547003 - DNA, 22 bp, Homo sapiens
cagagagagtctgtccctgaag

SEQ ID NO: 7547004 - DNA, 22 bp, Homo sapiens
cagagagaggtgccgataatgg

SEQ ID NO: 7547005 - DNA, 22 bp, Homo sapiens
cagagagagtcaaatctttgct

SEQ ID NO: 7547006 - DNA, 22 bp, Homo sapiens
cagagagagtcaaatctttgct

SEQ ID NO: 7547007 - DNA, 22 bp, Homo sapiens
cagagagaatcttggcagctga

SEQ ID NO: 7547008 - DNA, 22 bp, Homo sapiens
cagagagaatcttggcagctga

SEQ ID NO: 7547009 - DNA, 22 bp, Homo sapiens
cagagagaatcttggcagctga

SEQ ID NO: 7547010 - DNA, 22 bp, Homo sapiens
cagagagaatcttggcagctga

SEQ ID NO: 7547011 - DNA, 22 bp, Homo sapiens
cagagagaatcttggcagctga

SEQ ID NO: 7547012 - DNA, 22 bp, Homo sapiens
cagagagaatcttggcagctga

SEQ ID NO: 7547013 - DNA, 22 bp, Homo sapiens
cagagagaatcttggcagctga

SEQ ID NO: 7547014 - DNA, 22 bp, Homo sapiens
cagagagaatcttggcagctga

SEQ ID NO: 7547015 - DNA, 22 bp, Homo sapiens
cagagagaatcttggcagctga

SEQ ID NO: 7547016 - DNA, 22 bp, Homo sapiens
cagagagaatatgtagtatgga

SEQ ID NO: 7547017 - DNA, 22 bp, Homo sapiens
cagagactggagtgcagtggcg

SEQ ID NO: 7547018 - DNA, 22 bp, Homo sapiens
cagagactggagtgcagtggcg

SEQ ID NO: 7547019 - DNA, 22 bp, Homo sapiens
cagagactggagtgcagtggcg

SEQ ID NO: 7547020 - DNA, 22 bp, Homo sapiens
cagagagaatcttggcagctga

SEQ ID NO: 7547021 - DNA, 22 bp, Homo sapiens
cagagagaatcttggcagctga

SEQ ID NO: 7547022 - DNA, 22 bp, Homo sapiens
cagagagaatcttggcagctga

SEQ ID NO: 7547023 - DNA, 22 bp, Homo sapiens
cagagagaatcttggcagctga

SEQ ID NO: 7547024 - DNA, 22 bp, Homo sapiens
cagagagaatcttggcagctga

SEQ ID NO: 7547025 - DNA, 22 bp, Homo sapiens
cagagagaatatgtagtatgga

SEQ ID NO: 7547026 - DNA, 22 bp, Homo sapiens
cagagagaatatgtagtatgga

SEQ ID NO: 7547027 - DNA, 22 bp, Homo sapiens
cagagagaatcttggcagctga

SEQ ID NO: 7547028 - DNA, 18 bp, Homo sapiens
cagaagcaggcagtgcag

SEQ ID NO: 7547029 - DNA, 18 bp, Homo sapiens
cagaagcaggcagtgcag

SEQ ID NO: 7547030 - DNA, 18 bp, Homo sapiens
cagaagcaggcagtgcag

SEQ ID NO: 7547031 - DNA, 18 bp, Homo sapiens
cagaagcaggcagtgcag

SEQ ID NO: 7547032 - DNA, 18 bp, Homo sapiens
cagaagcaggcagtgcag

SEQ ID NO: 7547033 - DNA, 18 bp, Homo sapiens
cagaagcaggcagtgcag

SEQ ID NO: 7547034 - DNA, 22 bp, Homo sapiens
cagagacagtttcacagggtct

SEQ ID NO: 7547035 - DNA, 22 bp, Homo sapiens
cagagacagtttcacagggtct

SEQ ID NO: 7547036 - DNA, 22 bp, Homo sapiens
cagagacatccatgttagttgg

SEQ ID NO: 7547037 - DNA, 22 bp, Homo sapiens
cagagacatccatgttagttgg

SEQ ID NO: 7547038 - DNA, 22 bp, Homo sapiens
cagagacatccatgttagttgg

SEQ ID NO: 7547039 - DNA, 20 bp, Homo sapiens
cagagacctgtcttcacaga

SEQ ID NO: 7547040 - DNA, 22 bp, Homo sapiens
cagagactggagtgcagtggcg

SEQ ID NO: 7547041 - DNA, 20 bp, Homo sapiens
cagagacctgtcttcacaga

SEQ ID NO: 7547042 - DNA, 20 bp, Homo sapiens
cagagacctgtcttcacaga

SEQ ID NO: 7547043 - DNA, 22 bp, Homo sapiens
cagaagagtagctgaacaagtt

SEQ ID NO: 7547044 - DNA, 22 bp, Homo sapiens
cagaagagtagctgaacaagtt

SEQ ID NO: 7547045 - DNA, 22 bp, Homo sapiens
cagaagagtagctgaacaagtt

SEQ ID NO: 7547046 - DNA, 22 bp, Homo sapiens
cagaagagtagctgaacaagtt

SEQ ID NO: 7547047 - DNA, 22 bp, Homo sapiens
cagaagagtagctgaacaagtt

SEQ ID NO: 7547048 - DNA, 22 bp, Homo sapiens
cagaagatgctttgtaaaatga

SEQ ID NO: 7547049 - DNA, 22 bp, Homo sapiens
cagaagatctcttagtggaggg

SEQ ID NO: 7547050 - DNA, 22 bp, Homo sapiens
cagaagatgcagtgtctgagaa

SEQ ID NO: 7547051 - DNA, 22 bp, Homo sapiens
cagaagatgcagtgtctgagaa

SEQ ID NO: 7547052 - DNA, 22 bp, Homo sapiens
cagaagatctcttagtggaggg

SEQ ID NO: 7547053 - DNA, 22 bp, Homo sapiens
cagaagcaaatgccttgctgag

SEQ ID NO: 7547054 - DNA, 22 bp, Homo sapiens
cagaagcaaatgccttgctgag

SEQ ID NO: 7547055 - DNA, 22 bp, Homo sapiens
cagaagcaaatgccttgctgag

SEQ ID NO: 7547056 - DNA, 22 bp, Homo sapiens
cagaagcaaatgccttgctgag

SEQ ID NO: 7547057 - DNA, 22 bp, Homo sapiens
cagaagatgctttgtaaaatga

SEQ ID NO: 7547058 - DNA, 22 bp, Homo sapiens
cagaagcaaatgccttgctgag

SEQ ID NO: 7547059 - DNA, 22 bp, Homo sapiens
cagaagcaaatgccttgctgag

SEQ ID NO: 7547060 - DNA, 22 bp, Homo sapiens
cagaagcaaatgccttgctgag

SEQ ID NO: 7547061 - DNA, 22 bp, Homo sapiens
cagaagcaaatgccttgctgag

SEQ ID NO: 7547062 - DNA, 22 bp, Homo sapiens
cagaagcaagggccaaagtctt

SEQ ID NO: 7547063 - DNA, 22 bp, Homo sapiens
cagaagcaagggccaaagtctt

SEQ ID NO: 7547064 - DNA, 22 bp, Homo sapiens
cagaagcaagtagtgattcttt

SEQ ID NO: 7547065 - DNA, 22 bp, Homo sapiens
cagaagcaagtagtgattcttt

SEQ ID NO: 7547066 - DNA, 22 bp, Homo sapiens
cagaagcaagtagtgattcttt

SEQ ID NO: 7547067 - DNA, 22 bp, Homo sapiens
cagaagcaagtagtgattcttt

SEQ ID NO: 7547068 - DNA, 22 bp, Homo sapiens
cagaagcaagtagtgattcttt

SEQ ID NO: 7547069 - DNA, 22 bp, Homo sapiens
cagaagcaagtagtgattcttt

SEQ ID NO: 7547070 - DNA, 22 bp, Homo sapiens
cagaagcaagtagtgattcttt

SEQ ID NO: 7547071 - DNA, 22 bp, Homo sapiens
cagaagcaagggccaaagtctt

SEQ ID NO: 7547072 - DNA, 22 bp, Homo sapiens
cagaagcaagggccaaagtctt

SEQ ID NO: 7547073 - DNA, 22 bp, Homo sapiens
cagaagcaagggccaaagtctt

SEQ ID NO: 7547074 - DNA, 22 bp, Homo sapiens
cagaagcaagggccaaagtctt

SEQ ID NO: 7547075 - DNA, 22 bp, Homo sapiens
cagaagcaagggccaaagtctt

SEQ ID NO: 7547076 - DNA, 22 bp, Homo sapiens
cagaagcaagggccaaagtctt

SEQ ID NO: 7547077 - DNA, 20 bp, Homo sapiens
cagaagcaaggcaggtacct

SEQ ID NO: 7547078 - DNA, 22 bp, Homo sapiens
cagaagcaagagccggagctag

SEQ ID NO: 7547079 - DNA, 20 bp, Homo sapiens
cagaagcaaggcaggtacct

SEQ ID NO: 7547080 - DNA, 20 bp, Homo sapiens
cagaagcaaggcaggtacct

SEQ ID NO: 7547081 - DNA, 20 bp, Homo sapiens
cagaagcaaggcaggtacct

SEQ ID NO: 7547082 - DNA, 22 bp, Homo sapiens
cagaagcaagagccggagctag

SEQ ID NO: 7547083 - DNA, 22 bp, Homo sapiens
cagaagcaagagccggagctag

SEQ ID NO: 7547084 - DNA, 22 bp, Homo sapiens
cagaagcaagagccggagctag

SEQ ID NO: 7547085 - DNA, 22 bp, Homo sapiens
cagaagcaagagccggagctag

SEQ ID NO: 7547086 - DNA, 22 bp, Homo sapiens
cagaagcagaacactagattta

SEQ ID NO: 7547087 - DNA, 22 bp, Homo sapiens
cagaagcagaacactagattta

SEQ ID NO: 7547088 - DNA, 22 bp, Homo sapiens
cagaagcagaacactagattta

SEQ ID NO: 7547089 - DNA, 22 bp, Homo sapiens
cagaagcagaacactagattta

SEQ ID NO: 7547090 - DNA, 22 bp, Homo sapiens
cagaagcagaacactagattta

SEQ ID NO: 7547091 - DNA, 22 bp, Homo sapiens
cagaagcagaacactagattta

SEQ ID NO: 7547092 - DNA, 22 bp, Homo sapiens
cagaagcagaacactagattta

SEQ ID NO: 7547093 - DNA, 22 bp, Homo sapiens
cagaagcagaacactagattta

SEQ ID NO: 7547094 - DNA, 22 bp, Homo sapiens
cagaagcagaacactagattta

SEQ ID NO: 7547095 - DNA, 22 bp, Homo sapiens
cagaagcactaggaggaaacgt

SEQ ID NO: 7547096 - DNA, 22 bp, Homo sapiens
cagaagcactaggaggaaacgt

SEQ ID NO: 7547097 - DNA, 22 bp, Homo sapiens
cagaagcactaggaggaaacgt

SEQ ID NO: 7547098 - DNA, 22 bp, Homo sapiens
cagaagcactaggaggaaacgt

SEQ ID NO: 7547099 - DNA, 22 bp, Homo sapiens
cagaagcactaggaggaaacgt

SEQ ID NO: 7547100 - DNA, 18 bp, Homo sapiens
cagaagcaggcagtgcag

SEQ ID NO: 7547101 - DNA, 22 bp, Homo sapiens
cagaagcagattctaaagcaag

SEQ ID NO: 7547102 - DNA, 22 bp, Homo sapiens
cagaagcagattctaaagcaag

SEQ ID NO: 7547103 - DNA, 22 bp, Homo sapiens
cagaagcagattctaaagcaag

SEQ ID NO: 7547104 - DNA, 22 bp, Homo sapiens
cagaagcagattctaaagcaag

SEQ ID NO: 7547105 - DNA, 22 bp, Homo sapiens
cagaagcagattctaaagcaag

SEQ ID NO: 7547106 - DNA, 22 bp, Homo sapiens
cagaagcagattctaaagcaag

SEQ ID NO: 7547107 - DNA, 22 bp, Homo sapiens
cagaagcagattctaaagcaag

SEQ ID NO: 7547108 - DNA, 22 bp, Homo sapiens
cagaagcagattctaaagcaag

SEQ ID NO: 7547109 - DNA, 22 bp, Homo sapiens
cagaagcagattctaaagcaag

SEQ ID NO: 7547110 - DNA, 22 bp, Homo sapiens
cagaagcagattctaaagcaag

SEQ ID NO: 7547111 - DNA, 22 bp, Homo sapiens
cagaagcagattctaaagcaag

SEQ ID NO: 7547112 - DNA, 23 bp, Homo sapiens
cagaagcacctgttgactgctgc

SEQ ID NO: 7547113 - DNA, 22 bp, Homo sapiens
cagaagcactaggaggaaacgt

SEQ ID NO: 7547114 - DNA, 22 bp, Homo sapiens
cagaagcactaggaggaaacgt

SEQ ID NO: 7547115 - DNA, 22 bp, Homo sapiens
cagaagcactaggaggaaacgt

SEQ ID NO: 7547116 - DNA, 22 bp, Homo sapiens
cagaagcactaggaggaaacgt

SEQ ID NO: 7547117 - DNA, 23 bp, Homo sapiens
cagaagcacctgttgactgctgc

SEQ ID NO: 7547118 - DNA, 23 bp, Homo sapiens
cagaagcacctgttgactgctgc

SEQ ID NO: 7547119 - DNA, 23 bp, Homo sapiens
cagaagcacctgttgactgctgc

SEQ ID NO: 7547120 - DNA, 23 bp, Homo sapiens
cagaagcacctgttgactgctgc

SEQ ID NO: 7547121 - DNA, 23 bp, Homo sapiens
cagaagcacctgttgactgctgc

SEQ ID NO: 7547122 - DNA, 23 bp, Homo sapiens
cagaagcacctgttgactgctgc

SEQ ID NO: 7547123 - DNA, 22 bp, Homo sapiens
cagaagcacatgtttacatgta

SEQ ID NO: 7547124 - DNA, 22 bp, Homo sapiens
cagaagcacatgtttacatgta

SEQ ID NO: 7547125 - DNA, 23 bp, Homo sapiens
cagaagcacctgttgactgctgc

SEQ ID NO: 7547126 - DNA, 22 bp, Homo sapiens
cagaagcacatgtttacatgta

SEQ ID NO: 7547127 - DNA, 22 bp, Homo sapiens
cagaagcacatgtttacatgta

SEQ ID NO: 7547128 - DNA, 22 bp, Homo sapiens
cagaagcacatgtttacatgta

SEQ ID NO: 7547129 - DNA, 22 bp, Homo sapiens
cagaagcacatgtttacatgta

SEQ ID NO: 7547130 - DNA, 22 bp, Homo sapiens
gtgcagctgagggcctcttcta

SEQ ID NO: 7547131 - DNA, 22 bp, Homo sapiens
gtgcagctgagggcctcttcta

SEQ ID NO: 7547132 - DNA, 22 bp, Homo sapiens
gtgcagctgagggcctcttcta

SEQ ID NO: 7547133 - DNA, 22 bp, Homo sapiens
gtgcagctgcaggagtcaggtc

SEQ ID NO: 7547134 - DNA, 22 bp, Homo sapiens
gtgcagctgcaggagtcaggtc

SEQ ID NO: 7547135 - DNA, 22 bp, Homo sapiens
gtgcagctgcaggagtcaggtc

SEQ ID NO: 7547136 - DNA, 22 bp, Homo sapiens
gtgcagctgcaggagtcaggtc

SEQ ID NO: 7547137 - DNA, 22 bp, Homo sapiens
gtgcagctgcccaagcctgagc

SEQ ID NO: 7547138 - DNA, 22 bp, Homo sapiens
gtgcagctgcccaagcctgagc

SEQ ID NO: 7547139 - DNA, 22 bp, Homo sapiens
gtgcagctgagggcctcttcta

SEQ ID NO: 7547140 - DNA, 22 bp, Homo sapiens
gtgcagctgagggcctcttcta

SEQ ID NO: 7547141 - DNA, 22 bp, Homo sapiens
gtgcagctgaaggctggccagc

SEQ ID NO: 7547142 - DNA, 22 bp, Homo sapiens
gtgcagctgaaggctggccagc

SEQ ID NO: 7547143 - DNA, 22 bp, Homo sapiens
gtgcagctgaaggctggccagc

SEQ ID NO: 7547144 - DNA, 22 bp, Homo sapiens
gtgcagctgaaggctggccagc

SEQ ID NO: 7547145 - DNA, 22 bp, Homo sapiens
gtgcagctcagttgaaatgcag

SEQ ID NO: 7547146 - DNA, 22 bp, Homo sapiens
gtgcagctcagttgaaatgcag

SEQ ID NO: 7547147 - DNA, 22 bp, Homo sapiens
gtgcagctggtggagtctgggg

SEQ ID NO: 7547148 - DNA, 22 bp, Homo sapiens
gtgcagctggtggagtctgggg

SEQ ID NO: 7547149 - DNA, 22 bp, Homo sapiens
gtgcagctgggcgctgaccttc

SEQ ID NO: 7547150 - DNA, 22 bp, Homo sapiens
gtgcagctggtggagtctgggg

SEQ ID NO: 7547151 - DNA, 22 bp, Homo sapiens
gtgcagctggtggagtctgggg

SEQ ID NO: 7547152 - DNA, 22 bp, Homo sapiens
gtgcagctgcttgcctggttag

SEQ ID NO: 7547153 - DNA, 22 bp, Homo sapiens
gtgcagctgcttgcctggttag

SEQ ID NO: 7547154 - DNA, 22 bp, Homo sapiens
gtgcagctgggcgctgaccttc

SEQ ID NO: 7547155 - DNA, 22 bp, Homo sapiens
gtgcagctgggcgctgaccttc

SEQ ID NO: 7547156 - DNA, 22 bp, Homo sapiens
gtgcagctgggcgctgaccttc

SEQ ID NO: 7547157 - DNA, 22 bp, Homo sapiens
gtgcagctgcccaagcctgagc

SEQ ID NO: 7547158 - DNA, 22 bp, Homo sapiens
gtgcagctgcccaagcctgagc

SEQ ID NO: 7547159 - DNA, 22 bp, Homo sapiens
gtgcagctgccgatcagatagg

SEQ ID NO: 7547160 - DNA, 22 bp, Homo sapiens
gtgcagctgccgatcagatagg

SEQ ID NO: 7547161 - DNA, 22 bp, Homo sapiens
gtgcagctgccgatcagatagg

SEQ ID NO: 7547162 - DNA, 16 bp, Homo sapiens
gtgcagctgcctggta

SEQ ID NO: 7547163 - DNA, 16 bp, Homo sapiens
gtgcagctgcctggta

SEQ ID NO: 7547164 - DNA, 16 bp, Homo sapiens
gtgcagctgcctggta

SEQ ID NO: 7547165 - DNA, 22 bp, Homo sapiens
gtgcagctgcttgcctggttag

SEQ ID NO: 7547166 - DNA, 22 bp, Homo sapiens
gtgcagctgcttgcctggttag

SEQ ID NO: 7547167 - DNA, 22 bp, Homo sapiens
gtgcaggacagcacatctcctg

SEQ ID NO: 7547168 - DNA, 22 bp, Homo sapiens
gtgcaggacagcacatctcctg

SEQ ID NO: 7547169 - DNA, 22 bp, Homo sapiens
gtgcaggagcaggagccatgtc

SEQ ID NO: 7547170 - DNA, 22 bp, Homo sapiens
gtgcaggagcaggagccatgtc

SEQ ID NO: 7547171 - DNA, 22 bp, Homo sapiens
gtgcaggagcaggagccatgtc

SEQ ID NO: 7547172 - DNA, 22 bp, Homo sapiens
gtgcaggagcaggagccatgtc

SEQ ID NO: 7547173 - DNA, 22 bp, Homo sapiens
gtgcaggagccaggggtaggaa

SEQ ID NO: 7547174 - DNA, 22 bp, Homo sapiens
gtgcaggagccaggggtaggaa

SEQ ID NO: 7547175 - DNA, 22 bp, Homo sapiens
gtgcaggagccaggggtaggaa

SEQ ID NO: 7547176 - DNA, 22 bp, Homo sapiens
gtgcaggagccaggggtaggaa

SEQ ID NO: 7547177 - DNA, 22 bp, Homo sapiens
gtgcagctgtgtgagagctcca

SEQ ID NO: 7547178 - DNA, 22 bp, Homo sapiens
gtgcagctgtgtgagagctcca

SEQ ID NO: 7547179 - DNA, 22 bp, Homo sapiens
gtgcagctgtgtgagagctcca

SEQ ID NO: 7547180 - DNA, 22 bp, Homo sapiens
gtgcagctgtgtgagagctcca

SEQ ID NO: 7547181 - DNA, 22 bp, Homo sapiens
gtgcagcttcctggtctcagcc

SEQ ID NO: 7547182 - DNA, 22 bp, Homo sapiens
gtgcagcttcctggtctcagcc

SEQ ID NO: 7547183 - DNA, 22 bp, Homo sapiens
gtgcagcttcctggtctcagcc

SEQ ID NO: 7547184 - DNA, 22 bp, Homo sapiens
gtgcagcttcctggtctcagcc

SEQ ID NO: 7547185 - DNA, 22 bp, Homo sapiens
gtgcagctgtggtggagccagg

SEQ ID NO: 7547186 - DNA, 22 bp, Homo sapiens
gtgcagctgtggtggagccagg

SEQ ID NO: 7547187 - DNA, 22 bp, Homo sapiens
gtgcagctgtggtggagccagg

SEQ ID NO: 7547188 - DNA, 22 bp, Homo sapiens
gtgcagctgtggtggagccagg

SEQ ID NO: 7547189 - DNA, 22 bp, Homo sapiens
gtgcagctgtggtggagccagg

SEQ ID NO: 7547190 - DNA, 22 bp, Homo sapiens
gtgcagctggtggagtctgggg

SEQ ID NO: 7547191 - DNA, 22 bp, Homo sapiens
gtgcagctggtggagtctgggg

SEQ ID NO: 7547192 - DNA, 22 bp, Homo sapiens
gtgcaaatacatatgctgtgga

SEQ ID NO: 7547193 - DNA, 22 bp, Homo sapiens
gtgcaaagtgcatggggaaggg

SEQ ID NO: 7547194 - DNA, 23 bp, Homo sapiens
gtgcaaagatataccacatggct

SEQ ID NO: 7547195 - DNA, 22 bp, Homo sapiens
gtgcaaagtgcatggggaaggg

SEQ ID NO: 7547196 - DNA, 22 bp, Homo sapiens
gtgcaaatgattctaatgggta

SEQ ID NO: 7547197 - DNA, 22 bp, Homo sapiens
gtgcaaatgagatggattcaag

SEQ ID NO: 7547198 - DNA, 22 bp, Homo sapiens
gtgcaaatgagatggattcaag

SEQ ID NO: 7547199 - DNA, 18 bp, Homo sapiens
gtgcaaatacttgctgac

SEQ ID NO: 7547200 - DNA, 18 bp, Homo sapiens
gtgcaaatacttgctgac

SEQ ID NO: 7547201 - DNA, 18 bp, Homo sapiens
gtgcaaatacttgctgac

SEQ ID NO: 7547202 - DNA, 22 bp, Homo sapiens
gtgcaaatacatatgctgtgga

SEQ ID NO: 7547203 - DNA, 22 bp, Homo sapiens
gtgcaaacatcatagagtgtac

SEQ ID NO: 7547204 - DNA, 22 bp, Homo sapiens
gtgcaaaatttggccaataaca

SEQ ID NO: 7547205 - DNA, 22 bp, Homo sapiens
gtgcaaaatttggccaataaca

SEQ ID NO: 7547206 - DNA, 22 bp, Homo sapiens
gtgcaaaatttggccaataaca

SEQ ID NO: 7547207 - DNA, 22 bp, Homo sapiens
gtgcaaaatgatatcctgaagc

SEQ ID NO: 7547208 - DNA, 16 bp, Homo sapiens
gtgcaaaagtgaggag

SEQ ID NO: 7547209 - DNA, 22 bp, Homo sapiens
gtgcaaaatgatatcctgaagc

SEQ ID NO: 7547210 - DNA, 16 bp, Homo sapiens
gtgcaaaagtgaggag

SEQ ID NO: 7547211 - DNA, 16 bp, Homo sapiens
gtgcaaaagtgaggag

SEQ ID NO: 7547212 - DNA, 16 bp, Homo sapiens
gtgcaaaagtgaggag

SEQ ID NO: 7547213 - DNA, 22 bp, Homo sapiens
gtgcagcctgtcgccagtggat

SEQ ID NO: 7547214 - DNA, 22 bp, Homo sapiens
gtgcagcctgtcgccagtggat

SEQ ID NO: 7547215 - DNA, 22 bp, Homo sapiens
gtgcagccatttgcatgcttcc

SEQ ID NO: 7547216 - DNA, 22 bp, Homo sapiens
gtgcagctactccttggtccta

SEQ ID NO: 7547217 - DNA, 22 bp, Homo sapiens
gtgcagctactccttggtccta

SEQ ID NO: 7547218 - DNA, 22 bp, Homo sapiens
gtgcagctactccttggtccta

SEQ ID NO: 7547219 - DNA, 22 bp, Homo sapiens
gtgcagctactccttggtccta

SEQ ID NO: 7547220 - DNA, 22 bp, Homo sapiens
gtgcagctcagttgaaatgcag

SEQ ID NO: 7547221 - DNA, 22 bp, Homo sapiens
gtgcagctcagttgaaatgcag

SEQ ID NO: 7547222 - DNA, 20 bp, Homo sapiens
gtgcagccaagctgagccgc

SEQ ID NO: 7547223 - DNA, 20 bp, Homo sapiens
gtgcagccaagctgagccgc

SEQ ID NO: 7547224 - DNA, 23 bp, Homo sapiens
gtgcagcagtgtctgcagtcatg

SEQ ID NO: 7547225 - DNA, 20 bp, Homo sapiens
gtgcagccaagctgagccgc

SEQ ID NO: 7547226 - DNA, 20 bp, Homo sapiens
gtgcagccaagctgagccgc

SEQ ID NO: 7547227 - DNA, 22 bp, Homo sapiens
gtgcagccatttgcatgcttcc

SEQ ID NO: 7547228 - DNA, 22 bp, Homo sapiens
gtgcagccatttgcatgcttcc

SEQ ID NO: 7547229 - DNA, 22 bp, Homo sapiens
gtgcagccatttgcatgcttcc

SEQ ID NO: 7547230 - DNA, 22 bp, Homo sapiens
gtgcaaatgtaattgcagtttt

SEQ ID NO: 7547231 - DNA, 22 bp, Homo sapiens
gtgcaaatgtaattgcagtttt

SEQ ID NO: 7547232 - DNA, 22 bp, Homo sapiens
gtgcaaatgtaattgcagtttt

SEQ ID NO: 7547233 - DNA, 22 bp, Homo sapiens
gtgcaaatgattctaatgggta

SEQ ID NO: 7547234 - DNA, 22 bp, Homo sapiens
gtgcaaatgtaattgccattga

SEQ ID NO: 7547235 - DNA, 23 bp, Homo sapiens
gtgcagcagtgtctgcagtcatg

SEQ ID NO: 7547236 - DNA, 23 bp, Homo sapiens
gtgcagcagtgtctgcagtcatg

SEQ ID NO: 7547237 - DNA, 23 bp, Homo sapiens
gtgcagcagtgtctgcagtcatg

SEQ ID NO: 7547238 - DNA, 22 bp, Homo sapiens
gtgcagcagggggaagacagtg

SEQ ID NO: 7547239 - DNA, 22 bp, Homo sapiens
gtgaataaagggagttttcaaa

SEQ ID NO: 7547240 - DNA, 22 bp, Homo sapiens
gtgaataaagggagttttcaaa

SEQ ID NO: 7547241 - DNA, 22 bp, Homo sapiens
gtgaataactttctatgttaat

SEQ ID NO: 7547242 - DNA, 22 bp, Homo sapiens
gtgaagttttagtatatgtaga

SEQ ID NO: 7547243 - DNA, 22 bp, Homo sapiens
gtgaagttttagtatatgtaga

SEQ ID NO: 7547244 - DNA, 22 bp, Homo sapiens
gtgaagttttagtatatgtaga

SEQ ID NO: 7547245 - DNA, 22 bp, Homo sapiens
gtgaagttgattgttatcgtca

SEQ ID NO: 7547246 - DNA, 22 bp, Homo sapiens
gtgaagttgattgttatcgtca

SEQ ID NO: 7547247 - DNA, 22 bp, Homo sapiens
gtgaagttggccagtttagttt

SEQ ID NO: 7547248 - DNA, 22 bp, Homo sapiens
gtgaataattttttagtataag

SEQ ID NO: 7547249 - DNA, 22 bp, Homo sapiens
gtgaataattttttagtataag

SEQ ID NO: 7547250 - DNA, 22 bp, Homo sapiens
gtgaataattttttagtataag

SEQ ID NO: 7547251 - DNA, 22 bp, Homo sapiens
gtgaataatcacccttctggat

SEQ ID NO: 7547252 - DNA, 22 bp, Homo sapiens
gtgaataagacctaaggatgaa

SEQ ID NO: 7547253 - DNA, 22 bp, Homo sapiens
gtgaataactttctatgttaat

SEQ ID NO: 7547254 - DNA, 22 bp, Homo sapiens
gtgaataactttctatgttaat

SEQ ID NO: 7547255 - DNA, 22 bp, Homo sapiens
gtgaataatattgtttataaaa

SEQ ID NO: 7547256 - DNA, 22 bp, Homo sapiens
gtgaataatattgtttataaaa

SEQ ID NO: 7547257 - DNA, 22 bp, Homo sapiens
gtgaggtaaactgtagttcaga

SEQ ID NO: 7547258 - DNA, 21 bp, Homo sapiens
gtgaattaattatatgcctta

SEQ ID NO: 7547259 - DNA, 21 bp, Homo sapiens
gtgaattaattatatgcctta

SEQ ID NO: 7547260 - DNA, 22 bp, Homo sapiens
gtgaattaaatatagccaggtc

SEQ ID NO: 7547261 - DNA, 22 bp, Homo sapiens
gtgaattaaatatagccaggtc

SEQ ID NO: 7547262 - DNA, 22 bp, Homo sapiens
gtgaatggggcaggaaggatgg

SEQ ID NO: 7547263 - DNA, 17 bp, Homo sapiens
gtgaatggcatagtcgg

SEQ ID NO: 7547264 - DNA, 22 bp, Homo sapiens
gtgaatgatagcttctctttgg

SEQ ID NO: 7547265 - DNA, 22 bp, Homo sapiens
gtgaatgcaaactgtttctgat

SEQ ID NO: 7547266 - DNA, 22 bp, Homo sapiens
gtgaatgacatattttgtactg

SEQ ID NO: 7547267 - DNA, 22 bp, Homo sapiens
gtgaatgacatattttgtactg

SEQ ID NO: 7547268 - DNA, 22 bp, Homo sapiens
gtgaatgactgttttcagcatt

SEQ ID NO: 7547269 - DNA, 22 bp, Homo sapiens
gtgaatgactgttttcagcatt

SEQ ID NO: 7547270 - DNA, 22 bp, Homo sapiens
gtgaatcagctcacgaaaatgg

SEQ ID NO: 7547271 - DNA, 22 bp, Homo sapiens
gtgaatatgatcttatttggaa

SEQ ID NO: 7547272 - DNA, 22 bp, Homo sapiens
gtgaatatgatcttatttggaa

SEQ ID NO: 7547273 - DNA, 22 bp, Homo sapiens
gtgaatactgtatctcaggaca

SEQ ID NO: 7547274 - DNA, 22 bp, Homo sapiens
gtgaataattttttagtataag

SEQ ID NO: 7547275 - DNA, 22 bp, Homo sapiens
gtgcaaaagtaattgcagtttt

SEQ ID NO: 7547276 - DNA, 22 bp, Homo sapiens
gtgcaaaagtaattgcagtttt

SEQ ID NO: 7547277 - DNA, 22 bp, Homo sapiens
gtgcaaaagtaattgcagtact

SEQ ID NO: 7547278 - DNA, 22 bp, Homo sapiens
gtgcaaaagtaattgcagtttt

SEQ ID NO: 7547279 - DNA, 22 bp, Homo sapiens
gtgcaaaagtaattgcagtttt

SEQ ID NO: 7547280 - DNA, 22 bp, Homo sapiens
gtgcaaaagtaattgcggtttt

SEQ ID NO: 7547281 - DNA, 22 bp, Homo sapiens
gtgcaaaagtaattgcggtttt

SEQ ID NO: 7547282 - DNA, 22 bp, Homo sapiens
gtgcaaaagtaattgctgtttt

SEQ ID NO: 7547283 - DNA, 22 bp, Homo sapiens
gtgcaaaagtaattgctgtttt

SEQ ID NO: 7547284 - DNA, 22 bp, Homo sapiens
gtgcaaaagtaattgctgtttt

SEQ ID NO: 7547285 - DNA, 22 bp, Homo sapiens
gtgcaaaagtcattgtggtttt

SEQ ID NO: 7547286 - DNA, 22 bp, Homo sapiens
gtgcaaaagtcattgtggtttt

SEQ ID NO: 7547287 - DNA, 22 bp, Homo sapiens
gtgcaaaagtacttgcggattt

SEQ ID NO: 7547288 - DNA, 22 bp, Homo sapiens
gtgcaaaagtcattgtggtttt

SEQ ID NO: 7547289 - DNA, 22 bp, Homo sapiens
gtgcaaaagtaattgtggtttt

SEQ ID NO: 7547290 - DNA, 22 bp, Homo sapiens
gtgcaaaagtaattgtggtttt

SEQ ID NO: 7547291 - DNA, 22 bp, Homo sapiens
gtgcaaaagtaattgtggtttt

SEQ ID NO: 7547292 - DNA, 22 bp, Homo sapiens
gtgcaaaagtacttgcggattt

SEQ ID NO: 7547293 - DNA, 23 bp, Homo sapiens
gtgaggtatattgaaatcatgct

SEQ ID NO: 7547294 - DNA, 22 bp, Homo sapiens
gtgaggtagcagagacagtgaa

SEQ ID NO: 7547295 - DNA, 22 bp, Homo sapiens
gtgaggtcaaagccttgggtat

SEQ ID NO: 7547296 - DNA, 22 bp, Homo sapiens
gtgaggtcaccggccgttgcca

SEQ ID NO: 7547297 - DNA, 22 bp, Homo sapiens
gtgcaaaagtaatggcagtttt

SEQ ID NO: 7547298 - DNA, 22 bp, Homo sapiens
gtgaggtcaccggccgttgcca

SEQ ID NO: 7547299 - DNA, 22 bp, Homo sapiens
gtgcaaaagtaattgaggtttt

SEQ ID NO: 7547300 - DNA, 22 bp, Homo sapiens
gtgcaaaagtaattgaggtttt

SEQ ID NO: 7547301 - DNA, 22 bp, Homo sapiens
gtgcaaaagtaattacagtttt

SEQ ID NO: 7547302 - DNA, 22 bp, Homo sapiens
gtgcaaaagtaattacagtttt

SEQ ID NO: 7547303 - DNA, 22 bp, Homo sapiens
gtgcaaaagtaattacagtttt

SEQ ID NO: 7547304 - DNA, 22 bp, Homo sapiens
gtgcaaaagtaattacagtttt

SEQ ID NO: 7547305 - DNA, 22 bp, Homo sapiens
gtgcaaaagtaattgcagtact

SEQ ID NO: 7547306 - DNA, 22 bp, Homo sapiens
gtgcaaaagtaattgcagtact

SEQ ID NO: 7547307 - DNA, 22 bp, Homo sapiens
gtgcaaaagtaattgaggtttt

SEQ ID NO: 7547308 - DNA, 22 bp, Homo sapiens
gtgcaaaagtaattgaggtttt

SEQ ID NO: 7547309 - DNA, 22 bp, Homo sapiens
gtctttggaaagacaaagttca

SEQ ID NO: 7547310 - DNA, 22 bp, Homo sapiens
gtctttcttcagagcttggact

SEQ ID NO: 7547311 - DNA, 22 bp, Homo sapiens
gtctttgctgtctttgctctca

SEQ ID NO: 7547312 - DNA, 22 bp, Homo sapiens
gtctttgctgtctttgctctca

SEQ ID NO: 7547313 - DNA, 22 bp, Homo sapiens
gtctttgcttttaaccagaggt

SEQ ID NO: 7547314 - DNA, 22 bp, Homo sapiens
gtctttggaaagacaaagttca

SEQ ID NO: 7547315 - DNA, 22 bp, Homo sapiens
gtctttcttcagagcttggact

SEQ ID NO: 7547316 - DNA, 22 bp, Homo sapiens
gtctttgctgtctttgctctca

SEQ ID NO: 7547317 - DNA, 22 bp, Homo sapiens
gtctttgccacacttctgtaca

SEQ ID NO: 7547318 - DNA, 22 bp, Homo sapiens
gtctttggagaggtgccatttc

SEQ ID NO: 7547319 - DNA, 22 bp, Homo sapiens
gtctttggagaggtgccatttc

SEQ ID NO: 7547320 - DNA, 22 bp, Homo sapiens
gtctttggagaggtgccatttc

SEQ ID NO: 7547321 - DNA, 22 bp, Homo sapiens
gtctttggagaggtgccatttc

SEQ ID NO: 7547322 - DNA, 22 bp, Homo sapiens
gtctttggaggcactgttgagt

SEQ ID NO: 7547323 - DNA, 22 bp, Homo sapiens
gtctttggaggcactgttgagt

SEQ ID NO: 7547324 - DNA, 22 bp, Homo sapiens
gtctttggaggcactgttgagt

SEQ ID NO: 7547325 - DNA, 18 bp, Homo sapiens
gtctttggagtggaggta

SEQ ID NO: 7547326 - DNA, 22 bp, Homo sapiens
gtctttggaggcactgttgagt

SEQ ID NO: 7547327 - DNA, 18 bp, Homo sapiens
gtctttggagtggaggta

SEQ ID NO: 7547328 - DNA, 22 bp, Homo sapiens
gtctttggatgtaagataaagt

SEQ ID NO: 7547329 - DNA, 22 bp, Homo sapiens
gtgaaggtagactgggcttcct

SEQ ID NO: 7547330 - DNA, 22 bp, Homo sapiens
gtgaaggtcagtggccctgggg

SEQ ID NO: 7547331 - DNA, 22 bp, Homo sapiens
gtgaaggtgggagacaggtgag

SEQ ID NO: 7547332 - DNA, 18 bp, Homo sapiens
gtctttggagtggaggta

SEQ ID NO: 7547333 - DNA, 18 bp, Homo sapiens
gtctttggagtggaggta

SEQ ID NO: 7547334 - DNA, 22 bp, Homo sapiens
gtctttggatgtaagataaagt

SEQ ID NO: 7547335 - DNA, 18 bp, Homo sapiens
gtctttggagtggaggta

SEQ ID NO: 7547336 - DNA, 22 bp, Homo sapiens
gtctttggatgtaagataaagt

SEQ ID NO: 7547337 - DNA, 22 bp, Homo sapiens
gtgaagtcaagaatgcaatttg

SEQ ID NO: 7547338 - DNA, 22 bp, Homo sapiens
gtgaagtaagtactattaagat

SEQ ID NO: 7547339 - DNA, 22 bp, Homo sapiens
gtgaaggtgtgagccagctgca

SEQ ID NO: 7547340 - DNA, 22 bp, Homo sapiens
gtgaaggtgtgtccactgcggc

SEQ ID NO: 7547341 - DNA, 22 bp, Homo sapiens
gtgaaggtggggagcctcagtt

SEQ ID NO: 7547342 - DNA, 19 bp, Homo sapiens
gtgaagtgccagaagtcag

SEQ ID NO: 7547343 - DNA, 22 bp, Homo sapiens
gtgaagtggagtggtatggttt

SEQ ID NO: 7547344 - DNA, 22 bp, Homo sapiens
gtgaagtggttagggagttggc

SEQ ID NO: 7547345 - DNA, 22 bp, Homo sapiens
gtgaagtgattgaagggtaggg

SEQ ID NO: 7547346 - DNA, 22 bp, Homo sapiens
gtgaagtgcaaagcagccagtt

SEQ ID NO: 7547347 - DNA, 22 bp, Homo sapiens
gtctttctgctgcacggactgc

SEQ ID NO: 7547348 - DNA, 22 bp, Homo sapiens
gtctttcttaaacaacagaaca

SEQ ID NO: 7547349 - DNA, 22 bp, Homo sapiens
gtctttcttaattcaagtgctt

SEQ ID NO: 7547350 - DNA, 22 bp, Homo sapiens
gtctttctctggaacagtaaaa

SEQ ID NO: 7547351 - DNA, 22 bp, Homo sapiens
gtctttctctggaacagtaaaa

SEQ ID NO: 7547352 - DNA, 22 bp, Homo sapiens
gtctttctatgcatagagcaga

SEQ ID NO: 7547353 - DNA, 22 bp, Homo sapiens
gtctttctatgcatagagcaga

SEQ ID NO: 7547354 - DNA, 22 bp, Homo sapiens
gtctttctgccatgtgaagaga

SEQ ID NO: 7547355 - DNA, 22 bp, Homo sapiens
gtctttctgccatgtgaagaga

SEQ ID NO: 7547356 - DNA, 22 bp, Homo sapiens
gtctttctgccatgtgaagaga

SEQ ID NO: 7547357 - DNA, 22 bp, Homo sapiens
gtctcttctttgccggtcctgc

SEQ ID NO: 7547358 - DNA, 16 bp, Homo sapiens
gtctcttccctgctga

SEQ ID NO: 7547359 - DNA, 22 bp, Homo sapiens
gtctcttatgggcaggagcaca

SEQ ID NO: 7547360 - DNA, 22 bp, Homo sapiens
gtctcttagtcaatattttctg

SEQ ID NO: 7547361 - DNA, 22 bp, Homo sapiens
gtctcttagtctcattttctgc

SEQ ID NO: 7547362 - DNA, 22 bp, Homo sapiens
gtctcttagtcaatattttctg

SEQ ID NO: 7547363 - DNA, 22 bp, Homo sapiens
gtctcttagaatcgcatattgt

SEQ ID NO: 7547364 - DNA, 22 bp, Homo sapiens
gtctctgttatttccagggtca

SEQ ID NO: 7547365 - DNA, 22 bp, Homo sapiens
gtcttaaaatcagaggatatag

SEQ ID NO: 7547366 - DNA, 22 bp, Homo sapiens
gtcttaaaatcagaggatatag

SEQ ID NO: 7547367 - DNA, 22 bp, Homo sapiens
gtcttaaaatcagaggatatag

SEQ ID NO: 7547368 - DNA, 22 bp, Homo sapiens
gtctgtttggggacctgtggcc

SEQ ID NO: 7547369 - DNA, 22 bp, Homo sapiens
gtctcttctttgccggtcctgc

SEQ ID NO: 7547370 - DNA, 22 bp, Homo sapiens
gtctgttagtgataactgtttt

SEQ ID NO: 7547371 - DNA, 22 bp, Homo sapiens
gtcttagatttcaccgataatg

SEQ ID NO: 7547372 - DNA, 22 bp, Homo sapiens
gtcttactgcttctgaaagata

SEQ ID NO: 7547373 - DNA, 22 bp, Homo sapiens
gtcttaccgcacctcatgaact

SEQ ID NO: 7547374 - DNA, 19 bp, Homo sapiens
gtcttacaggcaacatgag

SEQ ID NO: 7547375 - DNA, 22 bp, Homo sapiens
gtctcagttttccaaactgtca

SEQ ID NO: 7547376 - DNA, 22 bp, Homo sapiens
gtctcatatgatataaatgcag

SEQ ID NO: 7547377 - DNA, 22 bp, Homo sapiens
gtctcagttttccaaactgtca

SEQ ID NO: 7547378 - DNA, 22 bp, Homo sapiens
gtctcattggttctgccagagt

SEQ ID NO: 7547379 - DNA, 22 bp, Homo sapiens
gtctccacagcccagctgccac

SEQ ID NO: 7547380 - DNA, 22 bp, Homo sapiens
gtctccacagcccagctgccac

SEQ ID NO: 7547381 - DNA, 22 bp, Homo sapiens
gtctccacagcccagctgccac

SEQ ID NO: 7547382 - DNA, 22 bp, Homo sapiens
gtctcagttgtatcacctggtt

SEQ ID NO: 7547383 - DNA, 22 bp, Homo sapiens
gtctcagtttgaagtgatgcca

SEQ ID NO: 7547384 - DNA, 22 bp, Homo sapiens
gtctcagtttgaagtgatgcca

SEQ ID NO: 7547385 - DNA, 22 bp, Homo sapiens
gtctcagtttgaagtgatgcca

SEQ ID NO: 7547386 - DNA, 22 bp, Homo sapiens
gtctcagttactctccctggta

SEQ ID NO: 7547387 - DNA, 20 bp, Homo sapiens
gtctccactgggggttaacc

SEQ ID NO: 7547388 - DNA, 20 bp, Homo sapiens
gtctccactgggggttaacc

SEQ ID NO: 7547389 - DNA, 22 bp, Homo sapiens
gtctccactaaaaactttcacg

SEQ ID NO: 7547390 - DNA, 20 bp, Homo sapiens
gtctccactgggggttaacc

SEQ ID NO: 7547391 - DNA, 22 bp, Homo sapiens
gtctccagaagcctagacagcc

SEQ ID NO: 7547392 - DNA, 20 bp, Homo sapiens
gtctccactgggggttaacc

SEQ ID NO: 7547393 - DNA, 22 bp, Homo sapiens
gtctcagtaagaaaggctcctg

SEQ ID NO: 7547394 - DNA, 22 bp, Homo sapiens
gtctcagtccgtgctgttcagg

SEQ ID NO: 7547395 - DNA, 22 bp, Homo sapiens
gtctcagtccgtgctgttcagg

SEQ ID NO: 7547396 - DNA, 22 bp, Homo sapiens
gtctcagtaagaaaggctcctg

SEQ ID NO: 7547397 - DNA, 22 bp, Homo sapiens
gtctcagtccgtgctgttcagg

SEQ ID NO: 7547398 - DNA, 22 bp, Homo sapiens
gtctcagtgcccaatgccataa

SEQ ID NO: 7547399 - DNA, 22 bp, Homo sapiens
gtctcagtgcccaatgccataa

SEQ ID NO: 7547400 - DNA, 22 bp, Homo sapiens
gtctcagtgggagggtgatggg

SEQ ID NO: 7547401 - DNA, 22 bp, Homo sapiens
gtctcaggtattgaatgggaac

SEQ ID NO: 7547402 - DNA, 22 bp, Homo sapiens
gtctcagtaagaaaggctcctg

SEQ ID NO: 7547403 - DNA, 22 bp, Homo sapiens
gtctcagtaagaaaggctcctg

SEQ ID NO: 7547404 - DNA, 22 bp, Homo sapiens
gtctcaggttcgagcctcctta

SEQ ID NO: 7547405 - DNA, 22 bp, Homo sapiens
gtctcaggttcgagcctcctta

SEQ ID NO: 7547406 - DNA, 22 bp, Homo sapiens
gtctcaggttcgagcctcctta

SEQ ID NO: 7547407 - DNA, 22 bp, Homo sapiens
gtctcagataacatgtattcta

SEQ ID NO: 7547408 - DNA, 18 bp, Homo sapiens
gtctcaggagtggcacgt

SEQ ID NO: 7547409 - DNA, 22 bp, Homo sapiens
gtctcagattcagacatctaca

SEQ ID NO: 7547410 - DNA, 22 bp, Homo sapiens
gtctcagattcagacatctaca

SEQ ID NO: 7547411 - DNA, 22 bp, Homo sapiens
gtctcagattcagacatctaca

SEQ ID NO: 7547412 - DNA, 22 bp, Homo sapiens
gtctcagggcagctggaggagg

SEQ ID NO: 7547413 - DNA, 22 bp, Homo sapiens
gtctcagggactgcttctgggg

SEQ ID NO: 7547414 - DNA, 22 bp, Homo sapiens
gtctcagggactgcttctgggg

SEQ ID NO: 7547415 - DNA, 18 bp, Homo sapiens
gtctcaggagtggcacgt

SEQ ID NO: 7547416 - DNA, 18 bp, Homo sapiens
gtctcaggagtggcacgt

SEQ ID NO: 7547417 - DNA, 17 bp, Homo sapiens
gtctctgtcttgctttt

SEQ ID NO: 7547418 - DNA, 17 bp, Homo sapiens
gtctctgtcttgctttt

SEQ ID NO: 7547419 - DNA, 22 bp, Homo sapiens
gtctctgtgcccccatttccgt

SEQ ID NO: 7547420 - DNA, 22 bp, Homo sapiens
gtctctgtgcccccatttccgt

SEQ ID NO: 7547421 - DNA, 22 bp, Homo sapiens
gtctctgtgccttctccccacc

SEQ ID NO: 7547422 - DNA, 22 bp, Homo sapiens
gtctctgtgccttctccccacc

SEQ ID NO: 7547423 - DNA, 22 bp, Homo sapiens
gtctctgtggctggctccttcc

SEQ ID NO: 7547424 - DNA, 22 bp, Homo sapiens
gtctctgtgccttctccccacc

SEQ ID NO: 7547425 - DNA, 22 bp, Homo sapiens
gtctctgtggctggctccttcc

SEQ ID NO: 7547426 - DNA, 22 bp, Homo sapiens
gtctctgtggctggctccttcc

SEQ ID NO: 7547427 - DNA, 18 bp, Homo sapiens
gtctctgtgggaattggc

SEQ ID NO: 7547428 - DNA, 18 bp, Homo sapiens
gtctctgtgggaattggc

SEQ ID NO: 7547429 - DNA, 22 bp, Homo sapiens
gtctctgtgtctgagagagccc

SEQ ID NO: 7547430 - DNA, 22 bp, Homo sapiens
gtctctgtggtacgtttcatcc

SEQ ID NO: 7547431 - DNA, 22 bp, Homo sapiens
gtctctgtgtctgagagagccc

SEQ ID NO: 7547432 - DNA, 22 bp, Homo sapiens
gtctcttagaatcgcatattgt

SEQ ID NO: 7547433 - DNA, 22 bp, Homo sapiens
gtctcttagaatcgcatattgt

SEQ ID NO: 7547434 - DNA, 22 bp, Homo sapiens
gtctctgttatttccagggtca

SEQ ID NO: 7547435 - DNA, 19 bp, Homo sapiens
gtctctggatttcaggtcc

SEQ ID NO: 7547436 - DNA, 19 bp, Homo sapiens
gtctctggatttcaggtcc

SEQ ID NO: 7547437 - DNA, 22 bp, Homo sapiens
gtctctggctttatgctggttt

SEQ ID NO: 7547438 - DNA, 22 bp, Homo sapiens
gtctctgggtgtgtgatgccaa

SEQ ID NO: 7547439 - DNA, 22 bp, Homo sapiens
gtctctgggttaagcagtgcat

SEQ ID NO: 7547440 - DNA, 22 bp, Homo sapiens
gtctctgggttaagcagtgcat

SEQ ID NO: 7547441 - DNA, 22 bp, Homo sapiens
gtctctgtcttaggccaggcct

SEQ ID NO: 7547442 - DNA, 22 bp, Homo sapiens
gtctctgtcttaggccaggcct

SEQ ID NO: 7547443 - DNA, 22 bp, Homo sapiens
gtctctgtcttaggccaggcct

SEQ ID NO: 7547444 - DNA, 22 bp, Homo sapiens
gtctctgtcacaactactcatc

SEQ ID NO: 7547445 - DNA, 22 bp, Homo sapiens
gtctctgtcacaactactcatc

SEQ ID NO: 7547446 - DNA, 22 bp, Homo sapiens
gtctctgtcatttcaccttccc

SEQ ID NO: 7547447 - DNA, 22 bp, Homo sapiens
gtctctgtcatttcaccttccc

SEQ ID NO: 7547448 - DNA, 22 bp, Homo sapiens
gtctctgggttaagcagtgcat

SEQ ID NO: 7547449 - DNA, 22 bp, Homo sapiens
gtctctgggttaagcagtgcat

SEQ ID NO: 7547450 - DNA, 22 bp, Homo sapiens
gtctctgggttaagcagtgcat

SEQ ID NO: 7547451 - DNA, 22 bp, Homo sapiens
cagcagagatgagattcctata

SEQ ID NO: 7547452 - DNA, 22 bp, Homo sapiens
cagcagagatgagattcctata

SEQ ID NO: 7547453 - DNA, 22 bp, Homo sapiens
cagcagagatgagattcctata

SEQ ID NO: 7547454 - DNA, 22 bp, Homo sapiens
cagcagagcatttggtaggagg

SEQ ID NO: 7547455 - DNA, 22 bp, Homo sapiens
cagcagagatgagattcctata

SEQ ID NO: 7547456 - DNA, 22 bp, Homo sapiens
cagcagagatgagattcctata

SEQ ID NO: 7547457 - DNA, 22 bp, Homo sapiens
cagcagagatgagattcctata

SEQ ID NO: 7547458 - DNA, 23 bp, Homo sapiens
cagcagagagcagacctttgtgt

SEQ ID NO: 7547459 - DNA, 23 bp, Homo sapiens
cagcagagagcagacctttgtgt

SEQ ID NO: 7547460 - DNA, 23 bp, Homo sapiens
cagcagagagcagacctttgtgt

SEQ ID NO: 7547461 - DNA, 22 bp, Homo sapiens
cagcagagacggtaagcagaac

SEQ ID NO: 7547462 - DNA, 22 bp, Homo sapiens
cagcagagatgagattcctata

SEQ ID NO: 7547463 - DNA, 22 bp, Homo sapiens
cagcagagatgagattcctata

SEQ ID NO: 7547464 - DNA, 22 bp, Homo sapiens
cagcagagatgagattcctata

SEQ ID NO: 7547465 - DNA, 23 bp, Homo sapiens
cagcagagagcagacctttgtgt

SEQ ID NO: 7547466 - DNA, 23 bp, Homo sapiens
cagcagagagcagacctttgtgt

SEQ ID NO: 7547467 - DNA, 22 bp, Homo sapiens
cagcagagacggtaagcagaac

SEQ ID NO: 7547468 - DNA, 22 bp, Homo sapiens
cagcagagacggtaagcagaac

SEQ ID NO: 7547469 - DNA, 22 bp, Homo sapiens
cagcagagacggtaagcagaac

SEQ ID NO: 7547470 - DNA, 22 bp, Homo sapiens
cagcagagacggtaagcagaac

SEQ ID NO: 7547471 - DNA, 22 bp, Homo sapiens
cagcagagacggtaagcagaac

SEQ ID NO: 7547472 - DNA, 22 bp, Homo sapiens
cagcagagacggtaagcagaac

SEQ ID NO: 7547473 - DNA, 22 bp, Homo sapiens
cagcagagacggtaagcagaac

SEQ ID NO: 7547474 - DNA, 22 bp, Homo sapiens
cagcagagacggtaagcagaac

SEQ ID NO: 7547475 - DNA, 22 bp, Homo sapiens
cagcagagacggtaagcagaac

SEQ ID NO: 7547476 - DNA, 22 bp, Homo sapiens
cagcagagctgggctttgaatt

SEQ ID NO: 7547477 - DNA, 22 bp, Homo sapiens
cagcagagctgggctttgaatt

SEQ ID NO: 7547478 - DNA, 22 bp, Homo sapiens
cagcagagctgggctttgaatt

SEQ ID NO: 7547479 - DNA, 22 bp, Homo sapiens
cagcagagctgggctttgaatt

SEQ ID NO: 7547480 - DNA, 22 bp, Homo sapiens
cagcagagctgggctttgaatt

SEQ ID NO: 7547481 - DNA, 22 bp, Homo sapiens
cagcagagctgggaataaaatt

SEQ ID NO: 7547482 - DNA, 22 bp, Homo sapiens
cagcagagctgggaataaaatt

SEQ ID NO: 7547483 - DNA, 22 bp, Homo sapiens
cagcagagctgggaataaaatt

SEQ ID NO: 7547484 - DNA, 22 bp, Homo sapiens
cagcagagctgggctttgaatt

SEQ ID NO: 7547485 - DNA, 22 bp, Homo sapiens
cagcagagctgggaataaaatt

SEQ ID NO: 7547486 - DNA, 22 bp, Homo sapiens
cagcagagcatttggtaggagg

SEQ ID NO: 7547487 - DNA, 22 bp, Homo sapiens
cagcagagcatttggtaggagg

SEQ ID NO: 7547488 - DNA, 22 bp, Homo sapiens
cagcagagcatttggtaggagg

SEQ ID NO: 7547489 - DNA, 22 bp, Homo sapiens
cagcagagcatttggtaggagg

SEQ ID NO: 7547490 - DNA, 22 bp, Homo sapiens
cagcagagcatttggtaggagg

SEQ ID NO: 7547491 - DNA, 22 bp, Homo sapiens
cagcagagcatttggtaggagg

SEQ ID NO: 7547492 - DNA, 22 bp, Homo sapiens
cagcagagcatttggtaggagg

SEQ ID NO: 7547493 - DNA, 22 bp, Homo sapiens
cagcagagcatttggtaggagg

SEQ ID NO: 7547494 - DNA, 22 bp, Homo sapiens
cagcagagcatttggtaggagg

SEQ ID NO: 7547495 - DNA, 22 bp, Homo sapiens
cagcagagctgggaataaaatt

SEQ ID NO: 7547496 - DNA, 22 bp, Homo sapiens
cagcagggaagctgtgctgttt

SEQ ID NO: 7547497 - DNA, 22 bp, Homo sapiens
cagcagggaagctgtgctgttt

SEQ ID NO: 7547498 - DNA, 22 bp, Homo sapiens
cagcagggaagctgtgctgttt

SEQ ID NO: 7547499 - DNA, 22 bp, Homo sapiens
cagcagggaagctgtgctgttt

SEQ ID NO: 7547500 - DNA, 22 bp, Homo sapiens
cagcagggaagctgtgctgttt

SEQ ID NO: 7547501 - DNA, 22 bp, Homo sapiens
cagcagagctgtgtgggaaggg

SEQ ID NO: 7547502 - DNA, 22 bp, Homo sapiens
cagcagagctgggctttgaatt

SEQ ID NO: 7547503 - DNA, 22 bp, Homo sapiens
cagcagagctgtgtgggaaggg

SEQ ID NO: 7547504 - DNA, 22 bp, Homo sapiens
cagcagagctgtgtgggaaggg

SEQ ID NO: 7547505 - DNA, 22 bp, Homo sapiens
cagcagagctgtgtgggaaggg

SEQ ID NO: 7547506 - DNA, 22 bp, Homo sapiens
cagcagagctgtgtgggaaggg

SEQ ID NO: 7547507 - DNA, 18 bp, Homo sapiens
cagcaggtagagtttggt

SEQ ID NO: 7547508 - DNA, 18 bp, Homo sapiens
cagcaggtagagtttggt

SEQ ID NO: 7547509 - DNA, 22 bp, Homo sapiens
cagcagggttaagtgactcacc

SEQ ID NO: 7547510 - DNA, 22 bp, Homo sapiens
cagcagggaagctgtgctgttt

SEQ ID NO: 7547511 - DNA, 22 bp, Homo sapiens
cagcagggaagctgtgctgttt

SEQ ID NO: 7547512 - DNA, 22 bp, Homo sapiens
cagcagggttaagtgactcacc

SEQ ID NO: 7547513 - DNA, 22 bp, Homo sapiens
cagcaggtcccactgagggccc

SEQ ID NO: 7547514 - DNA, 22 bp, Homo sapiens
cagcaggtcccactgagggccc

SEQ ID NO: 7547515 - DNA, 22 bp, Homo sapiens
cagcaggtcccactgagggccc

SEQ ID NO: 7547516 - DNA, 22 bp, Homo sapiens
cagcaggtcccactgagggccc

SEQ ID NO: 7547517 - DNA, 22 bp, Homo sapiens
cagcaggtcccactgagggccc

SEQ ID NO: 7547518 - DNA, 22 bp, Homo sapiens
cagcaggtatgtttgttcagca

SEQ ID NO: 7547519 - DNA, 22 bp, Homo sapiens
cagcaggtatgtttgttcagca

SEQ ID NO: 7547520 - DNA, 22 bp, Homo sapiens
cagcaggtcatgaaagaaaacc

SEQ ID NO: 7547521 - DNA, 22 bp, Homo sapiens
cagcaggtctgcatttgaggtc

SEQ ID NO: 7547522 - DNA, 22 bp, Homo sapiens
cagcaggtctcagcagctcctt

SEQ ID NO: 7547523 - DNA, 22 bp, Homo sapiens
cagcaggtctcagcagctcctt

SEQ ID NO: 7547524 - DNA, 22 bp, Homo sapiens
cagcaggtctcagcagctcctt

SEQ ID NO: 7547525 - DNA, 22 bp, Homo sapiens
cagcaggtctcagcagctcctt

SEQ ID NO: 7547526 - DNA, 22 bp, Homo sapiens
cagcaggtcccactgagggccc

SEQ ID NO: 7547527 - DNA, 22 bp, Homo sapiens
cagcaggtcctgggcgtggcct

SEQ ID NO: 7547528 - DNA, 22 bp, Homo sapiens
cagcaggtcctgggcgtggcct

SEQ ID NO: 7547529 - DNA, 22 bp, Homo sapiens
cagcaggtcctgggcgtggcct

SEQ ID NO: 7547530 - DNA, 22 bp, Homo sapiens
cagcaggtcctgggcgtggcct

SEQ ID NO: 7547531 - DNA, 22 bp, Homo sapiens
cagcagtggaactacccaggga

SEQ ID NO: 7547532 - DNA, 22 bp, Homo sapiens
cagcagtggaactacccaggga

SEQ ID NO: 7547533 - DNA, 22 bp, Homo sapiens
cagcagtgcttcagtgtgagat

SEQ ID NO: 7547534 - DNA, 20 bp, Homo sapiens
cagcagtggatgagagtttt

SEQ ID NO: 7547535 - DNA, 22 bp, Homo sapiens
cagcagtggaactacccaggga

SEQ ID NO: 7547536 - DNA, 20 bp, Homo sapiens
cagcagtggatgagagtttt

SEQ ID NO: 7547537 - DNA, 20 bp, Homo sapiens
cagcagtggatgagagtttt

SEQ ID NO: 7547538 - DNA, 22 bp, Homo sapiens
cagcagtggccatctgtgtggt

SEQ ID NO: 7547539 - DNA, 22 bp, Homo sapiens
cagcagtggccatctgtgtggt

SEQ ID NO: 7547540 - DNA, 22 bp, Homo sapiens
cagcagtggccatctgtgtggt

SEQ ID NO: 7547541 - DNA, 22 bp, Homo sapiens
cagcagtggctgcaggcagctg

SEQ ID NO: 7547542 - DNA, 22 bp, Homo sapiens
cagcagtggctgcaggcagctg

SEQ ID NO: 7547543 - DNA, 22 bp, Homo sapiens
cagcagtggctgcaggcagctg

SEQ ID NO: 7547544 - DNA, 22 bp, Homo sapiens
cagcagtggccatctgtgtggt

SEQ ID NO: 7547545 - DNA, 22 bp, Homo sapiens
cagcagtggctgcaggcagctg

SEQ ID NO: 7547546 - DNA, 22 bp, Homo sapiens
cagcagtcttcccttccttttt

SEQ ID NO: 7547547 - DNA, 22 bp, Homo sapiens
cagcagtgacaagactaagaag

SEQ ID NO: 7547548 - DNA, 22 bp, Homo sapiens
cagcagtgacaagactaagaag

SEQ ID NO: 7547549 - DNA, 22 bp, Homo sapiens
cagcagtgacaagactaagaag

SEQ ID NO: 7547550 - DNA, 22 bp, Homo sapiens
cagcagtgatgtgtgagggttc

SEQ ID NO: 7547551 - DNA, 22 bp, Homo sapiens
cagcagtgcttcagtgtgagat

SEQ ID NO: 7547552 - DNA, 22 bp, Homo sapiens
cagcagtgcttcagtgtgagat

SEQ ID NO: 7547553 - DNA, 22 bp, Homo sapiens
cagcagtgcttcagtgtgagat

SEQ ID NO: 7547554 - DNA, 22 bp, Homo sapiens
cagcagtccctgcagtggggaa

SEQ ID NO: 7547555 - DNA, 22 bp, Homo sapiens
cagcagtcaggcctgtgggaga

SEQ ID NO: 7547556 - DNA, 22 bp, Homo sapiens
cagcagtcaggcctgtgggaga

SEQ ID NO: 7547557 - DNA, 22 bp, Homo sapiens
cagcagtcaggcaaatgggagg

SEQ ID NO: 7547558 - DNA, 22 bp, Homo sapiens
cagcagtcaggcaaatgggagg

SEQ ID NO: 7547559 - DNA, 22 bp, Homo sapiens
cagcagtcaggcctgtgggaga

SEQ ID NO: 7547560 - DNA, 22 bp, Homo sapiens
cagcagtcaggcctgtgggaga

SEQ ID NO: 7547561 - DNA, 22 bp, Homo sapiens
cagcagtctgtttcaacaggtc

SEQ ID NO: 7547562 - DNA, 22 bp, Homo sapiens
cagcagtctgtttcaacaggtc

SEQ ID NO: 7547563 - DNA, 22 bp, Homo sapiens
cagcagtccctgcagtggggaa

SEQ ID NO: 7547564 - DNA, 22 bp, Homo sapiens
cagcagtccctgcagtggggaa

SEQ ID NO: 7547565 - DNA, 22 bp, Homo sapiens
cagcagtccctgcagtggggaa

SEQ ID NO: 7547566 - DNA, 22 bp, Homo sapiens
cagcagtaattagtgctgcatg

SEQ ID NO: 7547567 - DNA, 22 bp, Homo sapiens
cagcagtaattagtgctgcatg

SEQ ID NO: 7547568 - DNA, 22 bp, Homo sapiens
cagcagtaattagtgctgcatg

SEQ ID NO: 7547569 - DNA, 22 bp, Homo sapiens
cagcagtacttctcagaggtat

SEQ ID NO: 7547570 - DNA, 22 bp, Homo sapiens
cagcagtcacacaaactctgga

SEQ ID NO: 7547571 - DNA, 22 bp, Homo sapiens
cagcagtcaggcaaatgggagg

SEQ ID NO: 7547572 - DNA, 22 bp, Homo sapiens
cagcagtagtctctgtggcttt

SEQ ID NO: 7547573 - DNA, 22 bp, Homo sapiens
cagcaggttaacagaggctggt

SEQ ID NO: 7547574 - DNA, 22 bp, Homo sapiens
cagcaggtgtctagcaagggtc

SEQ ID NO: 7547575 - DNA, 22 bp, Homo sapiens
cagcaggttaacagaggctggt

SEQ ID NO: 7547576 - DNA, 22 bp, Homo sapiens
cagcaggttaacagaggctggt

SEQ ID NO: 7547577 - DNA, 22 bp, Homo sapiens
cagcaggttaacagaggctggt

SEQ ID NO: 7547578 - DNA, 22 bp, Homo sapiens
cagcagtaactcccgtgcagca

SEQ ID NO: 7547579 - DNA, 22 bp, Homo sapiens
cagcaggttctacgggtgagat

SEQ ID NO: 7547580 - DNA, 22 bp, Homo sapiens
cagcaggttaacagaggctggt

SEQ ID NO: 7547581 - DNA, 22 bp, Homo sapiens
cagcaggttctacgggtgagat

SEQ ID NO: 7547582 - DNA, 22 bp, Homo sapiens
cagcaggtcttgttgctgctga

SEQ ID NO: 7547583 - DNA, 22 bp, Homo sapiens
cagcaggtctgcatttgaggtc

SEQ ID NO: 7547584 - DNA, 22 bp, Homo sapiens
cagcaggtcttgttgctgctga

SEQ ID NO: 7547585 - DNA, 22 bp, Homo sapiens
cagcaggtcttgttgctgctga

SEQ ID NO: 7547586 - DNA, 22 bp, Homo sapiens
cagcaggtcttgttgctgctga

SEQ ID NO: 7547587 - DNA, 22 bp, Homo sapiens
cagcaggtgcaggtgcggccgc

SEQ ID NO: 7547588 - DNA, 22 bp, Homo sapiens
cagcaggtgcaggtgcggccgc

SEQ ID NO: 7547589 - DNA, 22 bp, Homo sapiens
cagcaggtggacacactcacct

SEQ ID NO: 7547590 - DNA, 22 bp, Homo sapiens
cagcaggtggacacactcacct

SEQ ID NO: 7547591 - DNA, 22 bp, Homo sapiens
cagcaggtggacacactcacct

SEQ ID NO: 7547592 - DNA, 22 bp, Homo sapiens
cagcaggtgctgcctgtcaccc

SEQ ID NO: 7547593 - DNA, 22 bp, Homo sapiens
cagcaggtgctgcctgtcaccc

SEQ ID NO: 7547594 - DNA, 22 bp, Homo sapiens
cagcaggtgcaggtgcggccgc

SEQ ID NO: 7547595 - DNA, 22 bp, Homo sapiens
cagcaggtgctgcctgtcaccc

SEQ ID NO: 7547596 - DNA, 22 bp, Homo sapiens
cagcaggtgctgcctgtcaccc

SEQ ID NO: 7547597 - DNA, 22 bp, Homo sapiens
cagcaggtgtctagcaagggtc

SEQ ID NO: 7547598 - DNA, 22 bp, Homo sapiens
cagcaggtgtctagcaagggtc

SEQ ID NO: 7547599 - DNA, 22 bp, Homo sapiens
cagcaggtgtctagcaagggtc

SEQ ID NO: 7547600 - DNA, 22 bp, Homo sapiens
cagcaggtgtccttttggtgga

SEQ ID NO: 7547601 - DNA, 22 bp, Homo sapiens
cagcaggtgtccttttggtgga

SEQ ID NO: 7547602 - DNA, 22 bp, Homo sapiens
cagcaggtgggctttgcggatg

SEQ ID NO: 7547603 - DNA, 22 bp, Homo sapiens
cagcaggtgggctttgcggatg

SEQ ID NO: 7547604 - DNA, 22 bp, Homo sapiens
cagcaggtgtccttttggtgga

SEQ ID NO: 7547605 - DNA, 21 bp, Homo sapiens
cagcaggtggagcctcttgtc

SEQ ID NO: 7547606 - DNA, 21 bp, Homo sapiens
cagcaggtggagcctcttgtc

SEQ ID NO: 7547607 - DNA, 22 bp, Homo sapiens
cagcaggtggacacactcacct

SEQ ID NO: 7547608 - DNA, 22 bp, Homo sapiens
cagcatgcattttctctctttg

SEQ ID NO: 7547609 - DNA, 22 bp, Homo sapiens
cagcatgcagcccctggcagct

SEQ ID NO: 7547610 - DNA, 22 bp, Homo sapiens
cagcatgcaggggcctgagcac

SEQ ID NO: 7547611 - DNA, 22 bp, Homo sapiens
cagcatgcaggggcctgagcac

SEQ ID NO: 7547612 - DNA, 22 bp, Homo sapiens
gtcctgtgggagcattgctttg

SEQ ID NO: 7547613 - DNA, 22 bp, Homo sapiens
gtcctgtgctcagacatggggg

SEQ ID NO: 7547614 - DNA, 22 bp, Homo sapiens
cagcatgcccagactgagctaa

SEQ ID NO: 7547615 - DNA, 22 bp, Homo sapiens
cagcatgcattttctctctttg

SEQ ID NO: 7547616 - DNA, 22 bp, Homo sapiens
cagcatgcaagtccagatgtgg

SEQ ID NO: 7547617 - DNA, 22 bp, Homo sapiens
cagcatgatcccagttgattgc

SEQ ID NO: 7547618 - DNA, 22 bp, Homo sapiens
cagcatgatttatcacaaccct

SEQ ID NO: 7547619 - DNA, 22 bp, Homo sapiens
cagcatgatttatcacaaccct

SEQ ID NO: 7547620 - DNA, 22 bp, Homo sapiens
cagcatgattggtgtctggtga

SEQ ID NO: 7547621 - DNA, 22 bp, Homo sapiens
cagcatgattggtgtctggtga

SEQ ID NO: 7547622 - DNA, 22 bp, Homo sapiens
cagcatgcagcccctggcagct

SEQ ID NO: 7547623 - DNA, 22 bp, Homo sapiens
cagcatgcagcccctggcagct

SEQ ID NO: 7547624 - DNA, 22 bp, Homo sapiens
cagcatgcagcccctggcagct

SEQ ID NO: 7547625 - DNA, 22 bp, Homo sapiens
cagcatgcagcccctggcagct

SEQ ID NO: 7547626 - DNA, 22 bp, Homo sapiens
gtctcagagagctactctctta

SEQ ID NO: 7547627 - DNA, 22 bp, Homo sapiens
gtctcagagtcctacttattcc

SEQ ID NO: 7547628 - DNA, 20 bp, Homo sapiens
gtctcagaatggatttgcat

SEQ ID NO: 7547629 - DNA, 21 bp, Homo sapiens
gtctcacaaggtggcttacgt

SEQ ID NO: 7547630 - DNA, 20 bp, Homo sapiens
gtctcaagtatctcacagtc

SEQ ID NO: 7547631 - DNA, 22 bp, Homo sapiens
gtctcaatagcaactctatcct

SEQ ID NO: 7547632 - DNA, 22 bp, Homo sapiens
gtctcaatagcaactctatcct

SEQ ID NO: 7547633 - DNA, 22 bp, Homo sapiens
gtctcaatagcaactctatcct

SEQ ID NO: 7547634 - DNA, 22 bp, Homo sapiens
gtcctgtgtaagccaggacaat

SEQ ID NO: 7547635 - DNA, 22 bp, Homo sapiens
gtcctgtgtaagccaggacaat

SEQ ID NO: 7547636 - DNA, 22 bp, Homo sapiens
gtcctgtgggcccaccatgagc

SEQ ID NO: 7547637 - DNA, 22 bp, Homo sapiens
gtcctgtgggcccaccatgagc

SEQ ID NO: 7547638 - DNA, 22 bp, Homo sapiens
gtcctgtgggcccaccatgagc

SEQ ID NO: 7547639 - DNA, 22 bp, Homo sapiens
gtctcaagggggaactcactgt

SEQ ID NO: 7547640 - DNA, 20 bp, Homo sapiens
gtctcaagtatctcacagtc

SEQ ID NO: 7547641 - DNA, 22 bp, Homo sapiens
gtctcaaactcctaggctaaag

SEQ ID NO: 7547642 - DNA, 22 bp, Homo sapiens
gtctcaaactcctaggctaaag

SEQ ID NO: 7547643 - DNA, 22 bp, Homo sapiens
gtctcaagggggaactcactgt

SEQ ID NO: 7547644 - DNA, 22 bp, Homo sapiens
cagcatcttctagatccaggct

SEQ ID NO: 7547645 - DNA, 22 bp, Homo sapiens
cagcatcttctagatccaggct

SEQ ID NO: 7547646 - DNA, 22 bp, Homo sapiens
cagcatcttctccaaagctgcc

SEQ ID NO: 7547647 - DNA, 22 bp, Homo sapiens
cagcatcttctagatccaggct

SEQ ID NO: 7547648 - DNA, 22 bp, Homo sapiens
cagcatcttctccaaagctgcc

SEQ ID NO: 7547649 - DNA, 22 bp, Homo sapiens
cagcatcttctccaaagctgcc

SEQ ID NO: 7547650 - DNA, 22 bp, Homo sapiens
cagcatcttctccaaagctgcc

SEQ ID NO: 7547651 - DNA, 22 bp, Homo sapiens
cagcatctttataaaaagtaaa

SEQ ID NO: 7547652 - DNA, 22 bp, Homo sapiens
cagcatctttctcttctggagt

SEQ ID NO: 7547653 - DNA, 22 bp, Homo sapiens
cagcatctttctcttctggagt

SEQ ID NO: 7547654 - DNA, 22 bp, Homo sapiens
cagcatcttgaagggtaaacca

SEQ ID NO: 7547655 - DNA, 22 bp, Homo sapiens
cagcatctttataaaaagtaaa

SEQ ID NO: 7547656 - DNA, 22 bp, Homo sapiens
cagcatctttataaaaagtaaa

SEQ ID NO: 7547657 - DNA, 22 bp, Homo sapiens
cagcatcttgaagggtaaacca

SEQ ID NO: 7547658 - DNA, 22 bp, Homo sapiens
cagcatcttgaagggtaaacca

SEQ ID NO: 7547659 - DNA, 22 bp, Homo sapiens
cagcatcttctagatccaggct

SEQ ID NO: 7547660 - DNA, 22 bp, Homo sapiens
cagcatcttctagatccaggct

SEQ ID NO: 7547661 - DNA, 18 bp, Homo sapiens
cagcatcttcattaggcc

SEQ ID NO: 7547662 - DNA, 18 bp, Homo sapiens
cagcatcttcattaggcc

SEQ ID NO: 7547663 - DNA, 22 bp, Homo sapiens
cagcatcttcatgtgcatctcc

SEQ ID NO: 7547664 - DNA, 18 bp, Homo sapiens
cagcatcttcattaggcc

SEQ ID NO: 7547665 - DNA, 22 bp, Homo sapiens
cagcatcttattttctatggaa

SEQ ID NO: 7547666 - DNA, 22 bp, Homo sapiens
cagcatcttattttctatggaa

SEQ ID NO: 7547667 - DNA, 22 bp, Homo sapiens
cagcatctgtttttctgaccca

SEQ ID NO: 7547668 - DNA, 22 bp, Homo sapiens
cagcatcttattttctatggaa

SEQ ID NO: 7547669 - DNA, 22 bp, Homo sapiens
cagcatcttcatgtgcatctcc

SEQ ID NO: 7547670 - DNA, 22 bp, Homo sapiens
cagcatcttcatgtgcatctcc

SEQ ID NO: 7547671 - DNA, 22 bp, Homo sapiens
cagcatcttattttctatggaa

SEQ ID NO: 7547672 - DNA, 22 bp, Homo sapiens
cagcatcttcatgtgcatctcc

SEQ ID NO: 7547673 - DNA, 22 bp, Homo sapiens
cagcatgaccctggagcctgca

SEQ ID NO: 7547674 - DNA, 22 bp, Homo sapiens
cagcatgacagtctgcagcaga

SEQ ID NO: 7547675 - DNA, 22 bp, Homo sapiens
cagcatgaaacaattgagccca

SEQ ID NO: 7547676 - DNA, 22 bp, Homo sapiens
cagcatgaatgtgttcgtaggg

SEQ ID NO: 7547677 - DNA, 22 bp, Homo sapiens
cagcatgaaaagtgttgctatc

SEQ ID NO: 7547678 - DNA, 22 bp, Homo sapiens
cagcatctttctcttctggagt

SEQ ID NO: 7547679 - DNA, 22 bp, Homo sapiens
cagcatgaaaagaataggccta

SEQ ID NO: 7547680 - DNA, 22 bp, Homo sapiens
cagcatctttctcttctggagt

SEQ ID NO: 7547681 - DNA, 22 bp, Homo sapiens
cagcatgactcactgtggtcac

SEQ ID NO: 7547682 - DNA, 22 bp, Homo sapiens
cagcatgagaaaatgaatcaga

SEQ ID NO: 7547683 - DNA, 22 bp, Homo sapiens
cagcatgagaaaatgaatcaga

SEQ ID NO: 7547684 - DNA, 22 bp, Homo sapiens
cagcatgactcactgtggtcac

SEQ ID NO: 7547685 - DNA, 22 bp, Homo sapiens
cagcatgaccctggagcctgca

SEQ ID NO: 7547686 - DNA, 22 bp, Homo sapiens
cagcatgacagtctgcagcaga

SEQ ID NO: 7547687 - DNA, 22 bp, Homo sapiens
cagcatgatgctcacacaaaac

SEQ ID NO: 7547688 - DNA, 22 bp, Homo sapiens
cagcatgagggtctccatgcag

SEQ ID NO: 7547689 - DNA, 22 bp, Homo sapiens
cagcatgatgagtgcagtttgg

SEQ ID NO: 7547690 - DNA, 22 bp, Homo sapiens
gtcctgcaaagttcagcttgct

SEQ ID NO: 7547691 - DNA, 22 bp, Homo sapiens
gtcctgatagcccaacactgcc

SEQ ID NO: 7547692 - DNA, 22 bp, Homo sapiens
gtcctgcaaagttcagcttgct

SEQ ID NO: 7547693 - DNA, 19 bp, Homo sapiens
gtcctgcaactggctctcc

SEQ ID NO: 7547694 - DNA, 19 bp, Homo sapiens
gtcctgcaactggctctcc

SEQ ID NO: 7547695 - DNA, 22 bp, Homo sapiens
gtcctgagggcccaggcattct

SEQ ID NO: 7547696 - DNA, 22 bp, Homo sapiens
gtcctgagtcaagtgtgggcag

SEQ ID NO: 7547697 - DNA, 22 bp, Homo sapiens
gtcctgagtcaagtgtgggcag

SEQ ID NO: 7547698 - DNA, 18 bp, Homo sapiens
gtcctgagctctgctgta

SEQ ID NO: 7547699 - DNA, 18 bp, Homo sapiens
gtcctgagctctgctgta

SEQ ID NO: 7547700 - DNA, 22 bp, Homo sapiens
gtcctgagccctcagcacagca

SEQ ID NO: 7547701 - DNA, 22 bp, Homo sapiens
gtcctgagccctcagcacagca

SEQ ID NO: 7547702 - DNA, 22 bp, Homo sapiens
gtcctgagccctcagcacagca

SEQ ID NO: 7547703 - DNA, 22 bp, Homo sapiens
gtcctgagccctcagcacagca

SEQ ID NO: 7547704 - DNA, 22 bp, Homo sapiens
gtcctgagccctcagcacagca

SEQ ID NO: 7547705 - DNA, 22 bp, Homo sapiens
gtcctgaggcaggatgggtttc

SEQ ID NO: 7547706 - DNA, 22 bp, Homo sapiens
gtcctcttgctcattggggcag

SEQ ID NO: 7547707 - DNA, 22 bp, Homo sapiens
gtcctgaatgccttcatagtcc

SEQ ID NO: 7547708 - DNA, 22 bp, Homo sapiens
gtcctgaatgcctttaggcaga

SEQ ID NO: 7547709 - DNA, 22 bp, Homo sapiens
gtcctgaatgcctttaggcaga

SEQ ID NO: 7547710 - DNA, 22 bp, Homo sapiens
gtcctgacggctgattggcctg

SEQ ID NO: 7547711 - DNA, 22 bp, Homo sapiens
gtcctgacggctgattggcctg

SEQ ID NO: 7547712 - DNA, 22 bp, Homo sapiens
gtcctgacggctgattggcctg

SEQ ID NO: 7547713 - DNA, 22 bp, Homo sapiens
gtcctgacggctgattggcctg

SEQ ID NO: 7547714 - DNA, 22 bp, Homo sapiens
gtcctgagaccatggccttagt

SEQ ID NO: 7547715 - DNA, 22 bp, Homo sapiens
gtcctgagagaggctccttgcc

SEQ ID NO: 7547716 - DNA, 22 bp, Homo sapiens
gtcctgagagaggctccttgcc

SEQ ID NO: 7547717 - DNA, 22 bp, Homo sapiens
gtcctgagccacatactatcca

SEQ ID NO: 7547718 - DNA, 22 bp, Homo sapiens
gtcctgagatgtcacaaggttt

SEQ ID NO: 7547719 - DNA, 22 bp, Homo sapiens
gtcctgagatgtcacaaggttt

SEQ ID NO: 7547720 - DNA, 22 bp, Homo sapiens
gtcctctgtgtaggctgcagac

SEQ ID NO: 7547721 - DNA, 22 bp, Homo sapiens
gtcctctgttagaaatgtgctt

SEQ ID NO: 7547722 - DNA, 22 bp, Homo sapiens
gtcctctgttagaaatgtgctt

SEQ ID NO: 7547723 - DNA, 22 bp, Homo sapiens
gtcctctgttagaaatgtgctt

SEQ ID NO: 7547724 - DNA, 22 bp, Homo sapiens
gtcctctgtttccatctgactt

SEQ ID NO: 7547725 - DNA, 22 bp, Homo sapiens
gtcctctgtttccatctgactt

SEQ ID NO: 7547726 - DNA, 23 bp, Homo sapiens
gtcctagtgcttggtgcccaggc

SEQ ID NO: 7547727 - DNA, 20 bp, Homo sapiens
gtcctaggtttgaaggtaaa

SEQ ID NO: 7547728 - DNA, 22 bp, Homo sapiens
gtcctctgtgtaggctgcagac

SEQ ID NO: 7547729 - DNA, 22 bp, Homo sapiens
gtcctctgtgtaggctgcagac

SEQ ID NO: 7547730 - DNA, 22 bp, Homo sapiens
gtcctctgtgtaggctgcagac

SEQ ID NO: 7547731 - DNA, 22 bp, Homo sapiens
gtcctctgtgtaggctgcagac

SEQ ID NO: 7547732 - DNA, 22 bp, Homo sapiens
gtcctctgtgtaggctgcagac

SEQ ID NO: 7547733 - DNA, 22 bp, Homo sapiens
cagcagtggctgcaggcagctg

SEQ ID NO: 7547734 - DNA, 22 bp, Homo sapiens
cagcagtggctgcaggcagctg

SEQ ID NO: 7547735 - DNA, 22 bp, Homo sapiens
cagcagtggctgcaggcagctg

SEQ ID NO: 7547736 - DNA, 22 bp, Homo sapiens
cagcagtggctgcaggcagctg

SEQ ID NO: 7547737 - DNA, 22 bp, Homo sapiens
cagcagtggctgcaggcagctg

SEQ ID NO: 7547738 - DNA, 22 bp, Homo sapiens
cagcagtggctgcaggcagctg

SEQ ID NO: 7547739 - DNA, 22 bp, Homo sapiens
cagcagtggctgcaggcagctg

SEQ ID NO: 7547740 - DNA, 22 bp, Homo sapiens
cagcagtggctgcaggcagctg

SEQ ID NO: 7547741 - DNA, 22 bp, Homo sapiens
cagcagtgtacaaggtgtcaga

SEQ ID NO: 7547742 - DNA, 22 bp, Homo sapiens
cagcagtggtgtatttgaggct

SEQ ID NO: 7547743 - DNA, 22 bp, Homo sapiens
gtcctaccatgaattcactcca

SEQ ID NO: 7547744 - DNA, 22 bp, Homo sapiens
gtcctaccatgaattcactcca

SEQ ID NO: 7547745 - DNA, 22 bp, Homo sapiens
gtcctaccatgaattcactcca

SEQ ID NO: 7547746 - DNA, 22 bp, Homo sapiens
gtcctagagggtgagctaggct

SEQ ID NO: 7547747 - DNA, 22 bp, Homo sapiens
gtcctagagatccgggagggga

SEQ ID NO: 7547748 - DNA, 22 bp, Homo sapiens
gtcctagagatccgggagggga

SEQ ID NO: 7547749 - DNA, 22 bp, Homo sapiens
cagcagtgtacaaggtgtcaga

SEQ ID NO: 7547750 - DNA, 22 bp, Homo sapiens
cagcagtgtacaaggtgtcaga

SEQ ID NO: 7547751 - DNA, 22 bp, Homo sapiens
gtccggtgagggggctgcagag

SEQ ID NO: 7547752 - DNA, 22 bp, Homo sapiens
cagcagtgtacaaggtgtcaga

SEQ ID NO: 7547753 - DNA, 22 bp, Homo sapiens
gtccggtgcatttcaccaggag

SEQ ID NO: 7547754 - DNA, 22 bp, Homo sapiens
gtgcaggagcttctggcctgac

SEQ ID NO: 7547755 - DNA, 22 bp, Homo sapiens
gtgcaggagcttctggcctgac

SEQ ID NO: 7547756 - DNA, 22 bp, Homo sapiens
gtgcaggaggatgacaactgca

SEQ ID NO: 7547757 - DNA, 22 bp, Homo sapiens
gtgcaggagctcccgcagtggt

SEQ ID NO: 7547758 - DNA, 22 bp, Homo sapiens
gtgcaggagccaggggtaggaa

SEQ ID NO: 7547759 - DNA, 22 bp, Homo sapiens
gtgcaggagcttctggcctgac

SEQ ID NO: 7547760 - DNA, 22 bp, Homo sapiens
gtgcaggagcttctggcctgac

SEQ ID NO: 7547761 - DNA, 22 bp, Homo sapiens
gtgcaggagctcccgcagtggt

SEQ ID NO: 7547762 - DNA, 22 bp, Homo sapiens
gtgcaggagctcccgcagtggt

SEQ ID NO: 7547763 - DNA, 22 bp, Homo sapiens
gtgcaggaggatgacaactgca

SEQ ID NO: 7547764 - DNA, 22 bp, Homo sapiens
gtgcatattttgcacacagatg

SEQ ID NO: 7547765 - DNA, 22 bp, Homo sapiens
gtgcatcgctctaataggatga

SEQ ID NO: 7547766 - DNA, 22 bp, Homo sapiens
gtgcatctgggggcgcccgtgc

SEQ ID NO: 7547767 - DNA, 22 bp, Homo sapiens
gtgcatccagccatgagaacca

SEQ ID NO: 7547768 - DNA, 22 bp, Homo sapiens
gtgcatcgtgctgtaggctgac

SEQ ID NO: 7547769 - DNA, 22 bp, Homo sapiens
gtgcatctgaatttgaaaatct

SEQ ID NO: 7547770 - DNA, 22 bp, Homo sapiens
gtgcatctgaatttgaaaatct

SEQ ID NO: 7547771 - DNA, 22 bp, Homo sapiens
gtgcatcaggatctgaccagat

SEQ ID NO: 7547772 - DNA, 22 bp, Homo sapiens
gtgcatccactagggctctccc

SEQ ID NO: 7547773 - DNA, 21 bp, Homo sapiens
gtgcatcagatcagtggagtc

SEQ ID NO: 7547774 - DNA, 21 bp, Homo sapiens
gtgcatgcgccgctgagatgc

SEQ ID NO: 7547775 - DNA, 18 bp, Homo sapiens
gtgcatgcatgctctgcc

SEQ ID NO: 7547776 - DNA, 18 bp, Homo sapiens
gtgcatgcatgctctgcc

SEQ ID NO: 7547777 - DNA, 22 bp, Homo sapiens
gtgcatggggagggaagcgctc

SEQ ID NO: 7547778 - DNA, 22 bp, Homo sapiens
gtgcatgaagactcagaaagtc

SEQ ID NO: 7547779 - DNA, 22 bp, Homo sapiens
gtgcatctgtaagtggctttgc

SEQ ID NO: 7547780 - DNA, 22 bp, Homo sapiens
gtgcatgcacacatgtgtgagg

SEQ ID NO: 7547781 - DNA, 22 bp, Homo sapiens
gtgcatgcacacatgtgtgagg

SEQ ID NO: 7547782 - DNA, 22 bp, Homo sapiens
gtgcatgcacacatgtgtgagg

SEQ ID NO: 7547783 - DNA, 18 bp, Homo sapiens
gtgcatgcatgctctgcc

SEQ ID NO: 7547784 - DNA, 22 bp, Homo sapiens
cagccctgtgcggagggccctg

SEQ ID NO: 7547785 - DNA, 22 bp, Homo sapiens
gtgcattattcttacctttctt

SEQ ID NO: 7547786 - DNA, 22 bp, Homo sapiens
gtgcattaggctggaatgttga

SEQ ID NO: 7547787 - DNA, 22 bp, Homo sapiens
gtgcattcaggggttgacagga

SEQ ID NO: 7547788 - DNA, 22 bp, Homo sapiens
gtgcattacatgtaataaaata

SEQ ID NO: 7547789 - DNA, 22 bp, Homo sapiens
gtgcattaacaacccagaactc

SEQ ID NO: 7547790 - DNA, 22 bp, Homo sapiens
gtgcattacatgtaataaaata

SEQ ID NO: 7547791 - DNA, 22 bp, Homo sapiens
gtgcattagtttcctattgctg

SEQ ID NO: 7547792 - DNA, 22 bp, Homo sapiens
cagccctgtgctaagcaccctc

SEQ ID NO: 7547793 - DNA, 22 bp, Homo sapiens
cagccctgtgctaagcaccctc

SEQ ID NO: 7547794 - DNA, 22 bp, Homo sapiens
cagccctgtgctaagcaccctc

SEQ ID NO: 7547795 - DNA, 22 bp, Homo sapiens
cagccctgtgcggagggccctg

SEQ ID NO: 7547796 - DNA, 22 bp, Homo sapiens
cagccctgtgctaagcaccctc

SEQ ID NO: 7547797 - DNA, 22 bp, Homo sapiens
cagccctgtgctaagcaccctc

SEQ ID NO: 7547798 - DNA, 22 bp, Homo sapiens
cagccctgtgcggagggccctg

SEQ ID NO: 7547799 - DNA, 22 bp, Homo sapiens
cagccctgtgcggagggccctg

SEQ ID NO: 7547800 - DNA, 22 bp, Homo sapiens
cagccctgtgcggagggccctg

SEQ ID NO: 7547801 - DNA, 22 bp, Homo sapiens
cagccctgtgcggagggccctg

SEQ ID NO: 7547802 - DNA, 22 bp, Homo sapiens
cagccctgtgcggagggccctg

SEQ ID NO: 7547803 - DNA, 22 bp, Homo sapiens
cagccctgtgcggagggccctg

SEQ ID NO: 7547804 - DNA, 22 bp, Homo sapiens
cagccctgtgcggagggccctg

SEQ ID NO: 7547805 - DNA, 22 bp, Homo sapiens
cagccctgtgcggagggccctg

SEQ ID NO: 7547806 - DNA, 22 bp, Homo sapiens
cagccctgtgcggagggccctg

SEQ ID NO: 7547807 - DNA, 22 bp, Homo sapiens
gtgcatgttaatggtgtacaaa

SEQ ID NO: 7547808 - DNA, 22 bp, Homo sapiens
gtgcatgtgcgttgactgtcca

SEQ ID NO: 7547809 - DNA, 22 bp, Homo sapiens
gtgcatgtggtaaagaggagag

SEQ ID NO: 7547810 - DNA, 22 bp, Homo sapiens
gtgcatgtcggggtgcatgtca

SEQ ID NO: 7547811 - DNA, 22 bp, Homo sapiens
gtgcatggtaagatgcttcaca

SEQ ID NO: 7547812 - DNA, 22 bp, Homo sapiens
gtgcatgtgcatccatgtgtac

SEQ ID NO: 7547813 - DNA, 19 bp, Homo sapiens
cagcctcaatccctcgggc

SEQ ID NO: 7547814 - DNA, 22 bp, Homo sapiens
cagccggacctgagggattcct

SEQ ID NO: 7547815 - DNA, 22 bp, Homo sapiens
cagccctttccttctcagcttt

SEQ ID NO: 7547816 - DNA, 22 bp, Homo sapiens
cagcccttttttggtacaaccg

SEQ ID NO: 7547817 - DNA, 22 bp, Homo sapiens
cagcccttttttggtacaaccg

SEQ ID NO: 7547818 - DNA, 22 bp, Homo sapiens
cagcccttttttggtacaaccg

SEQ ID NO: 7547819 - DNA, 22 bp, Homo sapiens
cagccctttccttctcagcttt

SEQ ID NO: 7547820 - DNA, 22 bp, Homo sapiens
cagccctttccttctcagcttt

SEQ ID NO: 7547821 - DNA, 22 bp, Homo sapiens
cagccctttccttctcagcttt

SEQ ID NO: 7547822 - DNA, 20 bp, Homo sapiens
cagccctttatcctcctatg

SEQ ID NO: 7547823 - DNA, 20 bp, Homo sapiens
cagccctttatcctcctatg

SEQ ID NO: 7547824 - DNA, 20 bp, Homo sapiens
cagccctttatcctcctatg

SEQ ID NO: 7547825 - DNA, 22 bp, Homo sapiens
cagcccttgtttctaaagctgc

SEQ ID NO: 7547826 - DNA, 22 bp, Homo sapiens
cagcccttgtttctaaagctgc

SEQ ID NO: 7547827 - DNA, 22 bp, Homo sapiens
cagcccttgtttgggaaggatg

SEQ ID NO: 7547828 - DNA, 22 bp, Homo sapiens
cagcccttgtttgggaaggatg

SEQ ID NO: 7547829 - DNA, 20 bp, Homo sapiens
cagccctttatcctcctatg

SEQ ID NO: 7547830 - DNA, 20 bp, Homo sapiens
cagccctttatcctcctatg

SEQ ID NO: 7547831 - DNA, 20 bp, Homo sapiens
cagccctttatcctcctatg

SEQ ID NO: 7547832 - DNA, 22 bp, Homo sapiens
cagcccttgggccatcctagaa

SEQ ID NO: 7547833 - DNA, 22 bp, Homo sapiens
cagcccttgggccatcctagaa

SEQ ID NO: 7547834 - DNA, 22 bp, Homo sapiens
cagcccttggctggctccttgc

SEQ ID NO: 7547835 - DNA, 22 bp, Homo sapiens
cagcccttggctggctccttgc

SEQ ID NO: 7547836 - DNA, 22 bp, Homo sapiens
cagcccttggcccagggcacag

SEQ ID NO: 7547837 - DNA, 22 bp, Homo sapiens
cagcccttggcccagggcacag

SEQ ID NO: 7547838 - DNA, 22 bp, Homo sapiens
cagcccttggcccagggcacag

SEQ ID NO: 7547839 - DNA, 22 bp, Homo sapiens
cagcccttgcgacaccctggct

SEQ ID NO: 7547840 - DNA, 22 bp, Homo sapiens
cagccctgttgcgcttccggcg

SEQ ID NO: 7547841 - DNA, 22 bp, Homo sapiens
cagccctgttgcgcttccggcg

SEQ ID NO: 7547842 - DNA, 22 bp, Homo sapiens
cagccctgttgcgcttccggcg

SEQ ID NO: 7547843 - DNA, 22 bp, Homo sapiens
cagccctgttgcgcttccggcg

SEQ ID NO: 7547844 - DNA, 22 bp, Homo sapiens
cagccctgttgcgcttccggcg

SEQ ID NO: 7547845 - DNA, 22 bp, Homo sapiens
cagccctgttgcgcttccggcg

SEQ ID NO: 7547846 - DNA, 22 bp, Homo sapiens
cagcccttaaatagatatacag

SEQ ID NO: 7547847 - DNA, 22 bp, Homo sapiens
cagcccttaaatagatatacag

SEQ ID NO: 7547848 - DNA, 22 bp, Homo sapiens
cagcccttaagagtcatccctc

SEQ ID NO: 7547849 - DNA, 22 bp, Homo sapiens
cagcccttcagggggctgcagg

SEQ ID NO: 7547850 - DNA, 22 bp, Homo sapiens
cagcccttcagggggctgcagg

SEQ ID NO: 7547851 - DNA, 22 bp, Homo sapiens
cagcccttcagggggctgcagg

SEQ ID NO: 7547852 - DNA, 22 bp, Homo sapiens
cagcccttccaggcagaattct

SEQ ID NO: 7547853 - DNA, 22 bp, Homo sapiens
cagcccttgatgataatttatc

SEQ ID NO: 7547854 - DNA, 22 bp, Homo sapiens
cagcccttcttccaaccagctt

SEQ ID NO: 7547855 - DNA, 22 bp, Homo sapiens
cagcccttcttccaaccagctt

SEQ ID NO: 7547856 - DNA, 20 bp, Homo sapiens
cagcccttgatttacaatcc

SEQ ID NO: 7547857 - DNA, 20 bp, Homo sapiens
cagcccttgatttacaatcc

SEQ ID NO: 7547858 - DNA, 22 bp, Homo sapiens
cagcccttgcgacaccctggct

SEQ ID NO: 7547859 - DNA, 22 bp, Homo sapiens
cagcccttgcgacaccctggct

SEQ ID NO: 7547860 - DNA, 22 bp, Homo sapiens
cagcccttccaggcagaattct

SEQ ID NO: 7547861 - DNA, 23 bp, Homo sapiens
cagcccttcctgcatgtttttgt

SEQ ID NO: 7547862 - DNA, 23 bp, Homo sapiens
cagcccttcctgcatgtttttgt

SEQ ID NO: 7547863 - DNA, 22 bp, Homo sapiens
cagcccttccttctgtttatac

SEQ ID NO: 7547864 - DNA, 20 bp, Homo sapiens
cagcctccactcactcagct

SEQ ID NO: 7547865 - DNA, 20 bp, Homo sapiens
cagcctccactcactcagct

SEQ ID NO: 7547866 - DNA, 22 bp, Homo sapiens
gtgccctgaaagagttaattca

SEQ ID NO: 7547867 - DNA, 22 bp, Homo sapiens
gtgccctgacacacctggtgtg

SEQ ID NO: 7547868 - DNA, 22 bp, Homo sapiens
gtgccctgacacacctggtgtg

SEQ ID NO: 7547869 - DNA, 22 bp, Homo sapiens
gtgccctgacacacctggtgtg

SEQ ID NO: 7547870 - DNA, 20 bp, Homo sapiens
cagcctccactcactcagct

SEQ ID NO: 7547871 - DNA, 19 bp, Homo sapiens
cagcctcaatccctcgggc

SEQ ID NO: 7547872 - DNA, 19 bp, Homo sapiens
cagcctcaatccctcgggc

SEQ ID NO: 7547873 - DNA, 19 bp, Homo sapiens
cagcctcaatccctcgggc

SEQ ID NO: 7547874 - DNA, 22 bp, Homo sapiens
gtgccctgacacacctggtgtg

SEQ ID NO: 7547875 - DNA, 22 bp, Homo sapiens
gtgccctgacacacctggtgtg

SEQ ID NO: 7547876 - DNA, 22 bp, Homo sapiens
gtgccctgacacacctggtgtg

SEQ ID NO: 7547877 - DNA, 22 bp, Homo sapiens
gtgcctgggacacagcagatac

SEQ ID NO: 7547878 - DNA, 22 bp, Homo sapiens
gtgcctgggacacagcagatac

SEQ ID NO: 7547879 - DNA, 22 bp, Homo sapiens
gtgcctgggacacagcagatac

SEQ ID NO: 7547880 - DNA, 22 bp, Homo sapiens
gtgcctgggacacagcagatac

SEQ ID NO: 7547881 - DNA, 22 bp, Homo sapiens
gtgcctgggacacgagattttc

SEQ ID NO: 7547882 - DNA, 22 bp, Homo sapiens
gtgcctgggacacgagattttc

SEQ ID NO: 7547883 - DNA, 22 bp, Homo sapiens
gtgcctgggacacgagattttc

SEQ ID NO: 7547884 - DNA, 22 bp, Homo sapiens
gtgcctgggcatgagcttgttg

SEQ ID NO: 7547885 - DNA, 22 bp, Homo sapiens
gtgcctgggacttgctccggat

SEQ ID NO: 7547886 - DNA, 22 bp, Homo sapiens
gtgcctgggcatgagcttgttg

SEQ ID NO: 7547887 - DNA, 22 bp, Homo sapiens
gtgcctgggcatgagcttgttg

SEQ ID NO: 7547888 - DNA, 22 bp, Homo sapiens
gtgcctgggacttgctccggat

SEQ ID NO: 7547889 - DNA, 22 bp, Homo sapiens
gtgcctgggacttgctccggat

SEQ ID NO: 7547890 - DNA, 22 bp, Homo sapiens
gtgcctgggacttgctccggat

SEQ ID NO: 7547891 - DNA, 22 bp, Homo sapiens
gtgcctgggacttgctccggat

SEQ ID NO: 7547892 - DNA, 22 bp, Homo sapiens
gtgcctggggttgagctatgaa

SEQ ID NO: 7547893 - DNA, 22 bp, Homo sapiens
gtgcctggggttgagctatgaa

SEQ ID NO: 7547894 - DNA, 22 bp, Homo sapiens
gtgcctggggttgagctatgaa

SEQ ID NO: 7547895 - DNA, 22 bp, Homo sapiens
gtgcctggggttgagctatgaa

SEQ ID NO: 7547896 - DNA, 22 bp, Homo sapiens
gtgcctgggggtaatgtaggat

SEQ ID NO: 7547897 - DNA, 22 bp, Homo sapiens
gtgcctgggggtaatgtaggat

SEQ ID NO: 7547898 - DNA, 22 bp, Homo sapiens
gtgcctgggggtaatgtaggat

SEQ ID NO: 7547899 - DNA, 22 bp, Homo sapiens
gtgctgagatcttccctcactg

SEQ ID NO: 7547900 - DNA, 22 bp, Homo sapiens
gtgctgagatcttccctcactg

SEQ ID NO: 7547901 - DNA, 22 bp, Homo sapiens
gtgctgagagtttattatgata

SEQ ID NO: 7547902 - DNA, 22 bp, Homo sapiens
gtgctgagaattgatgtccttg

SEQ ID NO: 7547903 - DNA, 22 bp, Homo sapiens
gtgctgagaattgatgtccttg

SEQ ID NO: 7547904 - DNA, 22 bp, Homo sapiens
gtgctgagagtttattatgata

SEQ ID NO: 7547905 - DNA, 17 bp, Homo sapiens
gtgcctgttgtcctgga

SEQ ID NO: 7547906 - DNA, 17 bp, Homo sapiens
gtgcctgttgtcctgga

SEQ ID NO: 7547907 - DNA, 17 bp, Homo sapiens
gtgcctgttgtcctgga

SEQ ID NO: 7547908 - DNA, 22 bp, Homo sapiens
gtgcctgtgccaggggtgtgct

SEQ ID NO: 7547909 - DNA, 22 bp, Homo sapiens
gtgcctgtccattcccaggctc

SEQ ID NO: 7547910 - DNA, 22 bp, Homo sapiens
gtgcctgtgccaggggtgtgct

SEQ ID NO: 7547911 - DNA, 22 bp, Homo sapiens
gtgcctgtaagttgtatgggct

SEQ ID NO: 7547912 - DNA, 22 bp, Homo sapiens
gtgcctggtttggggagtgttc

SEQ ID NO: 7547913 - DNA, 22 bp, Homo sapiens
gtgcctggtatgtaggtagcgg

SEQ ID NO: 7547914 - DNA, 22 bp, Homo sapiens
gtgcctggtatgtaggtagcgg

SEQ ID NO: 7547915 - DNA, 22 bp, Homo sapiens
gtgcctggtatgtaggtagcgg

SEQ ID NO: 7547916 - DNA, 22 bp, Homo sapiens
gtgcctggtatgtaggtagcgg

SEQ ID NO: 7547917 - DNA, 22 bp, Homo sapiens
gtgcctggtatgtaggtagcgg

SEQ ID NO: 7547918 - DNA, 22 bp, Homo sapiens
gtgcctggggttgagctatgaa

SEQ ID NO: 7547919 - DNA, 22 bp, Homo sapiens
gtgcctgggggtaatgtaggat

SEQ ID NO: 7547920 - DNA, 22 bp, Homo sapiens
gtgcctggtatgtaggtagcgg

SEQ ID NO: 7547921 - DNA, 22 bp, Homo sapiens
gtgcctggtttggggaatgttc

SEQ ID NO: 7547922 - DNA, 22 bp, Homo sapiens
gtgcctggtttggggaatgttc

SEQ ID NO: 7547923 - DNA, 22 bp, Homo sapiens
gtgcctggtttggggagtgttc

SEQ ID NO: 7547924 - DNA, 22 bp, Homo sapiens
gtgcctggtttggggagtgttc

SEQ ID NO: 7547925 - DNA, 22 bp, Homo sapiens
gtgcctggtttggggaatgttc

SEQ ID NO: 7547926 - DNA, 22 bp, Homo sapiens
gtgcctggtttggggagtgttc

SEQ ID NO: 7547927 - DNA, 22 bp, Homo sapiens
gtgctgagcacaaggcccagag

SEQ ID NO: 7547928 - DNA, 22 bp, Homo sapiens
gtgctgagcacaaggcccagag

SEQ ID NO: 7547929 - DNA, 22 bp, Homo sapiens
gtgctgagcacaaggcccagag

SEQ ID NO: 7547930 - DNA, 22 bp, Homo sapiens
gtgctgagcacaccttggagca

SEQ ID NO: 7547931 - DNA, 22 bp, Homo sapiens
gtgctgagcacaccttggagca

SEQ ID NO: 7547932 - DNA, 22 bp, Homo sapiens
gtgctgagcacaccttggagca

SEQ ID NO: 7547933 - DNA, 22 bp, Homo sapiens
gtgctgagcacaccttggagca

SEQ ID NO: 7547934 - DNA, 22 bp, Homo sapiens
gtgctgagcacagctgcccagg

SEQ ID NO: 7547935 - DNA, 22 bp, Homo sapiens
gtgctgagcacagctgcccagg

SEQ ID NO: 7547936 - DNA, 22 bp, Homo sapiens
gtgctgagcacagctgcccagg

SEQ ID NO: 7547937 - DNA, 22 bp, Homo sapiens
gtgctgagcatcatgaggcact

SEQ ID NO: 7547938 - DNA, 19 bp, Homo sapiens
gtgctgagatgtggtacta

SEQ ID NO: 7547939 - DNA, 22 bp, Homo sapiens
gtgctgagattacaggtgtgag

SEQ ID NO: 7547940 - DNA, 19 bp, Homo sapiens
gtgctgagatgtggtacta

SEQ ID NO: 7547941 - DNA, 22 bp, Homo sapiens
gtgctgagattacaggtgtgag

SEQ ID NO: 7547942 - DNA, 22 bp, Homo sapiens
gtgctgagattacaggtgtgag

SEQ ID NO: 7547943 - DNA, 22 bp, Homo sapiens
gtgctgagattggagtgagcag

SEQ ID NO: 7547944 - DNA, 22 bp, Homo sapiens
gtgctgagattacaggtgtgag

SEQ ID NO: 7547945 - DNA, 22 bp, Homo sapiens
gtgctgaggatacagctgtgaa

SEQ ID NO: 7547946 - DNA, 21 bp, Homo sapiens
gtgctgaggatacagtagtaa

SEQ ID NO: 7547947 - DNA, 22 bp, Homo sapiens
gtgctgaggatataaaactcag

SEQ ID NO: 7547948 - DNA, 22 bp, Homo sapiens
gtgctgaggccaatgtcagggt

SEQ ID NO: 7547949 - DNA, 22 bp, Homo sapiens
gtgctgaggccaatgtcagggt

SEQ ID NO: 7547950 - DNA, 22 bp, Homo sapiens
gtgctgaggagagggggtggtc

SEQ ID NO: 7547951 - DNA, 22 bp, Homo sapiens
gtgctgaggagagggggtggtc

SEQ ID NO: 7547952 - DNA, 22 bp, Homo sapiens
gtgctgaggagagggggtggtc

SEQ ID NO: 7547953 - DNA, 22 bp, Homo sapiens
gtgctgaggatacagctgtgaa

SEQ ID NO: 7547954 - DNA, 22 bp, Homo sapiens
gtgctgagctgcagatgcgctc

SEQ ID NO: 7547955 - DNA, 22 bp, Homo sapiens
gtgctgaggaaggaagacttat

SEQ ID NO: 7547956 - DNA, 22 bp, Homo sapiens
gtgctgaggagagggggtggtc

SEQ ID NO: 7547957 - DNA, 22 bp, Homo sapiens
gtgctgaggagagggggtggtc

SEQ ID NO: 7547958 - DNA, 22 bp, Homo sapiens
gtgctgagctgcagatgcgctc

SEQ ID NO: 7547959 - DNA, 22 bp, Homo sapiens
gtgctgagctgcagatgcgctc

SEQ ID NO: 7547960 - DNA, 22 bp, Homo sapiens
gtgctgagcatcatgaggcact

SEQ ID NO: 7547961 - DNA, 22 bp, Homo sapiens
gtgctgagcatcatgaggcact

SEQ ID NO: 7547962 - DNA, 22 bp, Homo sapiens
gtgctgagcatcatgaggcact

SEQ ID NO: 7547963 - DNA, 22 bp, Homo sapiens
cagctcccagtggcagctcctt

SEQ ID NO: 7547964 - DNA, 22 bp, Homo sapiens
cagctcccagtggcagctcctt

SEQ ID NO: 7547965 - DNA, 22 bp, Homo sapiens
cagctcccagagtgaccagcag

SEQ ID NO: 7547966 - DNA, 22 bp, Homo sapiens
cagctcccagaactgaccatgt

SEQ ID NO: 7547967 - DNA, 22 bp, Homo sapiens
cagctcccagaactgaccatgt

SEQ ID NO: 7547968 - DNA, 22 bp, Homo sapiens
cagctcccagagtgaccagcag

SEQ ID NO: 7547969 - DNA, 22 bp, Homo sapiens
cagctcccagagtgaccagcag

SEQ ID NO: 7547970 - DNA, 22 bp, Homo sapiens
cagctcccagagtgaccagcag

SEQ ID NO: 7547971 - DNA, 22 bp, Homo sapiens
cagctcccagtggcagctcctt

SEQ ID NO: 7547972 - DNA, 22 bp, Homo sapiens
cagctcccagtggcagctcctt

SEQ ID NO: 7547973 - DNA, 22 bp, Homo sapiens
cagctcccagtggcagctcctt

SEQ ID NO: 7547974 - DNA, 22 bp, Homo sapiens
cagctcccagtggcagctcctt

SEQ ID NO: 7547975 - DNA, 22 bp, Homo sapiens
cagctcccagtggcagctcctt

SEQ ID NO: 7547976 - DNA, 22 bp, Homo sapiens
cagctccccatggttcctgaag

SEQ ID NO: 7547977 - DNA, 22 bp, Homo sapiens
cagctccagccgactgtaagaa

SEQ ID NO: 7547978 - DNA, 22 bp, Homo sapiens
cagctccagcccaggcagctcc

SEQ ID NO: 7547979 - DNA, 22 bp, Homo sapiens
cagctccagcccaggcagctcc

SEQ ID NO: 7547980 - DNA, 22 bp, Homo sapiens
cagctccagccgactgtaagaa

SEQ ID NO: 7547981 - DNA, 22 bp, Homo sapiens
cagctccagccgactgtaagaa

SEQ ID NO: 7547982 - DNA, 22 bp, Homo sapiens
cagctccagcctgacaccaaga

SEQ ID NO: 7547983 - DNA, 22 bp, Homo sapiens
cagctccagcctgacaccaaga

SEQ ID NO: 7547984 - DNA, 22 bp, Homo sapiens
cagctccagctctgggcgcctc

SEQ ID NO: 7547985 - DNA, 22 bp, Homo sapiens
cagctccagctctgggcgcctc

SEQ ID NO: 7547986 - DNA, 22 bp, Homo sapiens
cagctccagctctgggcgcctc

SEQ ID NO: 7547987 - DNA, 22 bp, Homo sapiens
cagctccagctctgggcgcctc

SEQ ID NO: 7547988 - DNA, 22 bp, Homo sapiens
cagctccagctctgggcgcctc

SEQ ID NO: 7547989 - DNA, 23 bp, Homo sapiens
cagctccagtgcactcaggtagc

SEQ ID NO: 7547990 - DNA, 22 bp, Homo sapiens
cagctccagctctgggcgcctc

SEQ ID NO: 7547991 - DNA, 23 bp, Homo sapiens
cagctccagtgcactcaggtagc

SEQ ID NO: 7547992 - DNA, 23 bp, Homo sapiens
cagctccagtgcactcaggtagc

SEQ ID NO: 7547993 - DNA, 23 bp, Homo sapiens
cagctccagtgcactcaggtagc

SEQ ID NO: 7547994 - DNA, 23 bp, Homo sapiens
cagctccagtgcactcaggtagc

SEQ ID NO: 7547995 - DNA, 23 bp, Homo sapiens
cagctccagtgcactcaggtagc

SEQ ID NO: 7547996 - DNA, 22 bp, Homo sapiens
cagctccatcttgcttatacca

SEQ ID NO: 7547997 - DNA, 22 bp, Homo sapiens
cagctccagccaccggggggtg

SEQ ID NO: 7547998 - DNA, 22 bp, Homo sapiens
cagctccagccaccggggggtg

SEQ ID NO: 7547999 - DNA, 22 bp, Homo sapiens
cagctccagccaccggggggtg

SEQ ID NO: 7548000 - DNA, 22 bp, Homo sapiens
cagctccagcccaggcagctcc

SEQ ID NO: 7548001 - DNA, 22 bp, Homo sapiens
cagctccagcccaggcagctcc

SEQ ID NO: 7548002 - DNA, 22 bp, Homo sapiens
cagctccagccaccggggggtg

SEQ ID NO: 7548003 - DNA, 22 bp, Homo sapiens
cagctccagcccaggcagctcc

SEQ ID NO: 7548004 - DNA, 22 bp, Homo sapiens
cagctccagcccaggcagctcc

SEQ ID NO: 7548005 - DNA, 22 bp, Homo sapiens
cagctccagcccaggcagctcc

SEQ ID NO: 7548006 - DNA, 22 bp, Homo sapiens
cagctccagcccaggcagctcc

SEQ ID NO: 7548007 - DNA, 21 bp, Homo sapiens
cagctccactaaagcagctgt

SEQ ID NO: 7548008 - DNA, 21 bp, Homo sapiens
cagctccactaaagcagctgt

SEQ ID NO: 7548009 - DNA, 22 bp, Homo sapiens
cagctccacttgagtggggcct

SEQ ID NO: 7548010 - DNA, 22 bp, Homo sapiens
cagctccacttgagtggggcct

SEQ ID NO: 7548011 - DNA, 22 bp, Homo sapiens
cagctccacttgagtggggcct

SEQ ID NO: 7548012 - DNA, 22 bp, Homo sapiens
cagctccacttgagtggggcct

SEQ ID NO: 7548013 - DNA, 21 bp, Homo sapiens
cagctccactaaagcagctgt

SEQ ID NO: 7548014 - DNA, 21 bp, Homo sapiens
cagctccactaaagcagctgt

SEQ ID NO: 7548015 - DNA, 21 bp, Homo sapiens
cagctccactaaagcagctgt

SEQ ID NO: 7548016 - DNA, 21 bp, Homo sapiens
cagctccactaaagcagctgt

SEQ ID NO: 7548017 - DNA, 22 bp, Homo sapiens
cagctcaggaaggaaggccggc

SEQ ID NO: 7548018 - DNA, 22 bp, Homo sapiens
cagctcaggaaggaaggccggc

SEQ ID NO: 7548019 - DNA, 22 bp, Homo sapiens
cagctcagcttcctgggtgtgt

SEQ ID NO: 7548020 - DNA, 22 bp, Homo sapiens
cagctcaggaaggaaggccggc

SEQ ID NO: 7548021 - DNA, 22 bp, Homo sapiens
cagctcaggaaggaaggccggc

SEQ ID NO: 7548022 - DNA, 22 bp, Homo sapiens
cagctccaaagccccactgtcc

SEQ ID NO: 7548023 - DNA, 22 bp, Homo sapiens
cagctcagcttcctgggtgtgt

SEQ ID NO: 7548024 - DNA, 22 bp, Homo sapiens
cagctcagcttcctgggtgtgt

SEQ ID NO: 7548025 - DNA, 20 bp, Homo sapiens
gtgctgagggctgggcaatg

SEQ ID NO: 7548026 - DNA, 22 bp, Homo sapiens
gtgctgaggtgggtgggcagcc

SEQ ID NO: 7548027 - DNA, 20 bp, Homo sapiens
gtgctgagggctgggcaatg

SEQ ID NO: 7548028 - DNA, 22 bp, Homo sapiens
gtgctgaggccaatgtcagggt

SEQ ID NO: 7548029 - DNA, 22 bp, Homo sapiens
gtgctgaggtgggtgggcagcc

SEQ ID NO: 7548030 - DNA, 22 bp, Homo sapiens
gtgctgaggtgggtgggcagcc

SEQ ID NO: 7548031 - DNA, 22 bp, Homo sapiens
gtgctgaggtacacaaattcta

SEQ ID NO: 7548032 - DNA, 22 bp, Homo sapiens
gtgctgaggtgggtgggcagcc

SEQ ID NO: 7548033 - DNA, 22 bp, Homo sapiens
cagctctgaggaacactccttt

SEQ ID NO: 7548034 - DNA, 22 bp, Homo sapiens
cagctctgaggaacactccttt

SEQ ID NO: 7548035 - DNA, 22 bp, Homo sapiens
cagctctgaggaacactccttt

SEQ ID NO: 7548036 - DNA, 22 bp, Homo sapiens
cagctctgaggaacactccttt

SEQ ID NO: 7548037 - DNA, 17 bp, Homo sapiens
cagctctgcagacttcc

SEQ ID NO: 7548038 - DNA, 17 bp, Homo sapiens
cagctctgcagacttcc

SEQ ID NO: 7548039 - DNA, 17 bp, Homo sapiens
cagctctgcagacttcc

SEQ ID NO: 7548040 - DNA, 22 bp, Homo sapiens
cagctctgatgaaatgtaccag

SEQ ID NO: 7548041 - DNA, 22 bp, Homo sapiens
cagctctgatgaaatgtaccag

SEQ ID NO: 7548042 - DNA, 22 bp, Homo sapiens
cagctctgatgaaatgtaccag

SEQ ID NO: 7548043 - DNA, 21 bp, Homo sapiens
cagctctgagatttctactag

SEQ ID NO: 7548044 - DNA, 21 bp, Homo sapiens
cagctctgagatttctactag

SEQ ID NO: 7548045 - DNA, 21 bp, Homo sapiens
cagctctgagatttctactag

SEQ ID NO: 7548046 - DNA, 21 bp, Homo sapiens
cagctctgagatttctactag

SEQ ID NO: 7548047 - DNA, 22 bp, Homo sapiens
cagctctgaggaacactccttt

SEQ ID NO: 7548048 - DNA, 22 bp, Homo sapiens
cagctctgaggaacactccttt

SEQ ID NO: 7548049 - DNA, 22 bp, Homo sapiens
cagctctgaggaacactccttt

SEQ ID NO: 7548050 - DNA, 22 bp, Homo sapiens
cagctctgaggaacactccttt

SEQ ID NO: 7548051 - DNA, 22 bp, Homo sapiens
cagctctgaggaacactccttt

SEQ ID NO: 7548052 - DNA, 22 bp, Homo sapiens
cagctcctgcagctgctgccgt

SEQ ID NO: 7548053 - DNA, 22 bp, Homo sapiens
cagctcctgaggactgctggga

SEQ ID NO: 7548054 - DNA, 22 bp, Homo sapiens
cagctcctgcagctgctgccgt

SEQ ID NO: 7548055 - DNA, 22 bp, Homo sapiens
cagctcctgcagctgctgccgt

SEQ ID NO: 7548056 - DNA, 22 bp, Homo sapiens
cagctcctctgttagccctggg

SEQ ID NO: 7548057 - DNA, 22 bp, Homo sapiens
cagctcctgaggactgctggga

SEQ ID NO: 7548058 - DNA, 22 bp, Homo sapiens
cagctcctctgttagccctggg

SEQ ID NO: 7548059 - DNA, 22 bp, Homo sapiens
cagctcctgaggactgctggga

SEQ ID NO: 7548060 - DNA, 22 bp, Homo sapiens
cagctcctgaggactgctggga

SEQ ID NO: 7548061 - DNA, 22 bp, Homo sapiens
cagctcctgaggactgctggga

SEQ ID NO: 7548062 - DNA, 22 bp, Homo sapiens
cagctcctgcagctggctccca

SEQ ID NO: 7548063 - DNA, 22 bp, Homo sapiens
cagctcctgcagctgctgccgt

SEQ ID NO: 7548064 - DNA, 22 bp, Homo sapiens
cagctcctgcagctgctgccgt

SEQ ID NO: 7548065 - DNA, 22 bp, Homo sapiens
cagctctgagactgaggctatg

SEQ ID NO: 7548066 - DNA, 22 bp, Homo sapiens
cagctcctgcagctggctccca

SEQ ID NO: 7548067 - DNA, 22 bp, Homo sapiens
cagctcctgcagctggctccca

SEQ ID NO: 7548068 - DNA, 22 bp, Homo sapiens
cagctcctgcagctggctccca

SEQ ID NO: 7548069 - DNA, 22 bp, Homo sapiens
cagctctgagactgaggctatg

SEQ ID NO: 7548070 - DNA, 22 bp, Homo sapiens
cagctcctctggccagccctgc

SEQ ID NO: 7548071 - DNA, 22 bp, Homo sapiens
cagctcctctggccagccctgc

SEQ ID NO: 7548072 - DNA, 22 bp, Homo sapiens
cagctcctctggccagccctgc

SEQ ID NO: 7548073 - DNA, 22 bp, Homo sapiens
cagctcctctgttagccctggg

SEQ ID NO: 7548074 - DNA, 22 bp, Homo sapiens
cagctcctctgttagccctggg

SEQ ID NO: 7548075 - DNA, 22 bp, Homo sapiens
cagctcctctgttagccctggg

SEQ ID NO: 7548076 - DNA, 22 bp, Homo sapiens
cagctcctctgttagccctggg

SEQ ID NO: 7548077 - DNA, 22 bp, Homo sapiens
cagctcctctgttagccctggg

SEQ ID NO: 7548078 - DNA, 22 bp, Homo sapiens
cagctcctctggccagccctgc

SEQ ID NO: 7548079 - DNA, 22 bp, Homo sapiens
cagctcctctggccagccctgc

SEQ ID NO: 7548080 - DNA, 22 bp, Homo sapiens
cagctcctcagccctgccttgg

SEQ ID NO: 7548081 - DNA, 22 bp, Homo sapiens
cagctcctcagccctgccttgg

SEQ ID NO: 7548082 - DNA, 22 bp, Homo sapiens
cagctcctcagccctgccttgg

SEQ ID NO: 7548083 - DNA, 22 bp, Homo sapiens
cagctcctcagccctgccttgg

SEQ ID NO: 7548084 - DNA, 22 bp, Homo sapiens
cagctcctcagccctgccttgg

SEQ ID NO: 7548085 - DNA, 22 bp, Homo sapiens
cagctcctcacgagtcttgaaa

SEQ ID NO: 7548086 - DNA, 22 bp, Homo sapiens
cagctcctcacgagtcttgaaa

SEQ ID NO: 7548087 - DNA, 22 bp, Homo sapiens
cagctcctcacgagtcttgaaa

SEQ ID NO: 7548088 - DNA, 22 bp, Homo sapiens
cagctccctatggtgaggcgac

SEQ ID NO: 7548089 - DNA, 22 bp, Homo sapiens
cagctcccgccatcgggaggca

SEQ ID NO: 7548090 - DNA, 22 bp, Homo sapiens
cagctcccgccatcgggaggca

SEQ ID NO: 7548091 - DNA, 22 bp, Homo sapiens
cagctcccctctgtggggcagt

SEQ ID NO: 7548092 - DNA, 22 bp, Homo sapiens
cagctcccgccatcgggaggca

SEQ ID NO: 7548093 - DNA, 22 bp, Homo sapiens
cagctcccctctgtggggcagt

SEQ ID NO: 7548094 - DNA, 22 bp, Homo sapiens
cagctcccctctgtggggcagt

SEQ ID NO: 7548095 - DNA, 22 bp, Homo sapiens
cagctcccctctgtggggcagt

SEQ ID NO: 7548096 - DNA, 22 bp, Homo sapiens
cagctcctatgagtatgattcc

SEQ ID NO: 7548097 - DNA, 22 bp, Homo sapiens
cagctcctatgagtatgattcc

SEQ ID NO: 7548098 - DNA, 22 bp, Homo sapiens
cagctcctagatcggcgaagtg

SEQ ID NO: 7548099 - DNA, 22 bp, Homo sapiens
cagctcctattagacactgaat

SEQ ID NO: 7548100 - DNA, 22 bp, Homo sapiens
cagctcctattagacactgaat

SEQ ID NO: 7548101 - DNA, 22 bp, Homo sapiens
cagctcctagatcggcgaagtg

SEQ ID NO: 7548102 - DNA, 22 bp, Homo sapiens
cagctcctagatcggcgaagtg

SEQ ID NO: 7548103 - DNA, 22 bp, Homo sapiens
cagctcctagatcggcgaagtg

SEQ ID NO: 7548104 - DNA, 22 bp, Homo sapiens
cagctcctagatcggcgaagtg

SEQ ID NO: 7548105 - DNA, 22 bp, Homo sapiens
cagctccctatggtgaggcgac

SEQ ID NO: 7548106 - DNA, 17 bp, Homo sapiens
cagctctgcagacttcc

SEQ ID NO: 7548107 - DNA, 22 bp, Homo sapiens
gctggttagaaaacagagctca

SEQ ID NO: 7548108 - DNA, 22 bp, Homo sapiens
gctggttagaaaacagagctca

SEQ ID NO: 7548109 - DNA, 22 bp, Homo sapiens
gctggttaggtgagggtgcgcc

SEQ ID NO: 7548110 - DNA, 22 bp, Homo sapiens
gctggtttccttatctataaag

SEQ ID NO: 7548111 - DNA, 22 bp, Homo sapiens
gctggttcacctggctcctccc

SEQ ID NO: 7548112 - DNA, 22 bp, Homo sapiens
gctgtaaagaacattaggaatc

SEQ ID NO: 7548113 - DNA, 22 bp, Homo sapiens
gctggtgtctaacctggctctt

SEQ ID NO: 7548114 - DNA, 22 bp, Homo sapiens
gctggtgtgtgaacctagggac

SEQ ID NO: 7548115 - DNA, 22 bp, Homo sapiens
gctggtgtctaacctggctctt

SEQ ID NO: 7548116 - DNA, 22 bp, Homo sapiens
gctggtggtgggccagttctgt

SEQ ID NO: 7548117 - DNA, 22 bp, Homo sapiens
gctggtggtgggccagttctgt

SEQ ID NO: 7548118 - DNA, 22 bp, Homo sapiens
gctggtggtgggccagttctgt

SEQ ID NO: 7548119 - DNA, 22 bp, Homo sapiens
gctggtggtgggccagttctgt

SEQ ID NO: 7548120 - DNA, 22 bp, Homo sapiens
gctggtggttaccgtgctaatg

SEQ ID NO: 7548121 - DNA, 22 bp, Homo sapiens
gctggtggttaccgtgctaatg

SEQ ID NO: 7548122 - DNA, 22 bp, Homo sapiens
gctggtggttaccgtgctaatg

SEQ ID NO: 7548123 - DNA, 22 bp, Homo sapiens
gctggtggttaccgtgctaatg

SEQ ID NO: 7548124 - DNA, 22 bp, Homo sapiens
caatctctggtgcttctgagag

SEQ ID NO: 7548125 - DNA, 22 bp, Homo sapiens
caatctgagttgggaatgtatt

SEQ ID NO: 7548126 - DNA, 22 bp, Homo sapiens
caatgattgctatttacataaa

SEQ ID NO: 7548127 - DNA, 22 bp, Homo sapiens
caatgcaagcaagatggtcaca

SEQ ID NO: 7548128 - DNA, 22 bp, Homo sapiens
caatgcaagcaagatggtcaca

SEQ ID NO: 7548129 - DNA, 22 bp, Homo sapiens
caatgcaagcaagatggtcaca

SEQ ID NO: 7548130 - DNA, 22 bp, Homo sapiens
caatctataaatatcagtttcc

SEQ ID NO: 7548131 - DNA, 22 bp, Homo sapiens
caatctataaatatcagtttcc

SEQ ID NO: 7548132 - DNA, 22 bp, Homo sapiens
caatctataaatatcagtttcc

SEQ ID NO: 7548133 - DNA, 22 bp, Homo sapiens
caatcccatcaccatctgctct

SEQ ID NO: 7548134 - DNA, 22 bp, Homo sapiens
caatctatcctctgattttgta

SEQ ID NO: 7548135 - DNA, 22 bp, Homo sapiens
caatctatcctctgattttgta

SEQ ID NO: 7548136 - DNA, 22 bp, Homo sapiens
caatctatagagctttagacta

SEQ ID NO: 7548137 - DNA, 22 bp, Homo sapiens
caatctatagagctttagacta

SEQ ID NO: 7548138 - DNA, 22 bp, Homo sapiens
caatgcatacttcgaaatttca

SEQ ID NO: 7548139 - DNA, 22 bp, Homo sapiens
caatgcatacttcgaaatttca

SEQ ID NO: 7548140 - DNA, 22 bp, Homo sapiens
caatgcacgctcagatttgacc

SEQ ID NO: 7548141 - DNA, 22 bp, Homo sapiens
caatgcacatggacatcaggct

SEQ ID NO: 7548142 - DNA, 22 bp, Homo sapiens
caatgcaatgcaatgcaatgca

SEQ ID NO: 7548143 - DNA, 22 bp, Homo sapiens
caatgcaatgcaatgcaatgca

SEQ ID NO: 7548144 - DNA, 22 bp, Homo sapiens
caatgcaatgcaatgcaatgca

SEQ ID NO: 7548145 - DNA, 22 bp, Homo sapiens
caatgcaatgcaatgcaatgca

SEQ ID NO: 7548146 - DNA, 20 bp, Homo sapiens
caatgcacacagctgcttct

SEQ ID NO: 7548147 - DNA, 22 bp, Homo sapiens
gctggtggcagagctccgcggc

SEQ ID NO: 7548148 - DNA, 20 bp, Homo sapiens
gctggtgggggcttgacatg

SEQ ID NO: 7548149 - DNA, 22 bp, Homo sapiens
gctggtggcagagctccgcggc

SEQ ID NO: 7548150 - DNA, 22 bp, Homo sapiens
gctggtggcagagacatcaggt

SEQ ID NO: 7548151 - DNA, 22 bp, Homo sapiens
gctggtggcagagctccgcggc

SEQ ID NO: 7548152 - DNA, 20 bp, Homo sapiens
gctggtgggggcttgacatg

SEQ ID NO: 7548153 - DNA, 20 bp, Homo sapiens
gctggtgggggcttgacatg

SEQ ID NO: 7548154 - DNA, 22 bp, Homo sapiens
gctggtggtaaggaggaaaaag

SEQ ID NO: 7548155 - DNA, 22 bp, Homo sapiens
gctggtggtaaggaggaaaaag

SEQ ID NO: 7548156 - DNA, 22 bp, Homo sapiens
gctggtggcagagacatcaggt

SEQ ID NO: 7548157 - DNA, 22 bp, Homo sapiens
gctggtggcagagacatcaggt

SEQ ID NO: 7548158 - DNA, 22 bp, Homo sapiens
gctggtgctctgggccctgagg

SEQ ID NO: 7548159 - DNA, 22 bp, Homo sapiens
gctggtgctctgggccctgagg

SEQ ID NO: 7548160 - DNA, 22 bp, Homo sapiens
gctggtggcagagacatcaggt

SEQ ID NO: 7548161 - DNA, 22 bp, Homo sapiens
gctggtggcagagacatcaggt

SEQ ID NO: 7548162 - DNA, 22 bp, Homo sapiens
gctggtgcattagctgcagttc

SEQ ID NO: 7548163 - DNA, 22 bp, Homo sapiens
gctggtgcattagctgcagttc

SEQ ID NO: 7548164 - DNA, 22 bp, Homo sapiens
gctggtcctcaagggcacagcc

SEQ ID NO: 7548165 - DNA, 22 bp, Homo sapiens
gctggtcctcaagggcacagcc

SEQ ID NO: 7548166 - DNA, 22 bp, Homo sapiens
caagtttaaggcactgataagt

SEQ ID NO: 7548167 - DNA, 22 bp, Homo sapiens
caagtttaaggcactgataagt

SEQ ID NO: 7548168 - DNA, 22 bp, Homo sapiens
caagtttaaggcactgataagt

SEQ ID NO: 7548169 - DNA, 22 bp, Homo sapiens
gctggtctagggatgggcgtat

SEQ ID NO: 7548170 - DNA, 22 bp, Homo sapiens
gctggtctccgccgctccctga

SEQ ID NO: 7548171 - DNA, 22 bp, Homo sapiens
gctggtcctcaagggcacagcc

SEQ ID NO: 7548172 - DNA, 22 bp, Homo sapiens
gctggtcctggggttgcagcat

SEQ ID NO: 7548173 - DNA, 17 bp, Homo sapiens
gctggtccttggtaact

SEQ ID NO: 7548174 - DNA, 22 bp, Homo sapiens
gctggtgcattagctgcagttc

SEQ ID NO: 7548175 - DNA, 22 bp, Homo sapiens
gctggtgattgcctcaggaggc

SEQ ID NO: 7548176 - DNA, 22 bp, Homo sapiens
gctggtctccgccgctccctga

SEQ ID NO: 7548177 - DNA, 22 bp, Homo sapiens
gctggtctccgccgctccctga

SEQ ID NO: 7548178 - DNA, 22 bp, Homo sapiens
caagtgtgtaattactgggagc

SEQ ID NO: 7548179 - DNA, 19 bp, Homo sapiens
caagttaaaatgaggtcat

SEQ ID NO: 7548180 - DNA, 20 bp, Homo sapiens
caagtgttattgtgcattta

SEQ ID NO: 7548181 - DNA, 22 bp, Homo sapiens
caagttaaatttgcatttcaga

SEQ ID NO: 7548182 - DNA, 22 bp, Homo sapiens
caagttaaatttgcatttcaga

SEQ ID NO: 7548183 - DNA, 22 bp, Homo sapiens
caagttaatatatagaattttg

SEQ ID NO: 7548184 - DNA, 22 bp, Homo sapiens
caagttaatatatagaattttg

SEQ ID NO: 7548185 - DNA, 22 bp, Homo sapiens
caagttaattggtattttgatc

SEQ ID NO: 7548186 - DNA, 22 bp, Homo sapiens
caagttaattggtattttgatc

SEQ ID NO: 7548187 - DNA, 22 bp, Homo sapiens
caagtgtcttcaaaggctaaaa

SEQ ID NO: 7548188 - DNA, 22 bp, Homo sapiens
caagtgtcttcaaaggctaaaa

SEQ ID NO: 7548189 - DNA, 22 bp, Homo sapiens
caagtgtgactattttttcata

SEQ ID NO: 7548190 - DNA, 22 bp, Homo sapiens
caagtgtgtaattactgggagc

SEQ ID NO: 7548191 - DNA, 21 bp, Homo sapiens
caagtgtggatgtggaaggta

SEQ ID NO: 7548192 - DNA, 22 bp, Homo sapiens
caagtgtccatgatagtcttag

SEQ ID NO: 7548193 - DNA, 22 bp, Homo sapiens
caagtgtctatatcagtgcttg

SEQ ID NO: 7548194 - DNA, 22 bp, Homo sapiens
caagtgtcttcaaaggctaaaa

SEQ ID NO: 7548195 - DNA, 20 bp, Homo sapiens
gctgggctaccactggccct

SEQ ID NO: 7548196 - DNA, 22 bp, Homo sapiens
gctgggctcaccaggccactag

SEQ ID NO: 7548197 - DNA, 22 bp, Homo sapiens
gctgggctcaccaggccactag

SEQ ID NO: 7548198 - DNA, 22 bp, Homo sapiens
gctgggctcaccaggccactag

SEQ ID NO: 7548199 - DNA, 22 bp, Homo sapiens
gctgggctcaccaggccactag

SEQ ID NO: 7548200 - DNA, 22 bp, Homo sapiens
caagtcaatgattataagagtc

SEQ ID NO: 7548201 - DNA, 22 bp, Homo sapiens
caagtcacttatgtgcagatat

SEQ ID NO: 7548202 - DNA, 22 bp, Homo sapiens
caagtcacatggccaactgatg

SEQ ID NO: 7548203 - DNA, 22 bp, Homo sapiens
caagtcacatggccaactgatg

SEQ ID NO: 7548204 - DNA, 22 bp, Homo sapiens
caagtcacatggccaactgatg

SEQ ID NO: 7548205 - DNA, 22 bp, Homo sapiens
caagtcaatgattataagagtc

SEQ ID NO: 7548206 - DNA, 22 bp, Homo sapiens
caagtgtccatgatagtcttag

SEQ ID NO: 7548207 - DNA, 22 bp, Homo sapiens
caagtggtttatgggagttcca

SEQ ID NO: 7548208 - DNA, 22 bp, Homo sapiens
caagtggtttatgggagttcca

SEQ ID NO: 7548209 - DNA, 22 bp, Homo sapiens
caagtggggcagattctcttcc

SEQ ID NO: 7548210 - DNA, 22 bp, Homo sapiens
caagtgcatggtggcaaagaat

SEQ ID NO: 7548211 - DNA, 22 bp, Homo sapiens
caagtgcatggtggcaaagaat

SEQ ID NO: 7548212 - DNA, 23 bp, Homo sapiens
caagtgcaccagatatacaggtc

SEQ ID NO: 7548213 - DNA, 22 bp, Homo sapiens
caagtgatcctcccatcttggc

SEQ ID NO: 7548214 - DNA, 22 bp, Homo sapiens
caagtgcacacacatcctgtgc

SEQ ID NO: 7548215 - DNA, 22 bp, Homo sapiens
caagttctactgggacatcagt

SEQ ID NO: 7548216 - DNA, 21 bp, Homo sapiens
caagttctgctgaatcttctt

SEQ ID NO: 7548217 - DNA, 19 bp, Homo sapiens
caagttctggagattaggg

SEQ ID NO: 7548218 - DNA, 21 bp, Homo sapiens
caagttctgctgaatcttctt

SEQ ID NO: 7548219 - DNA, 22 bp, Homo sapiens
caagttctggacaggggaatat

SEQ ID NO: 7548220 - DNA, 21 bp, Homo sapiens
caagttctgctgaatcttctt

SEQ ID NO: 7548221 - DNA, 22 bp, Homo sapiens
caagttcattgtagcattattg

SEQ ID NO: 7548222 - DNA, 22 bp, Homo sapiens
caagttcattgtagcattattg

SEQ ID NO: 7548223 - DNA, 22 bp, Homo sapiens
caagttcattgtagcattattg

SEQ ID NO: 7548224 - DNA, 22 bp, Homo sapiens
caagttcattgtagcattattg

SEQ ID NO: 7548225 - DNA, 22 bp, Homo sapiens
caagttcacttgtctacaaggg

SEQ ID NO: 7548226 - DNA, 22 bp, Homo sapiens
caagttcattgtagcattattg

SEQ ID NO: 7548227 - DNA, 22 bp, Homo sapiens
caagttcacttgtctacaaggg

SEQ ID NO: 7548228 - DNA, 22 bp, Homo sapiens
caagttcacttgtctacaaggg

SEQ ID NO: 7548229 - DNA, 21 bp, Homo sapiens
caagttctgtgtcttactcct

SEQ ID NO: 7548230 - DNA, 22 bp, Homo sapiens
caagttggtctcctgtagcaac

SEQ ID NO: 7548231 - DNA, 21 bp, Homo sapiens
caagttctgtgtcttactcct

SEQ ID NO: 7548232 - DNA, 19 bp, Homo sapiens
caagttctggagattaggg

SEQ ID NO: 7548233 - DNA, 22 bp, Homo sapiens
caagttgtacagattgtattag

SEQ ID NO: 7548234 - DNA, 22 bp, Homo sapiens
caagttgtgaatgacagacttc

SEQ ID NO: 7548235 - DNA, 22 bp, Homo sapiens
caagtttaaagtgaggtttgaa

SEQ ID NO: 7548236 - DNA, 22 bp, Homo sapiens
caagttgtttaggaggtgttgt

SEQ ID NO: 7548237 - DNA, 22 bp, Homo sapiens
caagttgttgggagggttggtt

SEQ ID NO: 7548238 - DNA, 22 bp, Homo sapiens
caagttcacttgtctacaaggg

SEQ ID NO: 7548239 - DNA, 22 bp, Homo sapiens
caagttcacttgtctacaaggg

SEQ ID NO: 7548240 - DNA, 22 bp, Homo sapiens
caagttcacgttgctttttgag

SEQ ID NO: 7548241 - DNA, 22 bp, Homo sapiens
caagttcacgttgctttttgag

SEQ ID NO: 7548242 - DNA, 22 bp, Homo sapiens
caagttcacgttgctttttgag

SEQ ID NO: 7548243 - DNA, 22 bp, Homo sapiens
caagttcacgttgctttttgag

SEQ ID NO: 7548244 - DNA, 22 bp, Homo sapiens
caagttcaagtcctggctctgc

SEQ ID NO: 7548245 - DNA, 22 bp, Homo sapiens
caagttattcctttacactata

SEQ ID NO: 7548246 - DNA, 23 bp, Homo sapiens
caagttattctgacactcatcaa

SEQ ID NO: 7548247 - DNA, 22 bp, Homo sapiens
caagttatttcattggaacaat

SEQ ID NO: 7548248 - DNA, 22 bp, Homo sapiens
caagttacctacccaaggcctt

SEQ ID NO: 7548249 - DNA, 22 bp, Homo sapiens
caagttagtattggttttggga

SEQ ID NO: 7548250 - DNA, 22 bp, Homo sapiens
caagttacattagaaatcatgc

SEQ ID NO: 7548251 - DNA, 22 bp, Homo sapiens
caagttacattagaaatcatgc

SEQ ID NO: 7548252 - DNA, 22 bp, Homo sapiens
caagttagtattggttttggga

SEQ ID NO: 7548253 - DNA, 22 bp, Homo sapiens
caagttatcagaaggcactttt

SEQ ID NO: 7548254 - DNA, 22 bp, Homo sapiens
caatgcttttagcttcagcttg

SEQ ID NO: 7548255 - DNA, 22 bp, Homo sapiens
caatgcttttagcttcagcttg

SEQ ID NO: 7548256 - DNA, 22 bp, Homo sapiens
caatgcttgctgactccctgtc

SEQ ID NO: 7548257 - DNA, 22 bp, Homo sapiens
caatgcttttgttctttactca

SEQ ID NO: 7548258 - DNA, 22 bp, Homo sapiens
caatgcttttgttctttactca

SEQ ID NO: 7548259 - DNA, 22 bp, Homo sapiens
caatgcttttagcttcagcttg

SEQ ID NO: 7548260 - DNA, 22 bp, Homo sapiens
caatgcttctgagggaattaca

SEQ ID NO: 7548261 - DNA, 22 bp, Homo sapiens
caatgcttctgagggaattaca

SEQ ID NO: 7548262 - DNA, 22 bp, Homo sapiens
caatgcttctgagggaattaca

SEQ ID NO: 7548263 - DNA, 22 bp, Homo sapiens
caatgcttctgagggaattaca

SEQ ID NO: 7548264 - DNA, 22 bp, Homo sapiens
caatgcttgctgactccctgtc

SEQ ID NO: 7548265 - DNA, 22 bp, Homo sapiens
caatgctttatttcctcccctt

SEQ ID NO: 7548266 - DNA, 22 bp, Homo sapiens
caatgcttctcattagccaatg

SEQ ID NO: 7548267 - DNA, 22 bp, Homo sapiens
caatgcttctcattagccaatg

SEQ ID NO: 7548268 - DNA, 22 bp, Homo sapiens
caatgcttctcattagccaatg

SEQ ID NO: 7548269 - DNA, 22 bp, Homo sapiens
caatgctgtgctcctcatgagg

SEQ ID NO: 7548270 - DNA, 22 bp, Homo sapiens
caatgcttcaggctccttatag

SEQ ID NO: 7548271 - DNA, 22 bp, Homo sapiens
caatgcttcaggctccttatag

SEQ ID NO: 7548272 - DNA, 22 bp, Homo sapiens
caatgcattattctcccacttc

SEQ ID NO: 7548273 - DNA, 22 bp, Homo sapiens
caatgctaaaaattctgtacat

SEQ ID NO: 7548274 - DNA, 22 bp, Homo sapiens
caatgcccctgagggctgcacc

SEQ ID NO: 7548275 - DNA, 22 bp, Homo sapiens
caatgcccctgagggctgcacc

SEQ ID NO: 7548276 - DNA, 22 bp, Homo sapiens
caatgctatcatgtcagagata

SEQ ID NO: 7548277 - DNA, 22 bp, Homo sapiens
caatgctaggcagatcctgcgt

SEQ ID NO: 7548278 - DNA, 22 bp, Homo sapiens
caatgctaaagtcagtagttag

SEQ ID NO: 7548279 - DNA, 22 bp, Homo sapiens
caatgcatacttcgaaatttca

SEQ ID NO: 7548280 - DNA, 22 bp, Homo sapiens
caatgctaaagtcagtagttag

SEQ ID NO: 7548281 - DNA, 22 bp, Homo sapiens
caatgctaggcagatcctgcgt

SEQ ID NO: 7548282 - DNA, 22 bp, Homo sapiens
caatgcttttgttctttactca

SEQ ID NO: 7548283 - DNA, 22 bp, Homo sapiens
caatggaagaatctgacctgca

SEQ ID NO: 7548284 - DNA, 22 bp, Homo sapiens
caatggatattttatgtgagaa

SEQ ID NO: 7548285 - DNA, 22 bp, Homo sapiens
caatggaggtttactctgcagc

SEQ ID NO: 7548286 - DNA, 22 bp, Homo sapiens
caatggaggtttactctgcagc

SEQ ID NO: 7548287 - DNA, 22 bp, Homo sapiens
caatggaagaatctgacctgca

SEQ ID NO: 7548288 - DNA, 22 bp, Homo sapiens
caatggaggtttactctgcagc

SEQ ID NO: 7548289 - DNA, 21 bp, Homo sapiens
caatggcgagatcttggctca

SEQ ID NO: 7548290 - DNA, 22 bp, Homo sapiens
caatggcactgcccaaagagaa

SEQ ID NO: 7548291 - DNA, 22 bp, Homo sapiens
caatggcctcccaagcaggggg

SEQ ID NO: 7548292 - DNA, 22 bp, Homo sapiens
caatggttctcaaactatcatg

SEQ ID NO: 7548293 - DNA, 22 bp, Homo sapiens
caatggtggtgtcagaagagat

SEQ ID NO: 7548294 - DNA, 22 bp, Homo sapiens
caatgggcggaatcgggaggcg

SEQ ID NO: 7548295 - DNA, 22 bp, Homo sapiens
caatggctggagacaatctgct

SEQ ID NO: 7548296 - DNA, 21 bp, Homo sapiens
caatggcgagatcttggctca

SEQ ID NO: 7548297 - DNA, 21 bp, Homo sapiens
caatggcgagatcttggctca

SEQ ID NO: 7548298 - DNA, 22 bp, Homo sapiens
caatgggagcagaaattgtttg

SEQ ID NO: 7548299 - DNA, 22 bp, Homo sapiens
caatgtatcaaccagaaagttc

SEQ ID NO: 7548300 - DNA, 22 bp, Homo sapiens
caatgtatcaaccagaaagttc

SEQ ID NO: 7548301 - DNA, 22 bp, Homo sapiens
caatgtactacaaagattgtca

SEQ ID NO: 7548302 - DNA, 22 bp, Homo sapiens
caatgtactacaaagattgtca

SEQ ID NO: 7548303 - DNA, 22 bp, Homo sapiens
caatgtacaaaataattacaca

SEQ ID NO: 7548304 - DNA, 22 bp, Homo sapiens
caatgtactacaaagattgtca

SEQ ID NO: 7548305 - DNA, 22 bp, Homo sapiens
caatggttgaaccctgtcatga

SEQ ID NO: 7548306 - DNA, 22 bp, Homo sapiens
caatggttgattaaaatttagc

SEQ ID NO: 7548307 - DNA, 22 bp, Homo sapiens
caatgtacaaaataattacaca

SEQ ID NO: 7548308 - DNA, 22 bp, Homo sapiens
caatgtacaaaataattacaca

SEQ ID NO: 7548309 - DNA, 22 bp, Homo sapiens
gcttccagaccccagtccctca

SEQ ID NO: 7548310 - DNA, 22 bp, Homo sapiens
gcttccagaccccagtccctca

SEQ ID NO: 7548311 - DNA, 22 bp, Homo sapiens
gcttccagaccccagtccctca

SEQ ID NO: 7548312 - DNA, 22 bp, Homo sapiens
gcttccagaccccagtccctca

SEQ ID NO: 7548313 - DNA, 22 bp, Homo sapiens
gcttccagaatgactaggatgt

SEQ ID NO: 7548314 - DNA, 22 bp, Homo sapiens
gcttccagaatgactaggatgt

SEQ ID NO: 7548315 - DNA, 22 bp, Homo sapiens
gcttccagaatgactaggatgt

SEQ ID NO: 7548316 - DNA, 22 bp, Homo sapiens
gcttccacctactaaatgccac

SEQ ID NO: 7548317 - DNA, 22 bp, Homo sapiens
gcttccacctactaaatgccac

SEQ ID NO: 7548318 - DNA, 20 bp, Homo sapiens
gcttccacctgaagcgcacc

SEQ ID NO: 7548319 - DNA, 22 bp, Homo sapiens
gcttccacttgggaacctctct

SEQ ID NO: 7548320 - DNA, 23 bp, Homo sapiens
gcttccagaagactcattgacat

SEQ ID NO: 7548321 - DNA, 23 bp, Homo sapiens
gcttccagaagactcattgacat

SEQ ID NO: 7548322 - DNA, 20 bp, Homo sapiens
gcttccagaggaggccccgt

SEQ ID NO: 7548323 - DNA, 22 bp, Homo sapiens
gcttccagagagccccgcctgg

SEQ ID NO: 7548324 - DNA, 22 bp, Homo sapiens
gcttccagagactgagctcttc

SEQ ID NO: 7548325 - DNA, 22 bp, Homo sapiens
gcttccagagactgagctcttc

SEQ ID NO: 7548326 - DNA, 22 bp, Homo sapiens
gcttccagagagccccgcctgg

SEQ ID NO: 7548327 - DNA, 22 bp, Homo sapiens
gcttccagagagccccgcctgg

SEQ ID NO: 7548328 - DNA, 22 bp, Homo sapiens
gcttccagacgatcatgtaaga

SEQ ID NO: 7548329 - DNA, 22 bp, Homo sapiens
gcttccagacgatcatgtaaga

SEQ ID NO: 7548330 - DNA, 22 bp, Homo sapiens
gcttccagagactgagctcttc

SEQ ID NO: 7548331 - DNA, 22 bp, Homo sapiens
gcttccagagactgagctcttc

SEQ ID NO: 7548332 - DNA, 22 bp, Homo sapiens
gcttccagagactgagctcttc

SEQ ID NO: 7548333 - DNA, 22 bp, Homo sapiens
gcttccagcaaacactggctgc

SEQ ID NO: 7548334 - DNA, 22 bp, Homo sapiens
gcttccagcaaacactggctgc

SEQ ID NO: 7548335 - DNA, 22 bp, Homo sapiens
gcttccagatcccatgctctta

SEQ ID NO: 7548336 - DNA, 22 bp, Homo sapiens
gcttccagatcccatgctctta

SEQ ID NO: 7548337 - DNA, 20 bp, Homo sapiens
gcttccagaggaggccccgt

SEQ ID NO: 7548338 - DNA, 22 bp, Homo sapiens
gcttccagatcccatgctctta

SEQ ID NO: 7548339 - DNA, 22 bp, Homo sapiens
gcttccagatcccatgctctta

SEQ ID NO: 7548340 - DNA, 22 bp, Homo sapiens
gcttccagatcccatgctctta

SEQ ID NO: 7548341 - DNA, 22 bp, Homo sapiens
gcttccagatcccatgctctta

SEQ ID NO: 7548342 - DNA, 20 bp, Homo sapiens
gcttccagaggaggccccgt

SEQ ID NO: 7548343 - DNA, 20 bp, Homo sapiens
gcttccagaggaggccccgt

SEQ ID NO: 7548344 - DNA, 20 bp, Homo sapiens
gcttccagaggaggccccgt

SEQ ID NO: 7548345 - DNA, 22 bp, Homo sapiens
ggaacacaaatgggagagctgg

SEQ ID NO: 7548346 - DNA, 22 bp, Homo sapiens
ggaacacaaatgggagagctgg

SEQ ID NO: 7548347 - DNA, 22 bp, Homo sapiens
ggaacacaaatgggagagctgg

SEQ ID NO: 7548348 - DNA, 22 bp, Homo sapiens
ggaacacaaatgggagagctgg

SEQ ID NO: 7548349 - DNA, 22 bp, Homo sapiens
ggaacacagaagggctgaaaaa

SEQ ID NO: 7548350 - DNA, 22 bp, Homo sapiens
ggaacacagaagggctgaaaaa

SEQ ID NO: 7548351 - DNA, 18 bp, Homo sapiens
ggaacaaggctctgactc

SEQ ID NO: 7548352 - DNA, 17 bp, Homo sapiens
ggaacaaatactatgca

SEQ ID NO: 7548353 - DNA, 17 bp, Homo sapiens
ggaacaaatactatgca

SEQ ID NO: 7548354 - DNA, 17 bp, Homo sapiens
ggaacaaatactatgca

SEQ ID NO: 7548355 - DNA, 17 bp, Homo sapiens
ggaacaaatactatgca

SEQ ID NO: 7548356 - DNA, 22 bp, Homo sapiens
ggaacacagtgccttacaaact

SEQ ID NO: 7548357 - DNA, 22 bp, Homo sapiens
ggaacacagtgccttacaaact

SEQ ID NO: 7548358 - DNA, 22 bp, Homo sapiens
ggaacacagtgccttacaaact

SEQ ID NO: 7548359 - DNA, 22 bp, Homo sapiens
ggaacacagtgccttacaaact

SEQ ID NO: 7548360 - DNA, 22 bp, Homo sapiens
ggaacactcagaaatgctcgtc

SEQ ID NO: 7548361 - DNA, 22 bp, Homo sapiens
ggaacactcagaaatgctcgtc

SEQ ID NO: 7548362 - DNA, 22 bp, Homo sapiens
ggaacactcagtaattcagata

SEQ ID NO: 7548363 - DNA, 22 bp, Homo sapiens
ggaacactgccttttattttcc

SEQ ID NO: 7548364 - DNA, 22 bp, Homo sapiens
ggaacactgccttttattttcc

SEQ ID NO: 7548365 - DNA, 22 bp, Homo sapiens
ggaacactcgtcaaatagcggg

SEQ ID NO: 7548366 - DNA, 22 bp, Homo sapiens
ggaacactcgtcaaatagcggg

SEQ ID NO: 7548367 - DNA, 17 bp, Homo sapiens
ggaaatgtacctctttt

SEQ ID NO: 7548368 - DNA, 22 bp, Homo sapiens
ggaaatgtaatcacagagggtt

SEQ ID NO: 7548369 - DNA, 22 bp, Homo sapiens
ggaaatgtatgtattaagcacc

SEQ ID NO: 7548370 - DNA, 22 bp, Homo sapiens
ggaaatggtggaggaaggctta

SEQ ID NO: 7548371 - DNA, 22 bp, Homo sapiens
ggaaatggagagctacattgga

SEQ ID NO: 7548372 - DNA, 22 bp, Homo sapiens
ggaaatcttccttcactctttc

SEQ ID NO: 7548373 - DNA, 22 bp, Homo sapiens
ggaaatggtggaggaaggctta

SEQ ID NO: 7548374 - DNA, 22 bp, Homo sapiens
ggaaatggtggaggaaggctta

SEQ ID NO: 7548375 - DNA, 22 bp, Homo sapiens
ggaaatgtaatcacagagggtt

SEQ ID NO: 7548376 - DNA, 22 bp, Homo sapiens
ggaaatgtaatcacagagggtt

SEQ ID NO: 7548377 - DNA, 18 bp, Homo sapiens
ggaaatgtttggtactag

SEQ ID NO: 7548378 - DNA, 21 bp, Homo sapiens
ggaaatgtggtctttacttct

SEQ ID NO: 7548379 - DNA, 22 bp, Homo sapiens
ggaaatgtgggctgtttctgta

SEQ ID NO: 7548380 - DNA, 22 bp, Homo sapiens
ggaaatgtattatatttggaat

SEQ ID NO: 7548381 - DNA, 22 bp, Homo sapiens
ggaaatgtattatatttggaat

SEQ ID NO: 7548382 - DNA, 22 bp, Homo sapiens
ggaaatgtgcctgggaattaga

SEQ ID NO: 7548383 - DNA, 19 bp, Homo sapiens
ggaaatgtggaaacatcct

SEQ ID NO: 7548384 - DNA, 19 bp, Homo sapiens
gcttccagcactgcaggag

SEQ ID NO: 7548385 - DNA, 22 bp, Homo sapiens
gcttccagcaccagcagagggg

SEQ ID NO: 7548386 - DNA, 19 bp, Homo sapiens
gcttccagcactgcaggag

SEQ ID NO: 7548387 - DNA, 19 bp, Homo sapiens
gcttccagcactgcaggag

SEQ ID NO: 7548388 - DNA, 19 bp, Homo sapiens
gcttccagcactgcaggag

SEQ ID NO: 7548389 - DNA, 19 bp, Homo sapiens
gcttccagcactgcaggag

SEQ ID NO: 7548390 - DNA, 22 bp, Homo sapiens
gcttccagcaccagcagagggg

SEQ ID NO: 7548391 - DNA, 22 bp, Homo sapiens
gcttccagcaccagcagagggg

SEQ ID NO: 7548392 - DNA, 22 bp, Homo sapiens
gcttccagcaccagcagagggg

SEQ ID NO: 7548393 - DNA, 22 bp, Homo sapiens
gcttccagcaccagcagagggg

SEQ ID NO: 7548394 - DNA, 22 bp, Homo sapiens
gcttccagcaccagcagagggg

SEQ ID NO: 7548395 - DNA, 22 bp, Homo sapiens
gcttccagccttttctcctctg

SEQ ID NO: 7548396 - DNA, 22 bp, Homo sapiens
gcttccagccttttctcctctg

SEQ ID NO: 7548397 - DNA, 20 bp, Homo sapiens
gcttccaggagggctgatat

SEQ ID NO: 7548398 - DNA, 20 bp, Homo sapiens
gcttccaggagggctgatat

SEQ ID NO: 7548399 - DNA, 20 bp, Homo sapiens
gcttccaggagggctgatat

SEQ ID NO: 7548400 - DNA, 20 bp, Homo sapiens
gcttccaggagggctgatat

SEQ ID NO: 7548401 - DNA, 19 bp, Homo sapiens
gcttccagcactgcaggag

SEQ ID NO: 7548402 - DNA, 19 bp, Homo sapiens
gcttccagcactgcaggag

SEQ ID NO: 7548403 - DNA, 19 bp, Homo sapiens
gcttccagcactgcaggag

SEQ ID NO: 7548404 - DNA, 22 bp, Homo sapiens
gcttccaggcttcctacctttg

SEQ ID NO: 7548405 - DNA, 22 bp, Homo sapiens
gcttccagggctcagtcactgc

SEQ ID NO: 7548406 - DNA, 22 bp, Homo sapiens
gcttccagggctcagtcactgc

SEQ ID NO: 7548407 - DNA, 22 bp, Homo sapiens
gcttccagggctcagtcactgc

SEQ ID NO: 7548408 - DNA, 20 bp, Homo sapiens
gcttccaggagggctgatat

SEQ ID NO: 7548409 - DNA, 20 bp, Homo sapiens
gcttccaggcccggaaaacc

SEQ ID NO: 7548410 - DNA, 20 bp, Homo sapiens
gcttccaggcccggaaaacc

SEQ ID NO: 7548411 - DNA, 22 bp, Homo sapiens
gcttccaggcttcctacctttg

SEQ ID NO: 7548412 - DNA, 22 bp, Homo sapiens
ggaaaatttccttcaaaatgtg

SEQ ID NO: 7548413 - DNA, 22 bp, Homo sapiens
ggaaaatttccttcaaaatgtg

SEQ ID NO: 7548414 - DNA, 22 bp, Homo sapiens
gcttccaggggctgtgggctga

SEQ ID NO: 7548415 - DNA, 22 bp, Homo sapiens
ggaaaatttccttcaaaatgtg

SEQ ID NO: 7548416 - DNA, 22 bp, Homo sapiens
ggaaacaaaccactcatggtgg

SEQ ID NO: 7548417 - DNA, 22 bp, Homo sapiens
ggaaacaaaccactcatggtgg

SEQ ID NO: 7548418 - DNA, 22 bp, Homo sapiens
ggaaatgcataggagtttagaa

SEQ ID NO: 7548419 - DNA, 22 bp, Homo sapiens
gctggaggctggagtgcagtgg

SEQ ID NO: 7548420 - DNA, 22 bp, Homo sapiens
gctggaggctggagtgcagtgg

SEQ ID NO: 7548421 - DNA, 16 bp, Homo sapiens
gctggagggaggggtt

SEQ ID NO: 7548422 - DNA, 16 bp, Homo sapiens
gctggagggaggggtt

SEQ ID NO: 7548423 - DNA, 16 bp, Homo sapiens
gctggagggaggggtt

SEQ ID NO: 7548424 - DNA, 22 bp, Homo sapiens
gctggcagagagctggtgagga

SEQ ID NO: 7548425 - DNA, 22 bp, Homo sapiens
gctggcagagagctggtgagga

SEQ ID NO: 7548426 - DNA, 22 bp, Homo sapiens
gctggcagagagctggtgagga

SEQ ID NO: 7548427 - DNA, 22 bp, Homo sapiens
gctggcagagagctggtgagga

SEQ ID NO: 7548428 - DNA, 19 bp, Homo sapiens
gctgaggtggaggaaggag

SEQ ID NO: 7548429 - DNA, 22 bp, Homo sapiens
gctgaggtggagattgcagtga

SEQ ID NO: 7548430 - DNA, 22 bp, Homo sapiens
gctgaggtggagattgcagtga

SEQ ID NO: 7548431 - DNA, 19 bp, Homo sapiens
gctgaggtggaggaaggag

SEQ ID NO: 7548432 - DNA, 20 bp, Homo sapiens
gctggcagatgtcttgagat

SEQ ID NO: 7548433 - DNA, 20 bp, Homo sapiens
gctggcagatgtcttgagat

SEQ ID NO: 7548434 - DNA, 22 bp, Homo sapiens
gctggcagagctctgggctggg

SEQ ID NO: 7548435 - DNA, 22 bp, Homo sapiens
gctggcagagctctgggctggg

SEQ ID NO: 7548436 - DNA, 22 bp, Homo sapiens
gctggcagagctctgggctggg

SEQ ID NO: 7548437 - DNA, 22 bp, Homo sapiens
gctggcagagctctgggctggg

SEQ ID NO: 7548438 - DNA, 22 bp, Homo sapiens
gctggcagagctctgggctggg

SEQ ID NO: 7548439 - DNA, 22 bp, Homo sapiens
gctggcagagctctgggctggg

SEQ ID NO: 7548440 - DNA, 22 bp, Homo sapiens
gctggcagagctctgggctggg

SEQ ID NO: 7548441 - DNA, 22 bp, Homo sapiens
gctggcagagctctgggctggg

SEQ ID NO: 7548442 - DNA, 22 bp, Homo sapiens
gctggcagagctctgggctggg

SEQ ID NO: 7548443 - DNA, 22 bp, Homo sapiens
gctggcagagagctggtgagga

SEQ ID NO: 7548444 - DNA, 22 bp, Homo sapiens
gctggcagagagctggtgagga

SEQ ID NO: 7548445 - DNA, 22 bp, Homo sapiens
gctggcagagagctggtgagga

SEQ ID NO: 7548446 - DNA, 22 bp, Homo sapiens
gctggcagagagctggtgagga

SEQ ID NO: 7548447 - DNA, 22 bp, Homo sapiens
gctggcagagagctggtgagga

SEQ ID NO: 7548448 - DNA, 20 bp, Homo sapiens
gctggcagatgtcttgagat

SEQ ID NO: 7548449 - DNA, 19 bp, Homo sapiens
gctggcagatgtggccgtg

SEQ ID NO: 7548450 - DNA, 20 bp, Homo sapiens
gctggcagatgtcttgagat

SEQ ID NO: 7548451 - DNA, 20 bp, Homo sapiens
gctggcagatgtcttgagat

SEQ ID NO: 7548452 - DNA, 19 bp, Homo sapiens
gctggcagatgtggccgtg

SEQ ID NO: 7548453 - DNA, 19 bp, Homo sapiens
gctggcagatgtggccgtg

SEQ ID NO: 7548454 - DNA, 19 bp, Homo sapiens
gctggcagatgtggccgtg

SEQ ID NO: 7548455 - DNA, 22 bp, Homo sapiens
gctggcagcattagaccctggg

SEQ ID NO: 7548456 - DNA, 22 bp, Homo sapiens
gctggcagcattagaccctggg

SEQ ID NO: 7548457 - DNA, 22 bp, Homo sapiens
gctggcagcattagaccctggg

SEQ ID NO: 7548458 - DNA, 22 bp, Homo sapiens
gctggcagcattagaccctggg

SEQ ID NO: 7548459 - DNA, 22 bp, Homo sapiens
gctggcagcattagaccctggg

SEQ ID NO: 7548460 - DNA, 19 bp, Homo sapiens
gctggcagatgtggccgtg

SEQ ID NO: 7548461 - DNA, 22 bp, Homo sapiens
gctggcagcattagaccctggg

SEQ ID NO: 7548462 - DNA, 19 bp, Homo sapiens
gctggcagatgtggccgtg

SEQ ID NO: 7548463 - DNA, 19 bp, Homo sapiens
gctggcagatgtggccgtg

SEQ ID NO: 7548464 - DNA, 22 bp, Homo sapiens
gctggcagccaagtgaagaggg

SEQ ID NO: 7548465 - DNA, 22 bp, Homo sapiens
gctggcagccaagtgaagaggg

SEQ ID NO: 7548466 - DNA, 22 bp, Homo sapiens
gctggcagccaagtgaagaggg

SEQ ID NO: 7548467 - DNA, 22 bp, Homo sapiens
gctggcagccaagtgaagaggg

SEQ ID NO: 7548468 - DNA, 22 bp, Homo sapiens
gctggcagccaagtgaagaggg

SEQ ID NO: 7548469 - DNA, 22 bp, Homo sapiens
gctggcagccaagtgaagaggg

SEQ ID NO: 7548470 - DNA, 22 bp, Homo sapiens
gctggccagtgtggtgaccacc

SEQ ID NO: 7548471 - DNA, 22 bp, Homo sapiens
gctggccagtgtggtgaccacc

SEQ ID NO: 7548472 - DNA, 22 bp, Homo sapiens
gctggccagtgtggtgaccacc

SEQ ID NO: 7548473 - DNA, 22 bp, Homo sapiens
gctggccagtgtggtgaccacc

SEQ ID NO: 7548474 - DNA, 22 bp, Homo sapiens
gctggccagtgtggtgaccacc

SEQ ID NO: 7548475 - DNA, 22 bp, Homo sapiens
gctggcagccaagtgaagaggg

SEQ ID NO: 7548476 - DNA, 22 bp, Homo sapiens
gctggcagccaagtgaagaggg

SEQ ID NO: 7548477 - DNA, 20 bp, Homo sapiens
gctgaggtcattatgcctca

SEQ ID NO: 7548478 - DNA, 22 bp, Homo sapiens
gctgaggtccagcattcgccta

SEQ ID NO: 7548479 - DNA, 20 bp, Homo sapiens
gctgaggtcattatgcctca

SEQ ID NO: 7548480 - DNA, 20 bp, Homo sapiens
gctgaggtccctgtggtttt

SEQ ID NO: 7548481 - DNA, 20 bp, Homo sapiens
gctgaggtccctgtggtttt

SEQ ID NO: 7548482 - DNA, 20 bp, Homo sapiens
gctgaggtccctgtggtttt

SEQ ID NO: 7548483 - DNA, 20 bp, Homo sapiens
gctgaggtccctgtggtttt

SEQ ID NO: 7548484 - DNA, 23 bp, Homo sapiens
gctgaggtcctgctgagtggtgg

SEQ ID NO: 7548485 - DNA, 22 bp, Homo sapiens
gctgaggtgaggctggaaagga

SEQ ID NO: 7548486 - DNA, 22 bp, Homo sapiens
gctgaggtggagattgcagtga

SEQ ID NO: 7548487 - DNA, 23 bp, Homo sapiens
gctgaggtcctgctgagtggtgg

SEQ ID NO: 7548488 - DNA, 23 bp, Homo sapiens
gctgaggtcctgctgagtggtgg

SEQ ID NO: 7548489 - DNA, 20 bp, Homo sapiens
gctgaggtccctgtggtttt

SEQ ID NO: 7548490 - DNA, 23 bp, Homo sapiens
gctgaggtcctgctgagtggtgg

SEQ ID NO: 7548491 - DNA, 23 bp, Homo sapiens
gctgaggtacatttacaggaaga

SEQ ID NO: 7548492 - DNA, 22 bp, Homo sapiens
caaatttaggtaacagtctgta

SEQ ID NO: 7548493 - DNA, 22 bp, Homo sapiens
caaatttaggtaacagtctgta

SEQ ID NO: 7548494 - DNA, 22 bp, Homo sapiens
caaatttaggtaacagtctgta

SEQ ID NO: 7548495 - DNA, 22 bp, Homo sapiens
caaatttaggtaacagtctgta

SEQ ID NO: 7548496 - DNA, 22 bp, Homo sapiens
caaatttaggtaacagtctgta

SEQ ID NO: 7548497 - DNA, 22 bp, Homo sapiens
caaatttaggtaacagtctgta

SEQ ID NO: 7548498 - DNA, 22 bp, Homo sapiens
caaatttaggtaacagtctgta

SEQ ID NO: 7548499 - DNA, 22 bp, Homo sapiens
caaatttaggtaacagtctgta

SEQ ID NO: 7548500 - DNA, 22 bp, Homo sapiens
gctgaggtcaggagctgtgggg

SEQ ID NO: 7548501 - DNA, 22 bp, Homo sapiens
gctgaggtcaggagctgtgggg

SEQ ID NO: 7548502 - DNA, 20 bp, Homo sapiens
gctgaggtcattatgcctca

SEQ ID NO: 7548503 - DNA, 22 bp, Homo sapiens
gctgaggtaggaggttgcagtg

SEQ ID NO: 7548504 - DNA, 22 bp, Homo sapiens
gctgaggtaggaggttgcagtg

SEQ ID NO: 7548505 - DNA, 22 bp, Homo sapiens
gctgaggtaggaggttgcagtg

SEQ ID NO: 7548506 - DNA, 22 bp, Homo sapiens
gctgaggtcaggagctgtgggg

SEQ ID NO: 7548507 - DNA, 22 bp, Homo sapiens
caaatttaagttagaaagcaat

SEQ ID NO: 7548508 - DNA, 22 bp, Homo sapiens
caaatttaagttagaaagcaat

SEQ ID NO: 7548509 - DNA, 22 bp, Homo sapiens
caaatttaagttagaaagcaat

SEQ ID NO: 7548510 - DNA, 22 bp, Homo sapiens
caaatttaagttagaaagcaat

SEQ ID NO: 7548511 - DNA, 22 bp, Homo sapiens
caaatttaagttagaaagcaat

SEQ ID NO: 7548512 - DNA, 22 bp, Homo sapiens
caaatttaagttagaaagcaat

SEQ ID NO: 7548513 - DNA, 20 bp, Homo sapiens
caaattctgttgaatacacc

SEQ ID NO: 7548514 - DNA, 20 bp, Homo sapiens
caaattctgttgaatacacc

SEQ ID NO: 7548515 - DNA, 20 bp, Homo sapiens
caaattctgttgaatacacc

SEQ ID NO: 7548516 - DNA, 22 bp, Homo sapiens
caaatttaagtgaggtctttgt

SEQ ID NO: 7548517 - DNA, 22 bp, Homo sapiens
caaatttaagtgaggtctttgt

SEQ ID NO: 7548518 - DNA, 22 bp, Homo sapiens
caaatttaagtgaggtctttgt

SEQ ID NO: 7548519 - DNA, 22 bp, Homo sapiens
caaattgtgtttgcttttctct

SEQ ID NO: 7548520 - DNA, 22 bp, Homo sapiens
caaattgtgtttgcttttctct

SEQ ID NO: 7548521 - DNA, 22 bp, Homo sapiens
caaattgtgtttgcttttctct

SEQ ID NO: 7548522 - DNA, 22 bp, Homo sapiens
caaatttaagtgaggtctttgt

SEQ ID NO: 7548523 - DNA, 22 bp, Homo sapiens
caaattctcttactgtttgaca

SEQ ID NO: 7548524 - DNA, 22 bp, Homo sapiens
caaattctcttactgtttgaca

SEQ ID NO: 7548525 - DNA, 22 bp, Homo sapiens
caaattctcttactgtttgaca

SEQ ID NO: 7548526 - DNA, 22 bp, Homo sapiens
caaattctcttactgtttgaca

SEQ ID NO: 7548527 - DNA, 20 bp, Homo sapiens
caaattctgttgaatacacc

SEQ ID NO: 7548528 - DNA, 20 bp, Homo sapiens
caaattctgttgaatacacc

SEQ ID NO: 7548529 - DNA, 22 bp, Homo sapiens
caaattctcaccctgtttgatt

SEQ ID NO: 7548530 - DNA, 22 bp, Homo sapiens
caaattctcaccctgtttgatt

SEQ ID NO: 7548531 - DNA, 22 bp, Homo sapiens
caaattctcaccctgtttgatt

SEQ ID NO: 7548532 - DNA, 22 bp, Homo sapiens
caaattctcaccctgtttgatt

SEQ ID NO: 7548533 - DNA, 18 bp, Homo sapiens
caaattctcattgatttc

SEQ ID NO: 7548534 - DNA, 18 bp, Homo sapiens
caaattctcattgatttc

SEQ ID NO: 7548535 - DNA, 23 bp, Homo sapiens
caaattctaggcaggctcttttg

SEQ ID NO: 7548536 - DNA, 23 bp, Homo sapiens
caaattctaggcaggctcttttg

SEQ ID NO: 7548537 - DNA, 22 bp, Homo sapiens
caaattcctcagaatcagaaaa

SEQ ID NO: 7548538 - DNA, 18 bp, Homo sapiens
caaattcagtgctggaag

SEQ ID NO: 7548539 - DNA, 18 bp, Homo sapiens
caaattcagtgctggaag

SEQ ID NO: 7548540 - DNA, 22 bp, Homo sapiens
caaattcagaaaattggtagag

SEQ ID NO: 7548541 - DNA, 22 bp, Homo sapiens
caaattcagaaaattggtagag

SEQ ID NO: 7548542 - DNA, 22 bp, Homo sapiens
gctgggaggaatttggggaata

SEQ ID NO: 7548543 - DNA, 22 bp, Homo sapiens
gctgggaggaatttggggaata

SEQ ID NO: 7548544 - DNA, 22 bp, Homo sapiens
gctgggagccgtacctgtcacg

SEQ ID NO: 7548545 - DNA, 22 bp, Homo sapiens
gctgggagccgtacctgtcacg

SEQ ID NO: 7548546 - DNA, 22 bp, Homo sapiens
gctgggaggaatttggggaata

SEQ ID NO: 7548547 - DNA, 22 bp, Homo sapiens
gctgggaggaatttggggaata

SEQ ID NO: 7548548 - DNA, 22 bp, Homo sapiens
gctgggaggaatttggggaata

SEQ ID NO: 7548549 - DNA, 22 bp, Homo sapiens
gctgggaggaatttggggaata

SEQ ID NO: 7548550 - DNA, 22 bp, Homo sapiens
gctgggaggaatttggggaata

SEQ ID NO: 7548551 - DNA, 22 bp, Homo sapiens
gctgggagccctggtctgctcc

SEQ ID NO: 7548552 - DNA, 22 bp, Homo sapiens
gctgggagccgtacctgtcacg

SEQ ID NO: 7548553 - DNA, 22 bp, Homo sapiens
gctgggagccgtacctgtcacg

SEQ ID NO: 7548554 - DNA, 22 bp, Homo sapiens
gctgggagccctggtctgctcc

SEQ ID NO: 7548555 - DNA, 22 bp, Homo sapiens
gctgggagccgtacctgtcacg

SEQ ID NO: 7548556 - DNA, 22 bp, Homo sapiens
gctgggagccgtacctgtcacg

SEQ ID NO: 7548557 - DNA, 22 bp, Homo sapiens
gctgggagccgtacctgtcacg

SEQ ID NO: 7548558 - DNA, 22 bp, Homo sapiens
gctgggagccgtacctgtcacg

SEQ ID NO: 7548559 - DNA, 22 bp, Homo sapiens
gctgggcccagatcccaggatc

SEQ ID NO: 7548560 - DNA, 22 bp, Homo sapiens
gctgggcccagatcccaggatc

SEQ ID NO: 7548561 - DNA, 22 bp, Homo sapiens
gctgggccagccagacatgtga

SEQ ID NO: 7548562 - DNA, 22 bp, Homo sapiens
gctgggccagccagacatgtga

SEQ ID NO: 7548563 - DNA, 22 bp, Homo sapiens
gctgggccagccagacatgtga

SEQ ID NO: 7548564 - DNA, 22 bp, Homo sapiens
gctgggccagccagacatgtga

SEQ ID NO: 7548565 - DNA, 22 bp, Homo sapiens
gctgggaggaatttggggaata

SEQ ID NO: 7548566 - DNA, 22 bp, Homo sapiens
gctgggccagagcagcagcact

SEQ ID NO: 7548567 - DNA, 22 bp, Homo sapiens
gctgggccccatccctcgagca

SEQ ID NO: 7548568 - DNA, 22 bp, Homo sapiens
gctgggccccatccctcgagca

SEQ ID NO: 7548569 - DNA, 22 bp, Homo sapiens
gctgggccccatccctcgagca

SEQ ID NO: 7548570 - DNA, 22 bp, Homo sapiens
gctgggcccagatcccaggatc

SEQ ID NO: 7548571 - DNA, 22 bp, Homo sapiens
gctgggccccatccctcgagca

SEQ ID NO: 7548572 - DNA, 22 bp, Homo sapiens
gctgggccccatccctcgagca

SEQ ID NO: 7548573 - DNA, 22 bp, Homo sapiens
gctgggcccagatcccaggatc

SEQ ID NO: 7548574 - DNA, 22 bp, Homo sapiens
gctgggcccagatcccaggatc

SEQ ID NO: 7548575 - DNA, 22 bp, Homo sapiens
gctgggcccagatcccaggatc

SEQ ID NO: 7548576 - DNA, 22 bp, Homo sapiens
gctgggccccttgaaaggcgtc

SEQ ID NO: 7548577 - DNA, 22 bp, Homo sapiens
gctgggccccatccctcgagca

SEQ ID NO: 7548578 - DNA, 22 bp, Homo sapiens
gctgggccccatccctcgagca

SEQ ID NO: 7548579 - DNA, 22 bp, Homo sapiens
gctgggccccatccctcgagca

SEQ ID NO: 7548580 - DNA, 22 bp, Homo sapiens
gctgggccctgggtgccctagc

SEQ ID NO: 7548581 - DNA, 22 bp, Homo sapiens
gctgggccctgggtgccctagc

SEQ ID NO: 7548582 - DNA, 22 bp, Homo sapiens
gctgggccctgggtgccctagc

SEQ ID NO: 7548583 - DNA, 22 bp, Homo sapiens
gctgggccctgggtgccctagc

SEQ ID NO: 7548584 - DNA, 22 bp, Homo sapiens
gctgggccccttgaaaggcgtc

SEQ ID NO: 7548585 - DNA, 22 bp, Homo sapiens
gctgggccccttgaaaggcgtc

SEQ ID NO: 7548586 - DNA, 22 bp, Homo sapiens
gctgggccccttgaaaggcgtc

SEQ ID NO: 7548587 - DNA, 22 bp, Homo sapiens
gctgggccccttgaaaggcgtc

SEQ ID NO: 7548588 - DNA, 22 bp, Homo sapiens
gctgggccccttgaaaggcgtc

SEQ ID NO: 7548589 - DNA, 22 bp, Homo sapiens
gctgggccgacctgggctgcag

SEQ ID NO: 7548590 - DNA, 22 bp, Homo sapiens
gctgggccgacctgggctgcag

SEQ ID NO: 7548591 - DNA, 22 bp, Homo sapiens
gctgggccctgggtgccctagc

SEQ ID NO: 7548592 - DNA, 22 bp, Homo sapiens
gctgggccctgggtgccctagc

SEQ ID NO: 7548593 - DNA, 22 bp, Homo sapiens
gctgggccctgggtgccctagc

SEQ ID NO: 7548594 - DNA, 22 bp, Homo sapiens
gctgggccgacctgggctgcag

SEQ ID NO: 7548595 - DNA, 22 bp, Homo sapiens
gctgggccgacctgggctgcag

SEQ ID NO: 7548596 - DNA, 22 bp, Homo sapiens
gctgggccgacctgggctgcag

SEQ ID NO: 7548597 - DNA, 22 bp, Homo sapiens
gctgggccgacctgggctgcag

SEQ ID NO: 7548598 - DNA, 22 bp, Homo sapiens
gctgggccgacctgggctgcag

SEQ ID NO: 7548599 - DNA, 22 bp, Homo sapiens
gctgggccgacctgggctgcag

SEQ ID NO: 7548600 - DNA, 22 bp, Homo sapiens
gctgggccgacctgggctgcag

SEQ ID NO: 7548601 - DNA, 21 bp, Homo sapiens
gctgggcctgtacttgccctg

SEQ ID NO: 7548602 - DNA, 21 bp, Homo sapiens
gctgggcctgtacttgccctg

SEQ ID NO: 7548603 - DNA, 21 bp, Homo sapiens
gctgggcctgtacttgccctg

SEQ ID NO: 7548604 - DNA, 21 bp, Homo sapiens
gctgggcctgtacttgccctg

SEQ ID NO: 7548605 - DNA, 21 bp, Homo sapiens
gctgggcctgtacttgccctg

SEQ ID NO: 7548606 - DNA, 21 bp, Homo sapiens
gctgggcctgtacttgccctg

SEQ ID NO: 7548607 - DNA, 20 bp, Homo sapiens
gctgggctaccactggccct

SEQ ID NO: 7548608 - DNA, 20 bp, Homo sapiens
gctgggctaccactggccct

SEQ ID NO: 7548609 - DNA, 20 bp, Homo sapiens
gctgggctaccactggccct

SEQ ID NO: 7548610 - DNA, 22 bp, Homo sapiens
gctgggccttccgattctcaag

SEQ ID NO: 7548611 - DNA, 22 bp, Homo sapiens
gctgggccttccgattctcaag

SEQ ID NO: 7548612 - DNA, 20 bp, Homo sapiens
gctgggctaccactggccct

SEQ ID NO: 7548613 - DNA, 20 bp, Homo sapiens
gctgggctaccactggccct

SEQ ID NO: 7548614 - DNA, 22 bp, Homo sapiens
gctggccatggcctgcgccatc

SEQ ID NO: 7548615 - DNA, 22 bp, Homo sapiens
gctggccatggcctgcgccatc

SEQ ID NO: 7548616 - DNA, 22 bp, Homo sapiens
gctggccatggcctgcgccatc

SEQ ID NO: 7548617 - DNA, 22 bp, Homo sapiens
gctggccatatattttgctgtt

SEQ ID NO: 7548618 - DNA, 22 bp, Homo sapiens
gctggccatggcctgcgccatc

SEQ ID NO: 7548619 - DNA, 22 bp, Homo sapiens
gctggccatggcctgcgccatc

SEQ ID NO: 7548620 - DNA, 22 bp, Homo sapiens
gctggccatggggagtgaggag

SEQ ID NO: 7548621 - DNA, 22 bp, Homo sapiens
gctggccatggggagtgaggag

SEQ ID NO: 7548622 - DNA, 22 bp, Homo sapiens
gctggccatggggagtgaggag

SEQ ID NO: 7548623 - DNA, 22 bp, Homo sapiens
gctggccatggcctgcgccatc

SEQ ID NO: 7548624 - DNA, 22 bp, Homo sapiens
gctggccagtgtggtgaccacc

SEQ ID NO: 7548625 - DNA, 22 bp, Homo sapiens
gctggccatagaagccaaagag

SEQ ID NO: 7548626 - DNA, 22 bp, Homo sapiens
gctggccatagaagccaaagag

SEQ ID NO: 7548627 - DNA, 22 bp, Homo sapiens
gctggccatagaagccaaagag

SEQ ID NO: 7548628 - DNA, 22 bp, Homo sapiens
gctggccatatattttgctgtt

SEQ ID NO: 7548629 - DNA, 22 bp, Homo sapiens
gctggccatatattttgctgtt

SEQ ID NO: 7548630 - DNA, 22 bp, Homo sapiens
gctggccatagaagccaaagag

SEQ ID NO: 7548631 - DNA, 22 bp, Homo sapiens
gctggccatggggagtgaggag

SEQ ID NO: 7548632 - DNA, 22 bp, Homo sapiens
gctggccatggggagtgaggag

SEQ ID NO: 7548633 - DNA, 22 bp, Homo sapiens
gctggccatggggagtgaggag

SEQ ID NO: 7548634 - DNA, 22 bp, Homo sapiens
gctggccatggggagtgaggag

SEQ ID NO: 7548635 - DNA, 22 bp, Homo sapiens
gctggccatggggagtgaggag

SEQ ID NO: 7548636 - DNA, 22 bp, Homo sapiens
gctggccatggggagtgaggag

SEQ ID NO: 7548637 - DNA, 22 bp, Homo sapiens
gctggcccagcgcccagggcag

SEQ ID NO: 7548638 - DNA, 22 bp, Homo sapiens
gctggcccagcgcccagggcag

SEQ ID NO: 7548639 - DNA, 22 bp, Homo sapiens
gctggcccagcgcccagggcag

SEQ ID NO: 7548640 - DNA, 22 bp, Homo sapiens
gctggcccagcgcccagggcag

SEQ ID NO: 7548641 - DNA, 22 bp, Homo sapiens
gctggcccagcgcccagggcag

SEQ ID NO: 7548642 - DNA, 22 bp, Homo sapiens
gctggccattctctttgagatg

SEQ ID NO: 7548643 - DNA, 22 bp, Homo sapiens
gctggccattctctttgagatg

SEQ ID NO: 7548644 - DNA, 22 bp, Homo sapiens
gctggcccagcgcccagggcag

SEQ ID NO: 7548645 - DNA, 22 bp, Homo sapiens
gctggcccagcgcccagggcag

SEQ ID NO: 7548646 - DNA, 22 bp, Homo sapiens
gctgggagccccgagccagcgc

SEQ ID NO: 7548647 - DNA, 22 bp, Homo sapiens
gctgggagccccgagccagcgc

SEQ ID NO: 7548648 - DNA, 19 bp, Homo sapiens
gctgggagcagaccctccc

SEQ ID NO: 7548649 - DNA, 22 bp, Homo sapiens
gctgggagccccgagccagcgc

SEQ ID NO: 7548650 - DNA, 22 bp, Homo sapiens
gctgggagccctggtctgctcc

SEQ ID NO: 7548651 - DNA, 22 bp, Homo sapiens
gctgggagccctggtctgctcc

SEQ ID NO: 7548652 - DNA, 22 bp, Homo sapiens
gctgggagccctggtctgctcc

SEQ ID NO: 7548653 - DNA, 22 bp, Homo sapiens
gctgggagccccgagccagcgc

SEQ ID NO: 7548654 - DNA, 22 bp, Homo sapiens
gctgggagccccgagccagcgc

SEQ ID NO: 7548655 - DNA, 22 bp, Homo sapiens
gctgggagccctggtctgctcc

SEQ ID NO: 7548656 - DNA, 22 bp, Homo sapiens
gctgggagccccgagccagcgc

SEQ ID NO: 7548657 - DNA, 22 bp, Homo sapiens
gctgggagcaagtactcatctt

SEQ ID NO: 7548658 - DNA, 22 bp, Homo sapiens
gctgggagcaagtactcatctt

SEQ ID NO: 7548659 - DNA, 19 bp, Homo sapiens
gctgggagcagaccctccc

SEQ ID NO: 7548660 - DNA, 19 bp, Homo sapiens
gctgggagcagaccctccc

SEQ ID NO: 7548661 - DNA, 19 bp, Homo sapiens
gctgggagcagaccctccc

SEQ ID NO: 7548662 - DNA, 19 bp, Homo sapiens
gctgggagcagaccctccc

SEQ ID NO: 7548663 - DNA, 19 bp, Homo sapiens
gctgggagcagaccctccc

SEQ ID NO: 7548664 - DNA, 22 bp, Homo sapiens
gctggctgtgattttgccaaca

SEQ ID NO: 7548665 - DNA, 22 bp, Homo sapiens
gctgggagcaaagccatgcata

SEQ ID NO: 7548666 - DNA, 22 bp, Homo sapiens
gctgggagcaaagccatgcata

SEQ ID NO: 7548667 - DNA, 21 bp, Homo sapiens
gctggctgtctcttacacggt

SEQ ID NO: 7548668 - DNA, 21 bp, Homo sapiens
gctggctgtctcttacacggt

SEQ ID NO: 7548669 - DNA, 21 bp, Homo sapiens
gctggctgtctcttacacggt

SEQ ID NO: 7548670 - DNA, 21 bp, Homo sapiens
gctggctgtctcttacacggt

SEQ ID NO: 7548671 - DNA, 22 bp, Homo sapiens
gctggctgtgattttgccaaca

SEQ ID NO: 7548672 - DNA, 22 bp, Homo sapiens
gctggctgtgattttgccaaca

SEQ ID NO: 7548673 - DNA, 22 bp, Homo sapiens
ggagcagccgcgtctcagggca

SEQ ID NO: 7548674 - DNA, 22 bp, Homo sapiens
ggagcagccacgtctcagggca

SEQ ID NO: 7548675 - DNA, 22 bp, Homo sapiens
ggagcagccgcgtctcagggca

SEQ ID NO: 7548676 - DNA, 22 bp, Homo sapiens
ggagcagccgcgtctcagggca

SEQ ID NO: 7548677 - DNA, 22 bp, Homo sapiens
ggagcagccgcgtctcagggca

SEQ ID NO: 7548678 - DNA, 22 bp, Homo sapiens
ggagcagccgcgtctcagggca

SEQ ID NO: 7548679 - DNA, 22 bp, Homo sapiens
ggagcagccgcgtctcagggca

SEQ ID NO: 7548680 - DNA, 22 bp, Homo sapiens
ggagcagccgcgtctcagggca

SEQ ID NO: 7548681 - DNA, 22 bp, Homo sapiens
ggagcagccacgtctcagggca

SEQ ID NO: 7548682 - DNA, 22 bp, Homo sapiens
ggagcagccacgtctcagggca

SEQ ID NO: 7548683 - DNA, 22 bp, Homo sapiens
ggagcagccacgtctcagggca

SEQ ID NO: 7548684 - DNA, 22 bp, Homo sapiens
cacagcctcctctggctcacgg

SEQ ID NO: 7548685 - DNA, 22 bp, Homo sapiens
ggagcagcactgccacacagag

SEQ ID NO: 7548686 - DNA, 22 bp, Homo sapiens
ggagcagccacgtctcagggca
